United States Patent 7,745,391 (HUMAN THROMBOSPONDIN POLYPEPTIDE) - sequence listing, part 295

SEQ ID NO: 989470 - protein, 147 aa, Homo sapiens
RTPAPTRHIDDLQSFMFVYQHRNGLVRGCSMAQPADAPAAPGVQLPLGSDGRTVSAPASDVHHVLPGLLSREGGDHLRLLQRHRVPMAQPSAVPTAPGVHLSSSSQGKVVLTIRMGSNFYNVSGGKALDQLWGQRVTIIGLCGHAAI

SEQ ID NO: 989471 - protein, 71 aa, Homo sapiens
TEYWSSARCSLCRRNLYRAGMHRSGEYTSTRLHLNELWRSTRCSCDRRNLSMGGMHGSGEYTSTWMHACSR

SEQ ID NO: 989472 - protein, 40 aa, Homo sapiens
AALWLAAVQTGCQSITRYARVPRDMVQTLDEGTRWTTMGP

SEQ ID NO: 989473 - protein, 39 aa, Homo sapiens
TQPAEEFLNQSSPFYFFFNGDRIDSLPENDRQQTHMLDV

SEQ ID NO: 989474 - protein, 40 aa, Homo sapiens
GCRPAEEFLNQSSRFYFCFNSDRIDSLLGSDRQQTHILHV

SEQ ID NO: 989475 - protein, 37 aa, Homo sapiens
PAEEFLNQSSPFYFWFNGDRIDSLLGNDLQQTHMLDV

SEQ ID NO: 989476 - protein, 34 aa, Homo sapiens
LLRGLDLRPATAVELLCRYPFLARKAMRLASAFS

SEQ ID NO: 989477 - protein, 82 aa, Homo sapiens
GSRRRTRHQGMRTPPHSSRGDSETVGGKTKTKQKNHPPLQRASLQIQKLPEILERQNKREEWAAQGDSRVYIPARCEAKERG

SEQ ID NO: 989478 - protein, 75 aa, Homo sapiens
MVSRLFLSMRSSRDSARAGGGSSRGSSNSRMYGGYATIRLIAVFFMWQILQGRQVWNRVTGGKEGQKCWQQELAH

SEQ ID NO: 989479 - protein, 39 aa, Homo sapiens
SSVGGKSVTAGLGGCEDVEEWRKTGALGVPELDQGVNML

SEQ ID NO: 989480 - protein, 34 aa, Homo sapiens
SVRGSSLQSTGSNLKLWVGLAIPPPIGDIKVDLD

SEQ ID NO: 989481 - protein, 70 aa, Homo sapiens
MVTHSRLATFTNVLTEDIIDECKTRFYIHWAHTTHKHHAKYRNKGHSQLQTSRLSSRVSRQTYNRVASRV

SEQ ID NO: 989482 - protein, 139 aa, Homo sapiens
RSNLEESPVAQPAEINLCRLKRQQTKMCADSWILANESTALAYSCPWTGNLSADLLLPNHDNQSQMDLTTTTLTVLTRYGMGLAWCGKAIDITRRRTDSTEQPDDQKSLPLTAGPSRSQTPRLSHSTVCSKISLHVPLF

SEQ ID NO: 989483 - protein, 85 aa, Homo sapiens
IDGLLSFQREAPEESFIQNLSLELDLLSCEQKSLAQDSAHTGRVHEAPKQQIRAVVPGAPVVDWRTLSVAAAWTRHSQSLCYHTK

SEQ ID NO: 989484 - protein, 89 aa, Homo sapiens
LEDSLCAALRSCFHEEAEKALTLTVCREKRLRNMGTERGLMRLTRKELSAVEHTRVTRFKSKQLAACGPEGMWLGAAPAFCFCCVSCTQ

SEQ ID NO: 989485 - protein, 64 aa, Homo sapiens
MSSMTRAYKIISTASCTINCKAPLAAVIHDTFGLVAQAHAHSPCHHCPPEALWLAPPGKLLAVD

SEQ ID NO: 989486 - protein, 73 aa, Homo sapiens
DRVNTLARGKKRNDSAIPMNHDIYPDHQQRQLREDTARIGGAILATLSTYQQMWISKQEYDESGPSIDHRKCY

SEQ ID NO: 989487 - protein, 43 aa, Homo sapiens
KHKMMMVSDNVQSSDWKRGQLRDSRSQELEAHCRDSPQISFPL

SEQ ID NO: 989488 - protein, 54 aa, Homo sapiens
RQLARMDEEVQSINEMARHLQEYQDLLNVKLALDNRDLHTYRKLLEGEEEPDHH

SEQ ID NO: 989489 - protein, 49 aa, Homo sapiens
YPGMCMADHRHEPRCNASHWTKPATTWKAMRQEVELLKITRSSMMESKL

SEQ ID NO: 989490 - protein, 47 aa, Homo sapiens
PTGVLGHCLRPRGQALNGVAKLSGTGKLGVDTSLFSTQMHVRGSGVC

SEQ ID NO: 989491 - protein, 46 aa, Homo sapiens
TADGLVLRKILDWEVPLLHMDQEGWEGPNATCPRIRDQGSHRAVKM

SEQ ID NO: 989492 - protein, 38 aa, Homo sapiens
MECWSPWTDAGLQPGAEPVLVWHEPLPPQIPGASRRFL

SEQ ID NO: 989493 - protein, 55 aa, Homo sapiens
SGAGSGRFGMVIDTRGGPVTQITTCTKVSGFPRAADPASFLQCYVSLGYLRLGRG

SEQ ID NO: 989494 - protein, 32 aa, Homo sapiens
MRRHNGDSSLSWCMILTLLLSAKEALGNFGKT

SEQ ID NO: 989495 - protein, 44 aa, Homo sapiens
YEQQQDTADIAIVVPATMPIVSPLPLGGGIGAGYTVAGMPLGCR

SEQ ID NO: 989496 - protein, 86 aa, Homo sapiens
VIDSGLCAAYRVLVPEECEVVLLDVSQQHRVLCCSGLEDTAYSPGLRLGFSQYHGPYCERAFSSYVCRHPVARTFYWQTQETAIYA

SEQ ID NO: 989497 - protein, 30 aa, Homo sapiens
MALKLQPELFGQIGEGVLGRGPLGAKGMWC

SEQ ID NO: 989498 - protein, 56 aa, Homo sapiens
DCTEHGMKKHLAEGQLPCRARVPEHDHDGPPTAQQKVAALFPNSDTGVDNDARCVG

SEQ ID NO: 989499 - protein, 56 aa, Homo sapiens
TVCEHRSWLAALSCSTDLVICRLGSQSAGIIGVSHRARLLADIFKDGTWLEHLRAE

SEQ ID NO: 989500 - protein, 36 aa, Homo sapiens
MSYDCATALFLGIGRDLSLETESRSVAQAGVQWHDL

SEQ ID NO: 989501 - protein, 46 aa, Homo sapiens
LASRGWPCGSWRASVSSTGCSSGSHTQPHCRRCACQIFSMSSQLVS

SEQ ID NO: 989502 - protein, 61 aa, Homo sapiens
GAGARLALRCRRSRSVSFMEKAGGILTLFMLGVFSVHLYGYAAAAAAAVQILVVVANIQTR

SEQ ID NO: 989503 - protein, 46 aa, Homo sapiens
MEDVHLKGQECVWEADEHMHDRPLGSQTMGWPKEVVVDADRGTQSD

SEQ ID NO: 989504 - protein, 66 aa, Homo sapiens
RIIGQDLTFCPDKTVMSLQCRSQLSVIEPNVWIQYEHSLDDTQFSSRGNQTFSPLLCLLKLLVPRV

SEQ ID NO: 989505 - protein, 64 aa, Homo sapiens
AVTHLLRSKGGLFQWGSRSKGHDIHDYVCWACFKVSLNSLSKQSFRENLSKLRPCSHLAKIYSS

SEQ ID NO: 989506 - protein, 76 aa, Homo sapiens
CLLSAETYALEAISRESRKDAYCTFPRLSLVVTLACGSPNCYHSERLSRVYEETSVYFLTTASKSTIISIVNDTIL

SEQ ID NO: 989507 - protein, 73 aa, Homo sapiens
PSAEVYLNMCRAYIAGHELDRNWAKKGCCEAADVPVDPAKRRGAPAEATMSERVHHETLTGVRSWACKGRLWE

SEQ ID NO: 989508 - protein, 49 aa, Homo sapiens
MGFLHVGQAGLELLTSGDPPASASQSAGITGKSHCTWLCKVFVDAAANL

SEQ ID NO: 989509 - protein, 32 aa, Homo sapiens
MVELKLLTMDGDKVVVNLVYFCSPSKINYKTR

SEQ ID NO: 989510 - protein, 105 aa, Homo sapiens
GLPAHFKSTNNLKVSQIILQLPENPTIFQTIHAFPDNPCLPSKLQDLPSSIKVYTANPSLPSNILVFTPNPSIFQAQSHVLPRQHPMYFPITFPRIFHPNTSIFP

SEQ ID NO: 989511 - protein, 50 aa, Homo sapiens
MFIWPDSTGCGKSVPIGRQSDTVDKAGVVANRNLNLNGGPQRMPGSFIAP

SEQ ID NO: 989512 - protein, 85 aa, Homo sapiens
QSTHHVLSVSYSYVVVKKTGDQNAANASASKSVKTVTAGAGTIRTIKSSAVPPGLPVYLDLCYIPYPQQYVRMLMCEFFMIVRVF

SEQ ID NO: 989513 - protein, 44 aa, Homo sapiens
MTITRKQHLVLDPRMPEYKQQNATVKSVNDDEWGTHRGSWTSEL

SEQ ID NO: 989514 - protein, 133 aa, Homo sapiens
YCPPAEIRLSTSGHTEHAEDIRFNRLQQITTALRVLPKGSWHVWWQTPIGDLAFLVSPNREAVGHVDSGGGVPFWSPAPSLTALGTWSLRDPDRRNHTQSPQAHGRDVTRGGEALKPGFRLSGELAEPGANTL

SEQ ID NO: 989515 - protein, 32 aa, Homo sapiens
MRYPAHLDIFRMLSALQLEREYSPAPSGSNSR

SEQ ID NO: 989516 - protein, 172 aa, Homo sapiens
CNFLDHERMDVFATTHLLLATPSPQETCSEKSTHLHDYWSCRCPVGIDNLPRGRVCVLGATGRDRRSDTVDSADAEEDDSDVWWGGADHRLCRMGVKTEVVLNVAEDAEVADVEDEESDDDEDDEDGDEVEKEAEEPYEEATERTTSIATTTTTTTESVEEVVREVCSEQAE

SEQ ID NO: 989517 - protein, 43 aa, Homo sapiens
VGTGRWRVDLVTKRDDEAGSPWGWMRQAVSAGEDMSDIAFNGT

SEQ ID NO: 989518 - protein, 85 aa, Homo sapiens
MRQRDIVPLQIKVQREQSQRQSDKEQPDTLWKIELAFDIQPLGPLQVQAQLLRGSLSSQLWAERGETAELIAGELEHLRERLQAA

SEQ ID NO: 989519 - protein, 104 aa, Homo sapiens
MPWLCGVFDATKRKRGHVSHSVDDPGISVQHGNSCLELSRVCYNACIENIITHALNLDAIELYWNSDKNRRDLNFDVEVDITASRCPVMLVVCDQASFMRMLVV

SEQ ID NO: 989520 - protein, 48 aa, Homo sapiens
YFSTGQGKREETSPRLLSLLICYKRFLLDRTPPPPTKTQLISPWLQYP

SEQ ID NO: 989521 - protein, 146 aa, Homo sapiens
YFSTGCCKTMKHVGRRADAGSPVRCLEDLENRQTWIRCNDVAELEDICFLEHVDLLEYMAWLNRPRFPEHTYLLLAYIPLLEDVPLLEDVPLLEDTSRLEDINLMEDMALLEDVDLLEDTDFLEDLDFSEAMDLREDKDFLEDMDS

SEQ ID NO: 989522 - protein, 98 aa, Homo sapiens
GLRADLWCEQYTCGVRILEPQDVAPVRSLSSIRLDCVCCAFASAYLSPLKLEPLVVLSTWAGLSGSFLYTGGIGFKYVALGDLIILITFGPLAVMFAY

SEQ ID NO: 989523 - protein, 109 aa, Homo sapiens
LQQVSMKDKNYFDVIIIGGSYAGLSAAMALGRSLRNVLIIDSGLPCNRQTPHSHNFITQDGEKPEAIAEKAKAQVLTYNTVEFLSDLALSAQKNGSTFTITALSRGTEL

SEQ ID NO: 989524 - protein, 70 aa, Homo sapiens
FSTVQKQADCEPVLRPSELLQREQGLATLPCTQRRPETDASSAAKEISVKLKQELTKNSRRRKTRKWFTK

SEQ ID NO: 989525 - protein, 40 aa, Homo sapiens
TLVSYGTRLDPALSWLWHRPAATAPIGPLAWEPPYATDVA

SEQ ID NO: 989526 - protein, 35 aa, Homo sapiens
TASTPADCIQRLPDCIHRRLTASNAAWLRPIAARL

SEQ ID NO: 989527 - protein, 104 aa, Homo sapiens
CIQRRHSGILRDLQPYSLSIGRGYGGHRPSLRIRRSPISQDLTDPCSTAVHVEPFSTSAFKVLVRILATYHQDLKLRRIHPCPRPRLQGSLVEVLIIVAEFGCS

SEQ ID NO: 989528 - protein, 172 aa, Homo sapiens
GIHTLLVHGLVISALGPKKRCLETAGCLGRTLARTLSSGQEDSMWNMCERLAVSVRDGLLAWHELLLTLMVGLVCWLSSEIRQWNREGKIRELGQVPMSLPLLEEADQVLVVPGPQVQVIDEQQHAEGVLIRLETQVELEVLQCRALAASLSPGSSSACRGQVEALSSGLRS

SEQ ID NO: 989529 - protein, 46 aa, Homo sapiens
VTGHLTDIFSTYHCPPSYCLQTLGMSIPGNDVQPTKILPDLTSSIF

SEQ ID NO: 989530 - protein, 131 aa, Homo sapiens
MTVHVTQPKDGGFCEVCKKLVGYEDRNLEKNSTKQEILAALEKGCSFLPDPYQKQCDTVSGRVRARAVIEILVAVMDPSFVCFKFGACPSAHKPYLGTEKCIWGPSYWCQNTETAAQCNAVEHCKRHAWIA

SEQ ID NO: 989531 - protein, 52 aa, Homo sapiens
MIISHYVAMTGLELLGSVIILPWIPKVLGLYAVSQRAWPVIRFLIFLVTKHA

SEQ ID NO: 989532 - protein, 75 aa, Homo sapiens
PAYHRHPSFFHVTRSNIGLAAVTKQNVNRCQGLRILWVAKVKNLIQQLIYEHKVVLDVFLADRAKVGSHHVTHLI

SEQ ID NO: 989533 - protein, 33 aa, Homo sapiens
GTGFGSVYGGAVTLGGGAMNSEVLMNSEVPMNS

SEQ ID NO: 989534 - protein, 156 aa, Homo sapiens
CAQERLVTALQNAGNDSLEKAADDSSEIGMKVIETPGPSKMSKSMELHVKSSSDEAKHIAEEADRKYDEVARQLVIIEGDLERTEERAELAESKCSDLEEELKNVTNNLKVFEAQAENYSQKEDKYEEEIMILTDQLKEADTRAEFAERSVALWES

SEQ ID NO: 989535 - protein, 92 aa, Homo sapiens
MEDSSSNTSEWDFWSKDKRIHGCTAPILKRRNKRPCLEHESWPYPIVRWCQLCHDMILFGCDIFVVPMVITYCATHTHLCLAECELGCAMHT

SEQ ID NO: 989536 - protein, 34 aa, Homo sapiens
AIIGTLQIRRLYDITKYSFSGFRQSWLLWFKTKK

SEQ ID NO: 989537 - protein, 116 aa, Homo sapiens
MEPRPVAQDGVQGHDLSSLPLPPGFSSDSPASASGVAGTTSTVPPSPANFGILRREWVSPCVGQAWSELLTSSDSPAWASQRAGVMGVRPPGWYNGSLLTDFFPFIRPVKFLRGAD

SEQ ID NO: 989538 - protein, 31 aa, Homo sapiens
MRELSADTQIGIAHYSPELLDSSDPPATRCV

SEQ ID NO: 989539 - protein, 40 aa, Homo sapiens
MSGSRADRGCAQLLSWRLLPGYLVTCIALSGGLQLVLRGL

SEQ ID NO: 989540 - protein, 84 aa, Homo sapiens
RSVEAVDAGGDGGHAGRSGWEVADHAMALRHPPLFADKMSAPESFQPFPLDQHRMNPQSQYQFKSVNYTGLQPGPRVIIMGYRA

SEQ ID NO: 989541 - protein, 37 aa, Homo sapiens
VLVALSDPPVPRHLLMASTSSCVWRLTPEMPVCLRLQ

SEQ ID NO: 989542 - protein, 42 aa, Homo sapiens
MTLEGKRTPRETDKGTEKPAGMKALPSGLLFGLLTGILLLVL

SEQ ID NO: 989543 - protein, 76 aa, Homo sapiens
MTLRCQNHIKPYEKQKASLPGVVKALGRYGPADVEDTTGSGATDSKDDDDIDLFGSEDEEKSEEAKRLREERLAGA

SEQ ID NO: 989544 - protein, 40 aa, Homo sapiens
TQSPLLTPLLLPTLPPGWSAPPLPQTPPVATPLASPGYQD

SEQ ID NO: 989545 - protein, 145 aa, Homo sapiens
MRALHPGSKVLGLVVVIRVYVLTAHDPVGQRVLYLRLVSEIPLGPVVFAGRDLLHLHDLNGVGSGAVPGTHVSVALGDSACGGQVPVFPVHVVGAAPGVIAQPDPEVLHPQGGLLKHLPTVDISPEDFFIFFNSDTKYQKRDLAT

SEQ ID NO: 989546 - protein, 41 aa, Homo sapiens
MPGRPERITTHNTTHARCTTGDRRGPHLGLAMAPLGPRSSG

SEQ ID NO: 989547 - protein, 70 aa, Homo sapiens
LLLVVSRLSPLCSSFLSVCDWRDLPVLPPGSAVLFVPPALGFTGTSLGSWWYDVPKYLDSAESPEGFDLS

SEQ ID NO: 989548 - protein, 31 aa, Homo sapiens
RYPQSPSAIIPFVYWTILHRYQMKSCEGYRR

SEQ ID NO: 989549 - protein, 98 aa, Homo sapiens
TRCSHHVLGGRIWCTYKDLGLSVSEKVGSGPGMRIWICQYLRRKGLALEDLGLFMSEEVGSQYQYEELVLSISEDVGIWYRFEDLGLSVSRRYDLVQA

SEQ ID NO: 989550 - protein, 72 aa, Homo sapiens
RNAFVVQGWLQELHFAPDTLLSINPSTGTLSAKVEGKTKTFHLSDSSGWGQISGPLLDAAKVIAPGNNGDLR

SEQ ID NO: 989551 - protein, 55 aa, Homo sapiens
RRSLIIKGLPTQLTDQLKRRELMLGGVLKKVLLVLLVVGAIQNWGKVERLFKPSQ

SEQ ID NO: 989552 - protein, 49 aa, Homo sapiens
GIDGWWSLESPIIGYDSHADPTKKSASANIAQTRSYDFKHCCHSFEDEL

SEQ ID NO: 989553 - protein, 40 aa, Homo sapiens
MKVYTLFSDDIFKSDALLNLASPDLMHLDTWAVPDLKRVS

SEQ ID NO: 989554 - protein, 37 aa, Homo sapiens
TSDSLLQVIPHNIAHYALAAMGANDAIPYIAAGDKVY

SEQ ID NO: 989555 - protein, 84 aa, Homo sapiens
MPCYMVVPPWLNCVGVQVFADVHVTLHDGVEGSAFLDAIGLHAQEGMLEECLRAAEPLIAHGHDLAFRQFVQLFSREELEAVVA

SEQ ID NO: 989556 - protein, 69 aa, Homo sapiens
MLLVDSMSDPLLTSLLGSRLPGVALDPDCADPLCCLPWVLCPACPASLARCRILGRIHAMCDLPLRTLE

SEQ ID NO: 989557 - protein, 64 aa, Homo sapiens
SLFVGTSLFIGTSLLIGTSLFIGTSLFMGTRGYSSAPVFGECCCRGGCNTRRGAPMNSEVPMNS

SEQ ID NO: 989558 - protein, 69 aa, Homo sapiens
MGRINIVKMTILPKASYKFNAIPIKIPPSFLTQLEKSILKFIWNQKESPGAKARLSKKIKSEGITLPDF

SEQ ID NO: 989559 - protein, 59 aa, Homo sapiens
MADSRGYTRYFIGTYSRSGVVLTKNNTTELFLDPVIGMIHFKTSNEGPLGGKSVADEYR

SEQ ID NO: 989560 - protein, 44 aa, Homo sapiens
SHPDTGVECGAHQCAECATRYGAWASEQFPPLCVYELMKVPMNS

SEQ ID NO: 989561 - protein, 43 aa, Homo sapiens
MAVSRGSTIMGELCEEKKDEGSPKFYDTEEKYQLNITCGLRII

SEQ ID NO: 989562 - protein, 78 aa, Homo sapiens
CQNKLMIPAYCSIASLCRDQFNLPRGSQTSPQDRVSGALLCAPSTLCTKQTVQFSLSITHPRPECRRVIRSLYRELQR

SEQ ID NO: 989563 - protein, 82 aa, Homo sapiens
MHPACTGYLVDKLADRERKVALTAMIITYVVSSSLLPLLFPSFRLELPLRSDPGRRPPRAHNPCPGPCFPIILLHSVLPSIV

SEQ ID NO: 989564 - protein, 102 aa, Homo sapiens
LRGELLWCQLLPLREPPIRLPSLSPLAIHVGPVYIAKALLLNSMFNFRSSTSSSSLGKSPPIKLLALLLLTPLEFTIIDIAVLCGANPCRENPGHGDGCFRG

SEQ ID NO: 989565 - protein, 47 aa, Homo sapiens
SLPCLDCTRGAALLFRKLCSVALLRVSVLPRDQRQVVVTKRSNIVAP

SEQ ID NO: 989566 - protein, 69 aa, Homo sapiens
ELLPESLNSTPSPAAAALCLCLLLVSLSPEHCEWRLKQHKLAPCCSPLQPESLAPSLHASFGPLGLALL

SEQ ID NO: 989567 - protein, 54 aa, Homo sapiens
RLMKDSPGTADGPLVIERLSSMAYGQISAMIQALGGFFSSLCDPVQKMASCPGN

SEQ ID NO: 989568 - protein, 41 aa, Homo sapiens
MTLSKVSLVCTLNQKAADCRRMHGLKSPMAQIARYNKMIEG

SEQ ID NO: 989569 - protein, 120 aa, Homo sapiens
MSGGITANTLSSISSMTIRRRSECRVWMKVTVVHEGCLSWRTVLVLFARAQLSAVPVIAPEWLEAGQPETQGSLQSPQDSPALQALSYLWRGQTGLVDECLAGSVELPDGCHQAGQQKRG

SEQ ID NO: 989570 - protein, 139 aa, Homo sapiens
QLRGELLKTYQGKMLNTLLLAGAAELSGLEWLSRLANLTQGEDQYYLRVTTVASHTSDSDVPSGVTEVVVKLFDSDPITVTVPVEVSRKNPKFMETVAEKALQEYRKKHREEGDVDVAFAPTGASESSSPQDELQLAPE

SEQ ID NO: 989571 - protein, 35 aa, Homo sapiens
YQRRYSDGIRVTELHDHLSDTVKERPSQKCGKPPW

SEQ ID NO: 989572 - protein, 124 aa, Homo sapiens
EGKTLSAAAADVDHGSFLDLKVGKHTPVLTAGRPAGAKVSVESKGLVDGQIGLDHKQWVCRHLLLLEHVAPFTVQNPVDATVHLLWTLYLHKVDGLHEAWLGVQHTGIEAAPCCGDDLAPSAVY

SEQ ID NO: 989573 - protein, 40 aa, Homo sapiens
LKKYEITSFLGLTWTCFFFEMYLDNVLILLCKDEPRSAVF

SEQ ID NO: 989574 - protein, 56 aa, Homo sapiens
KTFWGISLLAWDVLAHLESARDPSEQIPVNSLKSCESVQCPGKVLYGTKDSVNYRR

SEQ ID NO: 989575 - protein, 101 aa, Homo sapiens
VQNPAHGILNFLLGLFLEVKPPPIQLVFSSGATSGGQNPPFLILFFPRALLPGSKPPLFNFFFSRGQSPGVKTFSFSFVFSPGETPLGQNSFFFCGVFSAE

SEQ ID NO: 989576 - protein, 37 aa, Homo sapiens
YLGPRCTVAASSLLVVPCSIAYIKCLDTCNWYWLVWD

SEQ ID NO: 989577 - protein, 136 aa, Homo sapiens
MLSVVHTLWDGWRDETVLVVPEVGPRVYSDPNTPSRVVWPVSVVTLIADIKDPLFPDTHGVCSEDRTRGFQRKSASLISMESRIHSAPYLQLLKAQKQQLHLSFAQALPLAELIQGTQQGADTGHGCITSFDATLD

SEQ ID NO: 989578 - protein, 132 aa, Homo sapiens
SWTSVALSLVRDSTRELTISRKPNVREKYDDTMSQVASNNGLEEAVRKLTSMSVQNDKMRTGNLPAKLKNNQCLTDHSSMKFNRVIIPVKAGQTEYRLFERILIDCYRQKDSYIASQGPLLHSIEDFWRMIW

SEQ ID NO: 989579 - protein, 141 aa, Homo sapiens
ALMDNPTHLSKKKYVHELIPRCDDLHREQTVVPCNQMWTITGQLRDCAARLVAHICNPLSTSIKHHAMSRITKTFMQELGVRDDALDDSLWLHRRSWLSWDSIVLKTLILPRLPLEGERIRCVLDGPVLSCMSRIAADHVQ

SEQ ID NO: 989580 - protein, 83 aa, Homo sapiens
LTRGVHFTLTCLTFNPPPGAPGPNSDLQILFDLCIPSDSNFSFTLYESHFTSTPASPGLYWTPPSELQFTFDLASPFTPHPVG

SEQ ID NO: 989581 - protein, 71 aa, Homo sapiens
RWQITCSPGPKESIKNKTKKPKNHNEYVNARSDREYQEMYSRARMQVCDYYTGPSSGTGFVPPLDTCRASR

SEQ ID NO: 989582 - protein, 78 aa, Homo sapiens
GVFSPLRNSTNWIVYDNQLERVSPVDDRGLRGLTRLRMAGNTRIAQIAARGPGRPGEPCMELDVSNLKPAWPVFGLRR

SEQ ID NO: 989583 - protein, 65 aa, Homo sapiens
PALGLDGTKMQELGLEEAAKKHELGLAECLTERKFSGLERKAGSAVSWCLNEAICNCCEHVPCVS

SEQ ID NO: 989584 - protein, 33 aa, Homo sapiens
MWRGHFVRRLPGPGGALGEAAESRSLPSEALDA

SEQ ID NO: 989585 - protein, 59 aa, Homo sapiens
AHCGTDLMQSGTHGDGRLFSSLAWCWAPADGPAASSGAEVSRGPLNSTAINPGPVGLVG

SEQ ID NO: 989586 - protein, 79 aa, Homo sapiens
STDSQLAPCHTVASRGLACILTPVLTGKDGHLLLPCQQTPLDQESMPMVLAYKSRFKATLVKHSETVMKSAFHPCRASR

SEQ ID NO: 989587 - protein, 48 aa, Homo sapiens
MAILSMLQDMNFMNNYKIDCPSLARVCLMIKKAYRYPPYHNWPFNAYE

SEQ ID NO: 989588 - protein, 89 aa, Homo sapiens
QICDNLCGRDKGMKLGVCVVAHREGPVVEGDDCVLLPLLDGLPVPLANAGATSIVQDNATQIPEDLCIAGPLNGGAESARNLKWPFNAS

SEQ ID NO: 989589 - protein, 58 aa, Homo sapiens
LVRRHLLRTELCALLGACDRRDRRVQRLGHLGADDIHQALKGLLDVGHFNASEPFNAS

SEQ ID NO: 989590 - protein, 96 aa, Homo sapiens
VSDYMKCGQDVHRVMAAKDTAGAPCGGQYGEVMPVYRAGQPLDVQAGGHDQPGEGIYLLKFENSYSLLRKKTLYCHIYYTQLKDCVAQGQAVGLVG

SEQ ID NO: 989591 - protein, 78 aa, Homo sapiens
VQRLQDDNFSMAGKVLDLSAQGHSTPPGHSTPPAIETAWRPFNASDHSTPPAIQRLRAFNAFGPFNAFGPFNASGPLN

SEQ ID NO: 989592 - protein, 43 aa, Homo sapiens
GGAGMPPLGRVHSSPASIQRLRAFNASRSFNAYGPFNACGPFN

SEQ ID NO: 989593 - protein, 77 aa, Homo sapiens
RRYQHTQASDDLDEEQTQVHTVLCTSQHHDDPKAKSVFEVLKEKAGPGCDVELTASSGWCKQFKNRYSLHNGKVVSL

SEQ ID NO: 989594 - protein, 125 aa, Homo sapiens
KSVVFDRDEKHHLKEAFAYQDNKQKLDGYVILSILLLHFAGISIQEGILKEEQESPTTSYISCSALAKCVCIDMLEAPRVLNMPNHKGVQFVACNIAPKQTVIQSLKDLKPGIALVYLMDQSPFR

SEQ ID NO: 989595 - protein, 49 aa, Homo sapiens
EDPHPHQWYTEAGTASSSGLRLLVHTAHSRVRARNTHTHSRLPPPWEPA

SEQ ID NO: 989596 - protein, 36 aa, Homo sapiens
LGHSKDPHVISGSERQSLCEITVEEKAVSVSNHQWK

SEQ ID NO: 989597 - protein, 49 aa, Homo sapiens
MIRCGGAEIVAEAVKNLTKVPDERFYLSSSPQFDLVMGMIKMKGGVTNE

SEQ ID NO: 989598 - protein, 56 aa, Homo sapiens
HRARYHGTPIIAKVCEHLSSELQKFKIKIMGEFGQQTGSMTYQFPSRHYEACCMRL

SEQ ID NO: 989599 - protein, 51 aa, Homo sapiens
SSYWLLLAFAVDRQPDSAFLVDGLVWATGLIWADRRRVVEALADLPRLLLV

SEQ ID NO: 989600 - protein, 34 aa, Homo sapiens
MIISSYRIGHCFSSAAISVDIIKSRHLGILGFEY

SEQ ID NO: 989601 - protein, 109 aa, Homo sapiens
MLFSQYYLLHFAGISIQEGILTRGAGSPTTSYISCSALAKCVCIDMLEAPRVLNMPNHKGVQFVACNIAPKQDCHPVPKRLEAWHCFGLPHGSKSFQASVSRIERFHPY

SEQ ID NO: 989602 - protein, 54 aa, Homo sapiens
IVSCPRHRERLTHVQLAVHMATLSPHSAFNSSRFEVFAYTTNDLHHADGSTLGP

SEQ ID NO: 989603 - protein, 58 aa, Homo sapiens
MLWADAWSTHSEECTGRTQVRGDLELGGLQERMRVVRIRDAYQGRPIGYAALDAVGVR

SEQ ID NO: 989604 - protein, 53 aa, Homo sapiens
RATEIQQREKMDKKKARATAIFILIRNDVKCKTRGCPCTITDCPNSEAQTRWS

SEQ ID NO: 989605 - protein, 75 aa, Homo sapiens
MHDDTCPALGGITGGGRATVPGGLEELLRYPLTLLWVLVGAELVRMFDPRFAELSPITSCLLGSNLKVLLAKAQV

SEQ ID NO: 989606 - protein, 31 aa, Homo sapiens
MSALLVFHPARVISKSTMEENVEPRDRVEPE

SEQ ID NO: 989607 - protein, 55 aa, Homo sapiens
MTIEAADDVLGACEHTKYSCFSRSSVSLKEVYIWIQERLEMTQASASDVPCRASR

SEQ ID NO: 989608 - protein, 55 aa, Homo sapiens
IELGPPPYSCVGEGRGTRERNNVLRLLLLWLLLHGACLDPPAVKQVLYGSCNWYG

SEQ ID NO: 989609 - protein, 64 aa, Homo sapiens
LAPACTVALSQLPGVAAAMVPDPCLRHPFTSTNKIRAAELQHAPYRTAGYHGHRPACLISPNAL

SEQ ID NO: 989610 - protein, 62 aa, Homo sapiens
MYSSFSQSHSQSQCRFARSLKLKKARRYMSASCERRTGASGCVSKDVVWRKKISISYGAYVP

SEQ ID NO: 989611 - protein, 85 aa, Homo sapiens
LTEDEIWVGDDKILVGLMRMSMDGARLVWRREEPPELLGLRVEAEKEQRGFLADGAALARGTGRHIWDKPEARPECGDKVDPRGT

SEQ ID NO: 989612 - protein, 80 aa, Homo sapiens
MGFVMCGDEGYTTANKLCSLFLKNMLLRCGDMLSLSASFPNRCDFGSFSESNPAHAYNGDSSAELTALHCLYGLSGVDDL

SEQ ID NO: 989613 - protein, 49 aa, Homo sapiens
SRSSMAQRLVALSIREGMTCTLAGVSGADPAVFVLRLMCSVILIPGLGF

SEQ ID NO: 989614 - protein, 40 aa, Homo sapiens
LNRITRAHQLRGGAGQLSFNTGHALLTTQMLVHGRTLLQD

SEQ ID NO: 989615 - protein, 55 aa, Homo sapiens
TEGSRREPLSSAGQPQFQNMRQVIHAEPCAAALHCFQDSWASENPTCFYMQYHAW

SEQ ID NO: 989616 - protein, 85 aa, Homo sapiens
SAHQLRGGAGHVSSRFTRSVEHQSWAGRTRSTDHLELGQGLNNGDRSPPVPDRAWSGGSGARCFWSSSPCTRPLPVITAVCDPNL

SEQ ID NO: 989617 - protein, 91 aa, Homo sapiens
MTIRGGTSDRGLAEYRAEDRSLVLNSIQALKHWETSVPLLRPWPALGVSGACPPLAKLWVVSRALPVLKDSWARIPPRSLMRPSVLRWSRV

SEQ ID NO: 989618 - protein, 54 aa, Homo sapiens
GDVRVQYVRSDAVQPSDSAPGETVVEEPLPSVTRTVVCMAHHQWMGGRDLSYGL

SEQ ID NO: 989619 - protein, 78 aa, Homo sapiens
GTGDEVRGLIRSRGGAGQLSSTRTRSADHPELGQGGQLLHLTTHELGQGLNTWGQQVPHVLCQGSGCGRFMEPMGASW

SEQ ID NO: 989620 - protein, 75 aa, Homo sapiens
MAPPWLAEEAALPLALHRSLTPQGQVAEQEEAAALRQALHPLSAGSAPVGGRQTPPDGGTDGTAQLVVHLGLRAR

SEQ ID NO: 989621 - protein, 83 aa, Homo sapiens
MPIISNTLHSSISPSDVQRIEANEPFYPDVYYQSQTASDGELHVRYAWSFHDVMSHYYIVTMDIGSVGKIGKLESFCWIECRA

SEQ ID NO: 989622 - protein, 101 aa, Homo sapiens
MPLGGTASATGILALQLLFSALFSYGKKQYGGLFFSLHTNSLFLTYLLSTFYLSTHGRKSSQSLEPNSMSSKSGFATSQLRDVNSFLSAQVEGGIDKHRVP

SEQ ID NO: 989623 - protein, 74 aa, Homo sapiens
GVIDATGVYRKPLVFIRCHWCIIDATYRGMYPDTVQKTQSRRPRAEDVDLRVNFAMNVGTWLEQGLKPEERGDA

SEQ ID NO: 989624 - protein, 60 aa, Homo sapiens
MHLRGMLVSSPKYELQPPRESSERHQVTGPSSRPQFRQLSPLWILHLTLDSAAHGKNRIA

SEQ ID NO: 989625 - protein, 138 aa, Homo sapiens
CHARVCMHISTGARSPSVSPQQQSPFTTAGFAPTPASMNLPPTRSRQQNSFPAAQQNCLYAPSFSRSAGVIPTHPNMAHVTFILIVPSGRGSFSSNCPMRAMNAKLTKQSPGESPGPPSPSTVAYKAHSSLGATAHFP

SEQ ID NO: 989626 - protein, 41 aa, Homo sapiens
MHYGRMSQLPQDELQPPERALTVTKKPGPSSRAPTPPSISP

SEQ ID NO: 989627 - protein, 54 aa, Homo sapiens
WTTGSYTELEGRERHPRVRIDWHCLTDGVGVSKMDGPNHEPWQVGPEQQGWAVE

SEQ ID NO: 989628 - protein, 47 aa, Homo sapiens
MYCVCGWDEGASWGMRLPRWLNVWDGIRASDLGRHPGPAQCCEEPLV

SEQ ID NO: 989629 - protein, 34 aa, Homo sapiens
VIFPMQPASSRSVQQCQAPSSGAAGWRGSWVAVA

SEQ ID NO: 989630 - protein, 88 aa, Homo sapiens
EELTPERVQHSLSLPGTPTTPVSQLQSAPLQQLLHLLVRSKHIPQGQLMLKLLPVLLSDPHIGAEPQDHNFLQQLQSAQGDTLPVAMA

SEQ ID NO: 989631 - protein, 111 aa, Homo sapiens
LVSEGRRGMEEKIFFHCTLNNSHYRPDAGHDVPGPAGEGKQTAMCRHHAVHHLAVPQDSISALLNAGLPSQEILPMHFLTFYPHPLAKIFQICRFSPGLTILSSRPTHTTA

SEQ ID NO: 989632 - protein, 93 aa, Homo sapiens
VTDARVQEYDHGSGQIQPLQAQVIFPTQGSQVVGSAGAHHHAWLFEEYLVELGSMLPEAVLILLNSNNRSISASQSAEITDVSHHTMIVFLGK

SEQ ID NO: 989633 - protein, 106 aa, Homo sapiens
FPCPVTLHLSTSMENNFVNLSEGLYAENETRILIEDLHAAGKTTIVYKLKLIQIVTTIPTIGYNVGTEAYKSISFTVCEHPGQDKIRPLWRHYFQNTQGLILVGSS

SEQ ID NO: 989634 - protein, 64 aa, Homo sapiens
ADFREPPVGGLLSIQHTHKRTVHTRTHMLHTAHKRTAHTRTHMHTQHTRKRTAHTNAQHTRTHS

SEQ ID NO: 989635 - protein, 88 aa, Homo sapiens
NVYEKTTDYRGECRETCAKSTSSHVRRIYYYEWHSRAIVLCVSPSKPNPVFKVFGAAPLENVARKYKSMYNEELEILLWQNTPLRHRR

SEQ ID NO: 989636 - protein, 45 aa, Homo sapiens
VFVKSERHGVQSLSKYKPSSSFRVSKVKVQDLDCYTTCAQLCPFE

SEQ ID NO: 989637 - protein, 84 aa, Homo sapiens
MASVPALQLTPANPPPPVRSNPKKPGRVTNQLQYLHKVAMKALWKHQFAWPFRQPVDADKLGHIPSEWPPRDSHVLLVSSDQTC

SEQ ID NO: 989638 - protein, 126 aa, Homo sapiens
FLWLKPVSSLLRDGHPLPAPESSLRHESPPPPSTDIHVCLPSQFKCTNTNRCIPGIFRCSGQDNCGDGEDERDCRGVRGGGGPVVGDDTEAGQAESPHSFERLSNNSRWATIILGVTCFAHKNHHA

SEQ ID NO: 989639 - protein, 92 aa, Homo sapiens
NDRFQKILNVKRFKTFCWLIIKHEVNNFAESAISPFCTEKKSVFLSAEVHIIVLYNVLYINDKNKPCFMFHLVQKVKFPQCFVVCWTCNYSS

SEQ ID NO: 989640 - protein, 62 aa, Homo sapiens
SAGAFIGDLMAAYFFSLQLLGTSSFASAASIFSSFMVPVNASVMGVRASAISAFSSSTLVSS

SEQ ID NO: 989641 - protein, 37 aa, Homo sapiens
MRRLLLLLLVLLPLLLLRVSRLCAGGRGLGAPGGAAA

SEQ ID NO: 989642 - protein, 40 aa, Homo sapiens
DLLARYWRMEAETEGAIKPGLQRMSGLTYPAGYTREGPGM

SEQ ID NO: 989643 - protein, 145 aa, Homo sapiens
MPEVKDGKEVSNPSEYLLVVDAMTVHDAVNVAETFNNSLDLSNNINKVDGDTRGGAALSIRDITGKPIKFVGVGEQMSDIEVFHPDRMASRILGMGDVLSLIEKAQQAIDQDEASKLSEKMLNQEFNFDDYFISYGSNEKAWTYK

SEQ ID NO: 989644 - protein, 37 aa, Homo sapiens
MLTRMANVREAVLVQDRVLQEAVRKPGAFSSSPMSNK

SEQ ID NO: 989645 - protein, 50 aa, Homo sapiens
MEQMGQWNHKLEPLDERHLLWPGTVAHACNPNTLGGEAGWSRSPDLVIRR

SEQ ID NO: 989646 - protein, 59 aa, Homo sapiens
QSRVLSRVCLSLFRKQSLYPPGHACRWNLCPHQQASLTSLPLCWKGLNPGKSGYVTYST

SEQ ID NO: 989647 - protein, 56 aa, Homo sapiens
GLSLPSLLHLRAGVLGGLDRIYCMPALHAADSLYHSSIYFAFVGETVSCRTSRGGR

SEQ ID NO: 989648 - protein, 84 aa, Homo sapiens
MPTGRHTLSQSVERAAAYNGVACGLGRHSDDRVLLDLCAFLKTIALNGCGGRANRCLSNYALEDDPLSGYTGPKLARRKGIKNP

SEQ ID NO: 989649 - protein, 70 aa, Homo sapiens
IFKDSVFAEAVTVPCEHANSRSPGSSEEQAQLLARLMVLKLCSPRHNLMAVQDFLMTVDRESLHLILIKM

SEQ ID NO: 989650 - protein, 34 aa, Homo sapiens
MPDSIGRGTQSAAGSLWREMWVQGSFLQPCWASR

SEQ ID NO: 989651 - protein, 80 aa, Homo sapiens
MPTALDLTEAWARSSPYSRVSSRPPLFPSCFGSLTPLEPVLPPPLEVFPSLNGISGARSLWCNSTDMIHGRSVLHIVAGL

SEQ ID NO: 989652 - protein, 54 aa, Homo sapiens
YPTSRRGGRKEKACNVQRIRVFPGKTQRFRWGDEVSGAMSTVLGGDRLHCRASR

SEQ ID NO: 989653 - protein, 65 aa, Homo sapiens
GVLRITDAGSDYLSTMSSLRSSTCDGAARCNDFGLMQLLALGSLRLLSLAGCPLLTTTVLSGYSG

SEQ ID NO: 989654 - protein, 55 aa, Homo sapiens
TTPNQEISTLNLNMKTFPFFQMEDKDDIFKRTIRINTHVVTICDLGRKCQVDAAA

SEQ ID NO: 989655 - protein, 46 aa, Homo sapiens
PLRLAGQGVEGCTKCIKYLLFVFNFVFWLAGGVILGLDLIACRASR

SEQ ID NO: 989656 - protein, 54 aa, Homo sapiens
AVRGEAEATDSAARAHPRAYHVVGVQVVAALQVVGVEVGLVLITGLVGAVGLSG

SEQ ID NO: 989657 - protein, 44 aa, Homo sapiens
PWVNYTLPRFKGQLESRELRTGRFQGMALSRDEPIPPVRVVAGS

SEQ ID NO: 989658 - protein, 41 aa, Homo sapiens
VTPLGNTCCVTPLLLEHPATEHLYGGQVSDRAPVTLGGAPA

SEQ ID NO: 989659 - protein, 68 aa, Homo sapiens
FSDPPYVLIHRGGPKYFCIDAQPVHGVSAGAAPVRCRARGLPGSRVALRNLQPNSVVVNSTLTAKVPG

SEQ ID NO: 989660 - protein, 50 aa, Homo sapiens
YHKLSAAPALAKVDNPRVSGHENGLPLTETRKVYRRYYLLDSEYSGVELF

SEQ ID NO: 989661 - protein, 34 aa, Homo sapiens
YLTITKTLLPALRPEPRLCPEFKGHWLRMVADCA

SEQ ID NO: 989662 - protein, 35 aa, Homo sapiens
MQRTRAASVRFPARTVEWRPNVSPSTLTERKNELF

SEQ ID NO: 989663 - protein, 47 aa, Homo sapiens
DPNAAESEAVAQGMAQQTMSACGGCCLHQPQWQMTHHPPMLSGTMTR

SEQ ID NO: 989664 - protein, 155 aa, Homo sapiens
TSGIGGSTWNVLTVHHTSNECAATWQDVVALAWIEDFAAVQCNAGSQLPAHIKHGRFHVGHVEDAADVERCVRLIVQGVAGLVVTLRDVAGRTPHVATHRTSLGGPIIRDGLARVVHPPSNFKYKGKLTKLLYFVTTFRTRGLVGKLLCSRIPRW

SEQ ID NO: 989665 - protein, 48 aa, Homo sapiens
DSRGSPMQRNREAAVIDDHFLFDKPVSPLLLASGMALVMALTPAVIWH

SEQ ID NO: 989666 - protein, 41 aa, Homo sapiens
MQRNLEVSGAMYDQQQWLVAEASDSDQSQGNGTEHVQWPWV

SEQ ID NO: 989667 - protein, 89 aa, Homo sapiens
GNKQLSLSQKSMCMWLDLYTDIINIFLYILIIIGRAKEYAELQLAVPAQVARAGLDPAPGTAVPIVLPLSLVPRHSLKEKDASTPTLLY

SEQ ID NO: 989668 - protein, 106 aa, Homo sapiens
ADSAVKRGSGRSREVQLSSVPAMAFTSISVIITETSLLLTRRLAFKAWMSVATPETPGKCHLLHGSALDLLQALGHDVGHLGALSLGDPAILSPKTLSVSGRGLLS

SEQ ID NO: 989669 - protein, 32 aa, Homo sapiens
MAFQSQIASTWACLEAPAKHSCLCRGARVRVH

SEQ ID NO: 989670 - protein, 73 aa, Homo sapiens
YERNNGTPNLITQRHIRIYQPAPAERDIVRKRWRLVKQVSHVGVLGQVDTRDKSKCLPFSSEPVREFVMSFQR

SEQ ID NO: 989671 - protein, 108 aa, Homo sapiens
LEDISTSACPQIHHGSCWDECKFFSHKVAKSTESDYIHFQSRGLGIHLVPGNIRKMSTGLKPNYDAIRTVLDDLRNNEFEDINISLHQIEPTLPFLLTDSCSYHYNLR

SEQ ID NO: 989672 - protein, 96 aa, Homo sapiens
MGRRYLTVFKRQLLSWIDFSKALPLRVQGQIDDLTFLRINQAREMSRTADALAIKLLYSISISKSALKAGESSETIVIFNAIVRLTRLTFCFIQFN

SEQ ID NO: 989673 - protein, 53 aa, Homo sapiens
YLLSPTLLNIHCARLCHADAHWCHVRVWLSCACRLGHHARSLVRLVRSTGLSL

SEQ ID NO: 989674 - protein, 76 aa, Homo sapiens
MATTEDRQRGQAGKRSEKYPSQEKGKLGKAASPRTRAAHAGLPVQFRGLRILFRVRSRLGGEKLGRGKGPGLIGSD

SEQ ID NO: 989675 - protein, 55 aa, Homo sapiens
GNLDLLASWTFWHTVDLLGYLEPSGHTVDLLAYVDLLAYVDLLAYLDLLAYLDRG

SEQ ID NO: 989676 - protein, 44 aa, Homo sapiens
EGVNGFGVSKSPSSHEYGSAGMSCIRYGHQRLAPSDLRSLRFQM

SEQ ID NO: 989677 - protein, 56 aa, Homo sapiens
WTSGIPATSGILDLLAYLDLLAYLDLLAYLDLLAYLDLLHNELTRNNFARREKVQV

SEQ ID NO: 989678 - protein, 45 aa, Homo sapiens
MKPSRQSTCSPPVSHHVDLPFRQHVAHNYQSTCSPAYQSTCSHLY

SEQ ID NO: 989679 - protein, 34 aa, Homo sapiens
MTSAYLTFWHPDLLAYLELLAYLELLAYLELLCI

SEQ ID NO: 989680 - protein, 145 aa, Homo sapiens
RPYVARTTGVCHMSANNVVFLSPLRWSLPPSPRLEYSGVISAHCNLCLLGSSDYPASASQVTRTIGAHHQAWLIFVFLVEMGFHHVGQAAFALLTSSDLPTLDSQSVIRCWDYRTATVPTLIFKFMVDKGSCYVAQAGLKLLASG

SEQ ID NO: 989681 - protein, 122 aa, Homo sapiens
KAQIHFVSFSLRWSLPPSPRLEYSGVISAHCNLCLLGSSDYPASASQVTRTIGAHHQAWLIFVFLVEMGFHHVGHAAFALLTPSDLPTLASQSVIRCWDYRTATVPTLIFKFFVDMGSCYVA

SEQ ID NO: 989682 - protein, 48 aa, Homo sapiens
VILDFSWCHGIPGLLDYLDLLQRPLSLPLSALSPPPFPSLQKVQVCQK

SEQ ID NO: 989683 - protein, 34 aa, Homo sapiens
AGLQEQQLFLQEVQFASSHLQESAQVRSHQKYAW

SEQ ID NO: 989684 - protein, 51 aa, Homo sapiens
TGHSPERTNFFFLFEEEVGSFTRRSRFPDGPAYASMVQVCQKVQVARRSRY

SEQ ID NO: 989685 - protein, 68 aa, Homo sapiens
PASGLLASGLLAYLDLLAYLDLLAYLDLLAYLDLLAYLDLLAYLDLLIVDTGCRGFSAETLQARRSRY

SEQ ID NO: 989686 - protein, 99 aa, Homo sapiens
RSPKRGWVIVHNDPEVEKMQAGPPGDMEAAALPCCEIQLRIKFLVIALKSSVWVYAWAPKPYHKFMAFKSFADLPHRPLLVDLTVEEGQRLKVIYGPRP

SEQ ID NO: 989687 - protein, 58 aa, Homo sapiens
IELGPGVHSPLRILGWGVENGTPVTVLVANSLEHCTGDDKWTSLNILRVTGSLLESNS

SEQ ID NO: 989688 - protein, 77 aa, Homo sapiens
GPRSRGLGVYVVVAVALLCPQDLRTPWSMAGYSVGLSCLCCGSRGCLTGSKSCHTGCKRSGSLDAAESCSLCWPSYP

SEQ ID NO: 989689 - protein, 73 aa, Homo sapiens
MPRRRGLGPGQIRQPQPGYKPTPRDSGFRPTPVLLKIQTPGASPWTQLLGPPQWMLMPDQHQPHWTQGPGLHL

SEQ ID NO: 989690 - protein, 41 aa, Homo sapiens
GGGRLKALHGAHHRLVLHAQLSQQLGADQARHQTPPAADCH

SEQ ID NO: 989691 - protein, 85 aa, Homo sapiens
GQLTETTEAALQIGAFALPFTVAHVDRQTHMSSGSDRMELLAHLLGREVRWVRTQAHFCTLAFPAHQAGSCDELDGERSDVSSPM

SEQ ID NO: 989692 - protein, 71 aa, Homo sapiens
LLGPQELLGEGVHYLGEELHHQNEGTQADTRESDKMWLVRHLEIIRKYVLDDLIVAKNLMIQCFPLHYEMF

SEQ ID NO: 989693 - protein, 114 aa, Homo sapiens
CARSMRIPAEMTVGPVRMAIIQKSGNNRCWRGCGEIGTLLHCWWDSKLVQPLWKIVWQFLKDLELEMPFDPAIPLLGIRPKDYKSCCYKGTCTLVFIAALFTIAKTWNQPNVHR

SEQ ID NO: 989694 - protein, 67 aa, Homo sapiens
RGGRKVGHEKSEMEEALTAITEELTASMRDEKKEAAEQMEEEPAAEEDEVAAKKSAEKATAPDVKEE

SEQ ID NO: 989695 - protein, 50 aa, Homo sapiens
DSNMRGSAGWVGLGLIGTDVLDLQPGHTITGSESSPTLSLVVAAQEKCAG

SEQ ID NO: 989696 - protein, 144 aa, Homo sapiens
SEAKNKRDEFPCPLLTVWISFYDLVKLSFFLSAMPGNPVTARPRAQAHLRGQVHRATPLLLVGSRCRAAATMMRLRTSLPVGSFLLGLTHRNHGLDGCAEGGSRTGCCCQGPWCCWHCSQRKSDRCEWFPVTFVSRVPCLSSEP

SEQ ID NO: 989697 - protein, 87 aa, Homo sapiens
TLEDPNAADSDHAGAASGANVLTLIEKDICTPNLAITTVPEKLYFSDATLDNDRAVRVLTAPTGYVILKSQSLTPLGLACVMAEHIF

SEQ ID NO: 989698 - protein, 36 aa, Homo sapiens
NAADSEERCLQKGRQKEEAGEKEVCGDQVKGPDKEE

SEQ ID NO: 989699 - protein, 112 aa, Homo sapiens
ELILEDPNQRNGTAQLIQAGSTRSFISEEMLLNTRFRSLWLRKLLQRQLSLGCQLRGPLLLAQKCGTAPLLCFEVGLLLSTVNGCCQVMPFGQQGGQRVHAEGPCQADSRAN

SEQ ID NO: 989700 - protein, 67 aa, Homo sapiens
MSGMAELWSSLEALQLTRVPRDMRRCCFCHEEGDGATDWACPVLLNLGPVTLWVHQRVPWSTEGCMR

SEQ ID NO: 989701 - protein, 80 aa, Homo sapiens
SRGSLGFNISARPSLWLSERRRGVGEWEQLCSVRQVPLLHESRYPLPERDSSPLAQDIHPLYALVICSSSSSVNLGQQGS

SEQ ID NO: 989702 - protein, 46 aa, Homo sapiens
MQRTRISEQSVFSSANSWVKLLLLLLQVGGDLARGGPVSTCEARPA

SEQ ID NO: 989703 - protein, 42 aa, Homo sapiens
MGSSILLTLVTRAQLLAPQRVLGIYGLYAHGARAICAVVYYR

SEQ ID NO: 989704 - protein, 47 aa, Homo sapiens
VTSWQGLACRVCLGAQVRKLVTVKKPVMTASSEQGMQSLLGEWGTGE

SEQ ID NO: 989705 - protein, 145 aa, Homo sapiens
LVGCFSTEKRCSLYKRENAEYVLSGATLLKISERYTTLHLPLLENANVLARNANICQQNGIVPIVEPEILPEEEHDLKRCQYVTEKVLAAVYKGPKVNIMYDLEGTLLKPNIGDPGPCCTIKYTPEEDAMAIVTDLRSNVAPAFP

SEQ ID NO: 989706 - protein, 66 aa, Homo sapiens
GGAQKDTFLLWCCPHVFQQRSGTESGVTSSDTLETYRLASLSRACQPERSKHEAGWAFSPYQLFLM

SEQ ID NO: 989707 - protein, 100 aa, Homo sapiens
RRFQQEENRYKFWIGEKPLVRCFPSNKRCHGGLGKEYTTSLAKVVNAISPKTTTDEPSVVKHTCNTQIPGNLRHKNSLNRESGGCSEPRSYHCTPAWVTE

SEQ ID NO: 989708 - protein, 96 aa, Homo sapiens
EGHTLQCIKSHHQMWTWTQFPSVPSHPRVWTWTQFRCALAQSKVGTGTESLCGLSHSKVDADTEFLCARSQSKVDADSESLCALAHSNVDAGSESL

SEQ ID NO: 989709 - protein, 42 aa, Homo sapiens
DQQQAGARQLQDQSQGKGQSSARPGRAGISGSGPVENQGKFS

SEQ ID NO: 989710 - protein, 41 aa, Homo sapiens
MPCCGNGGCVAVGYYGTLVSGGSLQVVPAQRAALLLRGQVF

SEQ ID NO: 989711 - protein, 41 aa, Homo sapiens
AILEYPNLRNRSYLVLDEISNSGLWLGHVTWTMSQGNGQSS

SEQ ID NO: 989712 - protein, 48 aa, Homo sapiens
YTVPMSFSTTVPAFGPLSNLLPLPIVKLYMTDAGRLQLTCVQQCLARE

SEQ ID NO: 989713 - protein, 64 aa, Homo sapiens
NLKGKPTDDGAIEFTFDLEKETPGGGGQEMIESGFFQRVTVQIVAQSIRDRVGHNSCCGGRGSR

SEQ ID NO: 989714 - protein, 65 aa, Homo sapiens
TLRIPDCIECRESGCGDGRREVSSAVTRRSRRSLVVAPGEEYSSFVKWQWRPWNWVLPLRDGALV

SEQ ID NO: 989715 - protein, 51 aa, Homo sapiens
PDQPDSQLSPDNQDTRSNLDITVGSRATSHPRLDQHIPPVGLVGETLSGYS

SEQ ID NO: 989716 - protein, 37 aa, Homo sapiens
WCILLILLIHVTFSGILGIGVYPSAYLCPCAYEGPGM

SEQ ID NO: 989717 - protein, 54 aa, Homo sapiens
PGLSSQSLKATVRVLTSAQKWGAPARIWAEKKQNLIYTTFKNYSACCVEKCAWV

SEQ ID NO: 989718 - protein, 66 aa, Homo sapiens
TGLLAYLDASGIPDLLAYLTFWIPDLLAYLDLLAYLYLLAYLDLLAYLDLLISELTRNNFARRARY

SEQ ID NO: 989719 - protein, 56 aa, Homo sapiens
VSLPLKLFLLYLPPTSPGAPSSPSDGFISLSVTTQSYWHKFIFFQISFQNTQRSRY

SEQ ID NO: 989720 - protein, 34 aa, Homo sapiens
MSITYRRSGMPEWSRYSRRSRYARRSRYARRSRY

SEQ ID NO: 989721 - protein, 42 aa, Homo sapiens
ERRLGRTEHFQSSRWRDGCRVRFACDDDFPAVFVTPFLPSNR

SEQ ID NO: 989722 - protein, 68 aa, Homo sapiens
LTSQRSHGFLEKAEPVSPGCVKLAGHEGLVETVLLMEPWWMRFLQLYHEDLLAGLGDVALLPLEGPGM

SEQ ID NO: 989723 - protein, 80 aa, Homo sapiens
MRETIDISHRIDRPENASHELVKRESPTAITLQIPDHIDFTLSQTRLDHSITLSKVQVCRKVQVCHKVLVCHTGPGLPDG

SEQ ID NO: 989724 - protein, 69 aa, Homo sapiens
IIPGLLAYLNLLAYLTFWHTLTFWHTWTYLGYLDLLAYLDLLAYLDLLEGDRLGPKDERSSDIYLRYKR

SEQ ID NO: 989725 - protein, 116 aa, Homo sapiens
WTNDPKTEEHQVIHEAVSLAGWKGRIGAPGLDSSSLAGTPSDETLATDPLGLAKLTGPGDKDRRNKRKHRTRGGRLSDRDYLGAAWDGATVVYWLELWVGMPAWYVAAWRGNVKSC

SEQ ID NO: 989726 - protein, 125 aa, Homo sapiens
VVEGAGIGHGRGAIRMRMGLNISHRHNWCELSAVGVAAVVRIVPGVVNRTLSVGFSVCWVDGASGAVVVAVKSTTSSTSRAVVKTAWLSSIEERVERLLEGVVTSHLNSSSSREPSGRRSRGYGL

SEQ ID NO: 989727 - protein, 43 aa, Homo sapiens
MPDSTPRPLGCSGAAALGAKRPAPEKYRASSSGGSGGWQWGPR

SEQ ID NO: 989728 - protein, 45 aa, Homo sapiens
MLRLLYRSCCRMGPGEKADQRVLLQAGRSDNSSSVVHPWKLTWHN

SEQ ID NO: 989729 - protein, 46 aa, Homo sapiens
LEIAGGRTQRQHSYLRRRPMLDSTEQPGVSGVYCPGHLRTLFLGTS

SEQ ID NO: 989730 - protein, 101 aa, Homo sapiens
MIGRSGGWRGSRAACSPDRALAVVLVSDQHPPDAMFLVVAGSVRDGAKLLSDGIAHGVGLVAINVDGTNEQVVGDVIQVPMELEPGASSCHVVSGTLPFDL

SEQ ID NO: 989731 - protein, 66 aa, Homo sapiens
SNVIDLVYSEQVCLEIELDKISAIDVTTSRDRTTRILMLVINPSFLAYGVQVHERPERWGAVYHII

SEQ ID NO: 989732 - protein, 78 aa, Homo sapiens
LDIDRPSTSGSFDYKKPPPATGTDTVIAHWVVQPLSAMIQKSSGIPVKPVNGRKTSLDVYNSAEPGFLAPGARTNIQY

SEQ ID NO: 989733 - protein, 38 aa, Homo sapiens
TLTSHVTNAGPTQPSGGLLPSWDGAPSTSEVYPCTQRP

SEQ ID NO: 989734 - protein, 97 aa, Homo sapiens
ALKQLDEQRLRNWRTSTARAGGGQLPWVEQQLAGHMRAQLEALQKQIDSSDYPEVNEEEEEPENEKSSGQSRECELALWDYRKWQWYQFTSLRDLLW

SEQ ID NO: 989735 - protein, 58 aa, Homo sapiens
CTVSPSLTKGWLYTSDLPKWLPTALFFRLLKIDSTTMHRLLQCHEPMRRPESHSNTVT

SEQ ID NO: 989736 - protein, 35 aa, Homo sapiens
WLDASIQASRGSYVNLSLKSGAVWLGHQPQAQVPS

SEQ ID NO: 989737 - protein, 65 aa, Homo sapiens
RLRSAYRGSCGSDEGRSSCIVEGPRGSDEWETTPYGGGSLQFCIKGDHPRMARKVQSMPGDSSRR

SEQ ID NO: 989738 - protein, 93 aa, Homo sapiens
KQQNDAKKKWKPDRAIKVSMRLYALSVRIATGVKAGPAVFRGPPPRSLPQHMGILGDIIQVEIWVGAQLNRIMSLVYCEKIVTSCTQRVQMKL

SEQ ID NO: 989739 - protein, 74 aa, Homo sapiens
LWHLGLLAYLDFWHTWTFWHTCDASVLTWTFWHTLTFWHTLTFLVALGLIFKLSIDNVSLVLWHNITEFHEKVQ

SEQ ID NO: 989740 - protein, 131 aa, Homo sapiens
CCVNALQSHKERMSTLSVDMQGQALPDCIGKGHVAVGNSLPVNAQTLQAYLLQIVISGLPCSLFSAQSATNLMMTDYAEKNKPHHQLHATKLYSFKGRWFSEYCGTEASERQVCSGYDHSFLWRINSPFVA

SEQ ID NO: 989741 - protein, 69 aa, Homo sapiens
TMMCQMDDTAHMTGSGMEGGIDHLDICSAQTSSTEKEPHLNTLGAWLTIFSRYIREVIRFSCAPSQIST

SEQ ID NO: 989742 - protein, 41 aa, Homo sapiens
LALEYWGKYVGVDRLVRRSRLSSEPGLALNLGDQNGVWQVL

SEQ ID NO: 989743 - protein, 40 aa, Homo sapiens
LELLAYLELLAYLTFWHTCDLLAYLDLLVCQKVHGMPVWI

SEQ ID NO: 989744 - protein, 50 aa, Homo sapiens
RDAFQEHPTRAIIIKMHKLFDANSSTVNLPMGIYPYALFIITVHQNVICI

SEQ ID NO: 989745 - protein, 33 aa, Homo sapiens
SVWSSLREIPLDLNLGPTRGSEGGVLCGHREYF

SEQ ID NO: 989746 - protein, 66 aa, Homo sapiens
RLTSGIPDFLAYLDLLAYLDFLAYLDLLAYLDLLAYLDLLAYLDLLAYLDLLRNELTRNKFARRAR

SEQ ID NO: 989747 - protein, 50 aa, Homo sapiens
GLLVCRRSVIRSSGIQKVRYARRSRYARRSRYARRSRYARRSRYARRSRY

SEQ ID NO: 989748 - protein, 59 aa, Homo sapiens
KWDVRDSISSLVIHTFPVEVREEAGAEGEVSESDLLDGEAELGSDAEELLTARSRRCDL

SEQ ID NO: 989749 - protein, 35 aa, Homo sapiens
RLGPVCHVDFQRDGRKGSISVNSRSTPFLCHWRQR

SEQ ID NO: 989750 - protein, 44 aa, Homo sapiens
VGIAENVLLSLKTPDSFPPAISKHVKPTVEKMRFMSRKRDNYND

SEQ ID NO: 989751 - protein, 73 aa, Homo sapiens
VMGDVWHVLKTHCSSSRDIQHGAYFPDLSPSVSHCTVRKQNCIGEERRDKGQYRAVCPAYGPCTFSQATNTLT

SEQ ID NO: 989752 - protein, 45 aa, Homo sapiens
TFPRLYVEDEIYDQIKEHHVVSYTCMKMVWNSLQKCKDRPKDFFR

SEQ ID NO: 989753 - protein, 65 aa, Homo sapiens
PTSLTGLNSEGPVPVAGLPEGSYECCGPDWTTPVSSEAWESIKRQDVAQCAWGAACRASLGGVLM

SEQ ID NO: 989754 - protein, 102 aa, Homo sapiens
SAGSLLLVPSIFSLLVGGRDSEQPVHGGRLRWGLVPVGSRSPLGRGWSLLLADPLTLAQLGQKLPHAGGNLRAQEPQKYANVPRHRDELYTIITKFHASNNL

SEQ ID NO: 989755 - protein, 51 aa, Homo sapiens
PTSPTGKNGKRSPPMLKGGLIGSAIVLTNLQIQPRCVSLTALVQATVGLVG

SEQ ID NO: 989756 - protein, 122 aa, Homo sapiens
ECIQLPAFMLVDIQALVPARGLPVKPVVCLRLQQERSLVALQQAPAHGLVDGHLLLGVLQVDAGEAATALQQLSCTGAQLRKVLDRRLAVLELLKLGPAEDPAVLDAVDCNIFTAKESRLLS

SEQ ID NO: 989757 - protein, 109 aa, Homo sapiens
YSWAGRAVLEVFFSPLIFSPPWEGSDEQSRSSETALNGAWCRLGPEALWGEAGPCCNSDPVTLAQLGKKLPHADGHLCSSGATEICSCPQTTEMRCLPIITKFHASDNL

SEQ ID NO: 989758 - protein, 33 aa, Homo sapiens
RGATAEVHSNQDTSRVTTPREACKRATPQTITP

SEQ ID NO: 989759 - protein, 64 aa, Homo sapiens
RLARQAGDLLKETDISNASEGRQLHLNGSLKACLTLIVSMLQLVWASLGWVPESLNSVHHVSIA

SEQ ID NO: 989760 - protein, 153 aa, Homo sapiens
VRYPNPEAVSYPENWRHFIRHLQRQQILAASPEGLGTISSCNLQNLGSQPGLPPLSQGSHPLQSLLNLGKPFPAVYPEPGPQPPMCNQALGNQGQLGPKALGNPNPSASSGPWKPAKPDPSVSPGPWKPIPSVSPGPWTTRSICVFCILEIII

SEQ ID NO: 989761 - protein, 41 aa, Homo sapiens
PDQPDSCPQPGLLVGVSIGLVTPNVPWPQPVLLFRVCLASR

SEQ ID NO: 989762 - protein, 150 aa, Homo sapiens
YHHGHLRFILEGARLQQDCFIVMASTTGSYSCSGGGCSTRMPQWMPGMGSASSRDTHNTDCSFPAEGRNPTFRVGGRLGVENCATMRSWSIVSTFQLPPDPPAVREVTVPTWVSTANRSCRLLLSRVKNTLWLSADQNPKGKRMQKIPKK

SEQ ID NO: 989763 - protein, 29 aa, Homo sapiens
MGVQADPSRTRARVGLRLTRKNRRKHRVT

SEQ ID NO: 989764 - protein, 70 aa, Homo sapiens
PGIWTFFFLLSPFLFFNFRCSCFQWRLLGSYFFFFSSRAPLPFLLLLSFFSSFMETANSSVMAVRASSIP

SEQ ID NO: 989765 - protein, 49 aa, Homo sapiens
MQIFAQWFGKSRTNIRYYFELNGKSEYPRTSNGTFKNSPGQTPPFGNGR

SEQ ID NO: 989766 - protein, 38 aa, Homo sapiens
HNSRRSRVASGNTVLAMLVHAMGTWCPARQGSRHTTGT

SEQ ID NO: 989767 - protein, 35 aa, Homo sapiens
CNWAVMNWAPPACEKLGKCLTPPESIPKKCLWRGE

SEQ ID NO: 989768 - protein, 62 aa, Homo sapiens
EQEEEEDEESEEEEEEEEKVKAVTGDEEDEKVSDEKDSGTDIRLKTPSTRNEAHDSELMTSE

SEQ ID NO: 989769 - protein, 66 aa, Homo sapiens
PTSPKEEDVPVWLRKAFEGADGGDMTMLETGVDGGMLCPVPPTVEAYSGAVVASLGLSGLCRGLSG

SEQ ID NO: 989770 - protein, 58 aa, Homo sapiens
MEVEEGILSPSWGFEILNFTNISPNLTRLRKHLAFSKLKSELIQIQMPPTVGLVGGVP

SEQ ID NO: 989771 - protein, 51 aa, Homo sapiens
VSIGPRHDTAGGGSKFQFHTFCNVCVSFLGAPGGHICRLGGRVPLGGVGCS

SEQ ID NO: 989772 - protein, 42 aa, Homo sapiens
PTSSTVGPAWIWPTAPWGTLQHYMNVPCGHDWCATVPMISTC

SEQ ID NO: 989773 - protein, 38 aa, Homo sapiens
LGSSYVCEPKTKARDQVQAMNARSEEEALICGPGSWCY

SEQ ID NO: 989774 - protein, 48 aa, Homo sapiens
PTSPDSQLARQPRLARQRRHQFQTMEITHDVKAVCSQEAMTGPCRASR

SEQ ID NO: 989775 - protein, 102 aa, Homo sapiens
VTLEVPPRLALTAALSSCHGHSPGHMAGLQLYGGLNVPEWFITWSPVRDTMGNKCQCSHAPVCIRSLLFHALRSWVYSVGFTVNLHLSIICCPPVGLVGGVP

SEQ ID NO: 989776 - protein, 40 aa, Homo sapiens
DWSGQPGVTDPADSAVGVLADKDSTNFLVIPAESAVGLVG

SEQ ID NO: 989777 - protein, 31 aa, Homo sapiens
MELQKGCYSPHFSLPSWEQISGLSVAGPHEA

SEQ ID NO: 989778 - protein, 61 aa, Homo sapiens
PHLPVGLVGPTSREGWSDPYLEPKRRGIFRQIDSGSSSPFITSPQHSAQYMTGASAGGARS

SEQ ID NO: 989779 - protein, 84 aa, Homo sapiens
MTDKMLSMQPLPRCTLIIDPLAAGSHLTRIPIASWNSHTNPLIPHPLHENEVLRHQIFAAPYRDLPASLSAPSVSRSSDCRPCT

SEQ ID NO: 989780 - protein, 66 aa, Homo sapiens
HVIRMDQSQVRLCCPVTNSRFSVWFHGHVQLHQESSIEEPLSTLDFQNSCMVYFKYPQGNSHAWIA

SEQ ID NO: 989781 - protein, 44 aa, Homo sapiens
HILRERPTSPHNYQSHWGMQLFPRTVHGTDSSSRDPTEKITFIL

SEQ ID NO: 989782 - protein, 79 aa, Homo sapiens
IDEIDCHHMIVRHILVLLPGTVTVCLSSLLRPIHDQFGPYLIAPRLAALKIGRIGTSTGSDEDLKVPTTILERINRPYR

SEQ ID NO: 989783 - protein, 64 aa, Homo sapiens
MRMSQICLFYEVYSSEIFHVYLSFYCGILPRLGVLDRDLPLLGGVLERERPMRLAGVLERERTS

SEQ ID NO: 989784 - protein, 66 aa, Homo sapiens
RSVRCDQICLFFEVYQSEIFHVYTKLLLRDLPRLGVLDRGLPLVDGVLDRERPLHLTGVLERERPR

SEQ ID NO: 989785 - protein, 43 aa, Homo sapiens
TASTRIGRVLQKIGPCRIVVLKECSLHVPLSPCPVFQTALCSG

SEQ ID NO: 989786 - protein, 100 aa, Homo sapiens
PVITHVHQEALSAEQPHTCTSKLAAPVWASSGAEDKDEGPVAEQVKKSTLNPNAKEFNPTKPLLSVNKSTSTPTSPGPWSHAIPSIPLLTAGQSGLYSPQ

SEQ ID NO: 989787 - protein, 95 aa, Homo sapiens
MKCAAGYDSLVRRRFQQMDVLEGHQPARQHLMYISDTSWGCITCPGSVNKILHNAQYLEKKQGLDQRGRTWSGCGHYRVVNYERIKFLVIALKSS

SEQ ID NO: 989788 - protein, 53 aa, Homo sapiens
PPALRSLDLDDWPRELTLVLTCYWQRGGQPRVGNATREACANALAGTSLVMRE

SEQ ID NO: 989789 - protein, 38 aa, Homo sapiens
MVELTALIQIHKTALRCRPGRSHLVYEGAFASKVTIVT

SEQ ID NO: 989790 - protein, 119 aa, Homo sapiens
MTLNEPAAFKHLFNKAHLAPALNPFNPEWTQHMFQRAQGWGYGHRSTASQGRRIFLSNRTKWSLLCLLLSTQTHVNNLISLSFPHDSALFYTTNPPLSSWPVLSELLGTLTDGVADGRG

SEQ ID NO: 989791 - protein, 73 aa, Homo sapiens
SFTGLPAQYCPKDDAACTVPAPELTHTVKGAYSTSPPYSPYANAQVHLPMPMYIANAQCGLMNPPHCLRVTIA

SEQ ID NO: 989792 - protein, 73 aa, Homo sapiens
MASAEQQLQVLQEKQQQLLKLQQQKAKLEAKLHQTTAAAAAAASAVGPVHNSVPSKPVAAPGFFIHPSDVIPP

SEQ ID NO: 989793 - protein, 89 aa, Homo sapiens
QDRSKGVPQILVLMANAGAMTYRVTNSSIIDEFIPMSELHASGSNLASGAHLGGSPWLFGFADRVFWPHLLVGAMEIGAGLMTRTVPED

SEQ ID NO: 989794 - protein, 82 aa, Homo sapiens
ASSALEKEARILRLSVQTTSASVSVPDSSGPERILSISARYCKQLGRNSRRKIIPYLEKRACSMPYSALFNRAELPARNLDS

SEQ ID NO: 989795 - protein, 71 aa, Homo sapiens
LGVAERHAGGRAEVRQHLGHGVMLLFRGDLVEALFDLVVGVERFGFHLLRRTHELGGQLLDAHRVSGREQA

SEQ ID NO: 989796 - protein, 92 aa, Homo sapiens
QVLGRKNWKGTEECVQEWGEVGIMLPCVAQPTCSLTASIRGDGLSGLVWGLVGLVWGRVGLVWGLVGLVVGLSVLVCGTCRASRGTVWASLV

SEQ ID NO: 989797 - protein, 36 aa, Homo sapiens
RTPLHASLDCQQSHHTVHTLTPSSQVSPPNQNLPVG

SEQ ID NO: 989798 - protein, 60 aa, Homo sapiens
SSVPCISMRSPDLLHLVLIQARCHMSWAPPCLRTPLIVLVVVHAPPVRALCRSDVHHCLP

SEQ ID NO: 989799 - protein, 51 aa, Homo sapiens
MSYYCNFYSQTQAILPPQAPESWDRKRQHHTQLIFCIFGTDGVLPCGPGWC

SEQ ID NO: 989800 - protein, 81 aa, Homo sapiens
TCILRARKGGEKASSTSRSRRSFLRAICGYQELGMGRHYGPEMKWVDGGRPLLKMSHSSGFYSVYSGSGFTIIWSMYCQKT

SEQ ID NO: 989801 - protein, 51 aa, Homo sapiens
MSLDNAGCFNRQTWEHVGYSTVKTLKRNIAKLMHAVIIVVEQGECGITLGF

SEQ ID NO: 989802 - protein, 49 aa, Homo sapiens
AVLDEPVSSAIACKDVGIDVYYTIALHASLYKFRRHSEHCVTSKYRKLE

SEQ ID NO: 989803 - protein, 46 aa, Homo sapiens
TEWDHVDAQRMQSGADTPETRGLAWCSARVLPSSNTRPGLCGPVTG

SEQ ID NO: 989804 - protein, 79 aa, Homo sapiens
CSGIGGSSGSRAADGRSRRRSSCGNRRAVLSCRGTTGTLVSGGSLQRGPAQVQPLQYLQRGQRGHFLNMHQVLLLQGLG

SEQ ID NO: 989805 - protein, 35 aa, Homo sapiens
MFGVFHVGISELRGFGPSSVFWLEECRCHRGAEER

SEQ ID NO: 989806 - protein, 56 aa, Homo sapiens
MGDVVNEENMIPGFLDSLGQTLVLLHTDSCVLSIEDDNRVGADKILQELHVPPKFR

SEQ ID NO: 989807 - protein, 46 aa, Homo sapiens
SSSAPVSELREMFIIFSDDILQHVCALDGDLLVVLNHQVFHQLICP

SEQ ID NO: 989808 - protein, 95 aa, Homo sapiens
RDRVHSGLMAPVTGLRLCCALMLSQELTFLSRGSERRRGIQYNLNAIRAGRFPDPGRFTFSYDRALLASALNAWREQSDNSVGLPLTRVNQARLR

SEQ ID NO: 989809 - protein, 46 aa, Homo sapiens
PRTSCGGLDESLQVAERYYRKYKELLKSYQWKMLNTYLLAGAELNE

SEQ ID NO: 989810 - protein, 85 aa, Homo sapiens
LSSSSSTRWVSTPFDELLMIVVKYNNSGSPELPRSPELPRRSTNLPRKSRTCPEGPELAPNVQRLPRKFKDIAPDDPDIAPEIQE

SEQ ID NO: 989811 - protein, 68 aa, Homo sapiens
SGILDCAECLRLAFWAVSVVIAVMQLGPLSMQKHPGKLAGYISGLFTLASLCYMLFAAVVLCVNSFIW

SEQ ID NO: 989812 - protein, 35 aa, Homo sapiens
LAVVTKTGPFSFLWIEGLFFDVYRMRRLAMEICLD

SEQ ID NO: 989813 - protein, 40 aa, Homo sapiens
GPYTACTACTFKAYNSSYYSPILPVQQTDKAYTVSPRIAP

SEQ ID NO: 989814 - protein, 76 aa, Homo sapiens
LGLSEPMSLVQAWGECDLNTALKTRTGSLNASPATMADARSTVTISEPFGKLTKPKPQAESKKKKKEGKKQEKMLD

SEQ ID NO: 989815 - protein, 41 aa, Homo sapiens
KANEHTWTLCVLWYPDNNHSRHSVLLTFGAPCAQLPKCAPT

SEQ ID NO: 989816 - protein, 78 aa, Homo sapiens
MGVRVFSFSFSIVSLSSLRSSLVPTKMMGVLGPVVPHLRIPLCTDLFQLMQDSQGKSKLRTHLFADRIRGVNCHNLLV

SEQ ID NO: 989817 - protein, 58 aa, Homo sapiens
MLKSQKRKNYENQEGEVVRKALSSSSKIHCPLFAKPIFLAFLPLVVVQIVQPFPFCNP

SEQ ID NO: 989818 - protein, 36 aa, Homo sapiens
MASDYKKHTRPMVHKVALQCKLQFALPGAKPHYDEL

SEQ ID NO: 989819 - protein, 121 aa, Homo sapiens
FAFSFLTKGSQLSTPRLQQVCPPVWSLRHTPVGVVNAESSKATFPESLRRALDAPRTQGYHQTRQDEMQKEQLRTHEEDTSKAHGPEERKEDTGAKGERTGLPLISTTSAGRSLRDLGSVC

SEQ ID NO: 989820 - protein, 67 aa, Homo sapiens
TKTPGIALVCPTDHWLPSHVWSQSNCFVVGTSPSTFMYTVGTYLHKCTVNIMRGLGAHVTLGVVQGG

SEQ ID NO: 989821 - protein, 81 aa, Homo sapiens
DSGLAVLFDNSSSALAELGQDLPGSGSAGLPGGSKATSTFLLLGWFFREARAQKLTGPSSLQNIKVFLYKSPSCALEGTHA

SEQ ID NO: 989822 - protein, 144 aa, Homo sapiens
QIPLRVSCCCGRHRTGANRWDGAACLAHGGQYASKILVRSRARQLQLYMTTPSSLTWVSERQSMLAAAQVEVGLVHHPELGMQDAMGQLLHVHHADLGTALQQSLQVRLWLGPAGLAHSDTDVHALWCQGLQLPEDLLNLQGRG

SEQ ID NO: 989823 - protein, 61 aa, Homo sapiens
IRTDRQWDVSVDHMSDPLLESWTPRPLLGHIQINATNSSTPPTVLLEMPLIGTPSPTQASK

SEQ ID NO: 989824 - protein, 131 aa, Homo sapiens
VLAETARTDEVHALNDVHGSQLNTRTDILSVTQRQSINEEVAVVTPISLAVLILRNYISNEVLSPGHAWVLSGLGSSILRSSVASKYWKVVLKSTFPSKDFLSEQILLVEEQDHRDGAQPSVVPDALEEVQ

SEQ ID NO: 989825 - protein, 76 aa, Homo sapiens
MSLEARGGCLQYGSSALEALPTWGTLESNIIPALVTRKHHQEPALRDSGRAPDILNSGQGKEGWTQGRGARSRLHP

SEQ ID NO: 989826 - protein, 83 aa, Homo sapiens
TVLCGLSLCVYARGPLTSCWTCRRCATPSMPTELPPLHIVRLLHTVQLDSRRFFVITRSTSVIARSILEAFLSGRNPSSERHP

SEQ ID NO: 989827 - protein, 110 aa, Homo sapiens
LVTSVSTADTLHTYIPWTQNPLLLLVWTSSVMGNAREHSLEWLEFPCLFLIKSATTGAKDHLPSRNKNKGNNKNCALGKTGSYHSQGICGLSIKQKKVSLPPPSGGTLSK

SEQ ID NO: 989828 - protein, 83 aa, Homo sapiens
STASSISLSYSSDVYLIYSSPHNTFSSLSGNAPDVSSVATPDALLHMKHPIICWLIHFSYSNSINNSHDLRSLRFEGKVQNSP

SEQ ID NO: 989829 - protein, 73 aa, Homo sapiens
LAAEVCSLEGEGGTEESPISRPLTLIASSIQWAGEHLRQHKFRTTYLPRRTKDTHDRSRTHDKPVNKGTGLGV

SEQ ID NO: 989830 - protein, 41 aa, Homo sapiens
PSGVEHISVSSTTFGFVLCSLTLITLCTDDCSSMSRTKHRD

SEQ ID NO: 989831 - protein, 41 aa, Homo sapiens
NTGLRGILDFGAVLDYRGNSGLSGQFWTLEKDCPDSPELPR

SEQ ID NO: 989832 - protein, 58 aa, Homo sapiens
MLYYEGVNDLLYQLDPSLVHGLDYCCLWDTWLCVAGHDCVAVAYVACSPLSPEPKVPG

SEQ ID NO: 989833 - protein, 62 aa, Homo sapiens
VLVVLYMAQLPIVLLAKSTPSCQKYYTVLDILFTSQDFYLYLKHIRKTSRDLVESAQSRIAP

SEQ ID NO: 989834 - protein, 91 aa, Homo sapiens
TSVIIQHILVVVLYMAQLPLFSWPKARPSCQKYQTVLDILFTSQTSSLPENIMSKDQHEISLSSAHVQKLPRRGIRLVARTVQDTARLGHR

SEQ ID NO: 989835 - protein, 34 aa, Homo sapiens
MSLLTSDLSNDLNLVTYTYGAFTSGALTYGALTY

SEQ ID NO: 989836 - protein, 40 aa, Homo sapiens
NWLQVDRPDPQAARSSSVHLPTELLSAQWSRQAQSPFPPP

SEQ ID NO: 989837 - protein, 96 aa, Homo sapiens
TEERVLHVTHRTGGKLPRIGVPVTIISRGELSADCMLERSDKVLARVENSETSQSLKQFSNYYTTFSLTTLPAEEGAGGRRLDFDFWQVNPPPGDS

SEQ ID NO: 989838 - protein, 31 aa, Homo sapiens
MVAASSGRCGMSPRASSVVGDHSRVSVCSEL

SEQ ID NO: 989839 - protein, 90 aa, Homo sapiens
LCEPLEMLFSRIPVESAESSGRPRSVERQNADHADLACLLCRCLPRLNLIHGQLIGGLLCTDPKPGADKLKIYTWKVRIALRLGMGYVKC

SEQ ID NO: 989840 - protein, 56 aa, Homo sapiens
DSARVVLAEKVLQFDPGTKNVTALLMEAKELEARVISPFCQRGRCCQRVYRAARDA

SEQ ID NO: 989841 - protein, 99 aa, Homo sapiens
NLQQVSSYTPAPDVLHQLPLGLWEDVAPPCLTVIFDGILYDTIPTSREETCAHTPSSHLQSRTTPFRLLSRGGVLTYCNLTSWGELMKSKYSDITIMFE

SEQ ID NO: 989842 - protein, 150 aa, Homo sapiens
PYTSLCPDTRGPCVISNWYIICFSSSSMCCYASAHSGTRVFCVVPPCWCLPSFERLPSAPGTQQRPSSSTCGAPFSCDDGLKHRIMTEAIISPSLLPLAVLPVSGHRLGLVCSSGLRREDGFSLVIACSRLEVPKEAYNSCITRNRKPLP

SEQ ID NO: 989843 - protein, 108 aa, Homo sapiens
RWNSRALTARGVIMPHSSLSHLLTGFLKGWMDPHTWSDPGMVYRPLAGPSRVLGVGDLLPEHSLDVAEHQRVMGLHLAGQPAQRGTGAQLCAQLLAEVGGRARQQVAP

SEQ ID NO: 989844 - protein, 138 aa, Homo sapiens
SLAAQRMFYGRCGIARAPPDGSWRVGGCSISSSLRWTSLSQLRHANTEFWSLTPTHANTQGSVGWEREGRFSFCSLGLPRAFPAAERDTSSQVKGHSGPGPDPVVTHLGTFPDQLRLPCPPLSRKEPEPSPLSHPPQG

SEQ ID NO: 989845 - protein, 140 aa, Homo sapiens
HPAASCVVSVALLPGINLLAVVRHVLQRDLRSVRALGPMVPAPPTRWSSHQQLHWRTPRSWLAASLCQTGCWARCRCHRHFGSRWCRVSGPERNASPCWAGLAEVGWNLLSFQVNPELSEEARFSHSLLADERVRIVRLR

SEQ ID NO: 989846 - protein, 44 aa, Homo sapiens
MLSGTPLHALIVICNTPERPGSARVVSESFHCAPDPAPVLGLVW

SEQ ID NO: 989847 - protein, 35 aa, Homo sapiens
MPPILESLHASVSGTLCPRAPPGDAALSGYSGGYR

SEQ ID NO: 989848 - protein, 46 aa, Homo sapiens
KCESLDLNPGGLTPNPYDHYAPLLPQPFLSQPWTSSQPWTSGFRSS

SEQ ID NO: 989849 - protein, 58 aa, Homo sapiens
ADSPVYRGNLPVGALPMTKHRQQAKATRNLIFPRYLLRKSYSYLPYSGYHGLIVWTAS

SEQ ID NO: 989850 - protein, 47 aa, Homo sapiens
PLTLQTHMLDYILFHLGSIIGTDIIRKLCRVKGSGRAKGSRRVKGSR

SEQ ID NO: 989851 - protein, 40 aa, Homo sapiens
MSELPFTIASKRIKYLGIQLTRDVKDLFKENYKPLLNRVK

SEQ ID NO: 989852 - protein, 118 aa, Homo sapiens
MDPNAADSSTYIEKCVHAAAPSPDSGNVDILSFEESNRAMQTGVSGIMIARVALFKPWLFTEIKEQRHWDISSSVRLDILRDFTNYGCSTGARDTQGVEKTRCFLLHWLSFLCRFRCI

SEQ ID NO: 989853 - protein, 89 aa, Homo sapiens
RGAPPLLMAAQWLHSPLSGCLRCLCASVASHHRCCFLVSLRVLFAALSIKPINMQHPLLLHNGAFTRFSSTQQHQAVRGPVDLPSPLHW

SEQ ID NO: 989854 - protein, 35 aa, Homo sapiens
MQRTRHNFLYPFLRLSGTSSKLYIASTIYDPQNTS

SEQ ID NO: 989855 - protein, 141 aa, Homo sapiens
CSGLGTSPLPAPICSSRAPEEISSINSWEFCYVRHSLSNCIIDELHNIGTISSRDELQGPGELLGTFESFFGSRLCLHQFYWPPRMHGISGLNSLISVYHVLQVPIGDFPLYIKHHDACVGLVVLGGMLALEPLLACRFRC

SEQ ID NO: 989856 - protein, 40 aa, Homo sapiens
FRILSGDGNLRSGGYDAKGPELESEILNEDTLFSQPIPGY

SEQ ID NO: 989857 - protein, 66 aa, Homo sapiens
LVHGWRGSLTITVEGKEEQVMSYMYGSRQRERTCAGEPLFLKPSDLVRANRGLVLVHGWLQEGRRG

SEQ ID NO: 989858 - protein, 35 aa, Homo sapiens
GGIMGQAGFCQFIQHVNGGGVQWLTQPTVDYVGTE

SEQ ID NO: 989859 - protein, 76 aa, Homo sapiens
CHGWLSSTVGSRPWLARRPGLAPRPRVGYSSTVGYSSPVGHSSTVGSSSTVGYSSTVGSSSMVVLLSPRFGIISLT

SEQ ID NO: 989860 - protein, 36 aa, Homo sapiens
LVQVGELGDASQTVDDDWLAGELGFIDELDKAKPGT

SEQ ID NO: 989861 - protein, 135 aa, Homo sapiens
PLSVGHLAWLPPGLFAFSGWNFLNYFTEEMVEARKNLPRAIFISIPLVTFVYTFTNIAYFTAMSPQELLSSNAVAVTFGEKLLGYFSWVMPVSVALSTFGGINGYLFTYSRLCFSGAREGHLPSLLAMIHVRHCT

SEQ ID NO: 989862 - protein, 118 aa, Homo sapiens
GAGEFASPATEHTSFCFPAFVPGCVSCWHYTAYDNVVATYTPATLKNIANKFKCRLKLACATLLVLNFVLPFCRFDGDELTTDERIRSLAQRWQPSKSLRLEEQSAKAVDTDMIILPC

SEQ ID NO: 989863 - protein, 87 aa, Homo sapiens
HQRIFQVTLEYPLAVRIALTALPHYCLQRIGAPTPFPGVSQELAYFEDLILKATEPHMVLFNLYDDWLKTISSYTGLSRLILHSSRC

SEQ ID NO: 989864 - protein, 64 aa, Homo sapiens
QYGLGSGANVTTEKREVLADQWLQMAACMLPVPCGMLADNDCFIRSMLLLLQSRGWVRHLSRLA

SEQ ID NO: 989865 - protein, 60 aa, Homo sapiens
RRSRDPPSALIHLSSIYLAIYPSFYLSIIYLSIYHLSLIHLSSMAVVATRHNCTSHRTLA

SEQ ID NO: 989866 - protein, 83 aa, Homo sapiens
QCSGLGSTLALRRKKVLSTECTWQLYESGSEPRRGGPRPPTAVQRSCVDLSEQLTLLAPVAGRSNISHSPLVCPREYGYQSRG

SEQ ID NO: 989867 - protein, 39 aa, Homo sapiens
MHTGSQCSGLGMCLDIIILLKVKLKVEGRAEQTLEARVS

SEQ ID NO: 989868 - protein, 37 aa, Homo sapiens
NAADSAGEGDKRHILNAENDNTNKGIEIEEGIITQGD

SEQ ID NO: 989869 - protein, 86 aa, Homo sapiens
GSQCSDSAAVYALLIKSNDVCLELCHVDGSLISHCSVGGQSCRLEILARLEGSETQSLQNASDPKAYKLSSALVKRILSWGFRGIG

SEQ ID NO: 989870 - protein, 36 aa, Homo sapiens
AVDSDHHCAAPRNFWELLINVKRGALLAETYIIPEE

SEQ ID NO: 989871 - protein, 37 aa, Homo sapiens
MLADSALSPLDPYVKPKIVNKENQRSSSVHQVRPDMA

SEQ ID NO: 989872 - protein, 93 aa, Homo sapiens
LQRTRHTFSIDCSPHNTVKKTANEFSLFCLHASLPWILVHNARFSCYPAVTSSCVPCKAKNPQEKILFTKAEDSLLALGLKHFDGTDVSYPSY

SEQ ID NO: 989873 - protein, 81 aa, Homo sapiens
AASTSILAEYTGLWFPHVLRTGSMLGKLTSRVEASWRLSLKSFPFFSRASSNSMASEASPFLHLIPTQHRATLENCSARNP

SEQ ID NO: 989874 - protein, 92 aa, Homo sapiens
GTSLRKSTGTGSPTCPSGAMGHTHRQIDHGMGGDRDDMEIFMEGDERNQKKTEGAAVQELSAYPYSGSSLISMTHHYEFWPMSLTPGIYHEI

SEQ ID NO: 989875 - protein, 41 aa, Homo sapiens
ELISIIDPPRAGVPECRGQMSKCWGERRGWSLTCLLYKTYT

SEQ ID NO: 989876 - protein, 67 aa, Homo sapiens
MKIDAARSETRAEKKRMGIEMKSRRPWAPWAYDNEKGQVVTKDSLLKHIEELIEEPGLTCCICKEPT

SEQ ID NO: 989877 - protein, 106 aa, Homo sapiens
MGLERDVRGAEDGQCSFRLTWAMGKLGVDGPECPVRPHECEEIDVLELVAGLPEGYMFIWNGEVSPNLFEEIDKDGNGEVLLEEFSEYIHAQVASGKGKLAPGFDA

SEQ ID NO: 989878 - protein, 99 aa, Homo sapiens
TSRVIPHSGTSGRSVRGMLSHKTKRGHGRSGHVSRCLSGIPPSYDKNTRMVVPAALKVVRLKPTRKFAYLGRLAHEVGWKYQAVTATLEEKCAWGSAPG

SEQ ID NO: 989879 - protein, 95 aa, Homo sapiens
RIVTTWDDMEKIWHTASTMTLRVAPEEHAGVLSEAPSEPKANREKMTQISAEDLQQHSVMYVAIQVGAYPCTPLADPLCIVLDSGDGVPHVVPFY

SEQ ID NO: 989880 - protein, 76 aa, Homo sapiens
LDTPDLWSWSEMVTGGHEEAEEKSVVLLVCKRSVPTSAIFVEVLASMRQMGWPRSVANDDVPHTDPEMRVIVPSGE

SEQ ID NO: 989881 - protein, 149 aa, Homo sapiens
MSPRVYCNQIFINNEWHDAVRRKTFPSVNPVHLEKVICQVADGDTADVHKGSEVLPGAAYQLVSPLEPNGRYHTWACLDEPALVDLIERDLYTIWRPWRPWTNGQRYVISYLVDFGHVSSHVSGNKWRLCVDTVTTGQPIPIDGDYFRV

SEQ ID NO: 989882 - protein, 94 aa, Homo sapiens
PSESHTYDGQMKALGSVLLSIIAPLCIAFKASQRNLELLCLQWFSHNWGMSERVLCVNTEDKGLATFAWIITVTVLQTNTNWRLPIVTHDGCIA

SEQ ID NO: 989883 - protein, 177 aa, Homo sapiens
GGSGGGVAGSQTTAMSAVSLSACCTAEGQAGSGLRKDAHMCLEMKASREGCVCGHLSGCASQASEFLRSPNRHIPKWLYEDEHKNSRWGHPHPPLTMDWDPTHATFLLGRRFHIHGLGVLAWSPPAPVPTAQGPHHKWVSYSSSRNGLSNQHVNLTLCLQAESPQLFQLQPGQGHLQ

SEQ ID NO: 989884 - protein, 106 aa, Homo sapiens
PQPRKAGAPRSCVYLSWLYLDRDDVTLERISRCFLETNRKRRGSTPKKLIMLQNLRVGASAFVTSGNQSVNNWESGLQAMECAFHLKESVTYRLLELDSPGHGAGV

SEQ ID NO: 989885 - protein, 72 aa, Homo sapiens
EQIKYAMIMNTHPLWQMSHCSMEHNSLPRSVEHLGTDAELKQQMLVFSIPGAEKESYSCLIIKTDTVVTSAE

SEQ ID NO: 989886 - protein, 114 aa, Homo sapiens
TPTRKLLRSRPEQWSPCPGGLWVIQNVEVGAGIVISAKATRLFLPPRQPGRGTHAQFSGDAIPTPAGDGSPPSGRQETLRSTRFPQALTFKGPGCSTMVLGLKIAQSSSFPAGR

SEQ ID NO: 989887 - protein, 47 aa, Homo sapiens
YIYAAQTRNTERSGYGGTRRRLCRKLESNTGCRNLRISHTLSLYKKK

SEQ ID NO: 989888 - protein, 146 aa, Homo sapiens
NAHEIRFSIKVVLVYAELSTQETKTNIKSTKKETVHIIKVKTKVEKFYFKRTEHLQDISYLVPHMSLKKFTYTLYYYFPRLVKQQTINRSEKPALHMPDWLFVTHLKDTTQSMEAFNRTALPISGLLADADMYYSQQLPIDRYMGI

SEQ ID NO: 989889 - protein, 34 aa, Homo sapiens
PNSGAELSSRCDAPQLTHTEERAVRVRRLWPGFV

SEQ ID NO: 989890 - protein, 53 aa, Homo sapiens
TSSGRAGELGWVDHSPPTAPWLEVERDNAGTVTCATCECMKLHVMKHNRDGWN

SEQ ID NO: 989891 - protein, 52 aa, Homo sapiens
ITRNSSTLAFRYLFPPTVPILNQQVCAQFYCIVLALTQISTCRLSSTTPPPD

SEQ ID NO: 989892 - protein, 119 aa, Homo sapiens
AVLEDPSSGELRVGEVLGSVSRSAQATNVVPPPGTRVLVQLLQAGAELTDHSWFVVFQAQGAPGSPRGPPIAWTFSGRGSEGGQARLAEASPAEAACCCWAMSSLSEDCFSRLAPELGT

SEQ ID NO: 989893 - protein, 43 aa, Homo sapiens
PLLIRHGGMDQALFPDHGPVHRLLKATWWSPCSLGGHRYMMPE

SEQ ID NO: 989894 - protein, 72 aa, Homo sapiens
RQSDLSGAVIHRRRFSSGLVTQLRNIQDPSLPCLEFPLALGHSNKLGPRVSPFPPGPGHTHSVTSPLYLCQA

SEQ ID NO: 989895 - protein, 40 aa, Homo sapiens
MVRHSKSQDAHCKDFADKTGTDYSELWLSSLLHSRGIDNT

SEQ ID NO: 989896 - protein, 47 aa, Homo sapiens
MSPSLHSLLFCLQTQTTNALTVASINPSRLEDFNTRTPDYLAFLHDF

SEQ ID NO: 989897 - protein, 63 aa, Homo sapiens
VLEEPSRRVRTSNTHGVDIRTSPAIRTSPREASRRASLPPPAGQGLTEQEHGGPVQAMLMPRS

SEQ ID NO: 989898 - protein, 34 aa, Homo sapiens
ARYMRRLPAESRQLKAAYEARMARLDPSQDLSKP

SEQ ID NO: 989899 - protein, 69 aa, Homo sapiens
ASRQCHNNLIKAIYKEYELNAKNDGRGEVVVVEDIKEVLETEFKTLVPFKLSISRGKQSQGQVKTITEK

SEQ ID NO: 989900 - protein, 67 aa, Homo sapiens
TIGDTNSRLSLTEFNISVNISASDTLPLHSDTGTHFSTPSPTVSMSQCRKAVSIKLTSHLDTPNNNS

SEQ ID NO: 989901 - protein, 42 aa, Homo sapiens
HLWVHTEKYESERRLGSERRLLGLRGEPPELDLSKQEDLSKP

SEQ ID NO: 989902 - protein, 44 aa, Homo sapiens
ESNAVRVNTQIKDSYGNNEERKTLLSNLSKPGDLSKPGDLSKPR

SEQ ID NO: 989903 - protein, 41 aa, Homo sapiens
LGLLSKALLSNYYVLAQDSTRGQRKVHPVFMNTSSMLDSVA

SEQ ID NO: 989904 - protein, 43 aa, Homo sapiens
TSSHPDGPAEEDTCMAFRSICSRSEAVHPGPAWTQHPPETSPQ

SEQ ID NO: 989905 - protein, 49 aa, Homo sapiens
LCLLLVPLEGHTALEWASIPTPGIPPFASWGTHTKHPPLLKETVPIDLL

SEQ ID NO: 989906 - protein, 157 aa, Homo sapiens
TLTLDNVSVEKLLEMDDLGHAEVSINYHSNLLPRIHGLSRRCPGTSYVELVMSVHDYAELCTRLLWQMPSLLPSGTLDGDPNTLARATFKCELVVLHSIIFIQRVKVDELRPEDGGGWHTGPTHCAKDVVRYGDVDMLVKPSVCCWNQDMELAEADI

SEQ ID NO: 989907 - protein, 78 aa, Homo sapiens
MLDDDCYTQPGWLHPVIRQAPLMPFKTTVPCPRPLKETVSPRLPIRMSLTTSFRPIPESPCSGLRLQLWLQHRCKGPC

SEQ ID NO: 989908 - protein, 39 aa, Homo sapiens
TDKHRCLDEFYTAGNSEEEGCVDKIYNQTHRPKTSQETT

SEQ ID NO: 989909 - protein, 44 aa, Homo sapiens
QEQCVATSRNPGSGTVTTIKMSIAQCTSSHPNHPPDPPATETSQ

SEQ ID NO: 989910 - protein, 41 aa, Homo sapiens
EEYLKAGCLLKKEVKVGSEFLQAVQESSVGSASRGDLSNPG

SEQ ID NO: 989911 - protein, 54 aa, Homo sapiens
MVHDTEDRSLSGSSQSRAAAEAIQKLPPLPGTETDKMPALVVPDIKEIRVSPTR

SEQ ID NO: 989912 - protein, 41 aa, Homo sapiens
IRAAKAIDFEVSDDGSPMDACLNQVEKHFNAGRCKDYSSNY

SEQ ID NO: 989913 - protein, 58 aa, Homo sapiens
EDPCLLRALRVAVAGFAAELALRLRARSDNRSESDHEAVLSFVQDCNPATTTPQALTY

SEQ ID NO: 989914 - protein, 81 aa, Homo sapiens
PTREDSRSLNAFDPTLPDDDAFLEQGEPPSEARRALLPSCQSYHGGDLPGSSTRPDKGVCGMNYVDHCKEQRPVPKEPIIS

SEQ ID NO: 989915 - protein, 67 aa, Homo sapiens
HCVCAREEERRSLGSGRLAWIQCLSRSVSSASSLAAAAAVVVPALELGPSQAGAEENDWVRLPSKAK

SEQ ID NO: 989916 - protein, 40 aa, Homo sapiens
FISYQSVVVSSFMWEIDQNNSLTLVEYPKNKGSHPPFLCI

SEQ ID NO: 989917 - protein, 67 aa, Homo sapiens
KVFHRGPQQSSYHLSLTPESLFRTVVFPTHLHSPDSTSMRLLTVTAAERGLSKFLANSRSLIYMAMA

SEQ ID NO: 989918 - protein, 74 aa, Homo sapiens
ICRTGAALSSGEGAAAGGHRAKSCRAVRAGPQEPLEIISGSALSLAWRCWTKGTAFAHPVGLQSHFSQQLPLPQ

SEQ ID NO: 989919 - protein, 40 aa, Homo sapiens
MVGGVAAGASSSVFLSLQAASFPEVTLGHLLSGCWETRAQ

SEQ ID NO: 989920 - protein, 70 aa, Homo sapiens
VIECHHLAKRGLVVFIDATTDQHGSLDVLRFQTWAGSPSLGNLVCFACLSVWSVANFAAGLHLVLRPMEV

SEQ ID NO: 989921 - protein, 50 aa, Homo sapiens
MSGRGDATSVYRVRQPSGLRIEDADLPGPRCATMAPETALIQVHYLLFIY

SEQ ID NO: 989922 - protein, 116 aa, Homo sapiens
KSSCFWGLLPRVPRVLTCRGQELTSLVPVTPACLTPVIPGHLRPKRWSGDCVWSLWSLPVCVRICGQGTGRWLGPRLARPSLTVLVTWPRALPQVSSVQGPPRPRQLVPVLFSVSD

SEQ ID NO: 989923 - protein, 187 aa, Homo sapiens
VCKNTRQAMSDDTVTGCLLHTARSDYQMNMENAKALRDAGGIREVGRNLQKQRRYTLSKSGQRLHLRSSTACDSTRDLRSLYKKDAWSQYHFVASYSTIERDRQRPYSSSRTPSISPVRVSPNNRSAVPQLHLGNMISLKELENRLRVHRQQSQPTMELKGEHTSRTDAMTAQQHWNFNLSRNSYGA

SEQ ID NO: 989924 - protein, 33 aa, Homo sapiens
TRCYDSRQLSKLEERRKIIQFWPGTLAHTCNPN

SEQ ID NO: 989925 - protein, 57 aa, Homo sapiens
YGTQLSHSFQYVYGCLTRTAKLNRYDRNSMADNTSWTITDILFITDLSSELFIYLST

SEQ ID NO: 989926 - protein, 108 aa, Homo sapiens
DSYKQERPITPPLLSDGGSHEGDRGPHGLLSDGGSHEGDRGPHRYSPTSAHTRETEDPTATLRRRLTRGRPRTPPLLSEVGSHEGDRGPHRYSPMLAHTRETEDPTAT

SEQ ID NO: 989927 - protein, 55 aa, Homo sapiens
IDNDRVVCAVALRWEHGVDVRHKELIGKYAMRDYVTGFQETHSTTLQTRACRMHP

SEQ ID NO: 989928 - protein, 61 aa, Homo sapiens
SLVYNHREGRKGLLLLPHASISPVRVSPNNRSASAPASPRDMISLKERKTDYECTGSNANY

SEQ ID NO: 989929 - protein, 69 aa, Homo sapiens
MHGVYRSQPWTSGVYRYTGVYRCHRRARWRVPVVPATREAEAGGSLEIQEFWAVVRYADRVSALSGIDK

SEQ ID NO: 989930 - protein, 34 aa, Homo sapiens
QRNYYSLSLQDQGGWQLFPKSDSKALDLLDRMLT

SEQ ID NO: 989931 - protein, 47 aa, Homo sapiens
CQRREIFHVSQDSHYSADVGFDAQCGVLETCVHGEVNGVGGLSAVVL

SEQ ID NO: 989932 - protein, 97 aa, Homo sapiens
VKHIGSCMLMGLMERAANEDPQAARSNSDGEKAPTVQDIKNNLKEAIETIVGAMSILVPADGAGQSRQKQFRVDYILSAMNVPEFDFPPEFYEHAKG

SEQ ID NO: 989933 - protein, 61 aa, Homo sapiens
AQVERRKSDEVPGIGQSEREQLRGAEVVKHGNISVEKVGGGGDSAISIALIWRYQIPDVDI

SEQ ID NO: 989934 - protein, 52 aa, Homo sapiens
YVCAVALAGVMSDVRHKELIWQIRHARLVHRLPGGNNSNNTASKCMSDAPVT

SEQ ID NO: 989935 - protein, 69 aa, Homo sapiens
ATSGHRLFRLFSDVLPLVLPSYQSLWLHADCGSVFAALSIKPVNMLAPLLLHMVLYQILQHPVTAGGAL

SEQ ID NO: 989936 - protein, 76 aa, Homo sapiens
SDAPGMVIQDAEGIIFPERLSVHLQDKEMPVNNKMISRDSLGDIFVALTYMVRATKNSDFLCCLPSRLKNIIHGDH

SEQ ID NO: 989937 - protein, 70 aa, Homo sapiens
GDGTRSPMLGRSFTRARNYYAMGSHTKFVAVPTTRGATRQRKAGGSPLQSLHDIDVLNSRTQVFLVLFSK

SEQ ID NO: 989938 - protein, 42 aa, Homo sapiens
KAFAQTWEDLCLTGNVSSTAGHGCLVSGLKLSLYGQTKRRQG

SEQ ID NO: 989939 - protein, 36 aa, Homo sapiens
MKYVMLIWQILPCETYVLQASMDENNMQQHLKQRAC

SEQ ID NO: 989940 - protein, 80 aa, Homo sapiens
EATQLCEKRLTVVLCVVSERGGLGTMWAQFPLRESLSQNRGPLHGGRCPGLAVATVCVDLSPEHARVTQGVAAWGGLLSP

SEQ ID NO: 989941 - protein, 48 aa, Homo sapiens
IRSLSLRRVARRGSALITVTPLVRVPLRLQLWSASPPSTLSTRHAWTS

SEQ ID NO: 989942 - protein, 67 aa, Homo sapiens
MTGAWELLEQISCGLPSAVHISRSVSRCQGALPGCEVTPQFWCQRHDARIVCLPSSRLALGVPYAQY

SEQ ID NO: 989943 - protein, 72 aa, Homo sapiens
MSSAYPELSRVLRALLPWMSQGVLTYSGSISGGFKPLLSLRSWSDAYLLVGRVIRLHAESAALGIELDLVVV

SEQ ID NO: 989944 - protein, 45 aa, Homo sapiens
FIDAIKNNFCQTLGKVSGVGWAKFLIKIVQTGFLQAVTSAETEMS

SEQ ID NO: 989945 - protein, 54 aa, Homo sapiens
MASHRKQGLPGDLVMEMSSRWPLDVTVALHGGPRAASMNQPRFQTISPQQLSVH

SEQ ID NO: 989946 - protein, 72 aa, Homo sapiens
DVTIDRLSAVCQRHLWAHVLGVYTARDFIVSVHVLVYSNQTSMVRVPEQTYRPVEQSRGLRNNTTRLQPSDL

SEQ ID NO: 989947 - protein, 63 aa, Homo sapiens
MEQCLATFCLDCGKASGLRFARLLGRSMHLKILELEPLFNTVAPFAPLRNSFCPLPSGAVSAA

SEQ ID NO: 989948 - protein, 101 aa, Homo sapiens
VYRRHSTVPLSRDGMWHLQFLSDRLNQGLTLVFHFVFNISMNYQDTAFYREAPFSRSSWPFGTHSSKPKKVSTGSTHKANNGFLRKSRVSRRQPTSDVSFS

SEQ ID NO: 989949 - protein, 56 aa, Homo sapiens
WSVPLCGVWFGNEVVHKLLWWPPCSATVTVRGHLLDISITKSPVKTLFPCEAIAQP

SEQ ID NO: 989950 - protein, 68 aa, Homo sapiens
RYIIALSEDPDWLSAPTSKAKTDSINILADVLPDEMPTTVEQSMKLGVDVNPPRRGHCSGHFCRVRCI

SEQ ID NO: 989951 - protein, 32 aa, Homo sapiens
MIATHTSEDEEEKGQQGPGGLGEREEKVASIN

SEQ ID NO: 989952 - protein, 51 aa, Homo sapiens
GLSDVRDVWLSTNVALEPSRLAIQCVLAGVGPVDALSDIVQRQAIGPCDLG

SEQ ID NO: 989953 - protein, 71 aa, Homo sapiens
YSHGHHLYIIISFNSHVGITAWDGTAPPAPSHSECMSCNSLQQLCLNPSGRQPLYSSPLNIHSACVFIYGH

SEQ ID NO: 989954 - protein, 44 aa, Homo sapiens
DCPEAFHRRNAWSLGMPQLQTPATPLNDYEVMTVTLQLHMAVEL

SEQ ID NO: 989955 - protein, 35 aa, Homo sapiens
LDSGPVMLLRVSRRSLEPVLLCAVLSECGATASVC

SEQ ID NO: 989956 - protein, 103 aa, Homo sapiens
IQRRVLTPGTHCLTKKHNRKAFWALSKQNSADTWVEAGTNMYLQTTGVWGPYYPRSRSFCRKKGRGLVRLWARPGATNPITGTESPRGEEKKADPARPVGGVW

SEQ ID NO: 989957 - protein, 55 aa, Homo sapiens
NRCTGVIDATGVIDATGVIDASGVYRCHWCNRCQLVFIDATRLLAVDHSARGIDK

SEQ ID NO: 989958 - protein, 74 aa, Homo sapiens
MLEYLERAQTIFKVVTGTARGSSGDGTNTNGQPWIPYFFTIVLIQSEEEIDVDVESTEFSHGEVRHISTTSISD

SEQ ID NO: 989959 - protein, 114 aa, Homo sapiens
ICTHAQSSFAYSFKDVYGGPTLCQVVLSAGAITLSSLFFFETESCSVAQAELQWGHLSSLQPSPSGFKQFSCLILPSSWDYRLLPLCLVILVFLVEMGFHHVDRLFDLTSGDPP

SEQ ID NO: 989960 - protein, 154 aa, Homo sapiens
WRSRGPCIYSMAHLTHLLNYILCNILYSKSVNISVSLSSVSRSSKLIEPKEGVVVTPNLKAVSEKFQKPGLATGGDEGSLGPEPSHCGIRGYLQVDSVGTEWEDTSWCPLLAMWGKPPHVFIEGFLGVDDGCCGVKAEEKPSLRVFWKQPPFYK

SEQ ID NO: 989961 - protein, 66 aa, Homo sapiens
GPAQRRYHLAYKAYSPVPPLGRCAPHAGPQLSLVGLLLCCIRGAVFRFLLLLIAASSSIDLPSPLH

SEQ ID NO: 989962 - protein, 50 aa, Homo sapiens
ASTDVDEMIQEADIDEMQVIIKLSDMTESEGPRAAGDAVLLISLFSRAHS

SEQ ID NO: 989963 - protein, 39 aa, Homo sapiens
NLYLLEANDYRRQLQSLTCDLESLRGTNESLERQMREQE

SEQ ID NO: 989964 - protein, 56 aa, Homo sapiens
NLLIAQDEINELQFSLAEELVSSREADRRSRGLAGPAHCLSRANVIIMMQKPRVSG

SEQ ID NO: 989965 - protein, 41 aa, Homo sapiens
CCSYIADACHHRPCAVRLIIPLCHPVMRVLGTGGTRESDQE

SEQ ID NO: 989966 - protein, 44 aa, Homo sapiens
RSSSLPAARFSFSSSSSLVLILEPPLLHDAEVIQQQKRKEVRLG

SEQ ID NO: 989967 - protein, 33 aa, Homo sapiens
MPMWCQRLLHSIGNRRLVHGHRLDVDESTNELV

SEQ ID NO: 989968 - protein, 39 aa, Homo sapiens
PVRVCATNSEQASGRLRCLRHPPAYDKKKRMVVPAALQG

SEQ ID NO: 989969 - protein, 36 aa, Homo sapiens
CGALVCVCVCVGKGIVAVQWVMLSPLMDASRLLTCI

SEQ ID NO: 989970 - protein, 112 aa, Homo sapiens
SLLIADTTDLKTKTAPLQQWGKAASAAGIRGDHTQLSPAAGDRERPQAELHLKKRVLGFHAAEKSFKKAPKGMELSSTKDLSPPFSYFAVNLKRREIFSGEQDILSTSLGRS

SEQ ID NO: 989971 - protein, 86 aa, Homo sapiens
NERELGLGRVQMIEGPVLAEPGLTSTWLRPCGHPSCTSSPVAISALCIPLACVTLFSLSLCHSTGGLASPDARHFQVHPRQVQRDP

SEQ ID NO: 989972 - protein, 39 aa, Homo sapiens
DSSRRAPAWMRTLHTTASTGCHLIPQTLSPPQAHRVMNI

SEQ ID NO: 989973 - protein, 34 aa, Homo sapiens
GIYPPFYFYAFVSLVLLCVLMCLFISVLLCESAA

SEQ ID NO: 989974 - protein, 64 aa, Homo sapiens
REAKEKKEGEGREGEGEEEELVQQIEYHNEIMKQLGNHVRKEEEEGEEEGRGRRRKKREDKEKK

SEQ ID NO: 989975 - protein, 39 aa, Homo sapiens
VRTSAHFCVEKLQNFLPVVKVNPLGGAVALGHPLGCTGG

SEQ ID NO: 989976 - protein, 58 aa, Homo sapiens
PGVYRMPAEGTATPFSGIYLNNKEAGMYHCVCCDSPLFSSEKKYGSGYGVASINTGYR

SEQ ID NO: 989977 - protein, 35 aa, Homo sapiens
YQTPGLITWGKGRPYRLLVECLMEEDDTLPEVRLG

SEQ ID NO: 989978 - protein, 43 aa, Homo sapiens
MRAMFEELNADLFRGTWSRWRRRCVMPMLDEGQIQEIVLVGGS

SEQ ID NO: 989979 - protein, 45 aa, Homo sapiens
VTIQDLYRLALTGYPPLSSDITKWLSERHALSWYLVRAMETMNDG

SEQ ID NO: 989980 - protein, 135 aa, Homo sapiens
DVPVASPAVPGPYLKAEPIVSEEELGHTMQLVDDVQASGGVGERLQKGLERRARKTENWLSECWLNERLPPVPASLWSSTRCPCRDCTQAGLLWTCRFGSDLLPNSLRVCWLSKVIDLTTIPCPVMTLGEKATVH

SEQ ID NO: 989981 - protein, 79 aa, Homo sapiens
IPYRLARQPLLLVSFVSKLLSSYKPTQVPVVFVTPVSQVYTFPGRSEEVDMKQECDAQARYQSMIRRMLVFPTCRASRV

SEQ ID NO: 989982 - protein, 34 aa, Homo sapiens
YRVRSRRRHMLNPSYKTQISGVRQHCIQHCELGR

SEQ ID NO: 989983 - protein, 52 aa, Homo sapiens
LCVSTDSPSELAICSSHKIPTPVPKSIPISETPNIPPVSVQASRGLVAKRGL

SEQ ID NO: 989984 - protein, 50 aa, Homo sapiens
MARLLPAGCSAGGECRSHWMLLACAAPAELSTVVGVQVRRLPCRLVGLVW

SEQ ID NO: 989985 - protein, 42 aa, Homo sapiens
TCIHSAVHLLTMSCRHSDTVLTPNIVSWSWTSLEDRRVPEST

SEQ ID NO: 989986 - protein, 49 aa, Homo sapiens
MFSEVSAKYIKMASINTGVYRCHQDTKRAERQTQKEGDSGAGWTCGIDK

SEQ ID NO: 989987 - protein, 92 aa, Homo sapiens
LSYPTSRQETRRTVLRNRPAGGGGDSLAALWHPQEQQPSISGERGHTTVRVVAQLGAGDSLAALWHPQEQQPSISGERGHTSCGARSGGVPE

SEQ ID NO: 989988 - protein, 66 aa, Homo sapiens
MPTICGYPPGDSPCQARGPVPHDQLCSQHEAVLCQFFSRSVLSPRTVWASTGTCRGYVRGGYLRLE

SEQ ID NO: 989989 - protein, 86 aa, Homo sapiens
PRLADRWMQLELVGLAREDKENESTCVADPCRCHITQMSVFMPNKIVFQGLTSDPTPCLPLALGPMSFSLYPPFPRLLPGFYLAKV

SEQ ID NO: 989990 - protein, 38 aa, Homo sapiens
TGSSRLADRAEGSEAGRMHWAVGTEDKSLYHLTVGLVG

SEQ ID NO: 989991 - protein, 30 aa, Homo sapiens
MRQEDHGAVGPEEKLGSEVGADAVGLVGGV

SEQ ID NO: 989992 - protein, 60 aa, Homo sapiens
NRKCMPTSWSRECVMVNRSMEIRALLLPGLLQSMQTCSWGHFSLSSGVRVWGGIDKHRVA

SEQ ID NO: 989993 - protein, 62 aa, Homo sapiens
MPDRDRYGVPPEFPTGFCPCPWHSSPSFWVLTRALVLHLPGAAGLRWAWWCALVRTVWASSG

SEQ ID NO: 989994 - protein, 37 aa, Homo sapiens
GKSRRCVPCALLTSQNAATHAAHLPGVSPDSLVAFQH

SEQ ID NO: 989995 - protein, 34 aa, Homo sapiens
MIARQQDMLYSEQAGTFGQQLESTDWVGLYVHKV

SEQ ID NO: 989996 - protein, 83 aa, Homo sapiens
SPVGYYVTVGYSSTVGSSSRVGSSSPVGSSSTVGSSSTVGSSSTVGSSSTVGSSSHGWLIIHGRFQFHSQRHIVSHTWHSGSP

SEQ ID NO: 989997 - protein, 81 aa, Homo sapiens
PDPSRLARQPWLVVISVAALPETGGANSLWAIDGASARSLAPGSTICMFDVLWSYDMVDRELRPVSVVRTHLSGYSGGYRA

SEQ ID NO: 989998 - protein, 41 aa, Homo sapiens
ELGTDALSVGQAEGQVVSVSGAPVVKNLSWKSSSMMLDCAA

SEQ ID NO: 989999 - protein, 125 aa, Homo sapiens
MSSVPTLSLWGTLAQILPFPWSLQSADQEIHKVSMPPGPWVSSYQTGQPVWADTGLAAGVFFPYPSVWTGSAMEPGTFSKPGCARARLWGLRVGSAWAGGCVMVRVVLFDLMSLQSSLGPPTERA

SEQ ID NO: 990000 - protein, 97 aa, Homo sapiens
MAFVALSLHQAPRGKILTVLGLLVASELELEAWHLSASKGKCFIAVYINGMDCGALKKFYFVTCMYHGMHISFFFSFYKKRCLRRSDECYILRWNGL

SEQ ID NO: 990001 - protein, 76 aa, Homo sapiens
SGRIFRLIRRNHSSSYFSYVSQSLLLPLLKESRAQTQELASWIPHGGGYAVRISNTYADVSVTLKFSIRYPTMASE

SEQ ID NO: 990002 - protein, 40 aa, Homo sapiens
AIISVDLFSMDKTQYLRIEVDQCNDTCHYGNVTDDPGGMV

SEQ ID NO: 990003 - protein, 69 aa, Homo sapiens
PQVSELPSDFRSASLHMEKQAAACIPALHPAYADSVPTCVIAKVLEKPDPASLSSRLPVGLAALQQLGR

SEQ ID NO: 990004 - protein, 35 aa, Homo sapiens
LPSVMCQHGMDPELIMQVVNADVLHHMWAITLNNL

SEQ ID NO: 990005 - protein, 93 aa, Homo sapiens
QVTLRSYLQRCLSEAIREFASALPHCTRCFMGFAFMRAHSVFAYIFSVWWSLTSEEKFGLPLQHMYWNYGFMGRAFFGQGDGIRIKFPKFVHT

SEQ ID NO: 990006 - protein, 76 aa, Homo sapiens
EALNGQMELKTMAREPCEACKIFNSRFDQVEERVSVIEDQINEIKEKFREKRVRRNEQSLQEIWDYMGHSTRGTEL

SEQ ID NO: 990007 - protein, 84 aa, Homo sapiens
GADTGNDGNHSRGGGGDDAKGTGGRAALEAGVEKEPQMASLAGASKPDPQPPSLLISQTLSQAAQVPLPCSSPPRCLFATHTST

SEQ ID NO: 990008 - protein, 66 aa, Homo sapiens
SSRRVLSSNGSTDYDRGQLKIEEEGKRDSRIWEACKQSTPCRKGCRLSLVWEPGKKGSGDRITLLL

SEQ ID NO: 990009 - protein, 36 aa, Homo sapiens
RVDKTIQIFQVIIQSVFSVQATLKRTLDDKSDNDSY

SEQ ID NO: 990010 - protein, 101 aa, Homo sapiens
MDRKNKSIFPEPVSLGPSVSLTIQTLYYDTDPFLFYVMTEYDCNGFHIVGYFSKEKESTEAYNVACILALPPLQRRGYGKLLIEFSYELSQVEGTTGTPEK

SEQ ID NO: 990011 - protein, 145 aa, Homo sapiens
MLKQTLSRSWHDVQVSSAYVRTSEKLGEWNEKVTQVIPLQEDSGNSIQQAGQNDFGLPCHTVGSAISRKLGDMRAHPFSHSFNSYSIRHSISMPAMRNSADDFKSFEDRVGTIKSKVVGDRENGSDDLPSSVGSGDKPLSDCGTY

SEQ ID NO: 990012 - protein, 34 aa, Homo sapiens
MNPVLHGVNEKSIQKRQRMGAVIIWSTAPEYSEQ

SEQ ID NO: 990013 - protein, 158 aa, Homo sapiens
EDRICTELCWELETQNLYGDVWDGREIIAKKRGQVVYLWQVGLQVSTVFSFVMVMNAYQGFKLTHPGWMAVELAAIRPGVLVSCHSNYCFYELPGSTHSSNDDLALIYQSRICDVATISRQVCRMSHRNTVAQGVRAGGEMSARVTPDSKGERGDQLG

SEQ ID NO: 990014 - protein, 92 aa, Homo sapiens
LHLCIEGMRLTKQEGPLSDTHKLLMTWIEEQTQVHTVLCTSQHHDDPKAKSVFEVLKEKAGPGCDVGLTASSGWCKQFKNRYSLHNGKVVSL

SEQ ID NO: 990015 - protein, 75 aa, Homo sapiens
VHGWLAQWKPRSSSNLYGWVMVVLGKTTFVKRHWTGELGEEVCSHLWVLRFIPVVFHTNRRTYEVQGMGLAKRGL

SEQ ID NO: 990016 - protein, 35 aa, Homo sapiens
RSSPIILMSRTTTRHSFIQDLTSFLGLPLLYSLLL

SEQ ID NO: 990017 - protein, 36 aa, Homo sapiens
SISLRHRCSCPLFYHPVYGLVNSIPALRGLVAKRGL

SEQ ID NO: 990018 - protein, 80 aa, Homo sapiens
DLEDFPTSRQAFIPSSSLQPSCVITPPPSSLPSIHLPTHPSSHPASQPAFHSIHPALTINPTIAEGPSPTSEGRLSGYSG

SEQ ID NO: 990019 - protein, 81 aa, Homo sapiens
GAYGSYRLADWCLALRTLALLLSTMSSLRSSTCDGAARCRLRAEGLLALGSLRLLSLAGLPLFTTTVLSGYVGDPCLGLVE

SEQ ID NO: 990020 - protein, 45 aa, Homo sapiens
AHRKQTAMLVYQLSITYKVNVMQCKCYLKAITSVFASSPQAGDKN

SEQ ID NO: 990021 - protein, 90 aa, Homo sapiens
QQTPVQLRIGSYNGTAGGLPPAIINGRPFLPQKDRRQLMFGSDKLVPMSYTGSHAWYKELATGTKPTMGQYGEVQCTRQGHHTVYHLATA

SEQ ID NO: 990022 - protein, 125 aa, Homo sapiens
DCVLTVLYSCWVHMSVMVALVPRRCAVIIHDSYVPSVRLTIIREACDCPEYGRWFRLSHLVAASSLMTSVAFYLSSTEESLTHMSLRGMCDLTVDLSYHTERRAWRGEVVVSRDRSIALHPVRQE

SEQ ID NO: 990023 - protein, 111 aa, Homo sapiens
MVLALLCRLLSSYPAPCCEYLSSWHSSRVRGTGPTHLKFLGYAISVSLGASSPALTCSLGWPWRAMAVVTYSMSYAHDPVCMCVLCVCVCVCVSLAHSVSGVKSAPSLQVH

SEQ ID NO: 990024 - protein, 114 aa, Homo sapiens
MIGPEGTDNCHKFVDNSWLRTIFPLFMKSPRKLTKVGTTEKEHEEHVCSILASLLRNLIGQQRTRLLNKFTETDSEKVARLMELHIKYLDTMPVADKNIAGEKPDMVRRGEIID

SEQ ID NO: 990025 - protein, 48 aa, Homo sapiens
HSSFERWVKIHSCILQDHFAESSRLSIQGKLQFKPFQKKIPSSHDSHQ

SEQ ID NO: 990026 - protein, 42 aa, Homo sapiens
QDKRQQSSFTQSVRLSLFVSVYYYNYHVSSTWQVLSKTVLNG

SEQ ID NO: 990027 - protein, 48 aa, Homo sapiens
IPFQRIASDRRSDSPNSYFLDHPRGAYRKRFWDDRMKPGQQEVRGNGM

SEQ ID NO: 990028 - protein, 31 aa, Homo sapiens
MSFSDFRRHYSRREICNLTPDTLTSDTLEWN

SEQ ID NO: 990029 - protein, 40 aa, Homo sapiens
IPFAYNAVRSYIQFHSSVDRSNPGRFLSTSNSSRYAGMEW

SEQ ID NO: 990030 - protein, 227 aa, Homo sapiens
QFHCQTYNNYLILDKPEKNKQGGKDSLFNKWCWENGLAICRKLKRDPFLTPYTKINSRWIKDLNVRPKTIKTLEENLGITIQDIGVGKDFMSKTPKAMATKDKIDKWDLIKLKSFCTAKETTIRVNRQPTKGEKIFATYSSDKGLISRIYNELKQIYKKKTNNPIKKGAKDMNRHFSKEDFMQPKNTEKMLTSLAIRECNQNTRDIISHSRRRHQSGTGDVNDGYEP

SEQ ID NO: 990031 - protein, 146 aa, Homo sapiens
MPAYRTLNVSTSGSYVNLHYSWFVLKVLDLSYDNSIPYFHHHYSFKNLPSFQFQGVGGKACDIGVLKISQWSVRYEVDPDFNNSFFYFLIFNGVEIIWACTGSVVIIIFEWSVLKRENRHKVFCMGSILFPGNDVFNKFSFKLSTT

SEQ ID NO: 990032 - protein, 39 aa, Homo sapiens
QVPGHASSVATGWIVRADYVDKSQGSTTIAHHHSSGSPN

SEQ ID NO: 990033 - protein, 71 aa, Homo sapiens
MELNTFKCRWCRIAVTQFRRKISRELCATRATNIQNDRSMNWICVFRMRWVPKIRPPFEVAFLTTGKSMTR

SEQ ID NO: 990034 - protein, 34 aa, Homo sapiens
SRGYQTVVIHSDVPEEGPMTCKASATHPRPGGIG

SEQ ID NO: 990035 - protein, 117 aa, Homo sapiens
GTAEGLRAGTITSPIFISVKYMCGTCRFVAWYACAIVVSCTYQPVIYGFKPCMTKTPKAIATKARIDEWDLMKLKSFCTAKDTSIRVNPQPTEWEKIFTIYPSDKGLISRIAPKSRI

SEQ ID NO: 990036 - protein, 34 aa, Homo sapiens
GVIAYDRSIKELEAIEGLGDIIRSEELISDFGVE

SEQ ID NO: 990037 - protein, 71 aa, Homo sapiens
ELQSMRTEAPMEGRCAVHCSWRGGGAGIDLQQTGLSVPAHPVSARCRELNPYASYCAVKLVTAVLMRCEAQ

SEQ ID NO: 990038 - protein, 38 aa, Homo sapiens
GSELEPEEENPMLGFRGASRYIADDFAECFRMECEALK

SEQ ID NO: 990039 - protein, 122 aa, Homo sapiens
MVKAAEECKPTPEDQKAFEDYKCAKSVDSPGDKPLVTCDRERTMKYLESPVAITGTQVVSADSGIPQGQLSYVVNLKFNSIGTTSFSDATTYLCSKIEPTESVCGRPRLVSYLFPAAQRAGD

SEQ ID NO: 990040 - protein, 43 aa, Homo sapiens
RRYDYTRLKPKLTQEFLNTVNPTGAYTVDGKDKTWNRVTPGSP

SEQ ID NO: 990041 - protein, 37 aa, Homo sapiens
ILQVNTTDSQISLEHYKIWKMQPQVMQHAPELQLAPE

SEQ ID NO: 990042 - protein, 53 aa, Homo sapiens
SSYLARLAVIRTDRIAYCSAQTARPVVALHCLCVFRCQVVDADDYHNDSTIRT

SEQ ID NO: 990043 - protein, 122 aa, Homo sapiens
GPTSRAFSAYKWLYCQSLPRSSITVMRHQAGLNIVFLVEMLFHHVGQAGLKLLTSSDLPASASQRAGITGVSQCTRRNLGIFIDSTSVSDSSRTPPASTSRGCRQTRARARSLRSSPPVGWT

SEQ ID NO: 990044 - protein, 47 aa, Homo sapiens
EVDLEDPKLSGELRWALKSEFLVRENLQVLHVISRSNQRGRFLRILP

SEQ ID NO: 990045 - protein, 33 aa, Homo sapiens
GDLEDPNSVCELLAPVACVCGSLLVPYSGGCCF

SEQ ID NO: 990046 - protein, 42 aa, Homo sapiens
ICISRGILTQILRFPVCLQGFRITLHACGGDLQRGTHRSLAL

SEQ ID NO: 990047 - protein, 39 aa, Homo sapiens
IHSSEQLASICPLLCRRFYTPSIFYHMKTQLASLNQNLD

SEQ ID NO: 990048 - protein, 50 aa, Homo sapiens
PFSLEHRNSSASTWVVLTPAHEDGDRAGTSGICCWSWLRKHQVHFLLGTL

SEQ ID NO: 990049 - protein, 73 aa, Homo sapiens
WLRRNVKKAEGERCVTSGERILVIVLVVDMCSPLSQLQGRSRFVARDGFDEMKLVLFEDPVHALVDDGHVGQI

SEQ ID NO: 990050 - protein, 41 aa, Homo sapiens
KLRSELQEEGEDIDMSMVNVEGSKNILLRTQRVGVVNPFSN

SEQ ID NO: 990051 - protein, 90 aa, Homo sapiens
RLIRCSYGSTNIQCAVVAAVGPVEDPSAERMGTGGVEQNGACRVTVQSLSLLPYGIVRPRWLLASRPLGLLGPPLHPGTVEGSEAWSDCS

SEQ ID NO: 990052 - protein, 57 aa, Homo sapiens
VVACRARRLGHEVAGRGHERVAATSWSLVEEDIVCLGLHLILYTGNTLLSSKYFHLP

SEQ ID NO: 990053 - protein, 38 aa, Homo sapiens
PTQVRAALCLQSYLRGFWPEIGIARYSVSTKQSSFSSS

SEQ ID NO: 990054 - protein, 43 aa, Homo sapiens
RLSYLLFDYLMIIRNKLCIHAAREAPTAACNTSAMGNNNDDQG

SEQ ID NO: 990055 - protein, 53 aa, Homo sapiens
RIQLRCSCNSGASCNSRAELLTQCRAANSGPELLTQVRAATQCAALQLMVRAV

SEQ ID NO: 990056 - protein, 49 aa, Homo sapiens
SLQCAQLLTQCGELLNSVCELHPDAGVLLLLVGGVSEGLCGPPPEVGGR

SEQ ID NO: 990057 - protein, 178 aa, Homo sapiens
MHGGTAMYAAWRIGSRPSAQMHQDLPSWLAQRPVDEVVSRLEHLDAHVKGWRVVGLNTQVADAQPLIGLGRASPPAVGGIEDVRDAQAAKLPAVVSHVLVSEIEAWPDLVGMVTGCLACVEEPLQLEDIEEKDVERLASPPGSLEFEQETLSYSEEKRAIKVIEAQSQLPGHILEVEK

SEQ ID NO: 990058 - protein, 185 aa, Homo sapiens
YVFGVGLSVLHDILLQLPSHHQFMSALAPDSELGSSFAICYSALLTKTNCIARIFDGVKNGAQRPKFISPSSQVFICLGLILVQIVMVSVWLILEAPGTRRYTLAEKRETVILKCNVKDSSMLISLTYDVILVILCTVYAFKTRKCPENFNEAKFIGFTMYTTCIIWLAFLPIFYVTSSDYRVQT

SEQ ID NO: 990059 - protein, 68 aa, Homo sapiens
AGEYPFRGIRMTGRRGNSPFTRRSRGPCLATLDLPETLRGGDGGKCRARERVCICVARREEGFNVCSF

SEQ ID NO: 990060 - protein, 97 aa, Homo sapiens
RCALQDLVIVTRNFWPTTEKFLHKREVWFAHEDKVDSLYGDSCGWTGPRSCTGKTLGGQVFCYLGLQSLVTMATVVGSKPPGGGAWRVVWNWSGPVW

SEQ ID NO: 990061 - protein, 70 aa, Homo sapiens
LVFRAMNTDEAMVMLTVVAVARTGMLLGIEVDNQVVLHCVVDLPSWALDPVTRPYFLASTSKRGEVHALV

SEQ ID NO: 990062 - protein, 50 aa, Homo sapiens
SGQAIYRVIFGRTFWMSLVITAICLVLAYPLAYLLANLPTRQGNLLMILV

SEQ ID NO: 990063 - protein, 30 aa, Homo sapiens
MSLLWLWSLLWHGFNPWPENFHVPWVTTAT

SEQ ID NO: 990064 - protein, 40 aa, Homo sapiens
MSISQPLCKTVWRFLIEPKVDIPFDSCHVHVLGIYPDGKC

SEQ ID NO: 990065 - protein, 91 aa, Homo sapiens
GEPCREIVEDLPMRVSHRVSRLEVKENRCIEFLVVLCIFRSISKEFYAYNEQILPDNLRNICFCGNISRDMFRGRSSEYTTPLMQFRYFRD

SEQ ID NO: 990066 - protein, 41 aa, Homo sapiens
NKLTAHHAGMAMHAATWQHRTGSRQLNHTSVAVASIPHIHH

SEQ ID NO: 990067 - protein, 138 aa, Homo sapiens
CRYLYAGPVRCGINLAICVAEKVTVITKHNDDEQYAWESSAGGSFIVRTQQVNLMGRGPNSYPTPERRQTAVTLAGHDESKEIVKKPFSGLLDHPITLLVEQATCITSKKRMHRRLTHTAAPSTASKTQHSTQKDRTA

SEQ ID NO: 990068 - protein, 157 aa, Homo sapiens
RYKEVTVEGTQEAAPGRPTRLRKVACIGAWHPARVAFSVAALGRKCYHQRTEINKKIYKIGQGYLIKDGTLIKNNASTDYDLSDKSINPLSGLVHYGEVTNDFVICKGCVVGHKKRVLTLRKSLLGADDSDRALEQIDLKFIDTTSTLGHWRFQTME

SEQ ID NO: 990069 - protein, 45 aa, Homo sapiens
MELCLWRLLWGSRLICGDCRYVGYGPEEAIVSHELGLQRLTGESS

SEQ ID NO: 990070 - protein, 56 aa, Homo sapiens
ARYLQSLAGAWLRGQSVSSWRCRAGGGTACPILVHLDYDQLSQVLKHFPERQRNEV

SEQ ID NO: 990071 - protein, 49 aa, Homo sapiens
QFHSSVSKGLQEKKRERSGFSGSGYREPKRRATGVPATPGWDLGTREWN

SEQ ID NO: 990072 - protein, 35 aa, Homo sapiens
MDADSACGPAHAEITGTQPLLLHLAYPIWASSVAP

SEQ ID NO: 990073 - protein, 45 aa, Homo sapiens
MIHIMSTIGENILDVITNSPNCGTMKCIICRHKDLIAFQFNESLN

SEQ ID NO: 990074 - protein, 43 aa, Homo sapiens
MPITLNGFHMVLEPSWALKAKTGNGTFCAVTYAQRHTHTREWN

SEQ ID NO: 990075 - protein, 77 aa, Homo sapiens
GRTLCVCGGARAGWTRGVAVGVLRPVVQLLLVRYLPSGFLGEDHLGHGHMGDLLHVDRFHVSLADLHQDVPGLPGED

SEQ ID NO: 990076 - protein, 59 aa, Homo sapiens
YPFPASIGVASHGISMAHSSLKGHGHAAGGRAFIYPTQQVNSQIPNTHHMVVTIQHHIS

SEQ ID NO: 990077 - protein, 43 aa, Homo sapiens
YAGLPLDSFRAKEGEQKGEDGGELDMALVQTPSKRTSKWTAYT

SEQ ID NO: 990078 - protein, 96 aa, Homo sapiens
QRDGEMCPRAVTGHGADAGLSLEHREGELETRCQYSSWYRTQTSTPSCSEDTIPSQGSDYDCYSVTGDADSEGPPELDKSSSIPRNSNIAQYNLPV

SEQ ID NO: 990079 - protein, 30 aa, Homo sapiens
MTASNIVEMNSKPPPGANAASEKERSSSIA

SEQ ID NO: 990080 - protein, 44 aa, Homo sapiens
MMQEQTVGYTGQGAFQELREQPVQTLGDAGPVKKEQRRPGVEAT

SEQ ID NO: 990081 - protein, 33 aa, Homo sapiens
NKPALIHVTNNNFCDKNQEQDDDKRGKSQRLSR

SEQ ID NO: 990082 - protein, 145 aa, Homo sapiens
MTREGGGSGTFLQEAVVGSHSRAAQFAQLCSSGSAWGPLHHAMADSPEGFFLRRSQHGEDDEEPPPGSNDQQNRHSLTGTPLVPAGCQRHSVLKSPDGVEKGKPPLEPERISPFGSLLFPAGYQSSLYYRGNASILFHVEPFLGR

SEQ ID NO: 990083 - protein, 55 aa, Homo sapiens
MADSPEGFFLRRSKMERTMREPPPRSMISRPDTGSRGTPLSQLMPAHPSESPMSG

SEQ ID NO: 990084 - protein, 76 aa, Homo sapiens
WHLEIRLLRDASATGTDMTTRGLCWRHAMLPDRRTQPIQVKLAKPPAHSVKGTRQTQKCLCPLYNQQAPRKKFLLL

SEQ ID NO: 990085 - protein, 63 aa, Homo sapiens
MPCGKNFISSCSVPDFLKFLAPVDEHNTSEFMNTNSDFESTANHLGDSGATPVQTRRLSGSRD

SEQ ID NO: 990086 - protein, 72 aa, Homo sapiens
FHSVFVFYYFSMLQCVGYSVRIISSYHPNLTAIVSLCDASSFYLRALLGWITHTGGSKPGTPLAPGETQAPP

SEQ ID NO: 990087 - protein, 47 aa, Homo sapiens
DAESKLDFTAAISGHCNAACLILLPQPAICLQLQVRTDSPDCVSYFI

SEQ ID NO: 990088 - protein, 34 aa, Homo sapiens
PVVAERETKSVSVEGTYDTDLTDRKLMAALLTRQ

SEQ ID NO: 990089 - protein, 62 aa, Homo sapiens
RLGAWTVLVRLVVQEPCHRSYATTNVDRQIRNGPWTASPITAENFLGIALVINRSQDGPAFV

SEQ ID NO: 990090 - protein, 49 aa, Homo sapiens
FSIVIIECATYATTLKLIKPQFLMAFIVIPTPTLALADRHLGLVGGVPS

SEQ ID NO: 990091 - protein, 37 aa, Homo sapiens
TFPQIHLAKYQAFKCGSKRKRTTQERGVGRSSPGVDL

SEQ ID NO: 990092 - protein, 59 aa, Homo sapiens
MLFSKDRSGAAGKKAFRRLIGLSSEEVIALILFLDTTQADVLGEAESRLPLDEINWRRR

SEQ ID NO: 990093 - protein, 47 aa, Homo sapiens
VIERVAYKPLRKSTRVAALITAIGVSYLLENAMSYFFGAESRPFPSD

SEQ ID NO: 990094 - protein, 50 aa, Homo sapiens
NNPPSNPPRNPHIRNHRIHSTRAREHTRIAHPQPFTPPNSSLLINSAIPL

SEQ ID NO: 990095 - protein, 57 aa, Homo sapiens
MLVKREGKKARPTARRGRSKLRKISQQISVHSSKKMSLHHQGNDLERISQGEQVRAG

SEQ ID NO: 990096 - protein, 80 aa, Homo sapiens
AVRESNSDLQSMDTVLHEHVSTRISALFMTFSRSMYRYRTRGFVKLYHIYTCRNLFHCSLVRNLGWFNKMGKTATPKNTN

SEQ ID NO: 990097 - protein, 40 aa, Homo sapiens
VSSPFVLPGVMHMPTPRHGDNVIDRLSTICNFIQQHSDKP

SEQ ID NO: 990098 - protein, 133 aa, Homo sapiens
MALTVRHNVELIGKYAMETESTGFHGGNNSNNTASKAMSDDAVTAVCCTLHEGVTKNMENAKALRDAGGFGEVGGISKSKGDKHSPKVVKGCISGPQQHVALPRSEESLQTGWMVTIPLGSLVFNHREGPAKA

SEQ ID NO: 990099 - protein, 46 aa, Homo sapiens
MLLIDIELAYMNTIHEDFIGFANAQRGATRRTRRRLQGQDEILVST

SEQ ID NO: 990100 - protein, 44 aa, Homo sapiens
MRHVHCKVNAEGSVDSVFSQVCPTWSPKVGTLEPLPRSELGPPR

SEQ ID NO: 990101 - protein, 60 aa, Homo sapiens
VDICAAVLHCRSGNRTKFVINMVSSRERRTTRLPKEERGNRVEATGSKKRQTAVSRGNRQ

SEQ ID NO: 990102 - protein, 36 aa, Homo sapiens
EATSGIVTIHPFVETPQISVRAHAVEDLRCSLDHSE

SEQ ID NO: 990103 - protein, 64 aa, Homo sapiens
VPEPELRCLWADPLLYVPELGLASAHPFECRIDGTVGNRGKPIPAVTHMPLSTQPKCSERDEVM

SEQ ID NO: 990104 - protein, 165 aa, Homo sapiens
TGYEGIRRFSTVIRDVGLKVNIRSSRSRAMESDLGKKLGPSHLGLGGQRLLVVSGLHVDDTIQVLLGWGAQDAQNVVELIQVVLCQGQMGRLESISARMQPTDQMSMDLVQPLEFSMISGARYQRVATYSVRKPGVVMLRIGNPGQAEITNLKVAGGVDEQVGGV

SEQ ID NO: 990105 - protein, 78 aa, Homo sapiens
AVYYQDHLAESTASDTEEASIQLSEKIPARMISSTQKIVGGTSAGMKKLFLYTIVIPIMPGSCATTGSTKRQQSKFSQ

SEQ ID NO: 990106 - protein, 120 aa, Homo sapiens
MLSPTLIPGLRVVYGHTWRFFVVVFETEFHSCCPGWSAMAPSRLTATSTSWFKRFSGLSFPSSWDYRRLPTQLAHIVFLVEMGYLHVGQAGLKIPNSSDMTDLASQSAGITGVRQRNQKR

SEQ ID NO: 990107 - protein, 59 aa, Homo sapiens
MWKSRGSCCLCRCLIGLTFRLRETGHILSGFIRVAGVPKCVGTILRVIIAIGDVIPQPL

SEQ ID NO: 990108 - protein, 33 aa, Homo sapiens
RRTYDRALRALAITQHSRIRPLYLRFRALTPTA

SEQ ID NO: 990109 - protein, 64 aa, Homo sapiens
AVVKGKGCSLIGVPKLGWALSGTARLTPEPAFWLDSPGLSLALQEKRQEFIMPTKNETIRDWQV

SEQ ID NO: 990110 - protein, 37 aa, Homo sapiens
RACYLRGVDSRRTELRAGAAARSNGGVSMVWADASSS

SEQ ID NO: 990111 - protein, 44 aa, Homo sapiens
RIVNLSALMLVSRLEGGGGGGGNIGVGRNGLCTLPWLLPLQCAS

SEQ ID NO: 990112 - protein, 63 aa, Homo sapiens
TTLGVRMSGCPADSPRAPTLDNRVDRLKTRKRVDLPQPDGPISAVTRLEASSDIDVVQRLDTL

SEQ ID NO: 990113 - protein, 122 aa, Homo sapiens
TLCHKAASVFSHYAEKESVKEPWARIPGLWEWLPGELNTPIFSEVLHRWDMAWRNPGLQAFLALVVRFLALVAKLLGEAGLEERLAAAVQAFGSSCVLEMWLGFVSQWRQGIATFLFHYCTP

SEQ ID NO: 990114 - protein, 118 aa, Homo sapiens
TEGCFTIESIHSTDMNLLWCPRTLPHCTVWKPQLSVVYLFLKLFLFFEMESCSVNQAGVQWRDLHLLGSSNSCASAFQVAGVTGAHRNAWLIFVFLVETGFCPVGQASLELLSSSDPP

SEQ ID NO: 990115 - protein, 34 aa, Homo sapiens
SVHEIEDSVLAKDTFTTPGPPYALAVVDVTKRHV

SEQ ID NO: 990116 - protein, 132 aa, Homo sapiens
SCVRYHESWVCRSTHGDEPLHSGTQHLTLARDGWEAGIRSPLCCPRAILPLGGVGHKRAVLCWRESARLSRGRAGGHLAESLLALCADDEARGMSGQKSLLRPFTVHREMSRDWLRGVTTEMSPYVHEPSGD

SEQ ID NO: 990117 - protein, 66 aa, Homo sapiens
SLENGGGEQGPDAMVRRVEGDDDRESEMSMAVHRMSLTSAASRVPPRTHLDGWKIGTSSVTHDGQD

SEQ ID NO: 990118 - protein, 57 aa, Homo sapiens
IPTTPRFATSPRFATSPRFATSPRLATSREGCFETPTSPLKKEPPGYEEAMSQPWTS

SEQ ID NO: 990119 - protein, 112 aa, Homo sapiens
TPDPDPKWYDVELVRDTCLQLDEPTVDYVATYLLVANIPIAANCVKVAYPGLVANREIAANRILVANRGLVANHKLVANRGLVANRGLVANRALVANRVLVANHRLVVNQAL

SEQ ID NO: 990120 - protein, 187 aa, Homo sapiens
ELGSTIAASVELRLHEGESDLNRLRSRIRQDLSHFEGNAQAIRMVYSLLKLNLTYAQVGCILKYTRPAYWASDIPASHSYLMKKPGYYLAEEAFVDRLRRELHMGEFDRFPLTYIMEAADDISYCVADLEDAVEKSIFTVEQLYQHLIQEWGEVAPGDLFDKTVASAFRKIDRGGARRSAEDQFFMY

SEQ ID NO: 990121 - protein, 41 aa, Homo sapiens
RYSSAPGFGYARKRGEKSMALRLAGELLDAAEGKGAAVKKR

SEQ ID NO: 990122 - protein, 31 aa, Homo sapiens
MQLVVWKLRDSTEKPVFPPPPPAEKRNAGNA

SEQ ID NO: 990123 - protein, 38 aa, Homo sapiens
PRDPRHPRNRERAINLSILSVVRMTSEVPMNSEVPMNS

SEQ ID NO: 990124 - protein, 59 aa, Homo sapiens
LGVSFAWLRLRDSVSKWLSPKALLIGFVAVMAGCGIVDHPSTVQCRTPSGVAPGFDWAK

SEQ ID NO: 990125 - protein, 116 aa, Homo sapiens
ISDGDECVVVMELTHDVDREKPAEEWSQGSMRSEETGGGKVDPQACEALGRLLVLRKGPGDAEQCAGMKAGTQAAGTQHADTLRESASETPRWRCCGVWQWVSSSRKEPMAAVINL

SEQ ID NO: 990126 - protein, 59 aa, Homo sapiens
MSPGCTLSVSVELLSWLCDKLNPVFSGHRSATPRVQDRLSEHQQLLAHLKSRKDRGDCG

SEQ ID NO: 990127 - protein, 69 aa, Homo sapiens
LLLSIVVMLREDNADLRRDWTQAVNRLVDDVRWARHSEKLERIERERQRLRDIWMHPESRNVEQVNAAV

SEQ ID NO: 990128 - protein, 45 aa, Homo sapiens
TLEDTLAIHRHLAIHRHLAIHRHPPECYSPPGSSTRRIPVPMSEV

SEQ ID NO: 990129 - protein, 167 aa, Homo sapiens
SLFIGTLGAWLGKPYYLQARFSYVRMKYVVSCWIAESVASWIIYVQHSTYTELCRGKGCKKIICDKYKTGVIDGPACNSLCVTETLYFGKCLSTKPNNQMYLGIWDNLPGVVKCQMEQALHLDFGTELEPRKEIVLFDKPTRGTTVPGGLAKETLLPPGSLLIGADE

SEQ ID NO: 990130 - protein, 98 aa, Homo sapiens
SEIQSLGGTRHISSAQKPHVASGSHGMLPQYILSTTHYESSAGTGPSAALDTTVACGHGNHLAPYLALLSSHSTHMIYTPYYVSEHPRFITFIVISGV

SEQ ID NO: 990131 - protein, 65 aa, Homo sapiens
QTCVLSREVGTIDVRIVCITGVLHLALVIGMDTVRVLISEQKSPVREPVDNLSPEARDARTCFLY

SEQ ID NO: 990132 - protein, 67 aa, Homo sapiens
PRDLADFFSAVGKVRDVRIISDRNSRRTKGICYVEFCEIQSVPLDIGLTGQRLLRVPIIVQATVPWG

SEQ ID NO: 990133 - protein, 111 aa, Homo sapiens
MGARPRLSGSGETYSLEGNGQEPFHYGTHYSSAMIVSSYLIRLPPFVQSYLLLQGDSFDHADRLFQSIPDAWKSASSRNKTDVRELIPEFFCVPEFLTNMNGYDFGRRQSN

SEQ ID NO: 990134 - protein, 66 aa, Homo sapiens
LQVVWSLLDGPLQTLFVWVSPAEAAEQHILHNSKYCCLILPLEASSQKGTRLYEVSAGPYCEVSPS

SEQ ID NO: 990135 - protein, 77 aa, Homo sapiens
KNSRHASSLLHALMDLAVQGNDWRPPGTRTGGKTQHRTLLFRVAGYICHHLKVPRLWERSMSWTSPLGSLEKLSMKT

SEQ ID NO: 990136 - protein, 53 aa, Homo sapiens
MARLTVYQQFLAQRMGEGLAIIIASGWCSTMFRWLCEQVDSCQLPLDARFIDA

SEQ ID NO: 990137 - protein, 46 aa, Homo sapiens
KGVTDMGRITSHMLPDITSSYSDGYQGLKSSSPMLLGEAKCSEGEI

SEQ ID NO: 990138 - protein, 40 aa, Homo sapiens
MPARSPRGRPLAVRQIIGPQQLQRLQLQRHALALRHQLNM

SEQ ID NO: 990139 - protein, 47 aa, Homo sapiens
AARWFHNVRVGPAGLVCVEEAWYFSLYYSLNVMLCSCVNFQCSSREK

SEQ ID NO: 990140 - protein, 69 aa, Homo sapiens
MMSGRSRDDYEEMLYELPLHGWTSWITMAGPAAGVLRAGRPWTHMPQEQERRDVLLRTKYQYRAITGGR

SEQ ID NO: 990141 - protein, 32 aa, Homo sapiens
MTADTSLTQSAYMVLNITDHMTICYIHRYCAV

SEQ ID NO: 990142 - protein, 138 aa, Homo sapiens
QKKKSTENTHKKNSLHVFWVNTSWASQSLIHPSLPPPPQVTLKWSSLSSETKNQMAMSRKIIGRGNIMYHITCTTPTTLQGQGIHHQTRHLVPLSPEGYFYILYTALQSATVNGLRVGRRAQNLIFPAAKYTVPDTRI

SEQ ID NO: 990143 - protein, 45 aa, Homo sapiens
DPSRSCHKDVVVDLVCYLAATCHNDDGGAHVHSSRIMYKQILQDR

SEQ ID NO: 990144 - protein, 44 aa, Homo sapiens
SRHVHNGAGMEAASRRLHGQDEVPEMTLSSLTALNCVGVLRKRP

SEQ ID NO: 990145 - protein, 76 aa, Homo sapiens
GTEFTKLEGQMGEDGNSIKVNLIKQDDRRVPHQTLSGQDTETKLSIRSGKQKIRAPSLADDHCHADESLELDMLRY

SEQ ID NO: 990146 - protein, 65 aa, Homo sapiens
MSHEMVAMSRSRQCQADRKPKPVLQKYAEAAGCCRLWSTCLSMREVISTFDNDLLGSLWTDLKMR

SEQ ID NO: 990147 - protein, 34 aa, Homo sapiens
SRGSLTPCPQGFGYVTFSMLEDVQRALKEITTFE

SEQ ID NO: 990148 - protein, 53 aa, Homo sapiens
MRAVWWTSGVPVPRAFPSDPFFLGGVLLLPFPVSLFSLRVSLPLSVPANLILY

SEQ ID NO: 990149 - protein, 162 aa, Homo sapiens
NSETSQKRLLRWTGASSSSIYDPCRASKTSSQKFFLRVLQVIIQLRDDTRRANKKAKTDRQARVPPVKAQTNRIQAAVRELEAEADAIIQLSESSQSEASVRREESPMDVDQTSPSAQDTQSIASDGTPQGEKEQEGRPTELPMLREQLSLDELWDMLGECL

SEQ ID NO: 990150 - protein, 56 aa, Homo sapiens
DAQSRRRWWWVELAVSGPVLSTRGQTPEAPKALGSRGKEQGGAQLVSEGKQVKWNW

SEQ ID NO: 990151 - protein, 54 aa, Homo sapiens
MSHARSGDWLQHEHKSLIRNKHRLYLTSISLNDSGTSRYSGFADPSLSSRHVQS

SEQ ID NO: 990152 - protein, 41 aa, Homo sapiens
WPWRCMASLNAVPQQTRFGVFRDVTLCHDLQPVAMFTKVLI

SEQ ID NO: 990153 - protein, 35 aa, Homo sapiens
MVAMVTLTPLGGAAFYIIFQTEDPEELGHFYDMVI

SEQ ID NO: 990154 - protein, 70 aa, Homo sapiens
SACSSGTVIFEVTEKLEGEDIAVEQLNTSLIVHNATSHLFHPQPPNPIQAENQLAPFTNTTTDLTLKCNT

SEQ ID NO: 990155 - protein, 74 aa, Homo sapiens
QEVLTFGSVVYCDVLMTKTVTSILERGRHSFQEMMQNWWRKQRPPSGNNGQGISLCWLVVTDNFVVSSFPNELC

SEQ ID NO: 990156 - protein, 63 aa, Homo sapiens
WDPASIWLGGVPRYPVFMPNGPVIEEFTKKNSLIIPTIIATITFINLYFKLRLFTPTPALGRS

SEQ ID NO: 990157 - protein, 52 aa, Homo sapiens
STDVLLDCARRILAEGGAPCLLPRVSSPIVLGIIPVVRASDLARLRRHLMET

SEQ ID NO: 990158 - protein, 35 aa, Homo sapiens
VDRSEGCLEIIILLRVEAAPETLGGVLILSSAEGG

SEQ ID NO: 990159 - protein, 75 aa, Homo sapiens
WHTIPQRARLHPRPRPQASSSWDRESSRPSTPSIPCVWPPVHHSLSHSPNDPVPAGPFTCPVSLRRSCAWVPERR

SEQ ID NO: 990160 - protein, 45 aa, Homo sapiens
YRVQQKFAVDITRVVGLMNKFVEDTKKGVHQKEGWPSSAYVGDDR

SEQ ID NO: 990161 - protein, 71 aa, Homo sapiens
KGNPTIFPPNVSRKPMSPEGLQVVMGDDLPTKKGILGMLADTGNSSLIGPLQKYTALREKDDPYEEKGAIY

SEQ ID NO: 990162 - protein, 46 aa, Homo sapiens
HEQMDTFCLHPLKRQLGTIPPLTTAQVHRVYPHRPTNDAEQYRGAG

SEQ ID NO: 990163 - protein, 54 aa, Homo sapiens
MLEIPVAEVGLSTSVPTHSREHWRWSRLDWKNLFVVPLPWWWGGQTTSVLARGT

SEQ ID NO: 990164 - protein, 70 aa, Homo sapiens
MKSDAFRSLNLNSAPRLVGQGALGKGLTSRYHRCSLIVGRGGGSRASFQGLPRVKGGAAGKRLTNIGVPS

SEQ ID NO: 990165 - protein, 39 aa, Homo sapiens
KPSACARLPGRSVEYEYRVSGYSSGAPTAVRHLRALAAR

SEQ ID NO: 990166 - protein, 37 aa, Homo sapiens
LGPVVGLYLHYDAVVTCFLRSTFSWLKFSGYLWCARA

SEQ ID NO: 990167 - protein, 33 aa, Homo sapiens
PVLRRCGYGLYLHYDAVELCFLRSTFSWLKFRG

SEQ ID NO: 990168 - protein, 45 aa, Homo sapiens
SSSLFTLNRPKELKRFSRYSITATTWRRRPIRTTALSTFDGSGYR

SEQ ID NO: 990169 - protein, 46 aa, Homo sapiens
MEIVSMLEKNATLLKFGYHFTQQGPRPAGPHMFFAYGGNAGKCLEQ

SEQ ID NO: 990170 - protein, 62 aa, Homo sapiens
HQRTTIAYECDTNTACSIGKSMLTPSESNINPHTKGSTSNAKKTKPSWARGLTPATPAAREA

SEQ ID NO: 990171 - protein, 40 aa, Homo sapiens
FPEKGRRECKMHRENRRTHTQGGKEERRKAGREGGERLQL

SEQ ID NO: 990172 - protein, 34 aa, Homo sapiens
VQSSAAVGFWVFDPQRYDSKTLLRVSKVIVSIDS

SEQ ID NO: 990173 - protein, 53 aa, Homo sapiens
STVLDRSTHVLWSVESPSSRSVWNTDLEAQDLKSAVQWRTFYADVVIFIYITL

SEQ ID NO: 990174 - protein, 43 aa, Homo sapiens
TETVLVTCVQVNMLVMFVMKHLCSCEIGGAPLLLDELSWDLIA

SEQ ID NO: 990175 - protein, 87 aa, Homo sapiens
MVAVMDSDTTGKLGFEEFKYLWNNIKRWQAIYKQFDTDRSGTICSSELPGAFEAAGFHLNEHLYNMIIRRYSDESGNMDFDNFISCL

SEQ ID NO: 990176 - protein, 41 aa, Homo sapiens
MFSALPVSRLYLVSRLYLLYQLNEMDQWILRQGRAEGQGRA

SEQ ID NO: 990177 - protein, 35 aa, Homo sapiens
SRATANRQTQLGGDVPIKLMNHRGISVAPHYHMLF

SEQ ID NO: 990178 - protein, 34 aa, Homo sapiens
DKTETEILQLETREKLDEEYDMGANRSTCSPEEV

SEQ ID NO: 990179 - protein, 109 aa, Homo sapiens
MNVVRGYTIWSYAREIRAADINLERYNTHVVVYNVTRQNDITEGVIMNRSEKLSRTLTLRSWKYDEPAQGTLEPAREIGKTKNRDTVLEDKGRICYRTTTAKRSVRADN

SEQ ID NO: 990180 - protein, 103 aa, Homo sapiens
MFRDSAPTASHLSTLQKLEISLISSSDGQGSTAAPGEGPDYSTIDPEGEELQSFHGGFPQHPSGDLGPWSQYAPPEWSQGDSGMTPTPETPFSPDQGNTPQED

SEQ ID NO: 990181 - protein, 72 aa, Homo sapiens
VPRIPVGRVCREQESELAESLGNQANTDKGKEKKDQGLQEVGDNVEMTKPKKDEVYLRKKRNVNVGKTYLRE

SEQ ID NO: 990182 - protein, 62 aa, Homo sapiens
MKPGLYTYQQHQPGSGGTSLWSQLLRRLRWAYGSSPGGHGCRHAVAPLHSSRGNSKTLVSNK

SEQ ID NO: 990183 - protein, 42 aa, Homo sapiens
MGNTSRKPACCHANEVPRPGDYLFEHALCGWSNATDSAYTYY

SEQ ID NO: 990184 - protein, 59 aa, Homo sapiens
MALSDLKLYYSHFLVFLGLDQVQSLLERYTKTAWYWYKNRHLDQGNRIENPETDLYIYS

SEQ ID NO: 990185 - protein, 37 aa, Homo sapiens
MCASIVLCDFDPVIMMLAGYFIDLYMWLLLYWAHIME

SEQ ID NO: 990186 - protein, 39 aa, Homo sapiens
MGTWWVKAEDAGALEEKRHRLGQQGLGAGHNHCSDFSNR

SEQ ID NO: 990187 - protein, 66 aa, Homo sapiens
MKKYVPSFDIDTVMVGVLGREQGETLAVEAHLVELLVIRIDALLAADATEPDRLRLRIDAQHLGDV

SEQ ID NO: 990188 - protein, 150 aa, Homo sapiens
CWRRTYDEGCLHTDNGRGGGGVTSTSSHCRCHRSTPQRITLNLRSHNSEFVLVKWNESYLKLAVLLRRVRHIRVDPVRGQAVCADGQRTQSARELLTRGSHDGPHALITYRDEFVLVGSASGQDTAHPKSTWKVTSRVEYGLLTPTRCCL

SEQ ID NO: 990189 - protein, 35 aa, Homo sapiens
SVSRDESSPFYCWMNGDRIDSLLENGRQQTHMLEC

SEQ ID NO: 990190 - protein, 55 aa, Homo sapiens
MRPSVNLNLKGCQTSHFLEFESGALHDNRTTPPRAAGRRGSAVRSREGGPGRFTI

SEQ ID NO: 990191 - protein, 74 aa, Homo sapiens
MIITIGQSIVYVMTGMYGDPSEVGAGIGLLITIQLFVAGLFVQLLDELLQEGYGLGSGISLFIAINICETIVWK

SEQ ID NO: 990192 - protein, 181 aa, Homo sapiens
MCAHASIATQSSRRKGISDEDQINEIKQEEKFREKSKKKRTKPPRNMGLCEKTKSTLDGVSESDRDNGTKLENTLHDILQENFPNLAKQADIQIQEIQRTRQILFENSNPKMYNNQIHQGRNEGKHVGAATEKCRVTHKRKPIRLTVDLSTDTLQARREWSHYSTFLKNGITKPESHLQTT

SEQ ID NO: 990193 - protein, 59 aa, Homo sapiens
MERDKISPVWSTCAWGAVFSYTPGAARLPGSAASPCELHGQSSFFQWAEVVVCRPPSLR

SEQ ID NO: 990194 - protein, 167 aa, Homo sapiens
SGFIYVLVLNKYAANDIFHQDDEALICHSDFLACAVVCRPSNMKIPYWNAAWGKASLLFIYSRDILHWRYQSPRAGYRAPSCDPGPFCYDPSSSSRIQRQVIHRGWVARCITVGHAKEISQLLFVFWLLQRFCAFPASRPSKLFIDGLDQLLGRPRSFVNVHGLIIY

SEQ ID NO: 990195 - protein, 48 aa, Homo sapiens
SRAPSTPEFKPAESTPEEAEFHNSIIMEVQSLYHSALDDLEALVAGVP

SEQ ID NO: 990196 - protein, 119 aa, Homo sapiens
REDRMQETCSEYMSRRTRQPQEKEEIQEASTKMLKEQGHKEHTMLAGKQTKTRHQRLLRILCCSRRAVSSTGGRMPPGLMVQAVWVQPALLAPGSMIPNVDVIQTCSFKKRSHRGQGQG

SEQ ID NO: 990197 - protein, 31 aa, Homo sapiens
MEWVMHTARVDRKRMSTVSEMHYEHGGVWCV

SEQ ID NO: 990198 - protein, 35 aa, Homo sapiens
MSLSKSGGKKWSGPRCMSPRGSVHHGVFKAVFKAH

SEQ ID NO: 990199 - protein, 50 aa, Homo sapiens
MCLTHPGTTGLMEVEHRDYEVNGGVSHSGLQSQWTVGGTGNCMSQWRWHS

SEQ ID NO: 990200 - protein, 105 aa, Homo sapiens
MSDPPARPYFPSLRPVDTVSAQVKGHWQQGGLSALINAVAHVDDMLNALSALEELHAHKLRVDPVNFKLLSHCLLVTLAAQLPAEFTPAVHRLPGHVPGFCERSC

SEQ ID NO: 990201 - protein, 139 aa, Homo sapiens
CDASLALAVSGCVRHSDRYADSDVVYNKTWLALGEAGSYHSIPHNAINAHPLLTVCGVAGMDGQMTQEAVLDEPGLGVLLADAVVLSATAPRSDPCSGASVLFHINSGVLCMSPMFPQSVKMRRITVPTITRLQKDTMR

SEQ ID NO: 990202 - protein, 77 aa, Homo sapiens
SVMQGVDEEGVSLSYRTISVIFVHEARSATRESSSDSECSFMCDLGTHPCSKIHYCFSLVLSVVPVRNTCVNDSCDI

SEQ ID NO: 990203 - protein, 66 aa, Homo sapiens
WRSKQWLVIVMTAESPGSRLSWAHGPGVSHGCAPSDFCSNRDPYVLNLTQEETGLQLRHPEAIISG

SEQ ID NO: 990204 - protein, 35 aa, Homo sapiens
EPVPLCLTTMEAAGFTAQVIILHSRQISAGYALYW

SEQ ID NO: 990205 - protein, 130 aa, Homo sapiens
SRGSGSGDYPEIIQAKISAVVCPLVLDCLLRLTFACKLSVRLKDKIDAVHGKKLDDVPYILAGLVMLPYGDMVAGKPMCVESFSDYPPLGRFAVRDMRQTVAVGVIKAVDKKAAGAGKVTKSAQKAQKAK

SEQ ID NO: 990206 - protein, 39 aa, Homo sapiens
MRMKSCRPCGIRESKNLNSLLNKSLDSEFPRGEYHRLAT

SEQ ID NO: 990207 - protein, 168 aa, Homo sapiens
MEPLALGLSILLLFLTEGCIWADAAQEPTGINAEILYSVPLELRSPAGPYFSDEYYDRYTQSCRQFRVRGLARGNAYLGFYTWEACDDACWRIENVPKVRRLQVSVDEQCEGSTEKYFFNLSSMTCEKFFSGGCHRNRIENRFPDEATCMGFCAPKKIPSFCYSPKDE

SEQ ID NO: 990208 - protein, 101 aa, Homo sapiens
TRYVLNHRRRFWEINEKFQSTRTKALYPPYYYNRHSGPYVCSVRNLATGKESSKSMTGEVSDWTVPGILLVPPIPFSPMESLRARPTLFQKPYKLEVDNSM

SEQ ID NO: 990209 - protein, 44 aa, Homo sapiens
PTFHSGGDVLVSKLAVVPESNSKPKAPREKQETAPASPGCSPAG

SEQ ID NO: 990210 - protein, 88 aa, Homo sapiens
RYVLTHPLHVTKKTRVCPFSERGPLITFRASLSVRAGPRIHKQQKQSKQPNRLVMGKDPGLGLEDEQAMQLAQEKAIDEYRPAIFPDI

SEQ ID NO: 990211 - protein, 58 aa, Homo sapiens
RSSSVPIPIRERDKDRCRNFKLRHIRKYYLIKFLSSDGITFRNLSFRNSGTSYSRILS

SEQ ID NO: 990212 - protein, 55 aa, Homo sapiens
SLPVLYDYTLDVYPPRLWARTSHSNPDLRDRPGARRAGGRYLDLTPSTGAVGQHI

SEQ ID NO: 990213 - protein, 57 aa, Homo sapiens
MRVAHHDAAGIWRRKCRNTRAKVKPDRFVHRYLYDAFEVVFDRLLCGDQFRIDCVDL

SEQ ID NO: 990214 - protein, 44 aa, Homo sapiens
MSSVPLCSDPPGSAPAVARPGPVLYDSGSTACGPPSRLRDPFHG

SEQ ID NO: 990215 - protein, 55 aa, Homo sapiens
MFVHSAPRALVMRSSATLLACGLTLGMSLWLSVERCGTVVLGGRVNSKGDPSRSR

SEQ ID NO: 990216 - protein, 45 aa, Homo sapiens
LTQELLTQELLTQGRAAAGKETEPVAVRAKVGGGDVEGDGRQLPL

SEQ ID NO: 990217 - protein, 104 aa, Homo sapiens
MQGCGQLLLLLLLLLLLLQKKFCIELLLRAYLGHHRELSNCWLLGCWMYCLKLLSLGLLLLVKRACRLLLCWRWLLLLLLLLEEELLLVLGCGLGLSGQTLGLS

SEQ ID NO: 990218 - protein, 36 aa, Homo sapiens
AIGLECYQDNFSKIALCPFSDVAQLSLVRPACPGFH

SEQ ID NO: 990219 - protein, 46 aa, Homo sapiens
PCQVIDQKTSSRQGRKVWEKLRAVISGLSLTRVEEQSGSDTDTDKH

SEQ ID NO: 990220 - protein, 51 aa, Homo sapiens
LTLTGFLVTSSDPSERRQDSETGSSIGAGEQKWKHPMTHADMWNHVRWLGG

SEQ ID NO: 990221 - protein, 36 aa, Homo sapiens
QELYVIPLRHSDLSLDRIIFVRARLLCRLPLREEVT

SEQ ID NO: 990222 - protein, 61 aa, Homo sapiens
VGSGLGLFSIRAKACEVQGGLLRRVPVSADPNVPNVVVTGLPLVCSSAPGPLELELSGYSG

SEQ ID NO: 990223 - protein, 36 aa, Homo sapiens
RLFDWLGAPRAAVRGGGRSHVMLRPVRTRELSTYVG

SEQ ID NO: 990224 - protein, 37 aa, Homo sapiens
APPEHCGVMAAGSPEHHPCLYWRCKGCGQGHPCRASR

SEQ ID NO: 990225 - protein, 75 aa, Homo sapiens
AENRWAREAEVAVSLRSCHCTPAWATERDSVSQQNNYVTSQASLLDITRVTISSHFSELKFPGTAILGHIALTSC

SEQ ID NO: 990226 - protein, 68 aa, Homo sapiens
LGDSEDPPRLADRAVFEARYFHGLAIFLDTYPKDETTERVFPYISVMVNNGSLSYDHSKDGRWTELSG

SEQ ID NO: 990227 - protein, 68 aa, Homo sapiens
PRLADVVWQLGVSGTTFGEKRDHEILSRGGEGELCLGTRLAEERGMIWGTLGDHGWELSLEEDAQLSG

SEQ ID NO: 990228 - protein, 32 aa, Homo sapiens
MSLGRIANCYSFWGINSCGDGAHNGLRGHCAM

SEQ ID NO: 990229 - protein, 127 aa, Homo sapiens
VQYNTINSKKDPLDQERERERERARARSPYSRSVNAHTAWLGATDSLRHGRPNQTQGTRQEVAVPRLKARRETEAVRVTGEPDKDREVEQGTEGDGRRNGRVGMSKDHITLGAVHRLAAGTPGLYYL

SEQ ID NO: 990230 - protein, 31 aa, Homo sapiens
MAGRKRQSPVRSQLALPSVSNSTSFVEEVDS

SEQ ID NO: 990231 - protein, 138 aa, Homo sapiens
NGKCDKERRSHTGDSGLIRSEVHIGDGDAEEHYSRLGILNTEPYNFPAGSLNIQIRSISVHTGSRHINVSLGQIHIHFRDLCGEARHTELGHFHLGHFQVPIWVVNLHIWGINVHFGPFNVNIWHFHFTFYLGHRHWQ

SEQ ID NO: 990232 - protein, 123 aa, Homo sapiens
LSIPVSTEAVVSPELWDHQDITEDMLFPLLVAGAAELEIVVVGTGDRTERLQSQVLQAMRQRGIAVEVQDTPNACDTFNFLCHEGRVTGAALISSNRRDFTYIFGPSCSNDTPGTDLLTALWQ

SEQ ID NO: 990233 - protein, 35 aa, Homo sapiens
KSCGKVPCGKYPVEKYPVEKYPVEKYPVEKYPVEK

SEQ ID NO: 990234 - protein, 146 aa, Homo sapiens
DTGILGVSYSEVYWYYTGQRVESWFLLHVEMCSELRASVGCVVSLDSGVKLQTFAVSVTVLRAARLELSVPPGGLVVSLASGVKLQTFAVSVTAHKGSVDLQSEQQQDLLQRAKEQSFHSVERDPSGLPLRAGAACFYSLIWPHPH

SEQ ID NO: 990235 - protein, 51 aa, Homo sapiens
MPAMRNSPTFKSFEEQVENLKSKVGGTKPAGGDFGEVLNSAANASATTTEP

SEQ ID NO: 990236 - protein, 92 aa, Homo sapiens
MGVRDLGQPQCCPGLLCGFETTSCPLWSGVAGTWTGGHGAGLWATDRTQEGLHLKGLPSSSGFIDLHPGSGYCTGETGHELRPSVPYRVPEL

SEQ ID NO: 990237 - protein, 66 aa, Homo sapiens
LSTQRTNILHASMLWYTLDSSPCKPGYYRPVLRELGDDTGTTFHPQSEEPLVLISRTQHPYIQYNL

SEQ ID NO: 990238 - protein, 66 aa, Homo sapiens
RPGIHIPGPQASPHPVLSCTRTSGPHTAHRSISFTPYHDIGPSHPQNQVSAVTVTKQVEPSIAPHG

SEQ ID NO: 990239 - protein, 59 aa, Homo sapiens
WAEPGASSPPSINALCGSLKCLIVEVSLHWTVKKADQMKTTFYKANNNNSFCELNIYGA

SEQ ID NO: 990240 - protein, 164 aa, Homo sapiens
MDPRAVRDVILPKASTRSCFHRLEVLPARQAAWMRFERRSSFVVWSVIVLGLPYVAGSAHLDVPAPQDITEFICSKAICAASGTSYSTKAKPLCFMVTESQDMSDALDGAKGGKGLADGVLPQLIVDRAHVDAAYDGQRPLPLAAIDCKGERGSPKPIVTAAIC

SEQ ID NO: 990241 - protein, 123 aa, Homo sapiens
MSELLPEDKTTSGKAVILAVLIPALKKGDSEDSSEASESFGPGKEEQEEQEEEYEEEPEEDYDEEEEESSEDQHWSDSPSDADRELRLPCPAEGEAELELRVSEDEEKLPASPKHQERGPSQA

SEQ ID NO: 990242 - protein, 62 aa, Homo sapiens
TRGVFSSSKHVHHCVMVLGTQSPDAGTTATPPRACAVSGQHCAVACTECPCRASRGLSGYSG

SEQ ID NO: 990243 - protein, 50 aa, Homo sapiens
LTTSPTGLARGYGTIMACATSGSANHILAKARSSFYAKTHQPPTLSGYSG

SEQ ID NO: 990244 - protein, 48 aa, Homo sapiens
WGLSSCSDRPRFPLRLHLRDIFSAISCFWDLQHRIVVSSFLPPTMSSR

SEQ ID NO: 990245 - protein, 92 aa, Homo sapiens
RIASPVLGSQTVLTPILKQVLLWVKVLPSIITWYREIFCERKLIQPTSWLSYFKKFPQPPQRSATTTDQSVAFNIEARPPTRKKITTHWQAR

SEQ ID NO: 990246 - protein, 35 aa, Homo sapiens
RGDQKNLLRKVSRSVHSGDEEDLTGVGITVSHQVC

SEQ ID NO: 990247 - protein, 60 aa, Homo sapiens
LPTADRCCFPSCLWFVVSIRILGEMESFPQGAAVGLELFQDRFFTRGAPGYLPLPVGLVG

SEQ ID NO: 990248 - protein, 30 aa, Homo sapiens
MHDTAQPITSGTEGEPASSRVRSLGCRASR

SEQ ID NO: 990249 - protein, 73 aa, Homo sapiens
SSVPIGTEVTYPIDIADIAERLKVLVVDKSTPMSSYGEDDALARVLASGFDYHHSWSPWFSCVSTFNYNIGQT

SEQ ID NO: 990250 - protein, 38 aa, Homo sapiens
YRSQYAVFLIVLLPDISPFRVSKVHCISLYAFGHSRLS

SEQ ID NO: 990251 - protein, 37 aa, Homo sapiens
VESDLEDLPDSHEAVRSPPPAGTCTMVAASIPVLAPH

SEQ ID NO: 990252 - protein, 34 aa, Homo sapiens
PYDSRQQTCVMGCRTKQLMLLLSCRASRGGTELE

SEQ ID NO: 990253 - protein, 53 aa, Homo sapiens
PPTSRQQALLALRWGEPAVYCCWRELTARCQLTTSLYFACCHWPASNILSASR

SEQ ID NO: 990254 - protein, 63 aa, Homo sapiens
WSGTERLVMALPPDQALRPGQCAEAVVMAADSLVSELNAWSVVYSDMACGWHATTGITGRGTV

SEQ ID NO: 990255 - protein, 142 aa, Homo sapiens
GEDLRRDKGATWFRLGLASQVNIVAFEQLGIRFWGCRTRWYYGGNIPSGDLQIMLYEDQQANELDVTFSDADYANSLGDLDVLQRRFQFILRALNASTAGTIEALDRQVAALADTEAGGSFYTNRRQPPAGGIIRWDRPAEA

SEQ ID NO: 990256 - protein, 51 aa, Homo sapiens
FLGMCVCSVQNISSLLALQVWQVILAERELSCMLRVALPRVSVGLTCRASR

SEQ ID NO: 990257 - protein, 176 aa, Homo sapiens
SGCASGGGIRRPNHAACTTLNPGPARRGSMHTRTSPGKRALDIGGGGGILSESMAGLGAQVKGIDLSTEALGVADLHSLESGISVEYEAIAAEAIAAREPGSYDVVTCMEMLEHVPSPGDIVAACATLVKPGGWVFFSTLNRNLKAYLFAVIGAEYIAQMLAKGTHEYARFIRPSE

SEQ ID NO: 990258 - protein, 59 aa, Homo sapiens
LRHKEPPDLWHAVYRSTDVDGKGIIEENFPGLAERSMTSKYKKLNRYTRKTHCIQDYNL

SEQ ID NO: 990259 - protein, 52 aa, Homo sapiens
MLHHPHHHPSLTSTFYLRHILHHTPYQDKDGLLASSNLRKAIVTLSRHVANI

SEQ ID NO: 990260 - protein, 45 aa, Homo sapiens
CWVPPPYLSFVVVSRGARCAGRPVEGRPWSGLGSLGVRCSGAPAL

SEQ ID NO: 990261 - protein, 34 aa, Homo sapiens
SYVPCSVPPSFWVLTMCALCSTSPGAVSAHGPGG

SEQ ID NO: 990262 - protein, 33 aa, Homo sapiens
CSYQMITHLLIFSFVCRILGTQGLKFRMSVNIF

SEQ ID NO: 990263 - protein, 67 aa, Homo sapiens
GIRGSCVGIGREHLHGEWQFKRLALLGGVNCSRYQDLGVRQLDLPSAGRWNSPRSAPSAIGGRRGVE

SEQ ID NO: 990264 - protein, 37 aa, Homo sapiens
NTAPEIRNLGQGGFWGENHFPEKLGIGAGRFQGEKPF

SEQ ID NO: 990265 - protein, 61 aa, Homo sapiens
ILMADSRGETFATQGGEVFGQGIDRAYQSLAVVFLDLVVGHEAAVRGFVLGQDLVHRGEVL

SEQ ID NO: 990266 - protein, 54 aa, Homo sapiens
LDPRFAVQETPQSSRIFPLSAWDLGCRLHSLRPWRSRSQLYSTISTAVTASCLL

SEQ ID NO: 990267 - protein, 69 aa, Homo sapiens
MFSLEFVGLHPTPTAGVAGERRSPPSLPLGNLVVPGSPPNPIKDVSFAYPTRPERPVLKGLTLPIRPGD

SEQ ID NO: 990268 - protein, 120 aa, Homo sapiens
TTPSAFKYTKLHIGWQGPGSSAPAWQDTSASAHLRAAGFCTQPPRNPSAISTKSWQQQKRPSVSPPTVQCSQGTRSLTGADATRFERRPHGGEVCPPPVLEAGCLVGGPELAHLNPSSLG

SEQ ID NO: 990269 - protein, 98 aa, Homo sapiens
LLSRYRWEGAVHIAWYIHQELGHPANTLRCNGNGKAPNSFHQLTPWDRINGWESPSVTGQNLPYRLVVNNMNSWGKAAFSGTTASEGSSDGSGTHNEG

SEQ ID NO: 990270 - protein, 114 aa, Homo sapiens
EQFLESPKVWQLAQVSMLIVCAELRWLGRAEVGQGQVVVVRQEQVQVESESRQWLQQEQQLCVTGRFNHRGPGRKILLAGTGGRAGLVKEQDNISYLSLDLVPEVPPEQPTSQY

SEQ ID NO: 990271 - protein, 174 aa, Homo sapiens
IPCLTTSESSFRRCSAPTVSQHCGRRGGGSLESGVRDSLAHVNLSLLKSTGSTVVPATWEAETGELLEPGRQSCSEPRSRYCTPAWAQIKTPSQKTIKVTIQPDQGGGQERSRNRGLRCFRRGGPCSDFSLIHFGLSPQFPGGNGVLRLSPGARPAVPRDTSGSLGANNGNSRG

SEQ ID NO: 990272 - protein, 41 aa, Homo sapiens
LFIGTPLFIGTSLFIGTPLFIGTSLVIGTYNSQATRCQMNS

SEQ ID NO: 990273 - protein, 42 aa, Homo sapiens
IPSGRAALRGELQRQLVWLLSHVWVHALDLGQPAAGCDNKLA

SEQ ID NO: 990274 - protein, 69 aa, Homo sapiens
VQVTSCSSRGMQPPDGSGSSAGSRETCCEELAERRAVLEYLLPEHHALYTNRGVWLRSIKEPREDTPLG

SEQ ID NO: 990275 - protein, 114 aa, Homo sapiens
TTAGKDRLMTKAVSLRENKGPGTQNHRQGRFLKKKAPAVPSAPPSYEEATSEEGMKAVAFPPAPTAVPLHPSWAYVDPSSSSSYDNGFPTGDHELFTTFSWDDQKVRRVFVRMF

SEQ ID NO: 990276 - protein, 69 aa, Homo sapiens
SHDYRRDEGGSKDELALRGEVEQHQASASPITCDQGRYGNCSLNGEMKNYGVPPSMGNEGGSAEAGGAA

SEQ ID NO: 990277 - protein, 153 aa, Homo sapiens
MLGLLDAYLKTRTFLVGERVTLAEHHRLSAPLWWLYKQVLEPSFRQAFPNTNRWILTCIKQPQFRAVVGEAETVVRRWSRFVADKVGMRPNRKRTRHGREKGYKVKMEAECPRLSGKEENKGGLPRLHEEEMDECEQALGAEPKAKDPCAHLP

SEQ ID NO: 990278 - protein, 113 aa, Homo sapiens
MRTPSSKVCPEHFYLRTTQSLTASSRLEEPGNECLKSWPQLMTPPGIGTPTAFGSLTRGVRIILLFPVRHFPYLRYGVFPGISPNELLCTQFPVFSEFRSMTLSDVRNANVRN

SEQ ID NO: 990279 - protein, 75 aa, Homo sapiens
YIIFPNVSVKPCEEWPTVSHAISITHFKLHACLNEDDMLENQVIAFEYVMRCSDWTQIKNWMAYCVAYARGEQKP

SEQ ID NO: 990280 - protein, 63 aa, Homo sapiens
SYASCMSPLRKVTYRCRTYCGHPIGIAHYSPELLDSSDPPASASRVAGTTGTRHRARRGFVES

SEQ ID NO: 990281 - protein, 109 aa, Homo sapiens
VQLTWHISGYQLATGTLQTPGHPYALQLDLTASATSYYMHSHSSAKSKMRSTKKVDQILHHGILLIDKVEAHILSVTKHFHPFYCWRNTLTPLSSCPATPQPPRTDLKL

SEQ ID NO: 990282 - protein, 40 aa, Homo sapiens
TPVIKLGDADPTLTGYYAECQQLKEDRQVERLNEDVLIGQ

SEQ ID NO: 990283 - protein, 34 aa, Homo sapiens
TENKTKQNKNKQNTSDHPKVGHTALTHIDPTHSW

SEQ ID NO: 990284 - protein, 93 aa, Homo sapiens
KKKKKKYQIVCTPSSIMDHCEELIPEYLNFIRGVVESGGISLYHISRADVATKPTILKVHPGKPFGPKMLQTLFHCNWLADKANYKKFYEQFS

SEQ ID NO: 990285 - protein, 83 aa, Homo sapiens
MTGHSLIHTPCSFTGRILSHNRPRSYILITILPSKLKLGTHSQSHHNPLSRTSNSTPTNSFVMTSSKPRYLAYFTPTPPLGRS

SEQ ID NO: 990286 - protein, 36 aa, Homo sapiens
LHSYILSHGRSNSTPTNSFLDDYLANHRYNRGILYE

SEQ ID NO: 990287 - protein, 75 aa, Homo sapiens
MSSGTDEGDAWQSQVIGASMKNPDGNDVGVTQVVDEAADVDIVTDIYAATPLHPCSTKSEEVSLILSHISLKIRD

SEQ ID NO: 990288 - protein, 70 aa, Homo sapiens
DLEPSSHCPAVDLLEVHCLCPSTEEAHCHPSGREPRAGQAAVPLLAGPLPTQTEDVGTTALVGQPTLEPD

SEQ ID NO: 990289 - protein, 36 aa, Homo sapiens
MTLVGSETLAGSETLAGSETLAGSETLAGSETLAVF

SEQ ID NO: 990290 - protein, 76 aa, Homo sapiens
SEAHETPDYQSPVIYVIEKKFLISLIVHLLKACTKRALELQGSDMIVPKDLPRVVSGKRFIFLIYMPCLKLRTLHK

SEQ ID NO: 990291 - protein, 42 aa, Homo sapiens
RAQKLLAYLGDLAVNGSQIKGQIGEPKFKGDIAIPTLHDEQK

SEQ ID NO: 990292 - protein, 69 aa, Homo sapiens
METAKDEDGKRWLLHLIYQSSSLSISQHLLSIYHVPSHGNTMMNNIVLTFTELPLYDFTFQNFGSHSKD

SEQ ID NO: 990293 - protein, 65 aa, Homo sapiens
ECASLVESDRARLRIGAAILTWPEFFRLEQTFPLAQVISFRAIVLVGFAAVFVVMLLLCVARPIR

SEQ ID NO: 990294 - protein, 75 aa, Homo sapiens
LFHGDEAGVGQACLSGPTPRGICLPSGSPISGELLSFNKTLHSFSKPTCDPILPVHQDKNLGYINPSVLVIRKGV

SEQ ID NO: 990295 - protein, 47 aa, Homo sapiens
IIIISISSSSSIMLYMAGNVTARYGSDYYSKNRKGSEEAGNSGINQL

SEQ ID NO: 990296 - protein, 58 aa, Homo sapiens
MAHLMDASQIRSLSHNGNFVDLHFKITAVATGMENGLERKPGGGEIREGCYGVCFEIV

SEQ ID NO: 990297 - protein, 34 aa, Homo sapiens
MRANKLCKSGGGRVTELTTKPLFNLFYPELTGFV

SEQ ID NO: 990298 - protein, 64 aa, Homo sapiens
HYLFRGLKPAGEGLLGATAVVQRKRIAKCRLNQTSAEQSQRQADCRGVGRIAGRSGTGEIALDR

SEQ ID NO: 990299 - protein, 46 aa, Homo sapiens
MLMEPYLVTVLMGQFGGCSHKSPIMVVKVVLLGLGVSDFEFGVDPS

SEQ ID NO: 990300 - protein, 46 aa, Homo sapiens
ALPGDVLYASLLMSHQILDKAGDGGGMLCLGASDYEYGVDPVLILS

SEQ ID NO: 990301 - protein, 120 aa, Homo sapiens
RYLPCWEARNVVHTTGKLGKNSARGVHEAVHLEESVSRQEDVAQQDQCHLLHVQAEDGVEQLHCPQCVLLPRLLQQLLNQVVAEPVDAVHVQQSVKDVDGAAVHPALLQHLGKNVLSAPL

SEQ ID NO: 990302 - protein, 51 aa, Homo sapiens
LEILALPGSLTYGLTPGSLTLRYALPCAECSGAITVNYSLNLLSSSDASTF

SEQ ID NO: 990303 - protein, 84 aa, Homo sapiens
VITLRCPVMLVVGDQAPHEDAVVECNSKLDPNHDLDTYKMAVTPGGQPQYDSAKSKLTEAFKYFLQCMGYMASITAMTRLSRSR

SEQ ID NO: 990304 - protein, 43 aa, Homo sapiens
MLTIAEGRCGILDFSSGQSKGRRNQKYLFPSSRPGYKVCRATR

SEQ ID NO: 990305 - protein, 70 aa, Homo sapiens
GVYRLADSPPEYASRLDRASPLSFSMARCSPLAAVLGGGRSHWMLWPVRTRELSTVVGVQVVAALSGYSG

SEQ ID NO: 990306 - protein, 40 aa, Homo sapiens
EQCAIGVVLQHTLWLAAASEELPALVPVTVVPPAAPCHSE

SEQ ID NO: 990307 - protein, 61 aa, Homo sapiens
VQDSRIVGMMKTLLLFVVLLLTWRVAGLGDQTVSDNELQEMSNQGSKYVNKEIHNAVGLGG

SEQ ID NO: 990308 - protein, 33 aa, Homo sapiens
CQCRARGHRVPLTEACTDSRIGGMMKTLLLECG

SEQ ID NO: 990309 - protein, 86 aa, Homo sapiens
TLSAHITLSIMTSHTPTPPTTNTADLKNTSGGMWVTLLPPHWVQNIKQIDTVILSLLWTVWSPLKSWSWQEPKLAALLIHSNHSYV

SEQ ID NO: 990310 - protein, 176 aa, Homo sapiens
VPILSQAVEEEEEDRYSRVLEKRIKKKDDPIGIHDYFGVSVCMNVDTVILKIDNYYDAILILLTYINAYSCAESRRAPSVAHENIHVEPNEYFKNELLTKTYVLKSKLAYYDPHPYRGTAIEYSTGCEIDWNEGKNVTLKTIKKKQKHRIWGTIRTVTEDFPKDSFFNFFSPHGIT

SEQ ID NO: 990311 - protein, 150 aa, Homo sapiens
MSSSDEGDTQVGPLHWSQEDKMAVTHTLPSPALRRAREGVLDSRKHRDTGRTVCAGGRCPAGPPTLPMPTALGLVWVGGSVREPSGAECSHEALALCHGPSCIVAPGACKPPCSCLRACCSLERGLHTQTPLILSLVSCMGPSRLCLSVG

SEQ ID NO: 990312 - protein, 73 aa, Homo sapiens
MLMFQDATQLRLSATEWSREYSRLTLVLCTATGLLLEISAASAKAASSMTSLSGNTRLTSPLPRASSAIILQF

SEQ ID NO: 990313 - protein, 36 aa, Homo sapiens
PSPACAPAVWVCSMLMYQDATVVEALEHEWSREYSR

SEQ ID NO: 990314 - protein, 89 aa, Homo sapiens
LPDSRQRATGKRSRLRPCAEDHDKASATEPLPLPGGQDQLLSAFSPMDPMTRCVVLCFEHEAPWHCGRTGRECAELELGPCRGYVGGGT

SEQ ID NO: 990315 - protein, 35 aa, Homo sapiens
VRGTGFTDEIKRYIKKTRRFQSGPPDHVQTYSHSD

SEQ ID NO: 990316 - protein, 40 aa, Homo sapiens
MGCDLRPDPERCRRVAELAVNHARLRHIPVHERRIAIMLS

SEQ ID NO: 990317 - protein, 94 aa, Homo sapiens
DKLLYKIRKLGICGGMPLYVPATREAEVDHRETQEVGAVVSRDYAYLLQPGVTRVTRVSSEKNRKLPQYEPDSPADSRKFGGSLLEIDRARHGE

SEQ ID NO: 990318 - protein, 50 aa, Homo sapiens
MTEFVVYAKGAGFASAVYGKAIVPIAVAAGFGARGMRLNVVFAPVDFADH

SEQ ID NO: 990319 - protein, 43 aa, Homo sapiens
MANCTSSTCKPDLVKRLLFKRLKAYFAEVLNSENTKIKSPHMR

SEQ ID NO: 990320 - protein, 106 aa, Homo sapiens
TLTCSYDLYDDCNDLHVHTCYNFGASIKSLSANVLVSWRTTGGRVFTEKALTIRQIIDEFDYILKNLKTEISFDSAIPLLGIYPKEYKSSYYKDTCTCMSLQNYPQ

SEQ ID NO: 990321 - protein, 41 aa, Homo sapiens
MVTFILTSLALPIEIVILPPVSHECSFGRSYRKQLSMYRSQ

SEQ ID NO: 990322 - protein, 124 aa, Homo sapiens
TSIGLEWTSGHGHQADASWEADGPSVSRIGGFLVSLTSRMKPRTLTVSVTAFQVARLESVPPDVQMYSEFFSFWWVCGLPGSGVKLQTFAVSVKLYKVALRELFVLSSGLVVSGVKLQIFPVEK

SEQ ID NO: 990323 - protein, 58 aa, Homo sapiens
IELGTVSSFCGTPGLVHRLFRPSPPDEHDAFLLPPHEHDAFRCLPMNTTMTLFLRFDP

SEQ ID NO: 990324 - protein, 100 aa, Homo sapiens
LAALEDTLKPTLDTHFTVAGVQVGGVTFTLADVQVGGVTHIHAVAGVQVGGVTHIHTVAGVQVGGVTFMLLQALQVSGVTHIHAVAGMQVGGVTHIHAFA

SEQ ID NO: 990325 - protein, 79 aa, Homo sapiens
MREEKESKEEEKGKHTRHGLADLSELQLRTLCIEVWPVLAVIGGVDAGLRVGGRCVHKQSGRHATLLGVVYEGSTSAKV

SEQ ID NO: 990326 - protein, 38 aa, Homo sapiens
MARRIGPGRGLTCFLSAASPALLTDVSGSYSLVPEREF

SEQ ID NO: 990327 - protein, 44 aa, Homo sapiens
NILSASRSRWSSESSNLCKERPGKNPSLPPVSSDCHPLPTPELP

SEQ ID NO: 990328 - protein, 134 aa, Homo sapiens
MFRPQPCHYINPETPGYVGFANLPNQVHRKSVKQGFAFTADGGRRLRSKKPRSLIDSLFLTDLYPDSVVPGAVQTIDRTVQIEASAVEIEERGVKLRLTVVDTPGYGDAINCRDCLETIISYIDEQFHRYLRDE

SEQ ID NO: 990329 - protein, 70 aa, Homo sapiens
MASVISLRRTHDLDGLDLFFLYPGLRGSPMHDRGTFLFLMEELRFAFRKEARLTMRPRLLLSGYSGGYRA

SEQ ID NO: 990330 - protein, 75 aa, Homo sapiens
GQVVFPGTGEALVAFSTLFLGDVIRVSGLQIGLVLVLVLPESVYFSLICLRFLLIILISVILLIGTHIFTLGLFF

SEQ ID NO: 990331 - protein, 37 aa, Homo sapiens
MVLSSAHFWWGLFLVPTAGRASRGSRTCYPPHCRASR

SEQ ID NO: 990332 - protein, 48 aa, Homo sapiens
EIPRLARQAGDPTLRSDISKAERRQRHRRLTEGRPYFKVSRCSCRASR

SEQ ID NO: 990333 - protein, 67 aa, Homo sapiens
GVLWCSSGSPFAQPPSQRPSQLLLAVALTRARAGARPAAHAGAPPPAISPLGGSGRARRGGPALAFV

SEQ ID NO: 990334 - protein, 52 aa, Homo sapiens
MCPIRENGMKEEIVMRVFCNIHSQSGRFVGNRKFSLFFDTALALVTTGCQCS

SEQ ID NO: 990335 - protein, 43 aa, Homo sapiens
TLSNGADQHEPGAELVRLCGHQQQRGAVMPGSPVVKGDCRASR

SEQ ID NO: 990336 - protein, 50 aa, Homo sapiens
MSQVPKATGTAPVQAYMQVGAAHTVPLPHGHTGSGQGLLCSLLSGYSGGY

SEQ ID NO: 990337 - protein, 33 aa, Homo sapiens
HAGTLLRGEGVEKKVDAREEESIRNSCRIRSSC

SEQ ID NO: 990338 - protein, 55 aa, Homo sapiens
PDYRRAPLLVIDPCIDGANGSQSASTRNTQARVVEVAQRFPQYDLRPFNTASLES

SEQ ID NO: 990339 - protein, 122 aa, Homo sapiens
TRVQAGATQYRKGRSREPGLGSDVGQCLETMLLAEYMKRLLHLWVPVYRDAVSLGWAGWRGDSGITVASGATYLQQMLDVRGGVDSRSLTARKHTLESTDGFCKPVPDQESGNSYSYLVRGS

SEQ ID NO: 990340 - protein, 61 aa, Homo sapiens
GLVMSARPAAARSWRRPGRRRERQVLGLDAVDDGRVDLLEVQVADALGVLADDRDVVAAVV

SEQ ID NO: 990341 - protein, 70 aa, Homo sapiens
FHYDTKNVDSIVVTFIMASKKSWYRLHLMSSFEEHLAYPDEAGYGIKETTNGFIHSFVHSLIHCWEYKGN

SEQ ID NO: 990342 - protein, 87 aa, Homo sapiens
EASVRITDVNATAERTYSRREIINSSPGERIGCDQAFQATQLQLPSSPSSTHNATQGTGTTQRKHNQSIRENTEQHCGILLALLFLS

SEQ ID NO: 990343 - protein, 34 aa, Homo sapiens
MALGCSSLALGPVFSSASHGYDTLDYFTIDPRLG

SEQ ID NO: 990344 - protein, 109 aa, Homo sapiens
FDTWAHAIIDIQKNIAWLNTEREQAFTDSGFDYDIASTSNFMKVSRKQPHILSDWLWQFFWDSPIFLKEIAPEDGHFKIHMWPKPASNVDRKTIFQLSSCFIQGGKVSK

SEQ ID NO: 990345 - protein, 102 aa, Homo sapiens
TFAQWEERRIFLAYKNNLYPRNLDSHQNATDDVMDTLMPRFTQLCSYLVTVVFSHYAQPPELRRTRINLTSPTNKSADVTYSFSDVLLLTIFVEWREVRLSR

SEQ ID NO: 990346 - protein, 44 aa, Homo sapiens
MSRLCCTVWYKHHMQLSQDTSRFVEQVAASRISGNLDAPEGGFD

SEQ ID NO: 990347 - protein, 45 aa, Homo sapiens
CGRSNAPLLFHGLCVCSWDMPGLTWLAGRTDLDWVTGLDGLATLP

SEQ ID NO: 990348 - protein, 87 aa, Homo sapiens
VSLLALRCWIIGLVLKPSSVLLIKLGKDERGNPLTYPADAIVSSFDNDIRKQVCAESKPSFWANLLQHVICLLLQRLPKLYRLNALI

SEQ ID NO: 990349 - protein, 38 aa, Homo sapiens
MLSYCCARTVHVLRNGQFDCRNPRRRYLKGYRDERHNE

SEQ ID NO: 990350 - protein, 32 aa, Homo sapiens
RSDFCWTLSGGWSVQSLELEMRQALLYCRASR

SEQ ID NO: 990351 - protein, 99 aa, Homo sapiens
CLACSSRCGVGRARGPGVAVFGASGPVVGRARGAGGGLRRTNPIVGPGLRRPLLAPRWPRPHFLVGLSRGLTASRVSHLLPADPIALFARSRLSCLIWA

SEQ ID NO: 990352 - protein, 80 aa, Homo sapiens
IPDSRQARVGWVLCWSCRRVGAASCSAHPLSIPATCQAPSGVFETACQASSRRTECPGDSTFLPGGRGAVGLGRGGTGAR

SEQ ID NO: 990353 - protein, 82 aa, Homo sapiens
QESAPAKSHAEASHPWTMPPEDKEPSDGEGMGCRMALELPPENTLYNALSHSVRITYADKPMLALMERPGSVRDFGDRWNTD

SEQ ID NO: 990354 - protein, 31 aa, Homo sapiens
MNALVCGLCALGSHVVGVQVVAALQVVGLVG

SEQ ID NO: 990355 - protein, 54 aa, Homo sapiens
SAALWCPGTPAGAPSAPCLSPPRSAVPVSWLRCVLSAVRAAAVGGSPAVRRSAH

SEQ ID NO: 990356 - protein, 33 aa, Homo sapiens
TDLLSFFKDTFGRGPQSHSSSSVNEAIATLRRM

SEQ ID NO: 990357 - protein, 35 aa, Homo sapiens
CYYSAASTLLWQAFWECVVVAWVYGADRFMDDIAC

SEQ ID NO: 990358 - protein, 44 aa, Homo sapiens
PARTALRYSQIRSSWLLPKQFSHRVRCRASRGCRASRVLSGLVG

SEQ ID NO: 990359 - protein, 58 aa, Homo sapiens
AGRQSEYYGLEICLKSSNQAWKQLLGAGRRLQSRILEIFSHADLWTPSENGAGFLYVS

SEQ ID NO: 990360 - protein, 81 aa, Homo sapiens
STMRCKSVLYHSRLIKEYSRRDTIDSVDGGYDMGSSASHKWISVRRGIFTIKAIVLASHIKLFAQEFDSSWPVACESYTVS

SEQ ID NO: 990361 - protein, 89 aa, Homo sapiens
LTLAGSHPTSPTGPHSCPGVSEVHGLWCPGEGLKRGGAHSPHLEWHWAHSCPSLGLRWTSGSLRVCCALSMRPPHPMMCLLVGCCRASR

SEQ ID NO: 990362 - protein, 42 aa, Homo sapiens
ELQGVPSIYTGFLPHWMQSIDGFIAVSSLLQLWYLRLVGGRA

SEQ ID NO: 990363 - protein, 38 aa, Homo sapiens
MLTVTVGVPTAGSRWFALFFLLFPRIDFFHRYPFDETN

SEQ ID NO: 990364 - protein, 40 aa, Homo sapiens
MIQRGDDTARFRISSEVNAKTVGSVGFAAARQRPRVGLVG

SEQ ID NO: 990365 - protein, 48 aa, Homo sapiens
KHVELDSPDCRLIEEAYTALERTGKQERCFIGAARSGAVVGLASGGRL

SEQ ID NO: 990366 - protein, 49 aa, Homo sapiens
VHIEDRWRTLVPAVGADGAELKVYEGSGYALPDTDRDRLHAELLAFIDS

SEQ ID NO: 990367 - protein, 51 aa, Homo sapiens
MNYRRGSPSYYDNRIPFNNWDDKSIRKAFIRKVFLGAVNLQLVGDPVGLVG

SEQ ID NO: 990368 - protein, 70 aa, Homo sapiens
LYPTSPTAGGGEQRAACRDRRRNSPGQELLQPEVLHLAAPSQVEAAEGRHWVDKKAEAMCPGDAYTPVSG

SEQ ID NO: 990369 - protein, 39 aa, Homo sapiens
HGVELPLQGSPVADRAFNAFVVFVRSIPWFISSRLMQPL

SEQ ID NO: 990370 - protein, 72 aa, Homo sapiens
FWVTLRIPPTSRQPVVVAAGSCRDGGANSPVQEVLQPEVLHLAAPSQVEAWEGRHCGQKLEAVSVMRTHPVG

SEQ ID NO: 990371 - protein, 55 aa, Homo sapiens
LEDTFPTSPTDWHADSYYNTTYVLLCLCIRSVVCSQSPSSGSQTKFDFTSCRASR

SEQ ID NO: 990372 - protein, 53 aa, Homo sapiens
EDPLSSPFVRDKSTSSMRDVSSSPIKGWHFFSYSSTGINQAVGVIFHIPKTKF

SEQ ID NO: 990373 - protein, 43 aa, Homo sapiens
FTREKGDEIAHGCLTDVERGMRTQADLAPGATSFNYYYNPYLY

SEQ ID NO: 990374 - protein, 37 aa, Homo sapiens
DAARPSPQLTALGGLLIAAVLAGEQAAGERAPDQNRA

SEQ ID NO: 990375 - protein, 37 aa, Homo sapiens
CHPLRGQDSLFYSGSNDDIVFMHVDEPERHWVWHNLY

SEQ ID NO: 990376 - protein, 51 aa, Homo sapiens
GSLGNYGSLGLSSEHCVISYPGPWLSEALFFFLVSETKSCFGPPALKDIVA

SEQ ID NO: 990377 - protein, 166 aa, Homo sapiens
RYLRIRVIPFVMIPKLSCLAACPGRGRTLAVAVFLRLLSQHPAPLEEQGLWVPEGQRARITVAALDASNLLGSFHHPQRSEHDVLFQVTQFPSRGQLLVSEEPLPAGQPHLLQSQLAAGQLVYSHGGGGTQQDGFHFRAHLQAPAGAPWLGPQTSEAFAITKGDRT

SEQ ID NO: 990378 - protein, 44 aa, Homo sapiens
YNFRGLLTTPGHDQPDHEGLFPASKRRTSKKLRLQSGYREYKMK

SEQ ID NO: 990379 - protein, 81 aa, Homo sapiens
MICFILLISTAILRRRNYCDRLGDMSEVPQLGSSREKETDNEDTGLPIIHAILPSRNLTGSIQVMECFFMIVVAVKSVKTA

SEQ ID NO: 990380 - protein, 113 aa, Homo sapiens
YFHGQLKHAGRHMRERENHLWVPQTEPGGAGSTHVCLPAPLGIYLDLPTDQKLVEKLIVLACLSSRGALVLPSSEAPHYCLQLPLKGTKSESMWLVWGEEEEEKGAGEGTRIY

SEQ ID NO: 990381 - protein, 34 aa, Homo sapiens
MYVMPFSFMTSANSYQERMGCLRNFIFTGHTVGK

SEQ ID NO: 990382 - protein, 69 aa, Homo sapiens
IREDPVIQGFGSSDVYVITQAYSSRAGTTEHLASDITPSYGDCPVPCRMFSKSSLDLSSLDLSNSCHQS

SEQ ID NO: 990383 - protein, 162 aa, Homo sapiens
PCHPLREEGLESGDAGLQVIMADSEICGTKGPTFQRHLLDTRFELALDIPEEEARYSAKKLEQLNAMREQDEYSFQDEQEKPLPVPSNQCCNWELFVGWGEQHNDDPDSAVDDRDSDYRSETSNSIPPPYYTTSQPNASVHQYSVRPPPLGSRESYSDSMHS

SEQ ID NO: 990384 - protein, 59 aa, Homo sapiens
LSRGLRKAFYTKFISSPNDTTTDRILRLAVVMHMQAGRKWASLQHLVPLSCRVSLISIQ

SEQ ID NO: 990385 - protein, 91 aa, Homo sapiens
RGSFTLRTAVSGHPGSTPVCVKKDGPALLAQRWYSFLGSEPAGITALCAHPSAERGPGPSSMEVVTQEQAEPSLRSRQGPTLSTLMGGPSG

SEQ ID NO: 990386 - protein, 56 aa, Homo sapiens
MGFWWNTCNFRHDIFNIFHGNQGVILFSFQTTLCPCFINDINGFIWQETIINELCR

SEQ ID NO: 990387 - protein, 34 aa, Homo sapiens
RIFALTTQLGRCNIFTLKKRQDMVGVLALGIDGS

SEQ ID NO: 990388 - protein, 55 aa, Homo sapiens
YANPSTTMLIIIRWSAWTRKVSSRISSKFCYQDTANKLLTFLYVKFSGFKNIQTI

SEQ ID NO: 990389 - protein, 98 aa, Homo sapiens
SRDLVSPPHYTSQSVSLGIVLTLLAGICLSCTRRARTDSEEGSSGSWGFPPGHSLALPRDEATLSEQRVVTLSFLLPFRGRRRVVTFRGELGQESMVA

SEQ ID NO: 990390 - protein, 180 aa, Homo sapiens
RFSTHPSCMQVLPQEAEQGLMGPSVGHLVASSRDLACLMPSPVCALEVWPGFKCTEGQVAANRTSSPGRKLLSGDAAYGLGASCGPDWSLDCRVATGLRSPLPLWAAPPHHGAWAWGASSKAGFALGASGPSVHIRYRDKLPRAGGGGFWAPKGRRPGSLGWALWGCWGQELRWSFPFQR

SEQ ID NO: 990391 - protein, 69 aa, Homo sapiens
RKARSRLAELRGPRGLYDGPGCEVTVRRKTVTPASSAKTSPAKQQAPPVRNLHQSGFSLAGAQIDDNIP

SEQ ID NO: 990392 - protein, 63 aa, Homo sapiens
FSQGGNCTFKEKISRAAFHNAAAVVIYNNKSKEEPVTMTHPGTGDIIAVMITELRGKDILSYL

SEQ ID NO: 990393 - protein, 93 aa, Homo sapiens
MMAGDHRGRVRLSALAERFLADLLRSLYLSSQRQRDGLKLVSPLPAQGLQGKAQVVRFCQRTKIKIILGIDTGRNIDVELQQFKKLSLKLVHV

SEQ ID NO: 990394 - protein, 59 aa, Homo sapiens
LVMVLASISISSLYAVPLPAGTAVLHRLEPMSLIPSEDARSQCLPQGRIWTWAQMACHR

SEQ ID NO: 990395 - protein, 71 aa, Homo sapiens
GLRTHATLLTGRGLACPLLLSCPCHALLTSSPPPGPGPALAPGLLHCLLLASPPLVLPPTVDCPCRAQSDL

SEQ ID NO: 990396 - protein, 102 aa, Homo sapiens
RLARQRANHGCKSKSPKAEELGVGGSRAGSMGHKRKMKAGRLGRLSRLRESALPSSSVCFILATRAADGMVPTQMEGGSASPSGLTQMLISLGSTLTVGLVG

SEQ ID NO: 990397 - protein, 147 aa, Homo sapiens
TSKHMQAKGSYWASGLLSPWLGRKGREDGWGSLFGIDDVHEVRDLRGSITHKRSHPHHGWLARLLARLPHVTERSIKLIAGALEPPASEIVGLQHILRSFSLYFLGTVGRVARLAKYQLAHTWLKASDDLAPVLHVICDDLCLLENN

SEQ ID NO: 990398 - protein, 50 aa, Homo sapiens
MSVRYMIPSVPGSYSARTISVQRYPVRRRDFSKRVEGHRQDDDQADDDLL

SEQ ID NO: 990399 - protein, 147 aa, Homo sapiens
MTVLSELTSGIFSDEKIPGIGTLTQDTLWCFSHSERHYLKIGTTVRCALLPTSPSAMIVSFLETYPRHAELARTMVQSHFFPCPPTPGDWLRGGIIGYLSAGYLEPTQVSLLSMEEDIDTRKINNSILRDHSNATEADIISTVEFNH

SEQ ID NO: 990400 - protein, 41 aa, Homo sapiens
TVPQEPCHISFRPNSSPLLPTVWATMKQREDPERSSCQGLP

SEQ ID NO: 990401 - protein, 44 aa, Homo sapiens
KTIMVLVGLSGATIASNLPYNDIVTSASAKYGYDPLLIHAVIQK

SEQ ID NO: 990402 - protein, 112 aa, Homo sapiens
RVIPLRKLPPACSQVTLVGLLREVYEGTADNVLSLVEVWAAPPDTRVYCGHEYTINNLKFARHVEPGNAAIREKLAWAKEKYSIGEPTVPSTLAEEFTYNPFMRVREKTVQQ

SEQ ID NO: 990403 - protein, 42 aa, Homo sapiens
LGKKVEKVVVSTDGHVLDSKHERIMNTGYMAAKKHLEINPDH

SEQ ID NO: 990404 - protein, 52 aa, Homo sapiens
ALAGSLSPFVMSDQPGNTSSEITTKDLKEKKEVVEEAENGRDALANGNANRG

SEQ ID NO: 990405 - protein, 76 aa, Homo sapiens
DPSSPFVREPLVGSVRGNVGLKAPRRVPTGALPSGAVRRGLLFSRMVEPLAACTLHLEKPQTLNPACDSRLNSAKL

SEQ ID NO: 990406 - protein, 121 aa, Homo sapiens
YRILCHPPSCACCFKDTCTRMFIVALLTIAKTWNQPKCPSMIDWIKKLWHIYTMEYYAAIKNDEFMSFVGTWMKLETIILSKLSQGQKNKKLNALIHRWELNNENTWIQGGEHHATHRGLS

SEQ ID NO: 990407 - protein, 49 aa, Homo sapiens
LDASWSSSRICMRSLNLTSEIFEKEKGAVVGELRRHLDSAGSIAWDELM

SEQ ID NO: 990408 - protein, 80 aa, Homo sapiens
MIGVGNTEEEKRTRGEKRASVGIFSDNLREFKGIAKRLTRTDKVRATRFYVLKRLLGELYGVMSLCIQYLSCKSEIDVGV

SEQ ID NO: 990409 - protein, 69 aa, Homo sapiens
NHAVWDRYYSKPKPPKKIHSNIGINDIDILHQYSCINSSTSSSSYTIQKYMLIVYYIADFQSGVDASVI

SEQ ID NO: 990410 - protein, 74 aa, Homo sapiens
GERRKGGMQRSPPRMMSDSCRWRERCPIPEAESQKKKKKPEFPIGGLLVFVYHFWKPEIGTKGCIINFYAHWVD

SEQ ID NO: 990411 - protein, 53 aa, Homo sapiens
VEHDLVKVAMRGHVGVHGGLSHCSRPQELSSVLVDAMNSYYHALGSGRSKLSR

SEQ ID NO: 990412 - protein, 51 aa, Homo sapiens
TFPQERKASYMAAQEKNEEEQKAETLINPSDLMRFIHYHRNRTGPFDSITS

SEQ ID NO: 990413 - protein, 71 aa, Homo sapiens
GLPFLPSSLLSFHFYFLGQELLLEAHRSVVDEEFPILVSESSTLDFTIKPNWIRIPNLELKRLQLTYGYLN

SEQ ID NO: 990414 - protein, 74 aa, Homo sapiens
VLVWIGQRHLQDLGPALDSLTAPKPTKSNAALSQQYQTIGVGAQILRDLGVEKMKLLSSPLRFNALSGFNLEVV

SEQ ID NO: 990415 - protein, 73 aa, Homo sapiens
KIHTASLGFSGPKIQRWSKKALACARHSLIIWSEGVASKPFDPVPGTKKAAVMTASFIVSLQPCRTVSFSLFS

SEQ ID NO: 990416 - protein, 44 aa, Homo sapiens
ATEKNEEEQKAETLINPSDLMRFIHYHRNRTGPFDSITSPPVEK

SEQ ID NO: 990417 - protein, 69 aa, Homo sapiens
ADLLGIAWWLAITKLASDLPFLSSFTVVTLTLRTGSLELDKRMGMIMPVARVCFAVLAEIGIVAHCALV

SEQ ID NO: 990418 - protein, 37 aa, Homo sapiens
VLKNADDDRRSRLGARQQRGERLLVLDLLQRAVGSPR

SEQ ID NO: 990419 - protein, 50 aa, Homo sapiens
PSPGWLTAPRRRRDGWAEEPAPLDALPVAGLRIGVPRGLLFTETEPIVAE

SEQ ID NO: 990420 - protein, 41 aa, Homo sapiens
MLVPIVDWYDGATHLNVLALPEGNVSSSIEFYNLIESTSSI

SEQ ID NO: 990421 - protein, 51 aa, Homo sapiens
MNALWVLSSHTVSSFSVLFFFKPSVHVTVECTSSRQNAKVKERRRGILLDV

SEQ ID NO: 990422 - protein, 35 aa, Homo sapiens
NYMQGSDRTHKIHFPSILVAFMLTAAWFHDSQMAT

SEQ ID NO: 990423 - protein, 35 aa, Homo sapiens
VDIKERCARCLAPSVYWHPDDWCFLGVFACKHFLD

SEQ ID NO: 990424 - protein, 37 aa, Homo sapiens
RTVFPKFSGSRDMDWFAEMQQEAAAPSHAENSVTSQV

SEQ ID NO: 990425 - protein, 40 aa, Homo sapiens
SRSVPGSWGMSKKLRATGHYVCASPELCAFTIRKKEYLQE

SEQ ID NO: 990426 - protein, 72 aa, Homo sapiens
MSSYPIWKPVEKYRVEKYLGKRTLVKSTLVKSTHGRSTLGKSTLGKSSLRKSDLGKSTLVKSALEKSSLWKS

SEQ ID NO: 990427 - protein, 36 aa, Homo sapiens
LLRLSVPVLLIGFDRDGDVDTCKVLWCFPIWFDPVE

SEQ ID NO: 990428 - protein, 99 aa, Homo sapiens
RASVLRSSDCTVLWFFVMDSTLVVNEDQAIEEVDIEKYTCVVIYDEYDWGFEHQLVEKDDLLLSVPPPLFPDIFCDSSISHFPCVNPSMDASAFDHSYN

SEQ ID NO: 990429 - protein, 75 aa, Homo sapiens
MRRLVSRGFKTRTIFLLIDGCRRCCCCCYCYMCVCMCVRGCTRTVCVCVCVRVCGAEEVEVAWPSLLGVALMNSL

SEQ ID NO: 990430 - protein, 59 aa, Homo sapiens
AVRRRVGDPGTVCRSRSTTGQPGRGHACCPAPPRSRCVAVPARSTERNASRDLDVPVRK

SEQ ID NO: 990431 - protein, 149 aa, Homo sapiens
LHRLTNLCCTVNDEYATLAYLFHSSQMHCFPAIFLTTACRRLQGQTSGSHSKQSSLNEQPQPNTMSAFEQFHSHYAAIFLMLLYSSSMLPQASQCFTCSFTMKLYIVLLSKIHLPQRYRCTTPFKMFHGRLQWLKPVISALSDAAVGGL

SEQ ID NO: 990432 - protein, 37 aa, Homo sapiens
RGYYDKRLLEVTCRMCAWVNELFYETGLTNPDIAQKL

SEQ ID NO: 990433 - protein, 41 aa, Homo sapiens
PTSREGQCAIRSLAREALSDMLCDSDHMNDGSQTKRNDVDR

SEQ ID NO: 990434 - protein, 37 aa, Homo sapiens
RCWTSQRRPRTSSAGHSSSAKVRSRSAISFIARADSE

SEQ ID NO: 990435 - protein, 70 aa, Homo sapiens
EDVAMSLGTFRSYSPSTRGITFSFLLDGRKLLVLGRELKASVIFPAALSVTSLVTLLSTAVRVSPGGLLR

SEQ ID NO: 990436 - protein, 54 aa, Homo sapiens
MCPFLANSWCYTLTNVFTWVLALTLCLHQDLLNCMRCIGLSTEVAEVDRGFIDL

SEQ ID NO: 990437 - protein, 125 aa, Homo sapiens
YPHTGTRVACVVHLLVASLVLNGFLSTWDPPETSFSAAEDGRSAVTKVLKHRIRTEAMMSPSLLPLGASTVLRSQTKICGWSGLRRERSYSLVIARTRIGQVPKEAYNSCITRKRKPLPAGGICS

SEQ ID NO: 990438 - protein, 69 aa, Homo sapiens
MSIRSTHGVSKRELTGGQYNLPVEQKGKSSLDLDFQYEYSTVKAGPHDPSDLLGFKQEVSEQLPQGLLA

SEQ ID NO: 990439 - protein, 50 aa, Homo sapiens
MCRPIYRYEWGNWSHVHSLPSLVLRVQLELSFTLSPEIAKLGFTKRHTQG

SEQ ID NO: 990440 - protein, 127 aa, Homo sapiens
PSAVGHAWGSALVLYLPLPASATTQLALDAGAPVGSAHPGKRTGPEPHSLSCVLFDKSLNLFELQCSPLQNSEDDSICFMRLLWLSKALTHTESLAHDKGLRSASCHWHSWNYGRGPQEQQQGGLED

SEQ ID NO: 990441 - protein, 54 aa, Homo sapiens
TYHRINILFCPAARPPFQENRISILCSICLININRQSIVPTRVHALIGVSCAVQ

SEQ ID NO: 990442 - protein, 48 aa, Homo sapiens
GPLVYTDFRGTWRRDVCELFYRKLTGLPRDQSPGLFMRYPGVIFISHY

SEQ ID NO: 990443 - protein, 59 aa, Homo sapiens
RKLEKRNEGFPHAQRTLGFSCGPFTQGLDAYRLQVPNVCLQSNTIVPGVVLVVILSFLN

SEQ ID NO: 990444 - protein, 82 aa, Homo sapiens
ARAWPYGIARYTAHLCRRRGAALRGLPMSRIWESGLQAARARNLPSSANTSTVSPGRALPFRRPTEPAKIQGWRRSRERSLP

SEQ ID NO: 990445 - protein, 50 aa, Homo sapiens
MASAMFFSLSLLACGALLWGTTGLSSLFISSSNLVSILGKVIQLSCLFKQ

SEQ ID NO: 990446 - protein, 36 aa, Homo sapiens
HGQSRILVAGWQSILKNPKFEQPGQTIKVAANQVWF

SEQ ID NO: 990447 - protein, 38 aa, Homo sapiens
MVCTIGPRVEPYTGKVKKHSSFYGLNCDSQKFEHMNEM

SEQ ID NO: 990448 - protein, 80 aa, Homo sapiens
MMAQDVPRHGRRHQVVNGKSSGDRSRIVVDDTSRVFACTSRIRVCLDKSAASGASQARYCSSGVRANACSSVVPGRAITT

SEQ ID NO: 990449 - protein, 200 aa, Homo sapiens
LLRLTDPDPHTYKRSYLLSHWKTHLLIPVPDGKLLQTLTDADPHSLYQNSYPPLDIEQTPESSDSSYQSGNSLSTWTSPRILTTRCQYLTSFRHGQTQILIPGPDPTSSDTDGHRSSYLYPASLPQTLEDSGLHSCARCYLLRHWKPKGLKPESKLTILKHWKTQILISVPGATSSDMEDPYPHTCARCYLLRHGKNQIL

SEQ ID NO: 990450 - protein, 39 aa, Homo sapiens
MQQQVCKVHSILKCCGDRTRLQGFRRDLSVGISTVLKLP

SEQ ID NO: 990451 - protein, 65 aa, Homo sapiens
SIGSPESWMLYASYVNRVHVFTTLIRDDVVLTNLPYTFFTNLLKTMEHAEKLTNAAELKRVGYIF

SEQ ID NO: 990452 - protein, 128 aa, Homo sapiens
PPRRKLIQYTLQNRFLTHSGKESEVAIQGSHERPEYTICILSRWGPGVWRCIPCAPNLAQDVGHLSNTLINPYLETVFKHHAELIQNRIQFHLQLLQTVCSFKVQLLASHGLKHFLRLDPQLLQRCHQ

SEQ ID NO: 990453 - protein, 36 aa, Homo sapiens
GTSQGLLCELRPCQKHYVCELSPPCQKALLCELRPL

SEQ ID NO: 990454 - protein, 159 aa, Homo sapiens
MPVLGLLLPAHFCMRNCISLLSLTGLRTYMSSRPTPILWKRVSGPMVLLTTRYRGSAWMPRRFKCCRVRQASSMLRLAFREASGSRSFSGTLKKTTPSSGEIRFFTQSLELLEPWDCSSSSSANLRCSSPLMPGRLSDPMCVSSTELNAVKCRTGSKKD

SEQ ID NO: 990455 - protein, 45 aa, Homo sapiens
PEPPTREAQGQGSGFLISSDGYIVTNNHLVQGARGSGTVDRVTVT

SEQ ID NO: 990456 - protein, 53 aa, Homo sapiens
IHFTRLARKGLDIALGKPVFVVEIDPARNRVVLGEQQHLQRRGMLVKNINLQK

SEQ ID NO: 990457 - protein, 39 aa, Homo sapiens
TAVRYKVKSGTSSKSSADIRYKFKDNFFSKANSSFVRVG

SEQ ID NO: 990458 - protein, 109 aa, Homo sapiens
AEVIQRIPQEQGSVGSSDDGVVRSDVFKLKEFWSSQEEIVELEGVQGGGGEPVLGVLLLGNPLWASLMAQLGGARTRSLKGSSSSLKPSMYWGMGGLILGEELAEAGPG

SEQ ID NO: 990459 - protein, 47 aa, Homo sapiens
DRVLRGVMAGRMHGACGNREKLGSEVGADAVGLDRGDNTFASCRASR

SEQ ID NO: 990460 - protein, 91 aa, Homo sapiens
VAKTVGSNKGAIIVTHGWAVFVKATRDSSSPCVMLEEETVHIHSSLAVVEVDACCHPMRSATWSKMQQNGYENPTYKFFEQIQNYNPGKVF

SEQ ID NO: 990461 - protein, 55 aa, Homo sapiens
RYEPGENGVLTVRWEEEDVTAVWIGTLFGQSRCRNNTFPYSPGSKSVGLVGGDEL

SEQ ID NO: 990462 - protein, 36 aa, Homo sapiens
RARYLSLTVDVCLNLSEYRIRISRKRIRLVVPDDVD

SEQ ID NO: 990463 - protein, 137 aa, Homo sapiens
TFHRPQVKDIPTEWEKIFTNYLFDQLITRRYKRSNDYRKEANNPIKTRAKDLDRHFSKEETQMAIRHMKRCSTPLTNREMQIKTTLRYHHTPVKIPYMQKRGNKKCWQVCREKGTFVPHRVKRHAHRMGENIYKLSI

SEQ ID NO: 990464 - protein, 42 aa, Homo sapiens
RGFLFATIGGRWSAWRLKTAALTLKVAGQLIPWFLFYLFGLI

SEQ ID NO: 990465 - protein, 56 aa, Homo sapiens
DRVVRALRSGVNLRSRSDSSSRTAGIQLSATCRLYAALEGAVEPAEDVNPRKTAEC

SEQ ID NO: 990466 - protein, 55 aa, Homo sapiens
TVLHWGLAFSGVASSFTGDLAFSGGLCFFLHWGLGLLGTLLPSPVENVRGLRLES

SEQ ID NO: 990467 - protein, 61 aa, Homo sapiens
RSAETAARLYFDARTLEEEQVVNILYLALGTLKWVDPNNAANIRHAPLILVPVALERGNAA

SEQ ID NO: 990468 - protein, 78 aa, Homo sapiens
HRPRTHRSLPSGRELTRAQDAQITPVRPGADTGPGRTDHSLSGRELTRSQDGQITLVQPKPSGMDGTCSEPVSGSDRT

SEQ ID NO: 990469 - protein, 74 aa, Homo sapiens
IPLTPQQSQALGIPLTPEQAQALGIPLTPQQAQALGVPLTPQQAQALGIPLTPQQAQALGVSLTPEQAQASGVP

SEQ ID NO: 990470 - protein, 40 aa, Homo sapiens
IRGEDEGKRVVLVKDDPCSDRKRSPYTHTCLSLFPPPFPL

SEQ ID NO: 990471 - protein, 127 aa, Homo sapiens
DLEDLRSHPPTVLFEARAPSPPYMRDDAGENREVLGLGLRHFVPSPLVGLVQRSNVEDALSTNKPESGNSVNRLSNQQNEANCIKHGTPDEDKERTAAFPGQYNGLKAKRDKVTADCDSCEEGWVES

SEQ ID NO: 990472 - protein, 36 aa, Homo sapiens
AEKGIIRQEREREKPGKGRSDETVRDKDDTHVTEDI

SEQ ID NO: 990473 - protein, 50 aa, Homo sapiens
TFAQGTKGILKLLRNAGVLSDVLKVDCACVVNANMKRRYYGCVLLSARYS

SEQ ID NO: 990474 - protein, 41 aa, Homo sapiens
TGGHHIDANLVRIPIGIGTTARTPGLKRLQLSSRVARIQER

SEQ ID NO: 990475 - protein, 66 aa, Homo sapiens
MCAVIMMMLIEHAVSTQKWLDTQGVVAHFQARHYNKCVYANTPHDEFLCMTHCISCESMSTAEPYV

SEQ ID NO: 990476 - protein, 138 aa, Homo sapiens
LAGSSLSTHPSQGVVIVQPHLGNHTSPTDLCNSPIRRVPYMRPCQQGLGSDTQSYVESRQSSHLGTCRDPGVLNTPAPGFPERWEIHLYISLGRELNPGSQAATFCGPHFHSTSQVKTDWRGIPASQWQWIRVHQRQL

SEQ ID NO: 990477 - protein, 68 aa, Homo sapiens
TEATKDTHMSSDYRKMYDDKKLGQVTYVLPERHGDSDRTPRRQTSANPPTSQHPEEMEGRQENEEPTR

SEQ ID NO: 990478 - protein, 77 aa, Homo sapiens
RILSGSCDVQVAKHKDYVPGHFPTKTPDDEGQALTGHFFGSGRTSGPQKASCDFSCASSSFLRSSSCADISPSVGNS

SEQ ID NO: 990479 - protein, 123 aa, Homo sapiens
ILSHPPSSRHRSYFFFFHLSHFFLLRYFYYFVFNPKLDMSGVCSAPTDIRVILLRISRIHIVTFFSQWATHKLYPSELVNSAGQQHAVVMQVGTLLTACLFGDVCASEDEFRKHPSSPGVRIC

SEQ ID NO: 990480 - protein, 156 aa, Homo sapiens
ACEKCSEGFDHKILIVRLKNVFDMTLLQYWHLQATALYNQVIWNLKVTSVSMVRSALRALDVSLALRYYDSICRKCQCHGHVDPVKTPKFVKPESGECINCLHNTTGFWCENCLEGYVHDLEGNCIKKEVILPTPEGSTILVSNASLTTSVPTPVI

SEQ ID NO: 990481 - protein, 82 aa, Homo sapiens
DKDRVIPFVRSDQFIPSSGTVLVFSFFCNPLCPDTPNQLKINALPPASRSLTNVTAYPAKNLAQPRTLKYDLGRTHSPCKIP

SEQ ID NO: 990482 - protein, 38 aa, Homo sapiens
VIQRIRVIPFVKLSTKRSLFPEPALPWLPSRSPLASLA

SEQ ID NO: 990483 - protein, 53 aa, Homo sapiens
SKSGAYLIPLLERLDLKKENIQAMVIVPTKELALQVSRNLHSGPAKHMGTGPK

SEQ ID NO: 990484 - protein, 112 aa, Homo sapiens
SSSQCVDVVMLLGSLRMRGHFPESHGSHADLYFYEVLKRGKRRAGAAEKAVTKEEFQGEWTAPAPEFTATQPEVADWSEGVQVPSVPIQQFPTEDWSAQPATEDWSAAPTAQ

SEQ ID NO: 990485 - protein, 166 aa, Homo sapiens
GYKIFLATIGGECVRSVLLAAVVNSSAGTACFSLSAACRLYAALRGGMEPMQIDVDPQEEPQNAPDVNYVVENPSLDLEQYAASYSGLMRIERLQSIADHCPTLRVQALKMALSFVQRPFTVYMYEEIHPKLSEATRELQNAPDAIPESGVQPPALDTAWVARTRK

SEQ ID NO: 990486 - protein, 59 aa, Homo sapiens
PIILITICHIHGAELEHLMVAKVRSDFVDAIVSPMVIAPQPSITHKPHSGNGDAETYRP

SEQ ID NO: 990487 - protein, 57 aa, Homo sapiens
APRSYRLLEEHDFREYEVAVKASDVFLAVAAYQELASQVDCPLHLGITEAGGLIGGT

SEQ ID NO: 990488 - protein, 58 aa, Homo sapiens
SHGRYMNVWVTLGLGLVTFGPEIHENYRIKGIEERSTGAGGVGILDGPSQNMEAIASA

SEQ ID NO: 990489 - protein, 48 aa, Homo sapiens
QRFAGGVVYYFLGGQITLVPYQQLVDICTGHNDLFPGSHWFNSYGNGL

SEQ ID NO: 990490 - protein, 131 aa, Homo sapiens
MDNEWVATQLVVIIVCNEIKASVACAAAVLLTRYDALAIMSHDAFTVIKNCNTSGIQTEWSPPLTMLFLCATKFSASAPSSSTDITSFLSSDPSSLPKVPVTSSEAKTQGSGPAVTATKKATTSLGLCIEI

SEQ ID NO: 990491 - protein, 50 aa, Homo sapiens
LEDPGRNGERIHGLLEAGLASLVSEGNIHADKIREKADSMERRHKKNQDA

SEQ ID NO: 990492 - protein, 112 aa, Homo sapiens
SGRRGDTPCPDDAERPGNPRVSAVLCYFEGGLIGHGGGRTIVSEYSSIAVPKQRKVRGGHSMADKSLNKTELVAKIAASTGQSQATVDAVLGGLFDTLAESVGSGTKVSIPG

SEQ ID NO: 990493 - protein, 32 aa, Homo sapiens
MVQGGPRPPQGPGVLLSIAHGPLHLGQVSPGD

SEQ ID NO: 990494 - protein, 45 aa, Homo sapiens
STGSVQIPGDSMFEYIGLPQKRTRTDIGIISNQMLLVSHRLISHG

SEQ ID NO: 990495 - protein, 34 aa, Homo sapiens
SGEDKGPEGDDAKLEAELSRWRNGENVPETERLA

SEQ ID NO: 990496 - protein, 43 aa, Homo sapiens
LTEEGQPKLSENQTTVSLTQSPSELPWIKSAATVQFLLYYELI

SEQ ID NO: 990497 - protein, 63 aa, Homo sapiens
MKRRSRARRLRAVIYERVYWAQHLSYWGLLHSALDMLNVGTLTETHDFFQDMGYDGPYRAVRT

SEQ ID NO: 990498 - protein, 65 aa, Homo sapiens
AEFMVIQTYLYDVSMIKGALTVASSCATLYGKAGTQCFRDSSPSDEVADHYQPTIYHFRVVFAGA

SEQ ID NO: 990499 - protein, 44 aa, Homo sapiens
MAEHGYQPTIYHFRVVSGGAGVELSLFLVQPLNQVNAQALAIYI

SEQ ID NO: 990500 - protein, 36 aa, Homo sapiens
VFVLEGLFLRVGVLRLWRVEGRLQYPMEKGPRIAAG

SEQ ID NO: 990501 - protein, 48 aa, Homo sapiens
SRNLYNKVEMGQKRASEDTTSVFIIQEIFSQDQKKMPGMIYNPSLVEK

SEQ ID NO: 990502 - protein, 50 aa, Homo sapiens
EYEYVHIFEGYETIWKMDSYAFKQRIRKIEKKKLNGRIIRIARKEESMLI

SEQ ID NO: 990503 - protein, 62 aa, Homo sapiens
YFPQGESLRKEPSREDRCVECDTYMCISHSPSVTLLSGYIPGNFNDTVSWPSLVLPCLGFRN

SEQ ID NO: 990504 - protein, 108 aa, Homo sapiens
SKYKSGHGVGWSSPAELSSMSLSLCTGHHLFQPSVIYGLEQEEESRAGRRAVLQEWRLKSKGPALRQDRSGSRASNETQTARSHKGGQLCDRTQCGEAFSEHSGLSTH

SEQ ID NO: 990505 - protein, 50 aa, Homo sapiens
IETMEPRAMPGVPCWRVGHAVGGRAVHVGLRAGHGVELSGYSGGNELESE

SEQ ID NO: 990506 - protein, 48 aa, Homo sapiens
MPKWIEYLVHPGEVHEVMSLNFWQQTPQKESKFSIKFLRKSFLYSGKR

SEQ ID NO: 990507 - protein, 104 aa, Homo sapiens
TFHRGSKVINQGGHTKQQMFSVHKTAFYWKKMPCRTSVATEEKSDTWLQSFKVQDRLTLLLRLNAAGDCKLKPVLICHSKNPRLLRIMLNLLCLCPRNGKTKPK

SEQ ID NO: 990508 - protein, 57 aa, Homo sapiens
QWAGLSCIPCSILALQAPSVCLETSCSTSSRGRVPGDPLSCPSDVCCRPSRGVPELE

SEQ ID NO: 990509 - protein, 43 aa, Homo sapiens
SDSILLSCTAGSLGVSETAAALRRRQSAWASTSSQGRALSASR

SEQ ID NO: 990510 - protein, 44 aa, Homo sapiens
MCVHAKQSCCRSWPPLIIVPGAVVGRLPGIGQAEAISLARLQAL

SEQ ID NO: 990511 - protein, 39 aa, Homo sapiens
TSRQPVVVCSGQLPETGGANSPGQDVASARKSCTLAAPI

SEQ ID NO: 990512 - protein, 69 aa, Homo sapiens
SRYPLCNLETVYESFEYYSMKIVLGDMNAKVGKERMYRPNLGIHSLHQVSNDNGIRLIEFALAKNLYIK

SEQ ID NO: 990513 - protein, 30 aa, Homo sapiens
MIEYRVEILCHYAANPSLSQLGLKCPGGKV

SEQ ID NO: 990514 - protein, 54 aa, Homo sapiens
REALDQLRELCHQWLQREGTLKEQILELLVLEQVPRCTACEAPDMGGIAEPMRT

SEQ ID NO: 990515 - protein, 67 aa, Homo sapiens
PIPTLYEATLHLYRAYRTSRSDSRHFYTACYLQSSVLKRTERCGLRIDNMDAIVVAEAGLEDHAQND

SEQ ID NO: 990516 - protein, 30 aa, Homo sapiens
MYVQGGTSLIQKSKIGTVPKSKINRSRCAR

SEQ ID NO: 990517 - protein, 81 aa, Homo sapiens
IDKFHMLTISISVKKQLTEESSRDLVKPGGRIVLRQLTPPSNMFSLYLPLPTFGLGSIWICSNNDFISLLVMDLAHKILLL

SEQ ID NO: 990518 - protein, 49 aa, Homo sapiens
MDSLPTDNYVPFLVTYFTTLRWTYLSDYFLTRLNLLRPPVCYHTPGVNN

SEQ ID NO: 990519 - protein, 103 aa, Homo sapiens
MQIKNLKLKMILVSVHLSAAYNRVPETGKFTNKRNLFLTVMKAERFHVENLISSENFLSGGDSLKSPEEVQDVNDEGTECANVLVQVIWSSYKATSSTHMITH

SEQ ID NO: 990520 - protein, 45 aa, Homo sapiens
GRRWMSTTMSFPFSRKFTQKWDLPGPAPDRVLGPACNLGSVLPLL

SEQ ID NO: 990521 - protein, 381 aa, Homo sapiens
MPHRTHLNPLVNYNMYSPKRNSIFGHLRTQNPMIRRRRQNKKHTHTTTQTKQREKRAQPNHNKRTHKDTTNEESARRKDPKREKKKQGEKKQNTHTHTQEERKQETREQTRQKKKHNRETKKQTPRRKRTTTNERATREAKKEGEKTTNATNNKKATQDTHDRKHHTREKQTQQQEEGTRSTRDKQREHKTDRRKTDTRRTQNTAEEDKERKKEENKRDNRNELKDKEEKPRTDKRREKENSNGKETKKKAEEHKTNNEERKSKDRKSKRKKERTRSSTDKQQEDRKESSSRTPAKEEKKEHEKEREEGSPRVARNQEEAAKHTKRGQREREGKERARRTQQQRRSSRKSSKQQKATEEGDDEREKAKREPREIARRAERK

SEQ ID NO: 990522 - protein, 33 aa, Homo sapiens
TARPDIHCTPSLPKYRDYRHEPVCPANSSDVRS

SEQ ID NO: 990523 - protein, 70 aa, Homo sapiens
RSPDLLTGLRRRSPGSLLPQLGIAGGGSSSAIAELVAPLSSRWITGTISRHRGMRLKGVDVSIALDQHGE

SEQ ID NO: 990524 - protein, 113 aa, Homo sapiens
MWFPPIVASGTSGVDSILGSDIPKSVEDKQVGPRMRTNGTFVLSHQDLAFNAKVHCRRTRFVALLSIVCSTKSANQVMANGATETGNSLRATMTTDGTLRKKLSFRSRKGKEE

SEQ ID NO: 990525 - protein, 183 aa, Homo sapiens
MDTKNYKLTQKQTDTENPQRKKRKRQQTTHQPQRQKNTRTSSNHTKERTEKTTQKTQPNTKRPKNRDTKQREHDAAQQHKDYENHTTIKDTHAETPQERIINKNNQEVSATPNGAKTKRPRRPRTNNHRSGKHRPKNDQRKQQTTTRPRTTDHITQTTQPKRNTQPQHNYKKDRKQNEPHKQN

SEQ ID NO: 990526 - protein, 522 aa, Homo sapiens
AELAVSRDCATALQPGRQSKTLSPRLKARTSGREPGRRKLCSEPRLRHCNSSLERQKQDICTQKQTQQTKQKTPNSTLQWTQKTNTTQHTTHTDTTRTMLQQIGNNNTKRHTETHPTSHHTYTHTYNKNIILIKLRTEQNITEAPRHDNTNSQNKKNNNHRERDRDNRRHPSEQNTTKRQTTTAAGDDSQAEPPHDDAHRASNTQRAEHTARTIPKPRDSASTVARTSEQQGDGTDNETHKTNLHNKDSNTRGQVETQSSSSELLANSPQTTRHIRNNQHASREQTPTTSGRHYNTTRQRNPHHRAQPTTDTTKYTSARDTTERHTHTPAQHRPQPTNTKEPRPNPTPQNAYNSSNTTTEHAGRRHTPQTTTHQPTPPHRSPPKRTATTTPTTSRTTTPHNHQNPTQRTKRVTDLDTFERCPHNRQTASTLSKPTPSTQRECISLTRYVLRTELARRSDGQHYDRETKRGEQAEPAGGIRAAARSCSDDGRTHTRAAHAQRPLHETTSAQRPPSRDQPTREP

SEQ ID NO: 990527 - protein, 138 aa, Homo sapiens
MVPLYLVRARNTVQHRTTRHLVHVTYFAMHYFKRSNPTSGSTATSQYRPADRSHCSKPPSILTRLRPNKQHNTTTVRAPPRTTQQRGEHPERNRKHAHTRQTGGSTKADELHTRGQPNDSHNATQQTPNRTPPQDATS

SEQ ID NO: 990528 - protein, 290 aa, Homo sapiens
EIQETNMPQVSRGSETPEARKEIKVVKRGSSQNLVVLELCKMPLTEMRGPIYYDDQGTSGRGRTDFTSISPFQPPDLLNWKHSETLTSCSWYQRALFVHNCVESVGTPVYIQTDLISGTALGLISRLKAICGQETVQSTHTERDVRDMWWNAWKLSLKTRIVAPKALQTQKDELIALIWAKNSRQGKEECSDLQLTRGCQTNTSKGRRSIYRNRDVNPGDGHKGPEDEHRTKGGEVTQSVGRGTRGKGRQHKEARRHRRQEGRRKQTAKTRTPPTQRRRRGHKEGSATDG

SEQ ID NO: 990529 - protein, 135 aa, Homo sapiens
MLRPEKNDEARKTREGNGEHEAERATRESKRDNHRRNRKERENEHEQNTERRRRQANKAKSKQDKGAGGENVKKQQKSEKKRREKDREEENEHQRGADYNEEEETKKVDKESRREKQQKRTRTGPGGKDEEARKE

SEQ ID NO: 990530 - protein, 63 aa, Homo sapiens
MSGPQKKNSAEQKEKAAGGTPPQKENPPGGNQQAFRHTSKEDIKETKGDSPRGGNKDQIKIRR

SEQ ID NO: 990531 - protein, 142 aa, Homo sapiens
MCVPVPESISQWGVSRSRQIDRCFAPSTREALHVPFRIRWGAYSELLGRDQSNQLAGSQNHVDKECALGTHPQKQTVRARPPNLNKWCRAQGRNGRVQERTEGGPKTRAGWAQRRQYERATPAEGGGPTHKRATGHHWVAPS

SEQ ID NO: 990532 - protein, 104 aa, Homo sapiens
MTHAYEARGHGVNEKGNKGDHKSTDESKRGVDTRKKSAATRVLEHHKRVSKRDTRKDEAINIHRRRYTGERTTNGQTHDISRATMMGIENTNGSDGTDRSTEAN

SEQ ID NO: 990533 - protein, 126 aa, Homo sapiens
MKSIILYVLSLLLILEKQAAVMGQQGEINQANSQADLPNFHMDKRASTILDNKINNILNPKGRFSYSTHISCRHQLTHDWTRNKITQYEVRMPYIKANNNHNTQLRSEVPPTGSNLYNHSKGQQHQ

SEQ ID NO: 990534 - protein, 106 aa, Homo sapiens
MSRNRRRRHEHIFTSADHNHRYPHRRQSIKLTRHTPRKQYEMICCSALSPRIHLSCFTVGGHDMGSSLANSSLDIVHTRHVLRCKPTSHYVLSIGAVFAIIGGFIH

SEQ ID NO: 990535 - protein, 187 aa, Homo sapiens
MAPGLRPGESQHFGEPEVAGDHLEVQESEASLELDMGGNPGSTKNTELGRVWVACVPVAGEAEAGEMAWNPGRREVGTWGRDWRPLGLQAIGHKSETPSRKKQNKRKEKQKNHRGAAAVRRPTEKKHVLKTPQTNAVGDGAGEPKRERTRRKQWVTKKEVTTQGEHSGKSKQSGRREQQAHQKKTAR

SEQ ID NO: 990536 - protein, 101 aa, Homo sapiens
MPEGRRLRETQGTETEERAEGDGRTRADCVGVKRTPVRRKAESRAQSRWHTQADLWGTKLKRPTNRSNPLRGPKSSARNAIGNRRDPQSRTYCQSKSESAH

SEQ ID NO: 990537 - protein, 285 aa, Homo sapiens
MCIFSLPDVHETLLYDLGRTNRGTSLNRYTNVMAAQGIARKHDTKDTPHDRCCPKKAFHDGIRPMYELRNLFLRRIYHEAFTTRSLRPLTRPNKEKGNEAHQDGITIIVNSSYDMVAFLKTVCRITRIVGVCNTVDDSSDVYIAESTEDSMNVKRVLYDIITGGLYCNLPSEAATVTCRRSSLSSNRRGATLRDSTRGCRPQGILGNLRTCMARFPHDGVVRQVTLHDVRESVRLNAAERVVQGRIGGTTGGARKQKEREPANHGGAARKEQERPEAKREERDER

SEQ ID NO: 990538 - protein, 121 aa, Homo sapiens
MSWIRMKHSGCLHDVTRGPDVLLRQFLRYVRPKSVLSRCCAGIKEKPGTIYEDKVIVSLAVYLDSPEIIIVHLVRRRGLEQYTCDMDMTEYGRVVYSDYCLDQNPIIDVYYRRENVFADNH

SEQ ID NO: 990539 - protein, 456 aa, Homo sapiens
VLVACCLPDVQLNGQMRVHIWLFAIKQRLPSHVLLVCSLPVNPMHFGMCLTAGMITHQCQVVFRDHACANHCANNPLSLTKNYNNISLGRGGRRRLVNFSMTTLQVHRLDSVTDDLNILTPHGTGTKCLAKMDGLDRTHLPCLAIDATMAHCDAHTSDDGPTTRTLILPTYTTHTEYKPHTQDYTSFCTALYSPSPHSNGPQEQLAGVTSTILHNGVTLWNNPRPTDTYVFPPNFWFHILRLLTAWFGHSFLSIERLWTPHYTVTCQTLLCKLEPFLNFLLYLFSPTPLTRNSLRPVLILRITLHPPPSPTIGSTNGIQPLSATELNSNGQHVHTHALINTLLIAVGLDHSSPNTHDIDLKPAPVSNTGTLRHNRRSPELAIRPTTHHLRKTSRATTGPQPDYAPDHHTHTPPTNLPTPQHQNTIHPTPHNHPTTTTHPRPQPPPTPHPPSRIPRR

SEQ ID NO: 990540 - protein, 170 aa, Homo sapiens
VKQSSSISLQSGWDCLRGHHTLANLVVFCLFSVLGFRRAQWLRPAIPALWKAEVGGSPEVGDQPDQHEEIPVSTREKDKQRNKHKNKSVVRGAPRGAPRRKQPSLKRTHLAGEGGTRGPPTTSEKSHNRVAHQQGEAAHKREKHPRGTRDTKSDGGTSLTTKSEKKAPAG

SEQ ID NO: 990541 - protein, 272 aa, Homo sapiens
DCYGVVGTEVTDVSARHSGKLILHLELTCKLSDLVIPGTGARPDLNARSKPSYSQHVITWLVPGSSHLCVSTERVCRETGSERSRTIARASAAPSKRTQYDRRVRKRTRRHTGELSRFSRAEPSLPERHNADEKTRSSTPAKVVRQAERPANGSGIPGARSWEAPPPTKQRAHLKDDQAYTVGNTTAGGNDHRANNGMGKRTRTQEPSAAPHKAGATTPPAPHETGATAHPWRHATAPRHPPWHPARGPQSRPAAPTRRGPPHTPPKTWDAT

SEQ ID NO: 990542 - protein, 308 aa, Homo sapiens
MGNKGVKQTSVPPKKIHPKEKKNKGEANTQMTQNNSLTTVQQQHTVRKPPKYNGVKPPYKTVATAYNNVGPEGKDEGKPEEIRLDKRILQEQFEGTAKHNGGDRTKIYTKGRQHQQRTPVYYNTSQNEELAHRRGQDYTTQVNRTRTKNRGNHCDDTAHRTKHMKQVKTGIKTHTIGEQQLGTSKETIAAGTTHKHTTGRGQRTLIGTGLTTTARKNRDNSAEKEKKARQKKKGGHTNRPEKMNAQGKSSTNRRKKRHHVSWNRGRPRHRTSTRLVQHEKQQPANKAAREARDRTKQSSKQARLTKPE

SEQ ID NO: 990543 - protein, 366 aa, Homo sapiens
TQYRHIHKVCKCMLEKYGLDLITALSPLVSLCQIFSAPFPYRDFFSHQQSIHHDTVFHAPPFMVLNILFAHQQFPLYFNTTTNSSMAVFIMLPSAGSRNSWAHSDTILPWTSRRCWDCRHKLPCLGLNIISRGGFIKPFSVQSNAWCHISPFANVVSLNKNPPQEKQHGITPSNVHLHIEEQTSSITQQHHTSRDTPHKRRPNKKQPWQRDKTKNQGHPQHGHNCPGETHGVAAICMGDTHTLYLRRQSRNLTTSTLSRTHAHSVLIHNYTSIEYLRHLLERPQGTTERSRTNLEHHTPKRNTTTKGPRRHPHKDTVKTQQKKDPPNYYETQRKAPKDGAPHNHRDTTAPRNTNEKKTAAPYGNTH

SEQ ID NO: 990544 - protein, 377 aa, Homo sapiens
GQGNPRKMKPNIIFVLSHAPHLGEASSCDGTKRWITKADYHSELSQLSTRTTGPATILDKKASNKLTSKGRTTIQYTYHVDANDHDQDPKQSDNHDLNDLHKTTKSQTDIQVEDQQLLNNPHRQSETMITSKGYICKGKSNNTITGGNTLTREHNKHPISHDPTGHKAQLDTRKSTMSTLPHTRKRTPPRSTLDLSQRQNLTPYRRQQNRDDKQQRNHKDNNDTHKRKEAPHNENKNSRHNTLPSTTHRAQTQICITHTEHDANQTQEQTDVRTTHKHHRNNRKEKKKTLNNKNTGQNPQHTQSANEHHKPNADDNQRENGETTEESREKTIAREAQAARTTPTKSRSADLNETKHDKNQLSPDEKERSADDGAREE

SEQ ID NO: 990545 - protein, 283 aa, Homo sapiens
ELDHLKLRPIGLDQINTKKTYRNKLPFCHRAAYRKYTLLSVQCTFPQISQQLALIHTISQALLGSLQNIFPYHSRTMHISQNAFNQVSCQIAVNISVYMFTLPIFVHSSIPNSLAIQQAGGVPLLLLGPAQFILQVQQHKKGLVTRVYPLYVKYMGVGEGTTTSYNTRWPGPGYAAWGNLKGCTLMGKFPFLESSPPVYEHRASTGKGPNTAFFDTWNLTTITSLPTAAGTASNGWTIFYSGLQGHLHLALSTRLGKGSAQINRKVVHSQGPIDKPFPAKVAR

SEQ ID NO: 990546 - protein, 88 aa, Homo sapiens
RRPNAPESNTVDPRARSRALMDPSTGAEIGMRRGRGTQEVMLGCQGARRATHDLALCLQTHLAGTPEDRRSTIPKPRHNNISDYSTTL

SEQ ID NO: 990547 - protein, 105 aa, Homo sapiens
MLYRTASDALTTLILPICLVPTPSGTNVGILRDALPANSSEPPGAAGSTCPAREKNASCRDKDVPEPHNLRQGTRRAHVGDSTHTKIHLELKREALTPVTWVHAV

SEQ ID NO: 990548 - protein, 166 aa, Homo sapiens
EHYYHHEIYLLILTFVAAADMLPPIDDDRQDQLGGLHLVEENSSTHYTGSTFELLGYHYLASRLPIIQQTQIGVGCTSSVQLATKVPDDTEVDDLRTTHTQSDSTLGTAELTHVSVICRPKNSSSTHRKSTHRPGHSWHQVDTPCTESKATTITTLGTYNTDFHDD

SEQ ID NO: 990549 - protein, 380 aa, Homo sapiens
LIYILVFLVRDGEFTHSKSIDGLDLLTYVIRPTSALPKLLVIIGHENNCDLAKFILILLTILFLYLKSGNQTTLLDHTESHTKKHTPHTSHNNSKLNTKQWVCGAATEQPSTTKTEYTTHTQKPNKERAARRNPPAVQKENSTRAKPKTGEPTQCADTTTHVDANHGTAAARNEEKTNPATKKKKQIRDRESRGQTHNTEQSQTRNSTHDTPQTSLTKPHKEGRQRYTKPAEGGTTTPRPRRGGMSTQHNATRVDEVDRDSGSRRHARQEGGTTHTRRKTQRTNATSETNPTEPGIPEGNTRPSRVTPTPETAQAKQGGSREITRTHSGHTHETHTKNEDANRLTRPRTTQQHASENALGRPGNRQNTTYQQKDKINKKT

SEQ ID NO: 990550 - protein, 275 aa, Homo sapiens
MNPATWQVSSDAADHAIRTSSLGDSCNDIHSQPNTQQTEHTTPTQLLLAHTAPTCHTPTLYTPRKPPHSPPPTYTPTPPHHSLPPHSPPALTSAPPPHPTNPTHGPPPHSTPTTPHAPQRPHDQRTQPHGKPPRNPLPPPHTPPLSSRTPPLTPPTHSTRSPPVRARTRHHTSQNTQPPTDPTPLRPLPRPPPTQTPPTHTYTIATLAHTPQQSNTRGHDNFSSHSDNPETHHTLSRPFPNNKHNPAVHTASLSRTHQHASNDRNTPALSTNDPP

SEQ ID NO: 990551 - protein, 119 aa, Homo sapiens
MWELFIPRVLLLQSAVYTLSQLVSEPSEGGYHIEISHVIVDYTVPVLCLSELKPCVSDVQLILTKKAATRPEDTPKKGTPERTERIIGADSPSQCGSGSRRTPTRRAHRPIGIDALNND

SEQ ID NO: 990552 - protein, 270 aa, Homo sapiens
MQVAVVPNSSHYFTEGLRESDRHYWSTENHELRIAGGAVQGFITLGRTCLRHIRLLPAAANPYISMTRDVTTSAGDFALNKQQTGRLRTAHKLLARPSMHGTIFRRLTTTTDWHVTTDLEDIACTVKLNQLDWQQQHAARPEILTYNFLMLSGHRWHLRIDLLYMGYTAGISRPANEQLTDRMGPLLNQQNTAGIILHIEAILSRFTWRELVDHKLVDPLYRESLVGAHLSAKWLYALVRASHRARRDLCALLRTSILLWEPLSRFVWRP

SEQ ID NO: 990553 - protein, 343 aa, Homo sapiens
MGPHNKPNALTQYYNTHTSMTHTNEVHTLHIRTNQSQTTAPNNTSYTATQRHSHAHIPTSTTHRETQQRPRKEYHQHRPRTYTSPIATATTTPNFRSHTQPRRPRNRTLIHEPTRKVTQRQASTPHQTSTRSPNREIQRTTATLPQTRILYSNSNTKMHIYKPTHQSHTTPLSSQTINITVLPTNAYEYTSTHTQEHNNHHTQHTHIITQPHTYTPPTLTYLYTIHHIYHIYDIELNTTETEHTIDTDTHEQPHIVKPTRRADRGKTRSENTGRVISYARRRSIARLQDRGRTMSHPNVTPRTSTREPKTPACAKAEQPVAMRVYATTHHLNDDPSDANRNTY

SEQ ID NO: 990554 - protein, 171 aa, Homo sapiens
MAHAAQVASTRRYVHPYPYQELITLIMDHALINRFSYICIPSSCDALYIANRLTYKNVSSRLNNLRTAQRNGKRQNYPARHHAEVLIALPSLRILYITDEVNDPSLTIKSIGHQWYCTYEYTDYGGLIFNSYILPPLFLEPGELRILHVDNRVVLPIEAPISYNNYIINDV

SEQ ID NO: 990555 - protein, 480 aa, Homo sapiens
QLPKIMQYVHLTVLEESKNDELDHYAQITEGHPASMITLDHGYPRPFYVDIDMRSANHRSRYLLTPKTSHRVPYDFTCTASTLASSTLQYYSMRRLTYRRGSDARHTSLAYDLTFTRNFFVLQHRTLPRRTYTCQNISGTVSYRLKALDTSMWMSRCEYISDEGSRYTKTTTVRNGRKQHDGSYGTNDRSARLTWTEVIDTTPTAYASFDRIRSHVNIALFLHFSSQYLTSLYSHTAWTIQPLSQCQSSYFTHICHVRQQITSLERQNNNITNISTSTRHTSQYKYMSQPHNNSHSTHISTITIPSRHYDIVPPHMPHPPIHVSITTNITIHSQPSDHITTYHQSTSYTRKHCPEHTILAITHWTHSYNRLSTTHSTIQIPKTKKTDRQIYHTIQTHPQFTATYDIPIYNNTPQSCFVEFEMYDPKQHSYTVDINKTTQSAPAVRSAHHSMDTHTLPHYTRALTLTSLDMLTYKNAADAT

SEQ ID NO: 990556 - protein, 194 aa, Homo sapiens
MVAHVVVIELRVSRAVHPELRFAHIAEIGGHDASIRWPGSVTCTQIPAKLMPVKKSNRMNTMLGLYILLLCTQVLTLHCADVSTVAKICSSRSQCFSTMALLGKNNPSHEIDTGSWLVLGDNRSPAVPRASLLPWNPGAMGTTHGAGIKGSPLGTNSRKYLDHWGPPHGRRSGVLAGGVTNCRTLAGSRRAQWG

SEQ ID NO: 990557 - protein, 116 aa, Homo sapiens
MRRRSKSQAVIKANTSHKQPEPQGRGPCDYHRVTLVATGEEKHLSQTFRQELASPFTLRSCSSSKLDGSKRFVSNFESSRFLTGTDTSPWSVYDLLEQRSRGHLREKPLETVRAVS

SEQ ID NO: 990558 - protein, 281 aa, Homo sapiens
MPFSVSRHSHLCHSVIVHISRSSYDVQDTVRSELYFRMQVSMIYSFGPMPISANGSNLDDAVTAWEQDWSYELKSLQSQLTLGEGEITSFTARNWQSRPKLDSIMAEELGAINYIDLYELEDEGEGDTRNLSTLAKQIRITRCNYYFCRMSWRKEAKPGSMTEGRKARSRQPSTVDAQPQARRAQDGTTGLTHRPEDAWEHKEEPLGSRRNKRKQEPRQEAGNTGQDEDTRPRQRESHHGTTRVRNPAGKERPDKARGRNNHKAKGGTPKKQPEIRNAHAD

SEQ ID NO: 990559 - protein, 140 aa, Homo sapiens
MIRTQKHNKQTEDNSNDREPGEPHTNIYTSKATAAATQDEDKETTQTAATQLKTKRALNEDERATRQTNESVPHTTQSHSKDKEKNKQLRHKKQDLRTAPQQTQTRTTARMREKTQTEKCKPATRTRNERACHTKNQEAA

SEQ ID NO: 990560 - protein, 271 aa, Homo sapiens
MSIRFDFYPCYHLMMNFMFPFCVNGILSPSVISEPEHISIGVDILSMAGQMTVKFGTAKRWAGIDARVSAIVACRNGGDCGLSRQGGYHGASQETPSELAAHRASSKALACTGSKWTRLGVTNNTTHEMGQQDKGHHKPKKPTEGSGSGRPRQTPNQSHEDNTKIIKPRAQQRWTQAAPQKRSRPQEQSGPTTRDDTPRREETPRGRSPLQQPGRKDNTQEDINQEQHGREHRASGQRETNHNRTHQRPKNNARDKHPSETRKGGAQVYTK

SEQ ID NO: 990561 - protein, 294 aa, Homo sapiens
WRPGAADDRPPQERPFVIVAERPGRQCHLSAHRPHDLRVHRVLCWLWLDERLLMWTHRCGIIQSSFTCPRSPVCRAAHPSVPPSPQPLDSLIFVLSARFWPFLDVESEPYSVCPCETGCFHSAACVYGPYRSLQGLVLFCVWMEPGVNPLTYECLGSTCSGLSGLLLADKGGLNQCQQLSLNSVLPLTFSFDGRKGSLALDSVLVSIMSPATGGSGSPPGPVTRRSGVPGMLPSTGRGTHGNGLAGNGVPQPLGGSTHSITLLRPRGTHLAEPGVMAARTRRLGVCPLLRRIYG

SEQ ID NO: 990562 - protein, 62 aa, Homo sapiens
MQKKPRPGDAADYHEHPHAQLRWTRKHTNRRQQHHGDTPSGKATDSTTKRNRRQTATNQPSK

SEQ ID NO: 990563 - protein, 613 aa, Homo sapiens
TASLPNQEFTDRPRSRPTPVVSVQQELQAPAVATNHQRIHSSPQHNTSTVAHSQQPTHTDTRNTNREHNHTPTVGGNETQDAPPNRREREKKETKKIREERREVGQITHTTNGKTQNTKSRTNDTNVKTTTEQTKTTTRQKEQNEKQEGKKRHKKHTNDRSRKQQTATDNERENKDRRDREKEGDTNQQPRRKETERNDPKKTTKENYNNTREKSIQQHDKQQEEKVKTRTNDEKTPHTQRKRKQRTDKMTKNHQPTKGKTRQNTHTGQTQDEEQKSKKKKTKTTQQKEQKTKKTRQQQKTQNQKRRTKKTNTQQTEGKNDQSKANSQKKKKTKTTRQHNTHTTETTEETRHTRDNKAQTTEKKANATVGYTTASQEKQQRKAARKPKRREGNNDNSSSNNRDRTQKHSDTRQSKNAARKTLRTQQTSKQTGNAKDEKQEIRRVKHKETQDQTHSNARNIANERRHEHRKTTGTKHNEAQQKHENKGHDTMKTNNHTAETTTADQSKRATQRPRDITSRKTENAGVQQNSEKHKTGSEKDNLRNRHDKEPAGAETTSNERQENGETANKRAHKKDNKRKGQETTTQRRREDTERHTGARAKDTPDHNKTRNQQ

SEQ ID NO: 990564 - protein, 186 aa, Homo sapiens
LPELAGSVVRGSTIAGYGACTGSFVRYMGYPRLVIRLPPSRVLSAANQYLLMRSLRLLADRMPTESNTTNHSGTSFLEVSGLTVRSNYHRSTCMLALSGGPVRWGAHQAVVMRPCRAKKPDESPETYCASVAEPGGLVGLCAVIVIGYELRGLAPPPACTLGIAVSLAHSMGRLEVLGTVFAGPKV

SEQ ID NO: 990565 - protein, 251 aa, Homo sapiens
MKPEDDRLLLIALAPDVPYISATKQQQLVMGQKGGSRRPIYADVRLFTQVVQTLGAKKGRDDICVCTETKAHDQISTVDPMASCLILQVTHNPCSDDLDVVMKPDPEQSHDNYALVELPLTIKHRAEDSTSRALYVVECHIMAVTPYSNNTHKTRVSTHPIDDKVQKSGRSSITRCMPYYSTGKGVWTQSATARCEPSQKCSILRRSRARLVHMLGQKGYYTPCFEIHFEIHQNSNEGCRGSPVGTFICPL

SEQ ID NO: 990566 - protein, 579 aa, Homo sapiens
PPLAALKSHLCSCSFIRLLARRSRLRPLAASSARPRTLGDAFHSRSSPCSLSSSLLLVPCIGTQPACSQPLSERRPIDIQSSEHHQPRTYKRRTRTACGTMARTMERDAPATPGTAYLTHTRREAGHVCTHRRYDATTSDARVARPTDATARTTRQADRAHRHDACPRAPLQGRPPVQPTGPSGAAWQMHSTDGRMVAHRRKAKTNRRRHDPGPGNTRRLTRRHTHEPSGPPRAPHQTASTTHTIVAPPAPTQTHGGPAPPAGATQQRRKNQAGERQRTKSPAAPEDGNNPRTARHAAHQTPATAATPPPPTYAPLAPPRRPPTPPRATLAAPRGSAPPIAMLYRLPTRSDSPAPPPPPRVAPAASPGPGPCPPARTRAARASPPRARSAPLRSRPAPAPARLRPAPPPPTSPGRLRRGLGPPAPVRLSAVSPPCSCPRSGRRAAGRPALSRAACRCGGPERSGRVGRRQLARGPDRRCSVPSPRARGPAAVCARRPERATGVRRAVARPPAGAGAAVPAAPRGRAARAAPGDHPSAAAPAPAAAGGGARALGGEPPARAPAVAAAAGPRAVRSCSRGA

SEQ ID NO: 990567 - protein, 142 aa, Homo sapiens
MSSTVRISTLCVIVLVSLLNGSMWTELGRRGRVFVTWFPAMLTDIRQVEGHLEMHRGFHSQTVSTSRVMSYSVTTKLRRTVTRSQSLLRLLPRFQGDEISEKIVAICTLCSLGFTAIFACYGVSMKPHTRLGGDKHVHLRTR

SEQ ID NO: 990568 - protein, 74 aa, Homo sapiens
MHPRQQTSDVYTSESSNEPRTTMRQRRSTYRYDSRQSDTRSHTEADKPVHHTMIHKQHGNNILMDERVGWQAYH

SEQ ID NO: 990569 - protein, 229 aa, Homo sapiens
MDTTAEHDKEKHNTIEHKYKNSIANKRKYNEGTKQKQQKHTKTKKNDTKKKDTNKHTRERRHEHTDHKKTANITKSNKQHENNQKSCTMMKHKNAIDKKSNRDRTQPTRHNEPTQRNKRKKETHTKTHQQHTRTKKAKNSTNASEKQPKRGHETNQTNRETRMQSRKHGSKKQHKRERTNGQKQNKMQTERNSTNNKTNKGAHTKARKRHRRTEKNVTDTEKKQKTTQE

SEQ ID NO: 990570 - protein, 93 aa, Homo sapiens
MLSETDSLTITLLLIKDNATDELDGHSTSSRKEQQGQVSRAKEYIGSVQKRTDARQGRSEQINDSRDGQDEEPGSNIEHRTVTTDDTIKTSTS

SEQ ID NO: 990571 - protein, 169 aa, Homo sapiens
MTVPYAERNKNNQNTEQQQVVAASLEPHHPTHDTQQTIEGTPRRHQQKEKIKEGEQKGGQPRKNHRPDKQTRRGHTPPIPKLHRSTLRGDAEAENRSPNTKQRRRGGKNKQRQNNQQKKAQKHDPPHTNAKTQRRNSRRPHETHTTHTQTATYKQTDTTQQGKKEERGK

SEQ ID NO: 990572 - protein, 95 aa, Homo sapiens
FNCYLNGPTVSHFKALIIVMPVEAVTRDMTMSKTEKVPYAESYNLLMLTVPNKPTGPIKSVRKHSAFKNLRLECASSGDENPNLRAKYYAKTSPV

SEQ ID NO: 990573 - protein, 107 aa, Homo sapiens
MICFLKKKVSGLGAGAHACNPSILRGPAGTTAFEPQGFKELAWATFAETLVRYKETPRIIHNSPLCLHAETTFVWAPCAPLEKVFYTHICVARGAPYGMCTVAHTGV

SEQ ID NO: 990574 - protein, 304 aa, Homo sapiens
MKETIMNHGNNSAQTCQATSAHWWRRGTARSNARRWFIDTATADDKKLQFSLKKLGVNNISGIEEVNMFTKPRNSDPSFNDTLTVQASLAANACTITGHAETKQLREMLPSILDQLGADSLTSLRRLAEALRQTICGWKRHHLLLEEDDDDEVPDLVENLNEVPRMRQTGMESTSEGLNLEKDTGSCYVLILTCFTKISGQWIRYNQISRRKAKPLNTGALCETGANTQVTTLTNIAEEAGALGGTRQEKGLASTRTDDDRRKHRAQATPTKPHGRTERTDMRASTERANGAPRQGTVQKVTLH

SEQ ID NO: 990575 - protein, 109 aa, Homo sapiens
MLDGRPCVDFFDKENVQAIFPCVVMWCLVRPRLIGEADAGGVIEPGVKVAVSQEQAINSSWVEKTPFKRRKREETVGPAPKIQTLWGAREQSKARKRRGVPKTGRVKQV

SEQ ID NO: 990576 - protein, 80 aa, Homo sapiens
MHTEQPETAKAKRGTITTATQQTTTQTPRHKTTRTNRNNTETEAYTHHGKQHANSEQPTQTPREGKNRKPQPKTKQKTKQ

SEQ ID NO: 990577 - protein, 252 aa, Homo sapiens
MVCEMAGLCHLACDVNVKFAPTRVCVLGRRPHRATHAFQNSLPSSPEQVSHHAVSSDFIKTHCMILVQFAHLSVWCSPVGRWAVWVSNRWGILSEDLRATVSSAMQIRSHVGYFLIVAGVVVFARWVSCAVYVCSGLLSKCALVTCLLHPPPHLHWLRLQLPVVALVVHHQWLSSFLTYAGSVCHHERLWFPGRLHSSVEHHHERVKLLWFTNYTDFEDSPYFKENRCFPPFCGMTTFQKGNEPPSKGPDTS

SEQ ID NO: 990578 - protein, 187 aa, Homo sapiens
MRPPDRIDSSGQVMTPAHELMLLRLFRAPAELTDAVKVMDLGGTQEPALGETTLYASGWGSIEPEEFLTPKEDFSVWTSNVTFRLDLVLRRVNLRRVPQMLVLALDRGQSTWWGSIEYRMNMQPAEGLQGPKAEKEVFINKSLEGPGDRETECLPHELKILDAIKNKTQGDTIQKNKDKKKIQMRPQ

SEQ ID NO: 990579 - protein, 122 aa, Homo sapiens
SKKLCIASYGRDQILREVWWVIKREVGDRFRSPGVAGRWFHSLGSLKPAGLTPGGRQPTRRGRVDTSRGNGNWETDGHASGKQESHQGEWAIRGVGRTGRAVVPGGGALRRYKVMWRGAKVE

SEQ ID NO: 990580 - protein, 317 aa, Homo sapiens
EPYCSSPTTRILPLIQHLPLSERYSGAPLGPKSKAECEILMMVGLPAAGKTTLGHTNMQPPTLPSKYNILGTNAIMDKMRGDVAYTGSGTMLAAGHVLIHQATQMPQPPHPDCCPPRNTQLYPTSHNCSYCDSPTARKMTPSERFQRKAIANSLPPDERPNKTDQESRTDEDREGMSHTHAALKKMKAQTYTLPTLSNGPPLACRVHCPLDAIATATNDRHAYLKAIQPGRPQRHRTQPPHENAVLRQPKVLRAPNRRDRRQGNRNPTRHTHTTDPPRSNTGPPPRTPDTIYPLTDTLPNQLPIILILSSYSTTHIT

SEQ ID NO: 990581 - protein, 116 aa, Homo sapiens
MLAKLAAARLYTVERAQTYRAWLHSLRLSKTRTLSFNFNTIAHSNPLNPPCYNFTPASTLPTRANTASLCDTYRNTTPSVPRTHATQPHFTHPQYATALHNPSQPTITRKSRFNDF

SEQ ID NO: 990582 - protein, 393 aa, Homo sapiens
ARKLASALTKRMAAPRAARPPSRYQLATAAARARLLASTPIRLYASSCTAHAAHTRAKPAALPRSARSLTHARSRCLCHLCCSLASACTTRPHPAPATACLHPATLLLHPHSAQATAHRATLAPPTRATPTPPLTPPHAPSKRPPHCTPSRQPQPHSPLTHSHRSPSPHHPAPTAPPLRPCSTLLHPPPPAPTPSHPPLLAPYAPHHHPNQPHLPAPTPQPPPPPHLPPTHPHHPPTPLPHQPPLNHSPTSHPSLPTSLPTPPHPSSPPPSPASPPHSPPPTPPPPPPAPPPPPPPPPPPTPPPPPPPPPPPPPPPPPPPPSAPPPPPPAQPHHPHPTPTPYPPPPAPPLPATPTSPLPPHPPPPHTPTHLSPHYHTLPTPPPPLSPPSPPLP

SEQ ID NO: 990583 - protein, 35 aa, Homo sapiens
MREDNRGHKLSKDGGEEWQFPHHNNMKRKENTKHK

SEQ ID NO: 990584 - protein, 73 aa, Homo sapiens
RELVCLRKRKSLKEEVSKLRSSSLVSFTICSYSPQNFSGCLCSLNSQVNQIDPLWKEQMKEEWIQTSGDKHDV

SEQ ID NO: 990585 - protein, 76 aa, Homo sapiens
MPMAAQYDEPDAYVTPRAPGGGWQSHCSSGESTVPEPGATFDGGGATERSPGPKSDNEAPRQEREQKTQTHALQKA

SEQ ID NO: 990586 - protein, 423 aa, Homo sapiens
MRAAGFPVYSAFPFSRQHPDTQFYSHVLAGFITIRSSLHAFVMPGDTTERHDNTGLIRPTYTSYPGTDPICAGRTFADTLMIQRHAGGRPIRRGDERLTAWPGCHGGRSEGKLSTRRAADTTQATAWELALDSREYPISRRHRAGDPRDQSQDPRTRHYIHGPPHTLPDLPPSSNHRPWPMGQARAHELRMGTPPTKHHQDITRPGSVQPLTTPRLTTSPPISQTHSHRLLPRNPLHPADLTGRLQPTSGPQPTPAAPLGTPTTTPPGNNPGCGTETTTIAPRPLLTRRTYNHSWASRPHYNTPYGTPTLVTTPGTRTGTTRARHSPKQYCRHNTPTTPPLANTPPAPPTDAPHTTLRGDSNHPQHTTHRHAPAPNATPRPTPTNHPPYLRTTTEPTTERTNRRNPNEPDTKHTQPNTHPSRP

SEQ ID NO: 990587 - protein, 465 aa, Homo sapiens
MSTFTTSLLADATSLSPDYSPFMLNRSEPNSQGNFTSLCAAALPPSPSLQHSLHCTHCSLTHTTTAHAQCTATTTAPASKPSTPPSATPLSTAHTRLSLFYTPLPQRNLTFNLTWSLTLANFRPYNSSNPLYASTCTPCSTHTCAYSPCSYSIPFQNPVRTSLLRITPPPLSQPSPYAHATPKHNSPPRIPTLLTTNDFTRHRPPPPPAHTTCVTANFSSLSRSHSSMEDQLPNRQASNPHSPKVDSERHSRRTAKATVPLANLHNPPHALSSQLARRRHVTAAPPRNRRATPTRTLTAQMPTYTSDMRSCTTDIGSRHYPHLQHEPLYTTRHAGPPALAHSSQCPNASRNPPPDTPYLPATPPQHAATPTGTTTVRDDCNHEPHTAHLSDDPHPYAASTHTPRRDQSPQPTVPPTGQASTQPLKHTRYHDSPRHAHPAVTHHTATTTEAPTRPHSHPPPEDYYN

SEQ ID NO: 990588 - protein, 281 aa, Homo sapiens
MELAQRAREITSDPYTVETHKTHYGNSKLSPGLPKELAHMTGSVMDTWKTAIRKQITRQDVSTLRLTTPILLGAMRVKSTYRTYSRSKKKTHLHVSDYKRYQRTEDLRNLLDPYDSTEEYPSTKLLQREWLLTSCTSHHSVTCVAAPCYLKPNYEYVYTRIADEVCGSWTGRQEVTGEITLKGPGRRTTDKARSETETEERGKKGGQKVYEDMSIQKKERSIDDEKEAQTNNRQLRPSQTIKEDSKHRYDDNMQANDSTEKTYAKIYNNNNQNKREERMMS

SEQ ID NO: 990589 - protein, 60 aa, Homo sapiens
MAKCYQPGAVDKVAQRSKGGPWKGGLGANEDGTANVVLVVTTNTIWNVWFDTEQKRGSSP

SEQ ID NO: 990590 - protein, 344 aa, Homo sapiens
MERFQGPPGGEPPQPKNFGPTPGGGEGKGGRGQGGNQAKLDYTKERGSPSRKGLSPRELGTAGGLQKREDICERRNRDTVTTTVMSGDRGWTLGDREKTSAHRRAELPYIGREIYPPAGGEHPTEKAGNTCAEKKPTYETHNGGRNYYQFCVDTSDKLVLGRRVGPPQSGRQKNPPCVHKQGGLTQRGETQSGATEVLIPARKANWFGGTVLSDKQTDFFTKIGRRLTPKRWSIRTQHRGNNLFVTIPNGEKQLRRRGSGAARHETPNYGRQQRDARDQMRPTGALILEIKDTCAAHRPATRVVMQPGRETTEPKDTKHRMRAERTRIKTQPETSDAPAESRND

SEQ ID NO: 990591 - protein, 187 aa, Homo sapiens
AELLLSPSQSDMVFGACPVLSFTSPPSSRWVDRESLSEQRTQSRRLQYFLQEKKKTGAGFNPWLASKGPDSLWLGYSRIARRFWQQRLVPWELDLKNSNCGAGEIIPYPSFHFTQDKELAFGSLFWGQGPKGGGITMEKDLGLSWKTREGKALQSGPPGSGWPTIGCWDGAQAFQELVRTLPWSRSA

SEQ ID NO: 990592 - protein, 144 aa, Homo sapiens
MRITKQHTQGANERTDMENNKYEGPNNLEINTEAPGTKLCRAPKPKTPNRRYNQTETKANDHNAPGKNKQRERKLNPKNQNNRRPRDRDLGNKRTPEDNKTDPGASNRNRNKKRARNHRHNEQQTKYHPDTEEDSHTNHSDKKK

SEQ ID NO: 990593 - protein, 319 aa, Homo sapiens
MDAKLETLKDLASLSRYVTMAIGIYNTLDVYLSASRILWQERALMRYQKYKEIIERLAFGRPLLSFTLNGLSSELDVTRGYSWSVEYTIGRMACIKEDRQGSVNNVRQRLSLILLAGPWTFRSRWCSDSHDLYQYSATHGVSRIGPGHSTTCKRSVSRNPNNYRILHVIIAIFLQGLLNERQAGDGEYSWFRELLRSIIGPHVIRVASGLMKNEMVHRVCLYYECSTFNLRDDGWLTGMVPRDRIRRGFHIGRRRTAMNAGLKLYKQWGCEPRAGDAENKERGPIVTARYPKQRGVSGNWFSPQVMLWLNDQTVISQTT

SEQ ID NO: 990594 - protein, 171 aa, Homo sapiens
LLLLLFVLVCSISLSLCVLFVLVSFCFHFVSFCSCIFPFFVVFDFLCYYLVLFVVALLFSLCCVLVCVSQSCCACSPYFVVVSAVFSYFPTLSSCWGLLCNLAVFFFLVWVSYGGTWCTVSLCSSICGNGFTTFWHSRMLDVNIVWLYSRKSLLSVKRITVSELPSLSMSL

SEQ ID NO: 990595 - protein, 253 aa, Homo sapiens
MQNVEMEPNSLQMGRLTVWLARTLHFLQGFSIPALERRRPRILSLVRLCSYVRCTPNGSRFAIAELQSCRGKRGPSRLTFYPALNLISSQKTLPRAEIATMARMKSLLFRKGDFVKLEDLVNVVYILISPMWKMLASTLDHVEKLGLVEGMDMNGSSAEVQAVKPYTVDSNFKDVLKGEGMTWGVGTMEETNVIVLQAYPPVTAGYRLDCLKTASQDNAICPFLTGTQFAFGLGEAMQLGKSGTFRSGLVGTP

SEQ ID NO: 990596 - protein, 62 aa, Homo sapiens
MGEGGAPRRVYNRETTMALQENSAGKTRGGGSPQKKTPGNNAWAHTRGPERTEDTRGPGGYK

SEQ ID NO: 990597 - protein, 333 aa, Homo sapiens
LYCLILCQDFLQNIIKQRMRLHKWKQPYINTTMLTILRVSEMGNGEHVVPFSIYPESGTDSYTREVIRQFVTTTGGSLHIHGSHVCIFSQCIWSTPKDDVVIVRREDSVARKSALSPMGWTFSYDLQNYNSKRCKALKAFAPASLGHHYTYELTIEHDTIVALEDLDDLACYVPADHVVLGLVDTSTVTLATREPVYDHGMNKWICEMRTKKYLQRGKIFWVGPYGGGFYTTRVRASQVSFEEMLHGEFSTKKIWFANWRGFCTPEDSGKGRFGIQMSPGSGGRKPSRGRNTGREEIVEIGTRAEGLGRNPIVVFARRQVNLMVIKSSLRSAA

SEQ ID NO: 990598 - protein, 84 aa, Homo sapiens
MRRTIALSSCHRAKLNPVGRMRFRHAKASSNLFYILFRDYQEVLTSPERTSGTPDRTSRTLIVRSHASLSTNPLVTGRGMSHVI

SEQ ID NO: 990599 - protein, 132 aa, Homo sapiens
MRPRSLEEADRGFGCLLLEGGGEQNRRRHVTGRREVRAWDSRETYSSLYSSSPLYPRCGTWADTKDLGSPIKPELAWSSDGQLEGQTRISKKITYCVTIRDNGFLGMRQSNNKRPGEITPGPVNVRKTCIPT

SEQ ID NO: 990600 - protein, 194 aa, Homo sapiens
SGSLAAAGASGVVFTALCLLLLEAQLLWPRYLQVWEIHSYDARTHWKPRNGESAGSDIPREGAGLVGTGGKWLWRDSGLPAAGSKIRGPEFSLAQLGPQSPSAKDGGRADSSDPGHPVSSLRSDCALVWSPLWAALPQQPQLSPIVQGSLDGRQGRILTQDAEFMNGKSFGLRGSQSPFFLLKICGSLRRNIKN

SEQ ID NO: 990601 - protein, 183 aa, Homo sapiens
MVRHEELRRRNSVAGAGNPGVPPHARDPGDQKRRTVYSIQRMMQPPGGTHTRANRSKKNNAGSARCESSHTRDQAPEMTQKQGTIEHTPQHLTKEHPTNTRDQPRGHAMMNDDSGTHRTRQHTRGATPPRKAAHKAGTQRKQPGKDASPKDSAPHRPGTHRQIEETATKRNQRGARAERNGGR

SEQ ID NO: 990602 - protein, 237 aa, Homo sapiens
MLNKVRHSSTVPSRLELESKSQRTCRLCECAVSHVLLGDALCVHWLLTWAWCRFGVEVAWWCAGTFESPSTCPAGYTSSLGWTYYCPNIADPEYYVLSSVNGDATCRFSEYVDLMGDRASVLLPFMVVLLAGLYGFVHLHARSSSWHDLVCDLRDRQSVGPGLSRNWFSGGSDGRGRSKMALHPRSVLLAACLCPRLGQYGFGAFPDKVCVAFRIPDRVVASVVVAVICCVCVRFLE

SEQ ID NO: 990603 - protein, 102 aa, Homo sapiens
HITLISRRCFSPPSGSFVDLLCAVCSTLFVLRFLFVFLLFLFLCSVFLSSPVSSFCRSRHFSRCPPVLLLLSLFVYIFFSGLFVLCVVISSCLGASFCSSGF

SEQ ID NO: 990604 - protein, 150 aa, Homo sapiens
SRAMVLLVVLSFSLFFFVAPCVCFFRCTSLCGVLAYLCFPGCSRFISGIPGFPLIALALCLLFPAGMSSLPCCAMLRVVDLAWRGMSFFGVGSFGPLFFSCGVDPVLCFLFSWLVSSAFVPSTSSYLYSIVLLPKYVMYGSLYYCNRDLI

SEQ ID NO: 990605 - protein, 176 aa, Homo sapiens
VARVPFLVCPFSVMLCFFLSVSCVAFRFIPCFPGSSGSIWVIVRPFLLYPVVHVRCTCPYGLDTSYAGFSLLVCRYSILLLFFGIPLVPCLLFLRGSIAVGFYFFSAPFIRILCRPVSLLLWLLALHRAALPALLYLVPFTLLPLLTMAYLKGDLRRMWSEPFHFHSPSSSRFLEV

SEQ ID NO: 990606 - protein, 78 aa, Homo sapiens
GGKTGGETSFQGEVQVFICADPSPWRVLCVSGRSRIATVLKARHMTGEYWPEQHGEAMPKVPEGPGATQAAERNTQSA

SEQ ID NO: 990607 - protein, 113 aa, Homo sapiens
SSLLFVPRSLSLFIFLPVPFVLVLPWFFLFCSVVFFVVCPGPVCFVVSSFLLGGVFVLLFRCGPFGGAFYLFDWLGSLGPMPAGSLWDVVGSGVFGVRALGFSVSSVCVAPSL

SEQ ID NO: 990608 - protein, 169 aa, Homo sapiens
MVGTYRSRTAKAESILESRPSGIKLPGSSANSQVAHPRPRGHHPSPPRGPYFRSGQGEKIPSGTRKLAKRQAQGALEGKELLAESRRWFIEQPQQDDKKRQFSLKKLGVKNISGIEEVNMSTNQGTVIHFNNPEVQASLAANTFTITGHDETKQLTEMLPSIFKPAWCG

SEQ ID NO: 990609 - protein, 225 aa, Homo sapiens
DKFKSRGAFMGLRRRWEFGIRERMSLPILLGHSMSGTTRAKPFCFGGWNGVQSSSIEFSDSTPVSVLCMLAVIESPRFCATPCCWLGALESVRILKSACRDGCFSRQQPAQRSPLMRQSAYTGFPASLGCPHARSHIIPVRVQMLLKTTEVCDRTNDADRRHLAVQAINVSPYRLAPGEKRPPTECAPTPAPHTPQMMNYCAGLRNLLVTWKHSGAGTESRSFLS

SEQ ID NO: 990610 - protein, 239 aa, Homo sapiens
RGRAPANPLLEPCGPLEHAPDSPCWPGALVSPVPCYAPPITWWPADDLRHQGPTPRYFTWDEVAHDAQCCDGRGWPTDLTRKVYNNQRRSPAWHPRVDSLGHHAHYRQGTAATDPFSGLPHQQGALLKIAYDTLSLIGELSPEHTQHLEPTKNNELTDEFRRSYRTQLQRIGAHEGPTKVFFQLYPAAHLAAGCCNLGYTLWVKWHAFHAYHPLCESCTVHSRPGCTAQQDLPTDASAP

SEQ ID NO: 990611 - protein, 107 aa, Homo sapiens
MAHALIHFDSWRTHTTPLAQAFPNNCLFNRDKRGLAKKKVGPTSNYSIESSLGGNSTTTIGALTGKTHIEQGNTEGQDSLFRPTHWAIAFHMGNYKEPGKAAPTLGV

SEQ ID NO: 990612 - protein, 129 aa, Homo sapiens
MRREVRCSVHCVSWYCRVSPSLMSLTPTEGAFECSGWHPEVMIQGRSHPWGSQAFSPWVLPLNRCYNLHPLSCLLGIAIKNSRTPGDRSEVPNFLIRMTLQTGEKAHSGFLREDMRPGNSENKRDHKKT

SEQ ID NO: 990613 - protein, 234 aa, Homo sapiens
RSCRLLRTKSPGPPMRTKCMALSKLVLFACLAIPPRSSAFCRAVKVLEIPSLCDEVSDKGLCSSAAVSGLYRLASDQHISMVTYGKPVTFDCAVKPSVTCVDQALHIRNKKLHHEHDLQMCWQLPETDYECTNIHRSRNDGVLSSAVLPMPTCTVRDHVHCLGNRTFPKMLYCNGLEAIMVYVVWLYSITLVGCGADRFYLGSGWEGLGKLFKLRVGLGIMDRRLEGSCSLGGG

SEQ ID NO: 990614 - protein, 164 aa, Homo sapiens
RGTQRLGSVVYGTLLLVLSDALGPDPDLVGLPLLEVFPHFRVPARPWRSPASSLWAYVDATTTIVRCASDITVRRLEIRGWMTQGSTEGWHPMEGVENNRGIGEHHWSASGTPIQDFSGVESCAQACADTYNSRCDGRVVMTLDYGMQWMRSLGTVEGASSAVL

SEQ ID NO: 990615 - protein, 116 aa, Homo sapiens
MVGGKILGVLGKLRHHSPLRIARRAIDGISLGRLLLSGGEENRPCKYPQIYGERCNLMGAEVSNSYTKPGQRNVECGATYHYSFSANINPQGELGQQTEIDFGALNTFRAPLYSQW

SEQ ID NO: 990616 - protein, 298 aa, Homo sapiens
REGTDAETRAGQRRGDAGRWARGWGRRPRGRRSARSGDEQADRWTGGRGARDSLGQAGAVMEAERPGTGSWCHCTSWCPGVAAAAHGLRDGCGALRPVEYLETFGKGRSNADGFSTYFVLMVLLVGNILRDSLLSLALCQAGVQWYKSRLTAASDSWVQVILLPQPPGVVWALRGACQRYPGLAGALSPRCCGRAPSMILTCCLMLEAVHRGPCGPRASMSGAAPLQVAMPGVRSHVAPRRSSPASGWCSCGHALSLQDGLSAEGALCVSGCRCSRCGALALGGRLASPEGLRARAAA

SEQ ID NO: 990617 - protein, 283 aa, Homo sapiens
PLGSWSLTSVAPFVPPALLSPPVSFLLLVLSSVLPSVLGTCGSMPLRFSSVLLRGAPHGQWLTGAGSRVLLAPIALLHATLGASACAEIPFASGAADLHFLNAVLDVHLARRETVSGPGELEGCLLPAVLVLAEWRLTLLPWAFGLKQIPEWGRYLGLCPHSCPGPLPTPVCWLPHILAAVGVRQSDPCHRTLCPHPVAKRSHHVTQPFTDLQPGPQASSSYWMLPCGSNRHRLPFRRWRGRFPQASELCRRGRGPWEDVPRCLTPSSGSSGNTLECLSEGPA

SEQ ID NO: 990618 - protein, 59 aa, Homo sapiens
ERRARLRKRQAQLQSRKEYEQELRDDLNVERYATVLGPGHKKDQRLQPPRTCKIGGVIL

SEQ ID NO: 990619 - protein, 111 aa, Homo sapiens
MGLGIAWTHTWWSHAVCGGPRQARSLEGQNVRDQGGANHVQNTISTKNIKITPGQCVHAWSSQLFGKEAEGTKNWRWPGRAERVTLGGQRFVRTGMSRPQGKKGGTMSQKN

SEQ ID NO: 990620 - protein, 74 aa, Homo sapiens
WLKTSAGATSPRGIHNRGLGRVENRTLATRGSGAPQGVPGGRCAKPGPAHLEAHLAEVTHLHHVAVTSCFSEKG

SEQ ID NO: 990621 - protein, 307 aa, Homo sapiens
RITPDRRLCNPASYTPAPWRQQFDSMVGECYLSWLWELLRGWVLALLSSGTLKSPLDEENSDPGDTKTERSHVRASDFKRSVRTVELSSYRACYNAKLRSLKARADNEMSIYLPRREAISMRLARIALSLGWPISSTRGQEILEGPQVQHLAEHFLRQKYSIAFEQPSCGHCIEISLEQIESCEVVMYGKMPLYCLRASQSAVTRFHEDCHEALYWVLRRFATGRFSDSGVPLIECSSTDYVKNGTRGNIADLIDDLDFCLSMIGLVDPLFFNAYGGCFEPEKFSPGSWHDRWVWAYVVLYYRKILP

SEQ ID NO: 990622 - protein, 113 aa, Homo sapiens
MIVLALSRNLCLPIVGIVGIGRCNETACNIAEADIRNGVVPVDSTGGRLKSILFLEQPLNKYRCDKHYKRTMNVLVRTSVAIVCVPYCGDARADSLAKGWLRRYHGRQAQGVT

SEQ ID NO: 990623 - protein, 290 aa, Homo sapiens
FGPIKLGDEGPSPKGDRSIGAEKAKSSNSVFLQIRQDSPDAIIIAVCQPSGHSYVCYWRTKWITRDTALIEKMDVIWSSAEMFATLRLKNLAFIPAAAMDGFWGNMVDLKCRLCGVVLNVAGVSLQELNPDKWERTMIVRYLEEVHKMAGLQSAYCKSSSVKGYTNWAIGLSVADQYESMLKKSIKDSSRVHNGKGDVRHLRMKSSVSLAMYPSSARGLTSVTHTQKTKRMMRLLRLKKSADTLWDIQKDANNDPVTYVSSDGCSNFKTSNVIKLEPLSLESMYMDNSVA

SEQ ID NO: 990624 - protein, 82 aa, Homo sapiens
LCSLGLFGVFRFVMAVGRSGVFWLFLVSVLRVRTSVADPGFIVFGGFHTVAKALSHWFPVFFLSSSVGVFRLASAILLFYAL

SEQ ID NO: 990625 - protein, 104 aa, Homo sapiens
FLDFSSRLSVLGVCLTPLFPPSGVAVWYLSPSPCLWLCSYFFCSPMWVVSLIVLFIVCGVAFCCYLRSVVGLSSRIILFFTVSFLDVLIFWSFYFLCALIILFL

SEQ ID NO: 990626 - protein, 363 aa, Homo sapiens
MRKKRRRRGDATHNADARDRQDVRDERARRNRTKREKHTEGRPHCEAQRQRRKKREREKRTDRHKKIERKRTEKGGGSTTRRAQRKGADTGGRMRHEAGRPNTPQRTKTENTIHPDRPQQEKAPQRNRAHRPAGECKHTTTTTEKHEATESPNPRTKRHEKKKNKLKLTTPLQSPLRRSKSITLIHSIHTALIHIHYRTIEDTKHPPATHIGRTTPAEKHTANTEKKKAKTEQEPEERALTPEERQKERARTREAADQQTTSRTQRPEERQDKEKKTKEKTAGKSRPGREDEKTNQEQKQRESNTTTTTHRDEKEKSKKRETTATAKKTGPPNPRESEARETAKNTRGKHNKTGKENAEEAET

SEQ ID NO: 990627 - protein, 169 aa, Homo sapiens
MTILYRYVDLDPWPIIPCPSLVISFLMMPWSAGSLSVTLDVQIACAYVRCSFLCGLCPCGLSISLHVWWRWYTACHAPGPCGCVPPGRTAAYGSWARMIVLLSCWLSGVHRMRPHIFTLSSAFSRLPLDVRKLAHWCPLASRCRCPIQSGGWEGSHSEWQDPGRPLERL

SEQ ID NO: 990628 - protein, 394 aa, Homo sapiens
MLAMMVSISCDLVIHRASASQKVLGLQALATAPGEFFFLETELWPLCGPGWMFAGGATLSALTVEDLSTPPRVSKPNFSLTTQALPKYSRGIYRPLSTTQRPLDLKIVSYIYESIETTEGFSLQVFVGLREPWLFDNFVCTLPGVNFQPRPFGLSPKSGAWDIYRGHLERTTLLRVVPTMNACDFFENPYIGPSKRGKMWPPQSISPQKTHVNGRCPPGGVPATGGGRSPVVSAPGLYNHTGGFLHCGAPRSHHFPVDPFSHDFRVNMCCIQKGPVVKYFSPEVWGAPQRVRYLLERAHFCRACPPGGGTWPVWCGSDYSTPPRFGFLAGRGATHGVVIVPPRGWRRNHPFFLITAIIEETPRGEIHNDDVCSSVKTGGGGFIGGSSLANTYDI

SEQ ID NO: 990629 - protein, 90 aa, Homo sapiens
MTASTPPRKPPSVCSRRKKKDPQKQGNTAHEREEAREQRTDRRGGERSAGERTHTNSHPAKQHTENRQNKGKQRASPQKADRRNHETSPS

SEQ ID NO: 990630 - protein, 109 aa, Homo sapiens
GEVVGEVGTSCRARGGFCPLRGGEGAFPTGHQCKLEEKNKFFLLSHGLSVIQKYYFGKQSSGEPEMSSYSLNRSPPKLALQVLLQLDKAINAATGSEASGNSSQSSGAL

SEQ ID NO: 990631 - protein, 147 aa, Homo sapiens
PRPKTKSPVSPQGVRSLEGGACPNGRYRPTSPSGMTYYTKDTVSHKDLAFWEGPINVRTPPTPTGKNFPRFRLTLPLHQGNLEAHFPPYVLRPLPVHKDFWGKPGGINKKNDRPASQRPEEQRYSLPKTGIFAPKTAKYAPSSKPER

SEQ ID NO: 990632 - protein, 88 aa, Homo sapiens
FIDDIAYDGFHRRACDMDAHLVGSRSRLHASDFSVLSALYTDALVFHTVTNVPPGDSHVLWIRDASCRKHKLRQKLEQIILALVSSDS

SEQ ID NO: 990633 - protein, 229 aa, Homo sapiens
SGDRDRRTWVFCSLSSYDSSIDFTYDQEWQLDEASTPVHRCSDRGVELSSTGSMTVLGEHLPWLMRGTSSPSPHCHDAQRMIKDTIGVERRLTSLYLSKSSTCATDMECTSSVRPSGSPKWASHEYSATRLWGTIGQGLGFGNYAETFVEEEIAPRNESNLRNSAKGYSRGNNGAHTFKQRFPRIACAEIALEADRVYDTTLWVEKATRIGLVLHIKLIDSRKERLEEH

SEQ ID NO: 990634 - protein, 154 aa, Homo sapiens
MSNLLGGPSVRDQRRSNCPVLVEKREGYVPSKATSCYTHMTTFCQGMHHCARVHRLTRYTLHDLQMSHVRSVCSLMMRITPNARSTRTVLFLSYMQAWATSVHRVFRRMHIHILPHIYLGTTSQIRNATTRDSAIPSLLTILSIKVGIRNTLVS

SEQ ID NO: 990635 - protein, 262 aa, Homo sapiens
PLPESTPRCDNLEFGIMKANNLRDMYDHEITAATIAVHQRLIYFVDLFVPDWPKVSVSISSISVVNQQRVPRLNVTLGRNSRYKERRHTCTCMRRKALGYVPRRHAKDVGDHRYDSLLGPRPRAPSFRPHLGVATTRALLFCASFGEFLRWDLRERSDARKQVLQHDHEVAVDSYSKSSARYQLEVISAHHPIFLYHTFVEANTLNLICKRSLNHTLNRASLAHVGPKALSSVDHGWTAIRSIAEGAEDIGTAYVLPLSPKV

SEQ ID NO: 990636 - protein, 148 aa, Homo sapiens
MRLQSRLRSNPPYSSRDWAMPGDLLGNEHTSTSVILVTRTMHFVSNSSSIANTHHNREAYVAKRDLRLPPELNRVPARIVAVFRRHYNKALMPFLHSFTIPLVLLLLRHLHTRWRPDTRNTDCTTRYYASLSKGNISSHPWNAFPVRS

SEQ ID NO: 990637 - protein, 73 aa, Homo sapiens
ALFYYGTLLDYEEGRLAKPDSYYQVSSPGKESASIPARTAVVDYRSTRDYRPYMTSTPRGTHKREELLDTTAM

SEQ ID NO: 990638 - protein, 69 aa, Homo sapiens
MHFDYHNSVRGYTLNYSFPRRSHFSRALIPGKLPPKKGPGPNPRNGHKNPTLKSIPYCHPRNGPIPCSY

SEQ ID NO: 990639 - protein, 364 aa, Homo sapiens
KRKKTHNRNSGSEREKAAEHKAQVLGGSEISSSLMGPGGLEAAKEEAALGFLAQTGNPVSMALAHRGLSLSYASGLFCEQRLHEKIRGGPGARDSAKELSPAALEKRRRRKQERDRKKRKRTGAVGERQGHGTAEEANGGPGGWWQAIPDGGLQRSRGSQPGLIFHKAEASVRRVRSSKAQRRKEKRQRVKGNLTPLTARNYRQLLERLHARPERLDELRGPDDAHGASYPNHTTTGNRTTAQRQKPTRHRDANTDHTPHAQRNNPTHRRQNDTRNPAVDNHAGESNTRHQQTPHSQTTPWPQHHTRDHTTQHHAHNLLTTRRISNKSETPTSSLLSDSQHETMTTRESRYTPPSHTATAGDDH

SEQ ID NO: 990640 - protein, 96 aa, Homo sapiens
LSKKDEERTAASSLAAVLRSLCSASRQPYYVLLRCLFSARCLEPRFFVALRSCVLVRCLFSTYYSRLLDTFDLSALWKFDRRVSSGVRRSMYHRRV

SEQ ID NO: 990641 - protein, 354 aa, Homo sapiens
MSGVCVVAAGALWGDGCCVVGRCVLGLVWLGDVWRFLCPPWWGFRPVGVCRCGLLSSLVALLRGRCGLWVCAVAGACAVRCGVVGVGSRRARWVRWAGRGGSEVRGSCVLVGDGVKGKSCVAVEEWVSRVDVGVGGGVVGGWERVGVVGFAARCEKVEMCGWGGDVICGDVRSGEGELCRSLVGDVGFVWCGAARLVGVVARVVCRGPGGGGEGVGWEAVGCCAVGVVEGGRGVQRRMVEQGGCSALGFQVVGGELGARVCVGGCGMGEDALVRGGEGVGGERGVSMAEMVRKGARGGGAQARFERWWKEVEAWVQRGVGGEGVGGRGVCVCVCVRVSGGEAVSTVCVWRCAGR

SEQ ID NO: 990642 - protein, 149 aa, Homo sapiens
MSGTVPPGGYNIRGTAANGYGSCRYRMLLLRGQLGLLTSIMCIIPFLPCTMCASATAWMNYDLAAVCALVLSSVMVWSVSWTGRQLFAAVHSLRLPFDCLSHTRFRTGPGLSASWMERRKHGYCSPTGPSPENVTEMPMLQNVSGHGPT

SEQ ID NO: 990643 - protein, 165 aa, Homo sapiens
MHIINSSMKKQTKDRTHENRTGQHRGHHKATIYSCPWTQRTGREKGITLDTNQKYATRDGMEQKTQTHDTNAQTLHNTKTQTHGQTTVATTYERQEQNTPKSIREKETRTIINNTHKPRQKQQEIERTNKNTTTQQPAQDSRSKTLQGTNQQEQREKEDQNNTKP

SEQ ID NO: 990644 - protein, 184 aa, Homo sapiens
WQVLLLEACEWVVDMGLVRTSEDFRKVCIYEEGQLNVEFLPVHLSFFFPNHWLLSQLGISLAIANAGHLASNMYTLATSAFNGECNIPRLLVTVTFRRANHVVQYVKGNRGLPNMNGFLNEAREDKDLYNSKATYLGIIVKIDRDLPRDKWNRREKGGLWFLNTLRYVRGQYMDVCNPKFSIQV

SEQ ID NO: 990645 - protein, 188 aa, Homo sapiens
RPPFSLLFRLYSPRPRAPSAQPVSAASSPPASRRPGPPRFRGEISPRSPEAACGRTVAFMCRKTGLALASHASCPAAAIIRSRGPGAHGGRRALCLSAPNGAWSRGSWCRRFARRRQADSVLALQLPNSLPGRTPNAGSAGDLGGRARRGGTARGVKVRPDIANRRTGPSAGCDVSSWAPAGTPATSP

SEQ ID NO: 990646 - protein, 184 aa, Homo sapiens
MDYPAQLIWGKNLTDHTYDLRRPDTVWTCAEVNSWKGYLTRKYTHTLSWSTTGNVTGATQRQEKGRHKTTHTSPKEAKRTRQNGRWHMAAESKHAAQTRTEYCKHTPRENAGRRPQAHSGSTHKMTNHHSVTGRNQRNHPPRQKRASTQEPPQPPGGDGTTQGGRPQGRRPYRQQTVRAKRNAN

SEQ ID NO: 990647 - protein, 39 aa, Homo sapiens
MRVTSKIGSRSPIRSSNRIRLKRIYCLDLVAVNYSESNE

SEQ ID NO: 990648 - protein, 420 aa, Homo sapiens
MAAGSQMELNRCCKSTHTLPHTKPATATKAIALSIATVQTKLNPGSKPQAATQAHHSSQQHQNYQSQHCTSAHQLTAFITRDQSQAQQHLHTNHTREVKHQQWQPSTHHCSQDISQHSFPNSHLRESCFRIQDTQPGHAQHSTLVGNKCKEPTMANDILAMQSQGIHTDGTELQHATRHQNQEDTRVSHAAQYRGSNTKHMRDTKAYHQRTTGTNNEHRTHHTLPNRQTQQQTPNSAKAQRSYAHTRRRTRTRHQCDPRHHHAQGQGHAPNNDQHRERPHNRHARTHRSARTTHPQQHRELDDNQQHRHRTHTDTSRDQHGTRPRQARSYKYKRTPTAPHTPNGTDAGRTDTPTRRGTQRAREPCQRHITRRSAPRPQHDERHGTSSTQPRTNRHNRADTCRHNTRQLIEPHRTSHQQPR

SEQ ID NO: 990649 - protein, 311 aa, Homo sapiens
VTRSGKSELAEPIAIRPTSETVMYPAYAKWVQSHRDLPIKLNSVVQCGALGIQASSALPTYSCNFFGRKGDSALCYRWKRQSEEVLQILDLHMLRYMKNRPGNCCSKRKKEGKGKMCVEETIQTTIEANVYLLVEGAIQVENITSFEGRIVPKCLKSFLKIQEIPGEKQVCLSKSSWGLTTRTIGVMTMVHGDKHGFSITTPCCMCSGGELSSLWRLAQCTFWKKTGKRDAKCDDYRSEYSSVTIRVELIRDNYSPGVESTWGPGVPLLVLAVFETPVCVRHKDIGETKVAKGPNIHLGNSTLTGEKTQSV

SEQ ID NO: 990650 - protein, 102 aa, Homo sapiens
VTRRIQQQGGGPHGPHGLQGVKTPGPPVPSKMHKSEEMRPSLLGESLATLMSPTTLNLPSSQIAMYDPLKSGTGPSGACTFAHVPSINVPMMLNQKKEKNMW

SEQ ID NO: 990651 - protein, 216 aa, Homo sapiens
MQVNDRAPSIGVPTMSSASRLPLLTLLQLYRQIRTTETREKHSTLLNLVPRQFMLNSRRQNLLALSEYTCSKHILTKIVYRSPPFYHKHEETFHNSWIVLHHSEIRLWMMANCFLEALNVSVDMNNGERETFFLRGIRKSIISGVVVGLLCTWALMSEDANTIGRAQVLHLAHPWVPLSYTLWFKTNWKKHPGKARWGGSTLWQSLFFALTWVRVG

SEQ ID NO: 990652 - protein, 148 aa, Homo sapiens
MNFLILAWSSTAGEIPVVAIRTAKGEKLCHAGTELLAADGKALEHGSCTDYFAWQIMKRYLKSEPTPREQPMGHVKELASRRTLDDNSELMKTKDVLTRINMPLAVVTANEPGAHSYYTATCAKSSATDPNIVIATMDATANRCAFSI

SEQ ID NO: 990653 - protein, 72 aa, Homo sapiens
KISGIMWTRLYLRLMYTFDDIKGENIEDIPEEVLMELCPPLLKAKYACQGCKMKQVNVVYTDRGLTLKENGC

SEQ ID NO: 990654 - protein, 102 aa, Homo sapiens
ILGKTRPPTPPSHPHRHLQGPPVSRALTRRHQMMMIQDPGTAHSLQHTYQTHDEITDTEIHHWNASEHRNHKYQLEINMTKFIREQEFHTQHTETRKTRTKT

SEQ ID NO: 990655 - protein, 240 aa, Homo sapiens
AFMPPAPMPTCLPAKTPTPTSYDSHGPCYNGYPGGYPVDDVEQEIAQLVAKAPMYPCFGDADSSVASEVRSGYRIQASQHGRLSCRVRDTTGEKESGRNRSSPFSILAPPVAVCERAMGEVTSLHKDDWRSRAIPGVPAPHSRFRDEGVCVAMSPLESQCDGILVALPGEQATAGGWRAQAAPGPRPWDALGRAITSVEHRTESGSQVVPRGNGGRRSLGRMMHRAEPQQGRLYERRRLE

SEQ ID NO: 990656 - protein, 188 aa, Homo sapiens
MASSEPTSVACVAEQEPTVVTQYTRSIGQSIATLRGLGLFRMKCVQSLEQTKSTVGYNLEIDLQASLVKDETNAVEIAKGYGGETYYMKKLDCTAHPTEALFEEYDATTPLCSWLFLYEPNVVLIAIRRLDPWIAQGPRKSSLIMDRESRSRTLLVGYRSLRNRVWLLPCTRPRDQGTFLCALKGIFI

SEQ ID NO: 990657 - protein, 238 aa, Homo sapiens
TQSLTIRDAEMGPLDWLSGNAIDIWRVWIRVLRGCPRNVAMAYSLVIKSKKPRVVKVANADSELGRSEGSYAVMHLRQISPNGSLPRASSSVVDPLSRMSDFTFDNTSTTSKRLSMKYMAPGVWLRVMAHCMTGGDAIVVGRAENGAYGISYRVEEAVFFTCLSSVHCVHAIISLRVALKTHCRRLRSALSSVTRSTFVYLILLIILQSLNVPGTWLYVREDFTGAVGNLLVQSLYKD

SEQ ID NO: 990658 - protein, 233 aa, Homo sapiens
MRGREYFFSRKRRLFQVDICHMRLSSLVLQSSWDPDIRRVCAYAVDEENYLPQLSVSPASIEEKIVEIDASHRLCHEWANCVTAKSFNDKARVDDTEATGSPTMRTMTVESVTQAVSNLALQFGEEDADPGAVSRPLGVDYSFGGVDEKGPQAVSYGALSGDLRTSVMLEALGLLQRVPRAPCMRSFHKSSGFERSHHVSLIILNQYGGKLLPLWLPRQRQVPFPADSRSGLD

SEQ ID NO: 990659 - protein, 121 aa, Homo sapiens
VRRWARDWDLRKPFDLFILYSSYVLDVMGDESCWTFTTVRILKSGKSSPDDLNYACKPNDWFPYTTYESHTRSRVFKLNIRVVLWEKTHLDTNVVLGLDTTKDIVEKYHCIRDDQTIVPTK

SEQ ID NO: 990660 - protein, 232 aa, Homo sapiens
EPVFDLSELSTISMTTIEPLRALSLAMPVYSGSHSSYRDQTLIIAPLYRAYRPCSARWTRMIAPLVMLTAHRQMAEQGTSPKGTMDRINMLFCGTSRTSSPSHPYMLATRSPPGVIIPPWTATERSAKDDSLWKIHASLNQGTDSRRAIGCKDILIEWRMSKERESPKTIRGIFPPQEEPGQVSQGMAPKVFSIAVDISYSKGPRTDVEPGRPGNGLIVVYARGREDPQGRY

SEQ ID NO: 990661 - protein, 86 aa, Homo sapiens
RCQQLISCRPCTHSQTELQRLALEQQHVAAMPITLLHSVPLPAQEDYYSHLKKEKRQATVKPAIKRAPWSPTLDLGAPPPSPHRVP

SEQ ID NO: 990662 - protein, 76 aa, Homo sapiens
IIRDIKFWTELRLVHCHDGPLDYWVTLIGSEIDGWREEWLYTAARFLIAIDTVHKYIYTRRLVARVRCSSWKLAYV

SEQ ID NO: 990663 - protein, 397 aa, Homo sapiens
TASENSLEDSVRDGSTVRKVRDLQAGRRRGSPGGCIPGTAPDMPRTPCRTPAPLHRHATPRSALGLERPPAQLLTLGIPQTHRGTGARHGRSPEALVLTGRHDQRKHSAGAHQTSSPPDQTIRSTIQQLKLPDPAAPPDLHATAALRPPSRALQPRHTSPPLLISATPPERSPRLPRTYQELTRTHRPPYRDHPRDIQTSRTPDQPPQAYQHTYDTPAASPPTHPQQTPQPRTDLQHDNPGRQSKPSQQTQGYRRPYQDRSAHPAQQPPAAPTQTPPGPEAHTKPAGDNIPRRATTYDRANRSTKRPRTIPTTGHRQQQPHTNTADAVREGKATTKRRAPTHPRPHPRTEIRPKRHTRAHYPPTHPKATQQRTERHITRGRPNTTRSTRTPLPRRPT

SEQ ID NO: 990664 - protein, 81 aa, Homo sapiens
CKVSLDDYCPSDQVDTIQEKVLNMLRALYGNLDLQVYAAESPPSGNKQNIRLLCIWFSNRPLINLFVHESSREHCFILTFS

SEQ ID NO: 990665 - protein, 212 aa, Homo sapiens
MHDHALIIIFRYLLPTAVWPFANTHNKSKVIHNISDAQEIETSEAILPAIILVLIASHPYVILYYKQTEVYSSALSYSSKIKWAHQVVLIPTQYSATTVDVILQVPTYFPQLFLEPGDLRLLEVDYRVVTPDRKSPHSIEVKLSMHKTVLWQLMRLLPNIGFEKIRNAIPGASKIQDLIFQRYTSRGYTTVNALKSVEQNHSFRCHNPCLRM

SEQ ID NO: 990666 - protein, 206 aa, Homo sapiens
TAVKWGGSMLRDENVDASGSLAPGTFPFRLQMDPGKDKEGVTQPQGRSKEEICDTTSTRMRSLLDWQALITRSTTEDLPTCGTTSAPGGPIRTTPNMHISQTSGRGMGPKCHTQGVRARREEKKTDTKQRQTEKRGGQKNKNKTINKRTKQQRHEGGNIDQIRKQGNRCRPHATHEEIKGRTNKNTEIMIERRAERQDAGNTRKET

SEQ ID NO: 990667 - protein, 142 aa, Homo sapiens
MAPLWWFPFFLFPSIRVLLFLVFPLHCCCVVIELSALLHSTHWGSGLASQGKFVTLERLFILLGTKNFREFPLHPWARVPPGYICGYRGMETLGGSDLFNTTTLIKFPTTCTTVHLCDCINPVLFTWLNNNKKHNTFYHNTK

SEQ ID NO: 990668 - protein, 173 aa, Homo sapiens
FGKTVHTQMDNLVALATGEKGFGYKTQQIPSVIQGTSCIQGGRLHPGADGTGRQSSIYGERFPDENFKLKHIRDHGWDEQWNNDRSQDTNVTPRFYHQQTSQDKPWTENGKDTDGCKAKDSSRSMEGEGAETDGKTHKHRQTGINHLTGCDTSQTANKIEDGRSTIMTYDKGS

SEQ ID NO: 990669 - protein, 105 aa, Homo sapiens
MKLRLTPWRLPDPPISATRTIPTSMHYSPDCLNRPFHQSPTSLETYIMAEVIQLPFTSNVRPQYSLFCPLSIHSRDVGAIIIGSISTTHETLNSIGIYPPALQSH

SEQ ID NO: 990670 - protein, 291 aa, Homo sapiens
MAYGSPRGVRRRARDGPPEGAPGLVLDAGRVVRRGAQRGCFKLDGVPSCWGLGGPSFPSSLACESLPPLPRLIFFPWPIESSCLVSMGSRSSVRTSRARYVELKASGNVRSSVRGESRRSDSIDQLPCSSRVYQVCCVAPAALRRLGDSQYDARSPRGFLARCSAGNSGLREVDLVALRVPPTHCPPVGLPGYVSRGLDSFLLVCVIRGVAVNPRAIVQVKSRSAANGPSAPPCPGPATLVKVPRHLPFRAPCGIKGAPSPRSPTPRVAPGRISHAPGPDTRAFALPPAPP

SEQ ID NO: 990671 - protein, 297 aa, Homo sapiens
MSVDPEDFVGQNVLILGRGNSAFETGRETSLWCHKLYPIVLSRIPGSGHVLGPPIYVGKTLQDANQQLRHAWNTLPSINVPGSGVLSDVLTLTGFVAIRLNGHAYGNVAMSRREFFLEEASTRPECLTPCTLPQDDKWTTLHSARARMSVVSPTARGLEAFDFSASSISPSDLTRENAFGKKYPRDSKLATNPKKPGSVIPGYCSHSVGLTGNLAGFIHGFRYTGRAVHRLLEHRQHKVNWAATEVPHHTKVTNPQRRGRDRRSGLTDFGGAMTSRGENRLQEEETTNCTRTRGREH

SEQ ID NO: 990672 - protein, 37 aa, Homo sapiens
MSREDFQLNRAVVPRTPATPVDLPVRGGNIKGVQACA

SEQ ID NO: 990673 - protein, 308 aa, Homo sapiens
MAKVTTGSIKSSQLDNRSSAVPNRFLQYACGSSADNPGSVRCTRERRQFGVIEMRFASEVKTFGKRLGKRDIGDGAAISQTAERRLQRVGVAAGFDNHIGTLLAGQRLDLFTYISADGVKAEIRAVATGNITAMGDEDQTPITTEDRQRVSQSDGNRPMRQALPPPQKSPTRTWHRARRHGKLRRVVQTGFHGAATAGYWRQLKVMHCVNDEPPRRAAETHTLVATGVRTTQRPENGAQQCQWNCKTRRRDAEAKNTARERPQYGAGNHHARKNKLQGPPRTSKNRKGGERQREPARGATDQERNREH

SEQ ID NO: 990674 - protein, 107 aa, Homo sapiens
MSKIFRKNRSDYRHKPMTLYTFEASTYSPLVTSSSFAYTYESNFMYLSQVYRYLRKSITFYRYTSSDRKSNDTTSTVRPLLVIDACSIVVNRQLMRQGRRIIAASET

SEQ ID NO: 990675 - protein, 172 aa, Homo sapiens
MAWKKGRGTKGRRAYMYKFAPPLTKKGRPTGSKFFVMAPGGVHKRDARRGKGPKEIPQLGLGFAEHPHSERHTTGESHQPGEGEKPQEGSLRRDEEHTQRWYRRKEERKNPPGGLRKGGEGPWLDTFVSHPTANIVACLERAIRKQKGKTRKTQGTREISSHRGREKNNPRE

SEQ ID NO: 990676 - protein, 58 aa, Homo sapiens
MRRHNEGRSKKKKEEERREKRERRIKNNNMKSSQEDEQHRNKRNNKEHDLPSTPPDDR

SEQ ID NO: 990677 - protein, 104 aa, Homo sapiens
MNMRCGLPPQCVTTKGGELYVHKFFTHSPKFNVYILKYLKNSAPSGLRYKPPKLYTDKRGAGAQISRGHSVFLPVSPLKLHTNGSKYTQLYPCLSTVRYSPCST

SEQ ID NO: 990678 - protein, 66 aa, Homo sapiens
MKEALAPNKINPIYKKYPTLLFSPTQEIFRQSNVVATKSHYMKEQEELTRRGSINTQTHSITRYNK

SEQ ID NO: 990679 - protein, 167 aa, Homo sapiens
WKPLYVRPLYMPCGGIKRCETRANLTLHVQSCVQRKRTAEHANPDICSSHSQRIHVNGFALGDDHLTQLTRCVPTLRHRREGLWLPRQAEAGAWELKWTCVRYAGPLVLSFPSIRVLNLCPFLTKLLRSKQPERAPILGSPPEREIHDLPLRTEISWKGHSRKKCGG

SEQ ID NO: 990680 - protein, 77 aa, Homo sapiens
DIWSACSCYLTHRCSISAEAISRFTNARAQESWLVRRYRKYTLCQPECGYFTRNTYITLTKPTVHTTLTQVLLAADS

SEQ ID NO: 990681 - protein, 154 aa, Homo sapiens
MCMYSQSADLRIDSNSAPITSSNAHRTPSRSVASLCLTSDIVCGKTAYDVRTPNSVTEVSSPNYNGNSCDYTGVPMLTTTPILRQQVTKSHEAGIVTPNCSGVAMNLSELQAHIWHDCSRWPGILSANRVMPVLVIYPGMLSHYNGIVQKIGTK

SEQ ID NO: 990682 - protein, 132 aa, Homo sapiens
MSSVPSVTRKDFVTWFQYEYSGVPWQLLGLNPIASYRRMMLLSRQTGHDELYGYSKQSDVSVIVTPQYQNRGVAIVHIEPSLLVNSYDHNSSGAHDTKMHDPGHESPYVPSMVLRASVRCCALQIAKYVVPN

SEQ ID NO: 990683 - protein, 115 aa, Homo sapiens
MCGLIVVHADLRCVSLPTACRGASVLVGDVLHSAPERLILECKGLQVSLDHKATDHLVKTDTRGGAVIIRDTLVLLWYSWMHMTTLAAIDEGPGQLVRDSLHVLHCKTVSFLSPL

SEQ ID NO: 990684 - protein, 50 aa, Homo sapiens
MLTPASLTPRGRDPIRYKTYSDFGHLKLYSYSTRVRNIPFGILFGKKTFG

SEQ ID NO: 990685 - protein, 122 aa, Homo sapiens
LWYHTGHSTYILANRLYPESARDWFTMESPRRWSRDNVCSVRATCKAFPGLRDHVPNPSIASMSVSLSKNGKVSSLDLDVSPIILYGQDVNVYSGIMSRNPRHVEWIRWGEQMVFSYQTQTN

SEQ ID NO: 990686 - protein, 275 aa, Homo sapiens
SDRSITLPSCPQRHDLDPVGLSAVYVGEPRAVRCAPYFLFSTRRFIFHDNNNTWEGHYYHYSDPVCKHPTFSYLRPGPLQPRRPLVQVMGGTDFVFKVNHMKAPPMDAATASAAQRLQRPMICCGPRAPGRWASMLGCDPHRWLSWPWASNYLTRSTRSSQMEQDARGRYLLFNGQRPSRRVQPRQWPEKRATSYQMPLVQCASSSPRAEDLAGRTVEAACMGGPWEARLVLLVGDLLLVPLCLDLGSGILTSIFPQDLFGVVSRSFFLELMRMP

SEQ ID NO: 990687 - protein, 103 aa, Homo sapiens
MVRTLLLLHSPAVRLSAEEHVGLGTPGRNEPWFLMEYRKNTAWQPGGGYFEAECRDQPIADDQLTLNNRLRRTGVLPDHMNNEALEEKNFVIMLNMDHVQNCT

SEQ ID NO: 990688 - protein, 158 aa, Homo sapiens
MGYFGCFHLVPVGWVLMLEGGRLRGGTGPFEPPGRISEGMWRRPLSGLVSGGQWVGSPECLEGGGGGGAGLSLRVSGGVPREATGGGSVDWPEVGRRGRGYRVCNQRVSTQAGAGGPPSAHLRNPPLSLGELLARPYRPCLVSRRSELWWTPLGARVL

SEQ ID NO: 990689 - protein, 87 aa, Homo sapiens
APIIVFRGEHGYIGCLQVTESALDCQSLLAMTSSMLEFNDGAYTHQNDSIEANTGAVGSDSGVTSSGDAPVDFFFEFCDYNRGGHSR

SEQ ID NO: 990690 - protein, 150 aa, Homo sapiens
MATMISLGASSPYARCYSLPCLHFGLISVALLAYRSCAVGIRVLEGRDGEHVLPCLVCCSLLEVCVALLCGVRHIQRHRLGNVGKGPTSGDGLVRIPLPIDIYTLKISLIHKVLLNRYASVHFLYPRRVPTLATLGAAFQGSLGVFLGKR

SEQ ID NO: 990691 - protein, 132 aa, Homo sapiens
MSPLIKLINALILSTSPPHPNISASDETSAHSVGACLILQTHHRTIPSHAASSPDRLNRLFIEIAHYHSMTYNYVAEFIRYLHRQWRLNYSLSASSYTSGEAYITDHFSTQKPEIIGRVILLLATDSQASRS

SEQ ID NO: 990692 - protein, 521 aa, Homo sapiens
MRSLRFTQPVHGTSDVRLRSETPSDLRLAIRIYPARLMGHFENAGDYFPQKTFGSQGETVVPVCLVTLALGNWHPHMYNGGIPEGLTIWEADLLRPSLKAFPTFWCAPHVKNPQANIFPRPGESSDKDGSTNNPTKTQGGPQPPGKTPPSRPPTHDQHPTPTTTRQYSVPTSRHNLNCLIGEDNYIILTPTTTNHTTHPPTPLHPTQNHAPLHHTTPPATTILLPHNNTHQTPLRGRSPDSDDRRHHTEKERRGGTGDTHQRPHRRTTDARREERGKGTAEAENSRSSELEGREHDEERREVEEGEEEDREEVEGRTAGRDRREAEAAEEQSNNKESTEDSTKKRAQTEERNDSQAAEVREKRQQEEENREARTEKRRTEQTDGCSGRKQENHRRRRQQSDRRHSDGKLPRDTHAAHTHSGQENMTHNETQQTHAPHTQHARPAKRDGATETHTQTANTTSHPRTHTNACQQHSETVRLTATTQRLDRKKQLRLATDYSTHDGVRSSACDAAIRPTPHAHT

SEQ ID NO: 990693 - protein, 255 aa, Homo sapiens
KKQKATTIFFLIFSQKGRERGDTCVWGLGPNPRPTPGPVARARENKGTRRGKSPGTQAENRNLGQRPSERPWGNAQEVRGWEQRLHLEGKQMESHVGKGGGNTKQKPRKNKRKHTWGGPPLWEQPQKGEHRGPERRVDTPSGQKEERVERERPERSRRKEAKKVNKGVRRKKRKEEAERKTSGSEKEPPKKTGRAPGCVEREGGVKHCGGGGAPKKPKEEQRAPTKKRAPHTEPPRTGVWGKEGRTQHTKKSAPK

SEQ ID NO: 990694 - protein, 499 aa, Homo sapiens
SCWSSESPRSRWPPPTLASVSYPVLMYDMWACNTFSPARKIISRCEYASMRSIKLAFVQPLEIQTFRGCVPSCGEENDFPTDGAQQLIEKIVEYCMLTIGMCHEWAQLLMLRLLIDKARVETQNQLSPYNETMTSGECDPSCCPNLVCMHVWQKNDARLQVPCLGPCGASDYYLEELMQTGPQLVPYGSILGPLYSVMLEQLGSASEGAQSSLQEVYHKSMTLERNPPPGLPSIIFEPSNGREKVHCPQQWAFARGNLGHNFPVCPQGHMSKGYRELGRPVTSGNLWCNTWPYEAPHNFDPGWAETPGGQVNRRSDDGDHTPNTDATRLPPVPTLILLTEYDSFAFIFLAWYGAQRARGARGETGHGPRGTWGSGMEGHRRTTMAPRAGREQTRGHDSTTRPRTRTAAREHGAARRGEAGASRARQEWHEGKASTQPATSGEGAGDTCAEVGARDTRGARAGVEARGRDGVHGDGAGRTRERWGRGRVETAGVREGERR

SEQ ID NO: 990695 - protein, 176 aa, Homo sapiens
MSPKSTGFPIPGENSKPVFPASAGGSWVPGRWSRVVWSWQHTLAPPQAVFKGGFQPGSPMQACMVHGRTVSGGWIRTLLGLVLTGRVACRPLFNYPVLKTSGPLRWPTCSWGVLQGGRGWGPLRFTQPPPWARPGRCGWTPPAGVSPPGFIAHCTGGTCVGPPRVFTGCRHCLPPQ

SEQ ID NO: 990696 - protein, 434 aa, Homo sapiens
MPEKGRARSAISHSCGEAHGRARGGPQKHGESTTPTTHSIKQKARSHRSTRTHTSHDPILTPHYYPPPKQARTTTTHPRTHPHTPPPTTLIYYYNIIITTHHTNYTSIQTTHTISRSLSNITPQHNYTTSHHHPTPRHIQSPTYNFNQILYITLNSIRLTNTTTNNEQQQTPNRPEPNKYHIMTYNILIFTTYFVITTVRANYTDMLLASNSYYTIISHNHRIETDPIQRITIQRTQHVINLRTIEDDYIHSHTLHTSITNTIINLQIQNRAHTHPTHNPDQTLDVSLEHPHKSPDITQFTHKHHHTHHTVHHTQHHTHTNNHNEIYNHHPHTTDTHGSKNDRKEENRTKSSKIEIGTKQEAKRDTRTRDGTMAGSTTRKQQHQRCDNTPSQQTQTHRRSTDHRREDNPHQRHTKTTTRPQQGATTGGHNKMET

SEQ ID NO: 990697 - protein, 231 aa, Homo sapiens
PFGVVLFRNLPNIQHNYDSPFTPLFVFFHSVIEHKSSFTGFHSVIYKCAFQVQATSPNPSRETCVSHSPFYMCIKSRIISNNLTYHYTGWWKINAFSFILKGDPKRIVPPWHSDEVHSECYFHMLGITTLTFSYHHSLLHAISSRGAVPHKRFVTTVPNFSLVHTSLWFLPFSLYGALYPLTIIPSRGVVCVYSGESARTFSQPTTHHLISFLSALNISLSPRVLCRGGEI

SEQ ID NO: 990698 - protein, 95 aa, Homo sapiens
WMRLIKEFSIYMTKEWPHLCGRGHLHATWATLPMPFTRSPSNVPGARNNRDNRFLSSASAIESFDTDNERGWMVVMWIISLQPTVCNTQAFECFS

SEQ ID NO: 990699 - protein, 115 aa, Homo sapiens
AIPATDEFFPGETCQLRIGTGLIAVMLTLSNKSHVRGARLCVVVSDLESLPSSVTGEVVASESQSFSSTCTIPNKARLMCSVLEIFTYPINHLLRPENYLRLTLVKHDSGACQNE

SEQ ID NO: 990700 - protein, 68 aa, Homo sapiens
EIGNIISDAMKKVGRKGVSSQVKDGKSTDYDELQIIEGMKFDRRLYFSILYYYIKKVRNVNSRMPMFC

SEQ ID NO: 990701 - protein, 238 aa, Homo sapiens
MRQTLTDAGVAGRASRARLVRRCDLAVRHEGARRGGREHGETRAAQPRKRAARGSGQSTEGGVGAERGERYGAARVRGARGPATPESVSDGRRSDRRREAGREREQQGRVTQRDGAHTGGAPMDDERMGRASGSKLGANSSKRTGAAQRAEAKSSRADCAGRAWAARTDHQADVSQKDHKHTRTRSHALQRTSDIAPTQRQQRGRAGGDAVAGDPTPHRTLRSGTHPTQRATALAYRR

SEQ ID NO: 990702 - protein, 105 aa, Homo sapiens
MLRMGCVMGRALNVLAPSPGWGSESMALIPRGHGGELADREELRQGNAAKVAAWYVPAQDGGSPGEAPNARLGAPNLGRGELISEQGSIARKSTAGPHGPRGGNS

SEQ ID NO: 990703 - protein, 279 aa, Homo sapiens
HKVFAVSLVKPNPIILYLGGACVLLLSSRKLYPSVSERMIIMSTFSVPIRPSSLINLTPFIDAEQHRNAAYSLMCTTCKLFIYASIYVNTIQGPTLYSPPWSASIGRILHFWCDKSRNSFFDERLFYAVSVREDSVYLRSYYSPTIRDAMVISLTTLQNMAQGDYMEISLANKRPYYLTLSMTNALTSGKDSPEPNAYEGNYSQIISTFRNLTRRIEPNAHHWQGSIRNHQSLIGKGDTRDKGCIEHAVIQQCQDERSAHILILARILPQAWGDNRNFQ

SEQ ID NO: 990704 - protein, 74 aa, Homo sapiens
LLLLIGPILIGNGIANAYSNDKILEHIYKLRKGPKRCRPLRVYYNLFADAIKLFTKRGALKARSGSTITRSTSN

SEQ ID NO: 990705 - protein, 119 aa, Homo sapiens
MWKKNIRGDNSTCEEHKKLNRRYNSTVTEQRRDDEKIDTKRKEYKERREADDAKNERRAPQQRRRKEHNDEQLHTQSHHRQQLKRAPNKETDTKNTERGKRKTKRRKQHATDTTIQDTK

SEQ ID NO: 990706 - protein, 100 aa, Homo sapiens
MIDAWCMSDEGARGTEEEEVRSRRNKNRITLIQVGDSEFDSPPTKWVRRNDRWKMVNISRGRFDERIIGEQGGTYLWVVHTKQRREQEEKAQHEDDEEKT

SEQ ID NO: 990707 - protein, 193 aa, Homo sapiens
MDGKETYRGRWRYNQQKKHPEWNSDTTDTPRKRATQTHKWEKRRHTALKRYKEAEHTQKKADHDQNAKRNQQQQGGKLTKPGHPSRHPEHKKENTEQPGPTPNMKTTYDKTRRARKSMQQTQEPKTSTPHKEDDQESRVRKTHNHQEPGKKAHGITENRRTDKPRTATHEKRTNPKEPQETSDNTQNQHRHEN

SEQ ID NO: 990708 - protein, 204 aa, Homo sapiens
MEYSNHGPTRVTRGRRVPTGCTFRCSARWEALHKGRGTRRDGDSTKEGRPPTCDKPFGETTRERQRQPTTGRRHAAHIAHRDRLQNEASPRGPEKWYKRAPQGGTKLGKTPVEYTAKEEPVRPGTVVHPREKTPHTPSRKGTQKYNKHQRARLETDERDRITEKNTKVGTRGRKQNPGEKGVTPISKSNDIKRKNTNNNGDPTK

SEQ ID NO: 990709 - protein, 72 aa, Homo sapiens
SLQCHHPRKAFPDPARNKQGTKCAHIVLESRLSCVCLPPPHLPSSVWCFARLQAEAPVFPCFFSDREIKCAP

SEQ ID NO: 990710 - protein, 269 aa, Homo sapiens
MRKEEKERSTPIREISSARARNTYTRNNKEIQREADKVRQDKGITHQGCQTNTQGECNEAQDLTQIKREQKGQQRDRQQPSIVERQPQKKETSTEQQPQDNDNRKQMQKQHEEKQKSHREKKDTEENDKRDTDENTTRTRDNEGEQTQQHNERPRVNETKEEQAQDERKKTSENKTEAADRAQEDQETDETRRQREIAEHRSRHRARAENAEKGATHHQDRKPTQKGGNKQTKSTHNDRDREHDKQTKHTDDKKTGHSRHTPKRAETKR

SEQ ID NO: 990711 - protein, 346 aa, Homo sapiens
MAQEQSKGLLPQQSSQQTDHGSSQQPVQILIDGPDPGRTHTHDQCNQPDNNHTPHPRMGTIPIIENNNIERETRAIENRKLGQDKGILSTTHIEKNEYHHKPTLTSLCLSSSLNQKEKDKQPHHKRERGTTPTKSAPRHRSKKKGGTNNKNTQDKPRKRNTKENKHHTADQQQKTQQQARDNPEQKHAEHNKHTNHAHNHEEDSTEQTTKRHREKQAKDTKKREQKDTEKTNKQTRNPRMNGGTPARERRQRNTAGAHAGTERNQRGRQQERTQTEMNRDDEEGRKTARGRMSRRPTTPRRAATTTKRRREEADTRGTRRGAEGEDGEDGAQRKGTTRSKRSPTAV

SEQ ID NO: 990712 - protein, 280 aa, Homo sapiens
MYHLTQKPENIREQEYRPCLPTNRTNKHISLEHMIHHRGGHKISSLERGQQELTKAIQSPDQSPSKIEEQNPGTQEHLERGQTSKEQKTPTPYKRTDINLTNNTRETTTSEKERNTQEEKTQTSRKNKDEDKQRNKKKTHKSEKMTATRNEKKNTQNTTRKKSERTGGREPSGRNDKAAPDSRATQEAIRKTITTTENTRGTEPAKRKTKTRAPTKTPTNRKKQNTTTTGDRKNTPAEERKKQHENGKTKRKEQKEDRKKQKKDAREESNEKRRKNHQTK

SEQ ID NO: 990713 - protein, 71 aa, Homo sapiens
KHHQDPSRVTTGNGLMHRDFVADSDQMSDESNENYLGHKWWPPLSIDFLAHPSTGSFYNVTRMAMWNPMTS

SEQ ID NO: 990714 - protein, 103 aa, Homo sapiens
MGLYELACRITDIPRVQSLSWVRVVLTDEMCYVTEFMIRYVIQSLVFIYFKYRSLYRIGTKRYKAYFTIAPSPVLVILIINLVLYPKPATYNRVSNCANEPLI

SEQ ID NO: 990715 - protein, 120 aa, Homo sapiens
MALFPLVTSLRKRPQGVPPQRLFAMVGATQAASPRGTNRLAPSPWGKQNSAGARAARMSTLRRTSRDSAGDDLSKPHVGTSQSRLDSYGKYTPQPAAAPLIRNKHDEGQRGTDATTPPPP

SEQ ID NO: 990716 - protein, 137 aa, Homo sapiens
VESECKSDVEHVVPCSLNYELDNPSETFLSCCSYCLVLVATSLYAQEGTSPNTMADAAGRGRGQSLYSRSEAVLACVASDVSVLERLVSIVLLPCLLGVVRRSLASASRCRLVFGSIIALLAGPSRGDLLFDLNLFL

SEQ ID NO: 990717 - protein, 127 aa, Homo sapiens
MCYFVLPTSSYATQRNLYAVAFIVSTYKINIMLLTKQQTPGFDYTHTVWDETSEVEVSAHPGITRVSVCLIYRSLLNLPVHTHSRKLVTPPHMYHPNYQSTASICNDTPYTHHTMKYDYQPLIVPAP

SEQ ID NO: 990718 - protein, 100 aa, Homo sapiens
MVKPHKSRSAFLNRFTWPCLFSKHNCDNLRSPANASKFHYHINSTNACNVQASRVTCTSFYSLSLSYSMSSRGACLKSMWIITHNTLVLTGKIFLHVSYL

SEQ ID NO: 990719 - protein, 122 aa, Homo sapiens
MWPRCVTTRKRTLPRATTHPPVSKKAPSQITGINSLFYTSQEGFFLFSAGDFSLEPFLPTSRGLEPPYPPNLRKGHCGPQTEASPRLKFPLEESPTSYKPHSVIYFANSRRVSQSNLEAFTN

SEQ ID NO: 990720 - protein, 169 aa, Homo sapiens
MGPKKNKTHLGKKGAPQKETRPEVINDQEHGHALSPQRDGENTSDHRGSPGQQEPLQSGGRATSGDTLPTQQSESAQGANTRDSRGYRGDTTTASNRTGAHKHKMRPQRRINNQLNATYLSTRARTPPKRNHTNQTKAEPTDRQQPQNRQINTDNTQRPTRQHAHPPTS

SEQ ID NO: 990721 - protein, 204 aa, Homo sapiens
MLNLHTTYEAIDYVHNLNHTSNAENYVVPQQLVSPTTEKDASQHNTCTSRIPHERPTARRAKPSDRHYIKGTTPDVKHKQSHNSQASERHDNQYGPDTQQTIARTPPTTQQVQQEKQNQTEGHHPTHVASPPAATDQHKIPQRHANGHQAQHKTKQAHHTTERITAYHTGNTNTKHKTSQARTHKKPQAPSTTQATHTQNEDRR

SEQ ID NO: 990722 - protein, 109 aa, Homo sapiens
MVYTHVTITGHIRPLDMLKGQGLCDEQSIPVNFPKEWVGCNWNSLLKNLAQCGTTFLMEATRYILNRASIEYSGLLFPSLWGDGSERELLVFIGVQIYEALGDSKNNEE

SEQ ID NO: 990723 - protein, 194 aa, Homo sapiens
KQEHTRTIAPSDTPHYSPKIDVIPKNIPVHVEDSMQSNDNEVERRRMYQIISEAEDRPDFRNSFQHCNATDPARGERDKRRDPCSLRSMQITILWRLDSYSNLAHARGDLSTQERPQRLQDGQRAPEAARSEELKNENRLMLLAPCMQQAPTMGVWWAEGNPGSVDAPPATAAEPAPRRMLASVWAPFSQSSYA

SEQ ID NO: 990724 - protein, 197 aa, Homo sapiens
LRATSGPVCTVPGCGCPGLIAATHNLYSMNDCAQRRSCPVLCGLTDISWSNIPLRDRGLHGPSARFLSILGSLCFGMDPIQSCDVTCADVHVLCSLLALWHVEDAWQLVWAGWRRDAGSLLLTSKLIRSHPCHCPREETNYSSKAPTPEGHWVGRVDGWTDGSTCQQGQCRSLTDRWDVRKYLPRQSLVAERPHFCV

SEQ ID NO: 990725 - protein, 54 aa, Homo sapiens
RKCNGAIPGGISHAFPLYLMYLFAGILMLRRNLGYIQLRKRAPQRVGLGYNLAD

SEQ ID NO: 990726 - protein, 216 aa, Homo sapiens
MPRFIVIEELTAAVSILRVVAARIDPRLAYFASPSLHVTVAFCLRVTDTGRRCLVDRNRFVLLLVLRLCFATARFIVGLIWISRIGSARLPGLCASDDKMRFEVGKGLLPFQGVSDLAVGPGRVCSRAAVEACVSPRPYVFIPKKSCIAWWSRPDRSGCIQRLPRLHGAMRCELRSLSLLRYSLIRSRVFRIDGLSRVQAPPYFEIRLEIGRSDVY

SEQ ID NO: 990727 - protein, 565 aa, Homo sapiens
WCGGGEPGIELPRSERAGHRLHRPFRPPSGRPQPCGSPRPDPPNETSPTRLLNDLIPENHRIDRSQETHRTDTERIDRHETEETHTNTKNYRARPRTPIRATQRHTKPKHRETRRSTKDKRPRQRHPSTHEDTQMSQRERKKTQAAEVDRDHRHTTPETQAQRQSRTEARHRNENTTGAGQHRPRREAPGRPEQHGDRARQRATATGHGDRRSTHNRGSSRQKPTKRDAKRSRSATERATEREKTTAEQRKRRDLSEQGDRTKHAEQAGDRTAKTKEEQNQTPHPETRQAKDDKKHTRADKEMPDRDTMTTDTPTRRDQARGRDSEERAARHEPQTRRSRSEEHDAAADEEATRESPHERRTERTSTHRRARRRRRRRGRQRNEATDQRRTDAANERGERQQRQAARGRRGTERAGRTMTEQEHGHGAQSAAHTPQTAESRQAQRKRQSKADIEDSHTARAATAPPELRADQEGEKRTPRTATTLDADAEAEPIGEHHMRRLRRPPAARAQRGRRRVANRTTREEGQRDDRERRELRGATSDGKQRHREAPLGGAERAHEETETE

SEQ ID NO: 990728 - protein, 319 aa, Homo sapiens
GGGAMELKDGANVNKAQMMGGLTDAAALDTPPRCRAHKVQPESKQTWVGRSRDSPPTGWAALATPDPSQACSLIHEMELGQGGHRKALQTVKCSAYVGVPVASPEPVGEHSAVQARAPVGHPAVHPARGRKARTLANRSRVRLVRASAWRSRRWKSLGDMMAGEKKRRHRKLVTAMNGTFWRGAEERGLESPRPGLLGSPLPLGSVTGPRRDTASLVIPMGSWYATVFAGLAQPVTRPASQRVRAHSCWTRENSGKRGRVAKGADQGETARTAGRDAQRAPVGPRLNVQRPPCEEDTKTQVRGDEKDRKAPQKGPRDEE

SEQ ID NO: 990729 - protein, 417 aa, Homo sapiens
GKHQAEHIALNESDLHPLPSFAYIVNLHSHRMKKYYGDHWDHGLHCDLVRPQRARATKQLTGDLGKSVMASTSMWMCGRQGKGNKCSSVRGSLLMLESKQDEELLQRIVVSIVAAYGPGHGYPLPGTLSEVTSSYQELHAGGDRKKLEELLIKTKKEKPTFIPYFICACKEAARRKFLLGYQPRGKPRIEYVTVTPEGFRYRGQIFPTVNGLFRWFKDHQQDPVPGITPSSSSRTGAPSSINATPVNIQLAESDTGCECPGLRSMTFTDVQGQIAAGDKARDRTLNATPSQWWLHSQIRVMEAMEDGTEWFTHGIPPTAQEQEHRGPPHYNERREVTYTRHRRGSDKSARSRTKDYTGANTNSERRAHRHISRNEGRNRPYNACENGDAKRTKRKRESASSTNRTHEREARTYTSDR

SEQ ID NO: 990730 - protein, 476 aa, Homo sapiens
MQRWSRDNPTMQCDCRDSEKSIGSCRIRGSQDQDPVNSQSLTNAVSGTQAKLKSSQMVRWYAQWNLDAEYSRGDKLITFKSRRSHVDTACQSCHSLKLGADESPHVYATEQLVHYSATYVTSARHRFGTRDDGPTANKKQVQKISFCERGGLDPGNESCRLAHSLIAHPNLNAVMEGASGSPQFRAGIGHARIVVPCALLDIVVACCSALQIPLGVPRLRWVELVRLSTGELPRYQLGFIRHERKRNIGWHLRRNPRSASIERKKTVLRWDSTPRVAFWERSPFIRQETLSVNLGWRRSPGLAPPLRTLSFLGILSLSPRHFVRVPFSRVSCYRVGPPPVAFVPRGMSVRDFALLEGEGPSLAGETLYFLHLVRVCSTNYSWVFPLWPRWYVFTGLVATPIGVERFKKYLPVTFTTEGVSLGRRQPSRGITTMRASRDNMTHVVVTDSLEDERKYPKKEDAASVHHLQTKDRMPHD

SEQ ID NO: 990731 - protein, 463 aa, Homo sapiens
INILLERLRPAWADTRFDTYSIGHFGRKLPCTDDAFARQRAGRTPSHRTVRVCGWCEYDAETVPSKQPEERGIGSLRSRAGTYSGLLASGAVRDAMELYHTDAKRRSTECPWCVVVEPAHSERARVLDLGRFAHTHMMGWPASYRRGMANRRRRGRRNCPQTCSVRTQMGRVLGTRRQVRPRAFRTTRSVGLRDRGRPRHTVENRSAAAIPGAPLGFYTRAKATGPCTFTGTGLGPLIVAAWRPQRMGFRGWFRPRAYREGPFGSRAGGWVRFPRPKESNASFPCERGLGLALGGIKIAQATLAIRAPGSTPNNPHLIPFRSKHAHSPLQTSNSNLKKPRNVKHIWFVNLHRNFFSHANAQNHVEIFRLLRVLASLLTRGRQEAALGQTAPRGTRQKLAFEIALWGFIGCQKGVPLRPGGRNPKGPPCAVVWEFYAHFEAAEGVPSFFVGLLPSPPDVSATSV

SEQ ID NO: 990732 - protein, 435 aa, Homo sapiens
TAAAPAAPQCPECPAGPRRSGKWDPGPRQNPGAAPGTPAEESRLPSHVPFRPSCPESPWPDLTMSYPGYPPAPRWLPTSCTRVVVPGVGACRTPPSAPVDAPTSGWITVVTYCGGQITTRDLSLVGMADNSVWDSLAGCQTMPQSVYPWVPLWAGLAKQKGPPGRGWRLGAHDTDRSPNLVPVRIWDMVSRTNLIGGIKHNRSSEWPLHVFPVKYSQGEPRLWPEGDEPPLGLAPPGMKRESLKEDRYSVGNVNSGKELHDAVKVVQDGKSPHESKEEDTDERNKAKENHGEPGAGETTAERTPKTQARKHTERRVTLDGSPGINPPSDKAEGTGEQTKKRENRQKKRTKLGDVGIVSEREGEKSKYQEGVRKNGHRMDTKWRNMRRSGERKTDLKLSNDEWRRRANTPESKRSNKDERGYMQKCARRSRVANEK

SEQ ID NO: 990733 - protein, 219 aa, Homo sapiens
VESSSEHALNKEALIKKIWMEHPMMPHESLLETSGSLASEMMMVDMEPGDPNQMYTLGAESTGNSYGMCLGDHFIVYDRSRRDIIIHVIDVSETPGMMRVEHTYECRPHRMYAALRYVGQWTPIGVLASAGKDCRKEGTHCTSIHTPIKFCHASEPVRRYSKKQKSRGVNLWVERFLILAQVRTWDEIRPELLGTPGRPVDEIRRIGTKVLAHSKCSKP

SEQ ID NO: 990734 - protein, 356 aa, Homo sapiens
MSYCLIPDIVPPSRYRGAVPLSLGSLCNNTIPSRPLENAEGGSEGGISGACWMLTSKTSDLDLGEANRVTLVLDSPELVCTLISEVLIRQGSYEPFLSSEDLFLDYANPSGFPRTGIEAKGRTYRGPGLRGELETGCGERWATMTLTKFAVEPNPIKRDTATGKETAVPRGTRKQRNPPGCTGRARNKRRRGPLIPEEQAERATMETGPDTETQRPGDPRQVTPAPNKDHPGRAQVYTRDDPQESDTPLGTGTTLFWGTPHSRGKREPRLITNKDIPRETPWRHDEQTTQLKTIQGSIKQAMPVPIIRQEDNNYRVIGPSTPQPNKTSKCSRATTRYLFSPHPARSLLSRSSISGR

SEQ ID NO: 990735 - protein, 108 aa, Homo sapiens
MDLTEPVEHRSFLMTVPVPGVRGTHSEEEGFAMDEEDVVTGEAELTVGSCLEGTKLSRPNGNSLAIFLLRTGTSEVAKQIKGIHMMLTTSRRAFLKELKTLGVLCPTR

SEQ ID NO: 990736 - protein, 212 aa, Homo sapiens
MEYLLNTLTRFMRYQRFFSPCCLTHGSIKRTKKPVKLDQKRRAMRASHLAFAVTRSDEDLGEGCHRILQEDVTVTSWNSLLKSHARHQMGNCPGSPCVTARVDPGIHVRHLPVEYGSDSVWNQAAFVHLRRDYHTFKVAGVHIACQDMVDSVPVVHKQHRGATGTESRFDKGPRSPDAFNLQADELARAELEKYDSFTGLIGTRFERPNGTF

SEQ ID NO: 990737 - protein, 570 aa, Homo sapiens
PGRGVLRWRRRRRCSPRGPRERGDPVLAQTMGRRRHLLDPRHKPRPQVIRTYTRTEKTRKERKKKRKKRLPTGAGAQAEKAREESSGRHENGKKEGGRERPETEETDERSRRDGRRRQGSRDSKETEGDREHDGDSASAAHEAQESRERTEREPRGERSRERKEGEAKKKSQRGGSDRHRERRAEREGEKRGDGEGRHEREREQRRGGEARRRQRRREEKGRKGEREGRGEGSGDGGEHERTTEGGGEKGGKGGRSGRGGKGKRGPGTTSGRRRGGRRGKEGSEERPGETQTRREGEGAESRAQEGTKGERRQKNEAGRRRGREKGNEEHTSAKSEGQSETAKEGGGSRRRDRGRRGRKKREAKGEEKPGRAQRRATRERRESGGKKDKEEEERREREEGTRQAGEGEGARRGEREKAAREREGADEEARERDEGMGRRRGSAGEQGPERRERERREAEGRRDARKRKATEAGPGRRQERGEEDTADDSEPPPHEHDEEEARQSERRVHRARRSGETTEGDEKRSRVRQREAEEVARTATEEDEQQAEREGRRRDEEADEAVLRPGVDGG

SEQ ID NO: 990738 - protein, 79 aa, Homo sapiens
GGLLSNYADARLAVHQLDSVVRRSLANFPSVFVEDARKEGPAVGRYDQWLQFRSAVIKTSLYRKDMRQLSHRMRSRALH

SEQ ID NO: 990739 - protein, 627 aa, Homo sapiens
TAMQLTVKALHGRECSLQVPEDELCVHAEAAWIIRRKLVDVPVAADAAGMHVLRGKALADGTDISDYIIVAPNSIASNLSVSITPWKKVLLRNEGRGPEAVGDSPRPREVWTGESPKSLARHLQCWQMPGQGPGTVYRRDYGEVPEFAWLLDDIERLAQPRSCTLKMTENNGEGLLQSSNSREHGEVPNARLPLHVALRCVLLLRDGLIIDHQLGMYLGLWPKVLAHLLHSIDLGYVPNLRRGDPDTRGTGDEWDSQAKARALKAGEKEKGPETGLQLMFPSEITRTSRLTEQYTMWSNQPIRRDLTPSVICLSRDLTTHLLTDNNRRDETQTNNSNTQTDTHRNDNKKSNPERKPHNTHTGNDASPREKSASERRSERGKEKRQEKDRSKNTERRGRRGRQATPPQTERRTRPQTGRRRDGERRGGGEEGEEERNRRRERTRKQESANTQEPRQTRKQKRKQENQHERHTRREPRETTAETSEATDKKDGRDRASREERERGAEKRTKTTERRKERRRGRRTTTEQHRGAARAGRTERKWKERRQRGEEEEETEDEEENAQKASERKQGQSETEETEEKEEQGEQGGEEGQDRESREDERTDGERESRGGRESETKNEQDRHKHTP

SEQ ID NO: 990740 - protein, 214 aa, Homo sapiens
MTHNQDTELRLMPESTRGHSKAATVTMCTPIRRDRRTSMQRTKRSRDTYNEKQDHGHTWTKLSNGPNAQQIIPVEHSKTMDHRARHCTHDTKAARSLDGKNSSKKHSQEPHYDTEEGAHMDPNRQANESKNNSQIQSHAVNANTSWHTKKAKMGTTMNLHNASIEGSRRHEANHRCTVAEGLQTATPSSTVRIDTTRRQQENQRGGYRTDNCYL

SEQ ID NO: 990741 - protein, 162 aa, Homo sapiens
MGSGDDPFGPGPQDLCKDLSFDLGKGENLENLPQGRDGTNELKDIPGGSLKQPAGKIGRGDFADREGQAEACCGHDGLNPVLGICTLRREERGCHPREGHVMKMWDPEHMRKKSPCCFPCLVLLLPPPSLLGVKKKKTGTRKRHTQDDSKKTKNNKRRENER

SEQ ID NO: 990742 - protein, 170 aa, Homo sapiens
MCEGPHGETCDVCYCISAVRYDGKAHLLNVLHLLHFFILDVVHVMLPVMTSRSIQSRKLGTWFFTFTKTTKHKNFEGHQRQECGRKNRYIEMGPVALRNETVNPRILGAKQKKTGRDPLKEKHIKYANTQGEPAITDAESEKERASTDRQPAPGDTHVTTKGLRQAIYRE

SEQ ID NO: 990743 - protein, 138 aa, Homo sapiens
MGKAKHLVGGGQLHSHQAIAFERIGQRVISCTVRCCENVERTGVCNGYFTRPHARYPICRMRRNGQEAVIDQTFYRYKYSLIEHRMACIMDHFSVFIVTCNQHIDLVAGITVIGMIKDKKPFAKTKLHFRRIGDKSGI

SEQ ID NO: 990744 - protein, 415 aa, Homo sapiens
QRCPPPDVLPRVALIMPDEDFFSLIQRVQAKRMDEQRVDLPGGPEPGWQADRPRPQTAVPAWMQSIRPCAHRQAQPDPTSWTTGLTVHRTTSIPRANCRGQDTGACSPTDLTRTQGDQAQGQSLAQYSEEEAVLPIPQAHGDPIDPSRLPYPYMPTDKKELNGDLDGQCQGTRKLVSLVMNVTRNPFIDHKAPYTQREDRRTLKNIVENNMHRSQTEEHNTKRERTMTHKTEEKNNKGSTWEPEKLTTPPKHGIHRNTDHATDKTMANKQVPRKGQQRKKEKREENRESWEAAAGRLERDAREEGRQQRTHRRQNKHGSTRVTRTTHRDNTRREGGEGARDERKAADRRGEDGEGKEGRQEGGNGEGRRRRAGGEEGERGSGGEERRGWEEGGERAENGAEGEREERRRAGRRTG

SEQ ID NO: 990745 - protein, 488 aa, Homo sapiens
TEYGPEICGAQRFVENTPGLLPLHTSLGPWHIRPTPGGRMPGCERAVKHYRAVCGAALKWTLSKAPYLCVCPNSPEEYDPMTGRCVPPTNFCWHSSQSYADPRHLTSPDILPSQDHPTDNPMHPSRNQGTPTARDPCWQTVDSQRSGIHCDNKQATENAMLHEAFPGPQDSVDNCARDRAGMHHMLEIDRACAHSTAAMHRPFPDQETTRRPHTGTPTQTEHREVASRAVPKPGQGSQQSAMHKPQQKDSADDMKERSHTTQGDNRAGDDIQTGIPHGTHSTRRTSPNRKHTTDETAQREAEWPGTGSHANDGTHWSTRRLTHEATQDKQREQEAVKSKRRIDQAQHPLEDARHITTGARHQHSSKTGIANTSKVRATAPGGRNTHTSNPKQGRLETRSYTHTAQLINAPRNKVRRNSRRTRVKHTRGATQEPQRPQPPQTRATMSSARPIKRETTRRRRIGKEHHEPQRNADHEHRHSGPALTRRRR

SEQ ID NO: 990746 - protein, 205 aa, Homo sapiens
GSCGLVGIERDRELRQEEPGAMVEKLRRLAAALARSEAAQYDRADAACGDLEAQKRLRASTRCFYVCCLEQDLWAEIAKNLHTMAGVKGLTMLDHEQVTPEDPGAQYLAYVLRLLADIGLKPLMERAQNLNPMVAVTVDTAGYTRRHQSSSHHYNTQHDMSMLMTSCSHPRGIVTTTHTIDQDSWTTEVPPEYTDLNTARTLTNG

SEQ ID NO: 990747 - protein, 120 aa, Homo sapiens
MGPSSSSPLYPPSSCSYTDSDICRSNSMRITGPRLRNTLRYRAPGQMVTFGKEDLTHREPKAPGTRDQGTAPLTQSQNGANPERTPRNGQGKPEQTGKNRTNRKRQRRETPERTKSLRQG

SEQ ID NO: 990748 - protein, 103 aa, Homo sapiens
MVGHSVNTLAFALCFPDLVACTSMPVIPHSIWVVQLVKIAEDIPQEVKAGANCIETCTDQYRWSSYTTTMSGERYRSARNSIDNNWRDINLEQDTQAAPRGEL

SEQ ID NO: 990749 - protein, 113 aa, Homo sapiens
MESETEPETRHAPWMKSPNQRPPQTCELSGDRVFGVWATINGPPEPRLPRASASRENRGEFILGSCSWITNVSGTCFQSRKNGMYTHLDVQCEESISKMPEINAKVAESTRGA

SEQ ID NO: 990750 - protein, 163 aa, Homo sapiens
MQACRQACSQLTGQAGQLTDDDGRPMSSTKERRQTERRMTYDTHNTATKLKLQKKQGTHGDHITSLHIPSLSNLTREITYQNKRGPDQTTRETVHTQQMTTTASHTQPNPKTSEEDFANRGEGQTKEPQKYHTDPWIIDPYNKLALNKETFSHEETCYMNLNN

SEQ ID NO: 990751 - protein, 115 aa, Homo sapiens
MKQEGERWSGARRGSTEKVTGTAEQGCRTTKQRAQTERADGEERGAEGKTNETEKADDRKSSGRSNEESERASDEHREREELERCASGGGSRGWALMTVSSEGMIAEEKDGEDAR

SEQ ID NO: 990752 - protein, 241 aa, Homo sapiens
MYRSFTDVQTTVENKIELGDQTPDGLIIGKTHLAQRHFPRKGYNAFILLRIQALKSPAIMTGPLCVSYLIANQEVTAYYRHPRPALKLTACILTTINRRVSGKWIDRAPVHELLTGHGKNGFSLHVTGQQYTWIVPPNRGQLTPGTVYGEQHIKKPGDYPIDNPVQGQQGIIHYKAAVGPIKPLGNLKTSLRTESRAIVGTFPFGQQQTNPQDTGFGTTPLYGARNRVPSVTISPEHKDRV

SEQ ID NO: 990753 - protein, 456 aa, Homo sapiens
MCVGSVRRNKERYKEQAHKCGLIYTVYTPDRTPNIICVSNKGGTTSLSHGDTPYNEEGRRAQTLYTHVSPEQKRPASITPRCAHMPRTQRATQNTRAKESTRQGTDKNDTTQTRQQTRKHTPSTARPTHTRENKKRTKKETPHTHRQKEKRPQQAQTKHTDTENRKKQPNNKKTQRKTNEKTQKKERTKNKTTQRRKRTQRRRREKEQRKRRRIKKERAEGRGSGQTAKGGENGSARAGRRGREKEETETEEPRGEETRERRGENEEKKSRGEEENGREGTKEEARKEERERERRETKRKGTIRRRRSDTNRHEGEKQRSTDTTNSDARTEGREGGSERRGEQTDNNKEKREEVEDGKEAANKQGERGEKEAQEHKKRNTENGSTEEEKRKNTDETHRKEEKSERKGEDREKTERNTEKREEGEKTEKNQEEKREDDERQKRAKTKQNGRKERRHD

SEQ ID NO: 990754 - protein, 191 aa, Homo sapiens
MALEVLNLPRISSWQDVNGLTMLDHEQVTPEDPGAQFYDSYWVCLAEIEAASLFMERAPAISTPIGRMCKCGQLQDISRRHREYHIYHVKFRMHDGCLNLTSITRDVNRFTLDPDSVHHKHTAYKILNRQHDKTWSHPRGYNIVTQDLRENAMTGGPKGEESYEVATKGKPKDGSKELGPGQPKRSKKMRN

SEQ ID NO: 990755 - protein, 97 aa, Homo sapiens
MRMCPDKRPTEGATLGMKPNDPQITDIPDPYPNEAICGKGQKTDSPEKRDRDINQEEADPQNLKTHRENTHKQNQKKEYNTHGEDTKPGNKTRHNHN

SEQ ID NO: 990756 - protein, 258 aa, Homo sapiens
AVSTLIGWALPHASEQKLQHKEDFVMWTCDWTRSASDGDQGRGTGGVEEPQHEDFPRLSRAITHTHECYQTILTTNMTDAWRTNRHDIRRKVESIGTCESTTHERPGKQQHTTSRRTAQTLVLLIHIHTNGVSPTMALDQVDHASDIRPMSPLSVDTTKAMTHEWTIESRHKQQQPRQANRNNKQTFTSKQHKIASQTHSSCMRNQCVRYAANRTGHPRGGPREEQRSDKKKERQAELQRTYTTRTNLIITLQHHYHD

SEQ ID NO: 990757 - protein, 149 aa, Homo sapiens
MIACCYNAREYKRGWVQHLSTLAFRQATGKMGDGSGAVGIRTIGGRYRMLSVVSFEVTHNVGFTESTELEEVKSRTHVPSCNVGRSVVLVSGLFHHNRTVLAGAANSAGDCHFAPLRELQPFNLPRKVQKSFTPETNSGPLKKRQGFNY

SEQ ID NO: 990758 - protein, 125 aa, Homo sapiens
MNTFGWRALLVDSGLGEERNRRRILAAFIQHPWGSKRLYAILATDPCTVSKISFVAGSRFAGDIILVRTNIDPCDSGKIGLPGYGPDLRSNRILLAERYACKKRSKNRSTGCPMLKGGTHTNFIK

SEQ ID NO: 990759 - protein, 108 aa, Homo sapiens
MRTPGPIPRRRHHDALDSQAAEPRDSHQQRPQRLRRPGPATSKTRGTHHQGTYTAPTHPPEPGTLPWPRLHPTTGSRSYDNWREEHTNTKRHHQTATQKEQQDEIHPQ

SEQ ID NO: 990760 - protein, 370 aa, Homo sapiens
MCPAVKTTETERQKAQGHKNHRKAPREEKEHTWEESVTFEKICVGQNCGEPFFPPQRVTALREKPLIFQQERPVMLPEGAKRGRRQSVLIAPPSAPTLCDEGHTVGGQTPQNDQRKEQRTHPKKSVVVSPLTGAYTTVGGMSSHDPPTGGEKKVEQSDEAEKGGTNKMVATNVAEEKTTEGGTTVNIKQSRLITYGEKAAAPHRRGDYKPHTATEKMYVVIKGEGPHTSQGGATTPDRRQVAHPSTNDDSKTHTQGWGGLWQSHRRSETQHKGAGRCNVRASEYLGTPRWPPHSRREGGRVRGNIHTEQRTKGGSTLRVMSRVDKPPHHVVSEGEHKPTAVAPRVRKNMGSEAARHTTSPSKRPKAHHES

SEQ ID NO: 990761 - protein, 116 aa, Homo sapiens
MLQNKVPTPKTYRPGTPTHSIHQVRGGQPKYHGDRERTPTKHTGSTQIQGEAEATRQTATRQHTATRTGNDKRGTENPHQPARQRKRWTRNQKPQQRTRAATHKQNNPTTPRGAEH

SEQ ID NO: 990762 - protein, 126 aa, Homo sapiens
RCVVEHMPCSALMPFSDTCAGLVIPPRHFAERANGSSVEQKELPLSLYGRYASPAPGNNTLERGPCSRGPTPAPEGGASRDELETGASARDKKSWDKLAKPPPEWVPDYPRRSIQNASGDLGERTG

SEQ ID NO: 990763 - protein, 117 aa, Homo sapiens
MCGPPSQQECVAATLTQSSDTVIRKEQVPPRSLRNGERIRRGRRPSCAAEKPVYWRRGSGADPGKELLKPRCLPHGGIYKLQAGLFLQPIIFYLNTYGTYGSGFILSGFGRTGSRTA

SEQ ID NO: 990764 - protein, 446 aa, Homo sapiens
AYYQRTSKKIGSDRAIGKKQLEKDFSSMKKYCQVIRVHCPHPDAPAILCASKKAHQMEHPALTRQAHVRRAQLPLAPCAPAPMTHATRYHADTHKLLQRPATADCTRTPHIPGCNPHAHQPALPKRARLHPTLASAPTHSTPHPLASAPTTLHPPPPLPPPPPAPPATLSPAPPATTPPALPLPHHSLSTPSLTPHARQSPPPNTRALTPPSHTAHPCPHLHPHTPPPTFTTTPHTHRPPPHPLPPSSSPPPPRHTTPPHPHYTPASSYPPPSSPPPPPLHHPTPPPPPTHPLPPPPHLLPSPPPLIPPPLPTHPTTHAHSPPPPTPTPTPTPSRTPTTPTHPRHQPSTSPPSPTPHPPHHTSASPHSALSHAPPPLTQLDSPPPPLPTPHSHTAPPTHTRDTHTHSHNHSPHTRTHRPTPQDTLSPHTTPTLTLTLTSRSHYHTC

SEQ ID NO: 990765 - protein, 414 aa, Homo sapiens
MTSVTKATAYDSFSNLLHQPSFNASHHTPSMCGLLPTHSSCKLHCLLAHNWHPTLLLPYIQLPAPPSSQHTLATSPSPAFPRQALPPPRLPRLLPRNLLAPCSHPPLLHHTTPLSHSLSHTLKPPPHHGTTHLYAPLPPLTSACHYPLPLTPANSTARIFTLLSTHYPAHQTRTPSPLLFPHKPRPLAPPRIQPPRSTPPLRSPSLHQPPTFTPTCAPLSPTFQRPPALPHQPFPPNAPTFLHSPSGPYASQPRLPPAVLTQFLPFHHLTLLLVSFPHTSSLHHLTHPLALQSTPLLHSSTTHLASPGPQPTSLSLVPPPRAPRPAPPSPLSSLTLLPPLPPTQPPPSHPYPPLTPPPFTPYLPTPTPLHPHTPSTTPPSPHSSPPPPPLPPTPPTQPSPHTAHLTPPRHTHPP

SEQ ID NO: 990766 - protein, 428 aa, Homo sapiens
IDSKAWRETLTLQKQLRYLLFPELARHLTPATGFSVHATQLDFYHQLGQLCSGPETRQPPGKRSTGAYKEPARDQGIYLAYGNDLHAGGHNPGRRRVNHQTMPYGRKQHGGPGPTTMCIEGSQDCENPKAKPHRFSIGTGTKGLYDRAIHVIQRCPLHAGSTVACDNTKNDAVHWQLTHGAKHQLKGANADLPEKSRGPERARADQQMDCRRQTLNTLAGNSTQVGPPEDVWKVHETALEPTTMTLPLGCPDEEPTSKVRPDPACRTKLTVMPRHIKRTPNNKITSVTPGGTKESTKEENAPNAKHPYRGSTQTAQIPPNNKNKITEQQEHTVQNKKQGHEPRTPQEKTRAERRRRAHTRTHIETGKRGREGTTESKTRRRTQEATRNKKKSRKNTEKKQKERNKTAKAQPVETEQINKKSREHQRRE

SEQ ID NO: 990767 - protein, 113 aa, Homo sapiens
RVCRQNTGVVKTTPKSQNRCKEHTTHINIVVIVTRPFGASPPLLAICIYKIAVSAIDIRVTIDKHLTKEAAVDREQGSSKVIAMESLGHKLERRSSATVGICRFDHRTLSAHL

SEQ ID NO: 990768 - protein, 107 aa, Homo sapiens
AALEECGGGDVEWAAMPPGAWALGPGRGWGPVLAWGVSWAPHHNHGAQQTLEDQVSEGHELEHTKLPLSVPQTDEHDARRETSYDTESRQTIITAERSKKDLTERDQ

SEQ ID NO: 990769 - protein, 309 aa, Homo sapiens
MHHCGPSRNRTRPQAILCLALGPAWAQPLNDAMFGTQLLQMTGRIDVSEAINFPMSRSTKSHLFPKADIKIIILDDLQTSMTDGAQQGLRQNHGKSTLHATLASAIACHCFGIGSIEPIQSPLSQPSGNTTADRAQILTRLTDIVTRARTRDNATPDDGPETAILFNGTKSNMRPRASTHPAATPFYGTSASIHAGRNGASKGHEYADPHPMTWYTGECTQNGRQCHQLANTETNTDPPSDRYEGNNTKEFLHTLSPRSHAPHEQSGTRVSRDVTPPLDPKENPPQRTISMITHRRAHDTQQPHDTRIA

SEQ ID NO: 990770 - protein, 373 aa, Homo sapiens
MHKCGQPPRVKIEGSVMQVLDRRRQRGTSPQSPHPQKTTTSRTQVIPGGQASDQTHRTNTMGSGNPGPSALDGDGQYLAGTDVVLWNPVPITIPGHACPDGHLTDRNSGPYIYLGDPRIEGTSSTTGLVGAQKGSRGKPSGHERVWRHAFPKGAGTRHGRKAQELESMTDTGNWGHDNTRPRLKNIVHGTNGALIDRFDLWSRTMRHCNNGAERKTHGREHTRSQNDKMTQDTQTAQKELTQKNFNAPQNNNNIKNTKTYNQPTKLTYPQTIKHTKTYTNRHNNNTTHTSTQHNSPTTQHTQQPLHKYNTPHYQHHHHKFTQKRDNNIISKLYILIHTITTIPYHNHIKSYSRIYYETPIHSNRLTTQANAYN

SEQ ID NO: 990771 - protein, 169 aa, Homo sapiens
MTVLCLVLVPWYDRTREPLAVDVKCREDFAKRICTTPTVLRCIVLRDSALDRDLASCLDVDECRSEAQPCAGRSAVRTLPGSYACCPGLDPGVPQRAPRAPVTDVGMSAKEYGPEFVEPDVDENTPGILALTNQTVNLCIRPNDQGGGMHRNVKRVLKTLPGVCEAALT

SEQ ID NO: 990772 - protein, 349 aa, Homo sapiens
MHLAAPASGAHSNLPACDLRQTQKLLHFLAPYHHLAGAAKTHYTFYTHAGQIVHIQAGPVWQPRSDAHSTGQVHQCMNHGHRTPTGNLTTGHSAPCKHGTAISCCHYQMNANRMSNYDILDDQSMDEIIGHHGDQWTSDSATGSLYEPASFQTQHTLLIFGSDHGDSVTNLEPKGPHTTAGAPEHELNIMYHGLQSTGTESQSRMSTMPDRAFSSIDPHLLAREAHTDSEQWGTSILDPATIQRKKTPETASSNNLQKREPSTHKRVMTTVRRDPTSDIPSPTQQEDKKHDANIWHDTREPTYSESDSRHRELTKQNNEDQPPDTATRVETTGPEPRTSQEHTKMTHMS

SEQ ID NO: 990773 - protein, 601 aa, Homo sapiens
GVVCLSSRTDGARLRYQDPEAELLSTELYRTAPTVVSLRRWRCEPSGDLCVSSWHLAALWVPAHAAAIISRFQASIRWRNAQRLVYASQKYSSKVDYAHLVSGGEGPVPVPTRRWGPTIALPWQRRLTYLTITIFPPAAYLPSVGTAAGNGTRYGVTRHKGLEEHDTLIGIPGQLDYWQPVGHHKAGSERAVTRRAAPHMATHSYNTPKGRWWQGSGLAIRFDNARRRHQSPSETRLAGGRPQDEGARLARGYKITGAEINEPRVAKTGLASDLGPPQWGTREAQTPPWGTKPQGGSPLNMGALACSTLGPPLAEISLRSAQNIRGNRPPPESITFVWKRFTPWGKGNPSQAFVPLKANMHSQKRFGTTDRLDIRTRTQRQWGWVCHPRGTAWKTPKSRVPQSQEDIGGMEGTRVNAGSIGRAKGGHGPSESHAATRQQREVSSLPSPRVNTEREHGKDTEYWERQPPERDSYHSGHGVATPTMGTSKDKDKAKSVKLVHRRKRYDPPIPDCNKYRRNGYCLINSEILDDKQKDRLMNRTTWCAPHKAASYWTNPSTTYTNTKKQDTGATQHDRRHSGSNKRQSKDDDMQPAEGVTSYDAT

SEQ ID NO: 990774 - protein, 207 aa, Homo sapiens
MNASYCTTTRLVRAGIQSMKGQQEDIQWSLGKSASRHVSVCSAFSLSDNTASHSIKVECLVSLHADKRTIGPDLVVSGYSNSEIRGLVLLRDTLAVRFSIINCPRSMTWFILFYSMFMGTKPHWQSLGNPLHTKSSGPCVGLGGFFLPHQWEPLGVHQGFPRAPERPLLTSRFWSKSLQEARTQLPFLTFPVHFCRPWRKLFFFNLK

SEQ ID NO: 990775 - protein, 157 aa, Homo sapiens
RGVMGGLFWRSALRGAALRPAGPGPEPARCATAREGPPGPGRRTHEWRMKPRWRCKRRESMRDDDPDDYREGQGHSRWMGMTDALQRHQRSVHCTKKYRGPCRKRKPLHTHDPSSDYHAALGDLDEWHNGYMEKRYNRSIPTHLKGPKELAQQPNIG

SEQ ID NO: 990776 - protein, 76 aa, Homo sapiens
VGPASRTTLRGATSDLEVRGSDLPALLADWTENVTAVQGSDTYALQLMRAYEAGAIPWELDDLRLELMPLEDTAGH

SEQ ID NO: 990777 - protein, 441 aa, Homo sapiens
MHVQSTCYVPIIKQHIGTQHARHQGPKATHNIAICMVSKGPCVCTVQSLLAIMPAHACHTCHLKQTIPQPALTAQHVTSRKHNMAMHSTFPIGTLRLYNADRQQNSCYHIESKTQMGPSTPCTLAHDYTDKNCSKELTRECDSTIGHNRIHDIMLALEAYSNLRPKPRPNKKITKYAGQATPYYIHGLQVKTQKQGGSTGPPTHIPREAHGTRHLELAGNTSPKLTDPRERQGDSAKGKHKNVEHLHWTRTGKRVGGYKTLKRNFDDHFFAKQHTHGTQMNGGNTTQGKHNLVHKQHRTALRDHDNDTINMINVRPFPFRPNGRLGFANTEIHANTITELQHTSWHHCKTYTTSHTHTSASSGEHNRAQVTKRRPITQPRRGDAPAAPHHGAIAPSGAQRETALLHREERKQGTKQHGEQPHPAHATTHREVRITTAKPDG

SEQ ID NO: 990778 - protein, 117 aa, Homo sapiens
MSATNMHQYKLHCNSTPEGQYTQKTQGVIDRDMNHQKADTHEKYGNAGPHMIELPREQLGTMIHNTPNNKSVNPKRREQNKNGDNQCETQHHPLGSKDRKNTERKYAPHPKGIRHVR

SEQ ID NO: 990779 - protein, 116 aa, Homo sapiens
SPAHGLPRHSRLHALLGLAMPVDLSKWSGALEPCEEDGRAACSDPHDMSPYSQGACGWTRLGKVLSAHPGSRNRPTSIFVGMVLAFQWHKRLHTWVLTRSPGIASQADGNGTPKNT

SEQ ID NO: 990780 - protein, 181 aa, Homo sapiens
VSWSIIDSASQRTIEAPAYLRKAPLPSPQQIHENICSALAYNPYYIMDMDYQVQIQEEFEESSEILLKAVSLKTRWEAHSTFDLSTGKHKHEFYLFSGIWYTRAGGATPSLLIVFRHHIGCHHNKTNRGGFTTAHKCSCALLQGVRHHNIYGGAPRSTLKGSPPSGTQQRRFNQPPSPPLF

SEQ ID NO: 990781 - protein, 459 aa, Homo sapiens
QGQRSRPVARVVTIDEGDGQDLQGWAAPSLAAPVDVRRVWVVPDQVRAVTLMVELQKRKEVVHTVSPGRDLTSVKLSPSAQGISWLLFIMDEHSGEIKRHDRSREARSQMPEGVIEVGREGSVPRAGEFITVEAVLIPIRAIGPTIARQHQTEAICPFPYNIRGPSGRRMNTGQLLCPVWVNSRATQSGCAISTAENCWGVTHALTKKLGVHRANPLNNEPSPRPPGPWRPLRVNPDPTRPVTNGAANTNDRKAQHSFATPPGGADGKRSECCDRHSQGCTWTRPLPPGLVLEPAYEVRSMGKQTGQPSPPKRPSVQRPSEIDTGTCTQTTGDWLPRRQFVERADHHGKGAQGVATDPARDRADPEQSSATTVANATYTPPPAKQHHDKRHDNKRTAPYPAHNTGNPQKGRRTHVYTPIRKLGQLGATTEKPTRARYRNRKHPDTVYDTRINNAVGTHA

SEQ ID NO: 990782 - protein, 195 aa, Homo sapiens
RKRPGVGAGPDSDPRGRFEPPSMVTEAPLIHPGPDSRPHRRTTQDPDLTQQLPRARTHRRLHLRDTDVRGKGDTDEFIIGDHRENAEMQTTPCSAPRPNRTNAMTERTMREEFDKEDNIGKRDAASHRQTEMTGAGERNTSVVTPRRDGNYHIGREDVERYCTSHKQNPEVIMDNYFAVGKQAEMAPYPIPMTKL

SEQ ID NO: 990783 - protein, 179 aa, Homo sapiens
MMTRSSAKIVNAHTGEKPDEFDVRHLPGSIWSWTTDNSDLNVLSSGTLNITDSYRNIDRWWLDGKLLIIFSSRYPHTDNLSRDNTKSGYYAAIGDTKFESGQHVVVSSGSEGAIHAITPNIANQPDNKKKGKKRPSETRYIPDKTCCRRNAHILLTRAMDMTQQAHIEEAQDDIRQIKT

SEQ ID NO: 990784 - protein, 290 aa, Homo sapiens
LGGVKCLVAETVSFGVFGKRVVCGPVYRSGDTRETGGVTALPLPARVYWYCTAISYAADPYALQTRLAKRGILKHSWTPEPDGHDDSFAEELLTELTPGGPTDGHQDWTGLTTKLVQRCSTPYPAGHPHIPTGHADTDPRYPGSPPHLNPSSAGLPNIGQERSGSSNAQMLTENVRTGGHDKSGTGALTSRHRSPGATSDQRATTQVPTRGPRTSSDQGIDDRWHNTQVSHREQRKTGTATRTTDSHRLNQEHVKTHRDTHNQRRHMAPISLYDHAPYAAMIQDRPINQK

SEQ ID NO: 990785 - protein, 293 aa, Homo sapiens
MAELETLYTYPENWRAFKATHRCSDTSGAQVRVLSETSPHSILWTKPTAPHEFHPPNFLHGKGPSNMRVMTGFCSVYESNAIAYYVSKEELRGKYSRRPQPSVVQWVSFAEYRYRAPSQYLGSTPPMDIMHHNKEATANAPEDVGDYCGCRTAYSTDEDYTAWANTCHRAEINRMSCDPRAGIYKTEILRDLTNRPGPNQGTNRSGPQPAINQAPIRGSTRAASQPRSARGPHASQAQETYSPTPRHPIRTHTTAPESTPGTHGRRRPEPPRRGQRTAHHRQGPGTRRAHLRP

SEQ ID NO: 990786 - protein, 283 aa, Homo sapiens
VKGHCYDGGAQEAAECAERRMVLLALVAGARLGRRLSGPGLGRRGTVTGGRALPEPARSGRILMAGRAPVVQYVSVAALTAPIAVFVWGLKSSRGTLACLPLWCPDSGPGPPGRCPTRRKNPSPCPIAWAGPTRFHLLIAGMDYTLLYSNDCWIITKNVWEMGLNKDSQLGITQEPKDKTEGLRSMCEASPVSLALHRTLRRNGCVAGLMGRGHSLGVDLTGKESISQWETILMRNVERKVVPKFKFNLKVHIVQQMQAFHVPVGPVTMDRNRHRSPKNNGKT

SEQ ID NO: 990787 - protein, 273 aa, Homo sapiens
LGHRRRGEKRIPSEPRPQVTPPPGDAWRSPSPLSASLHSTSPHPHDLSGTTTAGRAMAGRGGARTTQWTTLLGTRSVNLSWFCWGSLAERKSKPRPPPFVQGTRFTRYQESTIGAAFLTQTVCLDDTTTSTFEIWDTAGTRKRVITELSPMYFGGPKACIVVYDNHQNTQIQFATGQEPAVKGALQRQGQTPKSSIGTPTGNPGQNLAHAKQQLVDSPSEATSTLQTTDTVCLFMRGKSSKFAMHAAPNLHATSSEARQTKPRCTGAPRTKVP

SEQ ID NO: 990788 - protein, 246 aa, Homo sapiens
SSLSAPSVALAFQQHLLKLLLGFQPCHFALFQAGFGAGLLLQAGGQLRFTALVIQFAVAEFLFRLRQLRVQLLHLFFQTGNLFTQWLGLRTQLSFPDASDLYVPGRCSHSLWRFVGLVFLLLYVAQPLLIIFQIAVERFDFTIVNQVEIVSGGTQQMTVVRNDNQRAFKLDECFGECLTHVEVKVVSGSSNKQQIRPLQTINASTRPGFFPHRRSGRVYFGYFIALKTKRREGSQRHFLFPTPDGG

SEQ ID NO: 990789 - protein, 408 aa, Homo sapiens
MRQDSLDIKKISPFEHQTLLTSCTHPGDPDPAAHSAMRMSSAIRDILRASNLEAMRDVYIVKDLMETDLYKVAEQPAAEQMTIICYFLYQILRGPQGTIHSDNVLDRDLQPPNLSIRTQPATFTIWRYQALDRIAGYLSMTTPDFLRSNVDYALIPRAQRIVAETFQGANNQVPFDHLSLDDMPYEAIEMRLLTGPILSLTRTYLGYGSPHILGILGDPQYPRKNTSDGFAHTIVMPSNNHTEISDIHDPAVFEPNIPPTTNLTNLTAVPTIYHNPNIRIIVRKLLPPPSDYIRQITQLTNPHTRRRCDTTQGEHHQKRDITEGSTTKNKEGDNTTSTDNPTARGAQSKATSDAAGRTIAHQQRVPKANTAVDHQQNQQDQIAPEHSRTTKQRKEAAKQATKNTTNRR

SEQ ID NO: 990790 - protein, 165 aa, Homo sapiens
MVTQPTRPELAATTTNSRLEPRRDHSTPPPILLPWRKDHPRPQQLTNNTTHETKTGTRPEGRSVNKPPPGGPTLNGPPHHPRATKHNTPRRVPTTTQPPPNAHPHPANAPPPQHSIHAQNPPTRRNNATHTRPTDLPPHTPPHYTTRATHTQPITKHNTRQEHTT

SEQ ID NO: 990791 - protein, 341 aa, Homo sapiens
SFLLLQQSGDAWAARAEVDQLLVAQIVRDAARWTLAQDSPVPRLCCCPRGVPLRVPLGPPWPAGLVPGVTTLPCEPARCGCLRACIAGPAIALTTGRGPWLPICGAHAACAHKRRTGREQAVQQQTHSQQDTYKAERAGEEIDPTRRHPRTDTETQKAHPEGPRAGKGKHARTHPEQRTAGTNTNTHDPDTGPANHRHPQGGSPQRRPDATHTADHQRPRRNGKTPGTLSGTSTKPKPNRQIGQDEHRRARKRDQTQVPAGGTHPPPARPPRHDNTNHECTKRQTTNRGIQSRPHTRTSHTKETKATGSNHVGNTRRDKTKRPHSKRTAATTTEHHAAQFD

SEQ ID NO: 990792 - protein, 111 aa, Homo sapiens
MGKKQQRNATKEEIAQDNRKKENTQEEDNKKQRRRRGPQKSKRPDEKEEAEDRKKKRGTQGGREQKGETHEEQRATEKSRGEEKGTRGQREGTEPRQRRDGETQPEGGQKD

SEQ ID NO: 990793 - protein, 261 aa, Homo sapiens
VTHTPRGHVFRSEGLGLGESGKRAEPRNVRHGGSCQTRCNGLAVPYGLHTDPDSRHKYPLRSRPSVSAERTTPRIAAFMPGRITAALFNTPIILNHDYLLNFGMQMKSVAGSLLAHRSDPTNVHNEYNNHFLLNGFKVRPNGGILYNKMRVWLSFILIHESIDRITPPWVRRNRGPDGIITSDPGTRRTASPALPDPTPYVPEPKAESSSITTMNSRIKRVRPDCRVQNIVSAANNRPGSHDIIISADSSGNADPYMIDRS

SEQ ID NO: 990794 - protein, 109 aa, Homo sapiens
MHESIWGRLLSPVCSSIVLVVKRWVTVSKPYYQDLGGGIRMNLIWGHWVTISRNAEIARNPGKSDDVADMVPIDMGKLVSWATAEEAPVRLEPEFQDELKSPSIFGNVM

SEQ ID NO: 990795 - protein, 480 aa, Homo sapiens
MRTSRPVALALGWCAVVHSYPKLKALARIALGEGILVQDIPFDPGNMHMSYIFLSVHSIAEARGRDTEGQYRQASSLKGLGNGNSHFSNRFRQQAGGAVDWSFSLSRVKCSQFTHHMDLGGSRTMGEALSEGPRRGAYSCPMGESLKGIPWGTPTRGLEANPYRRSGSKGPEDIAPSGAYGWHLSGDTKAFLSLPQSKKEGLAAHGVHFPCHLIPPSPPPLRHVAMQGVSHPADSLQGNHSLVCWACPPGLSVALILLRNPLTCMGSPRLVHPWSRVCLRRAPLSFRSGDTGQPGPLGTPFWDSTSSTWFPIWACACLCGPGTDLNYYGGTRVWLPHPFRKMFRAPTGGGDNMCFVPTARGLCDTHNGVPRFGWPPRRTDQVAKHHPIDCVLPQPRPTQGRRHTHVDSSGDIHPSSSDATIAANERSSDHKPETHRPRTHTVGGQTVLDQHDNEIAPQRPIIPNKQVANQSDKNHTAAEQ

SEQ ID NO: 990796 - protein, 86 aa, Homo sapiens
RRITEMANGIGGSGRCSRVSTSAEETGLVVLKIYQDINQRNEWTNGNLKVCTREVRHGDLSSRKIGVEDYQAGFPIPYSHRQEDDG

SEQ ID NO: 990797 - protein, 162 aa, Homo sapiens
GKSRGTGGLWVKAEANMGFGASLGPLDLSHLCVLSCRHVSSSAYHLLLTAAFTRRAADTRPVCQHHHESSRHVVHAPLVLSLQVPAQHTLDQATRGYQSHAASARDASSDPYPSADTHHLTQPSPWAHRPTTRPWLEEQPRPTPPASRPYNPAYMDAPKAAL

SEQ ID NO: 990798 - protein, 352 aa, Homo sapiens
MPQCKKAKGKKVAPAPACREEAWRLTKVVNPHVREKAYRILGIGHGHPAQTETSPCFVKWPRIYQVAACQSSHPSIRQDESASHAINTETPKAPWTDQNSDTSRCMYSMDHKATDQTDQQQRRTDTHDGPCRARSRQKRKAALGRTRDDPTATGRPNTDPYPEHSEVHNERSTEPWMAAHRQTKAQNMEMADTATTDRLESTSEAWIVRSLQPLSELIARTHKLGEGIPNFTMAFHVSRVTTGANAQCAQRGVGSEDAIHECMGHSARIRRLVGTPAGRHTSEQRNNKESSHSRGNDTHNAAHDRKPTRTPRSHTDINTEHHDRQIQHRDNIGRLRHSDPRHSHTSDTRQSE

SEQ ID NO: 990799 - protein, 274 aa, Homo sapiens
VDQRVPWSVASYVTFSRHRSCFSNMTPGRFNLLQHGCARSERTSRRAGPGWEVVLSALARTFAGFPASEPHALKVHSYRGACLHVITAGEIGSSDLVVARGLKCCWLLGVKLPTSAVPSSIPNNCSGARNGACASSVSGQVDQVGVPRDCSSDGPCRLTEGGRSLEAVDTSDLPAFDRPPRHPLAYPSSVLHQYTGRPIELEQMLLSKVKVPHTFLIHSYTRATVCQACKKLLKGLFRQGLNGKDCKFNCHKTLRTRVPNEGGAIGATHDAESG

SEQ ID NO: 990800 - protein, 116 aa, Homo sapiens
PDCTSPRCYATLITTEYRGLIMECELSLVFPSSLLFPKVSIRQVQLVAVWGDARCVQPWGGPCGLSVLAAVMVNVFRVSGTANGCLRVGIRLGLPGASEGVRICGVLFSMRVVMGQ

SEQ ID NO: 990801 - protein, 126 aa, Homo sapiens
MRKGRRLQGRDRQRQRGTERSLGERGSTHYSRWAATGTKLPRGASTKPLLCLSPIHRTPVERSDLREKHPRRRVAAQNPEPCRSTISGSIHGGAAAQYHHECRSQQNWPRGEDHGHMGANRGQRPY

SEQ ID NO: 990802 - protein, 279 aa, Homo sapiens
IQCLTVHNKRRLDPTFTLGAIGLDTVNLLGIQMTGGEIEVLRLVNRPPANQVIHGVTVRLSSGASLTRAACQWDDQPFAGYNHAPQLLRVTYRRYTGTFVDNVGPFKPESVVAQSVPRGDNGLLSLIVRLGTRSCPCMQRCPGSESASLGGSDQNSLGLRSSRRACWQCSKRPRDVREQTVVRPRFAWVVGLGNRGRKPVFPGVPRLSLPRVPLWGVQPDPRHGRWGLGQRAHNALPFQGGCHQYGGSAPTELIASEPALGATLRTIRAKQGEPRADPL

SEQ ID NO: 990803 - protein, 569 aa, Homo sapiens
MQNIKDITRQRSTSRRTVVKRLKRGAAAPLANGVVGEGCQKPLEYVDAARVGEPRDTVQRSNSELTSADTRGRTSTEDTKKEQEHRRRESKKEQTDNTKRNTSSGITERMRHRNRTRKARKKIERHKKETTDHTKRSSEKMKNAIKLTYDKDRKQKQDTERPRTKNKTREKPKKTRQNKNKEQDIRHTGDRGTQQEKDLGTPENEQTAQKNEGARVLGKPREKAIGRKGLKRHGQERLNTTATTRPNGRDKRKEENNKYTMRTHHRDLKGGPQKSHNIRGGHHDGAPHKGGKATHTGEHRTQKGNRITTRNKDDRDEQEKGHYGTHNDKGEQANYRDKGEAATRIDTEDRYEKRPQLRQVRRETDKGGKAIRTYQDRSISKKRRRDIPRKRMRDTGRARKESSPRQKIGDTIQQQTKATQTNQRRTQTRKATKEKRKRGNNEKKDKEKMTHEERQNESTIEREGEKKEQTKNKEDGEEKKRGGGAAREGGGSARRRGRGTRRARTKGRRRQERKERGGRPEGSEERREERSTKSARREGGGEEREGDRKRRRKQQRARQSTGGRRERRR

SEQ ID NO: 990804 - protein, 461 aa, Homo sapiens
GRVRDGGTCSARLYGPRRTDTSESMAVELFCAAAIRAAGPPRDPPARLARAMDLHYSDETILWASRGYLLSDCRPLQLSMRRQYGHHGLARPGPLHRGEDDWVAVQAMRPAARRTGREVDTSGCCPKGSAAFPKLISWWRMRVSYPCLCCPYAHSMVPELAFTRGTKSISQRCYPQVGRLTSERHVEEVLFRISSESGQTQRIERQTREAMTRSCLLTLVHLEQESLRQDCHRTSNDIPLGLLSFGSFGEDPIGGISLQPTLPTRGEIFNWQEATRRGPAFQFGNNFGVPSDNRKALMRLSVFPASTVVFPRSGLRVTSCSPRRPQYTNFGMHNPIERPICVRAPVNTPETPKLTTEVGQKRENHKVLNHKGASPETPRGHHLPFQMASARFARQTQLIEPGPYAVGSPISYGEAKFDGSYDKAALWLTFRPNAVQLCTSLRKGKAPEENAPERNGDPCGN

SEQ ID NO: 990805 - protein, 303 aa, Homo sapiens
MGLHSSHRWILEVTLRVALLEIPQGGDHEGRAFKDPTRGQKTSNTSIALHRCAWGRQTKDTQVPITLEERHRALGGSTPIGASQPKYKPLVKEKVGTGRNGLGFQTIGKGTRTTMLKHRGTFDRTSQSSMNPIAEGPTPQCKMLTLVAPLGCSIIKHPYVEQTSRYLGLLYRKNTGNLHAQGAHITPTRNNARTHQLERPKGPWPRGQWYPFPQKLSHDMTLKTTNSDRKRQQADNLRYPQVVNTDKRAHTPENLEITLDERVTTPIPQETTTPPQGRAIHVQERRAPPVDTSRTSEKEEMNM

SEQ ID NO: 990806 - protein, 99 aa, Homo sapiens
YLGTDRRAERPRKVRMRKRDLIWTIVVIGTPCIRRKSTDYFGHLIYTFAERIDLEGNPLWRDTLRAGKAERGAWKELEGKTRASISRIVGLRAPRGIPH

SEQ ID NO: 990807 - protein, 233 aa, Homo sapiens
GSTEISLVLTFSLGVWSILRSYLVLRDVDPVVYEVHPLSSTQDPMPSGRVCDSSREKSHLLVEIESSFTLERGTASRSRESDSPARVSFNIGYSIAGPLRRLPGEARMYYTTRLIIEETGCSVKGADIDATNQSIEAVVCQALAPVVVTDKVESVKSGLRLRATTDGDFDHTSIEWSRTIRSRKHTANLQPYESPYRVFSHLGRTNGHKIYLGKAALYPLDIVDRIIEQKKLA

SEQ ID NO: 990808 - protein, 446 aa, Homo sapiens
ASDCPCKLGTVLGENGKEHSRLSRKIEQSLQRGFGRFDWTILRGQLMATHWLRSWLIQALDDSCRASVFPCLRRLHDLARVQPEPGHSLLICCYSPLLAARTDHRTPRAPHSGPDQATRMLAQPAQSTGTEHAAPATHCLAHAQQTQPHKRRPIPSCERRLAAGHIPPQTHATLAPSMNSDHERRHATTILTHPIGTLTHSERAPPPATHPLDAPHILTHVEPPQQEHDPTRPERALTRWQAPHPFQQHDLTQVELDPPNSDYRSPQVCGEAHDITQGNENRNRPDPQQFSPNQISLLTLSNSHTNHLQITRPTLYPITNSYPYCTYNNDTQLKRTHRRPHLRINLQAEPHTTHSLAKHQRPHLEPQISYSTIPTLHPTSPHYTNQARRPAPKAPDPPNAVNAHATHSAHSITYTPQRKKAPDDQPLATHTDTTRHPHRPQHHRPP

SEQ ID NO: 990809 - protein, 408 aa, Homo sapiens
ATACCVRKLDGGAPRWLLVWRAPWDEQCCAVLISPNLGDRVLQQPARPASRAGALARMSAEHGAEPPGADWASRLCHSACVPQVTKPNPRVVFSSKMGREAGLDHVMCMHPPLRLAPKREPWPSKMLQPTCLVVENSHGASPRDEKKEYEELTMRGPPRDLHPRAPALTVPLAQVTLVIPAAVTKQRFDTGFPLPVDIPISWACTGHRTWDTLQVLIQGVLEARYEANGEYAVGAIQQKRTSASDTVGRTGPIHMRYTRDHAIRTLGSNGKLRPSGEMRPHATGEEPKNKVGLEAQHQAPMTVHCKSNVSQVDTPGAGFDSKENPYTGHMISRKPCDYGIGVSPGGVPFYCDPGRHERRTCPTVGMPRSAADGPTRSHIRVIPPVANCPPTDWQRIRLLHVSPQHIHS

SEQ ID NO: 990810 - protein, 171 aa, Homo sapiens
ENTKWWMTPVQRGGPGALVALGWGTAVASAEVSAVASRGQEVCWPVGTVRPVGPEDQREHRRKGNGRWISDVGCPSPSWASLCQGHEDQSPWREDRISFVPCPIRRAIQQHPLHFFPGGPSSSTGIAAVSDRTLIAQDMASKAQRPRLPEPKATTKSSKAIKSAIGDYNGT

SEQ ID NO: 990811 - protein, 113 aa, Homo sapiens
PDWWLVCRVDLRQCKCCMCSAGTTEGSRLIPAGCLTGLRLDLSGAPDRPSCLRARWWCVQLCAVHQRGHRAQGAGDQRAEIIRGTTNTPSSRTLSSSGQSPLTQTGILQRGSG

SEQ ID NO: 990812 - protein, 107 aa, Homo sapiens
MVRTKFQHHDARSTRQHSHSSSMHRACGRCLPPGEQEPADDPSVTLQRARENIQKSLAGRLRAPGDLPAATKRKTTDELVIRIASLEVENQSLRGRGYRRLQKAISK

SEQ ID NO: 990813 - protein, 303 aa, Homo sapiens
GGVRGLSGRYRRVTSAIALPGRSPALLRTPALRSTATFAHALQFVPETQVRPAGQCGLSCGLRRLVLSAHLHGGECVIDVGQPFETDRRIMGAGYFLAASGFQGNKRIGPGSALEKGRWESMGAHLTCLQAPGSTQLTTSGRCPRICRKLWSSWVTLCRTVVWARLTDCRKERDVILREMQENDASMRDVVFNYLSCHSIPGTPLTQACGGAQVRIVRKLSRARLEPSTSVHITRGPSNGAWQQLEELSTALFDLARSPRGFLTYAMTLLPLYFRPFTAWIRPGDVSFALAFGKACGHRHVLW

SEQ ID NO: 990814 - protein, 317 aa, Homo sapiens
MAHSFIVSMASRHTANTSSSHCHGEPTNSLADTNLRTATLPSPAANSTYRPSHNGPKIANGMTTQRLRMALATTTHRRRTHMPRRPAHTPSHRTAQGQATPPIMLATRQRSATTTHHEHRDQITARAYLSRHNNDPTPQPRSTNATNTPKHPPTHAPTPDIRPHPGCTTNKRHSTYTRQARPKRATRPPARPQTPGCMTQTETRHTLHAQPRATDVPPPRPHPSAPPTTGHHGTPQAPRHTHTQERTIAPPQRHKLGPAHALHTHRPPGAPPKAPGTPEPPARTTPHGHPHHNHNGTQTSRQTPATTNHHRTTSNTT

SEQ ID NO: 990815 - protein, 147 aa, Homo sapiens
MRYVASYLLAALGGKLLPQTPRTSMEDLGHAWVSRRTTTRLNKVISELNGKRQLKTSWPMGIGKLASVPAGGAVAVSAAPGSAGPDCLVLPLSEAEENDKMRTKEESEGAQMMHHGTSGAFLECKVPRSPWQSRHGLFYTSDEGQDR

SEQ ID NO: 990816 - protein, 108 aa, Homo sapiens
SQQEPWNTRQQGTSSDKGGVQRPLRYNNGNEGAAKAREGEREWSGAPGRDGRQGPWLSGPLQCGFLARVERRPYVRHSETAVELIRRKEKLAAEVSQLDLTSRLVRRS

SEQ ID NO: 990817 - protein, 94 aa, Homo sapiens
MMWRKPPNSSPRCGILGGGNDHTPPRDRRTHEKRRSAIDTTASDHERANASSSTKGEDSRRPGVTKTDPRLEMSMRKHRQKVERSNTENRPEDR

SEQ ID NO: 990818 - protein, 195 aa, Homo sapiens
MKNDRRQQHTCCTCVVIVEHANEATILKRGDEKTSVDHIMSVRQRNKHLMIFGDHDRRDRRGYMVRSGLLNNDCCGSVSPTNIWASSKCDGPAVIISVNIFIYISFYHAIKEAEILVQIYCGRHISTGVTAQQQSKSKRDPSDNELVRDPQIFATQGGKQAGGPHIGSRKIEKSQVTRLEQEHSKVSDSKHDARG

SEQ ID NO: 990819 - protein, 130 aa, Homo sapiens
RGVGQEAPDDPGRGRGGRRGLRLRRAPSRSRTRFPSHTPAARPQAKKLPAWPTSQEVGEAEGGGGGGTGRPSPADGRVALPVSERAGPPQPWCFHHAREGKEDGLTGARGGEEAEGAAQARPGRAGGRLP

SEQ ID NO: 990820 - protein, 69 aa, Homo sapiens
RRQSTSTLTRYILKKVPVINNDSVEILKCSEDDVPTFLKWCNIRFIHGMLYEADWYSNKPSRNADIIGA

SEQ ID NO: 990821 - protein, 78 aa, Homo sapiens
VSVFVLLLSLRQHSVCYVVLPVVRSSLCSPVWCVVFPYLFFIFFPLLSLPFLSFSGFASSFFLQVPSLWAPFDFLCPS

SEQ ID NO: 990822 - protein, 142 aa, Homo sapiens
MTGKKVKIGNKRMAWNEILTSGKTETDLAEDEVWKNRDELRRANKSAEPRTGQRGPHKGGKPKKQLSVHNDRRERRGRRATAAQAAEEHRRHAHQRSKAQAQTERGEAPQNRQRRRQNGTQSEKSNTEEARTRRKASDKEHR

SEQ ID NO: 990823 - protein, 200 aa, Homo sapiens
RVLNVAQSGVQWCDLGSLQPPPPSRLLWPPKVPRLQPLPSSHPVWEVRSISAWPPIVWDVRSLSAWPPSLGSEERLCPAPRRLRCGERLCPAARLGCEERLCPAGPVWELRSVSARPHPSGRSERLCPGARLRSEKPLRPEAAHRGSEEPLRRERHRRGKLRSVSARQRPIREVGGPLLAGCNPTEEVYQQPNEGGQDDR

SEQ ID NO: 990824 - protein, 216 aa, Homo sapiens
MRPDIPGAEETVGLGCRDSPVAPTLIRGLDICRRLATTGLSTYGGHDHDIIWMSYNLIASYNIDCFDSPWDLTRLNMPGVMPSETVMDFQEVACQRKTELSLEVGSDEREARESLDFTDAQENEEKASEYRASDIAQVGPCRTVLILLNCDEERKLGSPLWGLTVSRDTCYLKSVPPAYTFGPRKAGDRAFNIPKKSLRGCPRAGVAQSWDNSGLP

SEQ ID NO: 990825 - protein, 68 aa, Homo sapiens
GHAVLAVLCQLCQTVPAAAYLPVPLVFLLCCTCEWTRTVCCAVLCTQLTDELTVCGQPSDKHVTTLTL

SEQ ID NO: 990826 - protein, 405 aa, Homo sapiens
MIDLTQSTLSIRHTLLTVKECAIGKGDRDSTKVCNPDETRKRAQIPSDDAGRREPEAMDDIQTDATPRRGRKTRQQGEETQADETDYTPSIHNRRQTEKRDEGRQDILQTNTGQYPTHKHGEAPTHPSTNTLSQTLIKATTIWDLPGTIMGRYKQTDTVHYCTTIEVTIYWKVHTVHSKRAACKHATTARYPSSGKRTYRGAKILPYTEKPMRPMHVARISRRDRPHQTAIAGTARRHGKTTRQTHRQTDNKRQKKPTGNTHSTNKQRDTGRTGPNTPRNLDSAHTPIENRKPDTTAKDEKTHNMQRHNDGPYTEYRAIPDTLREPPTQERHGGTPHNAHPKSIHSREAQQEQEKADSRRPQRREQRTDTKSTHTADGETATHDNAAIGSHYEADRRDAGETPPT

SEQ ID NO: 990827 - protein, 83 aa, Homo sapiens
MSNWAWGRRKVAEEHGGPQTAGYGRNEGGPERRRDEAHTDIWGPAGGTANWPETKLATQTTTVGKHSESDTERPTGAHEEKRA

SEQ ID NO: 990828 - protein, 72 aa, Homo sapiens
RVDGCGSKWLWVLLRLVRRRSRFSSAVCDSFLICPQESCFFFFFETRSRSVTLAGVQWCNHRSRQGLIPGLK

SEQ ID NO: 990829 - protein, 164 aa, Homo sapiens
MSKPHYEWHTERGIQQKTQQPTSCMRLVETNETQGSVHQKQRREPRKHPNEGVTGATHGKRAKTQRARGGKHQGPRRKNNTGRGRKERAKRDINNRRNRGRQQTKKTQNDKERKHKKAREQTPNEQREEGDLRDNGWHSNDNDNAHNRRGDRNTEGRSQLSTET

SEQ ID NO: 990830 - protein, 87 aa, Homo sapiens
SGSAARGSGRLYVGNAGCAPEPDGCAVLCAVPAPCWALCLLFTVFVPSSVCATLAVLPVCIDAAIHCPVLLCACDATMHPCPMPCSP

SEQ ID NO: 990831 - protein, 236 aa, Homo sapiens
MSASTLDRICLVVMHVLGAIGVLMLLRLSLATRASLLAGIKPSHLSPYFDDQYFDLMSPFALKGHDLMRLGESTGADKGETGLGLWKINPIGTKRLVDLYLVPQVVHEQDFGKLGRAPEFLNTYMTTYKNKFPINHTLSISQQENPGCILSHNHQTHYQRGINIRPPVVFVSLQCKKHRRRIEGENQIEQTIRTHNNTKITRDRKHDRDTKVHVIIVLNSHRQTQHDTSANTKTII

SEQ ID NO: 990832 - protein, 110 aa, Homo sapiens
AEDVFNTVGADIIQQPSKVVCSWERRSSGKSSVASKVLGVGGTCFPEVLELSPGGPQFCNWSMFHKNDIDGNNMKDEENGVEAEEWGTFLHTKNKLYTDFDEVRHRTLKN

SEQ ID NO: 990833 - protein, 113 aa, Homo sapiens
AGCGVIQLPWLRRMRPQEEEGRARPAPVAPCVVCTDALLACDVLMAGVRGCACWWTGMCDGLAWWPPEANGWNCCYYLMTCVGGTCLLWPTVLSVKPRRTWGLMPCEQGHGKA

SEQ ID NO: 990834 - protein, 123 aa, Homo sapiens
SGGYNAGCAVLCGDLGPVTRWACAVCVVRCVLMGAAGANGMPGNGCCPWVLLMTWPSAHAPLPADTMMVKDDPCTMTPLCALNGPRMLIPCVVIDSNDIVSLIREHALASAIKMRILPSVEQM

SEQ ID NO: 990835 - protein, 123 aa, Homo sapiens
MLTILKLENPPAIIWAGGGGILKRPGKLGLQAAAVLSSGIFGVRLRRDEVEYVIWWQELPFQPISVSPGEGLVEEPSYQKESGEFAVVAEDPTQTLSKTSFKRISGFETPRRFRLKEFNNQQG

SEQ ID NO: 990836 - protein, 145 aa, Homo sapiens
RVLKLREPWRNPELTGRAGFRSARVSSDRYRLATRTIILLVRVLRLLRVLGLSVMRSELRVCERACVTARLSNDRLASCPSVPSQRSRRVPISCVLWVSSCRSLWSLVLTLCAGYLVRTQEWGSATSVVDPSNRLKATLQSGKYT

SEQ ID NO: 990837 - protein, 106 aa, Homo sapiens
MGAMLLVYLHQLDGFLLGKKEVISRLPTIMPKLTMMGENANNLELEEMERLMDDGLEDESGEDGGEDASAIQKAWINGFSLVLFITTFCYFTNSQRGLPRLRQIEP

SEQ ID NO: 990838 - protein, 46 aa, Homo sapiens
SRPSQFLKKMPQYQKELNKYSTHLHLADDCMKHFQGLGGEACVVWS

SEQ ID NO: 990839 - protein, 220 aa, Homo sapiens
MTSWRLLTDRDFELLLQGNIVAAVQGPSVEDEQDDDEIDRPSSHLRTWHPYKEEGGRYVVLLKKLVVKSLISFLRTFGIPTPRLELLDRRCLNGHAFPLCGAYQELYGVLDRLLDQDLTKGQGFLLGNSMCETGQVPTRKFCGSLHTHSFTFFTSTWEVIRSAAVKLTDAVVLNLTSQYVELLDREQLTTLTSKHFVKIHVLVVQRASLRLGFADLTCEG

SEQ ID NO: 990840 - protein, 235 aa, Homo sapiens
VCWWSWLPSSTPLPLVIRVCASWFCIRLLFGVLTGALVSFASVLLRSWLSPAWLVPVSFAVRLAVAVYGIDASGVAFVPGHGYVVVFSLSSVVLLWFNGGALLLLSASVWGSVERSGLWMVLWWGFGYVVGLVLASRLGLLVLLIFLWCEVRCASLPFAASPVLFGVECGACLGSLDGSLTLAWALHQWNLGQSGPSIASECSVSSVALPYTILYAFRLSSLVQRPAARHGGSRL

SEQ ID NO: 990841 - protein, 151 aa, Homo sapiens
MCLTLVRIGSHSSSHAVRAFSFRLYFLLVYMWVTRYLRCMSWVDFGPRVSRCHTFLGRLSIFGGPLLVSRGFLCLTVCGITLLMDVRVPIHCSSIIFRCDILSFVLDVHSPKPRLSLGVYSWAACKLVFVLSEGCERINQSYGLARPKCGA

SEQ ID NO: 990842 - protein, 138 aa, Homo sapiens
MGFICYNESIESCCRELLLFGIIYRYVFQFVDFAGFLSSAWVGLLFSLGRCSCAVVLGSVISSVCISVEYSPVLFLSCWDRYQPSSSQSAGSVSKRCVCSVVFLLMDVRGCSQVAKVDVTWVIDLMLFPKLRLGISQK

SEQ ID NO: 990843 - protein, 182 aa, Homo sapiens
MSFSSCLHICGAAHYLPLCVSLQRGVFRPLHTGGHNPCGPCASRGFIPPCSLLCIYLLLVCILRRCCMCLVLPLGGGTTLQGGPGFIRLSLSFRSSAYPIQGTSLPMDLPQQFGEAEDLSVNQASQPVVQTSRLVSVDTGVPTITGVARVLLTLLHKMAKRPRQVKHPLRTLRPPYPARGSC

SEQ ID NO: 990844 - protein, 71 aa, Homo sapiens
CPYTSRDWDPGGIEFTGNTRIILSWEKIALPTQPGLDIYRVFSPMRERLICVNRFTFPEAQRVLLPPSAAV

SEQ ID NO: 990845 - protein, 238 aa, Homo sapiens
ESCSLKSDNPQVLPGGLTTLGAVKLTGKGPCLHFRKASQNNESDGEGMNNSQISPRSEHSPVRSAASLIEVSYTQEPTWKEPITGTQGDLAHAALHETMSFLTGQEEPIPSYTSGAQLLSEHALEKHAMASSLVPMARLLVDSTGFSRYEEMSSVPRGAVLKPHQRWLPAQDRDLPGLWTTPWELMLAFGGAHSWPACAVVWSSELLLKHRDTPVVRGQQQSLSAARRSASLTLCRHC

SEQ ID NO: 990846 - protein, 72 aa, Homo sapiens
SSVTSDCVVVVLACRCLRHVLARFWSRIFIFVCVNDRRSPVWRCPPLMPYAAVPVTRVTNFDSGFRRIHGHV

SEQ ID NO: 990847 - protein, 105 aa, Homo sapiens
MNLKTLEWPHAIGREKPGIFMWYPAEAPTWRFVMQNPEVIILELSPIRCRHTVYAAFLPPVVKSFKWVPFSRKSLTTGGVRLNRLRGLDRAIYRHGGTPHLKSSK

SEQ ID NO: 990848 - protein, 124 aa, Homo sapiens
AEKWLKVSGMQSTFLGLCKMEMILLQFWEVGERAKQRADEIGNSLEKFLPAVPFSPHPSKFKPQLLGASSCKKGCEIRVWFYNRSYEEQSTNPNDAFPTGDCGEQPGLLAQELPRVLSPGSGAP

SEQ ID NO: 990849 - protein, 278 aa, Homo sapiens
MAKLCALEEGGGHRRVLVEKNEEGFTEFGWNEPLWRVYPHSTLSRCTDIHVPTKLTPSHTSCGTYESTAFTWMAVKDYCFRELIWGRWEASLKFARDLETSLRCLRQVEPTRRDEGRTRVKPINMNVSPNSSESPKTCYTSTNYNFLKISLLLLRQTFNRHRTDDAVERIEEYKNLVNCCEIGLSGLLGPNLLLDHLRTSGSQEMDENLESKKNMLSVPPLYRHVLDMWEQAGRTEEPAFYWTFHGTHPYLHQGCCEVLCELRVLQTPSSVPITGGGT

SEQ ID NO: 990850 - protein, 137 aa, Homo sapiens
MPFPGPVDIISEPPLALLSPSSAKLGHLMDLSQIVQSSNIYTVVTLNMYMRDFSTRELMSTDMVKAKCFYVFCTKNAAICKDNDPYKRTWLGAVNSRAVTRRYMVVRLVSNYCKTPVYFAKFLSSGPLQPPDLPLCR

SEQ ID NO: 990851 - protein, 87 aa, Homo sapiens
SRPNFATNHKGTLSADPIYGVGFPVQAAAGPKLDTNPSIGRPGTLPKSTPPTSPEGENNIKHDSSSPDTKKQEGQVSRSSRKHDLTK

SEQ ID NO: 990852 - protein, 102 aa, Homo sapiens
MEYTCDFLLGYIHCESKMDMHNRYRDVVPTYILPDITLMASGKDLYALPPNTLEEYQQYVSLTPSGRISLIIRVGYFVFHVRRHEEILKDKHHIIVNHQLKR

SEQ ID NO: 990853 - protein, 364 aa, Homo sapiens
SHKCRVEVARPIYLCLGPSLFCANSYACAFLIVGVHYVLVVLLTVVYVVPMWQWSGFFDVAVRGVCYWLLGYGGDNSYGAYSLLLVCPLLGFSWEGAYSVLGVVPACGVSLYSPLLNALHTHACSALLFSVYVAEVCRKTVSWIFGLFGCLPLVSSSPLVVVLVCAMDCDAGASRTFALCMTVTMDRGLSPCMGLVYMLDTSLVLVRNSIGYDTCFHHIGAHVDDVLMIFLMMHLMDMRWSVTVMGPRVQTLRHSPLSPSRSFSCWGSFRPALLGVTVVHLAALPWFYWPYGRLLCWAGTGMRGRREHREHTGFSAENIWAQEYWPLLSLALCLCTCPGGPNVSRCKKCCRYYFLRNDFYTTRQ

SEQ ID NO: 990854 - protein, 171 aa, Homo sapiens
MGQPRVPSHTPYTPGETTRDHKQTPQQKHKNALCKHTTENPTPPKSFPPEGPPRSTAIIKPQHSTPKGRTPTPGGNSENSNKPARLHPQTGGAPKNCRNPQRGTPTDKTRAKKKQPTQQRKKDNNNNMTREKIETTRHPKHRRQDHKPPIAPETPHAKKQQQHTNTTTPIK

SEQ ID NO: 990855 - protein, 365 aa, Homo sapiens
KRLQNWTEECDKSLVAMHSLTEFFEDDAMLTILLSACEDGPKRYTIGADPDPTLLPQSSLRGVLRRLYYVLKSPQGGIPQQSLYPSTVTRAVMVTQDGKPMFTQVCVDGPVDDLVVQCCDDMMRIKTWHFSHPASPRALPSRSILAMRAQDPQMLDRALQINIDSDVGCPNSTLNYLRLCVILEPMQELMSRHQDAYSLSPRDWLETWLFPKWQRMVAPCGANVSSQQRRKRTIPGADHELWWGNSTKDQSEKSPKHLALQPDFDVGKPLYGGETVSNDKGRSPGGRTPKLVDNSAVKERSIKNPSCGATLRRKRLRIEQGDLGPKRGGKRIAKHHEERNIDLTAGRTDPGHLDERTHWVTREDE

SEQ ID NO: 990856 - protein, 230 aa, Homo sapiens
MLALSAWVSIGTSRVTAGTQRAPRPSLAPHMVHSRARCACAWHVYRTCCESGRPQGRRPPAWYTWVSLALGQSPITGLGASQPQPRSSAGGAPRAYGYDNSFDDSEYCGLWLWLMIHWLLVKGASFAVGNSVVDVIYQWGSLVGERRPEPWVAFIVPSRWFLHWHGVPETLVPESPAVGSGPGPPVGDRAGGALVSCWLVGLGCRQFGLFRGLGGFASPRCVPVRREAIL

SEQ ID NO: 990857 - protein, 102 aa, Homo sapiens
NKKNGIYLKAFKMVNKTAGNFCFFLGELQEWVIQVNKNNNLFRYNLVSRDNLERWKKLPSPHYFNLNCGALCGTTNKRTLVYIFHLRPILKTPHIMWCPGQG

SEQ ID NO: 990858 - protein, 186 aa, Homo sapiens
MTHKPQRQGIKSQRHAPKMEAPVNTNSQHKRNYTPGNRSGKAGKKKNITDARENRAMNKWPTSNRTKNTPEIKQHNKDTTKTRNTHKTCSRDDTEKRLKATRKKTRETGSERSISEWQQTTSTRGHEQKTETRQKEKRDSMCRRNTEEGETKRERRLSRQRREEEHRDTKHRLKKRPPDTPATTNE

SEQ ID NO: 990859 - protein, 106 aa, Homo sapiens
MPRVAHAIPIVLPSTWRKSISHSDENSFTEAQSCTIEVLLSTRKVSSPFAQPVGKVKFSPFAFITYPSFALPISRSFSFLLTSNISPLFARLSKNGLFAVVVFAPF

SEQ ID NO: 990860 - protein, 201 aa, Homo sapiens
MSQRFCQLGRYVAAQTSILNALNDFSLCSLLTQLGRRRSYMSRQVYWRAWKGCHRAMMYRHESAWIHRAASMTGSKGETAWTSWNQYDCNHALLRPRSKHVASSMATITNMIMAMINYRRYPYRSALSIKRLQPYQSMSTLHCTSCRGEPCHRYLRIVAQTTVGTHLLEVRRDDAAYHNRRACRIILGCPGSTDCTKRAFG

SEQ ID NO: 990861 - protein, 160 aa, Homo sapiens
MQLPGEMTYSSIMSAVIPAQNPTQVVLTQYVDEEQGAQCTWGYDLRAEVSLAGRVILGPPSGGGPTRVFRDKSVIDEIRHKMEHGDYTVRPYIVSDSYIYGKTHQSLEMESLVRRVEWYLVRVFSAKGAIDVHIRENVKVGGAMDEYGADGNGATHFRQT

SEQ ID NO: 990862 - protein, 586 aa, Homo sapiens
GLEVRQIFQLLGVLLWLFIRCRLADLTLTHTLRIRASRSWSWRDKRVEIGPSVVYNWNKSSPLVILTSILLMRGGWLLQPFMLPVTHTVAYPSLAGGSHVRIVPSGAEGPCVPAEDLMEAKVLRQGQSYQAKAGRYRGADMRVQVWTSPRKVDPLRRGQIELHLPCILSFCCPTYKALIVPASLALYFGDCRPLFTAWGNRRFQLIECAVVVVIAAPRTAESPVRMCDECLVVTDREFTLSHIPYSVKRSETQDVLSACGKRGNGLDPWRRFMLYILRLLSLNLCTPYIENIARKAFLRCNTRCTFPFGDWESPVRGRNARMCFYYRSLPRGAHRDVRAETLAKEVYLPLLRDPSGLPPSVHRTNTPRPIKVLGELNQRADRYTLGASTSPNVLGNAFYLAPRGLRGDLVRSTPPPRDGLESPKTLGLSLETTEPTVSIYHGHWDVENKRPASHQGSCSEQRNLVVPQEANPKRTHTMLQEKESGCAHEQFTGPSKREPNKRGRVINELPAHDMSDKGSERILHRRNAEGRHHHDTPTGNYNSSRGSDERERRKGTHTQQDEIRSECILGPDPLPTQSQQIDEESG

SEQ ID NO: 990863 - protein, 59 aa, Homo sapiens
MGNASRVKETAAGRRLGTFTQGASPGKWSARHEVPSNNPYRRNPHTHNNGRTDTTQHTA

SEQ ID NO: 990864 - protein, 137 aa, Homo sapiens
MYRLDVVTISRVVTVSILDSDYKLMQEMPTVYTCEYPRFLHRLVQHVISGTVLEVRTDHPVYSRLRSRKPLRYTSMRSQMIASQYQTVKIYTAVTLSYAPYTIVKDCPCQYGAYVSEVLPQKFVDILVRTQVISSIA

SEQ ID NO: 990865 - protein, 167 aa, Homo sapiens
RTRGVGPEHSVLDLWRTKPPKGQAPTDRSSRDGTSNEPSHEGQKKQRTIPWRSKSPEILSSTKAGCQDEDQWDGAQAMENRTTWLDPRKPGEDQVPNGELLVIHGHVRQEAHPSLPDQLWLLLLPLVHSVTSGASEKLEQRAGMSIGKEDRDTFAILCPVAHIQICG

SEQ ID NO: 990866 - protein, 121 aa, Homo sapiens
MRRTVGHVENGSAALRTLSRLGQPSELKPFNFTLGTVTAFVRGPKYVKAQRHNCCRKKTPDRVGSTQMGDKDQRGNTCHIPLYSEVTDTRGCVCHKGRYREKAGRYKGMDVACRTPVECPR

SEQ ID NO: 990867 - protein, 414 aa, Homo sapiens
AVHPVGRGGALLASLLPPCRTPPGPSQTDLEDMIHRTHHPEYAHRNNVEQETNNQTDRPKYKNRNKYRKKQKPRRKKERTKNEQTDTAHSRETRNNKRDKRKRKQNKHNNQGTTSKTKKKKTETTTKPQAPRSTETQKHKNKEKQRKDTKTKENKRGKRRKQNKRKKKQKRSARRGKGKRKEDTDSKGEDGRTTRRNTEEERREERTNKTKREAKKEEKKKETDEKTTRQKQETQRRTKPDKRRTSEKSKKSEDKEEKTNKEEQKRRHRTERRRRQRRERERNAEKQKKYVLILIERYGEEGDEKEEAKNRKKKDNEDKREKEKEDEKECKNDEGKRKRGKMERTEKNRNTTRKHKQQKGNNQTAKSSRERGEEETAKRHEKNETERKRKGGKAKKRKERNKNKQKRQRKEEKK

SEQ ID NO: 990868 - protein, 220 aa, Homo sapiens
GFQFRLIFVPLRLLPVPSPRSATSPARLLLSRKGRGLWPWDVPNEPQCPSTHGTHYVGDLHPDVTEAMLYEKFMPGRAQSSPSGSARDMITRRSLGYAYVNFQQTADDGGGLPLDSMNLDVKEGKPVRIHVVSGVIHHYRQNVEIRANIFTQKSGQHPVDNNRHCMTQFPAKVTYLSKYTWYVMKSVSKGYCIRQVERRKHAKMKCRPSEKEWQWALYQT

SEQ ID NO: 990869 - protein, 102 aa, Homo sapiens
MVRHKDIAPVKAPRDAPSREVLGVSAISDPLSAFDEYPPSAAFGRRLGMPALIAALESEGISFLSPCVNLVKSCLTLRHLELRRFKMLANERRLSGLLPNQF

SEQ ID NO: 990870 - protein, 34 aa, Homo sapiens
MSTAFRPSPLLFVPFFCPHFGPPSKNGPGGKGGP

SEQ ID NO: 990871 - protein, 299 aa, Homo sapiens
RAPWIEQEGPEYWDRETQISKTNTQTYRENLRTALRYYNQSEAGSHTWQTMYGCDLGPDGRLLLQGITSLAYDGKDYIALNSGPELLDRGVTTAAHHHPSSSGESGRVAGAAESLPGVAECVEWLRRYLENGKETLQRADQEQKSLFPRSETRTCHMNEEIIPDPPKCTTREPPFPVSDHEGTLRCWALGFYPAEITPDWQRDGEDQTSGQLSCVEDQTAVRIEASQKVGSCGGASGESEILCLLPLEGGRALTLEGPLPGPSLVACVAVPPGARLARGVEHLRGARVPPCCPTLSRVP

SEQ ID NO: 990872 - protein, 215 aa, Homo sapiens
MQKTGHNLEILRLTQVGLFLNATRDNTPPLAIVSPKAENRYPTVLTYEKRPLRPHLFFGGSLPPIADTGADVNFLTSLLIGAKKPTGTRLSDSGFWGGLVGAISAPVGQGLSGGLRGPPFCVFHYTEREISVVGIKTPLLGAPGRALLDLRTKSTLCRCGPSEIGTSQFGSSLCSQAVRIYPLGGAVLGARLWDGPPVVSGRCPFPISTGRCPGW

SEQ ID NO: 990873 - protein, 105 aa, Homo sapiens
MLAHPWPIMHAQHNTANIKIAMEISSGEFCCVLHAILERSRANLSGWSERVTLAEHHSCLHPIVVSIRQVLEPSFHSAFPNTKRDSSPAIKQPQFRAVQREVTLF

SEQ ID NO: 990874 - protein, 323 aa, Homo sapiens
APFLDPGRLTSGGPHLAHSVAPWLCCGISADREPSMDMATTGVRPVGAVARNGAGPGYGEGSKKTSRASRLHTVIDMENYVMIPSELLAYEDMGELAISAVREEEVHGMYASMMLACLLKSEDGEVPVRIASGFKGQLSRASVGRDHECGYGLGKRDNHSKGSIQTCVIASNNRSYPINDPLIFQIVGQPCIRVLKREWVLGRSTRSPYPRMVIFPPGKIRTVKLLMDLSMLVLSLWVAIPSSIGMEGRHDTIIREGTLMGTSQLDTCFGYWLEVSSFIYFFAFLATPVPCECVQLALLLAIVAVFLCSVPPLTSVGGPACTS

SEQ ID NO: 990875 - protein, 190 aa, Homo sapiens
MHSYYVRDFKTPGHVLCAIQAVLSLYVLWAHHWHCHGTLETGSPTQVPIYEGYALPQPSCVWTWLAGTDRLPHEDLMSEVKLHHHGLSGNIVRDIKEKLCYRRPDSSRRWHRDLLSLEKVECRCRHPNEWRSESKAVSSSGWTAVRPLAPRCWAAPVPRVGTSVAEKDRPKKPKKGVLPCGGPYMVSPLL

SEQ ID NO: 990876 - protein, 38 aa, Homo sapiens
GRALYCFRYVPQSSNEKWTEPRLYTLGERDKSLFSLFL

SEQ ID NO: 990877 - protein, 246 aa, Homo sapiens
MSRLTLICCSRRALVLTVDWACSHSMKVFRHRRVPARLGTPRFISVGYVDDTQFVRFVGDPPPTSGRRLSPVRRGCEQSGCREIVVSSRVDTTRVLSAIAKCIEPKLYTVRDICHGIHSYRETKWRVSHPPLDVGCDLWPDGCLFRSYEHVRLQRVKNDHSALIGRSCAPGPVRPYTGGLTIHPRGSVGVRAVTAEGKWNDAICIGNGAGPGSALYLESVMADARGAELPSTPGDLTNPSLIMKAA

SEQ ID NO: 990878 - protein, 69 aa, Homo sapiens
MRHISSKSLPPRQASALCASCDRVPLDGHTISDLSLEQRGELIPISPSTEVGGSGIGTPPLCSSGEEER

SEQ ID NO: 990879 - protein, 107 aa, Homo sapiens
MRARGLMLILLVRSGRHWGIQTVMRKRLPSRMTTVGWKEDELLSPTVLSVKSLGAGKKRRTPGQVYMMGSGSPTGSLMTIRKWPIADQLFPHPEAVITGKEGLLTRK

SEQ ID NO: 990880 - protein, 229 aa, Homo sapiens
LRVGTHCQELPFPEAVVIVIRCPLVLNTEETCEMKISGEATVNVYSWTTDIRNFGCLQESRKRNINRSRRNCASLGERKWQSSHRAIRPRGDHASAEDVPGSRVLIDLPAHNREVAGVATHALGDIGYTDQDTHQRMYFSKMAGDYIYLVVVPSNVDIGTTEALRDGPGGGPRWETGPSGILIECLIVVDQMEHEDEGCGRWLRNLCVAPEVWVPDCLSAGVSRGSRIS

SEQ ID NO: 990881 - protein, 165 aa, Homo sapiens
MWIVRIRKMIQKQPWEKLSQTHIPPTRTRGPTSGAGDIDLEKRQRKRKLLRTGEKLSLCPRSVVADRMYLVEKHTALPVGSLHYVVPPSDCKGGVKRPRNPYYDPDPETPLKAMKGALLRVKVTVHFLAVLGMGRAQAAARPLGAACSVIASRFARRISLGPGWS

SEQ ID NO: 990882 - protein, 131 aa, Homo sapiens
MCSCVEVENRGGDDVCARGCVVRGTATEVSEESILRGVPSGVVRAAGGEKMATFTDKQRSSIHFYSARRASSVVCGANSSRRRRLFKKTKRIRASFCRGKNRSTNDAVEVASTLLLKGSAGLQWRYNRRAL

SEQ ID NO: 990883 - protein, 91 aa, Homo sapiens
GGKRGRKGLRIFGLRTLSCASCDSHRLFRFFAEDPSSAQERPRAEASGFKGYRKNPRVDPEVWQFHRISNSPLTSPTRLKSPLEKGVVCVT

SEQ ID NO: 990884 - protein, 356 aa, Homo sapiens
PCMVCLKLPGGSSLAALTVTLMVLSSRLAFAGDTQTTFLGRCIKSSVIIIFNGTERVQVPGEDTSSNQEEFVRFDSDVGEVPGRCQALGRTVAESWNRPEGPPWSRSGARWTITADTNYGVVASFTVQRRVHPQVTVYPAKNQTLQHHNLHGLFCELVSIQAALEDQSASEHGQDREDCSESPQGPESIIGELDLTEPGDARKQYLGVEEVTLAQVGAPDVKALITRGTGRGTVLTSCPEADMLTGTPKDNELGLIILGGRTCINVKEEHRPLWNYEPEGFLRVEVSQDNGRRSTLCHTIGRHTREPDRKDATHKRAHTERAGTVQRAELPGVTREAGEQPIGAEPQGRDTGGDDP

SEQ ID NO: 990885 - protein, 106 aa, Homo sapiens
MEISLSPEKPYDWNSHTGGNRSRIFQTRVKSSKSLTGNMVASNTINWANGGAAIKSPESNKLRRPHRIHTVEPSYPGRTERDDDTFRPHGSSNSQNTIHITREYNM

SEQ ID NO: 990886 - protein, 348 aa, Homo sapiens
LYAVAVGVLDGVEEACRLYQGVGVSRQASSNVERTLYALVLLKRMRYSARVGCCDSPAPCLLRAENKLRRTWPKAATLYEVVGLGRGLDSRVSVRGRMRIRLLCGARDSKASTQRRELVSGVKVSVEVVSRNDDLFGRGIHAWVLPLSLVLECSDVVRPVWKKAAHALSASVTVISRGMHGRVCLPNSGSVCLAILVRLYVDDAPQRREWHFSSLWNPRWNGRDLGWVSCQGPERCLVGTATCMGCRTFVRSCMDKAICRPQAIPGRETRRQSFRMSLSGLFLREGIKSPVLGWFFDYTRRVTLALACKQRGRPLARDVREARNGKVRGDLGDTACGKERTLRVTGDL

SEQ ID NO: 990887 - protein, 274 aa, Homo sapiens
MAPRSFEVHPRFSLPPWAATRVPSCGPSWGGAHFGRDIHDKRPLWFCCPIVGPPEAVLHPPRELSALSPTDLCPHSPYRHSLASIWFPHLAWRCSAPPQAAHDAAAAHAYFLSPSGAYNSGDTPPLNRRLASLSSSRTTSGVGARKCPSPHNGLPPARGYTGPSLTPVCGPPPCVDPAGSHTLRCREIPAPNAHSVTVLVVALCGPPPGEPPPPHSVRAGAGGSPTPTPPPSNTHERRVLLCSTHDDPTAPGDCARAQNKYPGAVQARRLAVLL

SEQ ID NO: 990888 - protein, 85 aa, Homo sapiens
VIYSTIFAGTLITGARLGLIFYLSRPTNNDATLDSSSNQENKPLVTTGSCHQGILRHGNLTASHQLLSKYLSVFNNITRPEQLNQ

SEQ ID NO: 990889 - protein, 134 aa, Homo sapiens
RGPTAPFLPLPTYWTLPCMLPSHSRRKSGGVEGDHTLDFWEHLLCVADPPAACSLLSYPLVCLKLPSQLLGRSPRLELAPTWWPGIWHTPSPWGEGQRPTLLTSACFFPSAAFTAEYLYSLGSLCQTTLSLGPH

SEQ ID NO: 990890 - protein, 120 aa, Homo sapiens
IYTKWPDYSGSEPWCLRGPLDVPIGVGDSRQLVFSSVSSRVGALVRESREVVGLGGRIARWPCSASECISRERMTCARGIACKMRNSRLVQRTGFGLRRRYVVRVGAVQTIPCISPVSMQ

SEQ ID NO: 990891 - protein, 51 aa, Homo sapiens
MADDAGAVVVPGGPCGPVNGEPLLASVVVSALASGAGFAGVDGAVAAAAEL

SEQ ID NO: 990892 - protein, 288 aa, Homo sapiens
QSAASSFASPAEPHRSRHHAGKVNGLEVKGSLGRIWAPGSPADLPFNLWLKLDSCEPSSDPFIDLNYMVYMFQKYDSILMAKFHCVTVQELSNGKLVINWKSHHHLPGETEIPPKIKLGPIAARCRYVVESTVRHSPPWTNGWRAHLHGGEPKGSSISAPSVVMPPCCVMGVNHEKYDNSLKIISQNASCTSSCLAPLGNVLHDNFGIVEGLMITVHAITVNQKTVDGPSGTLWLMARGALPDLSSLPLLASARAVGKVLPELNGNLTGIAFRVPDCHVVSGGPDWPC

SEQ ID NO: 990893 - protein, 99 aa, Homo sapiens
VGKSGRDSRCYRSEQGLGRWTLAFKVRRQAMPFKCMQLTDFILKLPQRAHQKYVGGQSLVEGRLVKITKEWAADTACGRNEDLVEPEYITRYSPPNDRL

SEQ ID NO: 990894 - protein, 162 aa, Homo sapiens
MRLRLAEQRNVNVTKNKRRVDKLTDSRVDGTDRSKSKFGCERHSGGVPVPSAKLDAVLRRGSPLYRRIADLAGSSEVILPVPACNVITGRTHAGQQSLARQECMILPVGCSKRSGTAMPHGAEVYHSRKNVIKANYGKRRHNGGDEGGLPQKVGNKKAGTVT

SEQ ID NO: 990895 - protein, 385 aa, Homo sapiens
MSYQSEGLVRSWSPAAGAMFAHNTDVKVSCRRVLLGSIYRFVIPAFCYDRDSVSIARTLTSSYLREHDDGFVPVDDDVIDDENTELPEMDDLHVTGRRSVDGSTSLLLRFRYTARTWLRRNGPSGLHRSRVEVLPSMGPMTDIATPRAPGSAPLMSVLVPAKHMHMTQSKSSIYLELTVSEVFKREEVSYQSSEVIDCRGVGAHTGGKDHSKSHNGGNDRTLGNQRNAKWPGWGTDAGKASRRRGAAEQTERREFNFHEEPELTRAESNQSSENKTQGELRRISITHDVSPGPGGHKLTRGRDTDINERDRCAGEEEKTEGELASPHREEENDAHRRHLGTTADPPTRTNGEEVESEDQRDSKDTEAHHDEPRRTGENDPLDTNT

SEQ ID NO: 990896 - protein, 330 aa, Homo sapiens
VQVFVGRERCTCRLRHLRDPRILSLSQADALSRPGRLCQRKRAGELRYHLWTVHARSLDASSIKWTLMWEDQDEELLNMLKLSLKLNRKILENKDVVVQDVDEDGLGRTEDDDRHECKYGRCLEGHIDLVEVYAGEVYTDARETTWSVYGNLSTTSGCVIDTCQGDDALTEMGLDAYPEECELEIEEINGQVSNNAWVVTTNELAFCVTWATKRSLIFRMRLVQQTMVSFSALPYGKKRKPSVVGSCHFLQQPRCREHFLNENSSVSLLLKLSGQFPGMPNLRARATYEWPQSLQLFHYEARPCKGRRNCGTGALSRGFFEERITTICHR

SEQ ID NO: 990897 - protein, 188 aa, Homo sapiens
EGSEAFCFIDDETLMHSYSFRSHHVCMANKSSCRPLAYRIGHCDTSLGSTVCVIQNMPLNACHQTRFGVLTGVIGDEKKLGYVVYQMRPSTLMFANVVYCTIYTGVFSPPLGEAQEFRYYEARKWCHRSVPGHFVLKLHVENGWDNFPFGLITHLKTRTKNIEAGTEGHMNVTKEYDDVPVGDLGGFL

SEQ ID NO: 990898 - protein, 130 aa, Homo sapiens
MAPMGRGGCRSSTLWCHFAATRRGDLPFVPPVHTCNGPLQLRKREFPPFSQFGDISQSERDLRERVLMHKTPIHRDRALTLNSAVVEHTFLRCRPWGTIFASGTKEKAIGEEHTKGPRATEKNPLTPPSK

SEQ ID NO: 990899 - protein, 200 aa, Homo sapiens
MAIFSFIGVAHRKRDNGAAEPCYDLGRHSQRVEIGGGAPCGGGPGMTKALVNLWGGHAGRKRKRPFGTSTAKGKPLWVENPPVFGVGGDRRECRKRIGTPETGSIPGGVWNTKGGAKRGFNQTTARFNPEFRVCAHHYQSEKCFGPPGRVEPPTRKGRIWLPKGGVPHGILGGTIWANPHAVTDDKRPFLTMEAHTARGA

SEQ ID NO: 990900 - protein, 72 aa, Homo sapiens
ERRGNQRKRVPGQDDAKKAKQEPEVNGGSGDAVPSGNEVSENMEEEAENQAESRAAVEGTVEAGATVESTAC

SEQ ID NO: 990901 - protein, 58 aa, Homo sapiens
QNTKWRMTPVQRGGPGVPGGPGMGNRVVASAEVSAVCIRGPGSDCAVVRGAGGPSAAV

SEQ ID NO: 990902 - protein, 302 aa, Homo sapiens
GGPDRYAPRELVLVPLLTGWLYCDSSDLPDAPAEDVSNTRARLAIRYIMLLPSNQLPAASAEPCGHWLASCEYASTVLTIVALCTNEPHLVQSQKQWWAVQGIIPANYVHESVDGAMIGGLPNSAVMPCDSIGNRSHGEQAERVLYPPEDYGLVPGAGELPTTPETTICCVGETAIGIWWSIYLQSCTIAMNLRHSTMEVYFENLMHAVGAVDLNADVTLYAPHYDPEGHGGHSWQSPGTDVATEDVFGPLTHARELKLLQTIGERGSSENVMLGHNRRETKSRKCLKRGMPKLLVNLLCQL

SEQ ID NO: 990903 - protein, 101 aa, Homo sapiens
RYRLTASVHRRSTPLLSSTERVPSESPVAFCDLQVGGRQAHQRAIFTQSFPEKRINSEASQRPLEPHHKQAFWSVNWSRRYTDRRMIFLVLTNPRSSCVIY

SEQ ID NO: 990904 - protein, 604 aa, Homo sapiens
MNVSRTSWWHERFLLAMMEFGNEGVQKHALSHAVMITVVYVYEICLCRLYTHDPVDNKQERALVQQPFMNEGTIGTSTDEMVRIFVAVRRMDLLEAQRNPCIVNRYHTGRSAKHLTHDVCATLHPPHMRDTFNRRTAIPSARTEHSYEPTLHRGTPGHVSGPKLGNVDDMDSDTSNEDWLYPLGKHSPGKGTPAGEQRQVYYLAAILHKFDYRARHTLPDASDTVGRHHKEVPAGYLRTWDHLAQTQHGIQKALPDNCDLKDFMLPAGNIFPYDPKLTRFTRSWISLLNPVGRHGLHKCPVRASGCGENIRKSTECRAIRNKHTARECRIDGIKQGPIAMRVTTYHVERWTEDYTNWDRLDRLVRPPPTSVVFNIDRVVVDKTPVNLRARVLAISDNRATIVTVRACEHNARSDCSKSRTKRPQYNDGELSSHRGGKDTVSKANKEATTHPKGKHKYKTQAQSEYSYWRNIPNCYETWANKNRARSDRSPHRTPETTSGNIAPHPWGERRTTSGKQHHSPKAETNTLHTTQTVKQAGLETQKEHVSGDHRTQLISSVNHGTRGSAQSEHNVRERTRRATVRRQIKHASHNSTRNTNPYRSNGTT

SEQ ID NO: 990905 - protein, 77 aa, Homo sapiens
GRGTYSLNLVVQPSSVYGDLSLLRRRPEMDSAGGDIGLSLQCVFTDLPNLDATLVWTGLLTPVRLPILSQVHSHVHS

SEQ ID NO: 990906 - protein, 269 aa, Homo sapiens
MRTTHRGRPRRETYRPQTGTATDTPHKPVDLPKTNAASANRAGPLSARTTRRSKPHSVVQTPNDETSKQNRAAQGSQHKDEPPRIPAGYSAVTHASSHQPELPQTTPPTLISNSKEAQATNSYTQRERQHNKQSADPTPPGDEPKYDSRLKKIDKQPHTAAYARRTKTANYERDADVEQDTQTIRSTHTGGDGHATIHVKIEQTRNIQHANNVLTTKLHSPPATQITTSRGEHKQLDNTWSLEGNRNYKAERARRDNTPAQANSKQKDN

SEQ ID NO: 990907 - protein, 278 aa, Homo sapiens
MPRKTGSTWKSNYFLKIIQLLDDYPKMFHCGEHEQYVVLHADAGRSACPFGGKAVVLMGKKHHDVSKAIRGHLVKQAQLLENTAASYPGATVGFRVASKEDLTEDTGYMFVANKVPAAVRAGAIAPRCEVSVTAPEHWSRAREDLAYSTALVSPPKISTGTNGNPEVMAADQDWRQHVGASEAPLLNMLTHSPPFSFGPGHPGRVYDLVAGILTNPEVALLSPAGNSAMLASLKGVRRCWPVSVWRLLRTWLHRSPFYQFTVQRSGPVGDGSPPSCGP

SEQ ID NO: 990908 - protein, 197 aa, Homo sapiens
PHHLCLLGLHGHGPPSARNPRAGHPGHGHSHPHPFPPGWDAPSRMSQMQLAHHGPHGLGHPHAGTPLGSGGQPSRPSTHSGNASSLELLHCGLCPPRGLSIRISHVVHSQVLCPPSMVCVELPPVMRAHAYCRPSYEPPALMDSPLRAPCSHAHAGPHLPRVVTQSTRLRGPPAVEQSREQPLVKSTHWAESATDSR

SEQ ID NO: 990909 - protein, 66 aa, Homo sapiens
SSTPEEVKEALEGGALLPDAEWTIMNIILEEGKEILVGDVGQTVDDPYATLVKMLPDKDCRSYASL

SEQ ID NO: 990910 - protein, 86 aa, Homo sapiens
EARGADRMGKCRGPVVLLGSSVVTDETISGMINSYNEKLIWAQRLKAEPFLAVCFSCKTESVLGKQSRTLKAYNSADILAHYGESS

SEQ ID NO: 990911 - protein, 110 aa, Homo sapiens
TRGLGGPMADSSPALSLREGGPGAGPRPPRRAGSRSGSESEEAELSAEPGPAHKTRSYGQHRKCARAAVGRRRTSERHGRHRGPHGGNKRLAGDIRGHQRYGGARSGKQI

SEQ ID NO: 990912 - protein, 42 aa, Homo sapiens
MPRVSDRYGPRFPGKDGNAGGTLSAWALWMILPTIGPWAAFP

SEQ ID NO: 990913 - protein, 66 aa, Homo sapiens
GHIARRTTVFTATERNRDFDYVKLRRSRIDRRSRHLPRPEVCFIGRSNVVKIISRSRLLIYHMVAL

SEQ ID NO: 990914 - protein, 102 aa, Homo sapiens
VAAEIELRLALVQTYVLLAFQEDRRCTVPPQIIYVLGHCMYGPTLIISSDVSERRPQKPKEKHHPPMCLKFHRVFMKSEWEMDQHDCLLRVIKDKSKTELRL

SEQ ID NO: 990915 - protein, 320 aa, Homo sapiens
MSGASTPQRHNTHTHKHTATIPTQIPTTLHTTRPHNATHNTPLQHYTRHRERRTPTRPPNLTHTKHAAPHKQPRHRAPYQHHHTHRTHGTPILHNAHSPLRQRKYHQPSTTTNTTTTNWPHHNITNRHHTPQNRRHTPQPSATLPPRNPPADKENKQAHHTTHTHHPPDHAPTPPPHAPTTPTYTNPTQPTPHPTPPTTTPPTAPPTPPTPTPRTTTTKPHTRPAHPTSRHHNTEPAPPTPSKPNTPNQTLAPTHNHQVPPPAPPSPTQAPTQNQATTPPAPAHDTSPEPTAHHHRHTITQTPRHTREPNPTQRHTQPPT

SEQ ID NO: 990916 - protein, 167 aa, Homo sapiens
CRVQSGTLTQHPLILSMARTPVSESDCGMSSPASGLTRGNRHRASGRLASDAALHRSERIGSHTCTRPCARSRSDYVVRLLRWLHLGAATLVLTYALLPFNLYTVHTTIVTISRAGVCYARGNLRFDYAPCVLRLVHIRTEPCVSHVHIVTFLRAHAENILRHQELA

SEQ ID NO: 990917 - protein, 164 aa, Homo sapiens
TGGLGGTMGIPRRTVPAEGGPGAGPRPLARGSARVRSRGECRERAANKRTRSYGQHRQGVRAAGGGRGDNVERAHGGQPPGPAAGTNPGWRGIRPTKVAGGPRMDPAFKGGPNKGVHPTGWRHIPGKETNLWTPPQLIYQKNALWWFKWPLTSQWDSPEKLNRG

SEQ ID NO: 990918 - protein, 273 aa, Homo sapiens
AFSLCPPLSATLLCGEWTAYPTEVKMCSPGELTQASSSTSSSFSSLLLLRPRQPDLLLRNLDPHRQDQLRCPLWAWPSCLCRSGPRVLAISGHLHHGHRPPGLCRGALKELRCLLWPVFRDAAAPVCHTESPCGILISTQCGPSLERSLRGRRKKTIRKYGTNPDETAAEESWEYVQFHAALLRRGTYPAVTWSPTSSILEEVAGVRMAAPRCPCSCLTNLVGDRSELPADPSDKVIFAPSSAGLGPWGRSTPPSRRLWAVPWRALFRRAAAG

SEQ ID NO: 990919 - protein, 102 aa, Homo sapiens
MRKRGRLIESVTPETVDHSSLSMVELHLSTGTLRRNLTAVSKKLDIFFLPTPGSLWRLLSEFGALSLAELDVERRRFSIYNNEFGKHSDDSNYIEQESSSSE

SEQ ID NO: 990920 - protein, 197 aa, Homo sapiens
GQTHLLLRRQPSHIAQTPWRKVKCRSQRIKVRIGRLVTRDCYKTLVKWICCHTMTTFIDLNYMVIHVPISFQPMANSMSTVKAENREQLVNQWKSTYTYFQDARSPYQNQVEGDARKAEIQSRKIPIGDTITNQWEKGMEAQIMQVEGDQKEDHSIIMTPYMTDETPCTVHWSVEPLRSMTTDLKIISNAYLAPPNG

SEQ ID NO: 990921 - protein, 129 aa, Homo sapiens
MRVRDPGWDCNGILDIGKCNNSQIRYANIKTRFGHNSGYFSYKGKSSPFRGSYTFRLEICDATSARRITKGKRGFVEAGCFFATVRANISLEKEDVTATIYPIVAKDFLIDTVINSLYNPQEHASKREE

SEQ ID NO: 990922 - protein, 67 aa, Homo sapiens
LVTIARYDRLKPQNIAMNIMQLITYHSPVGPFQEHSSEAAQAINAYRIYHEATTYPITCCNLIDNSV

SEQ ID NO: 990923 - protein, 323 aa, Homo sapiens
TDNAVKNHWNSTITRKVDLRYVSDQESCTTGPRHYELEHVIQGGQLECPDQTGQKEKLSHTHNTDGHSQKKQKKKEEDETKARDKKNKETKRESKKKKKEEERRKRKRKTTKRKHTKTQQKTQEKRETEKYTEHKNKEKTQKKNKKREKQTKKKRNNMIQERPQTKTQNKKDRKKKTETQQKRKKTKEDHTTKTEKEEKPKGEKRKTKKKNKRETKKTKKPDKTKKPKKNKKEKKNETQKKRTRADTHRTREEDKNERQHRTREIITGATRNRKRRKKQKEGKKKRGRKSQRNRQQKQRTTREKAKKQTRQEETRDEETKKRS

SEQ ID NO: 990924 - protein, 192 aa, Homo sapiens
MTLTEAVLNVNLPYHCACCNTAFSVCRYVDIAIPCNNKGAHSVGLMWWMLARQVLGMRGTISREHPWEVMPVICNYYRDPEKIANEEQVLLEKAVTKENFQVNGLVTAPEITGIRLNLRIVWSIQGGPEPITETPLEWRGTLAQELVATPRSAQSGEPPKRVTGAKEKHEHRRETHYEKNGNDGKTSDEDNH

SEQ ID NO: 990925 - protein, 186 aa, Homo sapiens
MAADRDPYLASPFPERMAYSDCVDFPPRGGVGPEGPGGQAPAGRPGGQSKTVTAAGQYSPGMTIERVMGRQPGPLCGPRLLPSALLQGEGLRSHLGHLGSWQSRLPAGSPRKDSYHLLKRRTQKVFLTGPSALALPEEGLGGPLPDVGVGPHMGPAGVGQHTKETRDNEGANTYWQASFRPLRDPP

SEQ ID NO: 990926 - protein, 88 aa, Homo sapiens
ATEGSSGASVYRPVYSESVDYEVLRNSCRVFAFRMYTEDEARNNRSGWLGEEYQRKGTVTGQVQGPEDKVDSMNVLAEQRLEALVSRS

SEQ ID NO: 990927 - protein, 217 aa, Homo sapiens
EQRQFPGSGCSRSHDLRTPPPDVHGVITLTGWTNPLTLARSLSLRGLMAACSRTVAARCCGVRRPVPARDGPHNQLASPGPSRFSVTDYPSDPRAAEATVDRPNVRCPLGPGGGSVFIGLRRLPVFAVCSRCAEGPGRVICDASSVGRGEKSSAVIGFPSTRRAGSRDRVGLPALAQRLPGGAPRPVPKVRLAPTRLRTLNPRGRHPMGVGPQGSPR

SEQ ID NO: 990928 - protein, 73 aa, Homo sapiens
GAHAREAAAGPDMSVLVELKASIGSLASKSKMQINTDSGTERLKNSVSISKDTQVLVIESYEKIQIAWGTHTV

SEQ ID NO: 990929 - protein, 109 aa, Homo sapiens
EKAEGSLDTGGSRVPPGREGRLLVGEADATGEDLFPAVGASPNFEYEIASLYPRIRASDQGDNVSFEKAIREGAEGLSEVVSVQVLGYGATASVISTKSAVVPLYDGFR

SEQ ID NO: 990930 - protein, 143 aa, Homo sapiens
TEAVAELWEMNARGLGSELKDGLPVTEDLSASGPFESGMIFFGDRGYVLCCGIGIDLLPQLPSRIEMYSSRNRKFPGSIIRINMIFCGTTEKDSGSIGFRASSLRGWNSRAVRAGFMRLRIGLSMLKSFIWMYGGVMIETIGV

SEQ ID NO: 990931 - protein, 159 aa, Homo sapiens
GVLRTVFFPTACCPRTRVGGWTSCVLSECANACTSHLFVWAARPLREHVGERGSVMATSGLSTDKRYAQTSDWGSTAWGLCQGQGGAHVRTVDPEYVGAVHADGREDRQCRGRGGVMCHQENVLQPKPALEALGSCPEQRKYSEGNPGKQILMGGAEVG

SEQ ID NO: 990932 - protein, 216 aa, Homo sapiens
ARPPGDAVAAEALHPQAAARPSQEAPGQRDPARETAASVAAAEGGLDRATGEAFACGTVVRGVGGSSSSDRPVALGREGQSPGERRCGLGFGPPICGPRQLQSRASPGSPGPPFPGVLLRFIGPHHKPPEWEISPTEAGNTTAQKHVGGRRHDTLAENERAGDSTKELGVPVGPGEGQGRRRTRRMSARRPKEGETRHISGAQNQWRGDPTSRAQL

SEQ ID NO: 990933 - protein, 154 aa, Homo sapiens
MRDTRDEQSARRRYPWLQHATFLPMRWVELMLPSPWSGAHRVRATFTGAHATSRGPGLVSRYVPWFTRTHGIPGGRWDECVAPLYKACLEGFLARVAVLSTAMRIGALPGVLCAVLRVRMSADTCPRSGDHMTIHDQRLNVMERNIEPMKRTHW

SEQ ID NO: 990934 - protein, 636 aa, Homo sapiens
MRERAPVDACRSSGCHRAMYPFPSLLFSFIIIAGSRGSNTCWSVALPLRARLTALIAMISFDNCGPFATAWYYRAAAHGLLRAPSPCVTLQCAIRRVYVRIVRLRTIHANDMREDRLPPSGRNLRTHVYGRRLAPPLGEPLLLDGSNERPAAHHVPPQVRSKGHAITLGKPKLHGNLRSSLHTVQGNRRRKVALSPFCRHPLGYANGNKPVQPRVAKRPEDPLTGGQPATLVLEEESAIAVVLDAPQVKNAQRVEGTSAGVCQTANRPKGHILGHNGGMMGKWRTIPYQQKKTTKAKKSYGPKFGPDPLRDKGKLLAYKDDGPMKDTDVHSDFATGAKCTTPPEQLRVGRLPLIARRQEKQGNLRIGDFALSPCAECATPPRAEEGGHCRAKERARQHTATAGRHDTGEELEKLHSVRKAKPRNIAMGFGVPGKTSVTLRQQEAETSALRVFVPGRHRRPQRNMAPGENTHLCSGHRERPGRGRVYIVGPRWPVNKPKHTSSGGPQEAQYPIATIGPRTRVGKVAIPLSKGNVAQQERPRGPKRGQSAHFLGEGAHPKPRLEQPPTPLVEHSKTSQLAQEAPHREMHHSHQECGSAGKCESPAGTESAVHSVKTPCHHLVRENPSCLLKTETVRIV

SEQ ID NO: 990935 - protein, 490 aa, Homo sapiens
MNCEQDAVVHDVTKAKGTPSAHLPNEITLSVVIEFNAASYIRSEVHISLVSILPMISSGDTLCINGSCLSPLVGTPRSNPRITLIRKYNIETLSNSMLRKVSIDFGYIVSKGGLGEQGLDGQMKVDALRSLRCYSTLVSRDTPKARLRRRLYRSVLLSARSLRGVACTQKGPKVGGTIGHAFIPQAIRKEIPHTEVYEKDSTMIRGLLKRDGLQTFTRIFRRRGGKSSQWEDITRVQGPTLSMERGETNTADRKTGRWRCSMTDRTTHYYVTPIGENAGRSGPVFPQRRTWLVVAKQRGALITKSQRGAETETPIQRRFERQFPPIGPMYQRPKGIGPVGQPLGARSIKGATRTSREGRTKHLHRRVENNPLAKTHFFGEHIVNIIKTDTNKSRLSRVLNYVFNFHAACIAGATNTAALQQRDSSGGSTKKRTLSKWVGSFTHESTTTLTYSLFIRPLVAVTSNARRTTPPPIIREDEHNSHKKLTNRPT

SEQ ID NO: 990936 - protein, 235 aa, Homo sapiens
EDSGAVVVGGGGGRAGRRPCAAAETAAVTVAAVRRWDLGLGGNECGLRLWPAAGAVYRRSSPSLLPLAEPGAARAVTARTSSRGIRENTYNIHGNPENGNHQQTRATVRTDKHTKLENENPENVYRKERTGELQRTYRGALNLTQYNYPQQRRRERDSTVRLAKNGCKTRKIRRDPTNTTSAPRQPPYVTERGKFKRQPIGKEIAQKSNRAASKETAEETPCKRKALQIETNGHK

SEQ ID NO: 990937 - protein, 278 aa, Homo sapiens
FSGVSDDRRRRYATTIPSYLLAVLSGNSSPSASDIMMILVDVGIKCVEERLRIVIGDLKWKMNMDDDFCPRVYRLKSMSSRCLACAWGHADRLWHGPRTTGSPLAVWVSCPLAENSRYLQNEHEGRRSIPLLKILDGMHLATHVVWSCPWVHAHRQWAAGRGFPTGVPMTPGSCRTLLGQIRVGEAGHPKQVMTPPKERGTVAGRMQRDCHRQYCRGLQTQYPPGRGGHFPTTYGAEEAPPPGIDGPTSWYETPMCPPMGDPPCKRESMGQCPSGLGS

SEQ ID NO: 990938 - protein, 357 aa, Homo sapiens
VVPVRTESVMRTARKSPEWQREIIISTIVVYCVQYDLLGRVEHYWRVLLYEMEVARAKEETDLIHSSENGSVVRRLAEPVSTLTSHACVPLLIDCTSLALVTRFDIYLLTISLWRALTYQLSTSVTFDCMRPGTLEDNITEAMMTADDRRERDLSLVTRISWFDRSISEDLTQAWCISPKNRRHDRRATLIASFVMYTLGRPCRETNYIRRVVEVESLGFPRRKRTPKVGIHHHCHGTLSTSKVQLPLHQGKMGYDAPDTGGRLRRRSGLASGDHLLGAYLLTCPGPRRCLAGPCSVPLPVPLRPVSGLCLCDPMLTVCRLRAFWLPLGMSTEGGVRTGLPRLQCGLERLVALARSV

SEQ ID NO: 990939 - protein, 187 aa, Homo sapiens
AWRLLSAAAAAATHAEPGWLRGGGGRPSPVAAARKGSPRLLGAAGAGLGGEPWGCTTRQRWHLRAQDLHAERSDRAALPVQPPLQLTLYQYKTCPFCSKVRAFLDFHCPALPGGWSVNPVRRGMRNQSSPPTERCPSMGGPREEEKARNEAKIDSSCHQSGALKDLPGCRGQPLEEIITYYPDHEGL

SEQ ID NO: 990940 - protein, 186 aa, Homo sapiens
GRAEVIAPVGSVVLEVWPRSCRQTISKADWDASCRRALEYGKACRPRGWWFQGLLGSNAFMLGRTARVSSNPLAPVLPYQMSDSSGRDELQPWQLRSKPSSDIANRSCRLGALNGHQGDTPEAVVPQRAPAALMPTLPAPSAKPVPVQTALLRRTLQIVTFRASDGELIYCILVLAFWSARILSKL

SEQ ID NO: 990941 - protein, 297 aa, Homo sapiens
ADTRRCDALVPRTLLLLLSGALALTQTYGGLPLHDGISPHPCPGPADGEPRFICSVATWTDTQFVRFDSDAASQRMEPAGAVVYEQERPEYWDQETRSVKAQSLTDPSGPGDPAAVYYNQSDGRISQTHPDTVWHADVGSDGRFLRGYEQHAYDGKDYIALNEDLRSWTAADMAAQITSASVEAAVWAEQLRAYWRARAWEWLRDTLENGKETLQRTGPPQDTYDHKPNSDHEEPEVLGPGANSPGEITLDLATRWGGPDQDAVVVQTSSPDAPPDGVSGLGRSNPRSIMLQATKGL

SEQ ID NO: 990942 - protein, 113 aa, Homo sapiens
MPSHTAVSWRYIAQQDRIIRQCCRSKSSSMAHMILLAGDQLHRNMQIRPCDTQTPRSDAQNELEYDLANLSEEIVAQLLRSNEKYYVARPSKRRTWIRRFRMFPIKLAASTGT

SEQ ID NO: 990943 - protein, 286 aa, Homo sapiens
MNRHPNFLVVAEGYTLSSEDRETLFRTISKAGNDHWHSSSINQVLSADDRCGRCPWTPNQESHPALSVVESRSKVAHQYRRLQGTSNPAQRPRGTVHMTERPLLHRETSLYEASESFHHRYNQGIIRQKAFAEFSPYLVTVCDALVIVSQITPGIHCPHIHLERKSDERVHRVAWDILQRRGPRAMLGPFFSLPKYPSFRCVPVYTRCSLLLFHFKRHIPCVLEKTRVGNATHIKHTHICRRAPTRITPPCERRPKKGVSTTPNTPGAERDQKKAGHACNNTAGLA

SEQ ID NO: 990944 - protein, 65 aa, Homo sapiens
MIDLLPQETRGICVLGTALDRWCGIFKFARYAGFNAGYKEVRSHKTLQGPHWKIFQKQGIDRKYQ

SEQ ID NO: 990945 - protein, 112 aa, Homo sapiens
YNPYDALLSRAPSAYNEESYKSPMVTLQSDRIARGNKSDTKPNSPDAPSVRDHCASNPPTEEVIIACYYYSCPRSNHLLRKEPTVVLQSLYHSVSTGSLLTYVLAVYIVVID

SEQ ID NO: 990946 - protein, 156 aa, Homo sapiens
GEKGGDIWARGLKPAGELWETPFSKKGKHNKQKNTKRPHQKTNQHTSKKKICGRAPRAGPEKRVSKHHWVRGRGAGDQGSVDGNQGGPHGLFPRRRTLVDNRNRGGVSSPKKKRRAGNTAAVLFDHHQGGSGSDTRGAYNKGGTNRERKINFAPRG

SEQ ID NO: 990947 - protein, 122 aa, Homo sapiens
MALKRIQKEWSDLQRDPPAHLVQLDRVGDDLFHCKATYYGGLLIAHIRVESSFSLYIFRPDYPFKPPKMVSQQKFTIQNINSNGSIGLDIREGHKWSPALSVSTTFYGPYVLYFGDPNPDDP

SEQ ID NO: 990948 - protein, 114 aa, Homo sapiens
GFGASVGAAGRLGARSDSAVGSEPGSRHRCAAPLRRAGAAPGQAAPGQERRGCVMHLKAICEGSRRKEHPPEVQQGKRQRILMNHQKGRVLDETVQRLDQYNYQGVSFLQASLR

SEQ ID NO: 990949 - protein, 252 aa, Homo sapiens
ELYKSSFRSPFILYVRLRTDFTQHPNLTNNDMGYGYVYASHLTNFFTLLSLTLYLLLTDSFLLLYSLLTFLHTTQLNPGQPHYLPLATLLTYASRRFPARHSLPLLLATPTCARDRHTTTSTNTHQLHARLLHTTPHLLPLIPSSLLITFFNSLSSSFHLSLRDPLFPPPLPLPRLPPSPTPLSNAFSLLTEPVLQLTHPCHLLFNKSLTSLDHSHYLATPLNLRATKPLNFLGAPAHGSTTCLTHPPASHA

SEQ ID NO: 990950 - protein, 114 aa, Homo sapiens
MNQLGIPAYVTINLNAGQMKAGGNILTNSIPPKRPKLGEPTSSLVQPPGHTKRLFASSYRQTGLCRTQVYQRYGVGLKFCTSGRGCIRGDTITLLGSLPGTEKGTGLPRGTALV

SEQ ID NO: 990951 - protein, 191 aa, Homo sapiens
DRRDRVRPASTEPRSCADPAALSTPGRQLTYGCMIFAALVVEQAAPGIVQGPGFRGQKIAPRGPFFPLPSVGAAPRAHRAVMRWDNVRSRTGIPINAWAERSAPGCKDRGIPFNLWKCNPQFEATGYSGHQMWGTTLRRTIVGTNNLSYTLKRALVGSPGVSNPRWLGSDPEVPPVETPYRGTTARKDWTL

SEQ ID NO: 990952 - protein, 123 aa, Homo sapiens
MNGNRSNKDAWCVGTLKRVWMVEGKAKDPFRLRGGKATKCAQERVPRIETLKRYVLKAQERPLPGLQGREKRWPRNNSFPWPETRIPGMALKIRVRYLYLEPLWALDFWATDWLVANTFDTSW

SEQ ID NO: 990953 - protein, 110 aa, Homo sapiens
GPRGLASLGLGFSGAAYDQNTGRSRRPEVRRTRCVRWSAPTRSCWVNQNPIAQTPGFSPPHAEGSTNAVLEGVGAEADSAAGVKKGSRMFWRTTGAPGTHGFAQENHTAH

SEQ ID NO: 990954 - protein, 189 aa, Homo sapiens
RPPRSRVARWWRAGGSAPRGTRRTVSPAHWATQLIPIKFSERQQASHYLYVRAHGVRQGTKSTWPQKEDSFGSSNVPPILHRGEPVPPSCPPVASSSRVELQEKGRTWLRAPKGVKVEVFSSQSQFRVSREPMLVFQKAKVGVSAALALGRGPPCLGGPPEKPPLGEGVAFTRWISDYADSVARPLKAP

SEQ ID NO: 990955 - protein, 298 aa, Homo sapiens
GFRGERWAPPAPRWVPRSDSAVGSEPGLPPTVCRHHCVGLVQPRARPRPGQERRGFVMHLKPYLEASRRKSTPRNVKQGQPLENSYEPPKGVYIDEHIAKVQPHTYHVSFPFSLSRYSIISKAIVEILSPNCLGSMSGNESCREQFELLKPKGIAHSEGIHQCERRGTTEYLGCCETVKFPRTQVGILGSHQCSTSGWDSLHHYNSSPGILSASSLYEQGHNIQGAFLKKEGTGAHGYGTVTRRVGTNLKPFGMCGFDTVLCPLYVNVGMASRSRARTYNMLPLSKHALAVSKGTPYV

SEQ ID NO: 990956 - protein, 134 aa, Homo sapiens
RGGVMERSREKQKWETCVTSCALQSDDRTLFQRCVPSCTTELWNAEEEACLHSCVGRLIHSNHRSWPLRAAHACLYRRRSEDYEAASVVPGVVWKQPWGLSNQAVCIPQTQEGGALGWTPQIERDPVWHLLGFV

SEQ ID NO: 990957 - protein, 105 aa, Homo sapiens
GDQRASPKRDRSSGCLCEVARFHPRSVYVKARNSLAMSVQRRGVFSAEPRGRTLPGFPQKRKAMEGPFYFILGADPTVWADQACSTGDVWTMAGDKVRTGEIRSN

SEQ ID NO: 990958 - protein, 81 aa, Homo sapiens
SSVSFVVVSFLLFFQKRAFGVVTPGCVGCAGGHKKEGHTEETKHNEINNRKSMRHKPQQQNRTQQKRGRNIKRRMSNTEQE

SEQ ID NO: 990959 - protein, 128 aa, Homo sapiens
MRENIRQYNRGVLTEWQLAIYTRCRRYMAPETAHGKGDEGELSDNMGAFGVTNSLIVSFVMMLPVRPAAHLSLQALFHPCPVAQPVHQPPFGMPLWALKSWHQALAFYLPYHSPSGEPLFALGSNSRV

SEQ ID NO: 990960 - protein, 62 aa, Homo sapiens
GAAGKMADSVASRGGGRGGNPAPRAPEDRSVGMRSCARAPGKSWSPSSNSMLRVLLSAQSSP

SEQ ID NO: 990961 - protein, 74 aa, Homo sapiens
IVRMSLPYGITRPELRICCLEYLSDASADGINTISVRPRCRTHLRIVTEVSLSFETIQSHDYTWQGDPSALPSG

SEQ ID NO: 990962 - protein, 70 aa, Homo sapiens
RKCLAAASRSRSAAPGPPVPRRPPSRAREGHRARRKRKLPRWQAPARNPRQWHPFKGGLHLAGQNTFGTM

SEQ ID NO: 990963 - protein, 174 aa, Homo sapiens
PQRRCYHLCVAAAILMAGRVRFWDSWNSGGDWNNFTKCKAIAELIFSSGDGQMCFVTEPDCFPISQDFCSLLKRVVIPKPFSTAGSSGSDESHVAAAPSKIYCSRNSVASTETIGDPFGPQDHEGSRLPWEHRVLGCHLRMGTAFTGTKSLVHKNFCLMFQQNPLFTVNDHDVC

SEQ ID NO: 990964 - protein, 131 aa, Homo sapiens
MNIMGDVVRKVLTKAFYLMKCPQVPTTLFEISGMARHNMSVGDKISMRALLGREGQGSGPPGLCLYTKLGHNKKQKAQSSWGTPELQLIGRYLWRKSRQEGYHSPGKTNNIDCFCVRRLYEKEAERTGADF

SEQ ID NO: 990965 - protein, 84 aa, Homo sapiens
EWNVTRVIGNASDPCCLWFVYCIRTTKVVLTLEKPWGLASFQECLHIVGVYRNVVLVEPSWDDCMLSQTRLWLEHHLVSRFIVT

SEQ ID NO: 990966 - protein, 178 aa, Homo sapiens
MVPEGGACGGNAERTESIQGGFRTALSHLEHGLHELKEIRQARVPESLGEHRVMPVQWLDPKAYNAVIPHNTRCCNSNPGPCIGDSVHENGENNQRKALLMDGLGNDVSDLRGPGRGCKLGLDSPERAWACFVEVALEPWLLERNAQGESLMEEGLKNLVGVKIQSFELEKKRFDLEN

SEQ ID NO: 990967 - protein, 140 aa, Homo sapiens
PARGGPPGQSLQPPREASVTKMKLIYPGALFSGERVGRLNYIREPHQSRFKPQGPGERYFPTLGGLPKWGEEINPNLGPGLTKGKRLHWEFTLLRRTGGEPRGSFINIFIGRKEPFQSHLELKDTGGGPSIRRTQPGGRG

SEQ ID NO: 990968 - protein, 314 aa, Homo sapiens
YQRRVPITAGGASTYVTRKPGRPPSLKQPEAMEAEETMECLQESPEHHKMILDRWIETARAGPVNCDYHPILSDGHHQFLGAHQRAGWSLLVVRVLSTNFLPGSFTPRTMWVQIEGVSKNGLSAHLKMEVHLYVHTFNLIQGEEEGTAKVIVVEKQPEFLTNMLERISKGPFESQENKRKNLSSSLGGKTTHGDQIEANNKRTMAGNFQVSHWSLAICRNQNPGGTGGIEDGRRAHLTGGRCRARTIRGKVLRTDKPERLNHNHGAPEERPGGAYTEDRRDKGEQTGSVPQKGITPGGGCKTEGGDTPLGGQQP

SEQ ID NO: 990969 - protein, 29 aa, Homo sapiens
MLEEATLITQGESRGTWRALRKKEENKLT

SEQ ID NO: 990970 - protein, 157 aa, Homo sapiens
MDKVPLCYLSFGTVSIIIPDRHRENVNVNSSVTPKRFPEPVYEDVRGSGAWYLTMDVYLLLETVFLVELIQMSENSARNPIRQRIHLANVASRQIEAANREFVQDGNIVTELLSEHKEKMTERLLSANAGTHSGVTNELAVCRYYSPLATLMLATNL

SEQ ID NO: 990971 - protein, 309 aa, Homo sapiens
ALHEGGGDGGGDSGFSQYSVDLTDPGRLTGSNYPGFSISLRLTWFLVHERRVPEEPSVKPQTTAMSPFVCRLRRNMFCDVQLNRRRCKRNAVNNGLLAEEMVECFNKISRELTVGSVVISACTDIDVVTAGIDLDGHGLSDMPAARKEMMWSGSAGDLRDIISFDTKETSPVLERCPSRDCGVMGADRGGVELVTAVQSGTVPGCSSGARGDVGWLRCPKLRACQVFGNPLSRAAHGRMMVRKLRMGGAGSQHSCVRATLGASPTRGEQQDRGPGPAGHLRAHTTHTSARNDPSVGAGAPKECLTHKAI

SEQ ID NO: 990972 - protein, 121 aa, Homo sapiens
MRKGLTEVMGAAPEALWQYSPEPNFSFKIVFPNAWLSGWITGPMKTSRKEVKKAFYGLNLLETSEKDCPCHPYYNKTSGLGLRVHGFTTEKGSSTVWNCAPIGTLEVKLTRKFLPRRRWHP

SEQ ID NO: 990973 - protein, 67 aa, Homo sapiens
GEEVGVSLGPWVLNVRGSGARTPMMLSYSPNCPDTRSFTRLSLWPEMKACRHCGEVRYRPGPNYGEL

SEQ ID NO: 990974 - protein, 110 aa, Homo sapiens
MTRTFLLLTSCSRTDYGGKNCKRMPCRFTGLTEKPLRAAVGEPGQKGTPRATHRACRFAATIDYHNQERDTTQTTRQHAKRAIQPSRVKGRHPSLHTHAAADTMPQNSAT

SEQ ID NO: 990975 - protein, 237 aa, Homo sapiens
FASLLNLSSSTAARRTPAATTCLHGPICMPLRTQSKDFIQTHDTQRKIDSRRTLHACRNTSPNDACEGEGPSHRKHHDTNINNQPRDQNPPCDNTTQLIKPSTEDDTAHKSLQRQETNKGERNNTTAQTQGTKTKKKRRKTSQTNHKTHTQPPHQRRSDHSRAKHNQGTPTKPNAPQKKNLPNKNTRDQHTKTPTKNTTPKKQRRTNPHKDNKTAPHRENNKPHHHKDKKPTHNTKP

SEQ ID NO: 990976 - protein, 178 aa, Homo sapiens
MQPTSAPHNYYTYTRNSQNIYIPTPPTNTRLTSSLNTTYYTSPHLAYHVYTHFANRRPQNAPSRTHTHNRTGAQDTLTGHPHAPARDGSASRRTARNRTSDGRAPLSPAKPCSGSLGSHKVNSPWPLLHTGTIVRRKTRHIARLIGDPTRHLQTGESHHADNVQRRNSRKHTEQTPRS

SEQ ID NO: 990977 - protein, 390 aa, Homo sapiens
GARTADEDGDRHDTMEHISGQYREPSLRTFRGTSSMMRELDLLSRKIRKQSMTSWLQRYIHHGRRQQILHKTSDVGAHQQKIPEQPNTQVQGITETTKVAARPCRPTKHRRITHITERLESQDQDAKMTRQDTAQNSIEREQRLQRHSTENRNASKKKTKEPKHQKRQNRRENTEETRQARKQHYTRRKKTNNKDNQKTHKAREKKVPKKNKTRNEETQNIQSQEQWQRRNTQQKHKKQAQITNKNTQIKANRKEDNQNRTGHKEDKTPRTAEQQETDTHKRNTRKHNNNIQNKGNHSHNQKKRRKKINTQENKSNKTEEEKSREKQKREKREECEQKTKKRNRKKKAESSNKKKDRNKQQTTTDENRQSARTDSRENDDERQSAQVLWP

SEQ ID NO: 990978 - protein, 391 aa, Homo sapiens
MGEHLLAHGYPDDFYVRVGSKRQRPLWVLDSPKQPNKINTKEHREDPIKRRGTAQGTGERPDDDINAKAYRIGPLEQPTWKITAHTDTGDSKEYLKRLLPEQNQETKQNQARDRPTQKHLHRGTETLTEKGMPKEQPKDSRGTMRLQHNPTKPGTSAASRNSVETPTESHTRDTGKGEDYHQNHDQTHGNESKHVNSRNQNRPRRRGTPNDTDEPERTTQNRQEDDRDKQDAANNRHTDEAQNDQEKQSKNTRTGDHIRTETESTQDHRRAPNSDPQNSQVTHKKKTKTKSQAQTQRQGRQANQRPKGPNENRQTDEKHRQNAKIEKKHDQTRRRQQEREDAGAHRSHRHEGKNGRRQPPTDASSATRPKAGRNDTDKTQPTGPEDAQRQT

SEQ ID NO: 990979 - protein, 363 aa, Homo sapiens
LQEMGRPESMPFWLTHMGVKTTQLSGDSQNGFHCSHPYSQQEYDVHRLRKSALHIKKHMAYNTPTPVDNMMPIIMDWNGDNNAGETKMLTHALWNITGDWKSKTIRIGNGQEETTACKKESRKMHPTQTNSIQTEQTIDAGTQPGKTYKKERKRENVTMIGPKKRKQRDTTKHKNSESHPKDTQEKQKHQETIKTEQKENQATHNDRWTPPTQERTKERKHKRQTERLRKTDIAPTGRPKDGDQHNRRNTDPTTTKRQKAQSRTNTGQTHPKKNKKKMPTGQQQANAKKKPHTEHTDGTNSDKYKTSSTGEDESKTRRPQNTREEKKTKRNNEQGETPEHTNNRREQQARHKKRRRTSKKKKR

SEQ ID NO: 990980 - protein, 397 aa, Homo sapiens
GLSISNIQTAYSFVSENPERADSVLCYLDVCIGLVLTHGCSGDNWISSPNRLQDGVPGRRYLQDRESRRESRDKRGQEEKDTEIQTTHTDDGDNRQIRDGHKEQSNEIQNIHRGESKDAAAPRRAEKSNSDSSNPIQRNESEHELTRQQEATRTPKRPELDILHQENAERKPTGTNNMEGTTIGKGRADTEQRTTEEDTTKEKETTENNTEKTKWMNRQEAQTRHRDRWDPIKTKAPEEDMGTEKREQHRYNGDAKENTNTKANKSDTIDRDNNTAEEKKTLQNEQMENRRQNPEEQQQTEQPNKTQTKSHEKTLENRKHKKKADTREADTHTCTRRGKTEGEGRQRATENEDDKPERGRADRNRKNRRTQQRKGNETNSQSYNKEEESKRTARRRA

SEQ ID NO: 990981 - protein, 251 aa, Homo sapiens
NEEILGIDWILDFANGKYDCLSRGNLIDLYGNQGLHPTRTYTISQLLSRPTFPNKKGAHRDLKHETLDKREAENGQSQTCPTQKNQEITKNDRIKEQGTKNTQEPMKPDMHKEQGKPTYKSIRGIYTETVAHENSNDDNKKLEKQTDIETWTTTNRTKEATEKQEIDTAGPKNKEKHLKPIPRDTQATPDKERNRTNKEETRNKAKQQTKNNHTNTCRHIHLTDNHPTTQQEQTPQQQSIQKMRTENNTEK

SEQ ID NO: 990982 - protein, 260 aa, Homo sapiens
MTCEPKKTQYNRQSQTATNTQKDYQASRQIKRPGRERERRTAENKKDNDCSEKPPDEKATGTSKEERRQKKAKNKNWKKRRPRKKRQGERKRTKQKSRERGEARQEKRDGRQKKQPAGQDAQHEGRGDTRNRRDEEAHKQTRRAGRHGTKPDTRNPHTAETSELQERGPRTDEGQRDARTKRDQDRREEGKTGPPGRGRRSTTAEAKKTKKPENRKDSKKEPERKQRAKTPQVTNRREKDRTGVTLRNTTAKRSKSKTQN

SEQ ID NO: 990983 - protein, 212 aa, Homo sapiens
MEDSDGTVDMTPLRPQNYLFGCELKVEKKIITYKVDNDENEHQIIFKNGQVYGLVQRMSAHMRKTEAMTLRRQSNESNTGKLEMSVTDKVSLGGSEITPPVVLRYEAPDARDRALITWKRHKHRHVDERCRVRTIDKGGSDVKHSHHEYRKSGMTPEGEQQGYNQKKQLTQRSQTERSMTTMRQKRTQKITTETNNRRRSKQEERLTKKEDQ

SEQ ID NO: 990984 - protein, 171 aa, Homo sapiens
MLIFAPSGLKRGGKTSFVHIGPTFKYYNAGCDTYTTGDIGLKKKNNYSPKHPFAGNRPEGFNPETRQHFGRHIGGQPGRKRRGSPPNRENGPEARERGTGGNITYPQAPFIGARSPDEIPRGTSGIRRNKGYTCGLKANNRRGEEMTMRRQVNREEGRGTKHDDDVIKSDN

SEQ ID NO: 990985 - protein, 71 aa, Homo sapiens
ASTAGLHTHISVLWTITYNDASRPDVTEQAQHKEVEHCDKAQPNEDEEDTWGRDYCIDKHDMSGVTAIEDC

SEQ ID NO: 990986 - protein, 92 aa, Homo sapiens
MWKGILTCVGPPLVPGPKANDDEGSLMSLQWRCFNRDVVLISPAQYNSVVAHSTVRMTDTLERRENTRPMSHNTGDKGEHTNRRHTERERDD

SEQ ID NO: 990987 - protein, 65 aa, Homo sapiens
MYDTHNAYEQEQKGQQHNRERGAAHPADSKQYTIGDTQEAKHEQGNTDDTKILKRDHYSHSNDEK

SEQ ID NO: 990988 - protein, 345 aa, Homo sapiens
MLVENTDETIAFDNEARYDICLRTLKLIIPIYGDLNHLVSATMSGCHHLPPISLASSLLTSASVAVNMVPFPACPSPYMAWLCPSHARPLEAQSVCETLTSAGNSPSEVYRCPRYMMGVPVTPVLPGDTSPWSADLSRGSRMVHERQGLMTQMLNVLIHEQASYFVEVESPNNGQLTTPSVTLTTFSGLKMACLPSLALRTAIEELFRRSRSSSLHVRRKAFLSLVHRRRLDEREFTEAESNDERTSSGVSGVRMPRKSRSSGGGAQRLERAPSTEGDRSGAEEPEAPPCPEMGCARHVQGSGGRQPAKWRQMVGPKEAANGDGPEARLKAHDTGRMHHIGAVVQ

SEQ ID NO: 990989 - protein, 188 aa, Homo sapiens
MVCMRTWILYPSQSFYNPANIFVEHREGENRHLVRNADHGPIQARPWRHDYRRSQGSTRVQANAEAKEDILDSSADSEIALQKALAVKNEPKIQAKAGEGAKGQAETGSAIRKPHRDREIRCELRGMRTEYREHEVRKMTRMATGASGTRASENKGGTFKSRMQKGRQEDEELRAGHERTVMERLLQK

SEQ ID NO: 990990 - protein, 158 aa, Homo sapiens
MFPQGPHFYPAPVFVVSHGGPPLLGRVCFFISRPAPVAALCFYKHARDERGKTRVQPCGESSWCATRTLYISLCGGEGTHYRCVDTTLYPIAEQYYIKCLSQEVDNLYNHIFSTAECHIKGVCLNTTIRAERYIICGDEAAETRSEENYYVYARAITR

SEQ ID NO: 990991 - protein, 92 aa, Homo sapiens
MSSTAGKDRSRLDHYYGTSLLYQAQTLSYRVEHRWPLVEEYFVDSTVRILCRSFLQLDSRSLIDTGDTALPIYVEGEQKFLSVMTLSGLQGK

SEQ ID NO: 990992 - protein, 173 aa, Homo sapiens
MPMRHPGTAQHISMHLFQPAQMTTQAEGASEAKARGLQKQDPQWPEPTKRDQARLGYTLTGTLQENECLNEECTTDVTRSQPRRRGEKSARCHESEDKRGPRNPRAQDTTRRPNKAGVREKQRRRTKREKRQSNKRTPRRNRHRDDPRAERHSGRHVLNEEENTGEKTRNKRR

SEQ ID NO: 990993 - protein, 364 aa, Homo sapiens
FTTKLKCCGDLIVLKTNTADSTGSQLTANKLLHTSQSLERGHWDHVTLHKKIHTNHSCLLHYLHNFTSLSNSTATNPTANTPLSMPPLYLIPATTAPAPPARHYLTLLLPARTHNAHYLPTRSAHPAHASHPTAPTPTPQPTSLRPLHPARTPRTPPTAHAHAHPPTALAPPPTRALSPQHTHYARIPPRPPTHAPALATTATPTPPRLTPAPAHRPQGLPQPGAAAPTPPLSPTACHPPPHPTPPRPSAPNPTSHLPPDGRLHTPPTRPRNPPQACIPPPGNPRNHPNPWHPQSQPPAAEPSHARPNPSPSTPPARPHQRPKPPPNLPTHPAPARAPTHLPHNTPVRHPPLMHPRPWLRAPFA

SEQ ID NO: 990994 - protein, 73 aa, Homo sapiens
GRVGRPTRRNRSGKTHLQIPAGYPANRWIPTTQGRKRGGDTLLPGEEDERPNKRKDWTPCRKVSGSRDTSICS

SEQ ID NO: 990995 - protein, 442 aa, Homo sapiens
MSESKSEPEICIRKFSRTWDAYGTNMGLTDALRTDCQYAQTKQRYRAYADKYQDIAEPGRTIIRKYHTYPEDNGIGNHTSTTTSLEWRQVLHTHKNTKEMTRHRGTSNTQKHIAAQSVETSQGTEESTIEDLRCPSHRAKDQGIIAQYRKFRSQRTSYEQKERDTNEEHNSRDPTNLTYREGANKKPIEIPDKSDNRRKGGSNGAKLHREHPTQERDQTNPSVASNKGEGTPDLIAEEPTKQGHRRSSVCDVLEHESQNINNPFDYPPGNPRTKGTMDKQSYANKVKLRTIPPRRKIRHNGTISRTTDTKGDKKNIENHKEHAPQKKHATEDDNNKKKTTRQIHKAKKQQKKPKTQNNAKYGTGSKKTIASTAGRGQHAKKRRKENEEEQVVRIEGEERNERESNRGDYTELGEATKGEQKHREAKKSEKEDTRGARQGRER

SEQ ID NO: 990996 - protein, 32 aa, Homo sapiens
MPHLPVDKSSRQPGCTSGTARRAQRAQHTAVT

SEQ ID NO: 990997 - protein, 128 aa, Homo sapiens
MHLLNLCDTIYLKFKSDIPLVDTTSTPRYAINTNEPTIWYCSSSWPTTMEPLVGPVEYWSSHLHQGTYAHRRSPKAETAPNEPFGPWKGAKLRESNDPAGLFITELILRSRETPLRPQYSSNTAHVNI

SEQ ID NO: 990998 - protein, 258 aa, Homo sapiens
THASRLTGTLTGGWRTGDSDLREDQRSESSKNHTTQSDAMSVGSGNLRGGRRVGKHKNSGALGKGEPKGEWLTVSELLKEGTQRKSSRAGAEKQPSLIKDFLKGKHERRMLFKAGPARHRCTSHTQASRRKWSRNKDHPAFAPLYFPMELDRKEALTKDMEYFCGENWEEQVQWPKAGQKYVERIHYIGHERAWSLTGGPCHTPAYVGDLSWGPGAEEVARSTETPQHREGTQFYLFENVDNARVEDKSTGRMNAWTE

SEQ ID NO: 990999 - protein, 71 aa, Homo sapiens
AAQAAAAEACGAGEQQPAVRARGAPHTPRPRASPELARHPRHWRGTMGQVPPGSGQSQKTHRVRGVLWDTV

SEQ ID NO: 991000 - protein, 414 aa, Homo sapiens
GNAEKGTGEKSRSSEMKSGKCFQSAPQTGARARYAGRIVSLSLSRTHTNTLLHAHTSFHDMEPTHADSYIVQGSTCLGTQSERRVELGANGDTKTKNIKKCDKTKTDTQHQSTDKAKTEKTRQQGSRDEKKRETERAPNAAASDEGKKAKEKKRNEKQRKQERRQQEANTNTENKADDHNQRPQSKNTHHTRKTRTTEQRPKQTRRRAAKKENTRQAGQTAESNRTETKHTKGSKEERRSDHQEQNRKRAKRTRENRGARSTEARGREQTKNKPSGARARKTKENGNSDKREQTEKRNGRDGEATTDQAHQAEQDEQETTGGAPEQRKERTKERRKQKTARRRRDKEKEKRKKKKRQRERETQQDRERRNETRARHQKDERESGGSETTRRKGEKQKKRKKQKGRQKRGEKTNK

SEQ ID NO: 991001 - protein, 136 aa, Homo sapiens
MRSVASCAPSCLGTTFTSPASTYSAQLSLMEIRGMRGHGLNAKRKSPRDIIGLSVNIHDIGRCVILDLIMLITKGCGYIDIAFSQPWLQVRCDSTDPISNSCGSEASLQLGCYSSLYNRYWGRTITYSPRDILRVP

SEQ ID NO: 991002 - protein, 390 aa, Homo sapiens
HASRTRGSNDVVRPTSCRSRDPLMGLVNGELQRLSWPGLQGHSWAHMQWLVGASWVRMCAEVRRTELMRDRETEGNMYAFVRFWARRLPYDCPDRNVPRLAPVWPATGHGWLSGHLECGWLRGWGLASNLSSIVYTRTPLFLQSPIPYATHGEPHGSPSSVVQPDQTTQNERSHPPDRYTRQRRRTSPRNLNSMHSRHHPTWQNGKQRPLTPHVNRQAPGEPHTPAQRSTTAGGPAQPARSSYPRNRTAQGPTTETGTGHGTDLNETQQNMTCLNRNTTTPDNNTQKTKKKAPEAAQRQQANKNANKNNEKKRNTQHTKPKQKGGQQRGRARDGDREDRDATREADDTRRTEPTRGKHTERDQGRERTPETGRRNKATRKEQETWSTYHT

SEQ ID NO: 991003 - protein, 187 aa, Homo sapiens
MAAGPPGYGWCGYEVWGGKRLVPGGDATGSPGARGPVTSSGGGGSVSGMPGIWSSRPEMKGLLGGLVTVNQQLLDPGQPGGIVTLHVQELIQVNLQFGDLLFRAVVKARELAPGSTPLGGGASVAPGGHTWRVTFPVGPHWGPHRPPRRGPSPAGHGGALNSRRVVLGRQCRPGAGDATPAPGCSVR

SEQ ID NO: 991004 - protein, 484 aa, Homo sapiens
GPQMAAAELRLPGEMRLGAEGLTWPPGARRAGGCSRDWCVPPLALLELGRTGVDRGGTAESTRPAPTMPAIVICEPVLLPGLHPGVQYEGGAHGRHWYCAVPMCCIVSVCITVRVPRQTLAVDSRQDDRSRSSVILQQQRITEVVAQGHPAQVVMGDQLRITRERTLMPHKSHAAAWRRARRKDARDTAQTHRNTVGKSVARRSEFLWHTRHTYNATKEHAGQSGTRRAASGYVYTPRAQLTNSEHTQRQTKRHSGAPQDARERTTQGGAETDARHSGRASTERAAERSPTHEKRAARAASAEASGPQKAQRAHTEQDAQKAHPLYTTYPSPPKHTIYNSKPSSFTTTPLTTHSTHQHNQNSYTIKLIKHNATPTAPQKRDTTATSEPRRTDEQPANERSITEHYAPNSTRRNIHSRRWRGTHNEHTASQRLANHTQVRSDITQTHDHLTTDPERGPTARSSADDAINRLIELNTRRDANRSPP

SEQ ID NO: 991005 - protein, 99 aa, Homo sapiens
MCVLQGVLQRRPNVGNPEAPHGVEHLVAAQMSAYGKFPTFQEQREVAVRGVTLPLQSWVVDTCSHGYQVGDNGPDLKRDDNSGGYHKQTNRLGYTPDKG

SEQ ID NO: 991006 - protein, 135 aa, Homo sapiens
MIRSWDPAATVPLGGVLTAVINPIRHLFPVKPRRLQQAVVNDTVRSQPEFSHCRASRNGSAPCGWCRPTEGPPHLWDTRLEIQQHPKKGGRLLADIRRARAANTVNPDWGAPTGNRPKGGGRAPQVGRRKKSTNL

SEQ ID NO: 991007 - protein, 196 aa, Homo sapiens
MEDKYKENRKKKRDQDKEEKGRKNTKRDNEQQRQEDMRHKRHRTKRHNTNKKGKTKTEKRKKKKNSTEKKKRKKRQNKEKQEGNRKETGTQRTKETKGTKKEETGKTNRKEKTRGKQIKEIAKEDKRKEDRAQKEEHKKRQGEKRHTAKKQSKKKEKRKQEYKRRGKTRERRKRRQQEEENKRKRTKDRKRRKRER

SEQ ID NO: 991008 - protein, 146 aa, Homo sapiens
MSYLEAHQHEGERALKGCRDPRSEAQGSQNSHSTRRRRSPAKDGDQGTHPCKMKEQRVSATACTRGGTRRGKRSTLHEGNTFVKGDRADTRWSGGGAYQNKQGRREARTTCWGEQTKQRHNNQLMKSTRSDRDSRDKKYKQTSTPH

SEQ ID NO: 991009 - protein, 155 aa, Homo sapiens
ERVGGRGWDQLGCFTIKSDVWSLESSYTRYVTYGKIPYPRVELMRDVMTACARATGCPGWRTGQMSSYDYYENVAGIEQAGMRGPRYDYLQSSLDDIYYEPRVRAIIQDERAVRAQGRPVHLAWCGCLIERGISEPSLVATYDFMCGDHLPVPGS

SEQ ID NO: 991010 - protein, 69 aa, Homo sapiens
ITSNVGAVRASSLTIYALEYSLSRSIRKLSKHLSVNRYIEAHVHGEIPDITLVKRLTVKRMKLRYVHHA

SEQ ID NO: 991011 - protein, 152 aa, Homo sapiens
MGHLGAHQERGKPTIQLTHFTLKFLETFGALPRALQKWAILSKNPTNPNTPGVTKSTLKGGKIFLKKFKNPPKNPFWVLLTRANVSTPFFTSYNRGRMPLGREPFTPAVKNIRAIDTPGSAKTQRREDPSTRSIHKRGGPHRGSGSTDIGPV

SEQ ID NO: 991012 - protein, 323 aa, Homo sapiens
VTRGGVPHVTVPRARPGLRVALRRCSCLHNGADGQRDCWCALAGVGRAASCGLPPKVAGAAGEVQWALARVIPGWWLLGAYHLLPVTSNGRRVPGCGREEVDGPSVAVGGQSGRKPRELPAGPALTPFATVKLQPKEGRDTVPIRWKARTSASTRVPASVHSNNNFVAREALGILNLSLTFPEFHFFLPREGPLQQVPPVKGAGNKHHSLHRLGKGTLDGGTPKVPSNKWQFHNAEAPHPRDLTLEAGICVKTPTTRGFIPNFEKYGMFQNYTTLLLRGQNRVKPPTLMPIPQSRRRVVPGDPPMSESCKEAVSGVPPVASDL

SEQ ID NO: 991013 - protein, 532 aa, Homo sapiens
TRGSTTRPKLRCNVRETTVRMWVFLAEWRGVLSIYLFPPHPPMGLYMEINYPTTNNPEQHTQARPHNTHTAQSIRQDSRRKQSNESGEQNTRYLSTRSTRSRAQRTQTTTEDNPETEHKERDKEKAPTHRGPTEDSGLQKQQKPAQPREMKRELRRQKGRTQSPKKRREQRQETEGKNTHTECKARAKPRAACWRSRATARTGREEEGAGRTAPVGRDGSRQGSRAEGRRETEARRQRGEKQSEMTGIAEPQRPRRARAAREIHKATEAERKRHDQAKPTTRRHKEAEDDQEEAERQSGKHARQGASGRRRRRRATNATSVTSTASGSGGVTHAEAEQHDASRPHVDETHGARSAMTGESTSVAGASKRPHKGTRTQGAHGNAVTHEELDRTHSERPPIQAKDMREDTRQEREEGRQTHERRRKHRLIVRTTRGSDDEKDNGRRDARQLRTTRKRTSRQDDNKHAKDQAMTDKEKRKIPPTGNNKRQRQTSETKEGQREDETIVEIRVEYGSDGILSDQIDEDRKRNSRQKR

SEQ ID NO: 991014 - protein, 436 aa, Homo sapiens
MVDTRQKENDGDRINDGEDEKFSTTSSAKVIDPLGAVDEVRSKQFAVERRMRREPRTCHAPVKDTTCVGKRSLEEGSLGGELCPESPGSRLGRCVCVWGAGQFTSIEHIRYGMKDSKDGGVGLGLGEIGAPKGPQGLYTVRPYTGGEPPSKVSPRVTTKGKFQPSFGTKNRGVWKQAHQTVSHLRAHNTIELPPKEIPTANPNIRAHNMRAQRKIYTGERPKAKNPGTRHQRPLWNNLCRNDNVLVTTIGQPYPPQAKSEPRLERTPRDINETRGRDNDPHLGKHHDCDAYRANKRDAPSTTRRRTPHTQKRDKPAQASRAVPPRSAARGPTRETTCHVSLPTKRQHTGSQNKGEPLTHRPRRVPPHTDVRTNTAQHKNRADREQNAGEDDQRRQTGQDRPKHEPEKLSKTATSATNPDKHDQTEQSEHAPTDPTT

SEQ ID NO: 991015 - protein, 137 aa, Homo sapiens
RQGLTVLPRLECIGANMAHCSLNLPGSSNLPTLASQVAGSTGACHHTWLIFFLFFERQGLTVLSGLVSNSWAQAILLPQPPRMLGLKARATEPSLDLIFFNDFMLFHHIDILYFLPIPILMDICFWLFSFLILQTKL

SEQ ID NO: 991016 - protein, 79 aa, Homo sapiens
LTRRTRESQTDLRLEETRETAQVEKGINVEEIINLDFWKPKKETKKWFYARKTEEVTALRTASKTHVRYTVAGKVQSER

SEQ ID NO: 991017 - protein, 113 aa, Homo sapiens
METNQSVGGACVIETMWLKAPWYLYRMVYGPNGCDVTVHYITSNRPTGFSRTDRLAHASHYKRHRVAGKRYYTNKLALHCSEDPYGQHDIYMPSHICPRHERVGQDSATRFIG

SEQ ID NO: 991018 - protein, 392 aa, Homo sapiens
MKRTVSPPQTTAASCEDKKEFLCAGIQAACLSSSLRMELCSMTAVGRSSDRGSDCYASAPNADTVCVQQCQHLWGRRYCCVRRPEKAGYCACRSWLANRALAARMPMTSTRCLMLSDNCYPALRTSDQGADDLCRLATYGNSHDDGDNDLPLALKALYVTGPDTSPDENDDVRTAVYHRDIPHIGVYSSRAVPRVTETCSGIDSLVGVSIDQRLGAVSILEPTLASLGRPSVTNRMQLTNHEFAPSIPSYTKRNRGEKDLDHEGGEVKFKDLKGLKIAAEGLEQGIGYDGKVILDRVGDEMREKMGQIKGKRRRRQIQGMYEETRHGVAQRGRTTGRRDHTKEKTRKAKKNKEEKRGTDKKRKREKEKKRRTTEKKNKKKEKKKKKRTKTTM

SEQ ID NO: 991019 - protein, 103 aa, Homo sapiens
MGPISAILKWILLNDPTRYSESKRAVHQYFVDETDFYKGFSTDTIAEEKAPSNNSKTIHASREVNFHSTMIYHSIQNFLPCLEIGQAKSEHFIINDNSVIYPR

SEQ ID NO: 991020 - protein, 99 aa, Homo sapiens
MTRHQEYQSPEVTHSLIENKPKNQHNSQHCLCTSVRGLYCTLLQASEYFESPFTMFRRHLRLNHLCSHRLPRIFIVIIGSASSLSASSGTNISLYIQHQ

SEQ ID NO: 991021 - protein, 181 aa, Homo sapiens
MCRARRAMGVVLAPQPRARSSSRDGDLATSCVLYWRWRALRPVGRLAGRVATFVSVARRNGRGLSCTRTRTLGRCTYVLLKWLSRLWIARAPTLWGGDPRVPPSLFPYPRVGRRRVGLRGGRLRRVGLLGVPLEGGRNSFCNPRRGKRGYWSKPQILSGQRGPQTNLVVRLLASSQGHGCS

SEQ ID NO: 991022 - protein, 109 aa, Homo sapiens
RDAWAPATQGVVNIDPNSSKWELKRLHITSLSVIGAQYDLRVKVQPHTCDRIMSLLNAECAFDQYRTIEDEFVEGGCLYIGHKGSFKICHGSLTIKLTTLSVNSRIITS

SEQ ID NO: 991023 - protein, 206 aa, Homo sapiens
GRVGRPTRPERRISSAGIVLGPLAPPPPPPRPTRACTGFSSPPSSIQGTHYREHLDQESRVAVSMAPSRRNSLIGSRARHTYQTLTETSTTKKMETQLAQSKQRKNTKNRCKRTHKQRQTNRKKKTHPTERKQNYRQNRSNKTEQQHRGDKKAQEKEGTRKENKSRENNENKRDKAEQEDKALHRTGEGGRRKTQQKEQQNKGSTT

SEQ ID NO: 991024 - protein, 300 aa, Homo sapiens
MDKFERGKAACNEDEEDEDHAVSGSTECTEQRLRTLLVIAVVMSPPECSQHQRRQHFLERLLSTTMLAKARRCSALSVVPAAADAGRKIYLCNPMEHLLSSYESRTQDYPYALKPELQASANYFAPSSLPLRNASRTHALNCMTPEISQGAKDPRDSPPLPYTQRLPQAYPLRAQQCPLTYLVAARHLNRAPREDTRGSIQLEAVNGHKPPRHKETAELQPGEDWTRVVTSTLATPNNPHHKNTSPIPIPNPPLHLPAIPQSANTPPPPPHSTHTIQPTHTYTLIPQQPPISTSPPTHLD

SEQ ID NO: 991025 - protein, 213 aa, Homo sapiens
GCYYYTISNKSTHRYIIVLWNMTLSVLSTTLSDLHSACFYYWLYQDAYWQLAHLLTFQPVHHQAHYNHFLRDCAYCFQPSINLCTHFPHTLCPLHHEPPHTPPAPTTHPPHPAPHPPFSPTTSSLPLLHLSPRDICTATPTPCAHPPLTSPYATPGHPRHAPPTPNSLHTSTALNCPARAPPTRAPRAYHHRTTSYSTKLPFALAQPTLSNTP

SEQ ID NO: 991026 - protein, 261 aa, Homo sapiens
GRVGRATRPGRTIGIVMDSGDGATHTVPIYEGYALPQAILRLDLGGRDLTDYLMKILTDEAYRLSATTAEREIVRDIKGEAVAYVALLSFLSREMALRSDPPLLCGECATMLPDGQVITIGKVRRFRLSGGQLFQPSFLGYGILYAFHDDQLPLSITEVLTVDQSAKDPCIANWRCCRGEYPPKYPGIAERGMQNGDRRLAPSSMRDSRIISDPQSASTQGESGGLHSGPHGPPFQKMLGLAKPEKYEEVGPLPSFSANDF

SEQ ID NO: 991027 - protein, 94 aa, Homo sapiens
GNIVHIHAAQCGKQIGAQVLERVISDEHGNRHPPITVPRETSDLQARYQNPLVYYNEKATWLAKYASFVPILWMRYYETCANNGHCVYDSRVTF

SEQ ID NO: 991028 - protein, 199 aa, Homo sapiens
MALQNQHTNRIPHRSGRGLLDDVEQQVNQGPTQQAIHSGNSEHIGPYQTDWGITFSLVDPASIICVCILSEKNICLEAFINNTQDHRHSRTHLPSIEEDQPDHLYLGHQRTQYQVSSIVKILSYLKTASQLYHIRNFHGDNRIGPSEDISQLGSLSYEIDKYSKCRRIQSRKLSDVDYTKFISMCAHQLFSSSYIHELP

SEQ ID NO: 991029 - protein, 276 aa, Homo sapiens
MLHACMLPAACGYVVLSAWSLAGRVDYPCCQDYSTWQLCEAEAPSRPFLRTVSCPRLRARLARRASGEVPTWCRCRRCVLVPGTAAIRRVPRGRVPTPGCPEPERQNYYAIGGHPACCMRRKPIAKSYEHCPLHEVTPQDLCIVPSHDSEDPDKRGTLKAGGGPARGNTRPLRNAQRKQREPHTESPGPPKIEQTLPAETPHDRGCVKPPKPSKGDTHGGTAKTSRTRTPAEEHRRRQTNTTTSNVRHKSKTRATQQHDQLTQHNLARGDEHTAHT

SEQ ID NO: 991030 - protein, 119 aa, Homo sapiens
MTECNVAATSTHTDDTLREHTRRQPNEEKANRQRYKQTQQTHKPVDGATHTHTDGGRKNTHALTPDTAPHSQQITQQLDRREQITHNTTSMQQHQPRQNIEYETVHTTIHHTQHRTDQY

SEQ ID NO: 991031 - protein, 365 aa, Homo sapiens
PRRPQERAGLSRWVRPVPGMTDDIISSSSLDVASPRLERALVLQPWRCGPPEAKEACVGGVTVSAEVEASWLKAWMRVKAEGSRSESGVTGYALRAYSRDDTHDRHGCMLTCGDSDYVMPLATGKFSRKNAISDERVGSRLYDIESTMAGLDILYALTLVDKTSRGDEYSSTLSEEVRGEVASMRPYGKGPPTRGNDEISSSLQNAPRKHFDHEFISTHRLFGSGKVQFVLVNEFSYIVSQWGCAIGKIGGRGNRRADAAFAVIAENRGQGAWRWRTGKQDLQWAEVPPLGVPPYGDKGSLCRGKTWWNCCKGNLSLVLSAIRAPWIQNGRGGRNKHKRNYTEERVWGTQGVSFGVAIHTPNSSQ

SEQ ID NO: 991032 - protein, 121 aa, Homo sapiens
MQSLARCQIRLVDYFERGEPIQIGACRYAGVLDHIQWCWTGHHVRMDEPLPNVRALQTIRHRGADILTAQGELTHTNPLSSGMLTWRRWDSCVLVEAHIALGVAYILPCTPQSSGTEHSSN

SEQ ID NO: 991033 - protein, 153 aa, Homo sapiens
MCLKKKMWTTSVTQKKLNQTLCSKTGYLGVQTQIGPHTVEHPENREGERQRKHNKSRRSTVENQLTTGEKTSHVQKWGCPHISRQASGAEPQRDTKYVTDNATQLGSYRGKNMPQHDPHSIFCGGPQKRVLTAGPTTLWDKTTCNTGAHSNST

SEQ ID NO: 991034 - protein, 430 aa, Homo sapiens
GRVGRPTRSQASAGNGAYMLVLLQQLKPVASLMPKKKKKGAAAHFFVLLYFVPRRRAFFFYSKLRGKLGTQSRGAPQRRAEQDLEGNPLSPKEKQRGKGGVARINAVRGVEYAGRRGAQHRGTQESKRGEKERPRTTITGGDHVGEMNADPPTDLSKMRPKPPVIPPKKRSNLRGRKANQGAQKQRGTATKEEIRTSIEADGEQTRPPYGGTLPDNQREHMGTTKITDQPLARQRREEGKNKRAKRWAKPKETLEGANRRETKAGGDTRTREHPKNTRDEKTGEPQVDTTRRETGITRGAKHRQRRGRKTPPRPPSEEAAQGAACRAQQGSKETRKYTHNDKRDTNARGDKGDGATGKKERATPTAMDRGAQHRGTSKSTVQTPRVTNARNGDPNGTSCKRGTKDKAERRRTERQKKTQRDKKGDDGAAV

SEQ ID NO: 991035 - protein, 117 aa, Homo sapiens
DILLKSGGRRSGNGNKPPSTDLKTCDKKNTNKCSLELRTLSCLPTPEAEPEGDNGRGSEQGRNSQRGLAGFKVDGQSSNAGSKTAATQGKQPATGTQKGKEQQERAERGAGNGIGEK

SEQ ID NO: 991036 - protein, 219 aa, Homo sapiens
MPLHSSLGNRVRLRLKQKTKKIQGKRRSGSLAAARDLGARSGQEPFRIGNAGPRATIPHPPDIPGQNSVKGHKSTTQGSLLGARQRDPTGPITITTPLNKRDTTGENHWHQEPHNPATLTNPITKQNTTPGRHTTQQPSEQWLTRTPPRPAAAQLQGARAPTTSATTNYTQRETAPQQPTPPPKQQQHSEEDNNKGSKDRTNTPPTRHTANTRQRRAKY

SEQ ID NO: 991037 - protein, 51 aa, Homo sapiens
MMTMVVSLNHSRGQCGDKKEKITIVTVSVSKEVDIGDSILFGTKKNSSAWD

SEQ ID NO: 991038 - protein, 485 aa, Homo sapiens
GNNREGERWDEGGLQRVVYLCIAGSFQQRTLGRKAYPREPYRYAPTRCGVAFLGVTALTYFPKEEKEVKLYLLTPTRLGIASTGSLGAPACYRLARVGDGEGRRPERKAQKKRRTMSDGKWNTRVTRTQQQTTKADRKKHNSTRNNRRTTNNDNTEGYTDDSDIEDKRSQKEQATTHRQPRKHDRKRRKQQHQYTKRGERSREEKEKGEGDTETPHQKKEQHDRKHNIKRRETDARKTTEGQRRTRIREDGRRAHEHKQDNNKRRRREKNEERTKNKKGTTNRESRKRERHSNEQKKAKAQKRTTGEEREADETGKQNTQNQGREQQAEEDGVNEENKKQHSEDRKKTKARAGEQAEEEVADSAQRTEERESRKDYNGKTNRQEKANEKTDEDAEMMNDEADKGQTKSESENNEEEREHKKTENKERRLQKGRRRDRTTGKKRVRDTTQEDEEMKETKRRKVKRSKRREEQDRGSGEIDKTGQAA

SEQ ID NO: 991039 - protein, 30 aa, Homo sapiens
DAGSTHASGPTRPHHYNLPRNYQVIKALTP

SEQ ID NO: 991040 - protein, 152 aa, Homo sapiens
GGSAAAKLARHAPRPLQRPGLPARTVQTAVPCGSRVLLSPCPTRGPAAFHWPCCSYLDAKDAGLLTVSAEMVTVAGACHRARIKPSDFSATSVAQRLTTSSSLHIYTWVSGSVTSFALLENTHSSVAHCIASDTYGIMRLRPYALPVTHRER

SEQ ID NO: 991041 - protein, 192 aa, Homo sapiens
MAYYYTFRTPLYTPRQAEPIRAHPTRYRSKKVPRRIYHHEELRSRTRQYGLSTATGLRGPSSPVPQISRPSFLYATDTAITIAQGASKRQTDQRHPDTAHQRHLNNTNLLHMIYPHRTINSGLYLPAPDTKELHHLTLCHLSTDVSGLTQIQNSAAHIGTTYHSSPPSSSLTPGLTNKSADYNTNYNHLHDP

SEQ ID NO: 991042 - protein, 312 aa, Homo sapiens
RHRPLQLTSVRDSPFPMQSPCCQAPLLIALGLLLGGPAQAHLKKPSQLSSLFRGETCDEGEGPCRVIMKPDSGACPIVVPGNVILSVVGRTSVPLSAPLKVDSRLRRRRWLGSGINDPMQTTTLGDVTFEHCFDVLDMLIPTGEPCPEPLRTYGLSLPLSLQEKEPTHCPKERIQLCLTWSWPVGLTTGSYRIESVLSRSGKRLGCIKMLLSRGHITWPLHRMNGASDGGPSLWLCRRQISTLCALNPLTVVQPTKWGHTLRGQTLQGMVQLERAGEQTRKPKRYTTGQEPKSHHGNKKAPSRTNKRAAPTA

SEQ ID NO: 991043 - protein, 211 aa, Homo sapiens
GSKSLRGVPPRQARQPEHAMLTPNKGSMFLFPGGPGAALPSVPPLPSHQTHPATELCVRDLIAVIARRALGSPQNGRGHRICVPHKDPSERLKKLGSRTTGIGAVFPPCCSARHAATLPARTTTHDTMSREDKRQGTGPPTKRGQNIGPDYVKPTGKTHETHPAYPASTVPSLTSSPRTKASSAIKGDKERTPGQKTGDKPDTQKHPSRHR

SEQ ID NO: 991044 - protein, 175 aa, Homo sapiens
MEPGPDGPAASATAAIREGWYPLKTLQPQWTRTRALISIDKCRSTNSIPANGRYALTQDIPTSFRSNDLIGNVLGSRTGVIQLQRTERPSTPYQDDDLPNLPLCQTTSQNTSERVLSHPGSGQMEVSMTRTAREKTSPYQKAVRGYTVEGSTEGTRQYQSSSTGNVHLATSNVPI

SEQ ID NO: 991045 - protein, 180 aa, Homo sapiens
MVEHKKKWEGHNKFKTKNTNNTTKKNKKNKKKEERNKREEEHQSREKEGRQEKEERKGAPERNRKSRKERGGERKKRQPTGGEETHARKEETEGKKEANKEKRKKAEERRERATDRGQGDRETEARQKETKQKNEGRDKRKDERERRRKQRKTRRKKKKQKGQHKKTTEGKRKTRKRKKQ

SEQ ID NO: 991046 - protein, 246 aa, Homo sapiens
TNLRSGTWYDDWAMEVMHNGTTILDEYCGTIWTCLKAVCHGVAWYGVEDGTLHFSCQLAMTHGPCLPGTVPTEDVLLLIRSSHLMEQDGPQGKPSVGTDSWHEWHHQFPGHTTYPLRAAQQTTGLLIPTLPTQITHFHVEAHGRGYPLNTLDGLYTNTMEEETPDNVNPGQTFTIQTLKHAGERPQDRPSTTPLQTTPTQQPGVRHNVAHDYRKDGQTCSQDPEYKLSSPIDPREAQPLDDDESRE

SEQ ID NO: 991047 - protein, 228 aa, Homo sapiens
AQRARTPPLSRRKAVDMRLRDGVGCSMKRWGRCPHLTLAPDSPALYFTHDASLVHISLQYPFGAVAAQKFMPGPTPMLCHQLVTRLAYDDHVAPGSLVGYVTTKSSIAYGLGEVPPPCLRSGQEVAGCCTEQYPVQFAAVSRDTLRCAAGELVLLLLPWLYALEQLAQLPSSWGPTAWAPLRPMGPPSEPPFAYNVPLGLLRPCVSLLSLFLCSFNVPVSRRWEFKAQ

SEQ ID NO: 991048 - protein, 199 aa, Homo sapiens
MESVAAAAAGPAAAAAAAAATTSLRAPRRCRTDAPTMPLIPARSHALPRPTLVRPSRRHVPGRRAVIVVLADLAARSFQRPSARARRACELPTPARPSEPTSASSSPGKYRCQATCRRRPGVRGGMLPSEATRTPGDRSNPARVRQIDSLLPKNCNLRMWPHVRRRAAHLAKRKPCSDLTRGRRRLQAAKAKRPGKYAK

SEQ ID NO: 991049 - protein, 128 aa, Homo sapiens
KLINHSFIDLPTPIQASPHDDTSAHSLDALPDPPRSTTGLLPESMHYSARRLIRSFHRIGPHHSRRKLWLNHPLTFSANGASIFFICLFLHIGRGLYSRIISLLRNLKHRIILLLATIATAFIGYVLP

SEQ ID NO: 991050 - protein, 125 aa, Homo sapiens
MKYIPARICHNAYDVPRSTYLCFNRNATAEVSHNVLRIQTSPHVKQVLLSPGPDECIEPHICTAHQRYLSFNYSHKLGRIRHITPCKRIEHATVQLPELRRRIDLNGHSLYIDNAVCCLSFYEMQ

SEQ ID NO: 991051 - protein, 206 aa, Homo sapiens
MADIPTRPLGTPTNNQAKALNQNRCLGTSFRTRGITTEYHYIYTFPIGREVPRSSTLTTNKLAKLRSKKIYRLGARSEPPQGKNDNNKPYHSNTHTDKTAVTAFTNDDVGEPITVSNGARYNNNIFPPASTPPRDKLHLFYLSTARTKSLESRQSKTPNNRTYHESNTYLPDSRKNQASQLHYTFVRFYILHTLLTSSRRLFYDPI

SEQ ID NO: 991052 - protein, 156 aa, Homo sapiens
KNFPNAIDAHPAVGSGGVLNGLFTQPAENVKQYLTDPKICGAEHCVLAEHSDPMEVLEAVQPQTWCCRRPQTWDWLRDLGHMTTHMEHPVHRTTIRTSMHDTQYPIHDQLNKASRSAMYHGHGAPKRMIHTPRHHLHVNNHPCTLALMMNGMTAQP

SEQ ID NO: 991053 - protein, 273 aa, Homo sapiens
MADAGVRRVVPIDLLPLVLGFLRDETNLVIVLANKVRHSDRSYQQDANASSLLDIYRLLAQQVCHCSQSETITVLIWIHVVKEMLRTRPSSSVTAECTRSCRPAAHGQLPHGALPANTYTCLLSPCAMLTSGSSPSLCATACLALIGHSTHQTLGQLLSLDKQVTHTYQLSLHLKCNRHRYPTHTQHTHAHYAHHTNAGTFNTAPHIHPNTQATYPKQTISIPITLTTGHKNNPSHHLHLAPIHRPYIKYSPSTRQFQYPNHITPTPNKLPKT

SEQ ID NO: 991054 - protein, 63 aa, Homo sapiens
MKHTFRHGDQRTQTVHGATATETFLQQWPSRRLAHQGRKPQTLARPSARITDPDFNQRHPRRA

SEQ ID NO: 991055 - protein, 250 aa, Homo sapiens
MLSYRATYHLLGAHRSSCRFSESQGELYKLQGQMRTPIACVPHMFVTFIDITKQWVYNQQMWTRLWSPPTLQNLEGDSTRAFRLRKECLRSPGARRAPRARWPPKVAKMYRVLTSGARRRAQEHAHTRGPHVHGNRPTPNDSTSTEEQRSAGERHAQRARKTRAATPAPADQASRAARAPKKRTAGGRKKDRETPHRHDAQHERRQSTRSRTPPSAWHDIRGRGTQGGTSHSPTPHAAPPDARRPARVAD

SEQ ID NO: 991056 - protein, 262 aa, Homo sapiens
MWTGLIGPPISRVERVAVCTGATSVVIDRRLAPACGAPGKNSCVPRKGPPKPQREAGPQPLSPHSVWVFSTTVPQTQPGGEAQGEGTKGGLPTIPQGNGNNIGKAPFNHPLVEQEATRKTGGDPYPPARGNPKRIQKEMGGTTTGARYENRRKNREGDQGPRKASTTVRRPPGPKRQDRSHRGTGAPKETQRGHALPPKHSHSHHHHPPRRIARPPHERQNHYAQNHMAHEVRPPQRPRPLKTPGEKRATKKGAVPHTTTEV

SEQ ID NO: 991057 - protein, 179 aa, Homo sapiens
MDLYPLNKVDWQSPTGHSIQGETQLFTEEQVELLYYLNSSLTNVSLRFNSHAQQAETKNKSSTDICAKERHIIPQTGDTETEEGTSPRHLEAVHNNSNTEHQKRPFTEKSKDTPNNQATNIHNHNAKTYPTPIHNEDNKEIQHTNKEVKNTPTKRRTKKQNNLYEYDDNETEEKRKLRK

SEQ ID NO: 991058 - protein, 353 aa, Homo sapiens
EPEKPRRCAFCPRAHLRDSRFRIQSEGVTLVTHAGVVTQWRQEHVVLAAQPVEPTRRNGQEVLGRPHEAVIATRISKLRFKEKLGEGQFRGGAPDVRSTALKIWISLEYYHHLMCVTGHPLTGAVKILRTDATKNARNDFLKEVKIMSRLKEPKHHTDMLGECDAGRTPLCMITDIHGERRHQTVPQMPNQDWKDKDKTEEGTPGAQRARLQTRAPNIRHNQLLDALWTRHQIAIEHARTGHQHTQSNIERHRTSRESAHKGQKTNNQEREHGQTHETNKHGEKNQTQERDKGHAHSRGKATSKRDPPNGEHDGGHRPEATKGRGNGDVHGIERNAMWKNEKKIERREEEEDE

SEQ ID NO: 991059 - protein, 105 aa, Homo sapiens
HKEKVEVVEAGVAGSVRLIGVSWALCGSRCPLLISTAKGREAATVVSREPRHVRCYGVQDDLQGHIRERCFVKTMLDGWSEHIKYVSASMLPRAWQRLARSGHYV

SEQ ID NO: 991060 - protein, 133 aa, Homo sapiens
GRVGPDAWVDPRVADIEDRHMVVSSMSGLFIQDEGDDVWLKQEEHITVLHRLLVVGVYNFTPYFPEEQKPVARSMSGELAIILVGQPRPPAAVKPLCQGKSQLASADERPALPCIDRRPPGPKHPQMDRLPQT

SEQ ID NO: 991061 - protein, 460 aa, Homo sapiens
ASGRPFFFLLVPGYLCRFLYILFLIFYLREEGFLNLYYGPEACEVCKGVPLLGFQCKASCLSRGINHQFPPVPSSLPAKIAWEHTGVPRTPQQRGKYFVRIYFKHKEAGVITARCYTTEDGLLELLAENPRRTASQHSAESSPKRVAWTIVRGCVCHAHSVTTHRAPYNVCVNHLYKCGRYTVCVNSDGIEKHYSTYLPRKKEERVVIKNKKTKTTHNQRITQSGTPEEDTPRYSEKKMLYRHTDDQQTQTIAERTQPPKTQNKSMFTIQQKDVGHHDKTKLISLKTSLQLLRRQRKKRCLHTTSHIDAPPPPTQRETGAVDPTSSLNHRHSTSAPRKQQRWLPRGIPHTTNKKQPSSTYKDNTTKSMLLVEHNSGMQAERNTKQRGDNPRIIHPNSEVHQRGRHKCRTTQMQKQHRPPFSMRWGTTTQSPSIGEHKLLCSRQTTSTSTIQMQNTPPPHL

SEQ ID NO: 991062 - protein, 369 aa, Homo sapiens
PSHFINLKVDDGGLYVWALVPMQSHSQYSPHHPLHDKPKWIIQIDNPHKCARTRVYINIRNRETVAAKEMTKMQGEPTQTPPVPPVDTTATPQRRTQHNTPYNQEALGQQSDPIRDGTTDRNRNGPRTDRSTTATPHTSRPRRYRGKKTHPLSSPQTSHKITTVQTLSQTLHHNKLAKEPRHGNIEPTTTAPYSNTLNAPTPAHRYTTNRSQKSTRTETAATILKRTQCDNTHHHHLAYSCPKPTLRKPTHAPHRTQPDPHPHSAPPQRARTDCEPRQAQHSDTTTMRQPVRRRPPYAGTSAVEETTAQTTRDTQPPPRGGHGTDAATARTPRRHTAMTADDEAACPVPANPHQRDSDAHASNRHARPN

SEQ ID NO: 991063 - protein, 257 aa, Homo sapiens
GRVGRPTRPGSGIERIGPLSLYHMASSIERMGQTMVAHWLWCGAHGCRMGFGLVSAWPFPSYRVGQTIERMGSGVVAIGPRAIERMGLSMERIGARRGMGVVSLERMGPVMVSDGHRPGAAWAPTYLQRMGLELHGRQQARAAWCLERMGAITASSAWAPVHGPRTLGAGIERMGLAMGGGGRCRRLTVPVEMERGTFGGSFQVLWVELERHAPGVGHERLQIFVRNLPIRFHMEDAKGTNSRVGGTVLYADIKIEK

SEQ ID NO: 991064 - protein, 217 aa, Homo sapiens
MDNIIIELTTRVAPTIIVSSQTGYLQEGGNTTHMMFLTLPHVFNVTTGLWDLGQRRTNDVSPVIDHKRRCCSTGYSRNIVKPYTIIHDTLSSRKENNPHWLGAEVPTGDHTLGASLSQTSVAPVSYANEHCFWNTERQTTKRKSVVKQDKLGINIHVDASKRLTGQARPLEKLAYGVPRGDPPMGIALIVVATTAQGTTIISEDERVVLSNHYGWLV

SEQ ID NO: 991065 - protein, 137 aa, Homo sapiens
MRQRCTALVAAAGNQMRCSMLGWAVAWIRYRAVCHEMLAQTARALRPYTPMKWRNLVLPVAHRKWAPLKSDTRPVVQRKLCKSGQRSLSPPETRNSVTVFDFSHASIIELCVSYRLVRKSPTQMKTACSVCDGSTRV

SEQ ID NO: 991066 - protein, 104 aa, Homo sapiens
SGSMTILFLLFWGHGLALLSRLEYSGVIMAHCSLQLPGSGDLPPQPPEQLGLQAYTTKPSQFLKSFVEMGSHYVSQAGLKLLDSNSWTQVIFLPWPPKVLGLQA

SEQ ID NO: 991067 - protein, 44 aa, Homo sapiens
TAQPWHLNGRKNGQCGKAKGSSDLGPDGACSSGDGTGARKIRLS

SEQ ID NO: 991068 - protein, 253 aa, Homo sapiens
MCGARLLGSGRLWQDASRSRTRTTKEVCAGKIVPKSLLLKPHQREKMSMEKYPIHRSPRPTSDVVGFRGFFEDDDFGVVVWELCRPEVSPGAVQRWTDSPVTEPEARYYRTGNVLGCMYRAPNPSYSSRPQAGQLFLNEELEVNIGDLTVDKVELTGKRAGGGPLIPRHRGLSRRAGSGGGGARGIQGSVGGTALGIGKGHAAQRRRSGNGRPNREKTGPKRGDTQTRLQNTIKRPTRMGERKKRATVLLAQL

SEQ ID NO: 991069 - protein, 55 aa, Homo sapiens
MTSYLIIYLMLEDTLRMRYSTYTYSQQDKEARAGKQRQDLKVKERDYTEQRYKYT

SEQ ID NO: 991070 - protein, 41 aa, Homo sapiens
EDSVTRGREDTRADEYYEYKHVKAKRRLLEVLISKQDPAVS

SEQ ID NO: 991071 - protein, 145 aa, Homo sapiens
MPGSFSYQWLVFIVSTESSWGVRGPLTSRASCLCTDWGVLSVPSRLPSAIWFVIPAASASSGTLPLAKECSLPMRTSWSLSLSSLGHVFRTLVPAALMVQAWLRTAQRGSFSVADAQRTCAQYVMLAQTLVLLCQEVLPGPPGII

SEQ ID NO: 991072 - protein, 297 aa, Homo sapiens
MRATGLCSTSALRDRLLDLSLATEDLTLPTPGGRPLSQPSSHLPSPLLCLCTPGGTPLWRGDCAWENLARHIAGDSPRTRKRPLPQLHPCVRDGRGSPHIMHPGALTVCGKPRASTTTPRHNKIKESCAHTFTALHKNNKKQNQKKKKKKKKEKKDDSAERKKGSETTAARRSEEEEHTAGEGRAAESRQRDKSEHTEHEDDKQKRERSEQRRGRGRRSESSAGRGPPQRQSERAGGGAAGRGGGARGGRARRSQPGGRVAGRSRGGADSRARGGGRNERAGSAGGREGRGTGGAGG

SEQ ID NO: 991073 - protein, 39 aa, Homo sapiens
LGPYSAMRREALIGEVVRGRGSLSAWTQHKTQHGQPRSQ

SEQ ID NO: 991074 - protein, 136 aa, Homo sapiens
MAPTTTKQTQGTLRQTAVLRHKQTGNKQTRNRNNRRQKKEQSRRLGTATRTKQQTKRQATEERAQTTEAAERIRQRIRTGEQNTEQDTTKSKQTTAARTARRSDNAKHKKKSKRETEEPMKREKRKRTKKNSGTVT

SEQ ID NO: 991075 - protein, 226 aa, Homo sapiens
MRFSGESCNITGAFDAWRLQLASAIHCNSLHTCCREHGQTRRFVSTDEAIYGETLVTFFHDSPRNDVSTTLHLNVALKLQRLVVPNDTISDLKRKHDLQSARVLIEVHRLHCQDPDARSTFVTSDSHWTMRKLMTLTIRVAPIDENLRLCEDASHDYGTMKGDPSVSSSHRGRQTIRTVRAPDKAVKFLFYQTGVIISSSQRPQERGGVVTTPPINLFEQNLLTTN

SEQ ID NO: 991076 - protein, 45 aa, Homo sapiens
DLTTRLQAKWGYRVGLFTVNVSKGREAEVDLLVVRRIIRVLQPRS

SEQ ID NO: 991077 - protein, 134 aa, Homo sapiens
MSQPTETAGSLILHGHSLANRACAPNTRTRRTPLVHPGFPVHLRHPGGQERSKQTRKQQEPEQPHQPPASNHNQHNEATDTQHTNRRDENTEQQQQRTGEHTPRDRHDSATSITTDQGGGDTGHTPVRKGPQTR

SEQ ID NO: 991078 - protein, 134 aa, Homo sapiens
MPSSCLNCKEAFLPLLLILLSTDPLRVSGWGTVRSFPSHEAIFQTITWGETLDNTWLSKAEVPAVFRSVCVPGYLRLGSGDDSQGSMLPSSICLTKHILHRLNPFNPELTQHMSQEARGKVTDLTASQGQKNFS

SEQ ID NO: 991079 - protein, 44 aa, Homo sapiens
HLTTRLDLTTRLKHPYVFSINFCSFWNGKHAQSVHSSAIASSRV

SEQ ID NO: 991080 - protein, 121 aa, Homo sapiens
MISCLVPYPHRSRHWRNWCPIAVFSHISSFASSLFLCLPRSHHSHTLTVLTTVSCRGPPNLLSIFHTHPMVHPFPHGVPRCPFSTYCTAYLSPISCFFTSPFLRHGGWPLPPFDSLPRGSL

SEQ ID NO: 991081 - protein, 80 aa, Homo sapiens
MAAMAENGLSSADILETGDFCAICNEDDGLMIRLFQAAVILRVHPSLWHSCSSLQILLMSSEPDSSAISPPTDPCALSDR

SEQ ID NO: 991082 - protein, 354 aa, Homo sapiens
PQSRQRGVIRPPQKGGGGGAPKHRGGGGPPGGDPENRGGRPRGGAETEEGGVCPPHKWGADKWRKHGVSETPAGRMKRPRHTRPQSHHNATVGREEPDYAATRSIVAATRDRSEKKRHATGFGGAHEHKATKTGGARKNTHCAPREINRAGATHRVAQHPTGRGRDSQKNKPRLERGEARRTMRLYTNQRTTLAGYGQNKSKRISPRPRADTTTAHAGLAQKDIIGPHSEPRVGDRSRPRQERDQHQNLVIYREPRYETHKRSSAGDNNNKLTRPEQDIYTLRRKLDDPGLPELVEVTQYTEGRDLTDKGIAESLHRLLDSTDMKVVDMRRRSESTSCTATCNWTTSEHNSEQR

SEQ ID NO: 991083 - protein, 275 aa, Homo sapiens
MPIHDVNIILEQLWAEDSFDESNFLEIDNSDVLFRNNSVFIFFHIEQLSQIGLSLKAERVHVNYRWHIFFFLNQAQRVIDGSITVAVHWSSLKRDAGLKELTYIFSSKYIPNKCMASRDGTLNLNMSGNWVTPHHRFLHELGCKGHIAESSTATPASTRNPNTGTPVRTDFGTTSRVRRRPRHVQPRQTGPHAALRIAPAGPLVTTNLWAIRHQRERATPTTRPDRHTRAHTSAPHTTPPLSRPQLSRIRRTPLRSAPAPDHPPHHHHAVIEVVL

SEQ ID NO: 991084 - protein, 106 aa, Homo sapiens
MPDTMRTHYHDDSRQWHEGSDPMMKYAPPGTQPPSLEDYNWIKRFGAGTNNPAPYEELTTLGYVLCESKSRDASLSRAHGIVHRAKLAGLSLSSCCARDADFVLEN

SEQ ID NO: 991085 - protein, 116 aa, Homo sapiens
MPWLIFGIFKVRRRGFHRGYAGMVSISLTWVIRPASASQSIGDYPGGATGPGLQINLSFFSFFSETESRSGGPGLELQGHGSRLTGTLRPPGVQAILRPQFPGVAGDYGGPPPGPG

SEQ ID NO: 991086 - protein, 211 aa, Homo sapiens
MRDRQNIGSQVLVIRGPKRGNFQLSTVGHSPMAEHIVLHRDPQNASGQPPHHLGNGLTRGEPRDRTTGQRAVPTGTNAPNTESVSRQGQTMPLSGPPREINDHEDTPNKTPRRGETMLPQRRPKHLHTTPTTKVGGTKERYIRSARHTHRTENRTRRREKTGRAENSKRGTHHVKRRRVNNQRNRRGAEKSSGRHKLTNDCNKIRAATANA

SEQ ID NO: 991087 - protein, 122 aa, Homo sapiens
DYLFCVTVIHTLCLQARMAQSCPSTEFTESLSGEGVSENSDTLQWSIQRILISEKLVVMTNTIQPTSITIACPIAIACALVAICPFRISQSTNSFSYNAVGMRSQPVAVILKLHSTAVMADF

SEQ ID NO: 991088 - protein, 121 aa, Homo sapiens
MRYNLRSITSCALLDRDTTKTTTPPHHPKQQPPAHHTQPTARHTPPHPHTRHAEHRRSRPPERSARENGGNAARAEPAGGNDRTRGENYDREEEKTRRKAGTRRRRRPHDRGRGREDRGRG

SEQ ID NO: 991089 - protein, 86 aa, Homo sapiens
SSSVPLDASVENLPLHEMALLHDTVICCSEYRRWGIRRSLLEFRYQVYLTDNRGTPEMDLTVSPRLLLRDMVEMDRGVCRGQTSLL

SEQ ID NO: 991090 - protein, 277 aa, Homo sapiens
MRTHAFGASRRDLSASVQDAPTVPIIRPGTGVRLVRASPCDGRGDRAGLDGEMGGHDDAAHRGAPVVTFGADEAVTRAPGLVHHRRRALGSPRVGMLRLSTGPMSAVLAAQDPGDTARGDLVPGAAHGVARHSLVTRLDLEDSAIATDFFAGTPERVRHGCQNRGGRRRNGTRGRVEAPEAVAAYPQVVARGFPNNLSITYGDMGNCGVTINCTMAQNKALHPTTPDLSMVSIGSRLGHNTLVDGPGESKSTCLVLPLSMWGTPTPVVSVPDRTQLE

SEQ ID NO: 991091 - protein, 135 aa, Homo sapiens
MFRRQLRQSLSPLIWDVVKQHVDPRNSVIMNSAYLFIGSYAVITNRVDIGLETRLSTLYSQRGEQTPHALLPGIYVPWGNEYGVEFSQQLARDRPESRLPTLPAGRVRESVFRLRKFDSTAVGPVTVLMAGISRN

SEQ ID NO: 991092 - protein, 154 aa, Homo sapiens
MEGGSGRSAVVGERGGGAESSGNVSREVGGEKGGFMLTVAPLAAFRVPLGVVVLLPPSLAHSCGVSSGLFGVAPSAKFPSWEKWQGVRFSPGPSLRGCRLCSGCCLTTVGLLERHGPCPQGTCHRRELLCTGLMPVALSPGAGSVGIADSLVSV

SEQ ID NO: 991093 - protein, 124 aa, Homo sapiens
MHVSVLPRTHCGDGVGEYNKDHFPLVTYCLNGKGVHLRRTGPPILTPQTIHKSCFYRQCETEVHYHFQDSSDPSGTAHCVCTFPLFSIHKTYASLTNTLLWHGTVLSKWNTQANPTILVLHPQV

SEQ ID NO: 991094 - protein, 119 aa, Homo sapiens
MWIQKKLNPKKCVLFQKKHSFEGKSGVLHTVYLRVKDAVYIKAPLCTPWGRKYHMCLAFYTLTRMCEHPGEAQGAHRAHTTGAPRENSPASILLSTALETPGVGTPADTQVSPVNTVGI

SEQ ID NO: 991095 - protein, 82 aa, Homo sapiens
RSDARRSLAEDRQDGTGRETALVTHYQMKYSLILSPYPITPIASHKKDNFYLDKMNNNTYYYRKRVLQKKDTDSYNGRTTES

SEQ ID NO: 991096 - protein, 250 aa, Homo sapiens
LDRLEEFPNTCKMSAQELGELSRPVLQTMQLQLGLKLSDYVLSLAACYTLMTSPPHSSSKGKLIPRHLDINIYSDTTQPTRANSSILACCASLQERLTMTIPLPCQHTLCQHGPEHCFPPPPQTNPTPTTTDSPRLLRHTTPPIRAHITTHYSSPTLSKQLHTSTTYPPPPTSHIAYSQQTTPTHNTTLPHPHTPGHPTPASCLTNTINQYLHHTFDTLNARNISLYQTLSRTSYCIHSLFSLTYTILIT

SEQ ID NO: 991097 - protein, 130 aa, Homo sapiens
HKRITARTLSLTPLTPYTRIGPARQTHSGALTEHMKQWNEEMTDAKPSLETEFACRILGGSSHTCTLVLQRLTPTYSSPHYLLTQSNPTSCNSEALRPPEGSQGSLVLDCGTGGTLVPGVSEVSVALTAH

SEQ ID NO: 991098 - protein, 210 aa, Homo sapiens
MSFNRFEGYSCVITSGTLYPLDIYPKILDFHPVTMATFTMSWHGSCLCPMIICDVAMTRCAISSKFETREAIAVILDYGNLLLEMSAVVPDGIDGTIFTSYQYMDEHTWHSWYEQGILEKHPRVNKLLFIRDPGWWLTQCRPVAQYQEACEQWPWCHPAVSGPGGHSVRRESTFVHPLRAGPPSWMASLRYTQSASQARWNTCGPVQIGH

SEQ ID NO: 991099 - protein, 109 aa, Homo sapiens
GPYLSRRWLDTFQLSDASHVCAARSCSMKNGQQPTLDAGCPGVFETLPKISALCLLDVPSFPTLADIAWIAAGDEETYCPVSGVITRPHEAHLINPVALCIVIAEANAV

SEQ ID NO: 991100 - protein, 88 aa, Homo sapiens
MARWGWRGPGSGQAECEGPPRLGHLVAEPGRGDAAREGAGLVGCSEQPVCLHYVSALLAPGHSCLHPQNSSAANQSARADNLIPGSRA

SEQ ID NO: 991101 - protein, 34 aa, Homo sapiens
TRYLSVFGVGAGCWAGGSIYRHGSQGDLSQRMPE

SEQ ID NO: 991102 - protein, 58 aa, Homo sapiens
DKDRWQSTDSRRASTWSYPPCKKIESALEEVEHGENQGLKVSRREMEGACGVTPIRTS

SEQ ID NO: 991103 - protein, 101 aa, Homo sapiens
GVEEGPESEEGLKTHRPYAMMGPVGAECLCCVLLTFGFGQSYDELKVDGTVEEDLGNKREGSRTDDEVVQREEEAIQLDGLNASQIRELREKSEKFAFQAA

SEQ ID NO: 991104 - protein, 40 aa, Homo sapiens
RYSYHIAARRRRLSRLVVCGPFFLTLTSSIHYGSLSVYPS

SEQ ID NO: 991105 - protein, 45 aa, Homo sapiens
RLSENKQVSASPSCPEACKLACNPYSISRVVRSSRVVRSEPRMSD

SEQ ID NO: 991106 - protein, 42 aa, Homo sapiens
MRALWVLVPLLLSLLDLSGFVLQTLTMRFDVDGTVEEDLGKS

SEQ ID NO: 991107 - protein, 59 aa, Homo sapiens
YFLLEDRPCPVVTGIYVHRMFLPGQWVVACCHLCCEFMKLYVNGAQVATSGEQVGGIFS

SEQ ID NO: 991108 - protein, 67 aa, Homo sapiens
PSVSGLRREPPHPGPSFVLVNPSHLFFRQSPHPDGPNIFIIQPSSWRGYPDGAPLEDSVSFLSVRVD

SEQ ID NO: 991109 - protein, 32 aa, Homo sapiens
MTRRVLLVCQPNVKKDGSYDSLLCVLLKLLKL

SEQ ID NO: 991110 - protein, 92 aa, Homo sapiens
YVRSFNSIYRYANGNVVTKKSISDLAELQEEYENYRKAAIEREQKVRRQLQDEIKNTVKPMRIDIISVVPELMESPFAYSIMKRAIETSKTR

SEQ ID NO: 991111 - protein, 105 aa, Homo sapiens
MRELMRRNYHPVRELRFHSCVYCLAPLEMDGSRRRPQSDESSRFSLTALSLQGEGRSVLAAVAHMACLHCNHRLGCSQDYGLLGQTGLMFGQSSPSDPAIENSKT

SEQ ID NO: 991112 - protein, 178 aa, Homo sapiens
LTLEYPPCQPSSTRTLYLQIDVTLDIDAHGTTQCLLLLDQSTGNENKITITNDKGRMSQEHIVRMVQEAREVTKLKIKKQRDRLSPRIHLSPSASDMKATVCRDEKLQGLITDEDYQKILDKCIEIINWLDKNHTAEKEEFDHQQKELEKVCKPIITKLHPEVFLQIEVTFDIDAHGT

SEQ ID NO: 991113 - protein, 53 aa, Homo sapiens
MTSNIAPDEWAWLSFGIKQKDIDKDLVIRIHSFHSTGVLSLTPPLRVSPEYSD

SEQ ID NO: 991114 - protein, 61 aa, Homo sapiens
MRIFSDSACAKRICFTFITLGNLLHAVGLNGNLYLALHNLYLKSHSCRIFVLFHGPPIQRS

SEQ ID NO: 991115 - protein, 51 aa, Homo sapiens
IPFHSTNYFFLIGPPLQSSPLYFQYQIIMTMIFHENLVDLAWAVCYYVRSF

SEQ ID NO: 991116 - protein, 40 aa, Homo sapiens
VPINVGCLPLSPLGCDSSSLSEVSYTKLLANILLRHRTDS

SEQ ID NO: 991117 - protein, 31 aa, Homo sapiens
MKDHNNSTPILLSIQRGRGILKTLSRETVHQ

SEQ ID NO: 991118 - protein, 83 aa, Homo sapiens
VILCELGLSVGGSSSIGIELSSRPAGLWAFSAGPGACGHTSLGCSLTELAIMNLKGRESRGKLGLPWPQERIPVLQASLLSVY

SEQ ID NO: 991119 - protein, 32 aa, Homo sapiens
WIPPVNVYCGKCLYFTIKTLDRLVHIIQYWWS

SEQ ID NO: 991120 - protein, 92 aa, Homo sapiens
GPRTPKNPPANFIEIRRQVATNIRIVVAMAVVVQSGFRIEILPLKPQWIVDFAHVEPGDLAVGAVVGGPDDFAFGVGQFLRGAEVVELVDFE

SEQ ID NO: 991121 - protein, 147 aa, Homo sapiens
ELARLVGLALMKTASVAMGPPGKGERAMAPNRGDMAQWVDEWCGSTESVLGSQHDVGGTAIRFGEDADALAIGCDIERFELGLGLDSRDVRFPLVSGNIAPIAAGVTPQKLERFFGAGTNQAIDAFADDQRPDGELQLVDVGVNPDR

SEQ ID NO: 991122 - protein, 70 aa, Homo sapiens
MKAGSDNSSVAYVVDRGNLRRQLPQHQGFLIVSDVNVLDSGDENTIAEVMAYDLHLIKEVIKKKEPSLLV

SEQ ID NO: 991123 - protein, 134 aa, Homo sapiens
MRPRVRTLPGPTTPVTSINRYRRAAAKFLYGGCEGKRKQFLHLDTLAKCLLKDRTEFPKYAGCKVSVDDQCEGSTEKYNYKSKFHDMEKFFTGRCHRNRIGNRLPDKATRMGFCAPKKIPSIRYRPKDEGLCSA

SEQ ID NO: 991124 - protein, 93 aa, Homo sapiens
EKLKVTILTGGAARHVRHTAQHRVLWSPRTPYSLTSLRACGKAFRVDQDAHTSPGHLPAGNSEPPCLSRPGHLRRTGQDCGEHPSVWVQHFLM

SEQ ID NO: 991125 - protein, 61 aa, Homo sapiens
SREGRTIFSSQLDGYSSMYETHITNFCSNNYHKNIPGKPRKSTDPLKELDCCCRLCGTAKE

SEQ ID NO: 991126 - protein, 155 aa, Homo sapiens
SYYAGDKLSLQCDLLMLNEVTFDQKISHILYTHKPFSSVNKLMANKAALLTKRFPAFSTLVRPFSSVNTLMVINAEFLTIRLPTFPTVIGSLSSVTLLMLNEGTLLTKRFPTFSTLIRPFSSVNKLMANKAALLTKRFPAFSTLVRPFSSVNTLG

SEQ ID NO: 991127 - protein, 98 aa, Homo sapiens
MGYAARSDYAARSHYAAQAGLELLTSSDPPASASQNAGITVVSHSSLAMFLKEGGNTHDNYSPRFCNWSHGSELVLMTAFFYYPFCIPLAFSKPRSQI

SEQ ID NO: 991128 - protein, 87 aa, Homo sapiens
PACFLPSVVPYMGSTEYIFSRVATVWGWCCVVVKIITKTFEVKKGRFIRESMKIHCKKAIGKSAKEELNASSKGLLGILKDGACAVG

SEQ ID NO: 991129 - protein, 44 aa, Homo sapiens
SARYRFFMQCHQKQAPPTSKIAVVKEKKMRKLADVTNTLELSKQ

SEQ ID NO: 991130 - protein, 100 aa, Homo sapiens
DLSVFGLTHNAQALSAGARGRRYVQAGEPPNGAYVWEGSGFFTQEGIPGQASGFRQQLLLTQQCTAAAEVLLLVEWGYPIGSVPRVVAQRQCCSHIYMHF

SEQ ID NO: 991131 - protein, 73 aa, Homo sapiens
SSVIMHLREFIISTCCLPATVTCCTMACRPSGLLAECVTQLLCSNVLQHPLESPHGQDHLGSTSELLVSIDQG

SEQ ID NO: 991132 - protein, 154 aa, Homo sapiens
ARYPLDASVQGSSAYENCPGLAGQEAVHKNGDSVALQGVSHLSWTHIVLFLLMSFPAFLPSLTLRLPSAPLSVHGLSLPYSCSTEPSYQSSLLCSVSPSFLSLSLSLFLSLFLFVCVCVCVCVSVCIRYNLKWRGTTQNYDADHNFVFCPMGAH

SEQ ID NO: 991133 - protein, 108 aa, Homo sapiens
IELGPLDDKCPELFIPSAGFVVSLASGVKLQTFAVHVTAHKGNTDPKGEQQQGLSVKMKEQSFHSMEGDSNMVAGGGLGGLVLFPYFGPNQIGGGWSLLQKTDWSHLK

SEQ ID NO: 991134 - protein, 57 aa, Homo sapiens
IVQILKQTYSKFDTELCTTMTALIKNYCGCSTCFSEGHGQGQRHSMRMVHMPALVEC

SEQ ID NO: 991135 - protein, 34 aa, Homo sapiens
EDMQQKSNLELHRIYPAAHLISVAGAQCGSYSEY

SEQ ID NO: 991136 - protein, 34 aa, Homo sapiens
MGCAQHDWVDRPFVVNRTGFQERVPINSEVPMNS

SEQ ID NO: 991137 - protein, 34 aa, Homo sapiens
MPGPSPQFQSPPAKQTSHSRSRHPVKPLQVLQTT

SEQ ID NO: 991138 - protein, 93 aa, Homo sapiens
RYSSAPAGPLELVCPRRRGEPGPPVTCWLMTGSPGADGKPGALVESGDAGANWRWWSPWTLSDPLVPLDPIDNVGAPRAKGARGSARPPGADK

SEQ ID NO: 991139 - protein, 49 aa, Homo sapiens
MSSNLYHVLPEAVEQPVVLEQCVMVVRVCVKLAVGLLEDLPRPAACPVF

SEQ ID NO: 991140 - protein, 80 aa, Homo sapiens
MTSTDTGTLTIAAPTRGRSLYAAPTLGHRYGDCYTIPAPTRGHSLLQQRHGDAHNSSTDGDAHLVPDAIAEGIPLDVDPA

SEQ ID NO: 991141 - protein, 71 aa, Homo sapiens
EEGTVPVEAWTWTPDINEPLSDSESEDVRGPEPSSTRRSSGVPSTWPSEADEEELARRREARKQEQAIQRL

SEQ ID NO: 991142 - protein, 40 aa, Homo sapiens
DGTGLLKDGVFTTSSDMWSFGVAFGELTSLAEQPYQGLSN

SEQ ID NO: 991143 - protein, 64 aa, Homo sapiens
IDQNDTHAVPCVALTPRPPSHSGPLSDTRQVPLLRKHGFLNLVQIFGDYYHFVASSSDEAVPVA

SEQ ID NO: 991144 - protein, 38 aa, Homo sapiens
GVQLTYDAHLFLNTLYDSSLSHLRATGSGNECVCTNLV

SEQ ID NO: 991145 - protein, 45 aa, Homo sapiens
TTPICDTSMQTKPEFDQVLHGTDASIKNKLPGPHHLSYGDHRCLI

SEQ ID NO: 991146 - protein, 34 aa, Homo sapiens
SLVIAQVECSGVILAQCNLHLQECSGVILAIQRL

SEQ ID NO: 991147 - protein, 36 aa, Homo sapiens
MESSYYAQAECSGVILAQCNLHLQECSGVILAIQRL

SEQ ID NO: 991148 - protein, 48 aa, Homo sapiens
VCWMIRFNTAVFGWMIHFRYSKVCNHDVCRLALSMPDKQYLKWIIQPD

SEQ ID NO: 991149 - protein, 71 aa, Homo sapiens
MLVHPPGTKGKEQNNGKQNRNKVSGNYSTAEVSDIALVIPLLSIQAPMRCLFQAVRVYLLFTNVHCPAVMM

SEQ ID NO: 991150 - protein, 56 aa, Homo sapiens
DLTFTILGPVTFLTMFSSLVIISSFIKNFSFKPHMTLITQCMVHGHLVIPRYSVTL

SEQ ID NO: 991151 - protein, 119 aa, Homo sapiens
VLIVGIIHEESAGSIYRYEKRRIFPMEGERAQRKKDGSLDYSDEDNESLQVIQTISVRGASSSMSSDDSLVDYGEGGEGQFNEDGSFIGQYTVKKDKEETEGNESSEATSPVNAIYSLA

SEQ ID NO: 991152 - protein, 130 aa, Homo sapiens
RRRWLRFVVFVLQILSVYASKSVGLLLVMASTPQPVCLLSSPQSIPGWSATIGQAILFTEDLVGRHVLLFWVFSSLSLLVLLFFLLLFFTMPICVEARKWQGRCCGSSVWDAGRRARCHGDLSHGHGRMS

SEQ ID NO: 991153 - protein, 37 aa, Homo sapiens
CYAAWHVSSGIDVFITSSTVVDTVGRYLFPQIHSLRL

SEQ ID NO: 991154 - protein, 45 aa, Homo sapiens
LSAGIPIQAQALWQVHACTAQQAPNHFPPGPGRSRRRRGPRFNSP

SEQ ID NO: 991155 - protein, 33 aa, Homo sapiens
LGEDCGAYLLTLRLSPVSERSLHSLPLIHSLRL

SEQ ID NO: 991156 - protein, 65 aa, Homo sapiens
LLLVLSRAPLTAPQCVCLALVLVFAGGNLFLVLVSSAWPFTRTASPAAYTSSGGPEPQSSPAGYR

SEQ ID NO: 991157 - protein, 76 aa, Homo sapiens
EDCGGTGRDSFCLRKGREEYGNFVFACLGISLTTVRQSNKRVLEVPDSRPWLLDGISAPELGHSLRLIHSLRLMGT

SEQ ID NO: 991158 - protein, 63 aa, Homo sapiens
MRRRGGEGAEKLPVEYHAHNLSNRINRTPNLSIMQYTPFKKPAHVHPYSKIKGYGTVAHSLRL

SEQ ID NO: 991159 - protein, 64 aa, Homo sapiens
MGTTSGDRTSRPLMRPLIELHTTNHLWSLRIRCILSIALHIRTSRQPIVRIRKALRSIRSPELN

SEQ ID NO: 991160 - protein, 163 aa, Homo sapiens
THLLLLLRGAQRKKGKRIKLMKAVKKRRAFLEKVIAPPKAAGEGSKAGLSPANCQSDRVNLEKSLLMKKAALPTFGSGHCTAEEVFASEDESEESSSLSAEEEDSENEEAIRKKLSKPSQVSSVQKLGPQNFIDETSDIENLLKEEEDHEENNDSKETSGALK

SEQ ID NO: 991161 - protein, 168 aa, Homo sapiens
PRAFLLLLRGAQRKKGKLIKLMKAVKKQAAVGEKGISPSKAAGEGSKAGLSPANCQSDRVNLEKSLLMKKAALPTFGSGHCTAEEVFASEDESEESSSLSAEEEDSENEEAIRKKLSKPSQVSSGQKLVPQNFIDETSDIENLLKEEEDHKEENNDSKETSGALKWKE

SEQ ID NO: 991162 - protein, 103 aa, Homo sapiens
MHVNGLVLVPMCLPSRPACTSSLPNLYMIESTAIHLAHYDMLLPCSLPECYLQASCLLPGSPVAHIHGHDVASHSPPHACAICQLRAPVLAAGVFEWAEHQGG

SEQ ID NO: 991163 - protein, 112 aa, Homo sapiens
SSSGFRLRPFLFFSRCNESLARLSVLSFWCPRVSLKPSLILIACGTSYLAGVATRQALEELTELPVMVELASDFLDRNTPVFRDDLCFFLRQSGETADTLMGLRYCKEEEEL

SEQ ID NO: 991164 - protein, 62 aa, Homo sapiens
IPPIQRQSKATFDAISNDLQLPDPRYSDHPRYSEAAKATFDAISNTYSYLDPRYSDHPRYSE

SEQ ID NO: 991165 - protein, 66 aa, Homo sapiens
LCDDGSEIVKMRAFVDAMTNVDVIVEVTHDVLVLRLLIYTDQSFGFLREQPTAILECFMNRQCRVS

SEQ ID NO: 991166 - protein, 61 aa, Homo sapiens
PGQFLLLCETPTSASRVAGITGLSHYAQLLYAESYREKREVRCNNTGKSQENISSNFSCIK

SEQ ID NO: 991167 - protein, 138 aa, Homo sapiens
HTLSRFRYSTELGTWPEADMHHIDRDNTHGRYVCVIDEILLKYVKLDAWIRDGKTGYGVEYGVGIIGFFRAHEHSLLSAQLKGFPLFLHSNLGLRDYQVNPSAPLLHLTRPSRLEPGPLPGDDWTIFQSNHSTYEQQC

SEQ ID NO: 991168 - protein, 67 aa, Homo sapiens
HSSSSFSSAPSAPPASFFSPTLHPDLHPDSLKPEAREPPPQKMSEEVRAEPQEEEEEEFAQEEEKSA

SEQ ID NO: 991169 - protein, 38 aa, Homo sapiens
SGAGFNEESGERVVAAQPTGSIQYPTPIKMAAAGSVAT

SEQ ID NO: 991170 - protein, 56 aa, Homo sapiens
MLLPFLFGLKRNDQKIFVYRLCFWKLALGLSADHMMWRIARPGMGQTCSGPMGVCC

SEQ ID NO: 991171 - protein, 92 aa, Homo sapiens
DLKDPGSLMVWSYCSSKYELQLAEYTHTYTSWSYSAILLPSDVVIEVESIKLSALHWWLCVVYWDDPCVSDLQAGLECHREAARPYMPPIQR

SEQ ID NO: 991172 - protein, 38 aa, Homo sapiens
MISEIDKEGTGKMNFGDLLTVMTQKLSETDTKEDIRDS

SEQ ID NO: 991173 - protein, 83 aa, Homo sapiens
TKVQSLDSCVGGVVIARVIVIIFVMLKKKQYMSIHHGVVEVDAAVTREERHLSQMQQNGYDNATYKFFEAGVRNQSPATGLRL

SEQ ID NO: 991174 - protein, 69 aa, Homo sapiens
SRCLHRDEYKPLDLSCFHTVLHLETEATNSLITAPGEFSDASMSPDATKPSHWCSVAYWEHRTRVGRLY

SEQ ID NO: 991175 - protein, 58 aa, Homo sapiens
MYAWMKHYHVRPRICMADQDSYNELTCPVNSSCIYVSRPACRRPRCVLARVPWPRLSF

SEQ ID NO: 991176 - protein, 41 aa, Homo sapiens
KYFWLISSCMYLCKKSSCEFVFSCMGHTSLTKSFPTGPTVF

SEQ ID NO: 991177 - protein, 49 aa, Homo sapiens
GEFVGDGHRYNFLSDVYVTCLKFSTDVLSLPHARYSECSLPGDRYGKTA

SEQ ID NO: 991178 - protein, 33 aa, Homo sapiens
GTPKVWYRSLFQDMKRGFPDVRQGGGDDESHRL

SEQ ID NO: 991179 - protein, 66 aa, Homo sapiens
IEDPIRRIMWNRELSKPSSRRLHSLISPILEATPQHESYAKIHITIIFIWVNLTNFPQSRRMGTEA

SEQ ID NO: 991180 - protein, 50 aa, Homo sapiens
VHAETFALISSTEENAVMMGVLERRNFVYRKNYTGMRETQHQDPQSSPGV

SEQ ID NO: 991181 - protein, 94 aa, Homo sapiens
MLSEKVCNHMDYHGWAGVVIARVIVITYGDAEARNSTDPFIMVWGEVDAAVTREERHLSTDAVEGILNMEGYKFFAGRSGELEHAVSTVSTPDG

SEQ ID NO: 991182 - protein, 77 aa, Homo sapiens
QADYCRKRKTIENNGRNNMELYMRSGMRVVVAHTCNSSTLKDVKQCGSLECLGYESSLANMVKAVSAYKYKNIGKHG

SEQ ID NO: 991183 - protein, 54 aa, Homo sapiens
DLWLLEVKQSSMTISPHRTSSWIQWNKALTSHLGRLGDTGDVPGTYPQVFVLMC

SEQ ID NO: 991184 - protein, 50 aa, Homo sapiens
REDCVSVGSVACAGFVVCVLEVGELPEGLITVGCSGSGLTAHGGCCIVLG

SEQ ID NO: 991185 - protein, 52 aa, Homo sapiens
DYDGDGLSLHCESKPNLGVADGLGGYRGGGAVSVFRRVSREDPTCLLSDGYR

SEQ ID NO: 991186 - protein, 72 aa, Homo sapiens
AAAVLSLEDPIRRLLWVHAGVALVAVALPVLAGDFFRAPDILDIYQVLVHKGVHWLAPPLCRIPSASPESSP

SEQ ID NO: 991187 - protein, 47 aa, Homo sapiens
QANDWCVCIERYHVVYSSLSPGMRRHRGIFGWYSCFRPQSSPDGYRA

SEQ ID NO: 991188 - protein, 37 aa, Homo sapiens
MTLTLFSAELLGEPENYTLANGLHTPPHSLRLMGTEL

SEQ ID NO: 991189 - protein, 44 aa, Homo sapiens
MAFADARSIALGCLSLVFCAPVACGPSIHCLEFRNKVLTGPEWA

SEQ ID NO: 991190 - protein, 44 aa, Homo sapiens
DGARGSEHTMSSHGLRLIQGSSPDSHSLRLIAESLRLISHSLRL

SEQ ID NO: 991191 - protein, 54 aa, Homo sapiens
QAKMWPTLGLALLGSQMPLPSLVSVFCKAVYVAMAFPKLEPFHHSQSLRLMGTE

SEQ ID NO: 991192 - protein, 64 aa, Homo sapiens
MVPWIRGCCHSLRLISGEDCVHDDEDATGNVSSLLSMSSTARFLCIVKWFFVFTCICHPIIPKQ

SEQ ID NO: 991193 - protein, 34 aa, Homo sapiens
TFCTDVRGRYAVHEEGGSLRVSHYDSAMRRWARV

SEQ ID NO: 991194 - protein, 35 aa, Homo sapiens
VAVELETSKYLQVHAIFSSKEFMCYSYNFLLDVFL

SEQ ID NO: 991195 - protein, 58 aa, Homo sapiens
IRRRYVGIVRHTTDDYFANFSPIYWDESASFLIQANHTHDEPTSLQVQGLTGTWLCLG

SEQ ID NO: 991196 - protein, 39 aa, Homo sapiens
MVCSFTFVGISISHLVGTLLRWGTVDCDRPFPGACMRAM

SEQ ID NO: 991197 - protein, 106 aa, Homo sapiens
QLLLCVGLEDPIGEDCGSILWHQARSVGRHPRSPTQIWAVPDLVLGEEPIPSPYSKEQSHSPKTAAPKLRSLPQSCLSTPHPRKQNLVGPETAQRGGGPQPQSSPD

SEQ ID NO: 991198 - protein, 36 aa, Homo sapiens
TRRFTVTAPMEQHTHRMEWHTRPMEQHTLPRNSTLS

SEQ ID NO: 991199 - protein, 66 aa, Homo sapiens
SGDDCADGVPKVIWRQVASWLRSLEHSLSNSPWTYPHMGAESARICWVGGAYPGRGEGELGHSLRL

SEQ ID NO: 991200 - protein, 37 aa, Homo sapiens
MIPSGEYVCYEDHTGKPWGRTDYPHLPGASTLSDGIV

SEQ ID NO: 991201 - protein, 35 aa, Homo sapiens
VGPTVFPVVDANGRVGGLDVAGRVWLCRWLVDLGV

SEQ ID NO: 991202 - protein, 95 aa, Homo sapiens
PSCSAGMQCTTLSSWEDKQYIVVREALMLFKSILEQQMAAHHLCDPVAQQARSARCESPCLGNLKICRTTFREFCSAKCTSMQDWYVPEPLVEDP

SEQ ID NO: 991203 - protein, 100 aa, Homo sapiens
ALISVCPHPVACPLSVAYPHLMPSSSVMPSSSGMPSSSGMPSSSGMPSSSGMPSSSGMPSSSGMPSSSADALFACPSHSGMHSSHALIQWLRAWDEGMLL

SEQ ID NO: 991204 - protein, 70 aa, Homo sapiens
YVVDPSSRPTWKSDTNSYNHDAVIKNYGLLYCFLKEMVQVETFLRILQCRSVEGELCLLGALLVDLVSDP

SEQ ID NO: 991205 - protein, 132 aa, Homo sapiens
MSARSLFMMEQTVPCMYNESRGMYEQVRWMTDRRYMQKNWENNSLSKLRMLFVGGVQLNFKPSPVRNIPPLEGCIWNLVINSVPMDFARPVSFKDADIGRCAHQNLGEDDEEHAPAEIVIQPEPSSPPARGT

SEQ ID NO: 991206 - protein, 38 aa, Homo sapiens
PPGAEAKHASLLEDVLNTDGGLGGLAGGISGKWKHVKR

SEQ ID NO: 991207 - protein, 45 aa, Homo sapiens
KQKLTASSKAIANIGNIAIKIKVSNTQIYAKSIISKTIDDSLTTL

SEQ ID NO: 991208 - protein, 56 aa, Homo sapiens
PHPVEMESQISMNCCVCMEQWPCVLQRLYCMAILDEFLVGSRARLPLCYGPLDEGM

SEQ ID NO: 991209 - protein, 41 aa, Homo sapiens
MVSESLNLTGLVKIHIQILEVILIDPFHKAIRAPARIQDSQ

SEQ ID NO: 991210 - protein, 65 aa, Homo sapiens
LSQWAVLLKGRPGSESLGPACPVGNRCRVSPWLWRDFKPGDGAVGPILRSRSHCSASSVMCFLRQ

SEQ ID NO: 991211 - protein, 42 aa, Homo sapiens
LVPVLRAGARARGCATQGNDLGSPRCSVDKDGSRTTLRHQHE

SEQ ID NO: 991212 - protein, 98 aa, Homo sapiens
IIGYQDALFETIEAELNELGAGSVKSLLAGVLCLGDVTAESESMRGSERDFMLNALVLLDCWETGRNVAREGCHETKVGPGKALVRHELGLKRPLDEG

SEQ ID NO: 991213 - protein, 50 aa, Homo sapiens
QLHVPVRLSYFSDTVNEDPCCLPKRVHLGGLLLGQQSPPLDEGMGPLDEG

SEQ ID NO: 991214 - protein, 46 aa, Homo sapiens
AYSPPGYQKHQTNSLSTSTIPLAPARIPEHSTNTLSTSTKHQHEYP

SEQ ID NO: 991215 - protein, 36 aa, Homo sapiens
IELLPNSIPAYYALPEEGMQEEELISEEKNYLDGIV

SEQ ID NO: 991216 - protein, 131 aa, Homo sapiens
GDSRGPPCLIHVLHSATGRESSKSMRVEVSELDSSLNSTSTSNSIFSHGITKSKTHSVPEALEAGGGQLNVNFMGKPLYVKHEPLRTHQNIRHHNNRCSNCKPGQQVDDFTLWTVFPKMSEQDSPLDEGMG

SEQ ID NO: 991217 - protein, 44 aa, Homo sapiens
YFLIMRLGIPVNSVRLQPVQIQSLETLGVLARAVGGAHEYAGME

SEQ ID NO: 991218 - protein, 107 aa, Homo sapiens
MSEMQIHSNVAHRCAKPHKCPHCSKSFAIASYLCQHLRIHLCVKPYHCSYCDRSFRQLLPPPSSTPESTQATDPTSGHILAVKKAYTQLSKLQSHTSQHHKEQALEV

SEQ ID NO: 991219 - protein, 45 aa, Homo sapiens
TLSRHPPMLSSRGSPVHRLSTVASIPTFTSGPRTQQSVSLFIFLS

SEQ ID NO: 991220 - protein, 68 aa, Homo sapiens
IELGTCYRCTMNVFDRHILDIEAHIVPRKSFTQSFMVYIDAIFLIAPIIMEVVDSVNPEFWKNTTKRD

SEQ ID NO: 991221 - protein, 48 aa, Homo sapiens
HLSQSGYDLSGSHEVSPVSWVLFRGQKVLSSESPARVPITPRSQKAVG

SEQ ID NO: 991222 - protein, 113 aa, Homo sapiens
DEGELQGALTRVVARPEPEDSGVGDSRNTVHGGSSHLLEVASAVSAAEEVVHVASDGWEDLLGLGCFLEWSTYCRAGCTVKKWKRTHRKQGKPRKCGSLPWQPIQFAPSEGYR

SEQ ID NO: 991223 - protein, 41 aa, Homo sapiens
KFQNIYITPKKKSITHQQSHSHNPKPKTATNLLCVYLDSPV

SEQ ID NO: 991224 - protein, 92 aa, Homo sapiens
SLGAELGRSQCRAIARFDTNVAQAVRHWSRTTGLLYCFSEGHGQGRDIPAHGAVPLCGGQLWHLGARGSIRVMPRYSALLLALKVAVQFAPS

SEQ ID NO: 991225 - protein, 60 aa, Homo sapiens
MLYLHLDLNLLRLLNLDLLFLLGLWLNTGGDWTGKFKQRPSHFSAVCVYAVLPAARGTEL

SEQ ID NO: 991226 - protein, 69 aa, Homo sapiens
AVAMLTGELKKALIEVLQPWICSSLWSVLGNKVRYMKDTVDITGSPPCEGYASSQFCNSMVYSVFRSIE

SEQ ID NO: 991227 - protein, 120 aa, Homo sapiens
ALMPCHNGLFHVALNSLQHGAISDLAEGSHGRAPVVVFSPSHVFVRLQGRRHCQHAESLGLFTPLQLPTPPLPRLLHEPPNQCSPSIPAPPSLTPHSCWREFHKTQNQTGHPPAFAKKFP

SEQ ID NO: 991228 - protein, 42 aa, Homo sapiens
RWWLHCLGVTETAGVDGWLLGLDLSTLVMGVLHACYHTMHSC

SEQ ID NO: 991229 - protein, 57 aa, Homo sapiens
LDGLPLAGGDTEQVQSYLNGGTGWAGISKASGLILQAHFQPQAREARRWGRNCWRGT

SEQ ID NO: 991230 - protein, 32 aa, Homo sapiens
LIITFFSVTIILSSFVLVSINFFINSFCSDSR

SEQ ID NO: 991231 - protein, 85 aa, Homo sapiens
MVQGEDVATRPIPRLVPQVAHLMALSWERSVIVECVRIAGRLIIISNFIAPDKWVTHEFCLSSHAQQSLGRDAIQDMNIQTACRW

SEQ ID NO: 991232 - protein, 39 aa, Homo sapiens
MHCSYLSRCYHDPICLLLGVAAQSFILNKRFSQSLDVTF

SEQ ID NO: 991233 - protein, 40 aa, Homo sapiens
MQIESLNVELAVHDEGIMKKDIMEFMQTRVVGQVNVEIDA

SEQ ID NO: 991234 - protein, 35 aa, Homo sapiens
NRARPIALITRNQYKGSLDENSDQQVDFQEYAVFL

SEQ ID NO: 991235 - protein, 54 aa, Homo sapiens
ARPYWILLKMQTLPVGGGAHLYSQTTRKAEEGEWREPGEAEVCSEPEVAVSRDL

SEQ ID NO: 991236 - protein, 66 aa, Homo sapiens
NTGKHMSDDRYNLHIAQPIHSSIIEAKAVTSTYDCTGQSGHNNHKYRECSPITVGQHLYCHGSQGA

SEQ ID NO: 991237 - protein, 95 aa, Homo sapiens
TTDVEWSCSCDIERATAEGLEVFEGSTMQFVRDDEDGAIAAACEEAVRQIDNIIANPLVRLASAPAFPANLQPAPAGCFFMRAPAVPPGGSLLCF

SEQ ID NO: 991238 - protein, 43 aa, Homo sapiens
MPVRPSDQALGSRDTMDGRLYWVLSRGAPRLIPTDPVGLHGEC

SEQ ID NO: 991239 - protein, 55 aa, Homo sapiens
RSSGSHRRRLWTQGCCGSAMSRRMETEIEAADNLADLEKHLRETALRSMRKAQVS

SEQ ID NO: 991240 - protein, 66 aa, Homo sapiens
ELLTGVYLMHLSCERLPLVNQDSEGEALTQQVENVEASQLRRLNIKKDDEFFHIRPTCAYAIWGLA

SEQ ID NO: 991241 - protein, 34 aa, Homo sapiens
MAEDGWEPALGAFQRKAHLQQSSALIEGLWRSTF

SEQ ID NO: 991242 - protein, 49 aa, Homo sapiens
LEDPHHGEDCGYRFWDVSGLAISVTCVSMCLACTCDRICWGVRVALMSV

SEQ ID NO: 991243 - protein, 42 aa, Homo sapiens
LEERGSILHRDTNSFKEMASIGGNTPVSQSPLCGPELRWNGI

SEQ ID NO: 991244 - protein, 69 aa, Homo sapiens
TVETMEEDKSQSDVDIQSCESCSNSDRAEYENGSRYFSEDDNETTMLIQDDENHSEMSKDWQKEKMCHK

SEQ ID NO: 991245 - protein, 96 aa, Homo sapiens
IIHQRFTYARKKGSSMVLDDGGIKLSSSMSTPIVSVYCVVTMARYSSKHFIKTQSSQLLCEVGTLTTKHILCKSKFKPRKIQLFAHSHEASTVPAV

SEQ ID NO: 991246 - protein, 109 aa, Homo sapiens
LDICNEDGRLGARLRVVMANKHAAAGIEATQVYQLDFGGRVTQESALNFPIELEGRQARPQTRSRCWAREGEGSSASAFKEHFSKGPIGNVEDNEHLLGRAHGVMVASV

SEQ ID NO: 991247 - protein, 68 aa, Homo sapiens
ASVALRIPPDINTVGWVTGDDVRFLTLVRGFGHVEQEVAREKGGYARMKKPEYLGISDHFSHSSLRIR

SEQ ID NO: 991248 - protein, 79 aa, Homo sapiens
PIPLRQTCPLSILFDHAMLQAHRAHQLAIDSYQEFVDSYFPLVLLFSFLLVSLSFFCFSVSFPSPSFLFVSLLFSFLVL

SEQ ID NO: 991249 - protein, 76 aa, Homo sapiens
TPSRLPDKITADTMEHWMEPVKDQSIESTDRRIWLPVPVFDLCFLTCVPFLAVGSRVSFFYRTFCLFVGGICCSSS

SEQ ID NO: 991250 - protein, 86 aa, Homo sapiens
DPVAGYLRNITADTLEHWMEPVKVQSIESSDRRLWLPVPDFVLCFLSCVPFLAVGGCVSFFFRAFCLFVGGVCCSSSLSSLLVFPF

SEQ ID NO: 991251 - protein, 57 aa, Homo sapiens
QLSEEEGLELCLVTPAHALNNRYSVPTVFVSLYENSQRVWRMIEATCLALIQQSSQM

SEQ ID NO: 991252 - protein, 143 aa, Homo sapiens
WWMHSDPCRPECPLWSRPPQYLPFMQPIGGQEKTSTCPAARNLAHRQSMGGQLMGCFGNQDESSLSPKLLQSVEGSILALVRSSATGKEGSGSVTCRWLWSFRNEDVFLSLIHYSSRGVITCISGQTGRTVAIDSSSNYLQSE

SEQ ID NO: 991253 - protein, 45 aa, Homo sapiens
RGSHQVKIVDGQKIMELSMLSGEHTDSPPIPWPPMTTSLRIVPKV

SEQ ID NO: 991254 - protein, 47 aa, Homo sapiens
MHLTHMQDIKKYLTNERLVWQLRISALQVHMAKLYTHRTTVHLPVCL

SEQ ID NO: 991255 - protein, 64 aa, Homo sapiens
FVIGEDPEIDYLTHWNQHEPLYIGQVYHVQRVIANHFVTISIEVIRGYCELHKCTSCTLPRCAE

SEQ ID NO: 991256 - protein, 30 aa, Homo sapiens
SRGSTAIYNYLCKIKMPFPTPLRKVIVNAG

SEQ ID NO: 991257 - protein, 46 aa, Homo sapiens
WVCDRDNDCVYGSDEPANCTQMTCGVYKLRYKDSIRCSHAVESATD

SEQ ID NO: 991258 - protein, 72 aa, Homo sapiens
RILEEYVELQIRSVLKELDAYLLYILLTGALQFGNVSSMGTFPFNSLLSGYISLCGEIIVAVRLRIEFVPSE

SEQ ID NO: 991259 - protein, 83 aa, Homo sapiens
TQEDHLLMLAISFLIAQKTQARHTSPQCTVEVGPDFTETSYFDWSGSLQAPSSVYPVHYTQGSHSNSDWLNSYLFTMSCSWTP

SEQ ID NO: 991260 - protein, 34 aa, Homo sapiens
VLCTASVVVAVCMGPLLSCRSILSELRQISHTEM

SEQ ID NO: 991261 - protein, 121 aa, Homo sapiens
RASPLVLSLSEYLTRSSSSFSGYTPRPRTSLANSKRQGSAARRSCPSARATLQTSNVKTDTETPKASAMTRRTLLPYSAAVLFSSSEGLYTGRNSDFHLSVKLTQCEPQDFQRSRSLPRRE

SEQ ID NO: 991262 - protein, 38 aa, Homo sapiens
MNLMLGVSLHAVVEQCEFFALVLVVVLSGLACSSEMDV

SEQ ID NO: 991263 - protein, 75 aa, Homo sapiens
LLLLVEQLDKSQRLSLFQRWLQHATMDTEHTSSEAEQKAGVCHCVTMDVDLCQCQCNASCSCHVTLEMGHMNGAT

SEQ ID NO: 991264 - protein, 58 aa, Homo sapiens
RLYAVNLNSDNDVEEGQEQPLRMAPQLPEEVPLESAKQSEAEVVTEIQLEEDQPKVNG

SEQ ID NO: 991265 - protein, 77 aa, Homo sapiens
EKLLPHIRWNAGFVFTKEDPTEIRDMLLSNKEPTAEPALLPLPYVKSLVPAHNTDLGPHKTSFIHTLGITTKISMDT

SEQ ID NO: 991266 - protein, 48 aa, Homo sapiens
GSSRASTRCGPCEATSFILRAERPQARYYVQVAAHDLTNYGELRDCSL

SEQ ID NO: 991267 - protein, 32 aa, Homo sapiens
MTITSYRTRGRHQTLMGRLEDWQPRDWADPQA

SEQ ID NO: 991268 - protein, 38 aa, Homo sapiens
MYVCVGSVVRVIVAPYGASSDAIQLNTSDEIPFEHQTQ

SEQ ID NO: 991269 - protein, 101 aa, Homo sapiens
MRYTWPDAGRKPVKSQFHGALSGQATACSGPLTRSVRCGWDCLLAIVCNRLLYRADYHFQGWYSLPERTLDVRHLITGVIQKRLVLGILIGQMTSGRVLVA

SEQ ID NO: 991270 - protein, 51 aa, Homo sapiens
MSKPCCKVKHNRVMAKQTSPPYIITIIITINTTTISSIITIIIITTTIINI

SEQ ID NO: 991271 - protein, 54 aa, Homo sapiens
NLGRIFITSCKVEHNRLWQAASPPLIITIIITINTTTISSIITIIIITTTIINI

SEQ ID NO: 991272 - protein, 71 aa, Homo sapiens
TRYGVMMFEITKQWTFNYILRELPEVPPTCQCACLGNYRDMGEHRVILPNDVRDFIDNLGQDLQGPSYYPT

SEQ ID NO: 991273 - protein, 33 aa, Homo sapiens
SSRYGWAVEMMTERLEVKGGGFEVPVSKGVLMV

SEQ ID NO: 991274 - protein, 45 aa, Homo sapiens
VHPPACSTPYKPPYGKLLLPPGTDGGIEGPRVLNGNPQQELKGDG

SEQ ID NO: 991275 - protein, 67 aa, Homo sapiens
APDRCTLPGKADNGIMDACSLSSSLHLIIPSCDTAVTDIDADGCIKEDSVLGHNCNVRPQRGLTHLR

SEQ ID NO: 991276 - protein, 119 aa, Homo sapiens
MRAPLQVCSCTSLKLEHQLLPRVFSCMTLNLNISSSPGLQLQEPKTRTLPSLQGSSSMTLILEHQLLPESPTEETLNANNISSSPSLQLQDPQTRTSAPLQVFSCTTLKLEHQLLPGSA

SEQ ID NO: 991277 - protein, 84 aa, Homo sapiens
RTEELGRYSRSAMNSRKDIYKRKYSAAKTKDEKKKKEKVLANVTKPVGGDTNGGPRVVKIRKMPSYNPTARYASNAVVTGAVYL

SEQ ID NO: 991278 - protein, 64 aa, Homo sapiens
RSCYNSTDRKYHSAIKKKHLYGKEKYPPDIQQPSYNRHSIDHSLDQSYFQYPCIEMMDELPSTC

SEQ ID NO: 991279 - protein, 101 aa, Homo sapiens
PYQDTLMDVEAKNKLKSECIYDFIPERSSVLMNSYASYLDYRKSIVQKLVFPLCYSYTSAKDNRQQIPTLVYSIVGLLSNAAFTTDYSQPTVPSPVTSTLQ

SEQ ID NO: 991280 - protein, 30 aa, Homo sapiens
MPGSTRAEICIAFYFLHQRRIIYRDLKLDN

SEQ ID NO: 991281 - protein, 34 aa, Homo sapiens
CRVCHSLQSVGSLQRQRKLPEEHARFYAVEICIA

SEQ ID NO: 991282 - protein, 69 aa, Homo sapiens
WFLAEPAHPGPPPPIAMHLHIPPRDLRTITPCPLPPSQGYTYTTQSGRDQPAWLLHHQNSLATGSARNP

SEQ ID NO: 991283 - protein, 82 aa, Homo sapiens
DYGGKVCELDENNTPMCVCQDPTSCPAPIGESEKVAGNDNKTFDSDCHFFATKCTLKGTKTDHKLHLDYIEPCKYMPPCLDS

SEQ ID NO: 991284 - protein, 108 aa, Homo sapiens
TRLITAEGSTFRAPSHSFSAGFDEDKPIAITGTYNLDFDNIELVHTLQTLEPRASDAKNQEGKVHTRRKSTDSVPISKCTLSRSLSLQARDSDGASSSGNPEAVALPP

SEQ ID NO: 991285 - protein, 61 aa, Homo sapiens
DYGGRERLTDREALELIMKNKSIPSGGNITHSSEAGRHSEALRNEETNVARLEDRGRAKRV

SEQ ID NO: 991286 - protein, 80 aa, Homo sapiens
DPNGGGRAAGTGSGTTNVATGKTLCAKGYLGRHGAQPRQVSGEQGPSARHHTCKGPEAGVSQEHNVSCQGGRVEPRLSQH

SEQ ID NO: 991287 - protein, 39 aa, Homo sapiens
RTHSSSSSKKVIPFAADCDLDDVHLPGPNGRRKSVTVGT

SEQ ID NO: 991288 - protein, 32 aa, Homo sapiens
EEEEYAQEEEEYAQEEEEIAQEEEEYARTRGT

SEQ ID NO: 991289 - protein, 66 aa, Homo sapiens
RDPMSSEPVFSQTKVAGGMSQTSLFYLGTEKTKVKMVGKSPMGRGAAFFYGERVSPSCPPGYIAWG

SEQ ID NO: 991290 - protein, 38 aa, Homo sapiens
MPLGKNSQGSRQDCPRTSEASGPEQLADPGAVLGETPT

SEQ ID NO: 991291 - protein, 45 aa, Homo sapiens
VVWIRKNEVRVSGVNKINEELYCSVRTAREELPWQRVVPPASLVG

SEQ ID NO: 991292 - protein, 73 aa, Homo sapiens
LDAKLSRRPEETVPSHWGLIPNVRSRAPNHRARPDLSSDRKDLSESIGECGMRLPKLTDVIRAGPGAPFSSQQ

SEQ ID NO: 991293 - protein, 68 aa, Homo sapiens
LLTTTTVLGIIVAVNRVLGERSSDMIGHAAVLGQRPHQCVRITKEYFVFSCQFVWTYPIVHSPVTHCY

SEQ ID NO: 991294 - protein, 44 aa, Homo sapiens
MQSVKTLGHCVCECESDSHVVRHQDTVSCDTLMISVSLCDEDYW

SEQ ID NO: 991295 - protein, 84 aa, Homo sapiens
GCKVSGYNNQCAKITSISVHQVIDKQRAKIMSELPFTIATKRIKYLGIQLTRDVKDLFKENYNVSHFNRCVVVTHLGFTLGVPK

SEQ ID NO: 991296 - protein, 75 aa, Homo sapiens
RGSLQNYERAPTVRLDTWWRQRRLEPRTVQLFWKPVPLEEDSGRDAKGYVCFLGDTSGQAGAILPLCKNPRVTEL

SEQ ID NO: 991297 - protein, 55 aa, Homo sapiens
TLCNNSRWQMPTTDTLEDMNSQLNSFHGQMENITTISQANEQNLKDLQGTHAGTE

SEQ ID NO: 991298 - protein, 65 aa, Homo sapiens
QETQVDRMFRVDFGLRATASAGNEGLVAIDFSSSSDKKSDKTGTRPEDSKALKDENLPPVICKER

SEQ ID NO: 991299 - protein, 37 aa, Homo sapiens
ALVAVTDKRPATARRSVYTECTQWMRKSFAPVCNEPT

SEQ ID NO: 991300 - protein, 41 aa, Homo sapiens
WVLGRCQENWKSPSLIIIKGKSWESDEEKSYHQRSPPLWFL

SEQ ID NO: 991301 - protein, 121 aa, Homo sapiens
GHHTHILTGTHTDEHSHARIAYVQHTLNYSLLGVVPVHLQTLCALPFVQKSVPSLHALTPQSVYHRLRVLHIENPPLSVSEVPDMCAYIAPSLPRASLISMCEYVKITCFLLRDYCSLPAE

SEQ ID NO: 991302 - protein, 68 aa, Homo sapiens
FRAYTHMSLGTALLSLLSPALRSRKWVFIEDKAELQDKSEFSDVDQLAIRDYEEFESSFESAGNMPRQ

SEQ ID NO: 991303 - protein, 39 aa, Homo sapiens
RNQKPGRPRQESRLKSLARLQSWLRRFLSSAQEYTLEWN

SEQ ID NO: 991304 - protein, 36 aa, Homo sapiens
DPVVINRVFKDCEAWEVSSDCRNCVGGLGVCRMIYK

SEQ ID NO: 991305 - protein, 95 aa, Homo sapiens
VQLVRKVFGGGSDSANGRKNSPKLTLIQCPVVQSCLCLKYCSAVTTVVVYVALRVHTPSSLHIVSAIPAHVLPSRRPRKTCILVLITQCPFLPNC

SEQ ID NO: 991306 - protein, 79 aa, Homo sapiens
PGAPVCMTPRLRELTINSKGPSRTGIQMLMGVRVAPEVPISWQDPLASSGWWDEKHMLPYFSANHGADPMRTHHYSSLS

SEQ ID NO: 991307 - protein, 91 aa, Homo sapiens
LHASPGPIALEYQELVCMSPCQSLFINLLEQKAIGDCELMVNTLRKNDSNCLTVFLKYRNDITACYNGLRPGRCPVPEGAETWTVSDVQLS

SEQ ID NO: 991308 - protein, 78 aa, Homo sapiens
MRRNYNKLESAYDKQTYSRSLDTLQSGNSRVVYSHSHPNPLKLHRRSHSHNRPRTPMLITMVPSKLKLPKRTHRVPRS

SEQ ID NO: 991309 - protein, 100 aa, Homo sapiens
MSRTVTCIAQDDGLAVVVQARGDTLRPYGIAIRALEFEVAVELVWNRALALHLLADMDGAVPGAIFPAWNDIAPKSLGGIMVFTLDPTITATWMMGMGYR

SEQ ID NO: 991310 - protein, 90 aa, Homo sapiens
TCVAFSILRSTRSHNSYDRDQPGEPSIPAIIEYPLPSSRASTSNVLRVHRSHNLNKEQDIRKIGGLLKTIPLSSTSLTIGSLAKAGVPFL

SEQ ID NO: 991311 - protein, 34 aa, Homo sapiens
RVRTYPASPPNHRPAVRSHVNAGTVVQNPAWLQM

SEQ ID NO: 991312 - protein, 50 aa, Homo sapiens
SPELVHVKACPCNAEYTCDQAPSKRSVDVNTVLTCRRNLSQEGITDSGEY

SEQ ID NO: 991313 - protein, 78 aa, Homo sapiens
TVLHHTTVRRSDGADTQGGTGSAWAVEGQESAHTLSVTKEGTAGPAELTGTYAQVQMVWVTHLPPLGGARGWRALEKD

SEQ ID NO: 991314 - protein, 37 aa, Homo sapiens
CAGSEPHSGAFACSLWVLFQFLTVQAAQENVDHSQDA

SEQ ID NO: 991315 - protein, 136 aa, Homo sapiens
FGLIRWTGVHAVRGPEGFGVEETAVGKKIGEEEIQKPEEKGELRWSLIAAWPVTQELAQVNITLQEQIEAIHEGEGLVPEDDTKEKSGPRKPNEIAQEPPPPSSVTNIASSAPPITSVPRPARRVPPPGSPPREGY

SEQ ID NO: 991316 - protein, 61 aa, Homo sapiens
VDTNNLLCSAYCRNMLEAEDGPEMNFLVGIHSGCSVVSVCQTAPGMITIELYVKFSHFLAL

SEQ ID NO: 991317 - protein, 58 aa, Homo sapiens
RVHARDEVGLRKAVNGISHSRMQRGTLFSEKGSRLRLSRYLDATLGPQDPIVADGALA

SEQ ID NO: 991318 - protein, 60 aa, Homo sapiens
SDSADSTKMQPTDHMSTAVRVFLRRQERCSGRPCAREAVERLHAGTGRGTQYAQVLTVGT

SEQ ID NO: 991319 - protein, 52 aa, Homo sapiens
CPAPAWLTTLTVVWSLSPEMLVLLLLSGATGLPCCPPPPAGRLRRTCALAPR

SEQ ID NO: 991320 - protein, 30 aa, Homo sapiens
MMEVPIFQYLMNTSTNIEQAVLGQCWIRTH

SEQ ID NO: 991321 - protein, 59 aa, Homo sapiens
MSHLGTLTAIQCMACLWPLTDVQVVGSMNSNPWDGMRLAIPDPLWRTTGHQYVCSWPNW

SEQ ID NO: 991322 - protein, 142 aa, Homo sapiens
MTDGTYHGDHNAGDHHACSQLDTKRSEPRSSASMSCSCRNNPLHYPKWSMTSAQPFYHRPGGYDVSFTFAPGSPSRGVALRFLQTTFDPITLEQSARRGETYSPDRDRAAMHFAMMRKLDCPEVGCERMLISIAPDTTATTV

SEQ ID NO: 991323 - protein, 42 aa, Homo sapiens
HEDPVTSSSYATACVETLAAHAPRRVHRVRCTPSLDKFLASV

SEQ ID NO: 991324 - protein, 67 aa, Homo sapiens
QTLVDPPCAQGDLTTDQHGSFDLLRFRPGPVHPVLRQPEGPPLPEGHHIDAELSADTRMNRPLQPRT

SEQ ID NO: 991325 - protein, 88 aa, Homo sapiens
MEQSPERKRRRQCRGVSVGASVHARFTVIERLERHTRGYTGKFRLDEVWLQFGYNILSGGASLLAKIVNDNAGAWFTAAHTAFSRASS

SEQ ID NO: 991326 - protein, 78 aa, Homo sapiens
YYHPKEVYTVILSLQTKAKGGQTSWQGVHAYHKWHGLDSGPSLLTYKVRAPRNTHIKNEQISNTVLDDEMRMQMTILP

SEQ ID NO: 991327 - protein, 61 aa, Homo sapiens
MVTWSIRAFMGWQSYRGWSGDEVRGQRDHEVLGTVWPMLQFGKAKVGPVKKVWNGVPRLAV

SEQ ID NO: 991328 - protein, 67 aa, Homo sapiens
LNAYSTGIPRRSPIQCTNQALTLLCFLEIMASCAWPGFMCLTMASCAVTSASCAWWYLSSEFCNQWS

SEQ ID NO: 991329 - protein, 57 aa, Homo sapiens
MSTVPLTPIPQQSTIVKHKPCSARVVQNEGVQPSPGAQGPDSSRGHPVHGCACSTLV

SEQ ID NO: 991330 - protein, 110 aa, Homo sapiens
LKPGKYNAGVLVDPILFRMIQAKEASLMSPRASEQLPLPLPLQVHHATYRQVGPKYVERSPGPLDEEPSALRVNVELHKLGVSHARPDKRNTIIKVCQALSNRGLSKECY

SEQ ID NO: 991331 - protein, 37 aa, Homo sapiens
CDQLLTDSAKNLIIFLGDGMGVSTVTAARILKGQKKD

SEQ ID NO: 991332 - protein, 75 aa, Homo sapiens
AYQLRFTVWREVRLRGCCTRVVVTTPTDFPAFLARFVTETTSVAGVSVLHVVKRGRLHSMPMVWKLPLTPQLVRR

SEQ ID NO: 991333 - protein, 63 aa, Homo sapiens
GPVPGQPRSVIAFGVPWGHARAVRVHGQEWDTGIRGHAVRGLYTQASRSTRLDSVSEHEASGA

SEQ ID NO: 991334 - protein, 45 aa, Homo sapiens
MRIPPPYHVAATASDSELDAAEGAGVSDTADVQLVAVWTEEILAL

SEQ ID NO: 991335 - protein, 43 aa, Homo sapiens
VLLWIPARTTLRYDVVRLCWCCPVGLLLQVLVGGTWKRRMPPR

SEQ ID NO: 991336 - protein, 96 aa, Homo sapiens
ITVLMRRITCGSYAQIQAVLILAELNHSEQPSSVTNTSITSSSQSHASVTNLLHRNTHHNRRVRRVTNSPNNRCPRYGVSPHKQHKLLTLTCPLCY

SEQ ID NO: 991337 - protein, 34 aa, Homo sapiens
AGDLAARAVAPGGATRLTDKAVKDYSAYRSSLLF

SEQ ID NO: 991338 - protein, 88 aa, Homo sapiens
PVTVGYPFLCGTGRACVWPVLRYQICCHHGPFRVLGNSWLLLNQGELGLQDQVWSRPKYSPGSAWIRCQLSESGFQINSRPQAGSGPI

SEQ ID NO: 991339 - protein, 44 aa, Homo sapiens
AGSIAKRYLEVSTAAHVSTELVHGRHAPEVVEYTYDQCSSLNWY

SEQ ID NO: 991340 - protein, 70 aa, Homo sapiens
GLTTGFAPMKGGEESPTAIRGALDTLHQLDIDGGILNAHVVGLYSIMGNKDLWPMMLSSILIPGLMQCIE

SEQ ID NO: 991341 - protein, 51 aa, Homo sapiens
YRPYFRMMSRRAPPSPLFVAQLEMYEGFGSPWEWVEAMQGLPVHCTATYGD

SEQ ID NO: 991342 - protein, 39 aa, Homo sapiens
VGRKSRLQLAETVTAFQSGQLTPVIPEFGEAEAGELLEP

SEQ ID NO: 991343 - protein, 39 aa, Homo sapiens
MSTMCVFSAAGTWLRAVGGLAAAGRKGLLAPVVAAARRG

SEQ ID NO: 991344 - protein, 34 aa, Homo sapiens
RPFHNLQMSFVLLAPSLPSTMILSASPAIVDMER

SEQ ID NO: 991345 - protein, 57 aa, Homo sapiens
PRTVAAPAPDVPAPGFCLFCLPGFKRLVRSKPVPAIQAFDHAYVPMPNRAHLVGLLT

SEQ ID NO: 991346 - protein, 36 aa, Homo sapiens
MGTADVAYQVNSARPKLNGSPNSFGSVKELPSDPPG

SEQ ID NO: 991347 - protein, 43 aa, Homo sapiens
LLYDDPPAVPVAMGAREDGVLEESYVVSQWSTYGQSVRLAGRD

SEQ ID NO: 991348 - protein, 38 aa, Homo sapiens
SEDPPLYSCACGSPGSVAFLHCLPRAPISCIWIRGSEP

SEQ ID NO: 991349 - protein, 60 aa, Homo sapiens
MQPARFNQCNTDTRQRGHLRDESGPMKCSGSHVGRGNHHTCSTPRQAGTYAHTVNRNWYG

SEQ ID NO: 991350 - protein, 33 aa, Homo sapiens
LEDPPMKKIKKIKEHETRSAATSTRYRRNWYGG

SEQ ID NO: 991351 - protein, 33 aa, Homo sapiens
SGTECLVSAQAWSCWSALHGSYQQQSLMGEAKK

SEQ ID NO: 991352 - protein, 47 aa, Homo sapiens
MLDKGSLAVSWAILTEYGHTQDNFSSGIWISSYTDLLTNGCFLYTED

SEQ ID NO: 991353 - protein, 60 aa, Homo sapiens
DLTGSRSRHCTASQAPAVLLLAFALLCLPWLPSRLVPSQHRFLFTQASSACRVTQLAHSV

SEQ ID NO: 991354 - protein, 47 aa, Homo sapiens
VGTEARYSRLKRFSYFSLPSSWDYRSAQDAIFPGDPRAEAVAIKTAM

SEQ ID NO: 991355 - protein, 80 aa, Homo sapiens
TQVFMMQHPTEPYESHSVLLAVPSDYRHTHASRLIRTFPMEPMWPLTWLGSTYEYKGASLKSQLAGGKVLVCLSNYVLVL

SEQ ID NO: 991356 - protein, 63 aa, Homo sapiens
CHIVSFTDDLVFTGVIMATGYRSPSQVGAPSYSVLHEQLGSGSYYEGISQMRPFAPRDVGTER

SEQ ID NO: 991357 - protein, 59 aa, Homo sapiens
MSHGAGETGPGRRRDGTGGDGSLPGVRLPQLFSENQVATQEVLQGPVSFLPPVGGGFSG

SEQ ID NO: 991358 - protein, 105 aa, Homo sapiens
GGQRNLQWGRAQTGHGLGGILGDNATSSGGAQQTGHGLGGFLVDNATYSGGAHRQGTAEEESWGTMQPPAEARTDRARLRRNPGGQCNLRWGRAQTGHGLGGIPA

SEQ ID NO: 991359 - protein, 38 aa, Homo sapiens
MDRYLITVPLHHLSPCTIYAEDRYRDTEVVSVFVRIPQ

SEQ ID NO: 991360 - protein, 34 aa, Homo sapiens
TECLSLTCRAALPQRGGVEEPETEDGLRNGMRLQ

SEQ ID NO: 991361 - protein, 42 aa, Homo sapiens
GPVLCLREMLLLAICIIGCQGPRIHPDERGLRLTRSQAGFMT

SEQ ID NO: 991362 - protein, 79 aa, Homo sapiens
MRIPALYQLLQVAWQPKSSNNRYDGLVTPFAITKNHYSSQTGPSYDQEEEEDRRMKSTYPWNEDVIWDEPSARKSYSLK

SEQ ID NO: 991363 - protein, 94 aa, Homo sapiens
AYSRGLRQFSPISVDGKYNRVLYRDIPLPRDRQETDAFFLSQLQRRHSFLLYYILLSTDPLRVSGWGMVRSFPSREAIFQTITWGESLDNTWLS

SEQ ID NO: 991364 - protein, 61 aa, Homo sapiens
FSSSCTDLFLIRSRCQAKRGQQGQGSEADWSIQSPHILIKNITLKGDRYVGDANNELDTYA

SEQ ID NO: 991365 - protein, 34 aa, Homo sapiens
LILTPTNTVIGQSKIFFLYWLLLAHLEEERDLND

SEQ ID NO: 991366 - protein, 46 aa, Homo sapiens
NLSLSQLIITSTIKCFNEAPAFLVPPVDGYVMVYSPEEPNDQPDVA

SEQ ID NO: 991367 - protein, 51 aa, Homo sapiens
MSNSALVAWVALEEGRSPRRLTDRGDLNETLGPGAVVSGIMQRNPSLVELA

SEQ ID NO: 991368 - protein, 111 aa, Homo sapiens
SPPPVSKLRLYGSWNPFSDPISTPLPQSPKPYSMSSEAQSVISKSVIFYLLSLCTLHLCPKTFTIFWNISQTILLEILEIPAFWNRGQPEENIKEEEEHEAAEALRPGERR

SEQ ID NO: 991369 - protein, 60 aa, Homo sapiens
ANPALVVRHAYSDEQVDGCFAGQHVGLGQLSALAGYDLEWREDSQVRAVSPRQDETLLEI

SEQ ID NO: 991370 - protein, 52 aa, Homo sapiens
NQLGPDMQRTHHFSYYGAHGIIVVYDVTDQESYANVKQWLQEIDRYASENVN

SEQ ID NO: 991371 - protein, 55 aa, Homo sapiens
RIPGVKVNLHLLRSLDRMYADLSAVGAANYTVWEKIPSMSNNLVPNSCCINVTLT

SEQ ID NO: 991372 - protein, 82 aa, Homo sapiens
QPARITPRTSEAELALRDRAVPSSLGDSSEAPSQKQTTPKEHKKQKYNKNIFKGYKSYVELNKFLQSEHTHIISIRSNRIEN

SEQ ID NO: 991373 - protein, 101 aa, Homo sapiens
RIPTRSEYLLPSEFSKTPTINNVLLFYCVLSLYILFGFSMVVPKIRVFCYCPKGKSLADNNYGCVPLLEDSETRKNNLTLDQLQDKVITGIAREKLPKVDI

SEQ ID NO: 991374 - protein, 35 aa, Homo sapiens
LGTGVSTVQLPRLDIQRRRFLSGNTLTAPKAKVCR

SEQ ID NO: 991375 - protein, 41 aa, Homo sapiens
MTRTSRDYSTHATTLTHLPSHLRFSRTYCILTPHYSHTDND

SEQ ID NO: 991376 - protein, 80 aa, Homo sapiens
SVPCEPCVRYRYAMEAHTTYGVIGVKVWIFKGEVIGGRQEELKPVAPAPRKKAAAKKGVRNMLQPKRTKFRKQMTGHNRG

SEQ ID NO: 991377 - protein, 132 aa, Homo sapiens
MGIINLAFKVYNTREEAARQQHISELQLLASAVRQNPAASPAYKNFKTPELQRPGIPPGPPAPGSCFKCWKSGHWAKYCLQPGIPPKPCPICAGPHWKLDCPTHPAATPRAPGTQAQGYLTDSFPDLLRLAA

SEQ ID NO: 991378 - protein, 39 aa, Homo sapiens
LEDPIIKFLFTLILLLALYLKYAVSSLSLTFYPLRVENI

SEQ ID NO: 991379 - protein, 111 aa, Homo sapiens
MSFLEDPQALTFPLGFLHLKKKSTSRARWLTPVIPTPWEAEAGGSRGQEIQTILANTVKPSLYKKYQKFCQVWWHMPVITATWEAKAGESLEPSRRRLQSAEIVPLHSGLG

SEQ ID NO: 991380 - protein, 59 aa, Homo sapiens
PPYSCDNIGLSAAAALTSANCHAATEVISVMNRAKKAGKSVGVVTTKRVQHASPGVNLT

SEQ ID NO: 991381 - protein, 36 aa, Homo sapiens
RVQLRNNKIERGLSIIPSCGWAVPGPGFLEAFANCG

SEQ ID NO: 991382 - protein, 87 aa, Homo sapiens
QVPEVEHSTAYLCGVKGNFQTIGLRAAACVAVATLTRGNEFISVMHRAKKAGKSVGVVTTTRVQHASPGGELYAHTVNRNWYGVGYL

SEQ ID NO: 991383 - protein, 39 aa, Homo sapiens
MSIQSIPRSLTSHLFLSDIMTLYVLISEENDAIEWISVD

SEQ ID NO: 991384 - protein, 72 aa, Homo sapiens
MSNGINNHDENARHGGVIGFQYAKVKPHMLIHDYSLQAWDHSATDFVTHAGVSSRMCLPAGQLAGNPKSPRI

SEQ ID NO: 991385 - protein, 35 aa, Homo sapiens
RAQFDVRFYLVAILFIIFDLEAAFLYPWAVSVFKL

SEQ ID NO: 991386 - protein, 52 aa, Homo sapiens
DTTYKRQIHNRLIQPIYIVVKEMHMHITKVTVHQSWQKYKSSENNRMVTSTL

SEQ ID NO: 991387 - protein, 72 aa, Homo sapiens
EHTANNYSNNNHSNTQTSKLSRYSFLRFEDILDNLRLEACKYGLGPDGTGRVEIYVDEQKYDTYKDTYGHWV

SEQ ID NO: 991388 - protein, 67 aa, Homo sapiens
RITSTAQCAGIRYGSTLQQKLVYDSILKYDYLKTKVVKERHTDWYHVGHVQHGSRNPSYTNKLDIST

SEQ ID NO: 991389 - protein, 72 aa, Homo sapiens
RVQLRDVEGSKEFYTWEAWMILLEDRKGSQSSAGCEWSVDDQCEGSTQKYFFNLSSSAIVMNSFPAGGIGYG

SEQ ID NO: 991390 - protein, 40 aa, Homo sapiens
MIPLQGVRPGLALIVVAAQCRQVHSGKSVRCPWGSVSSRV

SEQ ID NO: 991391 - protein, 34 aa, Homo sapiens
TLSTHPESRLYVTRLLIYCSVETTCGVSVDQSSA

SEQ ID NO: 991392 - protein, 54 aa, Homo sapiens
ASHTRQCNTSAIIEGREQSQWALISQKGRRKLRTRDEDEKKRGSGGTASSAGEL

SEQ ID NO: 991393 - protein, 45 aa, Homo sapiens
STFTNNLVYDTSDSDDYHLLKDLEEGIQMLMGRLEDGSHLTGQTL

SEQ ID NO: 991394 - protein, 36 aa, Homo sapiens
LRSSGQLVEHSSYDWMCECPSRTGLREQWIPLRDSA

SEQ ID NO: 991395 - protein, 36 aa, Homo sapiens
MESRRARSTLFQKPYKLEVDNSDVNFMGQPLYLTRV

SEQ ID NO: 991396 - protein, 58 aa, Homo sapiens
KNGNTNQKGAHPTADGSAEERGATEAGGFSAKEKMEKPVGPTATICPSLSYPFCLGAC

SEQ ID NO: 991397 - protein, 52 aa, Homo sapiens
MSSRRPERRRPPMSLKQKDKKLSEILLQCGGRAQDVPSSTRSSAEKGNARVK

SEQ ID NO: 991398 - protein, 30 aa, Homo sapiens
MPYVGGTVPGKAAMWRSCLAFRSRKFSDSE

SEQ ID NO: 991399 - protein, 41 aa, Homo sapiens
AARLVYASNSVTVLVFTSFRRCSQLRGSRSSTLACTIQFPE

SEQ ID NO: 991400 - protein, 64 aa, Homo sapiens
QARYPASLALPHPCFSELKSHYKNSVTLPDAVTHTCNPSIVEAKEDGSRGQEFKISLGNMVKPH

SEQ ID NO: 991401 - protein, 66 aa, Homo sapiens
RLMVSITPSTIHSPTPVHTTHISLTPFPCHSSPHAGHQFIQQASHHDLTHPTSTSTHPRPFAITPS

SEQ ID NO: 991402 - protein, 40 aa, Homo sapiens
SARTHLHVGSGDTEGMQSFPVQLSDDLPTALLQRQLRLRG

SEQ ID NO: 991403 - protein, 36 aa, Homo sapiens
RHHAIMSPNHPTGQCISHCKASGHGASLSQSHLPGH

SEQ ID NO: 991404 - protein, 92 aa, Homo sapiens
REFIILLREFIILLREFIILLREFIILLREFIILLPGSDDAGLKTQLLGRLRLEHRLSPGDLGCSALCRSGSRTKFGINMVTSRERWTTRLP

SEQ ID NO: 991405 - protein, 64 aa, Homo sapiens
REFIILLREFIILLREYIILLREFIILLNSSSAARNQHPAIMCEQTLLLPGCQPLTVCCAFCQP

SEQ ID NO: 991406 - protein, 102 aa, Homo sapiens
REFIILLREFIILLREFIILLREYIILLSRSSVVQTHHPPIMCGQTRLLPGCQPVTDCCAFGEARYCLTRDLACLEAWSHGPSETSFLQGDDLSAAKETLFS

SEQ ID NO: 991407 - protein, 35 aa, Homo sapiens
GTAYVLYITSSPRHHHITTTIITITSVTVITTAII

SEQ ID NO: 991408 - protein, 120 aa, Homo sapiens
LILLYGRTPMYVSHTPMYGSGWEQGMYGSQTPLQDGSRTPHYGSQTPLHDGSRTPAQSGAWDPNNPNTPSRAEEEYEDAFHEPTPAPQAYGGTPNPQTPGYPDPLSPQVNPTIQPADARD

SEQ ID NO: 991409 - protein, 134 aa, Homo sapiens
MIGNPDSSVHEFKASGSSRSVHFHAVCGCSRTTAAGLMSCQRPPGPQGLSHCLSWSEACQPFPGHRLAWLLYAASWGPTVAESVASWRLSDGHRVLAGACCVPALLCICPRFLPGHLLPTLTPSPLLLAFCLKD

SEQ ID NO: 991410 - protein, 88 aa, Homo sapiens
VRSHAQFSAPLQTDPRVWVCDRDNDCVDGSDEPANCTQMTCGVDEFRCKDSGRCIPARWKCDGEDDCGDGSDEPKEKSVMNAPVAIPV

SEQ ID NO: 991411 - protein, 44 aa, Homo sapiens
VWNRCLVALRSRRRQEQRENHSSGGRLGIWGARECGTGGTTEKR

SEQ ID NO: 991412 - protein, 106 aa, Homo sapiens
MHSWKGDMLGVSLFSAAWYFRFLVVPSESLTPPLFLTWGCDELGGGALSSFTWMMAEPVGDAWKHGASRTLFLFADFSDLSRQVVSGPSVGSGAPHINVFGTCLLK

SEQ ID NO: 991413 - protein, 53 aa, Homo sapiens
ARYQSLYEGRWASLMLGEQVDADLIAQDVRLYHRRRADLRRGDDPQAGEWNGD

SEQ ID NO: 991414 - protein, 33 aa, Homo sapiens
PNDLTEEEGREKLIQELVTLIEQRNAIINCVIG

SEQ ID NO: 991415 - protein, 45 aa, Homo sapiens
LTTSCEMLSHCRYTSVSVTNVYAGVRNGYLARLCVDIHGSLSASF

SEQ ID NO: 991416 - protein, 51 aa, Homo sapiens
STTSQNGSPVYEEPPFPAHSQEGTEELPGLSSSPDQSESSSGENHGVFGER

SEQ ID NO: 991417 - protein, 138 aa, Homo sapiens
QLKEEHIAEDSDRKYEEVRKLVILERELERSEERAEGGREPSPDSVEEELLNLDQALKCPDWLRGGVFHQMKINMKRRSNLLEEKLKEAETRAEFAERSVAKLEKTIDDLEETFGSAKEENVEIHQSLDQTLLELNNL

SEQ ID NO: 991418 - protein, 63 aa, Homo sapiens
VLWVSCDPKYTLQIFLGPAKESLRAGTCGTVAYGVQALEETQVYGERDWTSKYRPGAGVGGER

SEQ ID NO: 991419 - protein, 71 aa, Homo sapiens
VEATEGLGDDALGQGQEEGGAGMKKKIGAPPELDISPGAAGWGLKMVSLGPQPREQVQLRSGVITLSFQLI

SEQ ID NO: 991420 - protein, 40 aa, Homo sapiens
ELGLRNLVFASFSNGHGTIQESIQSSESLLSSLHARPLGL

SEQ ID NO: 991421 - protein, 36 aa, Homo sapiens
MGEQQKHIGYGDFVACELRSWDWVPILIGGYYKLRY

SEQ ID NO: 991422 - protein, 61 aa, Homo sapiens
NLLHELRFCSTLTLRCYDIAVARYTFYSTGPQFCADYLGRPRWSDHCGARVCRCPDCTRYG

SEQ ID NO: 991423 - protein, 75 aa, Homo sapiens
PSNRARYQICREPKCLRFSKDALAKAAVHSSAKKPWGTQWAANPCEPNDQCYMTHMNNCDNCDSVYPTSQHTQGE

SEQ ID NO: 991424 - protein, 50 aa, Homo sapiens
DQMMRSVDEYADLYWVGATQKEVRSTVTGTDVEADAAVAKGDCTVRSLHH

SEQ ID NO: 991425 - protein, 36 aa, Homo sapiens
MRLMHRCTLANSFLYACLCGMLRAQDTSNNHQLWIP

SEQ ID NO: 991426 - protein, 73 aa, Homo sapiens
MTMALKVLEKSDGELKLPIPASSMPQQIGIPTRSLTQVVHSARRRIIVSPVPESRLRQSNVFRSDITDAAAAK

SEQ ID NO: 991427 - protein, 57 aa, Homo sapiens
RILKNPGLHSGEEQPRWQLFRPQRKKGAEGLRFGYINFSFHGGLLIFLLHLHYYQTL

SEQ ID NO: 991428 - protein, 133 aa, Homo sapiens
VTLRSLPLRDCPRGFPFGGSGPREATPSRNLAGWYVLWFKPELRAHPRANSNSRHLTDLDSCLLAGMDLMIYCTPGKRHGQRNRISNSKIPPNSHTAASSCLTTLRKESYTKVSSKPPPRPNLPSGPCRPGLA

SEQ ID NO: 991429 - protein, 44 aa, Homo sapiens
KPGCQLFTPHRRKAAEGLCSAYINFPFHVGFLIFLLHLHYDDTI

SEQ ID NO: 991430 - protein, 97 aa, Homo sapiens
YRNSESEGVSRYGQGGNTGLNTLLLSPVQLIRVWACFSFCQLRTWTLVLLRWDMATGLGLGSPGACCHHHSRRCTMALFHGIAAGLQLSGVVHPASP

SEQ ID NO: 991431 - protein, 79 aa, Homo sapiens
MASRPKCKKLIKGWSAGYTCNPSIWEVEASRSPGQEIETILANMVKPHLYYKIQKLAGHCRRTPNRPSYSSGTRAPSFK

SEQ ID NO: 991432 - protein, 39 aa, Homo sapiens
SVYLVSRLYCLSHTHDALLTNYGLLYCFSEGHRQGGTDA

SEQ ID NO: 991433 - protein, 41 aa, Homo sapiens
SAGPFMGTEMSSSWDEAVVCGSGWQSLKPSRTSPGETEEPW

SEQ ID NO: 991434 - protein, 70 aa, Homo sapiens
DELDPMQECSDASQFSSLRLRAQVISHLSPPSSWDYEHMPPPSPNFCIFCRDGVLPCWPGWSRTPELKRS

SEQ ID NO: 991435 - protein, 48 aa, Homo sapiens
IVTMDLGDDVSCRLINYNKHTTLVGDADDEGGCACVGEIHGKFLCPFQ

SEQ ID NO: 991436 - protein, 113 aa, Homo sapiens
AQAHKKAFSEEPTYGAEIKPSSRAGRISLTFSSDPGSSPSETVTSGHRAMKDELNLLQVQSTECGEMAFCIMDSKPFHSGPWIARSETFALPPVVDGDKQLPDSQECKPNKED

SEQ ID NO: 991437 - protein, 85 aa, Homo sapiens
DYSKKLPWLQGLEMLEEQQLDLHSAVFFAKHYRRLPSLDSLEARWTATLQSSCEAATTQTTQTDVRPEVLAKYGGLPKIGTVLLM

SEQ ID NO: 991438 - protein, 79 aa, Homo sapiens
SGRPLPMAQPAHRTYNLQERRRIASMTGAEQTLMPRIPTDEIEAHTLATADLDLMNSHRLEDVPGVRRHWWRKNAKGST

SEQ ID NO: 991439 - protein, 124 aa, Homo sapiens
VTAHLELWVWASTTTTTTYSLYTTLPSDDTAVHINLFTTFFIDCIVALCLAYDRKKVSKAAILARIRRTGDGNSYVADLRCPSGSFFINQSGRGFKCLLYYLTAYCYQDANDDHFISFQYSILL

SEQ ID NO: 991440 - protein, 72 aa, Homo sapiens
MGNGGDEDENQSLKERWALSEHAEHLYILTTKQEASSLHRTEEEVVRKERHAVDPGVSQLLAYMKLRCSTQH

SEQ ID NO: 991441 - protein, 108 aa, Homo sapiens
LGGRFSINAAQAMTPARAALIENLPPPSSKSEILSFPGLAGFFRIWISNFALLAHPLYEVAKGPPNEPLNPSHNILPSFHKLQTALVTASAPSLPDISQPFTLYTAES

SEQ ID NO: 991442 - protein, 36 aa, Homo sapiens
MLIRESSYLEQPLSRAHTVLPELGPLQLLVVRVAGI

SEQ ID NO: 991443 - protein, 54 aa, Homo sapiens
GRSGCDICHPIDRQELIRLIWLARRVSPSSLTAPCASLPKLRARSKRTTIPDRG

SEQ ID NO: 991444 - protein, 36 aa, Homo sapiens
RESPLYTRSLLSYTRDHSRHNISASPQYTQCNQTLS

SEQ ID NO: 991445 - protein, 101 aa, Homo sapiens
MSAPLLAGVAGTSGSEYQLRFTCVGLGPAGEACCTRVVVTFPLTSLLSWPWFITADDLVAACRVALVKAGGCTQANGLEVALNPAQVGRACGSTVLAPGTA

SEQ ID NO: 991446 - protein, 36 aa, Homo sapiens
GEWKANDQQILPTSDGWLSLVPACYNRACHELYALT

SEQ ID NO: 991447 - protein, 40 aa, Homo sapiens
PASYHSSRSLILKNNQKYTPYYPTIYYSHSCSAVYLIGLQ

SEQ ID NO: 991448 - protein, 37 aa, Homo sapiens
MHNMLHAIASYPWMTAYDLYNDLPDSSLDSYSQPEWS

SEQ ID NO: 991449 - protein, 83 aa, Homo sapiens
LEYASDCACCWRRNMPPMPINYSWSIHSPAIVNNPVPLEVYLSMRKFIAPSIYRCADLSMMIIACLDPSIEPRFIITSGLYPM

SEQ ID NO: 991450 - protein, 40 aa, Homo sapiens
MIPSGSRSCALAQSCLKYSMRSSVCATAMLAPRMFHRPQC

SEQ ID NO: 991451 - protein, 39 aa, Homo sapiens
ILEDPPRYRSERSSESAAAVDLAARIIGIGHFGHQRAVL

SEQ ID NO: 991452 - protein, 37 aa, Homo sapiens
SSQELHQIEIAIFHARSGCNSVDQLVYAMRFHLNIVQ

SEQ ID NO: 991453 - protein, 34 aa, Homo sapiens
CCFLLLCYVFAILDRINIGLRPAADAARHRTSRD

SEQ ID NO: 991454 - protein, 96 aa, Homo sapiens
VKRRCTLIRDVVLEFPCGSVTPYSAELPARHRSGRPAAASEGKVLVFMTVSPVGPGYRVAFAAVSGVRVGGMRLSHTFPDPGTTAHRDEWVTGCRG

SEQ ID NO: 991455 - protein, 34 aa, Homo sapiens
AAVKEFHASILHMQLQSAQDDQVAAAFGSLARLR

SEQ ID NO: 991456 - protein, 33 aa, Homo sapiens
MKYSDLTYLFLSDTSSGLRLETNRYRCSNPANR

SEQ ID NO: 991457 - protein, 54 aa, Homo sapiens
MLRGRGLALLLLAVQCLGTAGALHGSLRKSKQAGSAKWFSPMSPDGVSSQRYLR

SEQ ID NO: 991458 - protein, 81 aa, Homo sapiens
VARRRRVTLTDVMETIAGYLPEAGEEVDARHDIQQNEDGSWIANGYMPLEDLVLYLPMPLEEKREYHTLAGLLMEHSQRVP

SEQ ID NO: 991459 - protein, 43 aa, Homo sapiens
VTLRGSLLQRNLVVPRLPGRSPLLMPNLVLDTRSGIAALQPRT

SEQ ID NO: 991460 - protein, 43 aa, Homo sapiens
LSSRNRSRIIFSSSYSDYNCLISRFCWSFMVSSILLNSRTSVL

SEQ ID NO: 991461 - protein, 39 aa, Homo sapiens
SLGEWAVPNLGPITGRPQEQFDLRLFFSHGCDWRDRYEL

SEQ ID NO: 991462 - protein, 63 aa, Homo sapiens
VSSRNLAGPPSPGQVSILMPNLCADTPSALRTTSRTTPGLIVDPPISASHNADITGVVLPTVA

SEQ ID NO: 991463 - protein, 38 aa, Homo sapiens
MMLHVGGDTSERIPVPLILPDLRRERGRPADGRMPMQY

SEQ ID NO: 991464 - protein, 47 aa, Homo sapiens
YPLEPGGDDYLESHTRVRSKCISGKCSNWSQDAVFREEKRHSQPCSW

SEQ ID NO: 991465 - protein, 33 aa, Homo sapiens
STFSFEMPPTHCQAIFHPHYTTKNTLTKITNLP

SEQ ID NO: 991466 - protein, 59 aa, Homo sapiens
MTPGGHGNCDLTCDPETPDTSYQCWMIGQSLPMTHRFQLSESNRTLFLFGVTQYSAGPY

SEQ ID NO: 991467 - protein, 66 aa, Homo sapiens
MGDETDLVLIADTIPFLVPEYCAGWFEFAKHDRVEVISCSVIGVCWVNSGEVWAMEEIQGVWVTAA

SEQ ID NO: 991468 - protein, 121 aa, Homo sapiens
LFLRFPVCRCCGQTGCLTVAWWFVHSSVICGDSTEVLGDMLGRLTQLILELLSATGGVREPEWFLVAGGVSLSVNDQNYFQMHNACGWLEEILLRTVYPELFVEYGIWSGGGEQVVSDFEN

SEQ ID NO: 991469 - protein, 69 aa, Homo sapiens
YFSSCTFRGRDVASRLCLLLACAICILGLLIFLEYTYPAIVNNPFTSMNYSLALRKLSIVAESIRCGTI

SEQ ID NO: 991470 - protein, 155 aa, Homo sapiens
EPNDDLHLTVIITEAFLTVFEQPKTILTLVDLMTEKKKHETKRSINDEIHTQLLAHILTGIEDICGHYCHHHWRDQHNQLKKKHVKKRPIAVERSKKPQLIAFYHKTEMNQAIELMESVCSDKIPSAVSTVSMQNIHPKSLPSERILPALSKDKE

SEQ ID NO: 991471 - protein, 69 aa, Homo sapiens
LTTKLAPTICLDHMTYKGKGMPIVARERARRLYYMCDLKTLLGSELRLCELVKQYQWLFIISFFPLSFT

SEQ ID NO: 991472 - protein, 105 aa, Homo sapiens
LEQLLVWVCSQLKWNKYLIVVTDVAPPVMWLQWNPVGVLEDAVKLMAKRVVLSKSSRVAITPDQLEPRLSIICHGPHVTGATSRLADWGQSRDAEEAISQAIQRL

SEQ ID NO: 991473 - protein, 47 aa, Homo sapiens
DCPGLTGTVCMRHVTTRVASELQERGTSVKFPCTDRDACGSFNRLRG

SEQ ID NO: 991474 - protein, 33 aa, Homo sapiens
MRARGGGDGGRSEEQLQSPHEPPAARSQDGLDS

SEQ ID NO: 991475 - protein, 41 aa, Homo sapiens
MLRLQCASILPLCSSLGDSKPVSQKRREGWDIIDDRPFNAS

SEQ ID NO: 991476 - protein, 60 aa, Homo sapiens
PLYQLLGQGNFQTIGLSAAACFNQCTLTRGNKVISVDDIGPSKAGKSVGQLVTTHTECMH

SEQ ID NO: 991477 - protein, 44 aa, Homo sapiens
LSVSVGVATTPALEGCACVHGAVTDAVEARSLGLKPKHIHIYCA

SEQ ID NO: 991478 - protein, 44 aa, Homo sapiens
GQFYDGSPRCTPFAAILVLCPGAEHIHHSTPWIFNGPADELHLD

SEQ ID NO: 991479 - protein, 145 aa, Homo sapiens
ALRQDLCQPSQFETLLFSKRKSLAKIIPISGTEKGSKKKEKERPEIYPPSDFEHTIHVGFDAVTGEFTGMPQQWARLQTSHITQLEQKKNPEAVLDVPKFYALHTVKPKYLSFTPPEKDGFSWNNSTEYPGNRSPPVVTEEEDHD

SEQ ID NO: 991480 - protein, 56 aa, Homo sapiens
VTVAPACLILNYFKIVKEELFRGDDDTDENQVQLGSPTHLLSLSLCGMVGPRNWYG

SEQ ID NO: 991481 - protein, 157 aa, Homo sapiens
GRLQDPRRTVGVSTCLELTGAGVWPCSYVALGQSASASACQTPAVRTESGVHTRAAAGHEAHCYGHHLSQPLTSSLELPGTGKTVTLVAAIKQVVKHLAQAHILSCAPSNSGARLLCQRLRVHLPSSIKRLLPQQDIRMVPEDIKPCRNWYGGGYRA

SEQ ID NO: 991482 - protein, 57 aa, Homo sapiens
MRLDGPRADLQGVELRDIAERELGTTCYPRLWNPGKELPYGPCLVDWRTILAQLVRR

SEQ ID NO: 991483 - protein, 149 aa, Homo sapiens
RVMRFELVHERDRLIAEVNKQLEFGKRTQAVVLDQEDALVRLLHEGQPSFTAVGITSYCDYPCPPAHWPEHIKSCTQSATAPQQEADAEVNTETLNKSSQGSSSSTQSAPSETASASKGKETSAEKSKESGSTLDLSGSRETPSSILLG

SEQ ID NO: 991484 - protein, 80 aa, Homo sapiens
LAGCDDWNELDKGLIPNNEHDLNYMPVFKMPTEDYAGDRADFWRMRVQRSGVKKNLRKSREDLTAVVSVSTKFPAYERVL

SEQ ID NO: 991485 - protein, 37 aa, Homo sapiens
TLLSLLLLMVYHQSWQHDHVVPKPFRPILGLLLDLRE

SEQ ID NO: 991486 - protein, 80 aa, Homo sapiens
LICSDLRSRRYVWSSHDTVKGSPCVHSGLSVYFYTWKTPAHLKHEDSQRPPVHAEPVLLSPQDFGGDVIRGSAESARCVT

SEQ ID NO: 991487 - protein, 43 aa, Homo sapiens
DHDPSMIVAAGRRVSPVRCMPPCYRFRRDVSTVLSSKYRYAGA

SEQ ID NO: 991488 - protein, 95 aa, Homo sapiens
RCTSCADISWLRSYKQYNISWELDVREVRNSSLRRRLILAKCDISKIGDENCDPECKHTLRGHDVCELSPYCASLRFVKKQHNGVCDMDRNWYGG

SEQ ID NO: 991489 - protein, 53 aa, Homo sapiens
KLEDPLGLPCYSALPCLDREDQEALTQMPRWMGVDEEEEDEDRRRQGRADETR

SEQ ID NO: 991490 - protein, 114 aa, Homo sapiens
SGIRGCMEVPGCLGRSLLQWWSPYGKHLLGHCGREMWGWTHPMQSPHCAWPNRAVRRGLLSSSPQNGRSNSLHHVPRKATDTQCKPMCQPGGELYPAKAQGWSCPRPWETSCIK

SEQ ID NO: 991491 - protein, 33 aa, Homo sapiens
PVRRPLLLRQAAGDRTYILPNAADFILCPALIA

SEQ ID NO: 991492 - protein, 39 aa, Homo sapiens
MALAILNGQLSTLLGICHVGLEGLPSRPFEAPEILTPVS

SEQ ID NO: 991493 - protein, 36 aa, Homo sapiens
EPCCSAPCRPPRCSWTPPLERNRNGADRFSPCVDCQ

SEQ ID NO: 991494 - protein, 47 aa, Homo sapiens
CWSEEYRIGGVKIASNSATAFRVGSVQELSELSEQVWKLCMMPCVDC

SEQ ID NO: 991495 - protein, 40 aa, Homo sapiens
LRALGNGGDSYTVPRPGSLYPQLAGRLAAPAEQRPPCVDC

SEQ ID NO: 991496 - protein, 33 aa, Homo sapiens
PAVPVAEIKNLFTKTIRSGTPPQVLRDPKGKSL

SEQ ID NO: 991497 - protein, 75 aa, Homo sapiens
VCLRCFTRLLLSNTHRYPGFLTMLCSKLIALHHLAIDSYQEFAETYSPKDQKYSFLHDSQNSFCYSDSIPQTSKM

SEQ ID NO: 991498 - protein, 70 aa, Homo sapiens
PLYSCVTTGGHRQSHPGRSMREDVLLTHLEFENRLRSLRAEELYSFALADKTVRGECVGSVRAALILREN

SEQ ID NO: 991499 - protein, 38 aa, Homo sapiens
DPRVQLAASRSRQLTQLRASYRSRIGLRFPYYIVSMQR

SEQ ID NO: 991500 - protein, 39 aa, Homo sapiens
MLSMMPHTGEREINGKPANAPPNMRMFANVPVLPVECGL

SEQ ID NO: 991501 - protein, 69 aa, Homo sapiens
VNIQSGHTYCKLTPQRVAHTLNADAGSQRHILMHAHTRTYQTQSCTHRHMLTLTYKHSSNMHTHHACIA

SEQ ID NO: 991502 - protein, 43 aa, Homo sapiens
CGVTAIFFWSSWNDRFLPATCEESWGPAVFLASFLSSVAEAMR

SEQ ID NO: 991503 - protein, 46 aa, Homo sapiens
SCNTTLEELDSVSFSGKPPWTHAHSGGHKATLLALDLRNSAMRGLP

SEQ ID NO: 991504 - protein, 35 aa, Homo sapiens
TRQRDSLELINYGKYKIRNKDLVGTICLTYEQRLE

SEQ ID NO: 991505 - protein, 161 aa, Homo sapiens
RADSRGYTAVLYPTEIKTTIRKDSKYLYANKIENLEVGSFLNTYTLPRLNQEEVEPLNRPKTSSKIEAVLNSLPTQTSPGPDRFTAEFYINILLMWGVEELVAFLLKLFQTIEKEGLLPNSFYEASIALIPKPDRKQNFRPISLMNIDAKILNKILAGYRA

SEQ ID NO: 991506 - protein, 118 aa, Homo sapiens
LGTHMLVSALQHPLADAMAMRDIYSVFNSNGAYKTGAHAHDEFMLMVPEHGLLRYKDEERGRTTSVIDRQFVLVPPQSSHSSSSLTASQGHVAFYVDPDYMHYALRDLSGDANRLLRV

SEQ ID NO: 991507 - protein, 34 aa, Homo sapiens
AGVASNDDYDAMMIITIRMVDIYGVLANCQIALE

SEQ ID NO: 991508 - protein, 148 aa, Homo sapiens
RQRLDLGVNNVFYCTGRASDRLSRARGSIALSGSCRNTSVGRQRKAWSLACSEFFQKNTYELGVDFTSKKRRGADNKSWVKATGRNGDTVYEIDLKAAAISVVPASELTTKRERLANKTFKTEHFNPKAVNEAALGPKNQAGLSTPPI

SEQ ID NO: 991509 - protein, 36 aa, Homo sapiens
MMPGSSLPNEHELYSVSSGSLSVSPLGAALRSRTCG

SEQ ID NO: 991510 - protein, 128 aa, Homo sapiens
HHSKYVDDLLLSSPSLKDSQTHTATALLNFLAIKGYRVSPSKAQLSISMMTYLGIQLSPGAQAMTPARAALIENLPPPSSKSEILSFPGLAGFFRIWISNFALLAHPLYEVAKGPPNEPLNPSHNILP

SEQ ID NO: 991511 - protein, 38 aa, Homo sapiens
DPIYAAQTLPTAAQDALYAEFPVVSNVHATAIKGHITW

SEQ ID NO: 991512 - protein, 40 aa, Homo sapiens
LFSQEYVAFLSPIHRSGGLIKQMFRKTGRLISLSEQNLVD

SEQ ID NO: 991513 - protein, 57 aa, Homo sapiens
AGTVYYFLGGLISHVGHYEGLLKVLIEIIIYVGSTKYISKALHDIVSSLCKSFLESC

SEQ ID NO: 991514 - protein, 123 aa, Homo sapiens
LAPILGPARITGWSCSAGFLQVAAAVVAQVDDHAVDFFLLQFCQDFLNVAGGALVVRITGAERFEVQVERRDHHHAQLVVLAILLEVEDLLLDGLIFELHRFTGDGHDLAGLVVRCVGVRNHF

SEQ ID NO: 991515 - protein, 43 aa, Homo sapiens
IVLCVCAERPCAGARVVVLCVRVCCASVCAVRLRVCCVLVCVL

SEQ ID NO: 991516 - protein, 61 aa, Homo sapiens
VGREATSPSNLNLSSDAAKSDAQRQSDELALVRQQLSEMRSHVEDGVLSVAPVSSPEAPPA

SEQ ID NO: 991517 - protein, 58 aa, Homo sapiens
PDRLKSQAPAYRYLEVSTVLTCRRNYVQGGIAPAVVEYTSDHGSIFNDIYGGHARVAH

SEQ ID NO: 991518 - protein, 56 aa, Homo sapiens
QLLSSPEREDAGLEVSLDVGTSVFYLLLSSVVVSCTGLALENLRALAQIERASQAV

SEQ ID NO: 991519 - protein, 139 aa, Homo sapiens
MSAAQYVYALKVAGLEDLCLSGFMEHGHPCHPAGHSGILCDVFIGRYYTVFDRDNHRVGFADAVRLKFPMLYCAASTEYRGESQMQEAPGPSWTLPDITHITPPAPLVLGAALESTAGPMPQTCLFLFLLVFPPPLWFM

SEQ ID NO: 991520 - protein, 96 aa, Homo sapiens
LICLWSFFLPMVVSSLLSSLVIPLEEENSQGMMGGYTLDSFARLEDRDLVLTLIEIRFSRWVEAISLTLQKRPQKSPKIPCNKKVNPLDFWSPLVS

SEQ ID NO: 991521 - protein, 57 aa, Homo sapiens
RRYSRSIFTSGSGVPSGRDRDVNSLKRRRVNFIKLFGALVVFDIQFHQYLWQYASAT

SEQ ID NO: 991522 - protein, 55 aa, Homo sapiens
VPCAIQSRVAGRRSADRSIALHLLLGHPYFDIVDHRLIDLLGALIIGGATGKNGI

SEQ ID NO: 991523 - protein, 44 aa, Homo sapiens
DSTADRHAREYLGILELISTEENTQSSRDHEEPILQPLPSTQPR

SEQ ID NO: 991524 - protein, 148 aa, Homo sapiens
FSTCRCIGGHSVGRGKPPRSASPAAALGAAVVAAMCITRPRVLRGPSNLVDGQSWQLSCSVGSDPSDLPSPRVSTSPCPPKKVPQRLRTSWRQGRCAEGLCNDCHPRAAGRVPQVLAGRRAACPSLIEPSVYTTLLWPLSLFRASPPG

SEQ ID NO: 991525 - protein, 51 aa, Homo sapiens
RIRPGRCMEEGQLLTLSQCDISLQGLWVWQAECELGPSPSSGTWWVPLFTG

SEQ ID NO: 991526 - protein, 180 aa, Homo sapiens
VHRTVVGGKSASPETGGGGMATASGGSDLSGSGAPPAGVGAQAAAAAEEEEREVVRVRVKKCESFLLSEFRSFAVDPQITSLEVQQHILIRAFDLSGKKNFGISYLGRDRLGQEVYLSLLSDWDLSTAFATASQTYLQLRVDIRPSEDSPLLEDWDIISPKDVIGSDVELAGKGSSRDEC

SEQ ID NO: 991527 - protein, 105 aa, Homo sapiens
MGRPGSSPVLWAQTRLISLVPGLIPPCPREVPQSFAISWIPGRVLRVRGNISRGRCEGSSSVQKACSLAQSDVTLFLHSCCAFPLGILSASQEPPPVASEHPPDT

SEQ ID NO: 991528 - protein, 43 aa, Homo sapiens
DGILACCLKELINFLLNFWGYIRYLVEQREAWVPPFFNHVEMC

SEQ ID NO: 991529 - protein, 52 aa, Homo sapiens
MGWSDVRHYKQWTFNYILPGACKSAHHVPVCVLGNYRDMGEHRVILPDDVRD

SEQ ID NO: 991530 - protein, 48 aa, Homo sapiens
CKNGLSSKEKEGSRGEEDTGQEEGGSRREPQVNQQEVQQLMDMGFTRD

SEQ ID NO: 991531 - protein, 68 aa, Homo sapiens
KNKRLRCVVCELDVPGPASRDVVQLQVPGEMIPLSVQEVEGDADLGRVQNLCVLLQGSFLLPLQVNPR

SEQ ID NO: 991532 - protein, 33 aa, Homo sapiens
MDGTIKEALSVVADDQSLFDSAYGAAAHLPEGL

SEQ ID NO: 991533 - protein, 39 aa, Homo sapiens
RGELQERAALNCWLYSSVGTGERKSSEAVGSTPVASSAY

SEQ ID NO: 991534 - protein, 42 aa, Homo sapiens
MRQITSARLLRLQRQVVWVRCGAPQVQGLQGRHRWELPELCM

SEQ ID NO: 991535 - protein, 55 aa, Homo sapiens
PLQLGTEVTEKFVKGHEPSGMAPRHGVELTTAAACEDIIIDTSSVVMTIDEETDS

SEQ ID NO: 991536 - protein, 53 aa, Homo sapiens
DLRIRVGRWVCTGRLHVLGSRCGLSTPGLEARPGRWRQVLDSSSVLVSLQVNP

SEQ ID NO: 991537 - protein, 40 aa, Homo sapiens
PQWHREERQDIRSEKRKAGVLIMQALVEICECPCSRSIMI

SEQ ID NO: 991538 - protein, 79 aa, Homo sapiens
LVHCRALQKADIGELQMLLPDRSSGGFVSEEYPAVWGASLPLLGGASQLGYSGVRDPLEEAVCLFSDLQLSARNPRVPS

SEQ ID NO: 991539 - protein, 79 aa, Homo sapiens
LLKAQDYNGYTQEIDNARATTRTEGFFVLINNRKKNFGTNTWRRHLSDLEQRLDKSQNDQEASRYNLQTLLDILDVKDL

SEQ ID NO: 991540 - protein, 102 aa, Homo sapiens
RSRRRPAEDVEERHQVFLVGALDEDVALGRQRGARPAGGLVAVVDGPVRVAAEGLHALDEDDAVRLDGDDGAHLLQDGDEVHDLGLDRRVAELGHPVVWSGY

SEQ ID NO: 991541 - protein, 37 aa, Homo sapiens
QIIIDIVRELARRVIRYAVRYPRVYNAIITFDIGGSG

SEQ ID NO: 991542 - protein, 170 aa, Homo sapiens
GVTALIVSADQFEVTSSVLRLYADIEVEQQVSCSVDTAGQEDYIDCGSPPPDTDVILMCFSIDSPDKPGKHSCEVDPKRVKHFCPNVPIILVGNKKDLRQDEHTRRELVKMKQEPVRSEEGRDMANRISAFGYLECSAKNKEGVREVFEMATRAALQVRKNKRRRGCPIL

SEQ ID NO: 991543 - protein, 33 aa, Homo sapiens
MSRPHEVLLPPPEYTLLPAPDTECSPDDLVVIE

SEQ ID NO: 991544 - protein, 139 aa, Homo sapiens
MEPAHVSGPYGPPPRVSSGFALCKEPTRVGSLHTWGCMGLLQVSLLTGLEELCGWAPTCSPLGQGVVVPFPLLRLHVGPTLPWLCWEVIFPPFMSHLQPHFGGISSLHLQEKIQSSLCECDDPESLHTVIILEQQDVKR

SEQ ID NO: 991545 - protein, 31 aa, Homo sapiens
MSHAESLRISVEVLLTTRTAYPSSTAYPSST

SEQ ID NO: 991546 - protein, 49 aa, Homo sapiens
MGRREVGPEVGDPVTFHRSYLKSSPDLFFKWVQEVYRATDKQGYSALEG

SEQ ID NO: 991547 - protein, 45 aa, Homo sapiens
LAEFLRDARSVKLLNMGSPVCEDVTDTLKRFFRELDDPVTSGWNP

SEQ ID NO: 991548 - protein, 107 aa, Homo sapiens
LEDAKETGRVFSDHYKRKELGVGGQRELTQLLLLLRYIYWIQVSDLHAQHTYLACPHGHIHIHTPTMHTEAHTDMHTYTQLYTTPVHNRCAGMCKETYTDVHTQQNP

SEQ ID NO: 991549 - protein, 88 aa, Homo sapiens
GHTKFYNAKTQALLTPKKGYREHHIPCMLTRLTRQGTELSFRVMQRYGNGQALEPCKGEPTVAPPTAQGLPQCLCTSTMAVAEGPGSH

SEQ ID NO: 991550 - protein, 38 aa, Homo sapiens
VVPEVVVVGHVGGRSVGASDPAQKRMNSSPDTKVRKSV

SEQ ID NO: 991551 - protein, 53 aa, Homo sapiens
RGREQVSSRTEVVFGSASVTPPRRADTAPPSPGEAYPITPARYLQGTHLQGTH

SEQ ID NO: 991552 - protein, 40 aa, Homo sapiens
GIVLVLKPDVQCDLLGLACCACHGEVCSALNLCVVSPVST

SEQ ID NO: 991553 - protein, 34 aa, Homo sapiens
MPLNRSLAEPKAQIWSQCIDGGHLPGSVCLQGSH

SEQ ID NO: 991554 - protein, 108 aa, Homo sapiens
MRLVNRRGKICTSSVIRLYKLSAYMIMPVVGSDSEGNNDYDWLIVDIGAVNCQYRVINWMQALCRRIHVIMLRNTNIRAANTGDYIGPSGCEEFTIICCDFLSRACRA

SEQ ID NO: 991555 - protein, 46 aa, Homo sapiens
LVLLESFFILESTTLEMTSDSSWPAHLCEPHLIIGYNVVYMAFLLA

SEQ ID NO: 991556 - protein, 36 aa, Homo sapiens
IYSKVFILLNNCLPYGFFSDLLGFFIFFLYIKVFKV

SEQ ID NO: 991557 - protein, 37 aa, Homo sapiens
RPSSAIIQHLQKTNHAAAVLGLTDTPYRLGKGWIYQY

SEQ ID NO: 991558 - protein, 70 aa, Homo sapiens
LSASAAAQETCCEITCTLRNPLRQQNAPCSEQGLTARLRGRRRVSANALLPLHCPSGRNLSRAPMDATTL

SEQ ID NO: 991559 - protein, 40 aa, Homo sapiens
RSRGYLTAVQQDCVTRTAVIECQCRSGFVLHDNKHSTSTN

SEQ ID NO: 991560 - protein, 154 aa, Homo sapiens
TSIVPAEPRWMTAMTVVMEPVRLVRWSAFFREGYPGRGGLGSIFVWASGNGGREHDSCNCDGYTNSIYTLSISSATQFGNVPWYSEACSSTLATTYSSGNQNEKQIVTTDLRQKCTESHTGTSASAPLAAGIIALTLEANKNLTWRDMQHLVVQ

SEQ ID NO: 991561 - protein, 69 aa, Homo sapiens
ARQATLLGCLFLWLGAGGGAAVSWPEGWQFFLCSACPVLCLEHSHLRVPCFFPAAVPWALIPPSGEVLG

SEQ ID NO: 991562 - protein, 69 aa, Homo sapiens
MRLMKPGVGEGVIVLLVEATCRALVHPGCDVVSTSMSTSLLNVSTVGTTFWLGMEEPDHPDCRWALTPY

SEQ ID NO: 991563 - protein, 150 aa, Homo sapiens
ATEYAVCLLVWGSGADERLPGQTVIRVYRDCVLQCEEQNRSGGALNHFRSRHPIYTHVKQAAPFVTTVTLTCMWVTVGLYLQEGHKVPQFHGKWPFSRFLFFQEPASAVASFLNGLASLVMLCRYRTFVPASSPMFHTCVAFAWVSLNAW

SEQ ID NO: 991564 - protein, 34 aa, Homo sapiens
EHDTIVLADTMRSPIECSEVVQRSVTYNLIQQIL

SEQ ID NO: 991565 - protein, 40 aa, Homo sapiens
MRIPYAALYNTALHDSGIGSTNVKREETRPHQPNIKDHHR

SEQ ID NO: 991566 - protein, 65 aa, Homo sapiens
PSLSSVLASPCVLASAVVLPSPVWLPSLSLPATFITEFALAHSWNPFAYLQHQIVSAPSFVPRFL

SEQ ID NO: 991567 - protein, 65 aa, Homo sapiens
MYALTQGRVPIIGVGGVSSGQDALEKIRAGASLVQLYTDLTFWGPPVVGPVKRELEALLSEQGFG

SEQ ID NO: 991568 - protein, 42 aa, Homo sapiens
RGSCRECRFYRLPVEKIETAKYFSRKVRVASDICKEPTRYRA

SEQ ID NO: 991569 - protein, 38 aa, Homo sapiens
SESLAGGRASGTIQVSRKVLGPLGQELCGPLQLLQAGA

SEQ ID NO: 991570 - protein, 132 aa, Homo sapiens
DSRGSTLPTVSYLLNHVLENSPLVDVINVLEREGTRGCGSGNEQRSHSFFSSCWHSCCSQDQFSEPAGRQPQIQIQPSVFQGRRTECRKPPGEQSHCQDHHHRECSEHHDEQDLMRSGMGEAMMQRQEPIEG

SEQ ID NO: 991571 - protein, 160 aa, Homo sapiens
MPNLSTACNEQVHCTRQRGPPHMYMLNPHACGKGAATRLCRRQRGPPRMYTLNPHTCGKGAATRLCRPQHGRPRMCTLNPHACGKGGSYTALQTTAWEATYVDVKFTCVWYRCGYTALQTTAWEATYVHVKLTRVWYRCSYTALQTTAWEATYVPVKPTR

SEQ ID NO: 991572 - protein, 35 aa, Homo sapiens
FFFVRVVRHPRRALEAKGEKLAHLFMVAAEGGRHK

SEQ ID NO: 991573 - protein, 31 aa, Homo sapiens
MGYPSESVMTIYSVYGKSEKRLLDRYALIAR

SEQ ID NO: 991574 - protein, 53 aa, Homo sapiens
RDFYYLIRLAGFFQVLFQVPGHYPPFFGSKTSRTRRPIWRPCSYGALEDIISV

SEQ ID NO: 991575 - protein, 40 aa, Homo sapiens
DWQFGQLGQHPMDGYLSHTERAPRRAPLIPDGALHHRAFS

SEQ ID NO: 991576 - protein, 107 aa, Homo sapiens
MPHKKNRAGIRNPWVTDWYQTMACEEPGHKAGDEWWASEHYCLSSTLSDQLVALDSHSSVNPIMNCAREGARLHTPYENLMSDDLSLSPINPRWDLPVAEKQAQGSH

SEQ ID NO: 991577 - protein, 49 aa, Homo sapiens
RKRLSIVVLPGAYSTAVSINDQYTTIHEQYNSPQAESSAVRIFKYTGQC

SEQ ID NO: 991578 - protein, 73 aa, Homo sapiens
SRRIPPVSRSGTSGLFGSIFLFKFQVYMQEVQLYNIDKGVSGGLAAPINPLPKYYTRCALAICPDTLPKSART

SEQ ID NO: 991579 - protein, 37 aa, Homo sapiens
RTYTIELIPLVQAALPGMQERKFGRIVMMSRAARWAC

SEQ ID NO: 991580 - protein, 163 aa, Homo sapiens
DYYTLYKYTPLSMYTPLYNEHTTLHTMYTPLSMYIPLTMQHTTLHTMYTPLCKQCTHHSTMNTPLYTQGTHHSTMNTPLYTPCTCHSTIYPPLYTQCIHHSTMNTPLYTPLYNVHTMLQMNTPLYTEHTTLHTMYTPLYNVHTTLYTMYTPLYNVHTTLRWNG

SEQ ID NO: 991581 - protein, 125 aa, Homo sapiens
VELVPVEEGAGCGVTSPIAVFNIGNNGEEVLEIASNIRKVARVPVQTWEGWDPANLLGGWFSNLGGFKMLVGTVIFITGVLLFLPCGITIKTLVETTVNLLTIQMMLLLQRHDGYQPVSQEYPKN

SEQ ID NO: 991582 - protein, 34 aa, Homo sapiens
SSKLFCDHDSHGGPPGQALAHAVTMTHVEGTCKA

SEQ ID NO: 991583 - protein, 64 aa, Homo sapiens
WLSRGSRYASQDYSMLIFRISRSRLSESVTVISITVRCSFPIAKVKSPIFCNKLFGMRPSHKCL

SEQ ID NO: 991584 - protein, 89 aa, Homo sapiens
HRKKGLVELPQFRVCLSSVLSSGGSPFMSKQWVVTGSEVGPAEPKEIEQIRKPTPTPKVSLLSEKLKLLGAVAHTCNPSTLGGRGARIT

SEQ ID NO: 991585 - protein, 192 aa, Homo sapiens
FIDATSAASSEGGALFVQGPYEGGHCWQNPLAPVAREPSVLYTFCKLLEESCIFGCLSISDLELVIAVCSLGTVAGWKTYTAGAWSAQSSGRAGLRPHLREATVPLSALSPTVEILKLACQQAGHFFDCLLPQGPLAVKAVGITIGKLSKVDCQLQLGCGGCKFPVGGPSWGQLENDLLNMTFHGGIDNHGD

SEQ ID NO: 991586 - protein, 90 aa, Homo sapiens
IELGTYAAQDMWVLVQEGSTSRQDADAAGGSVPLTIVSLVLIVSTKMPTSPMAPHCTVRPGRPSCRLFLTYTLHGGIGKAVVALSRLPHS

SEQ ID NO: 991587 - protein, 100 aa, Homo sapiens
MGMMDVANEHIMDFVVSSINLNYLQGVYRCHIPLKEECDGDVACFFRALPLKPLGEHTDGQAVGLRTPRQCLGVNVYELMPQVYVTGYFFSLAIHGGINK

SEQ ID NO: 991588 - protein, 40 aa, Homo sapiens
YSSRIPSPSCATLPGDGDCNGRFRLTRHFAGATRCDLGRA

SEQ ID NO: 991589 - protein, 117 aa, Homo sapiens
MRCHLYVNLPSSLGQGSPKASPEKTLGNRLPFLRGGTSKYHGCVFLSTMVKISIFGFFFLHPNFAFGISNSCSVFLFLFPCLFWLIFFYGFSVFNFVDLCSYFFPSAYFGFNWLFFF

SEQ ID NO: 991590 - protein, 53 aa, Homo sapiens
SKDPVFIDATFAVAFNLGRAVAQVEVREVGLGGGCLESQLLRRLRQENGVNPG

SEQ ID NO: 991591 - protein, 34 aa, Homo sapiens
GYVITQQRPPVCGTWLACARTDVPACCRIWAFDL

SEQ ID NO: 991592 - protein, 146 aa, Homo sapiens
SLTDRNTFSTVGSVEKEVFFMVSWTADPWVALVVWNDIVDKEKQGVLSSEMNSLPDHEVELTNCETEGTRYFFRSRSPIRALGAFSTITGTRPGYFFRIFSPSERRYSNGCSSVYTNFILPGTVVYRAGLREPRVAGTLLDSHLLF

SEQ ID NO: 991593 - protein, 43 aa, Homo sapiens
LPSISTGQKAAPCSKAQKGQKAPAQKAPASKGIWQESISCIDK

SEQ ID NO: 991594 - protein, 39 aa, Homo sapiens
KSSACTPDEKRACLTAWIQRWHVDDEPSCGTGCVDALLS

SEQ ID NO: 991595 - protein, 175 aa, Homo sapiens
YYQELEEMRIYAESQTISTILSYVPEVLLLLILYSETLQYVVEQQQKSNLELLRMSLLPIESWLEPVRFLRQYIRQQDRCMTPRDSDDYHLLKELEEGIQNAYEEAGIQKAGDLGKILKQTYRRSLTQTRNNHYALVKNYGLLYCFRKDMDQVETFLRMVQCRFCVGQPVELINT

SEQ ID NO: 991596 - protein, 38 aa, Homo sapiens
MISGRKYVAARPSHVRIRHQAHHSTGTEWCIYPTYDWA

SEQ ID NO: 991597 - protein, 36 aa, Homo sapiens
YIAGTHDGSSHGWLYVHGCGDGRAVAASFLQANRGL

SEQ ID NO: 991598 - protein, 45 aa, Homo sapiens
DRELPDMMELPDHPWFCRRPVPPGRFTVHPCVTAIRCSPCYILRR

SEQ ID NO: 991599 - protein, 43 aa, Homo sapiens
LRARIDMQAENMWLRDPVMYRIRHQAQQSTGTEWCIYPKYDWA

SEQ ID NO: 991600 - protein, 171 aa, Homo sapiens
YVPIVDPFLSLFVVPVLAISVSSSPVLVSLSSVSLFSFSFPFFVPVSFPLSFPFSFVVSVSIPFTDSLSLCVFLSCRALTRSLSSSLSFSLSRSARSGPLVSHRAPRLVLGSRSLSLPFHLSYNPVCRLNVPLFFHHAQARHSFPDVELVSLVFDLSLFQDIYLFQDSYFE

SEQ ID NO: 991601 - protein, 47 aa, Homo sapiens
MFHSLLLMMFGKGSGLGSTFEFGTGGTSGGMATIPNLDSHSSLVNNS

SEQ ID NO: 991602 - protein, 39 aa, Homo sapiens
YVSRYPSWCILTNNQDDAHSSYKYGFCSCELQSYKFVSG

SEQ ID NO: 991603 - protein, 35 aa, Homo sapiens
IRNIRRMSDDSSVSSYVNDVFYLYSTGISHNAIAR

SEQ ID NO: 991604 - protein, 73 aa, Homo sapiens
MFSSRYKAIGVHINMHECRIISRFSGRNKKEICSKTVSLEFCQELEWMVLTIAESCLCSTCVSQAMGLVRLCQ

SEQ ID NO: 991605 - protein, 81 aa, Homo sapiens
RSRGSSALTHPNQCNYLVQLKFRRDGEHRVVESFESLSKQDQDRKAQKQRDKKDATEDEGGGGDGVIPLDGAQLWDDVVAG

SEQ ID NO: 991606 - protein, 107 aa, Homo sapiens
SRGSPALHPPRGCSFQLGECYAGPRRGLLSVRPATSWALLREGPSACCHPLCSQAQALPPARTGETDGKLGPGEYLEWTRVTVGDKDPSPSVTVLNLQGWVGLDQLA

SEQ ID NO: 991607 - protein, 104 aa, Homo sapiens
MTGPVRNGGSLDEPGAFQELNEDSVHKCVLAESLHQHHSLLPQHVQHSRDVQHLIVFQAGDHDLRQNHHASPSYPSTAVDQQRRVGALGITCAICMASNRLDLF

SEQ ID NO: 991608 - protein, 102 aa, Homo sapiens
MCAKQSSHFLLYLPKKLEIQVYTITLIENCNFDPTSEITYETHEGQEIILKKVLTVCLKQTSTLLNFTSSILYGKSQGSFGTHEFTSRDTVLGFSRRGGSSL

SEQ ID NO: 991609 - protein, 70 aa, Homo sapiens
GTLEDPPYVCQCDDMAAAAEYKEHASTGLMLQQHGYTEVEVAKDVFSYVLRTQEQEKMQKTNCHQINVNS

SEQ ID NO: 991610 - protein, 107 aa, Homo sapiens
SSIMCASARGVLRYAVCVCVCVCVCVCVCVCVCVWVHMCVCACVCACVWRVHMCVCVLLCVGAHMCVCVCLCVWAHNVCVCVPMCVGTLIGGHRAQTAHHVDIAIPC

SEQ ID NO: 991611 - protein, 34 aa, Homo sapiens
ELQAPANYACGIIFWYFKKKAGFGLCWAKAVINE

SEQ ID NO: 991612 - protein, 102 aa, Homo sapiens
MPVMENIEPTFVITVRCVSRGHYLRVSFDSFISVSPGQFAELTFSSLSLSLSLSFSFILFYLALVYPNIKAIIHYLINGSVLFLFKQFFMLAMKSSWGCVVS

SEQ ID NO: 991613 - protein, 69 aa, Homo sapiens
NSRRLYNRYTEFSTVLTVVDGTCTAQACTVMVNTRRPGSIFTILREVITVLTCRRNLSREGMHRSGEYT

SEQ ID NO: 991614 - protein, 81 aa, Homo sapiens
MGLKPIWLPTGLTLTPSSHNNSHGLSSLSDFRYSPHFFGQALARNLTSLNLSPSHLQYVDDLLLCSPSLKDSQTHTAIQRL

SEQ ID NO: 991615 - protein, 140 aa, Homo sapiens
GGNSDCKRDRSPDTVHCALHTHRHTHMTHPPQHTHTHTHDEHTRTAGNTLPQAAPEAAGFCSPRLIATGERAAHGHAGGPMLCHHKGSTFGETRPHTCPRTPECWDPALSRRRSVLRFLPSWGFFLLLDPPRIPASGERP

SEQ ID NO: 991616 - protein, 68 aa, Homo sapiens
EDPGPVNVRKCALYVVQDISGRMSRKGMRIRVSKDAWVEGKHFWNTEFGIFYKEGIELLDSGKERRGA

SEQ ID NO: 991617 - protein, 45 aa, Homo sapiens
LGVNHSSVTESVVLARTCGGEGHRRWFPVRAGRPVETQVQDNTWI

SEQ ID NO: 991618 - protein, 47 aa, Homo sapiens
GCLLLLRMDTPDVTRFTCLARGHSPRKNALQHLEPEPCRGVRAASKE

SEQ ID NO: 991619 - protein, 124 aa, Homo sapiens
MGEPLFLHSAEGSEFWSALLEKGIAKINGCYEALSGGAPLRASKTSPETLLEWYELRKPPPNLFKIIQKALKNGSLLGLLHQTSPAPGTSRAITFQRLVKGHAYSVTGAEEVESKRKALQKLIR

SEQ ID NO: 991620 - protein, 68 aa, Homo sapiens
ATLLYLYVVAKLYGQALSDAVESGRLHLPSKDTGLYEEVLMPVVARPCFTSECPWDMKSLTPHFGDCC

SEQ ID NO: 991621 - protein, 41 aa, Homo sapiens
SFPVCAIRTIISGLVVNVTHVGEHGIKSSFWPYTLKQRGSS

SEQ ID NO: 991622 - protein, 77 aa, Homo sapiens
ESVPDDERTQESPNRELCYTARSLLSRGLDSQKSKARPPLRADQRNSDISSPILPYQCAPPYLLLHPISPPPIYSPH

SEQ ID NO: 991623 - protein, 81 aa, Homo sapiens
ILLTGTCGPVHRMHGQWAREHARLDNCSGQGRSNKGLLARIFGSPSASESMEGPSLVRDSSGPGLPLTLPGPVLLPVYLIL

SEQ ID NO: 991624 - protein, 66 aa, Homo sapiens
SVKDPSDLGLDLSEVYYPIQAHRNKSYNFKKVLWKRILFLYFPCGAVGDEGPVYDYWERLPLIYIL

SEQ ID NO: 991625 - protein, 35 aa, Homo sapiens
YLAISLSKLQVLLYSLIAVPLTDSKSYDSTIMGGN

SEQ ID NO: 991626 - protein, 47 aa, Homo sapiens
PGLNLVPDEGDRMHSFSPLACRKRNCRMTFALPVSICVDTDDAREHR

SEQ ID NO: 991627 - protein, 45 aa, Homo sapiens
MLHPECSILMLHPDAPPCCSTLMLHPDAPPCCSTLMLQAGYLCSE

SEQ ID NO: 991628 - protein, 46 aa, Homo sapiens
MNRASIEPGMISSNVGDKELFVLIAETVPVKLSTNTLPVGSDSVKQ

SEQ ID NO: 991629 - protein, 56 aa, Homo sapiens
SAFVMELSHHSCPHCEMSIQQKELDLLEPQVVEALAGGWVLSRRHVFLALESEGSL

SEQ ID NO: 991630 - protein, 159 aa, Homo sapiens
QLLPAVALPDDPSTLTPSSVPHTLDSRGIPPCAGAHQLSGASLRGTGLMEDYGNPRAPQAPLHSVVQQLHGKNLVFSDGYVVQETIGVGSYSECKRCVHKATNMEYAVKVIDKSKRDPSEEIEILLRYGQHPNIITLKDVFYDANTCPGDRADAGWELL

SEQ ID NO: 991631 - protein, 118 aa, Homo sapiens
ECMIYTVKGIAYYIISKGYEDQLEAWRSHLNDRVIQLFFLWHQSHKIRRDVPAGCVSAQCCNLLLQTLDEQSTEQGGAPNHQRLLWVHEQGGPQVMVSLQQYQRLETHEHQSWIIKPC

SEQ ID NO: 991632 - protein, 72 aa, Homo sapiens
QNSGGSNINHPFLEALDGWWGDRRGREMPWYLTIYGLDLQTQKLWLHCYICPYMSLWVPPTQCGNCHSFTQA

SEQ ID NO: 991633 - protein, 48 aa, Homo sapiens
RVYLTLMLQQGCIMPGSDREALTIEPPNVGVVLTLRFTGEARTLARLG

SEQ ID NO: 991634 - protein, 39 aa, Homo sapiens
DSSSLFLPTVSHCSKEEGNFKQEWVALHTPISISELLVT

SEQ ID NO: 991635 - protein, 46 aa, Homo sapiens
CGHGDKERGQSGQWKRRIQRTLSLEQRLKEQMGESEGSLESLKAVW

SEQ ID NO: 991636 - protein, 41 aa, Homo sapiens
MFSSTLSAPCGLYSLADAIWGSSFGEDRLSPADSSRRDGPQ

SEQ ID NO: 991637 - protein, 45 aa, Homo sapiens
TGVEVKIQLHTGETLVLPGVLQCSGSALCYSELPIRTLQAEARTS

SEQ ID NO: 991638 - protein, 85 aa, Homo sapiens
TAIYNYVVFLYAFQPSPICNGPVYCLVKIVNMRPCGFSVFLGEKVLGESQAFEPNSHDYPDPILGNLLLLPANDNTLSNGDSCKW

SEQ ID NO: 991639 - protein, 78 aa, Homo sapiens
GEGRQAERTQSQKWVGWREWGRGVEPEQGHTVEDHDALVEDHDAVEEGENPRGQRTAGSHRLGLVGGSDGSMSQVLSW

SEQ ID NO: 991640 - protein, 37 aa, Homo sapiens
TVTLICLYGPDLLQTFTLHSPITVQEKSSTVCGFVRI

SEQ ID NO: 991641 - protein, 61 aa, Homo sapiens
TVQEKTRVVCFADSNPPAEYSWTINGKFQLSGQKLFIPQELLQIIGGSMLALCVTQPVARL

SEQ ID NO: 991642 - protein, 65 aa, Homo sapiens
DLVREWSWKGIMLLVFISHMGTSSMCGQYVCHINERRQMGDLQGPEGVCLRRSLSMDLGYIYFYQ

SEQ ID NO: 991643 - protein, 42 aa, Homo sapiens
CCCYDLEDPFLPAIEEVISSMQLSSLEWSLLILQSSLICTVV

SEQ ID NO: 991644 - protein, 39 aa, Homo sapiens
VCRPVMATTAPGAVLPQVVLIAAAAPDAPGLSYNFAKPG

SEQ ID NO: 991645 - protein, 95 aa, Homo sapiens
MGMMCSGLLCTGLTEPAPERYSARVAVWLSRSNREAQAEAVGEDEPPQRLKPQRQTPPGLLLPASWASLAYSYLPGPLHSCLGGPYEGSPAPRTH

SEQ ID NO: 991646 - protein, 32 aa, Homo sapiens
MGLWFLEHKHPMGVDSAIRRRFEKRIYIPFSR

SEQ ID NO: 991647 - protein, 64 aa, Homo sapiens
MRSMQNVEHVYTEIRMYKKKLCLKPGILQKLLPLTVIAIPFKHTSLPPTGNHQVPYTQRKALGE

SEQ ID NO: 991648 - protein, 35 aa, Homo sapiens
TPGIPVRASLGATSADCDWLDMCTTSARSFDVHCH

SEQ ID NO: 991649 - protein, 173 aa, Homo sapiens
VTSRDVVGEILVLKCFSYMSQEKKFSEVASLSDETNSIDVLSQPWNEPPVILSMVIHMLSYGRGIARAMVLMQWGAVLHMHRTVKTMWYLHLSVADLLCCLILALLAGSLGSPGKQCPYVRFLCNLIPSIIVLNIVCQCLPALLSLAWYRCLVLYKANLVSDIIASVGMDCSI

SEQ ID NO: 991650 - protein, 37 aa, Homo sapiens
MQTGDLKGHAQEQKVAVYRRPRHEDGVMGTSNQQLDN

SEQ ID NO: 991651 - protein, 56 aa, Homo sapiens
TQPLSWTLYAMSPPICMAHRSTPADTLIDTRGTPTVANHSPVSGFLTKHSFKSTIP

SEQ ID NO: 991652 - protein, 43 aa, Homo sapiens
ESTHNSCNLIGYPGANALGSPEVKCESIHQIVEYLRWAMRGLP

SEQ ID NO: 991653 - protein, 43 aa, Homo sapiens
CYHSILTLKKTQVQRRKEAAEEDRESVWKASSTCNVAVMPLAG

SEQ ID NO: 991654 - protein, 61 aa, Homo sapiens
FLALYTSLDFVGSGKVDHTVGQKHLTFRHAYHMTAFVGSNRFVNADRSARPMSSLADLSKP

SEQ ID NO: 991655 - protein, 55 aa, Homo sapiens
MRALTVQRVKFAMDLPLLKRAGQDLAEKTKNFVSRSLVIGEVLSMADIATEVRLG

SEQ ID NO: 991656 - protein, 45 aa, Homo sapiens
MSCSASRGIVTDLPSRALVVGRQVSKGARGVQVPGGILARWKYQA

SEQ ID NO: 991657 - protein, 53 aa, Homo sapiens
MLLGFSSADLIVVLCLAPPENMMGNGTPSYHSPGSFPQQQFGALEWWPDLHSQ

SEQ ID NO: 991658 - protein, 34 aa, Homo sapiens
SRMATPAGERRPLPGSGHRTSRLAAGKGLRSCGK

SEQ ID NO: 991659 - protein, 39 aa, Homo sapiens
VAIGFRVLRRTGTCEQVPHQVPWIEKAPAHLSLPDLSKP

SEQ ID NO: 991660 - protein, 49 aa, Homo sapiens
MPVSVPHVYVLRTRCYFRRGYQLSDVDGVTLLKTIDRSGALSHRVATSA

SEQ ID NO: 991661 - protein, 47 aa, Homo sapiens
TPISSWYRRRRSCVATRSPLSCLIIMCEQIPSIPSSLEDLPLCPTDI

SEQ ID NO: 991662 - protein, 40 aa, Homo sapiens
GLSRLMIVLHIVHHDVDLVHVAAHHNLSNGDDVGMLGLED

SEQ ID NO: 991663 - protein, 34 aa, Homo sapiens
VHLGDGKAGGLGRSDERDTRGFISMTIMRAFSGL

SEQ ID NO: 991664 - protein, 81 aa, Homo sapiens
TWCPADGWEPSADTGEDKDGTVYQRTSGGPRGVYNKGGPFGSAKGDIFGIPTQWIWFHVFASCRHHELMPQTTTMSNPCAC

SEQ ID NO: 991665 - protein, 120 aa, Homo sapiens
GLYPTKRRRKQEHKAQAGLAASSCSAPIYSVGDCQARQAPLHQAQGSFDRGSDLQRLSRGLKKFLPGLHPTLALPKKDPTCRRPWLCLALGNWALASFCHGLSFGLGPLSWKIVGSRPLS

SEQ ID NO: 991666 - protein, 76 aa, Homo sapiens
PVDQRLQELTASLFVYLSGRSSSVPVGLLDLVLHTYITPVIPLTATVIPITYRPGDLSLSSLKIPQLVLFSSHLHP

SEQ ID NO: 991667 - protein, 74 aa, Homo sapiens
MPNCGDDRWTMRSGVRLLALSLCRNDAPFSWASVAMGREPPLSEYQFLSCPVTQRWFNLESDLMELHAVYQRYW

SEQ ID NO: 991668 - protein, 98 aa, Homo sapiens
HASTSHNPDDHYSYDGVLFQAHQPTPQHAGICSLFPLHQANMKPGIRPPKQAEAQEVSPGALESFQEANEVNIYSRLQDMAVSAFPRAPRLATLRTHA

SEQ ID NO: 991669 - protein, 52 aa, Homo sapiens
CHSERIPLVSLLLCSLSVVLVTVTDKFHATMDNMLFILPYYYKAELGSMFGS

SEQ ID NO: 991670 - protein, 33 aa, Homo sapiens
HVSLSGHLCPATASGQHSIITCRQAIPDAFPAA

SEQ ID NO: 991671 - protein, 82 aa, Homo sapiens
LADYGARTTLVPLDVSLSGPSAQSCRSVAGSPSWGWQHVSRRSIQAARTRVVMGSRPSQQAPPCHHTAQAAHSHRVPDARHF

SEQ ID NO: 991672 - protein, 57 aa, Homo sapiens
LLCTLCAILLHVHACASAGLGPAACVGLGFLVCVSPCVSSPKQRITWGPGSSHFCPP

SEQ ID NO: 991673 - protein, 62 aa, Homo sapiens
VASQQAPPSRRIAVWQQIKGFGQFMACIPNSCSQALHDMGPINPLMVPHLPSNFMFPCNGLL

SEQ ID NO: 991674 - protein, 43 aa, Homo sapiens
MGLWGQLRKVAAPPVVWNDACAGALLLVWMRGEELQVVSCVLI

SEQ ID NO: 991675 - protein, 40 aa, Homo sapiens
SVAEHRKRKGLKEGILPWTTSWTNCRHALPAAPAAPGTRS

SEQ ID NO: 991676 - protein, 43 aa, Homo sapiens
LWIKIPCTDYMGSCTFEHFCDVLDMLFLRGGPAQSPCVPMGFL

SEQ ID NO: 991677 - protein, 52 aa, Homo sapiens
MPVLYALRLALPTPLGVCLPTAPRPPGPTPTRLYTVPTGVHALRLQIILDHS

SEQ ID NO: 991678 - protein, 66 aa, Homo sapiens
GAWAVTGPGAQLGLFVKRVLEWWCGPSGCPAPGACSPGGGGWNKSGGSDPALRGVCAPAHPPGRVR

SEQ ID NO: 991679 - protein, 49 aa, Homo sapiens
MEGDAELRGYSTGPHPTPAPMQHRIGVSLSHDQPPPALKKRPYQGKKGR

SEQ ID NO: 991680 - protein, 71 aa, Homo sapiens
GGDISNRQFLSINKPQFLQGLGEIGSGSFFSRGNQRVSKVFYFYPLGGLWGLEISWAEKHYWLDNPKSPVV

SEQ ID NO: 991681 - protein, 38 aa, Homo sapiens
TSYDETWTIGDDQATDLLQVAAHEFGHVLGLQHTTAAK

SEQ ID NO: 991682 - protein, 47 aa, Homo sapiens
IPIQAQAVWAASGSQGVGAGCKHGAWVASILPHNVSNHSSSFNASLV

SEQ ID NO: 991683 - protein, 50 aa, Homo sapiens
RYLYQRELKSSLQEAYRLGMKGDFGGWKGEQLLVIGYGMNGLDVTKLVSN

SEQ ID NO: 991684 - protein, 60 aa, Homo sapiens
DSPKAVNECSVCVTHSECDLSRKLGVLMLVGSLSMLLVVIILTLDVDIGEPGTFTSHHFN

SEQ ID NO: 991685 - protein, 126 aa, Homo sapiens
IRRRIRHCDLKAYLGGYQNGVRERRKGSNEAMALCDSLTGKKPGVGFENAQALKRIREQFSKMVPARGQGGPGVQLRLIEGGKKGAKMIMAKNADIRDTKVLREALALADLVLDSANPIGEIVGPA

SEQ ID NO: 991686 - protein, 80 aa, Homo sapiens
LVRYTRHSAIIKSMRLTNLSWTFTGLRSQTSWMRYNHVKPMNPMHSAQNMPIYIYPQFLIPLHTHTQYIYIHISQLKYFQ

SEQ ID NO: 991687 - protein, 35 aa, Homo sapiens
MHTGAHAVAVFWKALIALSPPSTFGNCSGLLQCAS

SEQ ID NO: 991688 - protein, 41 aa, Homo sapiens
HRLTWLVDAEKWPTSSFRLKVGDAVQERVTGQERVTGGTEL

SEQ ID NO: 991689 - protein, 43 aa, Homo sapiens
SVLYGSPVVALGCAVVYTCCRSVEDLPSPAAAVFQPPASGWGC

SEQ ID NO: 991690 - protein, 91 aa, Homo sapiens
ALEDPLWHTGLETMSVGTVYIFNGESILCSQAHSSLSVTKSVASSSFLNAENCDENGIVVVRWTRKEVCRSVYVKIFAILQERLRGGMELE

SEQ ID NO: 991691 - protein, 82 aa, Homo sapiens
MDYSAMKRKEILQPGAVAHACNPSICEEAEAGRSRGQEIKTILANMVKPHLYYKYKKLAGRVAGTCSPSYSGELRQENGVNP

SEQ ID NO: 991692 - protein, 68 aa, Homo sapiens
ACRHGRGIKNGVVEYGKIESKIQANRMRGWKFCHGNITSSFISHIGGTPQPPSCRYPVGNSDRYLCYV

SEQ ID NO: 991693 - protein, 47 aa, Homo sapiens
MNINKHNLYADFDDCKKTFKNHQQLKIHQCQHTNDPLFKCTQEGCGK

SEQ ID NO: 991694 - protein, 102 aa, Homo sapiens
RGSATVALLQSRGAARPIVPLTASWGQPHRSGVAVPQFSHAQQSRIVHRHIKPARQVAPSHTQAHGPCHHPAHGTSQHKQLIQSCLIHVLCTGPGVQVRAGS

SEQ ID NO: 991695 - protein, 43 aa, Homo sapiens
LPVKRKAERKSGVPPENIPTYVQHARSQVKYAAKVGVNIRTCD

SEQ ID NO: 991696 - protein, 188 aa, Homo sapiens
MGVASRRQRQVSSIAREKRGGVLPTNARPTVKILTDLQAVTRRHFTQFKGTALARFAQDLQGLLEDRRLRAFGLFKEFEQALQRSRFTRGQEKGLQQRGQFAGFSQIHRFSSLFGSRPHVDSRKRLILHQLDQGLLHQLKVRHKGHHHAQSALFGSKQLDKGHKPTSLETFQHIAHALAGGQRFTADL

SEQ ID NO: 991697 - protein, 75 aa, Homo sapiens
GRYSQAGDLRDTGIFLDLMHLKKPGRALTYPCSTEISSAEESDDVDLMGSLMMESKQCYEAPDCVKCSAPSETSE

SEQ ID NO: 991698 - protein, 68 aa, Homo sapiens
MRSEAEQSPCENLAIVGARLLPNLTAYSRLRQSSRGVDFNRSSCIGTYPTPGLSPHRFSNVSYPTMDR

SEQ ID NO: 991699 - protein, 31 aa, Homo sapiens
MVAGFSGRGLKLFNKGSTSVRAYIWGTQGNG

SEQ ID NO: 991700 - protein, 53 aa, Homo sapiens
RALPSAVCPQPYLAEDKGYALSRLRLGPTTLPGQPEAAEEGRTRFLLSVPINS

SEQ ID NO: 991701 - protein, 61 aa, Homo sapiens
VTRYHRHGAGELLAKNCRESWTSRMAPGLSTASADSRRCLFLRARRCRACSCHFFLVPMNS

SEQ ID NO: 991702 - protein, 89 aa, Homo sapiens
DIDRAGTSGASSTYSRFKSQHPASSFSSITRVCITDSGSREVLFFLELLLQPSPCSPGTSAPPLGTHLSPHQISVFRVIRGPAWVPMNS

SEQ ID NO: 991703 - protein, 69 aa, Homo sapiens
VHVCHDSSRKLWLFIWHQPKPICPSSWDHLWTGGHLCCLVLTCAENRDAAACCTMNGACMTAYAVSADA

SEQ ID NO: 991704 - protein, 59 aa, Homo sapiens
MDTCSTGRRIGQVFGGILLNTLTTDSDRREWSSKLVLSEALERYVALMYGLSPLSHVNT

SEQ ID NO: 991705 - protein, 32 aa, Homo sapiens
MDAILYDLLRGDSHRMSEVSYTRLLANILHEE

SEQ ID NO: 991706 - protein, 47 aa, Homo sapiens
MTSALRYSRAPRYTSSTSHIIGTIAEQNVSTIHCSSEENVGVGADNS

SEQ ID NO: 991707 - protein, 39 aa, Homo sapiens
MAKCRMVLSSRYYCSQFVMSACISSRITTVLQVRGCRSI

SEQ ID NO: 991708 - protein, 39 aa, Homo sapiens
VTIHRHLAIHRHLANSSAHRYSSAPDLPSNGYSLNGFNS

SEQ ID NO: 991709 - protein, 73 aa, Homo sapiens
SLCSQSLATLCTLEDILLDWDRLESHCGSEWADHWVTDGGTAHREVCPVTPFRRDPGETDPGHVRKSRQQVAV

SEQ ID NO: 991710 - protein, 102 aa, Homo sapiens
RKTRCQLQTPKRVPSNTGMWLTDKYKSRESDRVSLCRPDWSAVKQSQLTAVSASQAHTILQSDSQVATITGTRHHARIILSIYSKDRLTPCCPGWPQTPDLR

SEQ ID NO: 991711 - protein, 42 aa, Homo sapiens
DALSVGAVVGFIEQPTPFVSLFFQRLLRLHYPTERASPTERA

SEQ ID NO: 991712 - protein, 67 aa, Homo sapiens
YNHAHPAHGFSSTSMNSGDPSGPPTRITVLNLIQTHFRHSGGPAVQAQEPDQTSLHTTPQIPHEPLQ

SEQ ID NO: 991713 - protein, 88 aa, Homo sapiens
MHFAEVCDLLKTVRVSSSTSSILMTEARNMVQEVTLALSESRSSSQASVERDRLHPVDPQSPENQSLVTDQYLVIRAYALKNRATYYC

SEQ ID NO: 991714 - protein, 120 aa, Homo sapiens
MTLGDKDKHLNLNKMTIDRLIGVHPWIMSTTHSQNTSKVVHSVQYTFYFILEMESRSVVQAGVQWHDVGSMQSPTPRFKQFSGLRLPCSWDYRCLPPCPANFVFLVEMDFTMLARLVLNS

SEQ ID NO: 991715 - protein, 92 aa, Homo sapiens
MYSSLGNSSKHLVSKTFKTAMLTGNQSCILIVAGFGQSYCQGQIPSNITLLDQMAYAFSLFTRHHGHFMPHANSKQARFPRVIRLMVKFIKE

SEQ ID NO: 991716 - protein, 46 aa, Homo sapiens
VTKKHRHEEHFQKQIPRESSIIPAMMEMMGNQDSEWTCMKPYAVPS

SEQ ID NO: 991717 - protein, 68 aa, Homo sapiens
PLEDPDALSVGRRVVRGLPHLGLRHQTCGHHLLVGHVASEPFMKPPLQSWRVAVEEGKERKTTQHRES

SEQ ID NO: 991718 - protein, 94 aa, Homo sapiens
AGLSSTPELGGPEWPNQTGITRTLIQTHNGTREGRCTGPGTRSNKSAHNSSNSPRVPLALKARSSIRTSVCAMWSVSGTEDGYEPISRHAAVGP

SEQ ID NO: 991719 - protein, 48 aa, Homo sapiens
MPLLDCNPEIAGPSAPRKHIIHSRNYWQTQQLLNTNSSFAYAGCIHQH

SEQ ID NO: 991720 - protein, 94 aa, Homo sapiens
MSYITGFCLSIHTTPGLKTNGTDVTLELFIYFDCDFFGVAALFLQKNMSFYGCTPTTMTRKYKLCIQQRSNIQTLEGISFNNQKTTPLKMGHRT

SEQ ID NO: 991721 - protein, 33 aa, Homo sapiens
MLSSYPSNPFSKNKIARKLGKGEGVTVTDHLRV

SEQ ID NO: 991722 - protein, 66 aa, Homo sapiens
GKEHMTWGLRYDVWATDTDQVEATQSSGFCLCLCLLSLCDLMSRECFQTMLQQLESYERIRGLYHS

SEQ ID NO: 991723 - protein, 61 aa, Homo sapiens
ILSGRGIIGILIYMRRHTFHADLLLTYSISTVLKEVATGELMFLGKGGVGLVNAWLTFYGS

SEQ ID NO: 991724 - protein, 44 aa, Homo sapiens
GEIGRNPCVYCQPPHRAGAGPGGGLALAVLSRGHRGVCAHARRD

SEQ ID NO: 991725 - protein, 106 aa, Homo sapiens
LTDSRVGSPLVPLSEPCLLVFSSVAAIRYRNTYKLSKGSTRLMMKSSPGEPLSDSGYEFPCDCFGVLYGLSNIRNFVSWQHFKGNRYEHIALTAARPFNSVSKNGL

SEQ ID NO: 991726 - protein, 71 aa, Homo sapiens
MKTSHHRVLLLFILIRILVLSYSGSKGFLYVPQWVPDPFVAMSWMGKMLLPNMCVGKSFTSFKSVLKCHYE

SEQ ID NO: 991727 - protein, 69 aa, Homo sapiens
MASARWTLTSTSSRNKTILYGTEVYISVCVSDLDLLLILYFYTVHLEDEAKETQTYSYIRDPACCSWII

SEQ ID NO: 991728 - protein, 64 aa, Homo sapiens
PLQFQGSSKCIVPSALSKCMVQVHGPSAWFQVHGSKCICSKCIVPSALFQVHGWSLQRNSVTSM

SEQ ID NO: 991729 - protein, 35 aa, Homo sapiens
IGDRSSVIITGLLLVIHTTPGLKKSGTDVILRLFI

SEQ ID NO: 991730 - protein, 54 aa, Homo sapiens
QERVLNLDSSYTCETVFMRLAHLLSYSSPAVYIPNAGSSEHVIWATRNKIVVNG

SEQ ID NO: 991731 - protein, 44 aa, Homo sapiens
VTLEDPSGEHSLWQQPSKSEQIGLHEVKQLMYSKGNNQQSDCSP

SEQ ID NO: 991732 - protein, 37 aa, Homo sapiens
TTVPEDNYTSFLCFKEALECACICQTPIATRMSGLQK

SEQ ID NO: 991733 - protein, 35 aa, Homo sapiens
MPFAVRFGDPAWNSQGGSWTPEMLSNSTNRHPNPS

SEQ ID NO: 991734 - protein, 98 aa, Homo sapiens
PGITACELGIATDGGQTAHQEEEITLENPADVPVYVQWIPLAIYTNPSGGVDKLVVKGLTRGKGAKHEWRTLEVSSLQKAGLIHCRGATGYMEGLSRH

SEQ ID NO: 991735 - protein, 126 aa, Homo sapiens
SQRGTFTCSQAVKHQLGLHGTTLSPQNIQKLAGRGGLYLSSQLPVRVRSEDGLSLGGTGCSAPELMLLHASPGNKVRLCLKIHTYTHTPRFISEMESRSCCPRDGVHEDMIYGSMQTLTIWVQSDS

SEQ ID NO: 991736 - protein, 37 aa, Homo sapiens
RGTVTLASTSKSEQIGLHEVKKLMYSKGNNQQSDCSP

SEQ ID NO: 991737 - protein, 78 aa, Homo sapiens
MADNQSETTFIWDLIFSNARSRSENLFQVSFKESHVLKRKNDHPINTVFMWFYKRLASAISNYYLPKQTIICRPVLRL

SEQ ID NO: 991738 - protein, 78 aa, Homo sapiens
EDPLIAFSGATGNNAEICVLHLDYGPCRALNFSVYYYDRYTQSCRQFLYGGGEGYANYFDTWKASEDACWRIEKVRKV

SEQ ID NO: 991739 - protein, 71 aa, Homo sapiens
NETGPYNVKYGTDMVAIALTHITLNVLYGSRASPEFTSSFTVLPVQDEVLIRCLCSSVTSNPIRTLVFFGT

SEQ ID NO: 991740 - protein, 118 aa, Homo sapiens
CRSRHQVRTGCGGDTSVTCHTGLSIGQLASAGPSDPRESRREQERPTRWKPYIGRSLCYFSRGRGSHSVAQVGGYGRNSSAHVKPRSRGDSRRVSVPQFSELAGNYEAPTTRPGIIRD

SEQ ID NO: 991741 - protein, 97 aa, Homo sapiens
MAGTLCKRGKMNVMACIFLTGRQSFTLSPRLPCNSMISAHSNLQRPGFKRFSAPQPPEEYDYRHPPSCPANFSIIVQTGFHHVGQVGLDLLTSGDLP

SEQ ID NO: 991742 - protein, 100 aa, Homo sapiens
NMLSHAEAGVKCTGAIPRTDPAREFELLRFRTGTGSPLLRQPGGPPLTGATILMPNLVRTPIGIAHYSPELLGSRDPPTSASRVAGITGMNHHTQPFLYS

SEQ ID NO: 991743 - protein, 107 aa, Homo sapiens
YRQVRCASISDDRSPMKNGTWSQGEFAQGKRASTYNGKQPSDRNSLYCSALSESRGSIVMRCTLNIRGSETAGIRLPPRVFSRVETAVIRPNICILTSTQPLSLELR

SEQ ID NO: 991744 - protein, 111 aa, Homo sapiens
MTSLTDDLVLPSARCVILSKSLSSLGLSLPPVYKRGFRRQMYVQELGPSCCLSLGQVLPQAEPQFPSLGHEVIEVLVEAPACYIEEDTVCVCVCVCTYHEVIEVLVEAPDC

SEQ ID NO: 991745 - protein, 109 aa, Homo sapiens
RTTSPYKVVIKLSAGISVSYEACGLLPTSHGCWQNLFPCNCGSHVAGFFKTSRAWWLTTVVPALSEAEAGGSPEVRSSRRAWQYGETPSPLKIQYLPGMMAHACNPSYL

SEQ ID NO: 991746 - protein, 130 aa, Homo sapiens
MTHVTRVLGPEEWLASVPASQQSLAQASTSKCNQANEELTVITDADYSQRSHYEDYANVPTQKQSQSTLPNQHHYTCIGIKTFPMKVNDRMGRSNTKCAAITIRTPENMERKGNITLPKEYNNSLATDPK

SEQ ID NO: 991747 - protein, 76 aa, Homo sapiens
GSPDNHGCASLIRAQSTNSMEDDDLKQQFGTDVFVGAVNLIVVYEDWKVERHKPVKGRVPVYTHLFILPYLNVYLP

SEQ ID NO: 991748 - protein, 64 aa, Homo sapiens
GSSYPDSDRLEDMPNILTQADKLLTQHENIKNEIDHPYVVRTTREMRDLVRDCHPMGQTCIAHV

SEQ ID NO: 991749 - protein, 110 aa, Homo sapiens
LKASTATQSFFFLFFWRRNLALVAQAGSPLTATSTSQVQAIFLSPAPTSSWDYMCLPPHLPKLVLLVEMGFHHVGQTGLELLTSSDPPASASHNAGITGVSHRARPATQS

SEQ ID NO: 991750 - protein, 51 aa, Homo sapiens
MVGYDGGEIDEAMVFGESFDNGPLGQKSGLGGAGLLGKRRVDGIKGCKSCQ

SEQ ID NO: 991751 - protein, 118 aa, Homo sapiens
MLRENLTFYLHCPSQESAQDHTFPPTDGYYNTGKSKIKVDNQLPYHLGFAGRRSIPASTDRKHQEHPKGEISLRTARNKGSREGLPSPVLETLLHKLDKGDAISEWQFSSTMLWRLVP

SEQ ID NO: 991752 - protein, 101 aa, Homo sapiens
YRVHRMWPACKKFLCQSENQDVSWTLPREEISNKDATRTLAKDFEPWELTELSQQSGRIGRCEDKEVAALVRKKKKNPEDKGRRETSRTAGPRKTTNRTTM

SEQ ID NO: 991753 - protein, 134 aa, Homo sapiens
MCQSLHESVLMDIKRTIEARILILSRVTRNETGPYQREIRDRYGGIRSSPVTLNVRYGPGAPQNLALIHLLPDRRDPSILCWFAGILAHRESMLGQLVGSFGYQDKSSVSPRLLQIIAGSMLAAVRNSATGEAR

SEQ ID NO: 991754 - protein, 102 aa, Homo sapiens
ITINELIPEGDIGMSETPTCASEGDRARPTYGGYLLIASGSDPGYIEPYENRILDSTRVSLINEDRTLSSVKYGTDRVASEVIAVTLNVLYVPRSPQNLSYI

SEQ ID NO: 991755 - protein, 75 aa, Homo sapiens
HDSEPLVIASGLCSLRWVVELVRNRVHCAWISWLTWKVDVPGVIFPGDECTLFPKCLGGDRVVVRLDPTTSTCRT

SEQ ID NO: 991756 - protein, 73 aa, Homo sapiens
TTDKILLGHCNETVVCTQLPWDAQLEGFEQARAGSNAFQLLCGGEAERVEAVCDQLRSYGQSQMGTHGRLYQH

SEQ ID NO: 991757 - protein, 42 aa, Homo sapiens
AGSERRDVADRSMWECVSIHSQLTVQLHSEQETQWTHRSHGC

SEQ ID NO: 991758 - protein, 47 aa, Homo sapiens
SIKLTFSQVANNPNCIESGIQQQWDANEEHWRSSALKVHRPDIVVHG

SEQ ID NO: 991759 - protein, 74 aa, Homo sapiens
DALSVGATATLVVGFFRVHRPHRSWAPVHILKGQVFASRSYFLDRAGHCKDEGCSWEQSRGESTRCQDQAATPE

SEQ ID NO: 991760 - protein, 51 aa, Homo sapiens
GGVPEPNLHFHSGKQEISVRAGSFVVSSLCNGLIAAQLLLYWNAKPPHKES

SEQ ID NO: 991761 - protein, 42 aa, Homo sapiens
MSVQFGIPGSFDLVLKVTKDNAAHCSLNLLASSDSQTSASQI

SEQ ID NO: 991762 - protein, 157 aa, Homo sapiens
MGGHFRAGSKGWVGTVPRGLVRVLLSSILDGDMMSPRPSPELRCVCWAFELGEACSMVSLRTLLFVGLEPSSGGLPDGVGPLEGACFSGGGARPCRQLCSELALPRLPSLGRRPGVALQGLYSQPPWLCGDGYAACLRVPCSPPLSFGGVSRPHRES

SEQ ID NO: 991763 - protein, 51 aa, Homo sapiens
ALSHALPMGHFFGNHCDHDIFITLRTTMFSVLSLLMTSLTSLAGDHGLSID

SEQ ID NO: 991764 - protein, 74 aa, Homo sapiens
TFDLEDPTLVSVGEVNDRSNMFLKFGVGLTDVVQCINDDDGYDLKQVRACTYWRDGKRSGVGLECKTNSTYEYD

SEQ ID NO: 991765 - protein, 82 aa, Homo sapiens
SLATLFPRFFSQFPVPGHGKHHRVSVLVISACQQGSFTTRRWGRAIPSSHTGQRISAGASSGISAGGQGSLQRRTFGQSMGP

SEQ ID NO: 991766 - protein, 49 aa, Homo sapiens
MAMQQENRALRGIVTLGSPHCGCRWHLRRWNERPSDALGQPMADVTCAE

SEQ ID NO: 991767 - protein, 104 aa, Homo sapiens
MPLCMGAGVFLRDTERRRVFQALARIHEICYNSTILWDVTVRDLLPSSAMIKDLSQGAWDAPFQEELTDEKRFALSPQPAPNLEDYQSRNSTLSLEIHAPQRER

SEQ ID NO: 991768 - protein, 44 aa, Homo sapiens
DWETLVEGLWVTGDEAFAVSSQCVRTEHQTCAKPSEEELVIGEC

SEQ ID NO: 991769 - protein, 70 aa, Homo sapiens
LLPNDHTSFGSAAMYSIRCWSWNYRGGWQPDLPSDGSSCADLQWSHCQLQGLERVLYSHLTSVPRGAIYR

SEQ ID NO: 991770 - protein, 32 aa, Homo sapiens
MTRSLLELLELCVGHWGKECRHSTLYLPLTSG

SEQ ID NO: 991771 - protein, 76 aa, Homo sapiens
RSRGSATLSLWGLSDEPKEECDERTCSHTSSAARTTCCVPVRWQCDYDNDCGDNSDEESCTPRPSVGRPGRLWFEG

SEQ ID NO: 991772 - protein, 65 aa, Homo sapiens
LCSGSARAWLLGLVQQQVAVRQAGQLVVERQLADAGAGLFAFQRQRAQVHADVHQAVVEVVRQAA

SEQ ID NO: 991773 - protein, 34 aa, Homo sapiens
MRLCRAGILLLLVLDIRIPGSLTMGAPGLTALPP

SEQ ID NO: 991774 - protein, 100 aa, Homo sapiens
MKAATYTNAVVLNIVHYVSGACFVNFCSVINGNWLAACGAVSTASDSIHSDGIINSRFKAADGSCRLAPRHSELLDRAISSCFSVSDPVISHCDSRSIPA

SEQ ID NO: 991775 - protein, 43 aa, Homo sapiens
KVEYSGAITAHCELQTQTPRLKRASGLSLQISWDMRCAPQRER

SEQ ID NO: 991776 - protein, 31 aa, Homo sapiens
MVPPYITVIYFETLINGVCLDDVEVMLLGFG

SEQ ID NO: 991777 - protein, 43 aa, Homo sapiens
CTLNGRSRRIPKWVTSLPGSYLDIHTGSNILIISAKHYTIRPF

SEQ ID NO: 991778 - protein, 62 aa, Homo sapiens
SGEHSLDVWQSQALLESLGTSGTLASQEPVYIQHWKTAFPAQCACMQLSGPRSLRAAHVTVP

SEQ ID NO: 991779 - protein, 74 aa, Homo sapiens
QYPSMIECLAGSTCIHYCAACLPGLSIRRHVSNRADLQISYKLEPGRRVFTTAVHASLYKFRRHVSTVLTSKYR

SEQ ID NO: 991780 - protein, 38 aa, Homo sapiens
AGNNHFGWQPSKSEQIGLHEVKKLMYSKGNNQQSDGSR

SEQ ID NO: 991781 - protein, 106 aa, Homo sapiens
MPGPYVCVSDHASSATPGACVSHKCEHTLGSYLCSCTVGYRLSVDGRSCDDINECSSSPCSQECANVYGSYQMFTAGEAHSSVMWMESPVQTSDECALPTGVHICS

SEQ ID NO: 991782 - protein, 84 aa, Homo sapiens
LRQCLCLQWGHPGSIRKAECVPRLRWPQTIAACPGHAGDGGPTPTHKGCCVERWLVHPGQWTHSSQPNPEPGQLPGLLKQPSSP

SEQ ID NO: 991783 - protein, 92 aa, Homo sapiens
TSLSILFSSVNWDGIFPQFQKLEKLVFGPLLQGHQGTRFLLQILIYGKNDLGSLLCFLVSRVSEEPFYDSGSVFPKMWPTVFLREAVSEVVA

SEQ ID NO: 991784 - protein, 51 aa, Homo sapiens
SELTFRVTGRDGGGNPKIPSKTYIIFSLVLFSKQHGNNTITIKGAGGGLSL

SEQ ID NO: 991785 - protein, 103 aa, Homo sapiens
QSSNTGGSLDTWLDSNFSKADCSSSQGLSNAVSWREERQAKNKVMKHCPRKALTLRKRLAEKQGSTAGVEGGSPDNGDFRWVWSFSFAVIVYIDNNDYKGPTI

SEQ ID NO: 991786 - protein, 35 aa, Homo sapiens
MRIPFSSVGGVSDESEKQKEVGESCKKGRLCKKGR

SEQ ID NO: 991787 - protein, 88 aa, Homo sapiens
WEMVDDILASIFGTEKDKVNCSFYFKNREHVVMESGALGCTIKRRLARALPSMNMYRNPQNSSQCCGWFALCRDAMWRVRNTNDECGE

SEQ ID NO: 991788 - protein, 38 aa, Homo sapiens
VLGDKVNTRVVKTGGGIREVVSVIFLDSVKESLMYPFS

SEQ ID NO: 991789 - protein, 32 aa, Homo sapiens
MPGHTVGFEFNAFDMLSTSDTAAKNKNMVTAV

SEQ ID NO: 991790 - protein, 61 aa, Homo sapiens
GTSNILANMRSRKSLSLTRLFITVFSFSSFSLSVAEYLRKTFCSYPAFSSAIRLRLFACSA

SEQ ID NO: 991791 - protein, 38 aa, Homo sapiens
RFSITDESSAMAIWVTWKPKRRMEATVDSTMDRQVAKP

SEQ ID NO: 991792 - protein, 97 aa, Homo sapiens
MDPMWDMGSACITVKTGISTVESPGASSSSALHEKYSSEMRSSTRCYTVIIAMDCTHQLIYNSIRMIRIRFSGVLSIVFITSWSVSVSPFSSSVAKG

SEQ ID NO: 991793 - protein, 44 aa, Homo sapiens
AWFLPAVEWLIRQISLPSYKKKVTYSYLDNVTMWRLKGGRLGGL

SEQ ID NO: 991794 - protein, 87 aa, Homo sapiens
MRGWITVVMLLTVSYSSYPEILPSETPTATQVDGADLASPMSPRTSNSRMSMKLVVPLAQPINPKETSSPAVISSSHLSTNIGLTLS

SEQ ID NO: 991795 - protein, 82 aa, Homo sapiens
MNALLFHGCPFTMTWRAQQEDSVGAQRILAALPQRIEGDVQMACMGPVEKRLGCTGRRKPLRQVRPLARVGGPSLARWRLRI

SEQ ID NO: 991796 - protein, 52 aa, Homo sapiens
GLDSGDSTDSRGYLLNGNWCMKGEFWGGLDHGGDSGLNWSELETVSSGYLSS

SEQ ID NO: 991797 - protein, 84 aa, Homo sapiens
ASQCLLARSTGQHLRIHLVAYHCSYCDKSFLAALPPPAAHQNPHMATDPTSAHILAARSVSLSSPTSSLTSASTRMDNALQVVP

SEQ ID NO: 991798 - protein, 86 aa, Homo sapiens
LCWSRQTPCDLSSEAYMLSIAVMCCLPVFMDIAVRVGECQGFQPRAVSGLLTVVCCVLPCLVTFYSPRLKTGNGENHNVVFKTPQP

SEQ ID NO: 991799 - protein, 60 aa, Homo sapiens
TYRGEAGVQWWTHTLAAASTSSNPPTSRFPTQHGHYTVQCHHAQPTFSLFHWLDDTGFLP

SEQ ID NO: 991800 - protein, 50 aa, Homo sapiens
LICKLQMEPPEYTASCTHGLRTQNIGRTSSLLEPLANSICSASLRGGALS

SEQ ID NO: 991801 - protein, 64 aa, Homo sapiens
LLRGGLCLRSNTKSSLVPRLALLERPSPALAMRTICCCCCCCRTLHLYSNDCCHVIALNENAGC

SEQ ID NO: 991802 - protein, 85 aa, Homo sapiens
PRASKDSDIPSFSKSIWLAFTASIDIGMHFFPQIGSQGGFRCMKTRMLNIDYIGVQMNELQYFSRTLNNKIREGKNTYCGHYFES

SEQ ID NO: 991803 - protein, 67 aa, Homo sapiens
RDSYLILMLFTGPLNTSSHLILTLTLLASWLPFSHLTRQGNQGPARQGLTFCGAMGPWYQYRVSDFC

SEQ ID NO: 991804 - protein, 77 aa, Homo sapiens
VADELVSVSFRPCPDLCPADLAEAVWGCCLQASESGETGTVHVAVWELWVWVLSVFVGVHMTLRQSSAGPMDSMSVL

SEQ ID NO: 991805 - protein, 51 aa, Homo sapiens
RSLWVHHSYCLFPCLESVTTGSGVLAFSIGGHGYETKGESCEADLDPTERA

SEQ ID NO: 991806 - protein, 132 aa, Homo sapiens
RSLCGDTLPCGRGLSLLGHLTLLRRTWGCSLLLVSRSTDVGTIHLLLNSLEVCSEMKKCLWNLHGLTASKWAHQRQGDGEHILGEGQMAVRAEDPCTPWATSVGKLEFNACLPSSCRLAFALCQSNSPTAES

SEQ ID NO: 991807 - protein, 36 aa, Homo sapiens
MCCGDSRGSRRLSVGSGSAELNPNSEWFENYSLCHR

SEQ ID NO: 991808 - protein, 82 aa, Homo sapiens
LAAVCGLFFQWGPPWWHRVFCFSCGQCIPFVLSQAAFLHTLGFGTCLVVRATIGFALHLQLQWHSSHFVPITGCIGHILVGQ

SEQ ID NO: 991809 - protein, 43 aa, Homo sapiens
MKKIETDLDYSGLLSPVPSCISRVYSQHLSTFLPGITVGPVRK

SEQ ID NO: 991810 - protein, 45 aa, Homo sapiens
TLSLWGKGDEVYLTTGKGCTIGRQGGSRGIYILVGYLVGGYNEDG

SEQ ID NO: 991811 - protein, 39 aa, Homo sapiens
MPLGLFTSVRPCCVILGTCPGCDDLTRLLTPVHFPWCHA

SEQ ID NO: 991812 - protein, 166 aa, Homo sapiens
DWVEDRSVNFCFHITCVSVNFRVFMPTCVSVNFRVFTPTCVSVNFRVFTPTCACPRISVFTHPPVLSVNFRVFTPTCVCEYPCVHAHLRVSVNFRVFTPTCDVSVNLRVFTPICVSMNFRVFMPTCGSVNFRVYMPTCVSVNFRVYTPTCKSMNIRVFMPTCGSRG

SEQ ID NO: 991813 - protein, 34 aa, Homo sapiens
PSVGKLEVPRSREDTILMPIVRRYHITRYSALQP

SEQ ID NO: 991814 - protein, 102 aa, Homo sapiens
MPYKALASKVLNYNVVITWWERQVKCGVCAGAWEESAYPEALTDVTQSYGSGCGEKQPPEFSGLCGADHEQKGLYGWHYVDATCGGGGQSLVRSGPGFRARL

SEQ ID NO: 991815 - protein, 45 aa, Homo sapiens
MVVALDSTSRIFTSVLSGSPKLIKCFSPGFGLRVGCGWSFSTSVR

SEQ ID NO: 991816 - protein, 44 aa, Homo sapiens
VVGGSQRGTIIFGYGLSKSEQIGLHEVKKLMYSKGNNQQSDGSP

SEQ ID NO: 991817 - protein, 89 aa, Homo sapiens
MCDSLGKLTLLSLGVLNVPFTGSDATIDVYLLNGLYLIISVTERWNDVYACTGLEASSLNSPPLSLLPRSARRRAHDLPSQLPTLKTLH

SEQ ID NO: 991818 - protein, 167 aa, Homo sapiens
MGKGLQPRGCTVDGAPHELELLSVSNSTGILGCTAWIVDGAAPNMWLALSPGTPQPRPHEGSFGFSSDVFIMDTIGGGEVSLVDLADLTVTNDNDLSCDLSDRTDAFKKTCNPKFSLRSANDGIRSLAFPPTARSGLVTCLRGRDAQSSGSLHELRVTAHEECGARL

SEQ ID NO: 991819 - protein, 35 aa, Homo sapiens
MLTRTGESHGWYSWSLAGGKRIQKKRSLKEVMVPR

SEQ ID NO: 991820 - protein, 95 aa, Homo sapiens
SGQQMSWVLLPVACWSQAHYMLKPWEQTVFNSMLISIVEMALYTGYVFMPQHILAIWHYFENRTMNKMRSGSEVPWGRPSLRSRNETIRCDKKLF

SEQ ID NO: 991821 - protein, 38 aa, Homo sapiens
YNRRARVSYRSFTRMAGEAKAGEAPTENPAPAQSVRAV

SEQ ID NO: 991822 - protein, 131 aa, Homo sapiens
MSELRGETCHLASRNHLHSANEHEVKTCGVGMGQVENSEPYAPSGGAVAVREPSDWPFPLASGVCKPKAALRYEKGIVPQIFVTCRIRNHKMLVAGPHGPGGSDNLSPWNAPRGPKAQQVDYFSPGDVFPA

SEQ ID NO: 991823 - protein, 99 aa, Homo sapiens
GLATTKLFLAKALTSPPRSYTFFIDILLDTIRDADRWVHRARPTQKILFTAGHPRSSIFNYTHKQMTALRQRSDGWVLVPLPTYYTFCQHSSSKPERHH

SEQ ID NO: 991824 - protein, 34 aa, Homo sapiens
RSLGGGIYLNKPVDDIIRENGKVVGVKSEGEVAR

SEQ ID NO: 991825 - protein, 60 aa, Homo sapiens
TLSLWGLVASAHMSGAVSPGSLLKGVLGPFTVFCATIGHPLIVPTPEPPWLSSLVHSLEQ

SEQ ID NO: 991826 - protein, 77 aa, Homo sapiens
TAAVLTDGGVTRKERATVRDYSVVVCRTWLTGVTLGFRYQMKSVYAHFPINVVIQEKVLYVGDPPFLEVANTSARFG

SEQ ID NO: 991827 - protein, 88 aa, Homo sapiens
RSLCGTALRSLGGGAAHVLMPHESTVEHTHVDINEMESPLCHPETAHQVDFKQHCTTQRHQRDTVNYVNYNLPTFFPLGPTRESVGYR

SEQ ID NO: 991828 - protein, 91 aa, Homo sapiens
MLPSLLLHSCAQAILLPRHSYRLEIIGVSHWAGQGIQIYHRVIALSPPGGSAGYHTILCTTGSMANLAASRQFRCRGIPHGGTCMAQGNSS

SEQ ID NO: 991829 - protein, 111 aa, Homo sapiens
MLVVEDHDAVEEGENATGSKEEESSAGSVGGVTGDESGLELLSRMRMVDQEWGKGGVVRENADGLAHGESVGEGGRILKIVVKMYHSDSSSHFSKEVIFKSTWEVPPPPHR

SEQ ID NO: 991830 - protein, 88 aa, Homo sapiens
MTLTFIRKKTHKGYTNSISHPIKCPSKNNNLKSNKLDSTGPTSKQTCHQCCNTNQPTHHNHTSIIRSSHHSSSSQSSAISIIAPIIVI

SEQ ID NO: 991831 - protein, 78 aa, Homo sapiens
SSLCGGQYSHLKEKNFQPRISYPAKLSFISDGEIKYFTDKQMLRDLVTTRPALIELLKEALNMERNNRYQPLQNHAKR

SEQ ID NO: 991832 - protein, 40 aa, Homo sapiens
LSVWLTESKCWRSSCHALWVDRPPFLWGRPAVVWTSEHSL

SEQ ID NO: 991833 - protein, 33 aa, Homo sapiens
GVYATISGLKPGVDYTITVYAVTGRGDSPTERA

SEQ ID NO: 991834 - protein, 110 aa, Homo sapiens
MHSFLNDVTHTHDPTGRHLSTDTPELTLILTTLECTSGSLYVIIIGRGAGTSGGSIDFDGSQTGQPDEFTISSIYTSSPIPPPCSSLSYHCVYINQNNTKKPPGPTSLPF

SEQ ID NO: 991835 - protein, 72 aa, Homo sapiens
PRGSPLSLWGRWPGRGVVGRLKSWLAESDLSPPIPDYPGVGFNTQICDSTPEPGSRGMQPLNWRFLMTLPLI

SEQ ID NO: 991836 - protein, 100 aa, Homo sapiens
LSLWGHAFGGLTAVFPLNSDTHTHRYTQTHAQIHTHTLTDTDITQRHTHSHIHTIPGTLPKLQPQTDMPLRPPFSGAPHLPCARGVGTPHQLQDTPTERA

SEQ ID NO: 991837 - protein, 35 aa, Homo sapiens
QENWCEPPEMELAVTPRPAPLHSSLHEMSNDPISK

SEQ ID NO: 991838 - protein, 88 aa, Homo sapiens
MMRPEHVIPFPADRSGQGEEGDNARAMAAEQHSCCEWQCSVKHTEYQIPYVLVRSRTVTKKCLSLGEFKKNRGLIGSWFCKLYKKHDS

SEQ ID NO: 991839 - protein, 170 aa, Homo sapiens
PPIGRCTQVLHSFTAVCQDDGTWHRAMPRCKIKDCGQPRNLPNGDFRYTTTMGVNTYKAHDCQITKVEMKEKMLRAAREKSQVTLKGKPIRLTADLSAETLQARREWGPIFNILKEKNFQPRISYPAKLSFISEGEIKYFTDKQMLRDFVTTRPALKELLKEALNMERNN

SEQ ID NO: 991840 - protein, 83 aa, Homo sapiens
GSTDVVLFICLIKGQDEDLEVMLIKGAHGRGEEEGYLMDGEILIQNDLEMSEMNNAINNRIESSSTLHYDIKNHAPIKENKVL

SEQ ID NO: 991841 - protein, 227 aa, Homo sapiens
MDVEVTEVLRTPKYEASGKITIEYGTWKSGKNVISIIVDGMSWEIVASLKANGKLASQKSPVLRMARKSPRKPLENMVKDGETRMTPWFLKRCLGIEVRLTRLHTVPFRRADTHEIINHGSLAGRQTQSWRRRPQTRWAERRQHRDLREALGRNRERWGLDSPGERKLLGGDQGLAFGPKTRTRDQLVPGNSGAQHHITGAGALTTQERAVGTGTSCGGLRLCQHNV

SEQ ID NO: 991842 - protein, 78 aa, Homo sapiens
CSTDVRALDQGWQTFSIKGQTIDFFFLESESRSVTHAGSAVAQSQLTATSASRVQAILRPQPPESWGLQAPTTTSVRA

SEQ ID NO: 991843 - protein, 140 aa, Homo sapiens
LRQVYWKTGSVGGGFLLSQNLRGPHSSLSLLIGALLFNYLAIPESYGLEKKKVLVSGTSKKIYLFGTTRYINGILQESKYPPGQEQRTHSGLLLQPLFSLEKRNLGSGHPRAGVAGGASVGLSGNLSPSEVQGDPRGFSN

SEQ ID NO: 991844 - protein, 216 aa, Homo sapiens
GQYGCATDAPDPAQAQTWRRLEITGTRKFAPNAKCGHSRNANVAGDSSVGELSRGWLHNDTQGFPRMALAQHSGKVKETESTVSHGFAKPILPCGLENRTTLFSSQPNLSNLERSCRDEQSKHPFTSPRFPGGVLCHNRFTTLSVMCRYTHMHSHASVHAHRHTGTYASVHTHRHSHASVHAHRRTDTHPCMHTHRHSYAFVHADTEALKASVAAQ

SEQ ID NO: 991845 - protein, 34 aa, Homo sapiens
WQYGCGVKNEVAITLPRKQQVSSFEQWFHYMKNT

SEQ ID NO: 991846 - protein, 33 aa, Homo sapiens
QYGGENYQKPANLHNQTQGTPQQAQSNGPGVPS

SEQ ID NO: 991847 - protein, 34 aa, Homo sapiens
TDSPGQYGCGEDLKGGGGAGSGLSCFLTMQWRMT

SEQ ID NO: 991848 - protein, 83 aa, Homo sapiens
MMRRHSSLGDRARLHLKKKKKAAEFGQGFENPGPRGFGNSGAPWLVPFLGRAITLVPQFSIGPVSLTFSLPSFYGGRCKSLSP

SEQ ID NO: 991849 - protein, 45 aa, Homo sapiens
MTLSRFLDNGLRTGACKENFGGPSISEILYKGLIFLMRKKFTFFI

SEQ ID NO: 991850 - protein, 44 aa, Homo sapiens
TAGVLIPCDITTVLVGDHQLHHRKGIEDSKGGNVPEVDLVLFPA

SEQ ID NO: 991851 - protein, 48 aa, Homo sapiens
EDPGQYGLDSMTAVEEEGSGGSVLEAQSRRDQCVGDGTWGDRVLGLGC

SEQ ID NO: 991852 - protein, 90 aa, Homo sapiens
GPALRFSESRTQPTPISCPLQEIKRMLALCKSSRVEVGLHPHGLKSHRATALISPHCPLHLPPSHLLTNRPEGVRPVSVLLALSSKPGTW

SEQ ID NO: 991853 - protein, 37 aa, Homo sapiens
EIEAAVSCDCTTALQPEQQSQTLSLKREINKLSSHPY

SEQ ID NO: 991854 - protein, 33 aa, Homo sapiens
MQCCGKAEKRKLDPAELAIVAAAQKKDFPHRES

SEQ ID NO: 991855 - protein, 43 aa, Homo sapiens
GQYVIAVCSLALIAACASWVQVTLVSQPLKYLGITLHTTHECP

SEQ ID NO: 991856 - protein, 77 aa, Homo sapiens
MYHSPTHPWMADPASQGPSWKCKVWDHTPSPEPDLVAFLECGSRGDCSFTSCTSSSLTLRIIILLGENLAEAGKDFE

SEQ ID NO: 991857 - protein, 173 aa, Homo sapiens
MWQIRRVGYTTTTFEGGGRFLLAIPFVLLSLGVAVSPCEGREARLKYISTVVQRVQVSSSGWFNSKVRVDGGVPRRPREVLVLTIGDVLVGACIPVLLGQPEVDDVHQVALLPQDHEEVVWLHNPGGSSSLNECIRCELINLVSKQQDGFEAEFPGAEVEEGPPGLAPAVPSP

SEQ ID NO: 991858 - protein, 59 aa, Homo sapiens
MKWSGSRTSLLLALCPALPALASRGWRLSKPVPVIQCFFDHAMLHSPSARTTLAIQLPP

SEQ ID NO: 991859 - protein, 51 aa, Homo sapiens
PESDRMDSWCARWAWSITWSKSLDNENGYGQAPDHLEAMGRAEQGQNASEQ

SEQ ID NO: 991860 - protein, 32 aa, Homo sapiens
MRGGNGGCNGPCSVGLCVCGQKLAVLGTGEER

SEQ ID NO: 991861 - protein, 68 aa, Homo sapiens
NATREALLGVEIETGSGTTLRSPGRSAPVSFTVVRQGFLPCCWELTAEGRDCPSRATFETCVSHQAIQ

SEQ ID NO: 991862 - protein, 121 aa, Homo sapiens
DLEDPHSDDYCSDVAVLGRWTCSNTVISSAIILSSRTFSPACSEIVGGLRAVDLRPNDVPDDQNASPQGSRAPMILFLEPDLCEGPLVLRLRSRLQLRLRCQLRAVVLRLLRLLRIRLQLL

SEQ ID NO: 991863 - protein, 52 aa, Homo sapiens
GGQRGTGAVQRQIKRDPQELLHNQQAIDHQSSIDEDTASVAIQRHPRPFNCL

SEQ ID NO: 991864 - protein, 69 aa, Homo sapiens
TCDDVPYFVNSLSRNMPVGAGSNIESPSTVDWEVATDHSDLPAGGDIGPPPGASAGTYQTLASKQTKIP

SEQ ID NO: 991865 - protein, 69 aa, Homo sapiens
TSDEFTQYLMGTPLHMYCHDLVTLTDYSDDSGREEPTSCRTSRGSIPPPEELRVGNTMTVMLATQPGSH

SEQ ID NO: 991866 - protein, 67 aa, Homo sapiens
DDGQRTVLGQRTVLGQRTVYWKEYLLLATLVLVEPWAQSSVMYSWEARGLEVSLSAPPSSIDGALAQ

SEQ ID NO: 991867 - protein, 112 aa, Homo sapiens
MSEFPTASYTLLPVRMRDGGLSGVLLCVLHLGIAHGTNAQDQFLLKQIVSNVLIFSCTNIAGVCTHYAAEVSQRQAFQETRECIQARLHSQWENQQQERLLLSVLPRHVAME

SEQ ID NO: 991868 - protein, 80 aa, Homo sapiens
MLRRTKWQAVIVEASGGGAFLVLPRKTSTGRIDKAYPTCVCAHGYLSWTSTGVLTTTNSEPCASEDCTVTVRWPNTVRWP

SEQ ID NO: 991869 - protein, 35 aa, Homo sapiens
MRLPASTSALWMPSSRSVRWRWTLLSEAPYGALAQ

SEQ ID NO: 991870 - protein, 79 aa, Homo sapiens
MPIQVVPSVLCPVHKNSTGPCCRGGWCNQSSYIAEGWGQLMPAQRGGFFIPEKPGPVGGVRRLSEEAKLAKIRGCVESG

SEQ ID NO: 991871 - protein, 48 aa, Homo sapiens
EETSLNAYNSLDKVGAEAYGALKPDVPPKPSFAPTFHIAIECPIDAVY

SEQ ID NO: 991872 - protein, 58 aa, Homo sapiens
HTGNNARSVYLPLDYGPCRAYFSVNYYDRYTQSWRQFLYGGCESNANNFLHLEGLRRM

SEQ ID NO: 991873 - protein, 52 aa, Homo sapiens
LYIIQPNNAWFISISSDTCIDDLAILTVGDVCSTQPIDLDQLQTTATRQTQQ

SEQ ID NO: 991874 - protein, 86 aa, Homo sapiens
MPYSSARYEQLMEAWEKKVWSCIENNPRVVGQWRARCCEYYEQAVPKRSCKQREMQDAACRAWWASGAEGLIMSAARRDARRVSEI

SEQ ID NO: 991875 - protein, 46 aa, Homo sapiens
MPIWVSALRFGINMSDLPESGKTTSVAMKERVNLAQCLETGAIEPK

SEQ ID NO: 991876 - protein, 68 aa, Homo sapiens
KQRDMEGLVKRCQNFFGLLIGEDELMIWDYPVPLKGGSLLYRQSFLEWESSWVEIAWDNREGDGALAQ

SEQ ID NO: 991877 - protein, 114 aa, Homo sapiens
ITLSDTVMLQVDLPMAAVEAINIDQLGVNDVMLEKPRVEGQALVCELCYDRKVEKRCQTCKANLCHFCCQAHRRQKKTTYHTMVGPNKDLKGYSRNGKGQSCVLFTLQRELRLY

SEQ ID NO: 991878 - protein, 35 aa, Homo sapiens
MTMRGMSRLVHVLSCSSRAAVVLEQCVMVCATFVS

SEQ ID NO: 991879 - protein, 44 aa, Homo sapiens
SDTVRKQWSRTESVWEAMLVSMSESCIPVEDSQGTQWRGDYFSD

SEQ ID NO: 991880 - protein, 99 aa, Homo sapiens
APFIEDPVFIDSIHCSSSIQTGPYLLRNHHRVPHFNALFYIYKYLYIYFFNYCHPRLNMQWQGSHTPPSQAPRDFSLPTASAMYLETTRHVPDTPMLII

SEQ ID NO: 991881 - protein, 79 aa, Homo sapiens
DLEDPYGRCTKHSENRYNTNSFSKLKKGLIFSSFFFFVGRSRSVAQAAVQGRDLDSLQPRPPRFKQFWCLSLPSSGDNQ

SEQ ID NO: 991882 - protein, 38 aa, Homo sapiens
VVGVLEDPNGVFSGSPEYSEEKELEEITGEQEEYNLPV

SEQ ID NO: 991883 - protein, 144 aa, Homo sapiens
PRGSPTLSLWGGDLGVTLAPGFLTDDPVNHNLNRHIFYSQSHWPPHPGKVCINGPFIGIELKVDTNTTAELASERLRGAHSRRAARLGKEQRLCGCCAQPGASIKVANTTGWPWSSFRGKAKNPPGLGFNLRARRSGITGIISQ

SEQ ID NO: 991884 - protein, 39 aa, Homo sapiens
DSRGLPSLCGGHVRRDAVSHGTHSLLHRAVPQGLRQGGQ

SEQ ID NO: 991885 - protein, 66 aa, Homo sapiens
RSRGSDALSVGNALAPPDGDEGLLVFLQEMDNPCGCPQGVCDHGTGDWRNPWISTVGPAPPVRAMS

SEQ ID NO: 991886 - protein, 115 aa, Homo sapiens
AGCTVPWVNGSNTACKNWVRRCKRHGPSAKWRKRVMAGPRKGSSQAAQELRNHLGRESEKRCLISAAFFFFFLEMGVWLWSPRGGVRGHSFSAQCKARTSGVTPTHAISLCLSPP

SEQ ID NO: 991887 - protein, 67 aa, Homo sapiens
DALSVGALRTGPSNLSPAVSETRPASLTILLSCVVCEPSRTPWNTVQRVDKCAMDVPCTRGPCSCGI

SEQ ID NO: 991888 - protein, 66 aa, Homo sapiens
RINEKKDGIDSTVEMQYRGPERKQSLACGDLNLQKAVIQVGVRMGSFVTLKEQMGTPEGRTLQKGP

SEQ ID NO: 991889 - protein, 44 aa, Homo sapiens
LSQAPLALTPSLPHLQHRSGLPSFWLAAATSKSLAGQCGGCGQP

SEQ ID NO: 991890 - protein, 63 aa, Homo sapiens
MGPPGPPFNIKARKARKYYLGVIIWNNKDVILEEKMLTGEEMSDIYVKGWIPGNEEEKQKTDV

SEQ ID NO: 991891 - protein, 54 aa, Homo sapiens
GPTYVNVKTSASSALICLRIGHGDGPAAPELVPCGTFFHVSSLMLHELLATCDL

SEQ ID NO: 991892 - protein, 101 aa, Homo sapiens
RAVRMWRDLKIQLGILPGGSRLIAFDVWKTQRAFSKYEKSAGWVSNSQFLVKPLDMMVGKSGNMLASKAYIHQYTKLGIEEEDFLDSFTSLEQVVASYGNL

SEQ ID NO: 991893 - protein, 44 aa, Homo sapiens
MIPYTGSTCLCCSGGIGFTRFRAYDTQRVRGNRKHTISPEDHIT

SEQ ID NO: 991894 - protein, 40 aa, Homo sapiens
SGTYHFYDHDLIQGKYIVDGNPGGIVGKFKRRIHKYCYLQ

SEQ ID NO: 991895 - protein, 80 aa, Homo sapiens
GCCGRLSQAPPFPNPFKAHMYSHFFPGGSQSLHHGGPFWSSGPVGASCVHFHGSTHSPAMQPGATAHPQHMGCTHVHPHL

SEQ ID NO: 991896 - protein, 59 aa, Homo sapiens
VLRCSRRLPSGAQSIGGFSLAVTSSFFHSRSILIGSTLASGGLSQHSALVPPAGTGSSH

SEQ ID NO: 991897 - protein, 143 aa, Homo sapiens
MITAHGSLNLRGSRDPPNSASGVAGTTGGRHHAGIIKKRLGIDGSHYVAQALELRGSSHPPTSASRSARIIGVSHQVFFTFKNGNLRRYSLHTRGTHFTGTVLNSSTHTYTGVRTSHNQYKEYPSPQKVSSYICAISNTPFRL

SEQ ID NO: 991898 - protein, 89 aa, Homo sapiens
RSLCGEGTSFPRDSRPFKFIMAALSMSTPGGVACSTSDPVLNGPDDLCSAGEKFFPLGMNHQLLSPLTRVIYVGNAFPALQPIPPTERA

SEQ ID NO: 991899 - protein, 71 aa, Homo sapiens
VCSTLVESESGLDQWSLADLALVPVLDICHCFETGPHGQEHEGSTGRLDQMYNFNAGQAKVGHIMAGYELE

SEQ ID NO: 991900 - protein, 109 aa, Homo sapiens
PELSLVGTRLGDLYEKRFNGSQFCRLYGKHGGICFWGHLRSFTHGRRQSKGRHFTQKKQERERGATLKQPDLMRSHSLLQGQHQRDGAKPFMMNSPPQRERQRPPTERA

SEQ ID NO: 991901 - protein, 65 aa, Homo sapiens
DALFCGGRGGGLVRPLDSFKGPRVGPGSKPHSWFGWSGCCMGMPAVLHMCSVSVTPTVATCGAPA

SEQ ID NO: 991902 - protein, 34 aa, Homo sapiens
MYGQCYVSNSHILINVILPASELPEVLGITACRA

SEQ ID NO: 991903 - protein, 73 aa, Homo sapiens
KYCRGVELSWDACSSSYQRLGRYLWGTEHEFDFWGSPCNRKTTLFFQMRKTDPLITGSTEHPRPPHRESVGYR

SEQ ID NO: 991904 - protein, 55 aa, Homo sapiens
LSEDPQSVFLEGLVSRPVCWEIKFTASELSSVTSCFRDEDDINDVTSMAGVNLYE

SEQ ID NO: 991905 - protein, 81 aa, Homo sapiens
YGCGRTSGTRKRISGRALECLIWEKEKTLTALSSNKSSGNNKAVQWYPGNPLKSGVGKLQYHQRERLGMPNSGYGPGVPSS

SEQ ID NO: 991906 - protein, 40 aa, Homo sapiens
GQYGCEGQYGCSLSSRLRLRSRGNSDVTKQDPLLKCHIRT

SEQ ID NO: 991907 - protein, 73 aa, Homo sapiens
TALSVGAGPSSLSSLSGGGGQDSSLGPLATGTSSLVPGLAAIFSHSFLIDAVMAPPPFSLQHSPISTVPTERA

SEQ ID NO: 991908 - protein, 57 aa, Homo sapiens
MDRESGAFNDPSDPFGFLARRCQTSLPQGIIWLVAAKRSELRRVSDPSTVGVFLVIV

SEQ ID NO: 991909 - protein, 126 aa, Homo sapiens
MSTQEAHCRGEGVSMDLQKRHRSGIPCGLELYRSSRVRVGLDGAQGHGRGSPACVDECTRRSHLSAAPSPAGCPALPLHSSLIRYGSLGISNDSCPKHNSSFSFQIGFISLLVSLKDSPTERASGT

SEQ ID NO: 991910 - protein, 112 aa, Homo sapiens
MFVHMLLVYHDYSPALSIRYELKEVYLDIWFRVVAETLTIMASTGNGQVGHCSITVDGIRYGERVHENAPYIIYHQICMRVTIHDDRMGTTCPHGFNHARHWVPPTIHGNSR

SEQ ID NO: 991911 - protein, 174 aa, Homo sapiens
MLQGGMRTADVARAINCNVHTVRRLRQRYRKTRWTADHPRSGRPRVTTPAQDPNIRTSHLWDRYRMATTTARITPGTHKPSITAKTVCNRLRGAGLRACRPVVRQVLTRYTGNNVTYEHKLTIAAPDRPSKKCCSLTSRGFVSLGVMVGFAFIVEGMSVTPRPVLRSGIDLEVE

SEQ ID NO: 991912 - protein, 126 aa, Homo sapiens
TAQLLRVLVRAAASICSRVLQAEGWWAALYVQQQECWCWMRPPHPRAVQCMRLVLRCVVCCCVTVRGIHLHAHWCWCLLWRGVRVVPPSACTPTDRRMGVPLACLFPLGCLLQLALTTKVHFDLTW

SEQ ID NO: 991913 - protein, 103 aa, Homo sapiens
TTSDESSDVRCVFVPSGGFVVSDFRREAADLRGECYLLLKTWQTQSVSRSKIYSTLWKRTQADRGGKLGSLFIPLSDPTHILLIGTFYRELIGPFYRQLIGPF

SEQ ID NO: 991914 - protein, 32 aa, Homo sapiens
MDVDTAAKRLRGAGQWVLESPRDPVCWGRGVL

SEQ ID NO: 991915 - protein, 45 aa, Homo sapiens
MASSVRLVLPRDTRLRVPSLQSGLGVKGQVSNHPSPHLLRAGGTE

SEQ ID NO: 991916 - protein, 93 aa, Homo sapiens
MRTKQRVTQYSTISRNNVENKSDCKVIIKSTDFIKFLSVPTQSRDPESIRNPCLRLLQLALFRALPRPHLRGTLTAPRSRGWQAPETRRFNYY

SEQ ID NO: 991917 - protein, 53 aa, Homo sapiens
MEATCSMPGPATALHGASCLCLELPAPPQSACPAVHSGRMTLNSLTNSSPHPY

SEQ ID NO: 991918 - protein, 84 aa, Homo sapiens
MYGEVNGQAHRCLVLMPYDLLGGPGVSSFYLAGSDAIWSSLMVRIPKVAYSDVLELPERALSPVVSVAARGHWCRVRRLALTYV

SEQ ID NO: 991919 - protein, 87 aa, Homo sapiens
VLKVCIGTVSGARHMSSHRASGEDHSPSSMQVREAVVAFQYVQGDWHWNVNIDCQSVVPSVAGRRRQHENLDGDTGMLQIDCAHSAT

SEQ ID NO: 991920 - protein, 67 aa, Homo sapiens
WQHYSVGAMGVHAHIYPLSAAVPDATYLHEWQASEDVSPNPGPQQCPIYIPTNGWAPLQHTVRCAQR

SEQ ID NO: 991921 - protein, 89 aa, Homo sapiens
MLSIAAVGLGRGHRDVIEFPSSSLGDGSDEEKLSAIRGEHRFFILSVAPGLTFILVFLRADPRGGVAEGEDGHVLRPVQPGHGDHGALA

SEQ ID NO: 991922 - protein, 111 aa, Homo sapiens
RGDLEDPSGEQSLGQSLGTITWNNHLEQSLGTITGNNHWEQSLGTITGNNHWEQSLGTITWNNHLEQSLGTITWNNHWEQSLGTITGNNHWEQSLGTITGNNHFPLSDGSP

SEQ ID NO: 991923 - protein, 43 aa, Homo sapiens
ETRQPIQLKWDLECARVWQQDTMLKLNLVDPYTTVVSSVTYYM

SEQ ID NO: 991924 - protein, 92 aa, Homo sapiens
ERFKQRRSLDRKNPREKYTSHCKVTEVVSDVTAVHRQGGERVPSERPEWKRGPGLHAGTFQTVQIYSKSCKRQLERLKANRWYWLGTVRWPN

SEQ ID NO: 991925 - protein, 141 aa, Homo sapiens
MTRSFTSRFTVWDGGNDAVVLWTSALKEESVLTLGAYCFHRMVPKLLSMPSCLPEAFTIIIIFLVVEFISGQGVNVVPILNLTPGLPSIIKHFPEVGSRCLQQDKLRREAFQEHPQQAICLFAKFSFQLGLCPSQGEVHHL

SEQ ID NO: 991926 - protein, 113 aa, Homo sapiens
TDDESWRESHKLSSGDEVCLARRSRDNGSYALRSGERGILTEGWGKVCLTEFCREVRLAEVYREGCMAEVWRKGCMAEVWRNGHLTEGWVKVSLNEFWRESRVGEEPREGLSG

SEQ ID NO: 991927 - protein, 119 aa, Homo sapiens
GLVLVRPCGVRDGFWRKAPLRGPNTGQDDNLVWEPGVLASLVPDSCITHLLETSGRFCGSKLPEPIVSTDSRLWVEFRNSSNWVGKGFFAVYEAICGGDVKKDYGHIQSPNYPARQEPH

SEQ ID NO: 991928 - protein, 52 aa, Homo sapiens
MFSDAIQEVKWRAQDQIYILRTRMDSGSQVGADFQGATGCEAIDYAILDRQK

SEQ ID NO: 991929 - protein, 47 aa, Homo sapiens
CDKAAETQDLMKVLPNQVLKPLPGGFQVPKSAALFVGHNMLLVSEEP

SEQ ID NO: 991930 - protein, 90 aa, Homo sapiens
MCVGKPECVVPQWCSNRSPILPWLTKLQIIYCYSSVKPEVHNQGVMYESLSLRPAEDDAPGLSPASGVPSRPWDSLALVDGKLRSPPLSS

SEQ ID NO: 991931 - protein, 86 aa, Homo sapiens
KTPSTGSLNYGHSCCLAEKRPHYDAQAVMQWAIIANCSLDLFGSTEPPASASSVAGTKGTHHHIWLICVLICRDRVFPCCPGWALT

SEQ ID NO: 991932 - protein, 39 aa, Homo sapiens
PQPRVTEAAEVVVEVEVSDSTNYGKASDVVAIHGPFNAS

SEQ ID NO: 991933 - protein, 54 aa, Homo sapiens
MGLEHSVVKKPGSRNGLDGTSLLKPVQAAQGKSQEQCTSSEPGSHMPLSVSLSY

SEQ ID NO: 991934 - protein, 31 aa, Homo sapiens
MNSIFLHREPCGGGFLEGIVDNLHAVIHYST

SEQ ID NO: 991935 - protein, 70 aa, Homo sapiens
MSRRNNTITVHDMLLSSNPLITQRTLLPNIVPIAILVFAACEAAVGLALLVSISNTYGLDYVHHLNLLWK

SEQ ID NO: 991936 - protein, 60 aa, Homo sapiens
DLSVNRRASFTRIVYYYTRTESILRYRTDNALNTHLLVDLETLHKQKVKAGQDDDLHIVP

SEQ ID NO: 991937 - protein, 66 aa, Homo sapiens
QLSSSCVIHPGEIYDRHTLNNRETCSTRQPEKTIPIPDEKLDMIYHIQRDQKSPRRTPNNLEAQMC

SEQ ID NO: 991938 - protein, 67 aa, Homo sapiens
GGVSLGGREHAEGRSPAGVVNAEASGGDTERNSMAARRTEQSSPSSPAHARTDTLRAPWSTDRSHPT

SEQ ID NO: 991939 - protein, 71 aa, Homo sapiens
MYPDEDVYERAHLTYRVNNSDRGGTQTVASPPLGVHAGEETEAEVAGAAPGSRGRGRQGRESLTSGSSPPE

SEQ ID NO: 991940 - protein, 132 aa, Homo sapiens
MLRLSPITSQTSNMRGRQSWSHREVKNPEADNKRIGLSISFILRENLTFYLQCPSQKSAQDHTYPPTYGFYYTGKSKIKVDNQLPYHLGLTGRRSIPASTDRKHQEHPKGDISLRTGRHKGAENDYHPQSWK

SEQ ID NO: 991941 - protein, 64 aa, Homo sapiens
MFVSTHILHTITLCICKRLYLILTVHFELTKKNNGNYRNCGRTFNLLGLVLVVPIFGQSHNYSG

SEQ ID NO: 991942 - protein, 39 aa, Homo sapiens
MERHRCCTRYTAHVGQAPVHGRGKMCLVVAVSSPAGVSQ

SEQ ID NO: 991943 - protein, 46 aa, Homo sapiens
FTTLYFLNALYSLYAYTSYKNIQAGKRGEVYSVEKYKAWRKYKGVE

SEQ ID NO: 991944 - protein, 67 aa, Homo sapiens
VQFGTWLGTEQRSPVPPPLACWYLWEARGLASRPEHRTQAGEGSTTRGALSVPVGSSPHWSHQLSWI

SEQ ID NO: 991945 - protein, 57 aa, Homo sapiens
MGVSSHPLTISLVSARMNCSFSGVRIHRANFWPVRPSPSTTIRHWPGVTQLGGVNHG

SEQ ID NO: 991946 - protein, 104 aa, Homo sapiens
ENPEECALVRCASHGLPWKNDDALSVGSSLYRCRGLVVMCGEALQPLVLPPIPSVTYLNTFGAQPSVGCHVGDVGASLFSRAPSPSVRSPPPLLVDELRCLWWT

SEQ ID NO: 991947 - protein, 69 aa, Homo sapiens
MPAALSVGFLPWPFISPLPSGQFCQALLGGKLHAALAGPRLSLVVYSQGARPAVGFADPRFRHAPQAEQ

SEQ ID NO: 991948 - protein, 84 aa, Homo sapiens
MPGEVMGAPKSLGTELAQEVLASCVDHQVASHILPGVEASFTVVALVLLFLGSARGLLFRMGFEVVQSTSVLPSSRAQTPQRER

SEQ ID NO: 991949 - protein, 89 aa, Homo sapiens
MPTPLYGVTARQVHVHVMLTSMFMYGVLAPWVGPLPQPRLPHGRAQCRPGLHQTPCTWECLQALTHSHLPGQHGGIPLVGAACIILLHL

SEQ ID NO: 991950 - protein, 41 aa, Homo sapiens
ARSNTFQQCRTINRCCSPGCTVKGSFVAPFNHIHHRLKCHS

SEQ ID NO: 991951 - protein, 96 aa, Homo sapiens
MGACRQWTLKKSALIVHAYGALLMHQTLRFLFYPLTNSPTKYCQPHFKDEETGPGTVAHACGCNTLGCQSRRLRQENHLNLGAEVQGDEDGALHPA

SEQ ID NO: 991952 - protein, 35 aa, Homo sapiens
WRDDLLCEEKAAVGKKPKPEQGEGWIATRRDGEVF

SEQ ID NO: 991953 - protein, 88 aa, Homo sapiens
GSPGQYGMWVGRYGNKSQATEPSSGNLPGHLPTPWNVCVSLFAINFVAAHCLGLRHLYELLHSTHQQVCQLHSCKPSAARGNPHRAAA

SEQ ID NO: 991954 - protein, 127 aa, Homo sapiens
STLRTRRSLCGAITGLMLCLSAAGVVLAWCGDCPIDTGPFTTQPWDLWLWLELEKRAEKLVPTKDPQQHLLPLSDLGNSGHNPCTHPHSQLGHWPRSPQENVSGTHGPPQRELSTLLWGRHQWTQRE

SEQ ID NO: 991955 - protein, 92 aa, Homo sapiens
SSEDGVPPRDWVSVAWEDVIHVGSHSGRILIPINSISHDRNTGVDLLSVLTCTASRTDANYIGGTIRNKARPRPLPLRDATAHGLPRGIHHG

SEQ ID NO: 991956 - protein, 45 aa, Homo sapiens
GYKSLGSVTAGPLNGSQDLLLVLLGEVGVLRQAMGGRRGYACFII

SEQ ID NO: 991957 - protein, 59 aa, Homo sapiens
SSPRRLASPASPLGPRWSITALAEPSRRRLPFCPGDPFSPLKPRSSHIATVKPQATVNP

SEQ ID NO: 991958 - protein, 87 aa, Homo sapiens
AGFLMADELELAWSITPGVMAGLTAHSKFCGSLDRAACSRTAVGSVGAIFGLSLSVSCLMPTSWHSQEPVKLSPGQWLRPCLLNSES

SEQ ID NO: 991959 - protein, 78 aa, Homo sapiens
MRLPLGDRARPCLKNKKKLDRGPGISSESEWQKSESKSDDISLVEIIKVMALVVSQQPRFSSLALDTLFSTYDMNLGI

SEQ ID NO: 991960 - protein, 37 aa, Homo sapiens
MARSRLTQPPSYPGSSDSTCLQAPKLARTNRRYPPRP

SEQ ID NO: 991961 - protein, 78 aa, Homo sapiens
CVRILFVHPLSFSPIHFSLSSLPTPPSTLLIDLKDAFFTICLHPDSQNLFAFTWTDPYTLQATVNPQATVNPQATVNP

SEQ ID NO: 991962 - protein, 121 aa, Homo sapiens
MWVRPCFLIPRRAEGDTKVYQAVLKAKIQKLAESLESCTAGSGRYSATQLAVSRFTLLPPSSTSLGHDLKNLPLGLPKKCRALQGMSPPAPGHGCLILKPVKGDPPRSNLQGYAKSWATGP

SEQ ID NO: 991963 - protein, 30 aa, Homo sapiens
MTFSCGLLGGITVSLSFDSWKAGASGDVIL

SEQ ID NO: 991964 - protein, 44 aa, Homo sapiens
ILPPRLYHFSKAFIILHFHFPGHAINSVAGSHTQRFAGVTGSSH

SEQ ID NO: 991965 - protein, 59 aa, Homo sapiens
GLTVLEKALTLSSTSTTSYSLIKGISIAVYRGYLNEIARRPSCPQLYQGGSLKSSTLQR

SEQ ID NO: 991966 - protein, 90 aa, Homo sapiens
MSLLVMYSTLVLVICSASRVGLQVAYDHAKGEGGSDMSRGEKQEQEGGRRRCHTILNDRILQEFTIKKTAPSQATVNPQATVRPQATVNP

SEQ ID NO: 991967 - protein, 39 aa, Homo sapiens
MALWRDPRGLNRRPLAQQRSSGLCKPRVNPIKPRFNRTS

SEQ ID NO: 991968 - protein, 38 aa, Homo sapiens
PHDLWLEPYSPLLTTYTLLPMTPVWNPTVPYSQPRTLD

SEQ ID NO: 991969 - protein, 82 aa, Homo sapiens
AAAACTTEGDGSLGAQMADAWFVVASVKCVCSIACGSPWLGPHTPVFLCLEPGSAGIGHYSVSGDRVQFSYPTHAHKKVTIL

SEQ ID NO: 991970 - protein, 53 aa, Homo sapiens
VVVELGEAWVDCEHFWDKGKRCEYSLVRLDGQKLQLWYGQYLHYLKSCWRSLE

SEQ ID NO: 991971 - protein, 108 aa, Homo sapiens
MQVSFPPSSCTHRTLSARASAAVAIGVNGMSVCSQLDLTEHLLFILTGSGLADTRAVHSMSPEMSAHMIMVRLPLTCRLLHVPSRTHGILFCATTDTIKRFADYVTGT

SEQ ID NO: 991972 - protein, 51 aa, Homo sapiens
PEDLGLLGKRGFSGPLGGYWKTLDFSGPTLDFSGTPWTLQEDTHLSWNTLD

SEQ ID NO: 991973 - protein, 47 aa, Homo sapiens
MQVSNSIYRRSFMVQESIGVGGKKKDKVKGYMIETLSFGLQTPAKYY

SEQ ID NO: 991974 - protein, 32 aa, Homo sapiens
MIYEDPDFLDIFSSIRYRQYFLCFSHSDTCIQ

SEQ ID NO: 991975 - protein, 147 aa, Homo sapiens
CGVPLWETDCLLLDTLFILLILHLSPYLILPGRRTRTQDLSNGGARRAVAQTGLDMPPARHTVGEEKERTAVALQGAQTWELPELACDSIFGTLWFLVSPNFQELTMFLSVNHGSCLQCVWSGRSLTESPPMLAPGAAHPAAAPSVP

SEQ ID NO: 991976 - protein, 34 aa, Homo sapiens
SETGTGDKGQDRPRRNKKSESSPKEDKPSASREN

SEQ ID NO: 991977 - protein, 52 aa, Homo sapiens
LHLLVSAYGTNQCRGQEALTLNLGGGAHCLTLFSAARPMYHHAGSKWVNNRS

SEQ ID NO: 991978 - protein, 50 aa, Homo sapiens
DGAEEAQTLGGRPRLLILDDIAGNPGKWRLPGYQTGIGCGVQDTQSDWCI

SEQ ID NO: 991979 - protein, 61 aa, Homo sapiens
YILTFWVSEVYSTQSAQIRATRAGSTRWFIHLDHHTKRYTERRHLFKIDNTTIQLISVDIK

SEQ ID NO: 991980 - protein, 47 aa, Homo sapiens
ADVIYEDPDALSVGLPGSKGPVGEGSQRGEACGTPKGINVGAGGSVN

SEQ ID NO: 991981 - protein, 66 aa, Homo sapiens
CRHCVTGGGGEAQKRQAQEEASACGRQVQDGRQRKRQAEVDAGLRVKAEAEAAREKQLAPELAARP

SEQ ID NO: 991982 - protein, 57 aa, Homo sapiens
AAVISQAPRGAPSIGGCSGCPSSFSTSRSILIGSTLAQVASANTVHGSPAWVTAART

SEQ ID NO: 991983 - protein, 56 aa, Homo sapiens
AVIDEAAAISVEGGIKPQAHHIAVEEICEKLKKKDSQICELKYDKQLAPELAAAPE

SEQ ID NO: 991984 - protein, 158 aa, Homo sapiens
RLDVQQVVLEGKMSHEQEKERFTHSSSDLTCGGFQAKNDEGGGVILSRNIRHISGLCEPQFWEQELESLHFVIEMRNERIHELTGVILMEPVEEKNLILGEKITTLQQENEDLHVRSRNQVVLSRQLSEDLVLTREAWRRRCVGRQLSRRRRACVRVL

SEQ ID NO: 991985 - protein, 88 aa, Homo sapiens
GNKSFGERSRGHTGPGKTGDLCYYYRDSSPPPYLTTDSNRLQYNESNDSGKYGKIQTLLEKEFFFGGIKFILCFKFSVEMGISLCGPG

SEQ ID NO: 991986 - protein, 74 aa, Homo sapiens
GLYAVWLVDLFEDAGRVALGPPVLEGQSSSTDDASQCCCLLIRSCREVSRVKTLSANGGVVRDTISAPDSSSPL

SEQ ID NO: 991987 - protein, 113 aa, Homo sapiens
TSVMLWKVSAIDIEESELEDKVFELTQSNKDKEKRIENMNKASKKSGIMLNDHILRIISVPEEEENTKSLENISAGDNLRKTFPWPCLENVDIQNTESIKDHLGKFIFKKIFA

SEQ ID NO: 991988 - protein, 48 aa, Homo sapiens
GGTITGSQEYETGRANRWNPGGRGGREPRSVAWHSSLGERARLHLQKK

SEQ ID NO: 991989 - protein, 105 aa, Homo sapiens
LCCGALTVPRSLGGGGLRRRSMVCQNFLLAEDAPHGHYHRPRGTRVAAALPVQIHPPIIAVVMIRRVWVSINRHQGPRPGGIRGSKYQQQQLSPIAASVPTAAAS

SEQ ID NO: 991990 - protein, 39 aa, Homo sapiens
MSSAEKAGRWRSPAFTGRPVAGMPALHLRSPPHRESVGY

SEQ ID NO: 991991 - protein, 59 aa, Homo sapiens
DLSRSRSSLCWGLAGGSLGGRQVVPGSILGMAKVQAGMAQPAWPAIHISSKFRHTPQHF

SEQ ID NO: 991992 - protein, 75 aa, Homo sapiens
LSRLGDALRYRSLGGDLSLWGTALSGDLLSRVGDLSRVGDRSLGLTLSRVGDLSRVGDLTVPGPSDGDQDGYVTV

SEQ ID NO: 991993 - protein, 115 aa, Homo sapiens
MVTFRDGSKVTTDEVTDLTEKVREQISRAFYTHGAPLCILSHPHTSSSQGSASYACCYPLLKLPLPGTGAVRLHHPIMKDYSPPPVDSDRKQGEPTEQPEWVGTRHVPEASTERR

SEQ ID NO: 991994 - protein, 86 aa, Homo sapiens
TRCCDKISRSMQLDGYSIFAIGVADADYSEWDYIGSQPSARNVFLGDDFDAYTKIEDELITFVCANSHQQPVQWSHKAWPLHLAGI

SEQ ID NO: 991995 - protein, 46 aa, Homo sapiens
LTGAASPNAKRRPVLALIVCNSTFRHFFLIRAQPAFPMFKDLAGVK

SEQ ID NO: 991996 - protein, 37 aa, Homo sapiens
LCLSAVDSSPSGCGSRLVDVLILAFGLLCRALAVVWL

SEQ ID NO: 991997 - protein, 56 aa, Homo sapiens
MRLTEHVAASAPSNRSVDSLAFLVVVLGAKVHSVILCARSVRPSGSCKLVLPPICH

SEQ ID NO: 991998 - protein, 65 aa, Homo sapiens
NLVLGVEDFLVLGSNVSLSSRWTPGSSCGQNRALGGLHDFLGSINRSLPFEMFSLEIFPGLLFRD

SEQ ID NO: 991999 - protein, 101 aa, Homo sapiens
RQVVLHRQVSTPPDRLYSTGRLVLHRQIVLHRQFVYHRQIVLQRQVVLQRQVVLHRKVVLHREVSTPPAGCTLLGLVLSAAKKATGTGAMSPPMSCRKALA

SEQ ID NO: 992000 - protein, 40 aa, Homo sapiens
PCRGWRHWVPRSLALLCTAAIGEVHPCMAETQCIYGFSRI

SEQ ID NO: 992001 - protein, 80 aa, Homo sapiens
MLTRMVIDSPDLVIRLPRPPHSAELTGFYVVDTEHLLWLILIMNRAFSTTTSSLAASSGHSHTTDPPSCDDADRTLKAEP

SEQ ID NO: 992002 - protein, 102 aa, Homo sapiens
MCAVRPLIRVEILPVPYVTEASRLTVLLPLAAAERDLAPGFLEAFATAALEPGDAAAALTLLLLYEPRQAQRVAHADVFAPVKAHVAELERRFPGARVPWLS

SEQ ID NO: 992003 - protein, 59 aa, Homo sapiens
MAQGAESDPHVTEPLMGGVPETRLEEERERELPPPAPPAGITRSKCKHELKLLEKIPEN

SEQ ID NO: 992004 - protein, 38 aa, Homo sapiens
RAEAHEAVRWQAGPGEHSADPVTGLVRHANMWALGCSA

SEQ ID NO: 992005 - protein, 102 aa, Homo sapiens
MDALHFWSRRVLASPPLLILLRRPPPPGAVGTLRAGVLLFLQELSLSPSRVAGGAVVPSPPPRGETVVPAAGAPRPSAAFSCCSGNGGLGRKLLDGPSRSFP

SEQ ID NO: 992006 - protein, 33 aa, Homo sapiens
YFSALQAPINQRPHISFFSIPYVINTRPEIGYR

SEQ ID NO: 992007 - protein, 103 aa, Homo sapiens
RRVGSVIVGEVLRGESQTQEVAGHSHSEGLLGSGHLLDDLHPGLRHQKHLDGCAIDRDDANCYTEGEPTHRVLVQCKRGCPLDAGPRRHWLEVQHVDQADGAD

SEQ ID NO: 992008 - protein, 58 aa, Homo sapiens
MGSVDQILRPRGAVRAPQSLRSHGRSGPLPHLPPCVSSEEDSMGIDRPDSHREGHRMS

SEQ ID NO: 992009 - protein, 56 aa, Homo sapiens
MDPDTEALNLIDGTVRDELSTTDEDDATGGGNRPPRCSGWRKMTVRPVSASSPIDC

SEQ ID NO: 992010 - protein, 97 aa, Homo sapiens
MGSVLKLPFLALRSALPGLLQKVGLSLLLMLLDFLLTDLHQQLKEGWGCSFPSPGKPQLPSDGPAADAHGNDLLQARMIHIIIINGSILYHLLEQRL

SEQ ID NO: 992011 - protein, 62 aa, Homo sapiens
MGSEGPATRKAEEEHGVNGGCLSSQRAENVLLHFSLGSRARLHLKKKRGLSTGRGGSRVASQ

SEQ ID NO: 992012 - protein, 44 aa, Homo sapiens
CLRYELQRGTFSSKVGRLEGVTNWYHMSTILMLNALRGNWLRGW

SEQ ID NO: 992013 - protein, 104 aa, Homo sapiens
MGNLLTTRRRKTLITVNSHFFLKIVTLELRPGPDGKLKGWTLCQDSLGLQTLELSEIIAGNNLEADVALLDLGQLDHPSYAGYRDFRSRQRLGSASRVTSTKNH

SEQ ID NO: 992014 - protein, 34 aa, Homo sapiens
ILSLTGVIMKIDSCVSRKFIAELVLTMVDIGWLV

SEQ ID NO: 992015 - protein, 61 aa, Homo sapiens
ELTAGGQWLIALAKLSEIDVALEGVKGGKNFFEAKVQALSSGSKFEAELKAEHDITETGGG

SEQ ID NO: 992016 - protein, 35 aa, Homo sapiens
MFFKLPQFTNIVIRLLCCGNNKYRHKCVVTPINDD

SEQ ID NO: 992017 - protein, 72 aa, Homo sapiens
MVKKASFKVNCSVEGGVGSDEREKWIGVMDYGMNREDSLTDGLEVVNERYEPSDFLTGRIGVLYGECVGLRR

SEQ ID NO: 992018 - protein, 39 aa, Homo sapiens
MVLRVNDTERKRFVPAEDSCRPVQCSMLHTSEWQLCCVP

SEQ ID NO: 992019 - protein, 44 aa, Homo sapiens
MRTELCIFMVPFHLHQSLLRNSKRFSIDNAQQNFLVSTFLVFPS

SEQ ID NO: 992020 - protein, 131 aa, Homo sapiens
MDYTSCAYYWVKYATFCKTERTVPPGPRCLPPEGRHREGLWQASLNRWAGECPTPRIDPGHENSATECCAIIDLDPDFEPQSRTRSCTWPLPRPEIANQTSEPAEVEPDLGEKVHTEGRSEPILIASRITE

SEQ ID NO: 992021 - protein, 35 aa, Homo sapiens
LNDSEAGTSLEGTVSAPFGKFQETVTIWEIINSEY

SEQ ID NO: 992022 - protein, 46 aa, Homo sapiens
IIINSWYDGLNCTTQREVGVSADKVYMLYLNSLQVKARVGRAISGF

SEQ ID NO: 992023 - protein, 41 aa, Homo sapiens
MRYTSLPIRVGIPSSRSFRMCIVIACRGVLHQCCRRKILLR

SEQ ID NO: 992024 - protein, 112 aa, Homo sapiens
YLLRSFKASCRPSNCMEAQYHGFAMPYFIQVMQEYLTKVDKLDSSESLRNEEEPATETQPIVYGQPQLMLTAGTSVAVPPQATLGYGNNRHTVWTATDWHRVQHVTLQRLIL

SEQ ID NO: 992025 - protein, 75 aa, Homo sapiens
VCAGGPVAGTLSSHGSPGNRFTSESLICSDEKTEAIAEKELLIFTQPKNSSDKRASHTTHQNQHKKIIREQKNHT

SEQ ID NO: 992026 - protein, 46 aa, Homo sapiens
YVGYSGPKLPAIFKPGHQVIILNQLNMRPRQTDASSTHAACVHAPL

SEQ ID NO: 992027 - protein, 38 aa, Homo sapiens
TSDEFQFIHPESMPKKQKPKTNQKKPTSGLAILIWFLW

SEQ ID NO: 992028 - protein, 32 aa, Homo sapiens
LGICHCQLTRGAAEARGAGAAEAIDSVLADPT

SEQ ID NO: 992029 - protein, 35 aa, Homo sapiens
DCEPPAEEQLCNDSRTSLAEAIAMNLAAGPALMRT

SEQ ID NO: 992030 - protein, 36 aa, Homo sapiens
CASLPCAFTSVSYLLVSFSKSVFSFLVPTALTGDPL

SEQ ID NO: 992031 - protein, 102 aa, Homo sapiens
ERGRRAEDISVAGSSCRATQEWPAAPIWEVMTNTRNTPLCLTKFSFSKVEQKYQKYHTRTSPLFFFFFFFSEREFWRVPGGEEQGGRIWVHYNLGLGASALQ

SEQ ID NO: 992032 - protein, 172 aa, Homo sapiens
EFSNAHGYLLDTSLEPTLCGQTLWDNTEVIASYNQLSSLRQPKAVRYRVVNLYEDDHKNPTATREQVDFQHHQLAEAFKQYNIYCELDVLEVSNSSVRRRLILANCDISKIDENCDPEVQHTLTGHDGGDVPHPRHPAFVKKQHNGVCVMDCNYERFNDGGECCDPEITNVT

SEQ ID NO: 992033 - protein, 155 aa, Homo sapiens
TLWVSYVGEGTVEGGDVQSWVSTWVASPARTGWWKGSPWRHWGSPGPQECFPTALIRKGHSRGLGAGWDGKRCKSTYTHRNRGVIRAPIAHNRQNEEQQDPAGLLFRSLQRLNLIHGQLIGGLLCRHLQLLVDYQKPLPFLLSFLSMSLLVLNAG

SEQ ID NO: 992034 - protein, 72 aa, Homo sapiens
RAVQQVERIILSHAAGGTQPLVSKTVCACDAAGFLGLTEMQDGKVCAEPRNLARCKKSPAFSVIKPWAFNSA

SEQ ID NO: 992035 - protein, 54 aa, Homo sapiens
RGRMCLVMGLSLACALFNTLLAPLYAALGAICFTLFLAHDNCAAVSYDSATALQ

SEQ ID NO: 992036 - protein, 82 aa, Homo sapiens
LISIKYGGPYHIGGSPFKAKVTGPRLVRNHRLHGTSSVLVGSLTKDNCAHQHGAPGPAPADASKVVATGLWLSKAYVGQKSS

SEQ ID NO: 992037 - protein, 89 aa, Homo sapiens
FREQSQPTVGLWAMETCWLGQTACCPRWGLLPALEARLSGDSSTRVGQWDVLSSCSRRRSTRTLTLLLGAGHSRPCFSNSPCGWLQSCL

SEQ ID NO: 992038 - protein, 89 aa, Homo sapiens
DENAVCEGCFFTIALHPDSQNLFAFTWTDPDTLQSQQLTWTVLPQGFRDSPHFFGQALARNLTSLNLSPSHLQYVDDLLLCSPSLKDSQ

SEQ ID NO: 992039 - protein, 47 aa, Homo sapiens
RRQCTLILQVTLRTPARKNRPGEFECLIKNKAFVEGPGDGVFDSLML

SEQ ID NO: 992040 - protein, 118 aa, Homo sapiens
RVKRARWRRRTEIGASAVRAGHESTSPDWSATCPPAADGHDARSGARDKQDMTWSGVTAMDRGCASGLPEHLRLVRLRQEAGLSLYFLHGVGTLWLPSETPRSHKMTEMVLPSSSLGL

SEQ ID NO: 992041 - protein, 40 aa, Homo sapiens
WTGGLRRLGRKKRVAALVQRQSREQVKSGWTWLAPPPPPG

SEQ ID NO: 992042 - protein, 33 aa, Homo sapiens
RRKTRAGGMRAFIRSKPPAPAPQAGGRRRVLTV

SEQ ID NO: 992043 - protein, 67 aa, Homo sapiens
RIFWRQDTDYLHSRLGGSRAGHKERARCLLHVPATRVLLGACFTYPATRVLPDETREIMKQPTHIAL

SEQ ID NO: 992044 - protein, 52 aa, Homo sapiens
MVQWLIYLWAEANFFFDRKILTNPMVSKDKNITYFRNLGLWLGVCGSVLALP

SEQ ID NO: 992045 - protein, 83 aa, Homo sapiens
SQSVGDLKRLKGPSRSFQRRCKELHPKCQEVNKVRPLPFLPPPQHRQSVNRKKQWSGGKENKKIKTARPWAMRLPGTRDLGSF

SEQ ID NO: 992046 - protein, 33 aa, Homo sapiens
MTVENSAHVSASVESSCGFQVPSSICEPSPVLS

SEQ ID NO: 992047 - protein, 56 aa, Homo sapiens
HDELQDVKPPELYPLETIQLWDYNITQMLYLSTPTLRRVVPKMQYTILYSLPVLNI

SEQ ID NO: 992048 - protein, 101 aa, Homo sapiens
ARTTTLTLPHHLQKVGEWLPGREKGGAEALSVGGSGVVLEHGAAWELWLKCGLPGCGEMQSALELVLEEIGEPSKVLRGEVIRKTLLLAMGRMSGKGVVAE

SEQ ID NO: 992049 - protein, 64 aa, Homo sapiens
QPTLSCCSAIQDQKRLLDFREGQRPDRAILALALHGSVLDAQTGVRTFEYRGKATPEKWNPAVT

SEQ ID NO: 992050 - protein, 153 aa, Homo sapiens
GSPALQLLTAARKRRRLQVVAENGLCVGIAAVELEEEQPELKMCGYMALSLLWNLLHQEVSVLVPEPTVSCLDDPSHLPDQLEDTPILSEDSLEPFNSLAPEPVSGGLDGIDDTALMGAADKLALEDRPVISGLDWPSLHNGTGFNYWPMKIK

SEQ ID NO: 992051 - protein, 54 aa, Homo sapiens
LPDLQLLRELVILTPHRLEGGTCGCVDLHDDMQTLTGEHVGAGLLHVAGSSPSE

SEQ ID NO: 992052 - protein, 42 aa, Homo sapiens
AICEDENEHNLRLHTVTKIITLLLSASIVVLASKHQREFGVH

SEQ ID NO: 992053 - protein, 70 aa, Homo sapiens
PPSYDANMVGPPRIPGGRHIDCEVCADTRVGHKRDYMSKTPGVKRSSQLGLPKWWDYRCEPTPAAYRVRL

SEQ ID NO: 992054 - protein, 102 aa, Homo sapiens
GCDMMTSRRKRMVSGKSLRFQGNLVTDCAMDEMVQIQLRYYAFPTLFATHRSGDSLRCLCYQGPGLQAQNLVAVWADTEKLQFLFIPQWRLEHQRDRTVDSP

SEQ ID NO: 992055 - protein, 74 aa, Homo sapiens
MWVCKSLCNSLLKPNFVMTDATYYEDMYDYATITVSMQPTELMVNTVTLQLFVITNEPVKTIEVRNQEDGLKKT

SEQ ID NO: 992056 - protein, 87 aa, Homo sapiens
VWLQPLAWVPAAGRAVRAMRRPSVVWYGPAASPVVLGPGPGGPPVVPGPLAVAWRAPETPDQLTSGETRPPGYGGADAGARGLAGPP

SEQ ID NO: 992057 - protein, 66 aa, Homo sapiens
CKVAVIENTQIWESLSGPLLMEEQHLEMEGFGELINRDSSKWRIPVGQVQIKYAMRNPDRRSSVYV

SEQ ID NO: 992058 - protein, 128 aa, Homo sapiens
PLAPPQYSVFHIKLGHVLTPHTCRVLPKPPSHAGWRACLRPAQHPTDPEVGKKGTREGDLRFLFFLLFLLSVPSFSPRISLNTLTLNVKSEKVYTRHGVPISVTGIAQVKLSEPFPHSPLPHHPLSQT

SEQ ID NO: 992059 - protein, 41 aa, Homo sapiens
TSNEMSFHYGLVETELQLTFSQVAYRFICTGAGVRPGPGPP

SEQ ID NO: 992060 - protein, 86 aa, Homo sapiens
DTANISPLTKKLHSNVRFPGRNWYTEKLPAENRINSARCSHSTHYGWHEWVRVDINYTLPAEKGLFREISGSCKARKIFDVRDAAD

SEQ ID NO: 992061 - protein, 118 aa, Homo sapiens
MQVILPVSASQVVGITVACHHAWLIFVFLVERGLSPCGQAGLEVLTSDHLPVSASQSAGITGVSHCAQLRSDGFKKRSSPCMRSHFWPATIYVRCDLFLLAFHHDCEASPAIWNCKFN

SEQ ID NO: 992062 - protein, 56 aa, Homo sapiens
MDTEGLHRIGAGGFLVGSPTGHVPYMPWGPYLVLSGPGPGSSRFSSCACPREWLTC

SEQ ID NO: 992063 - protein, 136 aa, Homo sapiens
MPTSRTGTYQKRDVSLGTYAAGLLEPQEQEFGKSAWIRDYSSGGSSRNLDAQDRSFGTRPLSSGFSPEEAQKQDEDFEKKIPSVEDSLGEGSRDAGRTGERGSGGLFSPSTAHVPDGALGQRDQSSWQNSDASHTL

SEQ ID NO: 992064 - protein, 50 aa, Homo sapiens
ALPHNSLSKRPLAAPVSWQTAGAWLVTHGAPGLQAGDVVYRTDYKYTEWI

SEQ ID NO: 992065 - protein, 57 aa, Homo sapiens
GFVCAETYLLAIDITLHGISSADASGTRYVMYFHKGPLDDRDTFTFVRSWVCRGHLA

SEQ ID NO: 992066 - protein, 70 aa, Homo sapiens
MARKLGFHSLPLEAEEVITDLRQHFRTDHPELHLEKWTDGRTKTRETILHCVHAVWSKTKVVDLDLDVAI

SEQ ID NO: 992067 - protein, 38 aa, Homo sapiens
MPLHAARWSTERQSLPSVRSPMSQFNVCLAQYVVLLNW

SEQ ID NO: 992068 - protein, 86 aa, Homo sapiens
QPTIAMQHNHSFQAICKSCIFPLPSVFPSMYCNHQGRQKHNMVNTYNTHKPAPNNPAWTGLWQVINSVAVYVRRSGRHAPSSHSDG

SEQ ID NO: 992069 - protein, 144 aa, Homo sapiens
AGRNVSHTGFSALECIKQSHVSVYFKTLLLAALKSRIFIPMFLSFRSYLIREVILSIVMHRNYPPSKCASSSASQPDPVFGREVLAHSSSTATQSRKSTGCFVSDISDFLRANTSSDKPKELEPSLFLTETPALAHRLRHLASR

SEQ ID NO: 992070 - protein, 182 aa, Homo sapiens
LDAKCLEKGIAGPYQCEIRDRYGGIQSDDPVTLNVLYGRDLPRIWPSFIYYRAGEVLYLSLFCGLYPTGTVFLDNGMNSISSQDNSVFIRHITTKHSGLYVRSVRNSATGKDSSKSMTVRSLCLDSSLNSTSISNSIFSHGITMSEIHSVPEALSAGGGQLNVNFMGKAVYVTHEPLRSQQC

SEQ ID NO: 992071 - protein, 110 aa, Homo sapiens
MFTLAISKSRTWCSSLSVTRRSKGYLSSRRVWLVHVFVSERGPDDELLRPEDRPTVLVTVLFNQASLALGADQSVNWIGSDPDKHQALTNTQYMNPSETAHDTARTLCIQ

SEQ ID NO: 992072 - protein, 106 aa, Homo sapiens
MQVTLDGLPLLMQVSMATCRNYHGVSTSIDGCNVVMETGYCCVAHAGVQWCNHGSLQPPVPGAHVILLSRLVLNSWVQAILLLQPPKVLGLQHLSAQAHSHFLTTE

SEQ ID NO: 992073 - protein, 55 aa, Homo sapiens
VDSCLLLVPCQHPDLDARFVKSFYRFRDSLLQTVFNASSTKKCKLFSKLMADSSS

SEQ ID NO: 992074 - protein, 73 aa, Homo sapiens
GLQLLRFLEPAELSHTHSGVGAQLPVYLCFRLLHACGALPSCTYRLVGSDSGCSTLCCSYDVLSPSVEPVPVN

SEQ ID NO: 992075 - protein, 49 aa, Homo sapiens
GTLPDKDEWTPDMHHQEATHLILTPEKEPRGVLIISIQKTSGFAAKCGY

SEQ ID NO: 992076 - protein, 84 aa, Homo sapiens
MQCTRWLVQVGLAIVWLHRPPNFPSNAMWGTSSVVNTSKCSASFRQPIFSLQTAAWSTASKPPSGASRFRDTLCFRTSSLKLST

SEQ ID NO: 992077 - protein, 55 aa, Homo sapiens
VQERVFNLMADYKIEPKLTDPLTAARFQEVKKAFVSDAKAKVEAKNKETPSETVN

SEQ ID NO: 992078 - protein, 151 aa, Homo sapiens
MKPYIPKDQKYSFLDDSQTSLLLLRLYSDPLHHGGNATDLQSRAAPIYSLLLHRVVCWRPCGPSGVCSPNKLVYDTSDSDDDTPPNGPRGRHPTRCWGGWKTDAAVTGQILKQTSSPSDTTSHNHDALLKNYVAALLVQRGADSSKGRSRC

SEQ ID NO: 992079 - protein, 84 aa, Homo sapiens
WDTYPGGRDLDMAVRNLNDETSLNGVLWRDIIVVEWDGCMENNKIISAKSSHYKHWPTGFLVSDVTLNPRRAHKKMSLGREHAL

SEQ ID NO: 992080 - protein, 85 aa, Homo sapiens
MCGRKPAQLAPRPWIVGGHCTFWVPHSPWEAPAPEEGPKPFGGENREGDNTSGMANAFSPKAATGNPGPTKVATHPFLEEGKAAR

SEQ ID NO: 992081 - protein, 109 aa, Homo sapiens
MMLDPLCNEILLLSHFTILPIYKASALRVGSHLTWQTLWPFLSWLPLYLSLAMPAARRREAINQGGNAAELIVLLFSSAIAKISSLNPELLVEAVDHNGSALGVLLDVD

SEQ ID NO: 992082 - protein, 83 aa, Homo sapiens
GQNISCLLVTQEVQDPREQPTPKEPANTTLAKDWGLRQNKREQPSPSHAYLQRRKCSEVMESTTEGESKLTETSFETQAQKKG

SEQ ID NO: 992083 - protein, 106 aa, Homo sapiens
DDKSGVVIYVTRVSYRRPADLAGLPMGDQIMPVTGGDMPMVTHEQARKRLTKRSEEVVRLLVTRQSLQNGVQQSMLSSSHHHLRLLTAASLIQKRHFHTLSPSGFC

SEQ ID NO: 992084 - protein, 42 aa, Homo sapiens
TIVVVTNCDNAAAMMWGKMILLELARRKVVGILLENRFFSES

SEQ ID NO: 992085 - protein, 33 aa, Homo sapiens
MRPLPHLSTPTLATGKNPVAEQGDVAAACQMFL

SEQ ID NO: 992086 - protein, 119 aa, Homo sapiens
RREVTILGGSTEGPKALDPQGKTNSKSREQLYAQGCPSSLTNLSGVAYLLTLKMSFWVGVSMHKWSMASLVTSKQSSSKLLIWVGQPGEGSTLRKVPLEPLVLNGSFANLIEDVEVPLT

SEQ ID NO: 992087 - protein, 49 aa, Homo sapiens
LPVLTHGPPPCFQTWLLPEPPAMSRPGRFPRGPGSAVHDGARGEGDDKR

SEQ ID NO: 992088 - protein, 76 aa, Homo sapiens
MGHKPRRVIIAQEEQSMDVKVRVTTSDETRQRAWMGDDNYLARLSPCVVREPRTPSRMSFQPVWEGVPYDAVRKLF

SEQ ID NO: 992089 - protein, 42 aa, Homo sapiens
MNMAQTCCGQCISRGSPREAEAVGVYRKRFIIQELAHAIHVA

SEQ ID NO: 992090 - protein, 41 aa, Homo sapiens
MPVADSASSSYISILFLTITFFSLLLFLPTFFLFFVYLSVL

SEQ ID NO: 992091 - protein, 63 aa, Homo sapiens
MEAMSLSSSGPVCVLESIGRIMMLTVTHRGDCQEAATHMVCDVAGISPCSRLGKLSKSDEHVV

SEQ ID NO: 992092 - protein, 41 aa, Homo sapiens
LAGYGKPGSMEPGVEGGLTVSMAVSDAHDCAESEELVLSCG

SEQ ID NO: 992093 - protein, 232 aa, Homo sapiens
RLSLMGQGKRVIVCSAVCVHYPSLVSWGPIRFSIFFCPRPEAEDGGAHSLTMVPLMKQLVHRVGRKIGDTFRDLRDHVHWSQNSLLAQRRDVGCKSSFSTSGARSRHISAEPMVLKVHKARPVSCLNPLAQVILDAVGNEQVGIVPLIQEKHGPQVAHPLVCDSGGGDQFQALHLSKVGGVAQHVGVQQFGSCLVLCRGPVPLAAGLGPLLLPPAWPGLPAILERPDYQATL

SEQ ID NO: 992094 - protein, 63 aa, Homo sapiens
CCSLFSCSSYSWMFCCIFFFSACRCWQCSYFYLNLALWSLADLFLIPGFYGGSGGPRSSFKPR

SEQ ID NO: 992095 - protein, 85 aa, Homo sapiens
CSLFTSSSDLGPKLGLHTLFGSSRWAWEAPAHLGGPPVWNVCHKALVDGTSRSLCGQPRWVAGTETRTRVGYGQARNVLQLETVP

SEQ ID NO: 992096 - protein, 38 aa, Homo sapiens
LCCSLFIRWDVRLPKEASLYASSLCAGEPTSLGASCCS

SEQ ID NO: 992097 - protein, 85 aa, Homo sapiens
GSLGGSRKKLEHWVQFLEPEDTVTPRCSENGCSVEREARHFIWVRDTELRDNPGTRFQVRPSAFLGSLHISIQGYTPTKASSQMA

SEQ ID NO: 992098 - protein, 72 aa, Homo sapiens
MTLVEDIEQVQMKSRGNRKGDEAEKKPPFLLALALSFPVVPAILPKKFSTEKALVYSKEAPFKGTGWSEICR

SEQ ID NO: 992099 - protein, 44 aa, Homo sapiens
CGALTGSRSSLCGAQAPGPMAFSSHSTTHPGGQAIAAQPCAGKA

SEQ ID NO: 992100 - protein, 38 aa, Homo sapiens
LVIHPPGPPRGLGFTGVTSTTPWPSVRFLLFYPSCSPH

SEQ ID NO: 992101 - protein, 152 aa, Homo sapiens
GIGNWTLTRYGYALVCTAFTRQSFSDSVPSQGMNCTNILLLRQAVSSSVSSTNSSSSCPVNSPIMPPGSQESHIHCPQLPQPALHQNSPSPVPSRTPTPHHTPPSIGAQQPPATTIPAPVPTPPAMPPGPQSQALHPPPRQTPTPPTTQHVK

SEQ ID NO: 992102 - protein, 44 aa, Homo sapiens
TRTPPGLGPALVLSGPYKPSLMIPPNPPDPSAISQATSSVPPPK

SEQ ID NO: 992103 - protein, 123 aa, Homo sapiens
KDLSAPLQWGLYYLGEEELLHIPMGQDQAAEEANAVLGLDTRGDHIVMLSVIPGEKLRTKLSSEPSGVTCGCLEELEDSRCHVREKPFLSGIGLEHTFLTEKRSITQSQKLGNLTQPRTEDSQ

SEQ ID NO: 992104 - protein, 33 aa, Homo sapiens
LWASVCMKVLRLYEALLLLAIIDLSFCGVRFRK

SEQ ID NO: 992105 - protein, 132 aa, Homo sapiens
WALRSIFGVIQLLCLLRAPSWANHGTGGGKECEDASEEPEENDANHGEQQKKTRDRQIQKITNAMRAFSFTNLLLVGFGVPASFPPVPLQILSFILHTNLCEHSSTLLVGGLYAACVPLQPSPGSLTRLPSL

SEQ ID NO: 992106 - protein, 140 aa, Homo sapiens
MTEQCIPAQIPCFSHGLHNLQSRRFPRVPTPPGPWVSSTKRGGHMGRHQASCRSFFPYPSGTWNASKTEPFTLLERGLKKGAKWSSSVDPTPMEPFKLRSTGLKFSLQHSSLKSDRGRFSLASCITEACIGGFPPTERAR

SEQ ID NO: 992107 - protein, 80 aa, Homo sapiens
AGDLPYWGGLLSICAGCGCLRVWGDHLGKERLAEEDASSAESSPSLTKTWHERVGRSHIPKLRRWQAAALFKQLWGSTDR

SEQ ID NO: 992108 - protein, 171 aa, Homo sapiens
SRGSSAAPSSLPEAAELNAKVDTLTLAGESKSTNLENSKELHKSEIIYPANLPSHSIPKVSYPRRNESTCPYEDLHVNVHSTSICKSQELENNSINIHPQDKNTVVNPYNGTLLSNEKEKAMDICNNLNDPKNHHAELNEASQRRGPLLQWSLTFLASGTGFVKDNFPTEE

SEQ ID NO: 992109 - protein, 138 aa, Homo sapiens
RGSFLLLFTRLLVESWTGQCHITSSGLSVLASLVNCLSVGYSELSSRILCSLALISLSAAGEQSDLCQSSVLPDKLSLQRDLLYQAGDAAWIHPGKAQAFLSYPDANASHVHLYRWRGWNLADIELDFFQEELILRDG

SEQ ID NO: 992110 - protein, 35 aa, Homo sapiens
MLCCSLYTNYRGGSEHRVRVHGHPSSVSEALIQDL

SEQ ID NO: 992111 - protein, 82 aa, Homo sapiens
GHPKYTLSISRERFSSGPRVQASSASSGGFKCSYSAIWAPPPYTESFILEPGLEADNPSILLNYPQTGHQRLSPAYTRYHGD

SEQ ID NO: 992112 - protein, 55 aa, Homo sapiens
MDWSEFSYYHGLLVGGNINLVAIGDPFFLCKRRCRVLAVEGVGKVSSIWRSSDSV

SEQ ID NO: 992113 - protein, 33 aa, Homo sapiens
GFTVACGLTVACGLTGFRRFRRHQKKAVTKQQI

SEQ ID NO: 992114 - protein, 78 aa, Homo sapiens
MDASTAVLRCTCVSGPKSLGMLRPALAQVSSSSPNGALACQSIVGKILDIQDRSKTCLRALGANSLELRCWGPNGKSC

SEQ ID NO: 992115 - protein, 131 aa, Homo sapiens
MGSEGLGAARLLLSAVQVDKEDVLICAIAGSGLLKVTDAGAADSVGMGWVVVEDAASGPVVARQHDEVGLVVKELRQKQWWPLRVKQQYLTGAGAQVTVQQPRVQQHDGQMALSQVRPGMSFTLTVHFSTK

SEQ ID NO: 992116 - protein, 34 aa, Homo sapiens
WCRHHFKCDKHRISDYLNLYGFLRDIYQMPGITE

SEQ ID NO: 992117 - protein, 104 aa, Homo sapiens
PSPTHKEENRLWKIYLPSTDRNCTKRRFVLKLSMSFLKQYQQPVGLEQCVMFARACDKLAAGLLEDLPSPAAADFQPPHQRLDAFLYAPLGGDSHRCPSCYTPV

SEQ ID NO: 992118 - protein, 61 aa, Homo sapiens
VYRCHMSSSLSLLTSMVDDMWHYAGDQSTDFNWYTRRAMLVEVNDIKDLESITKRLVGLIN

SEQ ID NO: 992119 - protein, 35 aa, Homo sapiens
VYRCHDSRSSREKRSSSRWCLCRDSYMQEAPVKEY

SEQ ID NO: 992120 - protein, 57 aa, Homo sapiens
MMPLHSSLGDRARLHLKKKKKKAAEIWAAPLKSRAQGDFGNSGGTRGYGRLPRARAI

SEQ ID NO: 992121 - protein, 98 aa, Homo sapiens
MMPLHSSLGDRARLHLKKKKKKLLKSGSAFQIPGPGDSETPGAPWLRPFLGPAITLFLHISTGAIVSYISLPSLYRRRVKSLTHGNSTTCRGGDPQES

SEQ ID NO: 992122 - protein, 135 aa, Homo sapiens
LSRGSRNAGGTVFLIGSVQGAWKASRRGQKVISEHKNGRFYQFVKWSGSPPMTFYEVNLDDGSFSDNLYPEDIVSQDCLQLGPPAEGEVVQVRWTDGQVYGAKLVASHPIQMYQVELEDGSQLVVKRDDVYTLDE

SEQ ID NO: 992123 - protein, 54 aa, Homo sapiens
MGKSLYLMSEPLRTHQNVQHHNNSCSNCKQGKQVDDFITVDSFSQDVRIRLPIM

SEQ ID NO: 992124 - protein, 91 aa, Homo sapiens
TFDQEYQAEATYTSPGMRAATRAISPTSTEAQIEQGWKTEESAFGLRETQSVFTRCSPISGKDQGKWEDFRAGSSVHGRQISKLPLVPAGI

SEQ ID NO: 992125 - protein, 89 aa, Homo sapiens
PGNRTEADTPLMVADTRWLRTPSAGWGSLRVLLQMSKIASCAMQDLSSVSYTSWSTDGATVDRSTTVHDTVREISTLKAYMMQAGSSSR

SEQ ID NO: 992126 - protein, 67 aa, Homo sapiens
LEDPGQAELNYYQVPLARVVEDLGRYYPGRIVLLNEELGQRKVSGSFPLAEPLLALDSLGKVMGFSR

SEQ ID NO: 992127 - protein, 38 aa, Homo sapiens
YTDPPEVRLAHVKQIELIEKEDEYLSLVGSLVDYSHAA

SEQ ID NO: 992128 - protein, 75 aa, Homo sapiens
ARGRDCGKGVPGATLRSKDRFRIYSPEHATYSKAPNPGAGVARICNQQSDQQGAGHQHTSHCVGHLTFKITNHLQ

SEQ ID NO: 992129 - protein, 39 aa, Homo sapiens
SSYRKASNADGEAGRRSRRTGQYPQADLQHSLTQTRTTM

SEQ ID NO: 992130 - protein, 31 aa, Homo sapiens
MAGLYAKELMLRGDLSRMLVIAPGSLVEQWQ

SEQ ID NO: 992131 - protein, 82 aa, Homo sapiens
TGTESHLLQTQGEFLPKWIAKTVTSTSPRSLKFSVIHMQLVTVQFLSVGKGALGDHPGCFMSISTEEVSTLLAHVALLLWGC

SEQ ID NO: 992132 - protein, 106 aa, Homo sapiens
GIEGMGLSNKVFYANPNLASRKFIKPEVANDPAVFPPEAEMKKMAQPEALNNDIRRQMTRIYTSFKTVPVKNTMNSRTGEGYLVIDRVVKDFVSPDGGSFRAVDNV

SEQ ID NO: 992133 - protein, 48 aa, Homo sapiens
LYLFEDLVCFSADVRGPRRVSCFGERVGAGTGSGEAPGGRGTERFSGW

SEQ ID NO: 992134 - protein, 34 aa, Homo sapiens
MSWSIYSILILLRTSSVLCLLFNIKGMIALKDSG

SEQ ID NO: 992135 - protein, 88 aa, Homo sapiens
SEDPLLLLFEDEDDEDDEDDEDYDDDEEDYSERKKLWRLHQGKERKLAKFVPVKAQKLLRDKKEEDDEDEDYDDDEDDEDDDEDFKEE

SEQ ID NO: 992136 - protein, 61 aa, Homo sapiens
MRSRRTFTGVQVELRVMKKERVDYFGAMRLCLAVKDYIRTQSSARKLTPNFSREENTDEIK

SEQ ID NO: 992137 - protein, 56 aa, Homo sapiens
MWLIQEVNTKRLEETEGCTLVRPQTDEPGAVRVQRAQISERITDTPAQVSNANEQP

SEQ ID NO: 992138 - protein, 88 aa, Homo sapiens
ASRRPSSSVVHGRASKICMISDGGCRQRFPAVAHMICTMPKAAPTCHMAPYPSSSKTQFRDQPLQETFQGVELLVFSMCTCQTLCILL

SEQ ID NO: 992139 - protein, 78 aa, Homo sapiens
LFGVVRTVLTCRRTLVPGGLPRSGHYTSTRLQLSDLRRSARCSRVDGTCPRDGMPRRGDLPMSTLPACRAAAPGNLED

SEQ ID NO: 992140 - protein, 60 aa, Homo sapiens
VPHTDMEGLVKRCQNFLGLLLGEDELLICDYPVPVERRLLGCIAKLSRMGEFLEWIARDN

SEQ ID NO: 992141 - protein, 127 aa, Homo sapiens
ILCSSMQSVYNVSTVCIMSVIYCPCLSVLASQKVLTCKNVPNVAWLHLTRKDALVDVDECAPLLPVGRDIGSLNFSRQFPLRMQDGLLILTASAGCVFVVNECQRYPRRLCGHQCEKTLGLLPLELF

SEQ ID NO: 992142 - protein, 44 aa, Homo sapiens
RIPCCSLFTLQTRSIPEEQELEAYVDDIDIDSDFRKDDFYLLGL

SEQ ID NO: 992143 - protein, 86 aa, Homo sapiens
SWVLYMMYTPGAEFLCILADPTTMTCISMQQLLWLINGKREPTHATVWRKNFSAVGHLVLIGGPDDGVITPWQSSFFGFYDANETV

SEQ ID NO: 992144 - protein, 37 aa, Homo sapiens
LLKNAPDDGYKLSDLGEKKRLNKRAGAFQEVYEREAT

SEQ ID NO: 992145 - protein, 89 aa, Homo sapiens
MAKRGYLKYMKAYHVRADAHIDPVTPSKDVLMMLTDYIQGARDTPPLRAAEKPTQAVTARLVFPRAQEEACTLRPVTHTSLLDFYLHVG

SEQ ID NO: 992146 - protein, 112 aa, Homo sapiens
CCSLYSSRSSNCSDECTSEIKIQKKRRWSGGSRCGCLPWLPVNLSQKNPQLTIRILNLDQKKKEHLRIEERKVKGDCQEMDLEKTRNERGDGSGFKRRRTHLILSIKREAAG

SEQ ID NO: 992147 - protein, 167 aa, Homo sapiens
VEGILGLQSLAGSVEQNFGATPPEAEAKLANIIIMVTLLSTGILAVTLLQQVIWWSVEGQALVLFLKAIPGAFCQGAAGLTSNVRCCGPNLTVRSRGLPGSRLPPGGRGYYADLHPQGLHQARAGGRARALAGAVGTAGAVPRRLKPYCLAQGPLVQRSQNHGTGPQ

SEQ ID NO: 992148 - protein, 44 aa, Homo sapiens
KRIWVISRIFVLLSALSVPHNLSHRLVTGEKPRAGTKEEAAQLF

SEQ ID NO: 992149 - protein, 34 aa, Homo sapiens
TRGSKRALKRTAEETHRRDSLKRASEEPPKSLRR

SEQ ID NO: 992150 - protein, 33 aa, Homo sapiens
MMPPIIMSISKHQKITKCGKDLESSFIAGGIDN

SEQ ID NO: 992151 - protein, 74 aa, Homo sapiens
GMRSEGINPIGQDNAYADKLAKEATSDPTSVPQGQFVFFALCTPTYSRTETATYQSVPTQGRWLLDQGKSVLPA

SEQ ID NO: 992152 - protein, 54 aa, Homo sapiens
MEELLQQYAGAYAPGSGSSEDEDEDEVDANSSGCEPEGPVEAEEPPQEDSSSQS

SEQ ID NO: 992153 - protein, 83 aa, Homo sapiens
LLPLQPLDLNPSEVKEQQDGFGNVKPNINNITSIVPEAKPAATMPVLLLTGLFLLVWNYEGTSSIPGPGYCMGIGPLISHGRF

SEQ ID NO: 992154 - protein, 35 aa, Homo sapiens
LEILSHPQVRITGAVNHRPGCTIKQRVAETMCYAY

SEQ ID NO: 992155 - protein, 71 aa, Homo sapiens
AETPLMAADTRWRRSPRAGVGSLRERKQMSYFASLPMHEASYRILHQLEHRQRVVTWLHHRVYTLCESTTL

SEQ ID NO: 992156 - protein, 44 aa, Homo sapiens
TRIWEWRLRKNCAAQACLYVNHVSARACLHGIIISALAECCQVG

SEQ ID NO: 992157 - protein, 58 aa, Homo sapiens
GKRTEAETPLMAADTRWVRTPKAGGVSSRARKQMSHFASLPTQQALSVVSTSCSTHSA

SEQ ID NO: 992158 - protein, 84 aa, Homo sapiens
PGKRTEAETPHRAADARWRRTPRAGGGKLRERKREADKDRGPMQEAEHGCYTSWSTDSEAWQGATSGRDTGGESATRRADMMRA

SEQ ID NO: 992159 - protein, 202 aa, Homo sapiens
APSSSCVNQYRQPSHMDIPLDNKSFLRPHSMDMKFTYCDDRITEVIGYHPEELLGRSAYEFYHALDSENMTKSHQNLCTKGQVVSGQYRMLAKHGGYVWLETQGTVIYNPRNLQPQCIMCVNYVLSEIEKNDVVFSMDQTESLFKPHLMAMNSIFDSSGKGAVSEKSNFLFKLKEEPEELGQAGSNPGEAIISLDFANQNFQ

SEQ ID NO: 992160 - protein, 35 aa, Homo sapiens
MADDLHVFVAPHSHNDPCWIKTFDKCYTQQTKHIL

SEQ ID NO: 992161 - protein, 81 aa, Homo sapiens
SGSLFNNFDDNSLFVGWERWLMPVIPALWEAEAGGSRGQEIETILANTMKPCLYYKYKKLAERGGGRLQSQLHGRLRQENG

SEQ ID NO: 992162 - protein, 79 aa, Homo sapiens
MEGVLQEADRANRRIRIPVSEANNVIGATSMMGRRDVLVVMFSITVFPRLRCESCSLSTVTAVGERLRCCPRPRISYSR

SEQ ID NO: 992163 - protein, 67 aa, Homo sapiens
LEAEPGAELCASQVGSVVGKAHGDKHLAFDSWEDSTVDGSTHSGNHWFPHMLSCLMDSLTKLAESCN

SEQ ID NO: 992164 - protein, 106 aa, Homo sapiens
LQDPYAAPSSLLPGRLKHENRLNPGGGGCSEPRLHHCTPAWRQGKTLSQKQKQGQAQWLMPVIPALWEAKAVDHLRSEVQDQPGQHGETPSLLKIQKLAGHGGTHL

SEQ ID NO: 992165 - protein, 51 aa, Homo sapiens
VSVLVRLTFKELDLGGEKSVSSLALLKPAQCHGDGLPNLQLLEHFLGKEHK

SEQ ID NO: 992166 - protein, 80 aa, Homo sapiens
VVDELRYRRRPLASTWAGALNTLGSFLVPAAVVAGMHPRVCDRMSIEVLLSAALAEDPGPQVPFRTPRYVCQYHPADLAT

SEQ ID NO: 992167 - protein, 116 aa, Homo sapiens
IVDVYIFPWAQSPLSVVQRVPGRCGEYPFMPAYWESGLPPVPHVGYSSTAIIRHVVHNSDQGPSPLAGRPMVIDPGLPWDSSEWTSLFKQAMAFPGHFPVPMFAGMLHPWSGRVHH

SEQ ID NO: 992168 - protein, 115 aa, Homo sapiens
MKGELHVEFWEEHPVRVNQRQREPKRERERGEQGPDKENSHEKVPGGLEQDVHVSFNSDLLTAVPRLQCRALNGNEESHGESSATVQEGEGGVHTLSTDSTKTTSKETQGTEVGF

SEQ ID NO: 992169 - protein, 143 aa, Homo sapiens
TTCDGGSLQEVRQGQRRSRNSCVCGTNVQRGHIDDRQAEESWCLGIQITVLIHAPVMTRAPVCTSDRCCVQSACSPRARISHLGCCPGSNIAFLKLPVCCSLSARLFLAGLGHVLGGLGRHQAREGQLDGLIGQCRIPGRLTR

SEQ ID NO: 992170 - protein, 102 aa, Homo sapiens
MTLKEPAAFKHLFNKAHLAPPLIHLTLSGHSTCFREHRVGGKVIDQQDPKAEEFFLVQNKMKSLPCLLLSTQTRQPSDFSIFSPPCPLFYSRQEPHASKEPQ

SEQ ID NO: 992171 - protein, 44 aa, Homo sapiens
MCLREDLLEMNFPGDLNASVYWDVYVSSKASEVFLNLSPQNMFS

SEQ ID NO: 992172 - protein, 146 aa, Homo sapiens
VDVIRKAEYTPRTSTWEIAQKVHVFTTDYRVCILYRLLGDSKMSFEDIKANVTEMLAGGVDTMSMTLQWHLYAMAAHLQVQDMLRAEVLDERHQAHVRDGHDATAGPPSSKPESCAAPNDFTTISVTPAEISCNNAMETTRLHDSC

SEQ ID NO: 992173 - protein, 37 aa, Homo sapiens
SVSCDGVRVKDTVYTDFDVEPSVYALQSVILLPSSTM

SEQ ID NO: 992174 - protein, 66 aa, Homo sapiens
CGALSRLPAGHPSTSVSALFHVHCSKCIVPRAWFQVHCSKLHGSGAWVPQLAFRQSMVYQLFPSAC

SEQ ID NO: 992175 - protein, 136 aa, Homo sapiens
GSVMSVKRACPCTTLVPAIGGLLRLSSPVPGNCCAPIKMHEVPAQSDVYCDVCDFLVKAVTSLLDNQETDKEILHAFDALCSKLLKSLSDELPGGGATVRQLSILSILLVEVSPELVCSMLHLCSGTRLPVLTVLV

SEQ ID NO: 992176 - protein, 41 aa, Homo sapiens
RATGQHSYRGRCICAANSFLAVIHIFTHSSFLQTISHCPII

SEQ ID NO: 992177 - protein, 44 aa, Homo sapiens
MVMSRGGELVMVPSVEAIPWMDLCVVLVADRLLSAMTCGRPCTV

SEQ ID NO: 992178 - protein, 57 aa, Homo sapiens
AVLDPWNVYICLRPSSPRGVVQEIAWTLVSIPGFMTDILGAWGSQLLPLAASPPTSQ

SEQ ID NO: 992179 - protein, 90 aa, Homo sapiens
MNKVVMLAVMKVMHGLSNMDFCSPKTNWLQLLLSAQSAVSHDQHWFPNMAPFPGGRLIHWIASLMAGVVFISYWNTHFRYKFAFLTQNAS

SEQ ID NO: 992180 - protein, 123 aa, Homo sapiens
MYPSPLHGYGSSPTFPQPDKEPWSPTKCKGPLGTKEELLHGTVSAVCQIYLNTVLNTLTPFVLARKDAMITVDAWNQEIAAVLDAKGKVWTQDLILQVDDALLNLIDFNSTNATGKFTYKHNP

SEQ ID NO: 992181 - protein, 119 aa, Homo sapiens
PDWSTRLRSRLIPPDFYCTLRNKPPSFGREFTNTGPVHAAVVPHLRCRKLHTNSGLTCSMWMYRMERALYVFTLAPGTISTEIFERLLAHFGQRREFSCSQYLLLCVSSFGSFIRYLPD

SEQ ID NO: 992182 - protein, 67 aa, Homo sapiens
MDPISPGRMPGINADRMTTHIKLQHSGPDSGFPMTERTCVVYPQTSVTTRTRIAEERLRSLDLLNWA

SEQ ID NO: 992183 - protein, 94 aa, Homo sapiens
TLSVTRRQLITVPRAVQSCYVLTVPSYTLAARLLHGPTILKLLVFSHMSPQEGFIVPFILNHFKMNLSTQQSAPYNPFLSNFCPYFMSPFNILY

SEQ ID NO: 992184 - protein, 52 aa, Homo sapiens
MLPTDQQPPCSVAATPQESGEPQEHFGRSGMQVQGALGPTGAPSSGWPQLPA

SEQ ID NO: 992185 - protein, 71 aa, Homo sapiens
NLYPDHPRRAKNTRSQYTEGLPLLDTEMAHTALNYKNQLLCFHSEYRTQEMPTIMRPSTTNRSQLIKYTSN

SEQ ID NO: 992186 - protein, 36 aa, Homo sapiens
MIVVLLLMISYSDTLNMEDNSSRKSNLRAAPHSLLL

SEQ ID NO: 992187 - protein, 53 aa, Homo sapiens
MVTVMDMATLTVIPVFIMYMDDKRVLPSRSRAQRKKHRNQEGFRRGEEGAQYP

SEQ ID NO: 992188 - protein, 110 aa, Homo sapiens
MDVVTPECIEVGELRELDVTDDGAQVPGLEDGVGRVKALKRALKGVRLVREDMARQSSLMRAVFSPNPQSDVTCGFSWGSVVTDFRGFLLAPKCGSPSGWPVATQLRTIV

SEQ ID NO: 992189 - protein, 35 aa, Homo sapiens
SAKPYITINNLHPRENKDVLTYSCKPKSENYTYIL

SEQ ID NO: 992190 - protein, 140 aa, Homo sapiens
GLALSRWSFALVAKAAVQWRNLSSPQPPTPRFKQFYCLSLPSSWDYRHAPPSPANFVFLVETGFLHVGQAGLELLTSGDPPASTSQSVGITGVSQHAWPQTTFQWLQSIPMYGYTRIHLNLSVYKGIQTIFSILPLCTML

SEQ ID NO: 992191 - protein, 53 aa, Homo sapiens
TTHGGVLYVLLFRILPLIKKVSDDGNDGTFAKEGENEGVEDSLSVSLHRGWPY

SEQ ID NO: 992192 - protein, 48 aa, Homo sapiens
RRRGGPDQGKKAEGTPNQSKGLGGKRATRRVKGYPEVKGLPEDKGLPG

SEQ ID NO: 992193 - protein, 34 aa, Homo sapiens
MDERSPAIVRTFGWVAELVILSLRCIADGNQQGC

SEQ ID NO: 992194 - protein, 48 aa, Homo sapiens
MVGERERESSKDAQPEPFPFLGGTKMKVSQEKGGEYNLPVEYNLPVEY

SEQ ID NO: 992195 - protein, 60 aa, Homo sapiens
DATGKASDSWDKVLRRTQLICSSRDRGSPLQQVARTPDLLIHPPRLPQVLGYSVRTQPEP

SEQ ID NO: 992196 - protein, 45 aa, Homo sapiens
MVTCNQSFRGEGCSSTCHNLPQNLTGYIWYKRANDGTSTYYTYTH

SEQ ID NO: 992197 - protein, 138 aa, Homo sapiens
TQVMYSIPNKHDWLTQPCLNNRVSNQVSQPTSVQQIPIPNLCTTARAASSPTELGGWPCLFPKASGMVQLLHFQPYRSQPAFYAKVYPQPSVAPFVVLLIQQLSNVSNTQRTCQGHNSGSCLFSQTIRRRGLQGTRAR

SEQ ID NO: 992198 - protein, 39 aa, Homo sapiens
LEDLLREYKLIMSERDQVSLSWTSCRPKLELAESKLKSS

SEQ ID NO: 992199 - protein, 103 aa, Homo sapiens
CCSSSPNYGGDLSTESGSGHKLRLGGLIRICLSSKINGENPQLKQIEGLVKELLEREGLTAAGKIEIKIVRPWAEGTEEGARWLTDEDTRNLKEIFFNILVPG

SEQ ID NO: 992200 - protein, 73 aa, Homo sapiens
CCSLFKPPPAGGVKCPDGEVMKKNMMFIKNCACHYNCPGKMKFLNSLYYRKMYGDMAGSQRVRDINSLDWNLN

SEQ ID NO: 992201 - protein, 41 aa, Homo sapiens
SDGDLEDPSGNIHFDWGGGGSSKPKIVPYALQPGRQSQTLT

SEQ ID NO: 992202 - protein, 110 aa, Homo sapiens
REYEVSDLSTRGDSSRGLSSCLEIQCMKIRTLLDETTCPTFLTTLFITTNNLLDALLNDTCADRLVLHDRTTDNLQPNRTGCFLTRATLTEHLRDTAFPIWPDRVPDART

SEQ ID NO: 992203 - protein, 38 aa, Homo sapiens
IHFSSKHGSKCMVQVHGPSAWSKCMVQVHGSLAGDHGS

SEQ ID NO: 992204 - protein, 92 aa, Homo sapiens
WPNWVPVVYACFLDDNQIITSSGDATCALWDIETGQQTGVVVLDTVGDVMSLSLSPDDRTVVSVRLCCLYQAEERCGIPMCLTRPNIGHESE

SEQ ID NO: 992205 - protein, 97 aa, Homo sapiens
LLFRDPDHVGHGRGMSDVMGNWLLAPVVNNWSLTGSPWHWSSPSNQVSPWSLSRDKRLFCALAGIRKMLECGCWNLSLELNKHGFASPLCYQLSGFN

SEQ ID NO: 992206 - protein, 87 aa, Homo sapiens
ELSLWGADYPPVIPLGRGTQGVGPPTLSVTFPRKGQDETVCVYGHGAELSRAACVLATYSLAAAYRRVCTVFHQIFGLETSGKFQGG

SEQ ID NO: 992207 - protein, 142 aa, Homo sapiens
AVELSEDSGVMKGGTFAQKFIDHVALIGMAEVKLGQAGPIVQKWILVMFWNPVNNVKRPESELLSSGNNSEIVLEGEHAWKVLVDEIHKGVLVAPHDLTHSAVHEGTFAEVVNAKVMMSFRVMGLFSIITAAPKTRMLCMTM

SEQ ID NO: 992208 - protein, 46 aa, Homo sapiens
RTSWNSCQSLLLNNLQYDNDITETFIQTSNALVRFSDCLINVKVER

SEQ ID NO: 992209 - protein, 92 aa, Homo sapiens
MESEVMMSDYESGDDGTSKRRRTRPCDSSSTRKSDSQLPPKWLTLVNLEVILVIRAGLCSSASKLFLVSRMGMAALDPAPLDVLAISSVPAT

SEQ ID NO: 992210 - protein, 42 aa, Homo sapiens
SIRRTLSGTPYTTSPLEFLTTITSWASLVMISTSPCSIILLH

SEQ ID NO: 992211 - protein, 127 aa, Homo sapiens
SEIGIQMMMHIQDQQTKEICALGGFSGRRKKNAMRILVPAKVASKNVIPALERVEPIKKHEVPAKSDVYCEVCEFLVKEVTKLIDNNKTEKEILDAFDKMCSKLPKSLSEECQEVVDTYGSSILSIL

SEQ ID NO: 992212 - protein, 52 aa, Homo sapiens
CVVTLRIQRADTSRIFPSVVAKTSFEMDREDRQGLQGLLNPDLKNVNYNKKV

SEQ ID NO: 992213 - protein, 51 aa, Homo sapiens
SGEQSLPEQSLTENSILAQFAGEDPVVAWEAVGSLKTPGNPCTHLVWASIG

SEQ ID NO: 992214 - protein, 123 aa, Homo sapiens
SGNWLQVSRVSLCPVLLPCSGFPGFLMLVPFKPCRYSRLFEHAMLQALRAHQLGIDTYQEFDMKAIFQRIGTILIPALIPNLLLASRTLIPIAFQHWGKRKSKFRSKSLVPHLPLLAHSESSA

SEQ ID NO: 992215 - protein, 104 aa, Homo sapiens
MRTEFIDNCIPTKKARIEVRETSNFQQGRNTTYGIYLLLRGQGILIFPSAKAVNSTTNQLQSQNTMWHRPLDIVLADGRVIVFSQNVGHLEAKGSADGSDGAAH

SEQ ID NO: 992216 - protein, 69 aa, Homo sapiens
EETPLMAADTRWRRSTVAGVVSLRERKQMSQSDLLSMHEASYVFSTSWSTDSESCYGYTTAPDTLCESA

SEQ ID NO: 992217 - protein, 54 aa, Homo sapiens
CDCKVFMEMSEREEELCWGWSGLAFSYRILGHGSESRLDLQQTCNLTVSHTDRT

SEQ ID NO: 992218 - protein, 84 aa, Homo sapiens
MRRLNTLQYYRVPDGAAVALCRCLTKQVLRDNQDYVPGELDPNAGGCMMKEAVPPWHLLKPSEEPEPTMPGRGTLRGGERERAK

SEQ ID NO: 992219 - protein, 49 aa, Homo sapiens
ALSVGGLGNSSTQESGRMGVRNAMDDQTDNVLVIQPHEEDGFFCEDVHV

SEQ ID NO: 992220 - protein, 82 aa, Homo sapiens
QLGPDVGFVWVDRAHGLRLVSRCPLGLQSSDGCAVATGVFFPQLTHMAVVEKTYVPSFFPWCDSPHDLVAGSPHSHVIHERD

SEQ ID NO: 992221 - protein, 116 aa, Homo sapiens
GSVPAPGYPEAVRVSGMVMEFLVIAVPRVLLRRPPGWDERSRLSYRPQGPPPGLLKAGGKVQLSSVVLQRGRMAPAWPEGLQETTEPWIRPLSSSRGTGFQNSCTVLGSSCLCRHH

SEQ ID NO: 992222 - protein, 61 aa, Homo sapiens
DRCERSVDNRRKDGDGQWTTDRLVGSVSGQQIDEQMWRRQWTTDVWIDGYVRVTHTGLDYG

SEQ ID NO: 992223 - protein, 63 aa, Homo sapiens
FCFSDSIPTPFQMEGIRNRNATLVAAPSSPRAAHSKSWLGDPMRFRHEGNVQPNNPWVVLIIL

SEQ ID NO: 992224 - protein, 128 aa, Homo sapiens
QSTGSYAFYDPDSSIVYLFGKGDSSIRYFEITDVACLFVHYLNTFSQQDEPHRCMGFMPKRGLDVSLVDIARFYYLHERKCDPIIMTVPRYYLFLDDLYPDTPGPEPSLDAVEWLSGQDAEPVLLSVK

SEQ ID NO: 992225 - protein, 137 aa, Homo sapiens
FPLPTVSYKALIHFTVSYEDCILVKGPSLSSSCGAKVSNYLNHTNIHRMPRHSNKKEEVKLSLFEDDMILYLENPIISAQKLLKLISNFSKVSGYKINVQKSLAFLYTNNRQAESQFMNELPFTIATKRINYLGYSR

SEQ ID NO: 992226 - protein, 138 aa, Homo sapiens
MSASKQRGNILFGVVAAVVAVGLLHLALAGSCLLLAAARAGWPKCGYHAGKKETKDLYAPEPSGKASKGNKSKGKKSKSPKPVKPVEDEDEAGLQKFLKFNLMSDAPGDSPRIHLPLNYPPGSPDLGRHYRSNSPLPS

SEQ ID NO: 992227 - protein, 73 aa, Homo sapiens
ALDSDADDLEHLTDESADETRCAYAYKPIVASSVDVRRIDFAHTTCSLHDEHTVAHEGQDADYIFDLQSLIDI

SEQ ID NO: 992228 - protein, 38 aa, Homo sapiens
ARYPRSRVSLELLRKRLDQLGPGGSRQQLEYLAKDGDS

SEQ ID NO: 992229 - protein, 79 aa, Homo sapiens
QSRSIHGEDIEQVQMKSRGNRKADEAAKEASLSSASCPSPSCYPSNPTQELSHRESFAIQQGASFQGDWIVKNQKLVLP

SEQ ID NO: 992230 - protein, 66 aa, Homo sapiens
GDMATVGPDRHVPEILCVDCSTNNPSHAKLRRELDESLQVAERLTRKYNELLTSYQRLMLNTSCLL

SEQ ID NO: 992231 - protein, 154 aa, Homo sapiens
TVIVDKMQIEARGGIMAMKTNDKTKREGDVHFDYDETWTIGDEQDTDLLQVAAHELGQDAGAAAQTTAAKDLNVCFYTFRYPLNLSPDYCRCCQHLYGQPWPTVTSRTPALGPQAVIDTTEIAPLAPYAPPDSCEASFDAVSTIRCELFFFKAG

SEQ ID NO: 992232 - protein, 81 aa, Homo sapiens
RHADCRREHGYKLSAEFGLVTGVAHQLRGSLLTVEENHSRCRSLQGNSPYRRRLHMLSTGVLLINHLIAGELLYARERNAR

SEQ ID NO: 992233 - protein, 129 aa, Homo sapiens
MPCAVLAPLPSIRTSAYLLLALAMTLLLRLVLDVNAPPDNAETMLLERLPRFVSDADADAAAFDAVMERRAHGPLAELPFRVGDPSKMRGYPNLNGYFLRGQRGLSQKDGAVRSEPFATISGGIDKHRV

SEQ ID NO: 992234 - protein, 45 aa, Homo sapiens
MALVDIDTHSADAVQNSNPFCIRSGNWREKFHARDCPFPKGLKQG

SEQ ID NO: 992235 - protein, 143 aa, Homo sapiens
MDKATIENRILILPNVPSKVKHASCINVKYGTDYGGIRSDPVTLNVLYGPELPSIYTFISPINVQEEKLYLSCFAESNPTGHNILGALMGKLQVSGPKLSIPQITIQSIVGSMLALFVTQPLARKAPNPSQSKSLTGDYPEFY

SEQ ID NO: 992236 - protein, 94 aa, Homo sapiens
WSRGPETGWAFFHLIRTQPAHRSPWVAYASCSSSSGTSILRVLVVDISWICRACQGPSASLSSLNCSCKALDIRPMLGPVRSILAMFLSSISHC

SEQ ID NO: 992237 - protein, 71 aa, Homo sapiens
MLSPRALALVWSQLPSPSLPSPLPFLSAERVRGPLCPDVSHGPNVGTRNTLYVCAPPGALATWSPSLMCGC

SEQ ID NO: 992238 - protein, 71 aa, Homo sapiens
YCSWNQLMTVLVFRLSWVAEVFDGFVVTALWLLLTTLVSDASFSSGPRTTRGFFSWCCFCVLAPWLSSVPD

SEQ ID NO: 992239 - protein, 65 aa, Homo sapiens
MPGERGYCLYRFLALSKTYSCIGIKSVQMLLQSLPSHVSKPIVPGEWQSFQARLSRNALHLRLWP

SEQ ID NO: 992240 - protein, 106 aa, Homo sapiens
DFQSVAKGTGFIDWLQEVVSDLRRPQRLVGPGVPIRSWLPHPNLLLCRWSPCLTAPCCMFLAVHVVDKEKGRWSCDVGHAWPPGSSFLLAQLLAFTRANFQLAYLC

SEQ ID NO: 992241 - protein, 49 aa, Homo sapiens
MHGGGDPAHGGRHQVDEVPVGGGGQLEGAETDVRECLVVDARGLIRILH

SEQ ID NO: 992242 - protein, 51 aa, Homo sapiens
TPRIGVCSSTKTSRCTSLALIQRRERLHMFRVGGLVFHAIRQLLPHQMADF

SEQ ID NO: 992243 - protein, 53 aa, Homo sapiens
MSISHKLPSIAGEAYADKAIDLINTGASILTAAAEAAMNENLTVLSGEALITA

SEQ ID NO: 992244 - protein, 59 aa, Homo sapiens
MRSVGSAALAAADGAPVSAGAPSGSQWVLIGHRLYSAVLITLENCLLPDDKLRFTPSMS

SEQ ID NO: 992245 - protein, 80 aa, Homo sapiens
RAPQGVFSNAHGFLLDTSLKPPLCGQTLCDNTEAIASYNQLSRLRQPREVRYRVSNLYEDDHRTPTATRERVDFYHHQLA

SEQ ID NO: 992246 - protein, 44 aa, Homo sapiens
NGWISPVCSPSNEYLIHKYISTTLSISKHEDGYSYPIPIQLYSA

SEQ ID NO: 992247 - protein, 42 aa, Homo sapiens
RHQAIHSIGSQQKGLGSGHVDRDNGQYRARGPYIRDLDMLPY

SEQ ID NO: 992248 - protein, 42 aa, Homo sapiens
VLTANDVSSTTHMVADLNAFSKHIYNAYLKNFNMTKKNACSI

SEQ ID NO: 992249 - protein, 53 aa, Homo sapiens
MGFLHVGQGDLELLTLGDPPASAPHNAGITGVSHRARPSCQRFLLCTLGARAG

SEQ ID NO: 992250 - protein, 97 aa, Homo sapiens
RPDNSHDTVSYTNPLWDCFLHYDSDDGLETAGYLADILTLEEAKDGQETTDSYTAWALTAQLARLTVVQGVLEHQEGRERREIATCSKRQSTLAAES

SEQ ID NO: 992251 - protein, 63 aa, Homo sapiens
HERPKGHDSPKREYNLAILVHCNLCVPFHTYKQLEPRAQLSLQEHATMPGYFMSALSRDGVSP

SEQ ID NO: 992252 - protein, 35 aa, Homo sapiens
FFYTPVSLKGWDSPGTIQVKLAGWGFTVGQGDGRR

SEQ ID NO: 992253 - protein, 38 aa, Homo sapiens
ASGIEREEKQKAGRTIRTDPQMLPMDLTLPVPRQEGWL

SEQ ID NO: 992254 - protein, 31 aa, Homo sapiens
MCIFGNPVSASAGDPVTCISTEAAKPLIQPF

SEQ ID NO: 992255 - protein, 36 aa, Homo sapiens
GKIMHACIRLKAAGQRSQDGKLIIRDSYTTNSVPGS

SEQ ID NO: 992256 - protein, 52 aa, Homo sapiens
MSVAKLCPRQQSSSSSDEAGDPNEAPSPDTLLGALARRQLNLGQLLEDTESY

SEQ ID NO: 992257 - protein, 84 aa, Homo sapiens
QAYDYSKKWLQALKVEYKKNFKKIECNCCIVGTVLGCLRRIFLKHTTFTCFLQPHQSHHFIETLCTCAKKTHLWFLKMGIHGSR

SEQ ID NO: 992258 - protein, 52 aa, Homo sapiens
MPYDRVQVPSPDLGICLLCSVTSMGLGVDDLSCVFQTVYGLMTDFPTPALPQ

SEQ ID NO: 992259 - protein, 111 aa, Homo sapiens
KVDDGGQGKVSSPQRELSRLALDRTGGQRRVPGGKAEEMSERMSPPDGPPTSSSGVEFLAMAERFSTVALGSMSFGHVPINGPPQGSNQQSISFPPISKDIKGSGPKQHFG

SEQ ID NO: 992260 - protein, 34 aa, Homo sapiens
CLSFGMQVTYGPTERASLSRWGPSSLQSRPETET

SEQ ID NO: 992261 - protein, 41 aa, Homo sapiens
IVESEEAPVYNEYMECQQRVLTVVDGNVVQCSACTCSGRIH

SEQ ID NO: 992262 - protein, 98 aa, Homo sapiens
RYRSRYRPFHGIFSLRQGDRRLLLETDWESILQICDLIRQGDTQGVSGACALMLEEQPCTKLGSLGARWVSTTELTVLGSYVEDCMGYMLGFFDILED

SEQ ID NO: 992263 - protein, 102 aa, Homo sapiens
MTDVLDLVRTWLWFLVRTTYYLLNDGLATYERTMDAVACVTGHYLTGRFCRNRGFLFYWLHPGIKRYPVYFLRPTSGKNITCDAYAPVTETLPCGGLLYDVD

SEQ ID NO: 992264 - protein, 46 aa, Homo sapiens
MNLLSGAEPEPVPVDPKEMECMVRIIHRQFTDIQIQLKANHLRGCN

SEQ ID NO: 992265 - protein, 72 aa, Homo sapiens
EDLMVGCQSSIFCLSHGNECHGRGSSLYQLSVLSLWTVVLIVPELTVPKNKNLRTSVTYKGRGSERTQIGHS

SEQ ID NO: 992266 - protein, 58 aa, Homo sapiens
PKWARFLLSDCVLLENRAPELLQMNLGSVTGASRIACEQSRRHHQTINNAPQCFPRNC

SEQ ID NO: 992267 - protein, 38 aa, Homo sapiens
NEESVKEGEEKARYGQIENYLQTSSLLASDHHLTEEER

SEQ ID NO: 992268 - protein, 39 aa, Homo sapiens
ERYQHITISVSSSSSSFYLVLVLLFLLLFFSFSFFFFIF

SEQ ID NO: 992269 - protein, 36 aa, Homo sapiens
MPHGIIVWGITSYRLAVHRCALVTVARCYTTEKTLN

SEQ ID NO: 992270 - protein, 105 aa, Homo sapiens
RGLEDGAAAELVSHLIRAPLRQISALAPLVAFWAPEIAYRKSVAVVVGQHVLVVVADPVVRPSQQIHVLLAAQALSEALSVSAHSGEISSPSSFLSTPMPCSRLV

SEQ ID NO: 992271 - protein, 54 aa, Homo sapiens
DPGSVSVSSREAEPEHVSHAGTMAEPLARSGVGDGHLAGSEGQWTPVLDPGRGG

SEQ ID NO: 992272 - protein, 67 aa, Homo sapiens
ASATRDAPTLVSQSAGIIGVSHCTQPKLDLLNAKRFNGGNRKPFFFYARNTIQCYLEPTLFYDIACI

SEQ ID NO: 992273 - protein, 102 aa, Homo sapiens
RERHKGLELQDHAIMPSYIFAFSVEMAFHHVAHEGLKLLSSRNPPSLAYQRAAIIGASHHARPDKYINATSVTTTTASITLYRTESRAIDMCIRILNNRYPF

SEQ ID NO: 992274 - protein, 37 aa, Homo sapiens
RTATNIRFTTQYDTSSQYVDGVLNLDGETPASLKKQF

SEQ ID NO: 992275 - protein, 125 aa, Homo sapiens
MTHISICFRPLLFTSGGDCQTHISICFCPLLFTGGGDSVRAISPSASALYFSVVAANLSDPYLHLLPPFTLHSWRRLCETHMSICFRPLLHTGGGDYQTHISICSRPLLFTGGGECQNHISICSR

SEQ ID NO: 992276 - protein, 56 aa, Homo sapiens
RRDWDDLCGGVTDVSWHLRSHSMLSTELSTAPCAVRVSTLSMLLACKAVKSSPVSS

SEQ ID NO: 992277 - protein, 118 aa, Homo sapiens
MRRNEEPQRVITPVSASFLSLLSMMKTLASGPVSGPSFSLTETPILVLCKRMGLSGDLTVTMGHSGEAHACYPAPDLISSTGRRTMVRDQGTGEPDRAGCTGASYPQPWTSDAHHPEP

SEQ ID NO: 992278 - protein, 72 aa, Homo sapiens
AFYQDVDNSYVDHGHTHEYYDIQHESQNLEDIPYDMGLIEKRDYNNTLCISSEAFWMTYNSSDEDTTPASVQ

SEQ ID NO: 992279 - protein, 46 aa, Homo sapiens
SYETASKDIDECDIVPDARKGGMRVCTTLWRIPLPTENSPDYMYNN

SEQ ID NO: 992280 - protein, 47 aa, Homo sapiens
MLEASAREHQGQHMRDLLEDASSLLTVMATDRLEKEVHKRPRTNICA

SEQ ID NO: 992281 - protein, 146 aa, Homo sapiens
ALPQLLGEENWDNVKQDWSPMKDGSSPKVEFSNAHGLYCWTRVWSLLCTDRHCVTTGEVIASYNQLSSFQPAQGGCATAWLHLYEDDHNNPTVTREHAGLTSTTQLAEAFKHYNISWELHVLEVTTSSLRRLLILPHCDLSKIGDE

SEQ ID NO: 992282 - protein, 132 aa, Homo sapiens
TIRQIPITADRRRKLKLGGSGEDILMGSPQDTHYTKENSNSTGKRPGRHHLHPDWMQRRPDLFRVLARRHNGSLITRKYQANQNGGGVYKRPAHTSQGLGVLKDGSRDWEGRETTKYNGGAWGGPGTGKTDT

SEQ ID NO: 992283 - protein, 61 aa, Homo sapiens
MILFQGYKYWARDRVANKYREVKDEEDFETESYKMCYEIAVCREAGSVAFVPGYRSSEFCQ

SEQ ID NO: 992284 - protein, 46 aa, Homo sapiens
YTRSLFLCTALSRTGDGELQGEDIRRAPRGPGVPPRFPQSSGGIAP

SEQ ID NO: 992285 - protein, 46 aa, Homo sapiens
YAREVVHPEYSSPPPARRAADAWGIRTLPLAILYPSWLQPEDETSA

SEQ ID NO: 992286 - protein, 66 aa, Homo sapiens
MPVAICFRVSFRIVIVILIICVILIVLILCGRGSSCWFHRCGFNFIFILILVLVILLILLTVIIRL

SEQ ID NO: 992287 - protein, 48 aa, Homo sapiens
GSPGGGCSADSLGDDNGPLHLHLVTRQRGSRRRNGDITSEGAFLVNVG

SEQ ID NO: 992288 - protein, 70 aa, Homo sapiens
RWSGRRFVGYLLNEALAVLEGTSRSRSRGGSRRRQRRWRSIILLPRLDCSGTISAHYKLRLVGSRHSPAC

SEQ ID NO: 992289 - protein, 65 aa, Homo sapiens
MGIQVISALWALSGPDPGTQCLVGPAPAGRSPVQAPCLRNVRGAAHPVACFGLAGDVLGCNLSPS

SEQ ID NO: 992290 - protein, 70 aa, Homo sapiens
MLDHNSDGQCYQCPAIRSSWSDIKFFQSDSPVAHPCQALSSGTLQLAARPPEALSPSHISLRGNVTSPQP

SEQ ID NO: 992291 - protein, 101 aa, Homo sapiens
SDRGEYILGRRSNRADEITRQQKGRGGRKEAVPFFCLVALSFLLSQQSYPRTLPPRKLRYTARSLLSRGLDSQKSKARPPLRADQRNSDISSPILPYQCAA

SEQ ID NO: 992292 - protein, 39 aa, Homo sapiens
MSVGMRRNMINKHGLTSMRNIKSGMVAHTCNLSSLGGRG

SEQ ID NO: 992293 - protein, 67 aa, Homo sapiens
MTAYYTELEQQTGCNDRQAVQRRTDRSPLPYHAYSKAEWLTLHLLCSCNFPGYDTADLAGPPPSSST

SEQ ID NO: 992294 - protein, 98 aa, Homo sapiens
TEGLQQTAGEQAVAVRLRSDYEARLSESTTTLIIAGIRNGRHRVHHRAEVFADRKTNARISLQHLHFSPFFRTANINGTVPPNEIQRNDIWFMAVGKS

SEQ ID NO: 992295 - protein, 70 aa, Homo sapiens
FSVVCAASVITAVAPFKTRGTCTGTAAPAGTGVPVGFADSGQATGKPFHHPRLRCCTVISRLCLPQSLVL

SEQ ID NO: 992296 - protein, 42 aa, Homo sapiens
RGCHTLEGALKLYDRFRKVAHGGKSGICHTMMVVSSEALAIT

SEQ ID NO: 992297 - protein, 94 aa, Homo sapiens
KYMDNYSEEEYESSPPAGGSDDAVQGQELEEDDFDVGKPKKQLEIDKKNDVHDHGKKNFKQKVVALQKRYKVSDEDLDSEQNPAEHIPRDKRED

SEQ ID NO: 992298 - protein, 75 aa, Homo sapiens
LAGKGILQTVGSNPPVQKGSVKATSDTSKNPCPLQSHHTDLMKLQSQGDRSGYEQPRIPSALPAAAPASLSHRDT

SEQ ID NO: 992299 - protein, 55 aa, Homo sapiens
LLLRNLTLMCVSEPGAQSGYVLRDGARPAGGILYPFVSGCSVGDGDLNSSPSLCH

SEQ ID NO: 992300 - protein, 68 aa, Homo sapiens
WVMMESILFHELYEKDDECYAEVWTYMMMFSHRASQPQPKSQCKKNPVPEESDWKVDSSSGQDVVSTV

SEQ ID NO: 992301 - protein, 44 aa, Homo sapiens
QAQLHLQACQEFKVAKRRHFSHLAALQYGNTPDFPSSSVPSLCQ

SEQ ID NO: 992302 - protein, 110 aa, Homo sapiens
VQVDCYWLSATLTVGKPTYPNDEYNHKEFLVSYVRGVSVVEYESAMATVIIPEDRYWENLVVVGTWNQEEHIEWAKKNTARAYHLQDDGTQTVRMVSHFYGNGDICDITD

SEQ ID NO: 992303 - protein, 115 aa, Homo sapiens
STRFRDGIVRIYEAQSVMNLSEWSLQHEISCKLSGSCISGNPYKLSVQPSECGRVISSDVYRQESTALWLVVANDANVDLSRLAFCMHFALAKNPNTFHIYAQYQTHRLRYTQDN

SEQ ID NO: 992304 - protein, 39 aa, Homo sapiens
IFGGRPPSSVVFYKATLYQEICVVSSLQQAFVPAGYPLV

SEQ ID NO: 992305 - protein, 51 aa, Homo sapiens
VYQELSHRESLYTASSLLSRGLDSQKSKARPPLRADQRNSDISSPILPYQC

SEQ ID NO: 992306 - protein, 67 aa, Homo sapiens
PTAGLYCSMGEGSNTACKNWVRRCKRHGPSAKWRKRVMAGPRKGSSQCAQRVTNITCGRGIVKGRVP

SEQ ID NO: 992307 - protein, 35 aa, Homo sapiens
IDPKQILELLHLNILSGIEYFEAEHAMCSPSFMTK

SEQ ID NO: 992308 - protein, 95 aa, Homo sapiens
LISTAAGAYLPCRDQQGKRSRTHCRLCSARLLDCSPGGSSADSFLTHPALCFALSPEVVLSNLPFLPQSLGSRVQLHSPLPSTLVFPVQPQLRGD

SEQ ID NO: 992309 - protein, 36 aa, Homo sapiens
VWLLALERVRNGSPACVCRAAPAIHRGALLLHVFDY

SEQ ID NO: 992310 - protein, 39 aa, Homo sapiens
RRHSCACALPLCGGQLWVLGARVAFCDPSPVPLLALLMQ

SEQ ID NO: 992311 - protein, 83 aa, Homo sapiens
ALYFLHEFPLITNPTPPISLTPCSTMSLYCYKFQGTGLRKSKYQTKVVEYSTTGRNAEQLIYRLVAPARPPGSPLLKVTITTK

SEQ ID NO: 992312 - protein, 58 aa, Homo sapiens
VGTIRRGIKQECSKQLAVLVSLHQALLCCQPAGTGPTPLPTSAPSTHSQLPRSLASSD

SEQ ID NO: 992313 - protein, 67 aa, Homo sapiens
LVSRSTEKRSPKARLLKVSPQQPGPSGSAPQPPKTKLPFLCAKRIHPGRGGMVDADNSHVKGTCGAR

SEQ ID NO: 992314 - protein, 130 aa, Homo sapiens
IGKSKLLYLFLPPSSRVPSVLLSASPAPDPFPQYPLPASLINPSVAAHHDPIRIQLKDSSKFPNVPQYPISLTHQKGLQPIVNKLCSCSLLRPTHSPYYTPILPVKKSDGSYRLVHNLRAISQAVLPIHP

SEQ ID NO: 992315 - protein, 56 aa, Homo sapiens
ARGINLEDEFQTQFLRTSHSLEDTCRRAMSYLHHAIDTAWPIMEIELTVVNFCDWA

SEQ ID NO: 992316 - protein, 116 aa, Homo sapiens
MGHRMLLVAPKATSALHRAALAPCAANVSTFSDVLPEAVQQPVVLDQCVLVVRVRVKLAVCLLEDLPRSGGCRLPASPSAFGCLPLGPLGGYSHRCSEVSYTRLLANILLRNRTGS

SEQ ID NO: 992317 - protein, 77 aa, Homo sapiens
HERPKLQDADLTLYQTNTILRTGPPLGLYAKDQQQAALGDMGNDGVYNLRCRYISLIYTNYEAVKDDYVKALPGQLK

SEQ ID NO: 992318 - protein, 45 aa, Homo sapiens
MGFHPVSQDGLDGTSVMYAACYCHEHHDVRRDIDVEADSLRVGAL

SEQ ID NO: 992319 - protein, 39 aa, Homo sapiens
MVLNSQSRHYITTQLATKPEAVKMHHLPISGCKESDEDY

SEQ ID NO: 992320 - protein, 140 aa, Homo sapiens
MPQSRLTATLPPGSSDSTAPAPLEAEIMGACHHTRLIFVFFGRDTVFHHVGQAGIELATSGDPLASVSQSAWITGVSHCVQPMFLKCLLCARPCAEGLVDILSHLIHSALRREDEDTEGEACGAGPPLHNPGLRVFLQHL

SEQ ID NO: 992321 - protein, 34 aa, Homo sapiens
MEDGPHSSQPFLELLDPRLISTEENMHAAEIMVL

SEQ ID NO: 992322 - protein, 41 aa, Homo sapiens
VNLGGYTSLQAESSTQSGLEDCSFGVGGRPSGELVSCTSRG

SEQ ID NO: 992323 - protein, 72 aa, Homo sapiens
LTAEVDLCRETVEDGRTLSELQASRKSHLAAWCSVSEVGCTIFVKTLYWKDRSRLERGAAVTPLDECQRQEI

SEQ ID NO: 992324 - protein, 67 aa, Homo sapiens
AAVTAGMASGLSLAEGHDRLREQHVACDWDCGAACHVGTSPRCLPCPALQCLGSQAQVCQLALTTTH

SEQ ID NO: 992325 - protein, 89 aa, Homo sapiens
MKQLIPTASLLVSRRVTRGGRSDPTSFTHHNREMMGTEAVTGRFTFTLHLETPKPSISISNLNPRETMEAVSLTCDPVTPDACYLWCIN

SEQ ID NO: 992326 - protein, 85 aa, Homo sapiens
IKDRPGLVTQQEEGLGQSDAGCVPAKDWDQLQNKVPGGPDDLEGQDATPPKQGAACGAAKQLVQEGKLGTLVPAGLDETLSLSRP

SEQ ID NO: 992327 - protein, 110 aa, Homo sapiens
SADEHGAGREGKESPTLGARPSPFSFQDHRPLHWQEGGGGEVQGTFMVPGAERRGQRYVAGDDAFCSAGDNVLYRDGVTATYGSSWRAPGRSWGFGVWKPYLGHLVHPSV

SEQ ID NO: 992328 - protein, 37 aa, Homo sapiens
LELLFYLLLFWASYSVCVSMGLISGTRAARKVFWPAM

SEQ ID NO: 992329 - protein, 74 aa, Homo sapiens
MYKKRALRPPAGHPSAQRLWAEAYRLTPGVHELPVQHARRNAYLKVSIERAQQENPSPHRGPGHLIHHPGRAHQ

SEQ ID NO: 992330 - protein, 68 aa, Homo sapiens
MLVPPGRDCQCTAEYCYMFIVLLDVPVQQLHGVISFLQALLILMDLLHPQLLLLSQKVVVLIPLILGD

SEQ ID NO: 992331 - protein, 59 aa, Homo sapiens
PVSYVLSRLTWMRRTRSRSSTVSSLFTGGSLAAATACGLQQGVVGDAGSLHREDVECLL

SEQ ID NO: 992332 - protein, 47 aa, Homo sapiens
IESTPQHQKTDTSDISICLVEQQSQLKVRYTCPQTMGFLNLNAGFHY

SEQ ID NO: 992333 - protein, 117 aa, Homo sapiens
LYPINNSAAWHSAPLLVLRILAVVVPVPSCLFFYLFVLCLYFYDLSSLHTGRKTHRPCRAGPYRISCTVLSNKKCYLGPDALTHACNPNTLEGQGGQVTWGQEFKTSLASVAKPHLY

SEQ ID NO: 992334 - protein, 84 aa, Homo sapiens
MPMHQRVKSPGSICGSLCSARRWFALSCVSQTASFLTHPALCFALSPEVGLTNLPFLPQSLGSRAQLHSPLPSRLVLPAKPQLR

SEQ ID NO: 992335 - protein, 82 aa, Homo sapiens
TGERYKLRSITATDKRDRAFSFSFIASFIPELKKPEIQHTNIYTQKITNRCKQLSDTDPGKEEPPQSITIYDSNPSTPVKHR

SEQ ID NO: 992336 - protein, 138 aa, Homo sapiens
LLPEEGGVGPVSGCKTWSDCSSRVSLTFSRVTHEKTETLWCLPLSIRIPWQVSLIIRRRLECGRRGSAWFPHQICSGSLQYSMPKRLSPWRPTHTSHGLLTSMPGFAPWKEPTGCLSPTCSTSLPFHGARFLSRGSIL

SEQ ID NO: 992337 - protein, 131 aa, Homo sapiens
IPDNIKVKVMGCAESHQWDVQRGSHRCLSREKDLAGIYSEGRDLAGIYSEWRDLAGIYSEGKGHAGIYSKGRDLAGIYSDGRDLAHIYSKGRGHTGIYSKGRGPTGINSEGKNHPGINSDGGWATSAAVSG

SEQ ID NO: 992338 - protein, 44 aa, Homo sapiens
MGYMTGTISSMYQTKAVIIAMIIAAVDIHYQYTIFCFQTQGWTS

SEQ ID NO: 992339 - protein, 107 aa, Homo sapiens
YFGHLARNLTSFNLSPSHLQYVDDLLLCSPSLKDSQTHTDTALLNFLAIKGYRVSPSKAQLSISMMTYLGIQLSPGEQAMTPARAALIDNLPPPSSKSEILSFPGLA

SEQ ID NO: 992340 - protein, 33 aa, Homo sapiens
QDPCAHHRSSELYRIGQQLGITFSVWDSASLEN

SEQ ID NO: 992341 - protein, 121 aa, Homo sapiens
VTPGHRRSSTVYGWWQLTIDNPCQCLPHCSPHPRPGCQFRRGRASTMGPSMPSSRSCEQMVITGSLPRVPRSIPSPSSLAQCYVTTYELNLNLVADYGQSNTVSSLVAGGSASLVAQSIRI

SEQ ID NO: 992342 - protein, 48 aa, Homo sapiens
MIHPGIVAMLMCPGSTACTQGDCLDWSMTIPPDWSAVPCSLIGAMPMV

SEQ ID NO: 992343 - protein, 41 aa, Homo sapiens
TLEDSSLSDIFGGDSHRCTRCHTPGCWLKHTPERTGPARFD

SEQ ID NO: 992344 - protein, 73 aa, Homo sapiens
LEAWVAGLDRQCCQHHPPSQETWMSERDSEGDESYSVPVSQAAHLAGRGCGSRAVGARVPATLGLEEDVRRGR

SEQ ID NO: 992345 - protein, 158 aa, Homo sapiens
MSHDNVLCLSHVAGLGLSLGRSRNRIIIHRALYYDLISSPDIHGTYKELLDTVTAPQKNSECSRIVFEKKLRIKSSFVAPLEKSYGTRPRVLTGNPRLDLQEINNWVQAQMKGKLARSTKEIPDEISILLLGVAHFKGQWVTKFDSRKTSLEDFYLDE

SEQ ID NO: 992346 - protein, 30 aa, Homo sapiens
MVKRGQQYFFSPDLEASGVPGLVNPGAHLN

SEQ ID NO: 992347 - protein, 72 aa, Homo sapiens
MPVLLFSSMFQGKGFLGGVGDGWVGSCWDSDGGSRGNTKAGLGEEGPLSLGSQGGLGGFSGRSGTGGSAVSE

SEQ ID NO: 992348 - protein, 74 aa, Homo sapiens
MVVTLSSQRYTEVNLSKCTMMFEEALPVDTVGFNVKNVSVKDVRRGNVAGDSKNDPAMEAAGFTQSFMVHIDRF

SEQ ID NO: 992349 - protein, 36 aa, Homo sapiens
VDLRSFCSLFTLGFISVLLKQLYTWLVNDFLSSGSV

SEQ ID NO: 992350 - protein, 48 aa, Homo sapiens
ARMGRAVLTGSRVPAGLVQGLVNLCVSSLALAKVSSRSSMVISNFAHR

SEQ ID NO: 992351 - protein, 35 aa, Homo sapiens
LRNREWSPAKEERVGHGGQLSRCCPHEHEKKQKLE

SEQ ID NO: 992352 - protein, 113 aa, Homo sapiens
GTVRMRLVCPEDSFVPGDGEHCAVRKIAARVCSPSRCDQPSELGMQVVFGSLVSAFHEATPLSLAEFIIDTRDAGYGGLTLPIEGPSKVDINTECLEDGTCGVTYCPTEPGNY

SEQ ID NO: 992353 - protein, 60 aa, Homo sapiens
TLRKCKEVSTYIKRIGYNPDTVAYSANFWLQVVTTCWSQDANMPLVHRDGTVTAYWTGNC

SEQ ID NO: 992354 - protein, 52 aa, Homo sapiens
RHRLDMGRQRHAEGADTPETRGMGMELCPLALPPPPTTRPWDLHGRDCGGQS

SEQ ID NO: 992355 - protein, 72 aa, Homo sapiens
SIVRLYEATDVMNLRQWSWQHEIYMSAKRSWYFSEPIRRIIVQPMNVDCDIYTCFRRNPGPLVVVAKKRTST

SEQ ID NO: 992356 - protein, 42 aa, Homo sapiens
QKEVWYSCRNEYYLVLLGYEASSHSVVGVKWPCIESTQVVDP

SEQ ID NO: 992357 - protein, 37 aa, Homo sapiens
VSVSDFLLVLDEHLNESIFISSKALHGSTKFISIKVA

SEQ ID NO: 992358 - protein, 100 aa, Homo sapiens
ARENQEHGDAGSRYPDDRCRCAEFEEAALDVEVLDSFLSFIPHIFRPFLAIRKGCDRAAVETPPDTVQPDLTVRLVVQALRAVGPAVAQLETRDGDSSRR

SEQ ID NO: 992359 - protein, 55 aa, Homo sapiens
HCGGCRIESEKHEGGRELMQELNYYLAPWRTIGFFKLHGGVNGQLETRDGHPLEL

SEQ ID NO: 992360 - protein, 37 aa, Homo sapiens
RYTHYTMHYSTNTTASGYLMLLEVQYFIGSNSVISLV

SEQ ID NO: 992361 - protein, 129 aa, Homo sapiens
TQYSRTEQKATATQQQREDVLQQQQAQTQQFHGSTSSTPATSNGSVPCGVPRRLSTEANAEFLPAAAACMQQQQQQQRVTALHQQQLMTQQAALQHKPTMAEGQQPQPQPAAAPQPAPAQEPAHESSPK

SEQ ID NO: 992362 - protein, 50 aa, Homo sapiens
MVENSCALCSAGSVRGQLWLLGALSSILLTPPRVYWHSQWYLSSEFCNHW

SEQ ID NO: 992363 - protein, 58 aa, Homo sapiens
MKYHLAEISRAVRHTGETLRWLDVHNSACVGVCLRLRHIGGPHSATLCPQAPCCCPGG

SEQ ID NO: 992364 - protein, 77 aa, Homo sapiens
ILTSPQSRKLSIKLPKGQDKIQMILAEYTSLFMKEVWSGRAQWLTPVTPALGEAEAGRSRAQEIETILANTVKPRLY

SEQ ID NO: 992365 - protein, 42 aa, Homo sapiens
MSYRWWVSPNARKNAASSTGSLVPPPLWQEVTPAIGVVSTSI

SEQ ID NO: 992366 - protein, 47 aa, Homo sapiens
MRIVIATWVRGGAENQDATLHSSLGDRVRLHYTRNRSLNKENKHRTL

SEQ ID NO: 992367 - protein, 53 aa, Homo sapiens
QELLLAEETRMRLLHTRSTANCFTAKLYAVPPRLLSTYPTAGSARLSANHGKR

SEQ ID NO: 992368 - protein, 33 aa, Homo sapiens
CDVTGGHGAVWVAVGVGPLRTSSWQRSTKLPPP

SEQ ID NO: 992369 - protein, 34 aa, Homo sapiens
ITDCHCTLDQSKSQIWLQNAGHSTYRSTIVHYIP

SEQ ID NO: 992370 - protein, 48 aa, Homo sapiens
GGCSVLCGQAVLTSEVLTTASATLQMATCELSHSHPSQSSFPGLVPLQ

SEQ ID NO: 992371 - protein, 34 aa, Homo sapiens
AVGSGCSRALEASCLHRAAAHAQDVSDLSMSFLK

SEQ ID NO: 992372 - protein, 60 aa, Homo sapiens
VGYLVCKPENWITSQAPRLDCKSCVGAGKSLRSSGARTLREEGGTGAGPGILPPWPPTIR

SEQ ID NO: 992373 - protein, 82 aa, Homo sapiens
HEASVGHDGSGGGLWRSSGSVVVFIPPGCLLPQRTGEPLPAAGGPALSHICPPSTRPPVDSSPIGHSLIRVDALVQLLAVEE

SEQ ID NO: 992374 - protein, 44 aa, Homo sapiens
YVKIYAMPGGDSRLLVSASQDGKLIICDSYTTNSVLASHSVLAS

SEQ ID NO: 992375 - protein, 39 aa, Homo sapiens
GNQRDFPVTISDYGWTRVETSEAEITRKPGLPTTCLRCG

SEQ ID NO: 992376 - protein, 36 aa, Homo sapiens
AARVCCCPRTRWGNSGSFTMWKSSPPPQHCLDSGRF

SEQ ID NO: 992377 - protein, 156 aa, Homo sapiens
RYRCISMHSSTSSSFASRFFQEGTILACVFWHRLRGHVLLALISRSTCSVSPRSSYSPQCSHTGQPLGARPPPVPASSPPPDAGPSESAPDSSLSAFFVFSTHLNPLIGKCRFIMSYARPPQVLGAAITTLHVWDHSNTRLVHTAGQGTLGLNDTT

SEQ ID NO: 992378 - protein, 101 aa, Homo sapiens
RVSIPGRCPALGVLRRPGPGTYLLLPGNGSGGCEGGPVKESCAQEGLALSGGAGLWVGRCLGRERRRSRPGGKWREASLSPSAGKLGVKRQTSLARSAPAA

SEQ ID NO: 992379 - protein, 52 aa, Homo sapiens
VLTGVTELPQDHLVAIGEDPLEDPGGRAALWGREDPSDLAIPCPTTAFVRGI

SEQ ID NO: 992380 - protein, 42 aa, Homo sapiens
LEGAEPPDDFERVHAEVYTHACAVGENGSQRRLLQEPINQDL

SEQ ID NO: 992381 - protein, 57 aa, Homo sapiens
YLAWATDEENDRQAEAEFNRIMSLVDPNHSGLVDLPSLQYDFIVAGRPPYTVPYLRR

SEQ ID NO: 992382 - protein, 87 aa, Homo sapiens
MGGERVDHLRQESDPPEHHGETRLYQKYKIKQAWWRMPVIPATLWRLRQENRLNLGGRGCGEPRTAPLHSSPVNKSENPSSKQKKHK

SEQ ID NO: 992383 - protein, 45 aa, Homo sapiens
NKHIAKDTDHKYEEVARKLVILERRAGALGVKGLERYGRRAEAMT

SEQ ID NO: 992384 - protein, 51 aa, Homo sapiens
ASGSAEGGTHIAEDSDRNYEEVARKLVILEWELERSEEMGCWWPESLSHDS

SEQ ID NO: 992385 - protein, 49 aa, Homo sapiens
LLVSRHTRCFGEVGGLVSDPCGKVSVQEASHIIRLSAFVHLVEWGYQIS

SEQ ID NO: 992386 - protein, 35 aa, Homo sapiens
MGFGQILGRSIRLGVIHHLRTTHGIRSMLRGTGAR

SEQ ID NO: 992387 - protein, 82 aa, Homo sapiens
DAYAPLHGGTAACGQAARGAGEGWTVRGRCSAPDRDPWTDTPKPKLMPLSIPFWDREWGPGYEKGQEKMDFFGLGAPRGGWT

SEQ ID NO: 992388 - protein, 56 aa, Homo sapiens
IEIACSFTRPRCQLNPLPSQKWEECTYCDAGRGECPLRSASSSGEWRTTGSTASLL

SEQ ID NO: 992389 - protein, 81 aa, Homo sapiens
MGSEEERMRREQIERRLQSESARRQPLVEKEVMMREKQFSQARPLTRYLPIRKEDFDLKTHIELIGRMVLDTCLHVELSSK

SEQ ID NO: 992390 - protein, 97 aa, Homo sapiens
MGAHTDMEGLVKRCQNFFGLLLGEDELLIFDYPVPLKGGSLLYSKAFSVGEFLGRIAGITGRRGAEAEEREASFGCLIGLSCLPRGFHLEPVRCPQT

SEQ ID NO: 992391 - protein, 60 aa, Homo sapiens
VTEKGPRGEERVKQKDLLDGEYGYEYYPMAPGTYIVTITCGVQNIARSPFEEKAGTECGN

SEQ ID NO: 992392 - protein, 57 aa, Homo sapiens
LASISLRAPCHYWLSCTVTSCTLDPENFRLLGQGAGLCAGPITYGEEFTPPVQAAYQ

SEQ ID NO: 992393 - protein, 108 aa, Homo sapiens
LAETDTEFPAAQSCSVDSAEAATSVICSYLELSAWEVRSTGWSSSSSSDVVGFGGESDGDGGHLEVDQPVILAHTLFRDHRFVHGRDVGILDHQLAHSLILSLHKLGP

SEQ ID NO: 992394 - protein, 86 aa, Homo sapiens
EYLSSVWNLFDFYGTGCALLELLALTLNMEPFYFMAVLRPLQLLRWIKMKERYRNVLHTMSELLPRMASLALTLLIFYYSFAIADM

SEQ ID NO: 992395 - protein, 85 aa, Homo sapiens
ADDPRFRPGGEDTWVGGGRLISGLDQVGEDTRVGGGWLISGLDQEVKILEEELADDPRVRPGGEDTGEGGWLMIPGLDEEVKILR

SEQ ID NO: 992396 - protein, 63 aa, Homo sapiens
VLAVQIGEGTGSPDQTQSRHSEGPGMPQTADTGSPDADRADTAKALGAPDADRADTVKAQGAQ

SEQ ID NO: 992397 - protein, 57 aa, Homo sapiens
KDSRHECAMLDVGDFTLTALNTMLRKGGRELGVYCKEQQEAALTRMAKDTITYMGLS

SEQ ID NO: 992398 - protein, 221 aa, Homo sapiens
YLGDSKDPLCYLFIIYPDTQLLYSQMSQASPQCLRKNRTHLLEGWMQPNKWDKDHIRCAMSCGHDLQQAAPGPGRAHQGHPNQDNRTVSQILSKRWYTLGANETQKYHDLAFQVKVAHLQQGPKEVQLRGQAHKPGASRSVTRARGSGEYQRRALPLPLGCPSELLSVAAQTLQSSDTKERLLWGRMAAHSQGTWLSLAQSFSHSGETTWTAGNRPSGLTD

SEQ ID NO: 992399 - protein, 42 aa, Homo sapiens
YQSGDVPVTGYPGSQSHPKHDRYPTPRGWQPLRDPPPNLPYF

SEQ ID NO: 992400 - protein, 39 aa, Homo sapiens
RQPCSLFSDASISSYELLQNYAYFTVSKLAISAILYETP

SEQ ID NO: 992401 - protein, 131 aa, Homo sapiens
HLQGEEINARKETAPNEVYLGLPHLPLLHQVHALLAEITFKTDPEHTDYTMEHGATRNFQAEKLLEEEAKRVQKEREDEELISPKRSERTREIASPHVKEDVIIFRGGRSQCELPKQGPLQNMITHTETCQ

SEQ ID NO: 992402 - protein, 58 aa, Homo sapiens
LIEEWVYSRGCRSRRRLPFLQGDYRQEHVNPFTIAPPNTARPERAGPAVDNQERLTGA

SEQ ID NO: 992403 - protein, 41 aa, Homo sapiens
LSDQNWASSRFYSNVDRQSCMMIDCRLTLKKTLSISRETSQ

SEQ ID NO: 992404 - protein, 42 aa, Homo sapiens
IEDTYYSVVKTQQDGWEGAPGTRKCSISISCWKDSFNFCRVQ

SEQ ID NO: 992405 - protein, 74 aa, Homo sapiens
CDIVFSQSTTGRFTMKTSEMLDTHERKKYQVPAWSKGDVTCFHRDKHGPGNRRKVFRAPFWVGRATHPFNLTRG

SEQ ID NO: 992406 - protein, 46 aa, Homo sapiens
TGAAWSGECFEGYESGFMMMKNGMDMEEGERNPLPWRGGPSVNSGG

SEQ ID NO: 992407 - protein, 79 aa, Homo sapiens
VITGSWEPYPAAPLGPGVTESSGTFITFLALEKGLLAPRPRVAVSSRGAWLSDGALRTCRPRRTLFSLVPLASFRPRVP

SEQ ID NO: 992408 - protein, 165 aa, Homo sapiens
FSGIMMLNVKWGFTLYLGIGLLVLSAEILGKRINGLGPAKLLKSQCSTRGPVASPESWETEAKSQPLCKSNMTLGGKDEGNAVVLGFYVNPEEWPRNSSSFSSLALGMYLATSSLLNGFDTPPYTYPFPYKVPGPLKAPYITWPIGIFTAKATNQVRSASQPPPS

SEQ ID NO: 992409 - protein, 56 aa, Homo sapiens
MTIHTGSRIYKAAPRKCLYGHIMWSSVHPLGHVKSRWGSVCRGSGQPSLTAGTDSR

SEQ ID NO: 992410 - protein, 72 aa, Homo sapiens
MVTQSPCLLCRGHSLLGAVATQKGLQTPGEGALKLLGAKDSRDPVTISPYPYTCEHGIGKSRHPDPRHIRLT

SEQ ID NO: 992411 - protein, 110 aa, Homo sapiens
AGEHPYAETRYCPVAFLAQSHFHIQPRPLPVWEAPCSPSLEIITGWCASNPESVGEEGGQQKEQSLASPPLPAQLGSRSFSERQPLLLLDAVTANPLALNSNSTCIRNLN

SEQ ID NO: 992412 - protein, 37 aa, Homo sapiens
IGRIPVAEREEVELVESQGWRLLRLQAWDDSRETPSQ

SEQ ID NO: 992413 - protein, 127 aa, Homo sapiens
CFWRVPHDPDSVCYRVGRISSEAVMQMLKKSRTGAMYKSDRGHDKSDRSHEKLDRGHDESDRGHDKSDRDRERGYDKVDGERERDRERDRDRGYDKADREEGKERRHHRREELAPYPKSKKVSRKDE

SEQ ID NO: 992414 - protein, 76 aa, Homo sapiens
VYYSHGTRLLDYSDYSTTRLLGLLDYSDYSTTDYSTTRLTWKVKKEYEVQHRRSMWLTKLGGADVRSIQLKLRHHI

SEQ ID NO: 992415 - protein, 77 aa, Homo sapiens
QLELAVIQKSTGHLIRTGTLPFVWVREMLRDFKSDLRFLSAGIGAKQEASEAYLVGLSEDTNLCAIQCQPCNNYAKR

SEQ ID NO: 992416 - protein, 82 aa, Homo sapiens
FERGLDRSRTCIQPRGHPVIQQLILTEHAHGPVSGLELTATDSAIPLMASVSPVRAGRERMPSGLEAGGPVAPVRGTAGRDV

SEQ ID NO: 992417 - protein, 127 aa, Homo sapiens
LTTRTAPHSVTHTSQTANNLAAHTRTHMHTQHTRKRTAHTNAQHTRTHSTHTAHSTQTHSTRTHIHTQHTNTQHTHKYTAHTSTHSTHTRTQHTRTQHTQHTHKHSTHITQHMHTLHTLKHSTRGRT

SEQ ID NO: 992418 - protein, 32 aa, Homo sapiens
LCEQVGLDPGGPGKIVLITIFCSPAEMLLLPE

SEQ ID NO: 992419 - protein, 93 aa, Homo sapiens
EHRITWVVVSVTADSTDGYVGEPLKREHPLMTPYQGVGPASMPLWDYQGSTMLTSQYVRLTPDRRARKRGLSLEPPAVLPQRPGKLTRPHSTV

SEQ ID NO: 992420 - protein, 44 aa, Homo sapiens
MRQCTGDLIQPNLDKVCALLQGLPADLDAPARPPTRSWAHRLRT

SEQ ID NO: 992421 - protein, 110 aa, Homo sapiens
AVSTETGEQQQERPNRTRMMCSSDPSGDQGHQDEDCTVGGPRLDDSHEVDVLQTGGLQAMEDKATGVRHSGWRRRTGSERWSRRWCRESGGSSPAQGAQAPTPAVPRSCP

SEQ ID NO: 992422 - protein, 79 aa, Homo sapiens
MGTEMLPGRVCLSICWVGVGLIQSTDLSRALEDRHPSLASRARVSWGSLHLQGVPSPDLAALAGLSPYPENRPVLPGPP

SEQ ID NO: 992423 - protein, 74 aa, Homo sapiens
HTRTQAYTNTEHYTATIQKHSTYMHTAHAHSALHINTAHSTHMHTEQHACKANMNTATHKHTEHTCTHRTRNIN

SEQ ID NO: 992424 - protein, 81 aa, Homo sapiens
RHQCLVCGSVGWTRPSRRSQFPFLADVLGQNTVGCYLLRVGRGLHLPPVMYSFLIYCNGFFGTHFSILGRDDNKCGLSTVM

SEQ ID NO: 992425 - protein, 97 aa, Homo sapiens
RSLGGDSHRCRGVYTRCREILLRKRRAPDRLDEQREMRSSSRLDFVCVSSMEEGVGIESEKQKAVWESCRNEYFWSFGDIGFFKLLVGVNGQLEGAA

SEQ ID NO: 992426 - protein, 76 aa, Homo sapiens
HAQYTRHHSHTAHTHSTQHTHKDTAHNTHNTAHTREHRTTTTTQNTKHTHKHSTHNAHSKSTHMHTNEQQHTSTHM

SEQ ID NO: 992427 - protein, 102 aa, Homo sapiens
RTRTPDIHEHQHTNAQHTHTHAHTAHWHTAHTPKTQHTHATHSTHSANTAHTNTAHTAHTQRQHTHAHSTCTHSTHINTAHSTQKHSTRTHMHTQHTGTQHT

SEQ ID NO: 992428 - protein, 47 aa, Homo sapiens
ELMLYPSTLECYAGGLLEPRSLARLWQHGKTDLYEKYTTLARCGGMH

SEQ ID NO: 992429 - protein, 70 aa, Homo sapiens
CAHVLRRLLQAFEGELAPVGGVGARWASWELELFDGVECFGGVRIRLFVEVLVWIRHTSQMHIHAMLRST

SEQ ID NO: 992430 - protein, 93 aa, Homo sapiens
GALRAIATRTLERFEPRMGEPTGFLLKENIRPFQLYEIIVTPLYHDSHSVSSQTCLCLTLMQVAPLLLPRQPASEATLARPWCSAGRACLQPP

SEQ ID NO: 992431 - protein, 84 aa, Homo sapiens
SNDAEGGTRESQCAATSMDNSIDLYRAVHKYVASVRLEQSNSSVGATFVDRWVLSSSKRSSLSACVLQVRVSVIAISTDPGANM

SEQ ID NO: 992432 - protein, 82 aa, Homo sapiens
RISVIECVSTQRGLETEDEFRKDAAADLVELAEQFQVECQGPCPFLLPLSPMSQSRPAYAGLDWGPESLCKTNTLATRLEMT

SEQ ID NO: 992433 - protein, 89 aa, Homo sapiens
MYVSPPRRDIQQVGLYRLQGFSMYSIFSLHICLARHQPGFDQIFIKIVPESSNGDMVLNPVPTHWAEEVGVEAKGLLDLPEDLADVPDP

SEQ ID NO: 992434 - protein, 76 aa, Homo sapiens
LTDPVSHLAYLCTSPSPPFSPHNDPSEGCGYKNKRDWGWTEERGDASNASLGAWKGSSALNRKIRQRGKVRGDGER

SEQ ID NO: 992435 - protein, 53 aa, Homo sapiens
MGDTDCSRRQYCVNHPGHPIYCVNHTVLCADGYILNATGSAWHINACVMDALP

SEQ ID NO: 992436 - protein, 133 aa, Homo sapiens
STAPLITAPKRPGPSTDAHDGVWWAGTDGSHLRLRGLGEPSCCTWPGVSLLLSTNVHHTSPIFWKVPVPCRPGSPTELRVLGLVLPISFQVSVIFAALNPQGPAPQGGFMVIDSVLSHMRFGGVRALHLLLPV

SEQ ID NO: 992437 - protein, 56 aa, Homo sapiens
MGTFARTAFMIVTDIQYLLYGPISTFVQASDGTCQGVSVTAWALGSGSTYVQNLYQ

SEQ ID NO: 992438 - protein, 89 aa, Homo sapiens
QTPHKRKDSLPLGPEGGDSHTLSEVSYTKLLGEHTPERNRTGSSHDSIEQQGDAEQTLDWITVALPTMLEGVGIESEKHKEVWESCRND

SEQ ID NO: 992439 - protein, 141 aa, Homo sapiens
PRGLPLRAVMPGPFLGEKDHAPGFWLLSQHCRLLNKMVGLGILLVSIVFLTVVILLLPFSTHFGSQHLREVNGLRADELVIRVCIIGAHLVDIVCVIVLFLIVHTVVRQALAWLPWHLLHQQAILFAAAAAGSELHFVIPV

SEQ ID NO: 992440 - protein, 40 aa, Homo sapiens
RAPCEQETQDYSSHHQRWCMLQGSSPLSVLRDLGNVTETL

SEQ ID NO: 992441 - protein, 99 aa, Homo sapiens
MVGRMPKLSTRRTIPTDVIKCRAASKRGVHTFRETDTRKGIFFFLLVEGNGSSKDSSGICSRDGHGRISGGRALTGCMWGAVLSVAEQIPLTHHSCLAL

SEQ ID NO: 992442 - protein, 123 aa, Homo sapiens
MSRINGTEHLCTVMFRGRTYTARCQICKVDVGLGVALIEAGVRVLLLLLRGDAWYRILVVILKPSKQHIHVLGRHLEPEYRKSTLEITCYTILSMELAPRAGIPERNIARADSFARHKLKIKG

SEQ ID NO: 992443 - protein, 75 aa, Homo sapiens
VCFSYYPIHKSLKAVPRSSGKGNCGFKENGRFSHGQVVSRDKLAPFQDPDLSSLAGRVLRCLAKHQDGLGHAAGI

SEQ ID NO: 992444 - protein, 123 aa, Homo sapiens
CSRALLCLLVAHDMALESAFVCASEMSLRVAQEEYRDWRRLFYWLLLMLTLTRFSSSILLTDSRSELCTIVYMPGRTPAILGFRDIVMVLDLLLQCGSVLWLWLWPALGLRLRLYSYAVGGRR

SEQ ID NO: 992445 - protein, 74 aa, Homo sapiens
EKQTKEITLVRHDRDQSQNTKNYLHTARERRTNIRKVARQHSRARVHLTLAARGQRTRNLDTPYIEKVRTARTE

SEQ ID NO: 992446 - protein, 72 aa, Homo sapiens
MVEKINKPDSVANHPDLTPIGSRWVLEQDPVVRTHNLIQQLMGFRNGRADVLRIWAEEGLLGCEPQAWRGPR

SEQ ID NO: 992447 - protein, 72 aa, Homo sapiens
CGSKGLDQGSGELDLGGSRDPRGSASQVAGTIGTHHHTGLTFGSREKTGSHLVARGGSENLVDSSSPPAWTS

SEQ ID NO: 992448 - protein, 38 aa, Homo sapiens
VPIILSVSMFPPRGYTSSHGVSTQSLFSPAETLDQLET

SEQ ID NO: 992449 - protein, 82 aa, Homo sapiens
EAIQRDHLPMGEPAVLLKAALSLQAGSACLAKLAGWPLATQTRITGCGQRATTQAQFDSGVLLRGGPAAGRSSEESDRCEAM

SEQ ID NO: 992450 - protein, 126 aa, Homo sapiens
MAIPLLAGAVIYRLPLLDSECPNPRSYHYAPGTRYDRSTSRVPTRTLWRTRAVHLHRLLGREATVIEMYGPAHTSPYAKKRDLRRAWTMASINAHVPPGTREKECQKMDGPLCDQGVPLPARRHLN

SEQ ID NO: 992451 - protein, 57 aa, Homo sapiens
MRLPDIRCLLSLSFYSNVYRLAYYKLLKSEDEWSGGERDKGLHYGKWGSPWVLVWKR

SEQ ID NO: 992452 - protein, 71 aa, Homo sapiens
ASPDRSWKTAAAVTGQILQQTYSKFDINSHNHDALLNELRAVLLLHEGHGQGLDIPYASCRCRSVEGSCGF

SEQ ID NO: 992453 - protein, 92 aa, Homo sapiens
MWLRFSTYSTRRGCRRQIGRCLLNLAAHFAPTESLLENTLFTGPWVLAEGLFSGAGYTVSKGGAPACGSMCTASVVELRGRGQTWGAQRVSM

SEQ ID NO: 992454 - protein, 40 aa, Homo sapiens
EAEAILLNVKSLRESTDSPRSFHLDVQGEVGLVMFFTTGS

SEQ ID NO: 992455 - protein, 30 aa, Homo sapiens
MPSCPGETPQNSRGKCPTNLRSDASGSLTR

SEQ ID NO: 992456 - protein, 129 aa, Homo sapiens
LHHASRSGNGGSSSLERGVGCAPRKDSLLKPGLSGCCGEGPPPMSTQCHAQRARAKSMCLPKQWAAAGAVEPPAPCPMPSQRAPFPIDWTKRPAHCSTGHVGVHFRGPKQLPSSCSILSAVALDPSSPD

SEQ ID NO: 992457 - protein, 92 aa, Homo sapiens
AREQILRWFGLKASQCLAPGLQAWVFGCQSLSPSTCDFRHCPVHTASPSSLCSGFKGSPGGWEPSQTQRSQAVSVVWPWASTEEAERSRGLL

SEQ ID NO: 992458 - protein, 47 aa, Homo sapiens
MEQHSRVLLAQRERTTAQVSGGPYYTTYKDLGQPTAVHDTLGSDKRH

SEQ ID NO: 992459 - protein, 64 aa, Homo sapiens
MYDITRKDSFLTAPRRGWRTLRRRSCTQENVLVTAGGPQDGPQTRNGRCTSSDDDRVTQLQTSG

SEQ ID NO: 992460 - protein, 144 aa, Homo sapiens
MDFDFIYCRDLDKIYAIAMRNGLRVLIFRLASFSVTTLLSATPALLSKSYSPAQNLTHLPSPHPQTQPMTPLPLSPWIFSLLDSIMILHQSIMILHRMSLLRLYPSPPLSPTNPLLTLSPLCLLPSPALGPNVLSNQLPCFLSG

SEQ ID NO: 992461 - protein, 125 aa, Homo sapiens
MSTASTDLYYSDHPSPTCLQLLCLATELQRVLERYSYTRTPQGFSPQEPLALTWIKFIVEHVMGEASATHAEGPEAKRSMRDLLALLAVIIRAPKSNKNWLYFYEVDYHSRRLTHIRDSRPSYFH

SEQ ID NO: 992462 - protein, 101 aa, Homo sapiens
RGQTRIRLLSGNGLCTGSCQVLSAASSGPRSLLQVRGTPSNPSPAPLSATSTGLRSPLQARGMPSDPSPGAACSCVCLSPAPTSASFRLSISSVASWASSL

SEQ ID NO: 992463 - protein, 40 aa, Homo sapiens
LGSTINFHVVSSGSPEGSRSVPDSVERGKETDPASCRRPH

SEQ ID NO: 992464 - protein, 78 aa, Homo sapiens
DRRIADISAVLPVDSSSNRSRSSSISSSGSSTSTGSCYQHSTDWEPPPLHAVTWSAQTMSCVPDLCVGRPCRVCQQGT

SEQ ID NO: 992465 - protein, 39 aa, Homo sapiens
GGTCSTGQGVLGIKVTDHAALCDPTGRIGPKKPSDLDHV

SEQ ID NO: 992466 - protein, 72 aa, Homo sapiens
DRRTEHTSASYRERRPLCDQDALAPTSYRQIVANAGHGQASQSRRRLVPPLSRHEEVDLVVVEGSRSPWIQK

SEQ ID NO: 992467 - protein, 97 aa, Homo sapiens
AAYRNRYGAQRRAETRQVSSWVARAHQTAEGQDARYGGRYTQDMTWSGVTAEHEEARPAFLNTLGWWGCGKKRVCNFTSSTESAHYGLPSGLPEPTT

SEQ ID NO: 992468 - protein, 44 aa, Homo sapiens
MHGHSVIQQLILSEHAQRAVVMACGTGPAVAHSPCMALCDPQGR

SEQ ID NO: 992469 - protein, 88 aa, Homo sapiens
QHSQSNMRTLNEPGAQEDEVEDDPKVTAGGQGAVETKFHKLGTGDGHHQSPGRRMFPPVQVCESAGLGQARPSNILARCDICSQLDDL

SEQ ID NO: 992470 - protein, 52 aa, Homo sapiens
VLQDTVFLHPHPASADSGQSSFTTELSTQTVNYGTVGETGHPITSSPVQGMG

SEQ ID NO: 992471 - protein, 39 aa, Homo sapiens
GNCFAEGIPELPAVVPREPRRLSAPLTGGCVAGDAAVLW

SEQ ID NO: 992472 - protein, 46 aa, Homo sapiens
DTESRRRGQSLQLGVGRSPPASRKAKDARSGRTVDKQDIDIGPGSD

SEQ ID NO: 992473 - protein, 59 aa, Homo sapiens
SYIGASEFGLETRPGLQLGSEDVAQPASRRPRRQVPVGRDKQDMTWSGSDERGLEVGAV

SEQ ID NO: 992474 - protein, 34 aa, Homo sapiens
SVHTYACAASLQQQDQELAGLKQQAKENAGPASG

SEQ ID NO: 992475 - protein, 40 aa, Homo sapiens
MTTYSVDYDSEEQLAVSVRVSMEKQNEYGETDRNIDSRHN

SEQ ID NO: 992476 - protein, 76 aa, Homo sapiens
MTFLEDTFGGDHDVCNGHSLSPHHRTQPAHRSPWVACASSSGSQFRILADIVLAYVGHARAQAVTLLLDMYHQGLD

SEQ ID NO: 992477 - protein, 129 aa, Homo sapiens
MTEEIQQYQNQPYCLRIEPDMRRFFENLNPMGSASEKEFTDYLFNKSLEIEPRNCKQPPRFPRKSTFSLKSPGIRPNTGRHGSTSGTLRGHPTPLEREPCKISFSRIAETELESTVSAPTSPNTPSTPP

SEQ ID NO: 992478 - protein, 41 aa, Homo sapiens
PGERTLFLSSSSCCLRTSSKSNVVRLSRAEKLPTSVVTMMQ

SEQ ID NO: 992479 - protein, 34 aa, Homo sapiens
MHTRLAKHTFSSSGFPSEHASSGKVSLESRRRLR

SEQ ID NO: 992480 - protein, 54 aa, Homo sapiens
LHMVRFVSTCCRLIEDLPSPGAASSSLCKVKEEKERHPNADVGEWHQSPILGPH

SEQ ID NO: 992481 - protein, 35 aa, Homo sapiens
ASKQLRREKLLCFPEAAMCFLAEQTKTKILMDSPE

SEQ ID NO: 992482 - protein, 60 aa, Homo sapiens
TYKGFPMKFTLSCPPPAYRASGTEWVLLLVIPWEKMELEVLVEFRGTVQSETSTVIDLEL

SEQ ID NO: 992483 - protein, 33 aa, Homo sapiens
VGTRWAWTRRTHSTDLRCLSTDAYLGDSFYDVD

SEQ ID NO: 992484 - protein, 37 aa, Homo sapiens
DAARAEERAAPSELKCGDLAAELKNVTNNLKSLEAAS

SEQ ID NO: 992485 - protein, 103 aa, Homo sapiens
MSKRTTIFQVDPNNLTNGTKFTLGKQLNPILESISTIGFKTRCRMQDIPMVQALLEVRVSTIKVLRDLSSDRSNRGRDAIYFKFLPVRKDRRNKAYFTKRLPP

SEQ ID NO: 992486 - protein, 107 aa, Homo sapiens
MLVRVNRLHYSCYNVLLHIITALKKLQLVMFDVTSSTDGTHPVIRFKTKRNKGTCTVKTIGGHTVYNAKEINENANNSPVVDPQTLLHMGKLSRDHIRLTKPIYIVG

SEQ ID NO: 992487 - protein, 57 aa, Homo sapiens
ALWPAVSHGGNVLCWEKNQTKPSPKRESGEEILHGECGTSCVEKAQLHCIFLPVRLC

SEQ ID NO: 992488 - protein, 98 aa, Homo sapiens
SSPCEITCPVRLSDLVDLHLLCVGQRVVQGLRLQAVAAGARWQEVGCSSSALKGSEEDELGVLREKLSGKAPSAKTISSDVFLQPPSPTRTTLTDRTP

SEQ ID NO: 992489 - protein, 204 aa, Homo sapiens
MFKRFSRLRLLSSNYSKSCGQKARAAWDSCRHSEHQTTVEDFKRAFTSPAAAAPCKYIWGLQYLEHVNSIKMEASEEAVNTGAHMENQVHQRIADPEESRSVVPRGVCCKLQEAHDPSPLELSAWRTCRGWHELCQERCKVGSVKNMVRAECPAVQDEDRATEAWARSQEPNKLRQDVTVYKRIERLDIELPVKISCGSSAPWK

SEQ ID NO: 992490 - protein, 120 aa, Homo sapiens
MSILGRLYRSKYCEIDIVLNDGETRKMAEMKTEDGQVEKHYLFYDGESVSGKVNLAFKQPGKRLEHQGIRIEYVGQIELFNDKSNTHELVNLVKELALPGELTQSRSYDFEFMQVEKPYE

SEQ ID NO: 992491 - protein, 199 aa, Homo sapiens
MRKKEVPKHLSQGYPRCHRLSCMGAYPRDQRECRRPFGQLQNGKGLDPLGSKTGGVMDPVTKPLEEEFPHLAVSPPKLYPFFPLVNATSHRLLTSSNARLGRYVTSSINFLPVPCGFYGVPYYRPDITYVSTENLFVMASLPRLSRAASCVSDEAGIPIPPPGPHVHKARWRYKRKGDTTQVGCEINLYIKGAEKRAQA

SEQ ID NO: 992492 - protein, 339 aa, Homo sapiens
KNFDALKDDYSGDHDQNDYNSEHKKEMVRMTNNVERDKNHSIMKSKGCCPCIRQKHPLQYNYTFWSLQVATPGLYPLDSQSYKQNIKHDWHLCALWSRFVGVFYIHTGTSCVTLQARVTSISSKKELKPCGTMMQGYQWWQSGLFGCRMGLALPLLGRNLTFAPWLGDPSSWSGRRSVGLLCVCPPFLRTLNFPTGLLTASDQCNPPADIRDRFGECLIYSQWHIGIQKVPTDCINGQFKLSKYKNYLVESSQAGNILFCMCVVGDMVGASSQYSFLTGRTPDQGLFAIYRENDSLKPSECTLREKRSDLLDTVYKGTRGHPDEADKHGSATEKRINGT

SEQ ID NO: 992493 - protein, 55 aa, Homo sapiens
SELQTEIADKCSGETPRQRIGHRYIEIFRSSRSEIKGYYDPPRKTRWDSDTGPLL

SEQ ID NO: 992494 - protein, 186 aa, Homo sapiens
LRSCCWRGLEAAGVLSDAPRGPSRSGHADKGLLVKRPGRQGNSGPVNCENSAKVKGAQVGTGKVRGKGLNSAVLRVLGPVAPEEVALEAGLEAFARYCRPTVCQARSGALGHTKVTEQRQRTWSYVDYGPSWAREASKGISKPDVYIANVHLKAYEFKTYGYSDGDLGQVTPTLRKRHFSRELKDV

SEQ ID NO: 992495 - protein, 32 aa, Homo sapiens
MSESVLLALGSVRGGAAGLYLGVRSGCRLPWA

SEQ ID NO: 992496 - protein, 584 aa, Homo sapiens
MRDELREFPVISVDGGTAKLSSEINCAQVVGGTIQPCRPMSARDEWLRPRVAEEQRWFHCSDLEVVDQYTDRRHADEVNRLSQVQTGGYPTGAGQIVGSNNQDLIDDDASTLRDDLEVIHVGSTLLDERAYEGKHERAKRYTSDVEFKEVAPVTVCPVLCRGKSPGLEQCVAQGLWLFASTRDEKRYQACAPTNMTGVGQPSHMDAPFHKSQFEALVHHRINQVCETTRRTAGSDFNTSIHTREHFWPMAGCERHTHLWNVIHHSYSHATSQIHLWSNQTTQSRSTHHISARWNSTERGTQQEDTGGANPRGRELPTRETQPPTSRPQYETQRGERQQESPDINDEEDRKTTKQNRSEAQQMDGNDKQAELVHRELTNPAEHTIVNTQAGRPEGKSQSEEKATSRTGHQRGGDSMERQQYIRKKRRSDRNQEENQRRTPNQETAHTPITERQRSRNEGRHPSVKQNSSRCANTGETAERKCETTNKTEHRGGTAATSDARPRHNEAAGRRGTHGPKRRTTRVRGAKTQRNRPPEAQTMTMSRTTQEAPERREEREERTRTQRQTNRARQSGWWSDQETPGATSE

SEQ ID NO: 992497 - protein, 216 aa, Homo sapiens
MKERLLYDLFSRSKNMETLTLSHGQDTDWLTDYHLDLGIIMRAYPLDDDETWTEDESRNTSNSIRRLHQQTRTKSHGGTTQHKQERSTEITQPTAQSKGSTRTATASRRRTKQTPKTNAPRNTDGDTPEDTTRADKQKKARARDNRTKTEHNHQKEEKEAEQKQGETKDTHGPQNSRHRRHKGRKHKTTRRTAEHKTDQLLTSERHRERSSVDTAQ

SEQ ID NO: 992498 - protein, 96 aa, Homo sapiens
VGVLDVTQDSSFNENKAFIRGCALTRVDTDQQRRDQALQGSEQAGESQGESVTAHGARELGQKTPEGAAPGMRALDCTPRQRGAPEGLWACAHDRI

SEQ ID NO: 992499 - protein, 45 aa, Homo sapiens
GVTERRVVTENEESLKYKESQTICHCEWQKLSKSLSILNIESAIY

SEQ ID NO: 992500 - protein, 197 aa, Homo sapiens
MCAWGHSITQEAHYGHEGLLRATEACMLHIEPKTRTHGQLHNEANGAKHRVAGRHTTHKQERLKSARKADTQRRKTMEITSQDRNGQMRSRHPSRKARRRGQTAKRQRRPVAPKTHPGRVEDKHGTPAETSTRETGGSSRREVGDQEGKRDRSQRASSDRSNKRSQPDGQETDNDDRQRTDAEIQESDCTTRRKHER

SEQ ID NO: 992501 - protein, 57 aa, Homo sapiens
GRDPVTLISYLKLPKPYITINNFNARENRDVLNFTCEPQSETYTYMGWLHGQSLPVS

SEQ ID NO: 992502 - protein, 301 aa, Homo sapiens
MVLKKFSTSLADRDSYATAAPVVRDKPGRDALSATPRVTRPCLMEHKRTQRLSARTDRGPPSFLRSTLQGRMTQSPAITYQPYSEQTLQRRTQGPRYHCPAQTVLRRHAQLTWGAHATPEPHRHNPTAAHQKPPPKSPINSAASTDTPSSPLVDTVSPNAYESHNASKAEVQAKQATAAIPASQQGLLTHCKRWDTIGPIPQTPALAAPNQPPTGITPHNKAELSGQHNTPTAPQRAPVCLRLPSCHLGSPPFPCPPGAPSLGLVLPSKPLAVFGAPVVAPTRPCTRVRVPVPAPLPCAPP

SEQ ID NO: 992503 - protein, 34 aa, Homo sapiens
QGVRILLLLANSLLLFEPTNFIHNNGSTFTTQVI

SEQ ID NO: 992504 - protein, 472 aa, Homo sapiens
TQADPVHYLFLHRQAQRLLYSSVERGFIYRPQCHLCTSGFRLKISFVNFARGTTTTRSFDSDIDDPMPRGTPRYTLQPRIRTQRERRSGANLLSDSRSHAYPNTLNHQQHPTASHNDGALNPNAYRMHTHACTSALHRTPSTALALTSGPRPLHTGTDTRHRIPSAPKHIAQPETTPSRTAPRTRSKANTPTATLNPRPPTRCNRRHGQRLLRHQPNPRTSPNRPLLAPAHPIPSITLHADCNKAEPRRHCTNRNTLRTHQPSHNNAPNELAPETRPRQQLTPATVKRPLADQRFITNGRPHAHPTTGPPQTKAPMHLPLPLPGPHHTGPARTTQQPNVQNPPPEPLSPTHAASLPHPNRPPYPLPNPTVPPHHQPLSPPPPCPTPLPSPPSPTTPLNHLLPPPSPPPPSSPPSSPSTPPSPPSTSPHTLIISSLLPLPTPPLPLSPSALFSSTTPPHHSPPPSTHPLRFHS

SEQ ID NO: 992505 - protein, 33 aa, Homo sapiens
RHTTGVRLPAGRMNLCLGERDGTGVMLADQRNP

SEQ ID NO: 992506 - protein, 78 aa, Homo sapiens
DLEMHRCALSSVARCLGGLSVTVVRRRHCVASPRVHLVVGLPQSGAPCSRLRLGPPQRLVAAPSSPSADGRAFGAGQS

SEQ ID NO: 992507 - protein, 199 aa, Homo sapiens
MQQLLSQPQHEREKEVVLLRRSMGRRGAQPWAASDVLCRSLANRDPSAAEDADLHNRPHVSDIWPSVWMNDRHAQRELCGERSPDQIENTQMGTPSVQEMSIETSCRKKHRPVNNQKVTHVKDLNAKVAAHKKPAGDEYVRGLHAQAQGGCKIPQETRADEEEEISRVNKTSGTENDEMTCARSESRKLARSRKARECL

SEQ ID NO: 992508 - protein, 60 aa, Homo sapiens
MEFDDPACANTGDNPFSTKTKHNTYATDWWQVPLTPSYSRRLNDRRHFARGTRRSEFYIN

SEQ ID NO: 992509 - protein, 130 aa, Homo sapiens
MKYGTITIVHPKAWELYKHSRYKALEPQPDASYRCIYSANETVPWMLYVLTEYPDSQGEQYWEVTMVLKNYTVSSPMGCSKVGAHKSRWPTKHVTQQGVTGNKTRKRRGKPRKMPRLTKGAEKSYIKNEP

SEQ ID NO: 992510 - protein, 61 aa, Homo sapiens
MWSLEKKPVRKGIPVMLGANGEGGMKVIESRAQKDEEKMEIQEIQLKMIETSYTLPQMKSG

SEQ ID NO: 992511 - protein, 103 aa, Homo sapiens
FCLSVELSAMRVSQLCSYTVYKIYPGHVEALRQDRREGFQLSISAKCESAFLFQEESSDDKLDCPLQKEAAKRDSRKTHSQRKEPAEQSNSMSGHYWCISCVI

SEQ ID NO: 992512 - protein, 92 aa, Homo sapiens
DCDFIPTNALYHGLRDDKIEHLWDTCLGGFVLEVGLSLDVEVEFQPGEGILSRRNQVRRRRRYRTGRRFRGSSVKYVERFGVAGTSGRRTAL

SEQ ID NO: 992513 - protein, 73 aa, Homo sapiens
MTKKDTRNYKSQIQNHRTRPYHRDIRQDNNTNKTDRLNKKQERHDNQSHVPANRDDKDNRANHHTQNDTNDTR

SEQ ID NO: 992514 - protein, 157 aa, Homo sapiens
PTPSCALGSVGQWLGLPATAVAPRASRCLRRAPRDVAGAAARCDLGRSEECALGGDVSGNAGPVLRAALPGPVAASVVGHVACGLLNYPAASCKTSTPAWPCLRCLVLLTCLETCACTVCLQGDPVTCTVALVSPEIFSGIACPDVEKLHHLQALGD

SEQ ID NO: 992515 - protein, 107 aa, Homo sapiens
FSSVTIRTTVQADSYLSEVSLTSQLRSGSKCSLTICAEEVIKLEHLQQAGSRAQRSSILSPQELCRGGIVDLLLVSSTTHPHCVCSLTQPNCSCTSLRKRLQEEEDI

SEQ ID NO: 992516 - protein, 248 aa, Homo sapiens
RERVGRPTRLPVRPGRPQGGSGMAAAVLTQQRRREMVELQRRGSTVSWSLSDKHDWSYSSSTSKLAVRVAVRLGAICADWNQLGAKLIPPVLRGHGTSCSLEIANLEGTTRRSLKIPVLDAYLWGEEYSAGQFYAKGSVQPIHKGTLPVKGTNCQCCYAYGNPNGCWERTAPQIAWACPRATWGDPPRALMDPPCKLTRRGRVPEGRHGPFSVTMSYLEIYQEKGIRPPGALLPEDWYIRKIAGEYPD

SEQ ID NO: 992517 - protein, 119 aa, Homo sapiens
GAGTRVSASGLPCSTLRSLPCAAALSLGLRCAPGGAAMACRRKPAEDQSRCDGDASPAVPRAMDAWEEAQSRRKALEARRRRGGKSNRGARRDKTRELYHSLKGPKTPYQNALTRARCS

SEQ ID NO: 992518 - protein, 108 aa, Homo sapiens
LYRSADVVERIVHLDVHLNCTSNVKSNGKIHIDSKLHVTLYNCSFGRRDCSLCLFLLTPLQVCVVLWCQSRCSSNEALCNTTSECPADRHQQDLGLCRILASMPSTEL

SEQ ID NO: 992519 - protein, 35 aa, Homo sapiens
CSTKKAGSMMMMMMEGTAAIPQSGPQDLGLDAGTR

SEQ ID NO: 992520 - protein, 110 aa, Homo sapiens
MAKDTKEEYASKNEPHTMRRHSTTRQADRYAQQDGSEGERELRHRVAVPGSSARQAREDGARQRRSPPTPHSAHSARPDAQRPRSSENRGERVKRANIREAPVVSTQRRS

SEQ ID NO: 992521 - protein, 86 aa, Homo sapiens
HASERVKRLMLKIRVIDHYMSVQATSNDITSHLEINLGDLAAQDVAAGEDEVDVGVVGAQSVAEDRQVKCFCSMMWMIHEAFPALA

SEQ ID NO: 992522 - protein, 404 aa, Homo sapiens
MAVRKKDGGPIVKLLRWSVGHRRPTFDNVRLWLGKVTTRSILQAEPHHQSSPCLACVVHVATTFRKKFIGKHVSECSRSLILPIQTVSHSISNAGSASLMPTFYAAAYETSTSDQGMAGVYDSPESITHGPAIVAKCIMTIEDVLWVQNTLPDLDPYPVCVCSPEDLRPETYLEEQLQVTVIDETPGNSQLRHKNTASHVDSILVPGATLDSTEEMSTQQVSELRDLSRVPLQLGTYESLTDNDHAVITNKCIFEATSGVEPRLPNSMTTPQDTGLHAHVCDPATTEPLHSAMRLNCEQKNDRHSHDHKHRPPAERNILPHLLLSHFRLPNHKLTDNSTQLSQILRHAPHTNTHQYTKKRIRHNIHLSSSSTTQTKNQQAPHTRPSHSHHTPNTTPPTSTKIDN

SEQ ID NO: 992523 - protein, 210 aa, Homo sapiens
MATNFLAHEKIWFDKFRYDDSRRGDSSEQMNRAVWQVPPVAELRPRGPPDGHQLETTVSSLVRDCQSGSVRNQSLRGVVQELQLAISKSGGPAETCWMKSSPGHRATGPTDPSTYLPLRQVGGPQSKKPVTPAEDDDGMMTLTLYGSDNEEEDTGGGYKLREERHTVQYAGAMKASEACTGGQVLHPAGCQALGCMRRHMAQLEACVRSI

SEQ ID NO: 992524 - protein, 392 aa, Homo sapiens
DRERRPFLFFFLLKNYSVKVVSHSFSATGCEQGCGKTQCGRLTPVSVVGKLRGMCQSFTQATSLVLPGFRHSLAFHRGTLDIYSRLYYVVIYFYFITFMGALGTKEKRENKKQKKKKKQHTKRERETANRPRTTARQHTARHPRTTHTRRDDRANKNSTTGTQSAKSATTEQDRRTQATQKPQTEHTSSPTTIRRELSNKKETHNEAKGKTEQQRNSAQGGEPPVEKAPAQPRNKEDPHRQHTDKGAKRDATTAGTEGPAEERAGPRRSDTKKTDKQGKKEQKRNHTHRSREPKHNDGARHHAHTAQRKNNTEKTNRAQDKENRRKHAERRTRETAGRRGETRTEDNRTTRKREGEHKARSNRKRSSKGGKGGSTNAENDRDQHRHETGSDK

SEQ ID NO: 992525 - protein, 321 aa, Homo sapiens
DPRVRQMLMNVMGTTGANTVCQNILGGYRCGCPQGYVQHLTSGISVSYENRDAPIPMPVARLCRSCYNHPAGRSQVRPAPRGSPSTQFSMCLHDVVTECSSSKEPLQLSAALTRTGGYPLWLPPWVFHEWDKATVSQRMGFQQGAVPVTVMTRRSMSENALSPEACYDVQNHTAILRKTAGRRQVFMNLIPLLLNSISLESVDDGQPRQHEVQPSPQLRVLKGGSIPGTYGARASKAPFREAHPFRLMVISSRVTDDTAVFRSSTTGMGSANLHTGPKEVMPDYTCDRESSLRKIASTRQKPGGHTRQGEAKERSVKPTGR

SEQ ID NO: 992526 - protein, 68 aa, Homo sapiens
IQMGAVVGSSNKATESIQVFPITGNQHVQISRPSPWVASVLSVRARAAFLFWAVSGWLLMRVTSLVVS

SEQ ID NO: 992527 - protein, 220 aa, Homo sapiens
MQVIFKRRGKLGIKSKWAGASGVEQRKYTVPRHLTWGISNRNNSRNKPFKGLEHKTQLDCGSARIATLFPVSSIFSGPCKLMEELWNWRRIVLDEGGNRSKWLGGRLKNQEQRSIERRKEFQNVNLSGVTRKKAKYHCTFIWHANWCRKQSRTTPDGPDQTRDTRRIDANTVPQLSEPGPGHHTPDTTRDSTAEQTAQNGSTKEPRVTGTTEREHPHTRE

SEQ ID NO: 992528 - protein, 108 aa, Homo sapiens
MRGASIGDAGIVFHLSEVKDRCHWSPNNLVPWVNQVYAQRRRVSIVGQEMTTFEYRSWNPYRSKASSEKSWVEWTRSTSKPGSKVLYLWGVLRDTRSPMSLTSLVRMV

SEQ ID NO: 992529 - protein, 143 aa, Homo sapiens
YRETVSEESNVLCLLQGPPIKAQSAVHEGGGPSPTAMAEDVDKGEVSAPSGAQASGRATGREVRGGTWLRPARSGAWARRLRPQHPHRHHQGCAVTQSADQGQCGGRLPVGPPRRAHCVEDEACVGVRFDVHEVSLYAEAIHR

SEQ ID NO: 992530 - protein, 228 aa, Homo sapiens
MGEYSTNVRKKGSPVTTTATSKSNMEESSKKMPDGHKQQLNKQNETHMTIQATENTDSNTDNALPDKHHNQRRQVQSTTHIRKTTHNSLTTTNENLPRSVEEPNRNTHTTTDTRQQQAPDNKPWNESKEPHRKKPEMTNTKTDPGHKQNPERKRRHKTSKGAQTQGKTDPGTQNKTHTTTTKGKEENHKNLDHQKRKKTKNTNQTKTKRNETEEKRNETHPKQKKRAS

SEQ ID NO: 992531 - protein, 188 aa, Homo sapiens
MPDDELLSSSTANVCSYAPEVSDEAMSPLGGRNKSRCSGLKSCNIHRRKVLHGSPPWSRWVVPGTHLRRKETSRKAHPRTIRRRAKSPRSVASFVVVAYNLAPLEVSQWVQCVPLVGRHIEDRTTQFRVAWLACGELPVGLRSGAKTARDPVGPSRGRPILHSAGLVRETHALQEQQYRTVGTQGAPS

SEQ ID NO: 992532 - protein, 119 aa, Homo sapiens
MSSPAFLRSHHLVVRQADSSQQGSPGTAVWILSLNLLFRQLTDLETFGIKGTHLKCAAVLPGRIPGLICPKPINPRGNPSGRQGSWCPTGLREGKTLRDDYGKSTRGKVGGLLKHGRVY

SEQ ID NO: 992533 - protein, 224 aa, Homo sapiens
HPTLNQWWKNGLRDNIHFSLLSIQGRQEDASKEKTEPSKDRKRLENKHNTTTKAPQQQRNEQREPGAPGDNNEKEKTAEENKKGHKDKTKKSADRKKRRQNTQDSKKDQNKRRKRRTTKGTDKADRAQKTEKTTKKKMNKNKRKQTNKTRRNRDKNTKNRETTEEKKTEQERQHQKQEERRKRQSKKTKDNKNENTEREERNRTENGDKQTKKQREEREKRDKS

SEQ ID NO: 992534 - protein, 96 aa, Homo sapiens
QTRERGEMPVAVGSLRTVLQRKLRSTVIKSGLSVNGLRRWSHWRDRGASSVTFSCLRYRNAGSRADGRRLGRTSGCSSGRHRLASFYGPLGMGIRC

SEQ ID NO: 992535 - protein, 42 aa, Homo sapiens
MGVWKRQNEMKNEREQLDSLITALHAITERQARRGHNENART

SEQ ID NO: 992536 - protein, 117 aa, Homo sapiens
RPFPRPTITTAVWPNTPSSTCALTTTLHSTPAAAGLPWAEWGAVFALASVPELHPAQPASIATNGATLDKAKMALSRSLHRVCVPNCLLSGGDSRSLGLRSVVGCPSRALFDWYAPL

SEQ ID NO: 992537 - protein, 61 aa, Homo sapiens
MVVQFNQTVKQQTLQNNTDMSKIGQQPKPEHMPTTTAIINADTQQYSITATTSETGQLSRY

SEQ ID NO: 992538 - protein, 263 aa, Homo sapiens
ADFDTYDDRAVQQLRAPVGECPAAAAGCGHGSRTQEGVVPQSSPYTVYRSEIYLFNTVQGDIDAIFKDLSITSVRLVRDNRHQMNFKDSAMSTFDEVDSLTEALTYDGALLGASGSSSCGHCCKAENQMKVCFRHFRNEVVSDVVHHDAASGSDFFTGAGEVVAQATGVTGPPMGSVRFQRWPSPPWIQHGFQRTHRRGKSTRDLRLQLRPRTVATPLNQVANPNSAIFGGARPREESRSKGAEVSLRWEEWGVGVDAGHRLV

SEQ ID NO: 992539 - protein, 203 aa, Homo sapiens
FFFSEEHNFMKTHSYKTKLKHLYVVMIKTSNNEHFYRGMALLKVIGTSQKVMARSHLVSKTVHVKISGYSFKREQRTRQRAPKRKKNQYIFRSEQAFNIISRLSSIHICEKKENHQDPHQQATEKAGDATRAESTEDDTQPHKRKKETTNNRRRDGAGKTKKTGKSNKARTRAEQKNKRQRITTQHADRKVRAQNNVCAQNRL

SEQ ID NO: 992540 - protein, 164 aa, Homo sapiens
ARCTRGKASWSQSRSRNCGPSRKSGARRRRPRGQGSLQSSTRGSCRKEGFSSRCAWALPPLLKCLRDVAKSASRVRRQLPVARQQCPGASSGSCAKPPLISFFFFYLKDSGVRARVPRVRVAFGRRSQLTGSLDLLSSSELPGSASVSFRESCEYGHVPPVSGN

SEQ ID NO: 992541 - protein, 144 aa, Homo sapiens
DELRGTPQTHTMQNDDGKFDESVICMRNYALLTHICIHRVPKDHASIQIERWTDVIENGLYAHVFSRRRLKTYAIVQSELIRQRWVEIDDDSTYLPECGHRADVPRSQNNCRLGMKTSREDVDLIGRLIKIDMTRPEGQKIMVQ

SEQ ID NO: 992542 - protein, 78 aa, Homo sapiens
NLVIYSTILAGTVISSAKLGTDLFTVDVGAVGRVKHDVACCDCTDCKNAKENNSARISTEACHHTLLSLTVNAIRDRE

SEQ ID NO: 992543 - protein, 255 aa, Homo sapiens
MGTTMLQMDTSRSMYAHTVVLVIRGTQYTREMSGLSNMMMCHYDVCGIPGAHLYIIVSLSVCPVKSVGMRRHEREYNRVRFMVVGAVSEHIQKGTAFISYREFGRKTRIITHWKLIQENGVGLRKIWDRPHKFVRVLVLSQMLCRERAGLLVLPYGRSLFVAQFHVSVHVWALVVHLVNTSPIDTIWVVARTLSSVRAPSGSKTYRTCGSRDNSIYQLAATEGHFRRLYRQMRRGEKPPPLGPSINVHLGIIGTL

SEQ ID NO: 992544 - protein, 107 aa, Homo sapiens
MAWKHSQEHPASYGVRIIHVNMAHMYAYVTARQNGQTQFASSAIARRHHTIRRMAERKLLRSKYRALIADFNAPGTGIARAMGKDRVEKGGRSDANSDLNLTWGAIA

SEQ ID NO: 992545 - protein, 349 aa, Homo sapiens
MSFRPSHHSASGRKIIQRGATSGGSLTGNEYTAVTYILGCDNGRNTCRHDTNSMRHDTERHTQRGADKTSKARDREKNSSARHNQRRAQQRKEKQRKPGTQRQSKHRTGRRQKKEQEKHRDWREQKEERKKSTRATRERPEEKGKKKERGRGKDARATARSPPRRNGETRKPGAGPRETAADRTSKEGEQVDKKRGRSTRAPGTRKNRAEEKSEGRDGHEERERRRKNRHEGEPRRKRGAERGDRKKGEPERRRTKEGTRRKRTGGERTKRGEEQKREQGKAKRDRRRRKTSAEGSGARRNQTRRTREDAPGTGGPHRERADTDKGDATKRGHDETRSGRGERRRERGE

SEQ ID NO: 992546 - protein, 237 aa, Homo sapiens
MADSLIFSSSDLWDRRPRTRGTESKRKKDTAKEQLKETASGKKRDTLEKKPKSDQRKQDTKDTEKPHENAAAHTEHHSTPAEDEHRRAKKHPQQDSTRTTGPSKRKQSKKIKQKHDASEQGDEEERKVAEQKYQKQRLEAQQASELDKTRDTSTQNNVDRDTSEQSKEKSRRAEQQMSQRQKSKRQEHRQESKTTGAPATPQEAQTRIKHTSTDERRQRQDASHKERRSTATYRTSE

SEQ ID NO: 992547 - protein, 209 aa, Homo sapiens
MSHETNRPLMNCEREEVRLNARRLLEAYCEDRGTLPWVGAKQKWTIGIDHRASSVCHPLYDGVLIEAGFPKEGLPISSQGPFSQITKPGGAPIQSVAIKTKGPPGFPKAVYIGGGMFDNPGVGRHRYGRKVANCLNHRLWQGGPKFYKKVYRHHRGGEHTTGEGEFRGEGDDVSEKARRKAPNDVLEGGGNDATIQLQTTQAMTPGATI

SEQ ID NO: 992548 - protein, 148 aa, Homo sapiens
MAPPLGRKKPGADTNHDYDSPENYTKEEGQRDMSFYTTTDTRRPLPRRDTLVTIRDKTGAPPVDNRALQHKRTPPQGNLRGGHHTLCGGNNNRVRGGPTKKKKYTDEGGRPKIQAYPHGLFCGPRSAAPYKGLDYKHKNQGDGTTQSR

SEQ ID NO: 992549 - protein, 81 aa, Homo sapiens
VSRQNTGVVKTTPKSHNGKGKDYIYNIVVIGHARFGQVHHYWPSDSINCEWHTTKRTIEKVIEKEAAEIGKRATYQVCLGY

SEQ ID NO: 992550 - protein, 555 aa, Homo sapiens
MLQTPLRERKSAVIVGVLAVTRSHKQISALTTCDIQRSILLLQRVQRVANFVKRKYSGNTQIESVIPQANVSAANEFHHVGEQHSKYRKFVLGKIKEMKRKALMKWEVPRYCSTNFCAIKRPDKYQEDVNYQVRLRYPALILCPRKGPVGHYALPRTPSLSGGNSRISIIRGGIGHIKRYTSSTLNNKRVLGPNTSLVGVVEESDSSNDNEKEFANNHLIARCCTHHSDVTFPLIRYARENIKPHHTQREQSQDVYIVHTEAVIVTTVYKVKIQHIRNITQKLTEIVGRGVPRGSNSGGGTPNNTSTSPITTGIDKYKVKRSIEEKRRERKKDICDTNNQVQRGSQYERVGEQEKPQQNTKKNDDEEETTHNNEVRTRHRTGGAKRDDTSAIDNTTESEKDKGKEAQKEQQEETEREEHNVDEGQNNERKRRRDKARRETEDDAERMRKESKTAKEREQGKQERRTKDTKESRQRRQKEEQRTASARTKSRSSGEEKRSEKRQSRTAERRRSREERREGGGKGESDRQTSRERRRRGKDETKRKERGEEERRAEG

SEQ ID NO: 992551 - protein, 130 aa, Homo sapiens
MHAQLTRYLRTDTSLTEHSANAPATAQQTSRCNLPNTRAYHASKRLPVVYGTTCLVHQRTTSHTGLREPTGKTQPNPFTHNPGRSTGLHPPALHQSSPHSQAGADTHALQANGTPKLTRYPATPAVTTHK

SEQ ID NO: 992552 - protein, 177 aa, Homo sapiens
RLNILDTQANSLMMLIQKFPSNSIFCHEAWLAQMDTNNARLAAMLRQFSSTISAKDPNNLFMVRLAQVPDTFNVKGTLTLCTIPQPTGQLMSQVAVAGLITVLCLYHLACSTTFILRPITPMYRHGPGGMPCTPPNAGLRLTAARLRVQLASCSDPALRPIAYVNAECGHGWPSPQD

SEQ ID NO: 992553 - protein, 362 aa, Homo sapiens
MPLSIALTILAQGQQRWSAQLSKYKYNRSMSYHRLASTQQTTSKPPPKFNPVYQAVAVKGIHATHCGSNTMGSHAQTQQLRASRQATGSKSPRATRPREHLCKSNKCGKGTQGTVCIQAGHYSKGSTRYHFSSCSKQLQHGPGAATNACRGLVPRFIYFLLWNTLDDKEDHGHDDYEGAIVRFLQVPPQSPPQQGKLILLTHEQTGADNAPFRSGCFGAFIQGQPLQQQISKLESFRLSDGGLTVGGLTHHLGLGQTTLGGLQHTTGGPPKRLADTHSLTFPGQHQPSGNCQTKRHRRGMRTAHTKHAAGAPNRNPTPREDPSVGSTTGLVVTQACQHEARRITTKNGRINQHRGKHQQSHE

SEQ ID NO: 992554 - protein, 287 aa, Homo sapiens
QFPSHFIPKFCGWFPDSLNTIQNNVKYWSTIFLLTPCFPPLGGQPPGQPHLRGKRGSPYQIGSSKVRRECDNSLPLISLFKGPSAVRVRKASLWDSGGYIGKGNVDIGLLLFYFGGKRTRARGGEALTPKERGGVLNSVVHGGPLSLEPSKQGAPLLILKEHNKAVDKICVSNSHCGDHPLYTISPPLSVVRRLIYKPPQRKVIEYPAGDQRNNEVLDKNKRTPSQKIVTRAPTETHKLERGGDNIYTPTKRGKGRGYANKKELATTNSESAPHEKRSLPSMDESIH

SEQ ID NO: 992555 - protein, 102 aa, Homo sapiens
MHKQMKQGARQREHRDADDERTSTDRVRQGADEDDEYGLTKNERRLETTRMRQVEPSKPEQQRRTVRDADERGETQRRKRDEQTSYKRRDETAENKVNEGNR

SEQ ID NO: 992556 - protein, 66 aa, Homo sapiens
LESKGDGGERVNNQPQKQVQMLPLGAGCGYALALLHSQWIAVRDVLNWVKHETENKLGPIYTLRNR

SEQ ID NO: 992557 - protein, 55 aa, Homo sapiens
RAQLRVAGQRGVDRDGDAGVIDAGAGFGGGFLGVGHGGIGAGAHLGGGFLDLGLD

SEQ ID NO: 992558 - protein, 183 aa, Homo sapiens
MAQPRESAKAAKTRIRHAGRRAGEEESTEGKNRKDNRKETHNNTTKHTTITRSKRRNKKTSKQPDDPKKSTKQNTPHKKQKTQNTQTTQRKKHTRAHNTDNKTHRHTSPREQTSSTTRHAHNGVRKHKTKSNHQKEETKERDEQETNKQQEVRTKKHENTESNQASKKTKKTNSNRGRKKQDN

SEQ ID NO: 992559 - protein, 117 aa, Homo sapiens
MSGESAAAIRRGILNGLCATCMRLRELRQETIVQIEEVFGATWEPKVILDLTRATNFGDVVHLGVAFGHLSKVACPTDNVLWGPLAHEMESFNLQHGPQLCWELASSSCCNCKITQH

SEQ ID NO: 992560 - protein, 240 aa, Homo sapiens
MTTNSRTEQKKKEKDAHKEAKAENKSEEAKKRKETTQQTNRRRVEEEKRQTQDAGEREEAERENEERRSKKEREEEKKQVKETKKQRKSRESTKRRDRRKEKNQGQDTGENDKQGEKSAGDETERRQGTGSQPKSHSRQKRTNTNRANRQQTNTTTTKARKTHQKTQTTNEGHRAENTEQTRRGNKREQPAQRDSNDKQSEEERREPAETPSSNTGEGRRRQRTQNDKHITTSKYDNRRR

SEQ ID NO: 992561 - protein, 267 aa, Homo sapiens
MKRLGYVLCWCMRRRPLGSRFTKEENDFFKIFFSVSSSKSKTSQNGDLKSLTGLSLISGGSICCMASNKLKYYTGVITIHKQMLILLNMIAVHIRYTIMSLQFEFALMWQITGKADSRLGHYGQQPFLFTQLGHGSSPTGTFSHYVEVEIVPCDHWAKILTMSDRLSWNKELNNQSTCKITTQPCTHEQLTTHHQYSYSDHEHIKNPSLQHMCHNITHESNTRYTVNRSRQAHSSQTHTKGPEHTQTRPQRLAHHGEETATHDRAYK

SEQ ID NO: 992562 - protein, 591 aa, Homo sapiens
GHKQQIFWGPPASSFSFSRGNSSGSPRKNVPVRGRDRQVRTTFVAAQRGHLVAEWVGGLCQMVRGWCGQPLTKRDVPPRGFSMWHTHPRILSCGPEEVLLSCVPYNIVCWVYRRVTTAFYRRVWFVAQHSAQHSLTETHHNTHKTHTRALCVCALVREREITPLLFVRAPERGGTTLSHTGGGLYIWWELPSAGGQRVGDKKKDGRGAAIIKIITPVKSSPRSGAPKRVSRTRGVSPHKRGVILITSSQEGGEEDTHTRQSWVSPHRKLLFLKDIPGEKSGTAMISYEKKINPPRHREGGGPPQEGLIKRADETREVFILVLTTTEGGGAPLNKRGDGRDNNKKRTKEANLGGPDVCFLTQSVFGARLWGQQRGCLTLRGTPFVCGQRGNPIYIIVGGCVEPLMSWGPTINPYREEILKRRLLTRGKISYNTFFTRRGTTHAWRCSTLNYDGRNIYDQSAALLRKTTWGASTGDDSDSFLQYICTGSDHEYHTTSYIRIPATRRIRRQDSQQPGPDTTERVRGDRNDERRRGTEAKMNARRNEQHTPPREQQNDTPRPADFTTPGRRKRVTDRREDNNRQDSERCDDRRNT

SEQ ID NO: 992563 - protein, 76 aa, Homo sapiens
GDAVGRPTSSQSTRGSRDCMGWTRRFRTLMSATGWARDLDKRCETQLPNLRTGVQSETLSTQGNERDVGRLEPSGL

SEQ ID NO: 992564 - protein, 491 aa, Homo sapiens
MASDDCKFIRNLTIRKKKSLWNALSGNTLSFGIHLGHYRPKPWIKGKNERTLLRNKRHKLDATYHDRVDRVRHTTLIRIVTIGKWGDTETTEEAVGQEKRISTYRYNLNPKFPHELSNVIGGRQTKGNAHKGLSTSSEHMCVGKMEGCYKPLHRFKGKQRVYHKRRIHTEQEKYTDINTVETAMCRFSNKPHRLQNRQITSRRTAVTRRKTKRSTQDRIQHISITVYGPARKDSKAVHSTKRAKRHDIAIQRQSTTASTQKIREEWNKPAVVRNRKRADHDKSKRGTAHIHEDVMNETAVVREVSSTRIQVVKYKRRRSSDPKAKKSVQKGRSSHRNKEQHGRKGTDHQKKKPLSQDESRARNGNNSRSKAPQEVASEPTNDNKQSEERDDTGSTKGENNETEQTRQRAQPHDSDQHTETKRRTERKQEMTHRGRSHNNAHRAKRAHDKKDEADERAARQPAGERVNTQEEGDGSTGRRELSNKKRQHTEQ

SEQ ID NO: 992565 - protein, 71 aa, Homo sapiens
LLYRSYTFYSQYEQGLINRKQVRRMTCHNAAIKSNKKVREHQSKNSRKERYKSGVTRSLGTDPGASKQSSL

SEQ ID NO: 992566 - protein, 293 aa, Homo sapiens
MASLPQLDGGPDLFLHISDVERPSMSQCKATRSPIQMCSIPPKTEKLQAVEVVITHLAPGPKPETWSGHVITLLGPCCEAPPGPVACGTTPPRTQARQTLEHDLTSTRRRRFTRALPPLSTYPHLRANGRYSRRATVLTDASAMLPGAHHDTALLPPLAHHPTPTHLTEAIYAAFNNRGTPHTPDAHTNQRQPTQPDTHTTPPQPHRASTLHINQALTHTTATTTPPSPHHRTTHSEPHNGPPINRPTADDSKPPNPPHTHTPPHPTDAYTRPPANPAHHSTDPTPNPRALHT

SEQ ID NO: 992567 - protein, 121 aa, Homo sapiens
MRMEVEDDENPNYGTKSLAYSLTLPNSQIAVIRQGLTSSNPLRHRARCWKCNRMDNNAFKLTTRYCSNLTPALKLPETHEAGTTYHRQPDKQGYHDENPIKFTCTHQICNKRAMPRDKRAD

SEQ ID NO: 992568 - protein, 95 aa, Homo sapiens
ETVIYSSILAAPYSIDALSSEMIEHSWSRPKIELLVFHSSSNQKNKPSSHRSCHQVLPHVDSQAQSIILLIGYPLQQYTLRTMNHNQYYQSIPHH

SEQ ID NO: 992569 - protein, 102 aa, Homo sapiens
MAQRRDQYHASHYIRGLQSLPKSSNNSRFHCHPQDHGTLFSHSFPITPWRHHPHAHPHNLPHTLASPRPITTPTRPLKWYTPHRARPAPRAHPSTITTTTTD

SEQ ID NO: 992570 - protein, 102 aa, Homo sapiens
GIILTAHSCHTSKIRVDYFSQHVLLPRLVRRIGSRFPYTKQQFPLGTVSSDSDGAPDSELRRDSHWKEDMPGLECSHRRRYVCGYSDYCSSLTVWTDRSDVM

SEQ ID NO: 992571 - protein, 584 aa, Homo sapiens
RPYAHENTALLANSDSSLHLPPPASRSNAGNTTQETPWLQSPNFPTFTGTAENCPGMPTTTLTTELLLAPLPQHGLALPLLLLRLPPSCPSAPSPYHAHANNANALNTQRECFPLSSRKRNAHATYTHDHPLCTPHTHCTLRAHNPTPSTLNTTHSPAPTHTHTHTPPTPTPPTHTPPPPIHTNPSPRMTSQPATRRHTYSPHLPHLRYHSSRSHYTKLQTDTTGSSLPPDDARYLPLARQLRSLKVTALTAFSYVPYPTLLIRPSARLFAVQLSHKRTTTEPLRSDVYHMRHPYALSASPPPTHTHTTPLLPTTPDRNTDGPNAACLRPTRPTLSPRRQHRPTATFSRVQPPSARSAPLSLILVSSDQTHAGPPIAAPAVRRPIRQRRPRRPPPALLPSCSTPTSHTRREAHHDSPLRNPTSQSLCLVSLQRAPVTHPTTEQRSGKDDRTLPDSRPNPHQTETSTDEHTQDAARECKPTTEQTQKGSGTTQEQCNERRADMKTATRIQRRLRDDDSEYADATNHRTYQTTYTHNDVPQHRQTNDTQHTIGHNKRHLNHEQYHHNIRGIHKHRTEHYTPQYQPK

SEQ ID NO: 992572 - protein, 180 aa, Homo sapiens
VAGVALGTRGCRGCLRRCCKDCRALERLSAFVFPGELLLRLLRMIILPLVVCSLIWLAPTAWTPARSAVWAAQGADLYSSVTTLLGVRRSEEGLGGWLLQPGLPPPRAINAIRWEPAGQLPQMPPGKEDARLQFLDLASKYLPFQPGVSSLSLILYQLIDERNITGTRVKVPVEAGGGGD

SEQ ID NO: 992573 - protein, 428 aa, Homo sapiens
CNGSDLVLTTTSDLPGSSHFPASASQVAGITWHSSLPCPADLWISQGMICTTHSVVWDRWDAHTDNRQCIMLSDARTLPHPTCLPSKVAWRFITGHAGTTGGPPEQNYGAYTLRCRYYIWKTLGSTPYFAPQLRLVLLSCQQGTPAQRSLESRGQLNRRVRLQLETTHSSQYVSHTYYFPVIPDSRIIIYHITPKEVFKGYLIFRLRDSYKQLLKPVGRNLLLTVSTAKHSRGTAGILHKATALRWVPPRISTPPLIDTPDIAAMAHYNINSHLGHHHQLSIEPPLTNQQQMGADHRALDTYTILDARTNVYTRGGFSHLVTSSRDVFVIARTLTFIDPQPQYIHPPSQQDIPAVICPPPTNSCRFYTNFHRALALHHPPIIKHVSDHQLRRTSYHHCHLTTVQHRSSHYPALPAASRCDSTPTLLSI

SEQ ID NO: 992574 - protein, 192 aa, Homo sapiens
MPKDTSTNAKSHEEPKPRTHMTTIRKHIQIQNLRNNITSTHITTHHNQYNTNHQTTPEYLKIKDSHTHTLTLTHPRITTKTNNKTTQEYKHNPGAKKLNYANNDILKQSHNKTPTQHQPIEEHTETTKTQIAKQKSKIKPPITTKENKNQKNEQTWNTKSNQGKQMKQCQAVDTTNRQQIEKDIEHEKEPKG

SEQ ID NO: 992575 - protein, 74 aa, Homo sapiens
MSVSTPCSPHGPRFPVQFESGAHQDPLIYIPSSFTQIFRGAGSHIIFQNLYRNLPTPTQFRAFHLKFFDHPEGP

SEQ ID NO: 992576 - protein, 133 aa, Homo sapiens
MIPPAVVEEAPCWCYHRPRCCVCAIKNACWETSRRDNTCLLTVGPRWKKGPCCTPGKEKSFLPMAVCWSETPPLVGGNNQPIRGGRRRHYLLVAEGRRPPFLQSGGRKKGPCLGPLLCWPILPFFIKGSAQPM

SEQ ID NO: 992577 - protein, 341 aa, Homo sapiens
RTRWVDPRVRAPARSPAVREGAMMRRTLAKPERSTRTQAAKQRALEHSGDSTHGTTLVPNSRRMPTAADNTARLARRPKSDPSWLTLQHLTALLLLTEYPRTLTRWRLTEPFCTIDVIASHPLTGLYSEHRPGPGSNRTSSARSPKGYRIETPPLATHRYMGNPAMLAHPLDISARNGPLPITPIVILHQGQTGTLPNEEGPYTPIIYYTFPRSFSQNSDIKRYHSANKPLNSVESQNHVAITLIQPWWSQCKKTRGHQFCTHVKETVLPNLFGTIWPLKCLRNTSNRHPVYTFRVGKSEEDLFTFYQPTTAFMAKICGSQQQHIFATTSALHLQQLKPLT

SEQ ID NO: 992578 - protein, 345 aa, Homo sapiens
EGTKDPSRNRYKLFLECTLILTSVVPPELPIELSLAVNTSLIAHGPSIYMYDTEPFRIPFAGKVEVCCFDKTGTLTSDSLEVRECGRELSTTGTDGEPPGGPKDIPCSDTQHTEATGPISDHIAIMQPGQTAPIVGDPLEKAMLTAVDWTLTKVPCSECPSLPRMTRWASTDLCYIAAGEGGPEPLHSMSSQCPPDYHTSKTEISRQGAPVQDAWRTRSLGQLHFTSKPASSQTGQTLTVAPPATTRHHSQTHATTPASPQARDIREHPNAHQRRVPGLPAETHREQGQSPRGPPTARSRETGTHGGTQQPPPRNAAQHNEPTTQHHTPARPRNHSDDPERRTTD

SEQ ID NO: 992579 - protein, 31 aa, Homo sapiens
MACNDELANEQRTQGRLRSDYRRKWTFRGGR

SEQ ID NO: 992580 - protein, 81 aa, Homo sapiens
AIYKGNPMRLTADLSAEILQARRDWGTIFNIIKENLQPRISYPAKLSFLNEGEDEIIYRQANSEVIHYHHICLTRDFRKED

SEQ ID NO: 992581 - protein, 335 aa, Homo sapiens
GSHITLNHKTRREYDFVHTITHAYLILSSNELIAKDTHKGQQDLQKGQSLSISVGLRTWCLDNYASDTISVSYARTAIHYLREHQNGKDTLPASSSSKSSPISKIPYPCQISFEIRHFESRAETITVPHPEQMRSSDDHPQGLNRTGDLHAQFFEKRYTKVTVVPLEEFLLVRHRLVLDSGTFTRNYRGLTYVETYSQYRRHQRQGHKRKFAAVFWKGKDTFSPRTPRSRAYVEPTDEHSLQSGSSGGKYSVAQMEATTKSDRHSTVVRSSLIILWPFRDIVIGSIRDPEDRKYRRESKYHTPDIVKVTANTAADFTCPTQDKRTTDSAAPLKRT

SEQ ID NO: 992582 - protein, 194 aa, Homo sapiens
RKMAAAMTFCRLRCGEALRWMPAPWCCPVYGVCWVIRPTTGDTKGSNCQTHLGPPFKWFLQNKGPLNPRGARAQLFPRGLFWAEKGEFLGLPKANNTGTGGLCKTLVHKPEAAFFLWAPQNFSVATRSLCAKSFKRGPKPDKGPPKGGPPPLWGVWAEKGPPGTHTAEGLWGGRPHTGHKPIFSPQGAADGDFR

SEQ ID NO: 992583 - protein, 133 aa, Homo sapiens
MSHGHAADYPGHGVHMQGRGRHRSPDDCIPHSLGDLTCGRHGMGGPQSPGREGASGRQSSKQQIAPTVAPDRSLAIKKSQAHVAKAGAIVTKDMPTGGNTESNQKDDEKEQARPGEPCTRKSEKRTQRGRRTR

SEQ ID NO: 992584 - protein, 157 aa, Homo sapiens
MPASRHRRACRGLAVVDAMTDTTAPRGSKGTEKHAEKREQARRGGPTGRRARADGQEESRQERDADGGRETGEEGEARQGEAGGGAASEKGREGEQEGQQEARAASAAEGRRAERRQGRGKPRARGSTSDGGRRREEGGGAEGGEEAERAGGEGGGG

SEQ ID NO: 992585 - protein, 433 aa, Homo sapiens
MKGEEYDSDGGHPIKHHMEREGDHWDDARKQWPGQVGRPNTATSRTLSAKAAAPHHREWGQPPPRWAPQRTEAAPQTAEWTTSIQLTNNRPRRKRNQTRQRRYPPEKTITHTIIPQTPVGATRYNTPYTETDAPRQRTYYHTPWMSASYPHFRSANKPPKQEDQIKPLGGRNKDATQERMTHDIPAPVGSQYPSQGPAHNGTSTRWRTPRRNTPPHGSEEGTAYYQDSATLKNTRQPEANVGSGHPTPGCQTRTSWAVHTTCKQQQGQQTHMDYVNPPPAYSPPNTGASLPQRKSKRRPICRKDRIPTDDYRSRPDETTPSRSVPDKNGMSQQGGKMEAQHIKGQHTYSSHNNREHIVMHQHPPSRAGTTASYDPTRRSQQTTRRRKRHYYERERSNEVKHLNQESETHYTERHFSSALTSGRKDDTHTPTGQ

SEQ ID NO: 992586 - protein, 110 aa, Homo sapiens
MPFYEHAHDGRTRNQPPAMTVAEQGEARHLRASEYTRSTPVSKEQVQDVRDTAERDTDRRTLTSAPATDLPEETTAVPTDESHEHLEYDRGQTETKHNADNTTTTLPNTK

SEQ ID NO: 992587 - protein, 152 aa, Homo sapiens
MAPRGFSCLLLFEPVKIELPVNEAGMTSGNDEKTLWSCNLLDAKTGPNKTTGPKQQTCIKNVGGATSEQESRLRDSMMLRLSPVKSELLYSNVILSNLTQRNYSYPRDNSADPILESISTRGLTDLDCGIRNIPMVQPLYKRFVRSTINSPT

SEQ ID NO: 992588 - protein, 318 aa, Homo sapiens
MLGIIDHNYSARKGDLQNWPDLLPKLCSLLDSEDYNTCAGQHLEPFSKHLSQAFLLSILAPVHVFSIVRLQHHAFPKSLYSSSKPSVVPNNQGLHAVSNVSNQVLSIQSGLQALMLHIDFYEIEKSHLPLAGDCKNQKDGKHMCAEPLGAVSSKFRNGIALLSSPCIIIVEYMLQRLKIQMHTCELSDSLVTIGNLNLQPAQYCKNVTRTGIFLKLILVFVDMALVSIISTIRLLTPNFSRMTIRTTNIHNRTTPQTPYTRPNKSTPVNTTRYRRQEETHKPVHEEQATHTKQKTNHQTNQPRARLPTQQTVRDQTAT

SEQ ID NO: 992589 - protein, 418 aa, Homo sapiens
GRGIKFSTAHRPHPLVMGRQKPSSICQTWYHKAPNGNTSLSSFNIGCSAIGGLESHISWFIRVLCEVSGDIRRPICKIDSSHGRWPDCTNDRLDMCQVILVSLQLQASDTLPYRYDSMAESSIKLAITTRRKAVSWRRSHCPSSMVISKHPSWQQWSRLKNSSSSRHEGHGQRISYLDKHAMATEVMRSGFNRQSTRGVMRALGQSRRSSGHLKGPPGFSMAPGCVALKPPAARSWPQYVPEDLIVFSWVVGQGPLHCDRHPCCPGEAPPWGLLHPMAARPESSSQGPAPANKGNSFPAKGQRAKPGHREPRAAPPQLPPRRASTGAANRAPQARDAPLAKPPQTPTHYGGGPPPPERRALPPRSAAPCCSGANTRCKGHPQRGRRRRPRRHNEPDQSKAAVQTVTRHPSNPGYGWLP

SEQ ID NO: 992590 - protein, 140 aa, Homo sapiens
SPVCHGLCPRLCCWLELVQCSDLPSGGGMPGRPFGSLLVLRLYGQEHQAPSVCSELRLLHGTVASFLNLALPPPCYSEADNVGFLMPSPSLVCPGSPLRRALPFLTHPTGSDDANTVHESLRSIGFQGTLVLYDLGSTEE

SEQ ID NO: 992591 - protein, 107 aa, Homo sapiens
RVCTSLLQPLGRIPTFQPASCGANKNSLHYSLHPITITLQAQPKNNSHIFNHAGQHRAHPRLVSVATSIGAKFWEVISDEHGIDHHRTPTTGTANCSVDTNLMCTYN

SEQ ID NO: 992592 - protein, 297 aa, Homo sapiens
MPIARHDSGTTNTTISIRNVDCTPLNRMGCQPALGKWIPILNNRAHPFTEQYATRFPKLGGGFNRGPTFPLNEHRDCGFEATEVTLPSKTHTTHHTRRPNRHTCANRATFACRIQVQVLWLHPANYRPVGGDAHTRLGLITFERDTVYNLPKIACVVACVAYNNEKHGSRCNPACLYVQRQHSAHTSTHTYSDERTFPDSPRHRARHVRLGLNDNKGISRFLDRSTPVLVAKYNNRHSVHYHYDAEEKVLYAYAEEQKAQIAPQRWTRATVGLVCVLGPNNITPWRGNNDRIIGLPH

SEQ ID NO: 992593 - protein, 71 aa, Homo sapiens
PLLRTNAPCILFIDEIDAVEKEERKRQHLEGRVSRRTTLNQLLVEMDGYNTNNKCRHFGRHQSTRYPGPRD

SEQ ID NO: 992594 - protein, 109 aa, Homo sapiens
MMRRAPQTAWPGGRQGTTGRHAERRTRPCWGEDWVTTVATEDKRAEENRPPRGLYCVTTKRVMPARERGHPPVCRKITRRSDVNRTAATTDDAHRCEATAHQQQTTKQT

SEQ ID NO: 992595 - protein, 43 aa, Homo sapiens
EKKIACPCSGLPLVVVVMSGYKRSVRWGREAGWRGSQRGGGGT

SEQ ID NO: 992596 - protein, 107 aa, Homo sapiens
ESSSVTDHHPCDKCQLVFFTGACCQCYRSGKVSTKGGNIEITRHSRRARFRCSVIHGRRRGKPVVRYTRSRRVSDWRCMTIYSLTLITREGTTIRSDKRKAKCIELH

SEQ ID NO: 992597 - protein, 403 aa, Homo sapiens
MARSHGGRQTGNDGRTSTRHETTSPARRWDHKSPLEGHSRDARMKTSLRTKTAGFRGKGSASIRCLRGPHCGHAVTLSDIQRPAFKRHHSRYLVLQRHCRQRGHYSFQPFERLSGATREEPYIYGIPAHIPWRKRDRSWAHTQGTRLGITTKDIPQIRTQTHGGQQNSICRIRNETATIPLAPLKRSGDTAHKFFTEQSHSIGHRYISIGVAAPKVTGTGLRSKRRGHLGHSNPHGSMTSCICTEEEFSGLPSRQIPGPVCPYKQASLVRPRQRVGYTIFKFQADPGGLITGKRTPGGTHSHWTLYDVEPTIPFDEYPRGAIPEQGHRQLGEYTARHAATANPLVENTTSRAGQTDNPYDMVTHRAIENLVLRALGTQEQAQQRWQVAEHLNTAADHTAEGQI

SEQ ID NO: 992598 - protein, 277 aa, Homo sapiens
RRRLFISTRTTTGSFGHPPLVPWTCRCSNGLHVAYAQCASSLKRATDASSLNMPKGTEYGIDYNSWEVGPKFRGVKMIPPGIHFLHYSSVDNGYLRKEVGPRYGLPLLSPAPAALLTAAALRAHSRPTHGRPVPSPSSLTLQRHAGPTSSELDQFLPASPITATHDRQWISLTNFTQRSHSWTKLQPDAIDRSVPSPACATCASPLTHTKAPRGAKSTPLWPRAAKATNKGLTRLPEIEPTAGTRRPAHQQLPTQTVPASCLPNLYINPTTTFNPHT

SEQ ID NO: 992599 - protein, 309 aa, Homo sapiens
GKRSVRDAAGLECFGKGASPQAVVVFTSDGVKGGRNTWFNLSRRSLAMLPRLGCSGVISAHCKLRLPGSRHSPASASRVAGTTGARHHARLIFFIFSRDGVSPVSQDDLNLLTCDPPAWASQSAGITGVSHRPGEHVNFKQMNVPGNDLQGELKWDREVIYLHLCLNQNDEALPCQLVTGAGGVRSTPGLLPRNTTVLQNNITLISCLFLRTHWFEKSDGVIPVSSVIYQAPLITSSRPFLEHYYVPAGKFIEPLLCGRAVGGLQQLFLGPRLVTQQVPMAVLAWFANKRRGPLAKDPAHETGRHRQTA

SEQ ID NO: 992600 - protein, 279 aa, Homo sapiens
MSSGGNSSFGFNNMLTATLRAHNPGVLFRDDQCANLFDSIATNSSSCTQRTRRLANILQRQLLLPPCSMTDARHLLSPATLNCGFTILSHCTCPLLSLSSRTTWQYKVTPTNHLNITFMHSPLPTLLNPHAIMLPDTLLLSSYPAPNPLCTDCYTLHPTTPPPALLLPLAPTPHSPPAPAAPAGPHYPHHHPTPSPTRPPHPPPPPTPPPPTPHPPPHPPTPPPPHAHAPRAPLPPPRPPPHHRPHPPPPHTTTTRPLHTTPTTPTPTPPPQPPTPHTP

SEQ ID NO: 992601 - protein, 76 aa, Homo sapiens
RQSSRVCNASLKLWRYSVSARAPDLAGSRSDSAMICTSVKCLWYETEISFETNEDHNLSMNESLVESCEVTCDRAS

SEQ ID NO: 992602 - protein, 389 aa, Homo sapiens
SAFSDTRKPTPHQKTKMSSEAGQSRRPPRSGHERGHDPMICRKCETESQSPRSINGRHVQTIDDDQNRDGFVDKEEPDTTQHGTRLREEPPTDEYHGRVMMSEAPGPINITHVSSLSVRGRSMNGERYLRGCDSVTRFALLRPRKPQVSSNEDSPPRTLVTHTWVTASTDEEVDEMYREATIDKHKATLDYVECTRHPRNMAPRMKDDYGQPKSNRPGADGTRLSSSYALDPAHSYRTSYIVKKQDYTITRRPKGARTGPQRTGPGIRPEQEITGLHSEQKNSGRPAPHRRRTQGHKSAQQTNRNTTGGDTRHGEQPRRETPRRQQKENRQHDTTGTKNEQGRARNGRQPHNNRSKNGEETSKTQQQEPERETREGEDLENALRKRLRE

SEQ ID NO: 992603 - protein, 141 aa, Homo sapiens
MSAFLQGVVGSTKTGWSPKQTAPHGARGRGPLIWPSFGRAWGLSCTTSWTIWACHALPTPRRERSPCIGARDGPEGSWRASGDKGPGGMGARPIKLPEKKKRKGLQRATRVLGDPDKPMGEQHPEDKAGSTHVEPLRRDDS

SEQ ID NO: 992604 - protein, 201 aa, Homo sapiens
MGKRSSNEVLNVIQGNTTVDDFNDETHGLQLEIFRVPHKQDDIKDEDVNVKPREHGRMKRAQMRAIRLYNFEADHKRHEGSLTREEMAEQNGRAARFATRNKTDGNVEATHGCPQGAKAPALLKPNLNENCLSLEACTARIHDPQEGEVLGRRCILATHTSSHIVLRIWILPKDYPWDLTNRLLGHIINGKRIQLDPFNDI

SEQ ID NO: 992605 - protein, 120 aa, Homo sapiens
ADTLTPAGAGTVQSLGEGMCVSEELGCRNFAGSTNCSACDAEPKDACLLGWCGDSSTGSDHRKNQITREVKARAEGRRVNGIGHRRAGEERIEREEKSGEQRAKRRQNTTRLRGNEGRKY

SEQ ID NO: 992606 - protein, 156 aa, Homo sapiens
MNTESTNTRRARHHHQRSRRTNKHTETRAGARAQPHPDPWERREPTNRHTHTTKARRPRRHKKPKERGATSTNKPTAAGNETARAREKNPRPRHRRHSGSRQRARQAAGRPPPGPARGPPDAQTDQARAHTHKPRARSNQTKSDAHEQRRRQGGRT

SEQ ID NO: 992607 - protein, 125 aa, Homo sapiens
MHTHPKDRPKGENTQPNQPNTTHHHEQNTQAENNTNTRGTHRDTHPRTHAQTRSTRQNAKPPARRHDQTTAQPHRRKQAKTKHNRKQTNKQKITNRPTRPRTKKERHRQRPQSDKTHNKKQRETP

SEQ ID NO: 992608 - protein, 206 aa, Homo sapiens
MTTPRPTSAKHDTPPRTNTPPPRKSTSQDDNTHSTSRQGYERDNPTETQYGYAQRKYTTQALSAETTKPARPPPQTPHALTPTHNNTTKHRAADTNNISDYHTTTTKRTPHEHKHTQQHQTHSEHPTPTDQTSAEAPTHATKRDTYTVRPNTGHTQHHSTHNTHTQQHRPHKGPQGPTQHTENNPQQDKERTHNSKLLKQQPKRRV

SEQ ID NO: 992609 - protein, 101 aa, Homo sapiens
WIGYSFLMHTEDGETKAVAISLVSPGAGLSQKDLPSPTPFIDMQWRPRYLHTSYANKYSFWLTTIRAARATRASPLPRKTQLQGPGTHTVTTHQHACQCVL

SEQ ID NO: 992610 - protein, 105 aa, Homo sapiens
MSKRRTLVGPLVRNSGFPWVFREELYINIADYTGARNLYIISVKGIKGRLTSEIPWMHGVGDMVMATVEKGKPELQNEKKVGIQSVVIQTIESHTVEKMAVYLLF

SEQ ID NO: 992611 - protein, 67 aa, Homo sapiens
DISYKAPLGVARGHDKAVWAVMNISLCLLLKNWESLLQYMNLARKKSDLLYSNQMHIYKKHRVQHEH

SEQ ID NO: 992612 - protein, 151 aa, Homo sapiens
KPYICEKCGKAFNQSSTLNLHKRIHSAQKYYKCEECGKAFKWSSSLNEHKRIHAGEKPFSCEECGNVFTTSSDLLNIKRIHTGEKPYKCEECGKSFNRSTTLTTHKRIHTGEKPYTCEECGKAFNGPQPLMYTREFTLEKIPTNVKMWQSL

SEQ ID NO: 992613 - protein, 194 aa, Homo sapiens
KKLKAHEEDDMTKMIRPKKCPNDSVLDEQVSSEENEEEEIGNLQLAWDMLDLAKIIFEKGKRQKKHSFMLPRHILNYGEVDVFDSLKDYVHSCARSSSPALTCRNSTWKPDEASRLLADPLPSWACAYGYNSQYDEAVDTEFSRIIEVIENRMAVLNEQVKEAEWIVCLNTEKEIEEVKDLVPENLERMIEDAK

SEQ ID NO: 992614 - protein, 194 aa, Homo sapiens
MYSLVEVTQEANISNHHPATYVRTHPTRTLPPPYKSPANGGPPRTHHTPKLYTYAKSPHAQKHKTQNATTPHAHPLIHTIPPPQQQRSDVNIMAPETPTILSSATTDEPTTQAKQHGTTPTHHITTGHTVPTAGHTTPHINERPTAHRHNKPAATSRPHDRPAKPKRDTHRTQQDEHTPTRGPQRETTSSTVKA

SEQ ID NO: 992615 - protein, 90 aa, Homo sapiens
MQGSNVTRKTKNLCQYLVNESTPAKFLIRNPPCSGEQASARITLKVRTSPKSTLYILLNFIPRGTTPLEKALHDPSNHLHNRVYTAKKVN

SEQ ID NO: 992616 - protein, 354 aa, Homo sapiens
GDLWIHDHPFPFKKHGIVFGRNDLCNFSYVMRMNVFKIQGQSLFSKHCTTSSHSQYLKAGSFYCHQTLEPCMHNQKTNLSARYSEDECTFRRHTPSASSAIMTKGLPGAMAEYTKEPVTMALHTSSMGYRHANGNIGIHGMPQLLNIRTYYSQAWKNIDTETATYHGSAIYISSNGTDARIDHNPQKGDEPPYLADSHSERRKDRKSDADQQNKQNGENTAPNTAPHIHHEGPQPNKKRRTRTETNAQRTNHGGGNPQQPKEKTTARTLEHKAHKYKGLEDKRWHEDTPAHNNTQNTQPQQHTPSNTPSTTTHNQTHKTYHPSAKKPPQRPNNSTQEPETHGPDHTTTTQDREA

SEQ ID NO: 992617 - protein, 115 aa, Homo sapiens
MHRIHTWCDGNIMTIGWITEVYGYYDELPKPEYGNANACRYCTTVDDVLAEAVSVDDQIVCILCRLISWVSQNYVDQIHRPIGNGNRGIVPSITGEALLVIVVMRRDRLTDVDQR

SEQ ID NO: 992618 - protein, 315 aa, Homo sapiens
MSECDSSQTVVIYQNQAFRLYHVYETQTSYEPMQGDEMFYWESYSKNYPFRVIVSQWPRDTVHDVVLPWYSSDTCYNVTDRRSHCYMVRCEGLCMDAVLAGSTREDTTTVYYNSLLCLTIRLDNYKVMLNCLPLGSHTPGENMRPVSDAVYTQEGSNSPSYTVDPLEKVNQLTKTHFTGLIHVADNAPVREDSRKPEGAMQRNFWQTAQGLTRPVQQVPQTFPSQEPRCWHDNKAGKPSSFVAHLVAQLRQHPSQLPHPNQETGNVWATWNFGGPQSSRTRREPFLAKTLRTVERGTRNTREPPGTAISFDYRAW

SEQ ID NO: 992619 - protein, 60 aa, Homo sapiens
MSFVKNQHATKNRRRGVVVCGGAHTGARINSRAEQARVGVEDHIRRRVSLTATTNTYPIL

SEQ ID NO: 992620 - protein, 226 aa, Homo sapiens
LRGGGRVAYVSLGPHAGKLVSDSRDVIDLEQGFGLMDLGTQVRRHGHAFQSANASSLISSSSFRTVPTRSMSDKPGRREISIHKWAMTHDGPKKIEGRERKAKMTDLDRFKVMKAKKMRNRKSKNEVKKLQKAVSWKLLPKKQLVLRVLLLLLLLLLSVSAADVIVPAKIDHRRSKKAPAQKVPAQKVTGQNSSACPKAQKGQKASSPRKQAVQGIGKNDSGSIKV

SEQ ID NO: 992621 - protein, 77 aa, Homo sapiens
CRPRVACGLWLSRHGHCRGGCPESLSEAVSREAVCKVCVRRDESDASSSRILMLTGFSHIELIDLDTIDVSNLILQL

SEQ ID NO: 992622 - protein, 153 aa, Homo sapiens
MLRNGNRVSVTAEGIEAVASSCSYLTLKASLKKMLNLTDDRSRCSCTQLPAATDPRFGWLLKYYLMCPYCMRRPHCPFLAVCRLFSYSGFSTVVCCLVVDLVLKNSGVLWALCPLLVVLCEAVSSTGSIRLSLQDARVENMPGGWAVFGPNYA

SEQ ID NO: 992623 - protein, 82 aa, Homo sapiens
YHSGIYGFKKDYKKVENSSAHLETTTRVCGTTFHHREKGAPVGTGTGQGRPKSYSTRSTQNSDFYTNRLRFPHFISLFLCAH

SEQ ID NO: 992624 - protein, 364 aa, Homo sapiens
MWGARQFKAKFCHPQVRSLGRTNKSRGAAHKTYSSQYGYLIRAPKGKPEVGTTPLTRSPLVGGQWKKISIVLGGPGKDPVETDEINPKVLIHNVNSWCNNITGRARTIDNIPTCQDFFPAAAFIHEAVTLGTTIKHTPGREDGFRCAIAPRPHGAPYNVAPCPVETMNRGDKRPRKSPPEVHGPNETTDQRREKAQQPINSIHTTPTADAPTHKRTTHNNRAEETHADNRTKHATSKHCSNDTTTMITPAQNHEKAATTKPPHDTHNRADTKQERQRKTQTEDQTKRKQRPADNQPRKSESRQKENRHHTPTPATQHNTTESSNRRDRKKTKHDEHNDQRTQQTEETQGETTDDKRKKKQNRQY

SEQ ID NO: 992625 - protein, 160 aa, Homo sapiens
MAPRAKREGDRPVLPHPIGSGSQGGRKPVLTVSGVVGPRPLHICTLEPACPDKERRRIWGTRSVVPVPYSYAGYPGGAPFALSALRWARISSGPGLSVVRRSERGCVGPSRGVWVPPPSVKGDVGDINSTRANVFPVRGGGVPSPQDFGVFAVIAEGGTL

SEQ ID NO: 992626 - protein, 70 aa, Homo sapiens
IDLSKPGGENYPHIVSWKDSTCNCALHTILTSVSTLIPECSHADGYSSSGHPTPFTKLLLTGRSHFPLVG

SEQ ID NO: 992627 - protein, 74 aa, Homo sapiens
IVATLEQVVYAFYSAMRGRAENSNLQAIAIELYRSEICITGFWSYLTAKTLAERDLLEIDSLYTECGGKSVSGP

SEQ ID NO: 992628 - protein, 112 aa, Homo sapiens
MWGIQRVVSATLRERTFSEVNQGLFVHLLWGKGSKPVSSSTKEVPRIVEKAREAKKKKWRGNSGKAIKPKRRKQGWSWPQNTVECDELEEVGQGAPEERHIAKSVEEKGRPY

SEQ ID NO: 992629 - protein, 213 aa, Homo sapiens
GLSMCKNVSVKGLFVDGNFAGDRKNEPHNWKLVMDFIHAISVTDPGEIIHGQYNARGYCHRLIEEFAHPRRTHWQVQVLHELEGNKDPIGRLLVEKELLKHGSLTFPLAQYWVRLTSDIRGDNSGFSPGRPKGPQLAGGFDRGFHLVLNTTPSRAPLSWRGSVMIDDEITLRRRRVTHNRAGGTYRNGMLEAARKALDKAHWSQVKRRPGKGP

SEQ ID NO: 992630 - protein, 322 aa, Homo sapiens
RVEAPMSGITSGILVTAVCPFPGCMSALGPPAVDTQASKPPVSTYHRQQEAWACPQDQPSPKALSPASAQAWSLKESEKMALREVDGYTAQPGTISLEMERQKPDDQSRQEHERVGRRRGRQRSRSASLHRAYHQQAIQRIPSGGLLFSSLFSYTGSVYTRGTSDWLISRQCHATPHAATSRSYREEHWHLRLRECRNEPHKGPQNRTTIISIGTISLTHDEDRVTHAHYVIDNTTPNKADGYYCLIHLAASTRPNVQDNLPAPPRSPRPNRTQRTQGNAEKAAAPEQSAPQQHERTGTNTRRTNHRKNSAGHQNGEREKVK

SEQ ID NO: 992631 - protein, 142 aa, Homo sapiens
MIREGDRDPYFDRRSKCAISMIMRDLNEGVVDTLEIETGIGGVIEYERDEFDMSYDECRDDRDQSYLKKNKEQLPHPEEGGFDEDITYEHGSLTEQSMEDAIHGGEENRGTYPEELSASASSFTEAPRPPRSTARVEKKPES

SEQ ID NO: 992632 - protein, 113 aa, Homo sapiens
NSIWNQKAGDSGKWSFCALPQLIPVVLVPRVVPIALLPVEHHPNETWGTSPLRRAVVSLPTNPFINVGEEKEERRGEGDLCPLPSGILGGALCPHVGFNPFPWGLFFPRTHLC

SEQ ID NO: 992633 - protein, 229 aa, Homo sapiens
QPPAASPLRYTSRSSPTDLTPLHLNEKHIIVDEEDRSTIRIGSMDISIPSTRTRTQHGHQEDEREDRLRDRRRKTARQHLHAENLHMSAMENTIREPEQHTINKIKQEVKQTYRETRHTKHENEKKKTPHKYEKQEQEQINRHKQQRRTRHNKQHHEHTHTRKEKKHKHTHQPENSTTQTNNRRETQKTTPDKETTKDKNTTKYRNSHLRRHKHQQLNEQLQQKENNAT

SEQ ID NO: 992634 - protein, 478 aa, Homo sapiens
MLLMLRLGLHEPGKRKMRRQTPLEDVIAKPPEKSPRLRRHPRRLTASGSACHSRRSNHPPGSPPTAAHSTPTPSNARAQLNYPSAHSPTPDLHRLQPHQDKRDLNESTPHTSLHTHYTRTHMNSPIVALRNDPKHTPTRTPPAAPRPPSRRQPTPNRTHSARGPAIGQPSRTAHTPTMSTPHPPTPHRATQNPPHPSPAHPTPAPTTPATIATQANPRPPAHMEQGTQNASDHLTSPIRTQPHPPHRIAPRHRNTPTTTSPTADPSAILGPNAKQRPRRHPTQRTPPPSTTVHTPTSPRHQPKPPSPRRRRSTYTCAHRHRRRHSPSHCKHHTGHITHPRDNLPATAPSPTATHERTQRRLSIHARTATTQATERPDSAHHQHKTHASPPASTRPRIHTRTTTHTQRETTPIHTDNQYTAHKRNHATPEDRRTAAHPDTTELQAHNAGNGPTQHNPGARPTCRKQTLRRQTTHRATDK

SEQ ID NO: 992635 - protein, 243 aa, Homo sapiens
KKGQFIEELITKWQKNDQELITDPLQHVLQTKMKLLRWCTKSGDHLNAGYRNETGRTPDMEVPALYLNLTTLQSVKTPLDLANAQENSNSYRRITKFSHKYTQEQGQDTACTSCYPGRTTLVICLGQERTQLINLTVCSVARIVCEHAQAQALALISVGTLVMLLIDGNNAYYYSADSTHQPYNCLTHTLHVTAVDDILDTGCDNLLTKEPLSTHIPHIRQINDMVCSESLSKPFTDTTVKQN

SEQ ID NO: 992636 - protein, 252 aa, Homo sapiens
MTTLLVPLQRASRASGVPPLRADFHLWLDTPAHSPDTAGIPLRALRIQHARHLCVYGRSPPGQTRLAVQRRAARPVSPRALFNNSPLSPRVPVRGSLTSFFFSAPPPLCDATHSPPSQEECPTQGKSRSRHAFRQTIPHVPATPITGERPPRIAQPSADVFQSRWDNERTTNCRPQAIVCLSHTHHAPQSNNTNERAPARMISPTRTRRLLSTAQNQAELRAAVNQPRTGGLTTTRTPLTSSTNIRGTHEPL

SEQ ID NO: 992637 - protein, 411 aa, Homo sapiens
DTHPRADRLKASEHRQTVLESIRTAGTLLWAKDSAAFADRPGTKLTATVRWADAAGCSRGSTQPRTATARHWPPSLEARLGKPSLADGQTSRITAAAQAAAATPLHGHAGGLLSSTPGRAWQGCSAYVPALHTHGVPPTSPLATRNTQRHEPGACTRHHPAVLGHQATAHRRLFAHGHLALATQAWTYAHHARPGTLAPHGAANGVPAIAHALRLGQLPAGAASLLFMAGSQTPFLRKRAIERRLSKELQSHIEGFLYTWGQHSTNHAGPGPAFGLHNLNGALKQARYDLKGSTWKLADTRESEPAPGESTAAFYEQRVYKAGLQKQNKGPLDGAHINTDRKIQSRSAAEQSTLREDAQRRSRRAVPQIEPHETIATLLHYTPRHEAAEDGLLHTEASTLAHKNQDIASRK

SEQ ID NO: 992638 - protein, 141 aa, Homo sapiens
MGYANNVDPALYGVLNGSQRHNIAEYNMTPLLTADASAYGTSSERTFFDFHETPSHQRASLFTPLIQFTQPRHSYPIHQPLTITPLQRHLSTTPQHKDHQQIIIHFSVSHHLTDYPISTSTRHYFLPLTSLLHVPNHTHSK

SEQ ID NO: 992639 - protein, 205 aa, Homo sapiens
MTLIKEINQLSEAIGQGDQSLDIYYFYNKVIIIWAVLRFQSRYIKVKQYLSLSTQSKLPLENFLNPYKVHHIYVWHIQISIKYIPLTVLIETGSCSVNQAGRVVGDFELTEGVDSQGRVILHLAIRDTMDIPGQCTMPRNYLSQHNMGSTCCQAQPLLLTWPLRVEHGNGPAATIIDNSQYHDEQILGEYNYPPIVQQTSAANII

SEQ ID NO: 992640 - protein, 630 aa, Homo sapiens
DAWVEPRVRYTSLQDAMCETMEQQLLPRNPDSDPDYEDGSSSAPPSVTRCCIPADYPCGYASLGKPHPTGSKTLHPTYYHTYETPYSMTTRTLFIDLPTEYQYNYIFQDLQTRLNISSKATTGLSPSEMTTHTPKRYLSQLRSCDHREIVDSYDRSDWPLERPVEPNLSATPATTPLLDHCDNGRYQRHDRRDAPTHTATDYTIIMVDISAPTMIRGNPVCVVTASYVLGYTTIHPHATTHTPGTLSQSFFPAAITARSNQFQATTPQTAVHDPKGARLDKISNHYESSQPMCNSEVHFRALASSHRGPREGSPRTLNTPTCTTPARGPRSVNPGGRSHTPMRYRKYLLYACDPARYRSDIRRSHAWRKQTTSATPHVPHCGYCREFYHEFNATKRTNTLGREMDGCTAASHGCLVNPLHQYSQTAYPSNADQRSPYRTYTTETFASHTHTHKRADSLIMTDNMHHEGALASQTRPPLHLSTMLPSHSQTHIIARLQPHTHSHSSHDEPKPRRAQRLSALSSTRRSQRTHTHSRSSPRAELIATHSPSTVITSPAPSSHHHTSSTPPRDDSARIAFTLLILAALLRARLSHELTPNYIHAEATQYITHGFVHRSLQLRSTLTLLSRPHKR

SEQ ID NO: 992641 - protein, 275 aa, Homo sapiens
ESDSGSVADRQAGGHETSCGRRPGITSLLTVAAHLTKSVSASMDLTSVRAAEDYKWLLEDAVTPAPIVVERYVRAPYMEIITCSTMLDSRTPWVVVMVRQTILKSISRDNQARVNLELEEFIIRDVQDILGRTQREKVGECEASAMLSLECQYLNKKKRPDDPRGTPHSPGEALFSYKRKPKSATLRAELLQKSTETAQQLKRSAGVPFHAKGRGLLRKMDTAPIKGIQAGAFRRPTGPGFKPTGTGTHPASGGCGKNKCEVVEISEADIVGAPR

SEQ ID NO: 992642 - protein, 303 aa, Homo sapiens
MRGYVVWLTIEKWRMQGLRENVPMLCIALAQILLPIVRQFPLEIAWALCPQSWTRTYFAAHGSFILTSYTILFFPEIEEQKIHLTTGLRGVRGEISPVRIQRKGRGVATDIVFIVGYSGEKVKSGDGSRVERPAKKGELGRGNFTYPETEEVPPKGALGGKFPHRERNRLHTFESRNPGCGTIGSWEELFVLAGPTVRQTPYTPTSGGGSQRSSTLDRGDATRVDQAAQREDADLPQQFYNEAGAATSYKQPRFNNGRVTPGGGGANPKNIALVSVPVHLHHKRNVWRNSSRTQRWSSDKVFY

SEQ ID NO: 992643 - protein, 108 aa, Homo sapiens
LKSAEPKQGRICGLSVFGWKTTDCVLHKGSEMWCRVLYVCEFNWRSCEPASIALVRLYEWTTENRAAALQCNHYNNIMALYLNDQGRLHPGGLTLCAQCCCNAYKPME

SEQ ID NO: 992644 - protein, 47 aa, Homo sapiens
MVPYAQKYQYELSRHTYWRNKRHTGGIKKRENNAVRKNLGVKDRVDK

SEQ ID NO: 992645 - protein, 314 aa, Homo sapiens
GRVGQNTGVVKIVPLRSQNGRRKRLISTLVCQLDDCRFGQRSTDYWPSDLSNAVARPEDEPIDNRFEKAGCCTMGKRLLPQYAWDLCIKLNSLSVELLVSPVLTILLCGKFRDTVNVTMMHYSIDRPTGTTKQLRYKKIMDGPGHYLQRSTCACSVDMLGCRAMYGGNLRKPGNSSQMDTGARTPYEPIAAFLGITTPGVVETSNLRLVRVVSTDSSRFPTLKVAIRPGTNGLQLTSQKVTSEAAKAFGSDTRGTCFNGTTSIATYSSHTDILCALTQRHPGNRTMCRANYQDGSTTFSHAGSEGHVFWFVTNT

SEQ ID NO: 992646 - protein, 153 aa, Homo sapiens
MPVKPSSLGHRLPNLSKHQVKASMGATTKLPQSTLNHVGPFSSLTATDGPLTLCHQTGDHTRGPNRTRQLFTQRAHTCSDSPNSDVTRHINNYGLPRATQSLPYVGTGGTDIPGHASGNFPKRPPSPHTKLRKALQKCNTRIGQPQPLSIKET

SEQ ID NO: 992647 - protein, 96 aa, Homo sapiens
FRSKLVASLRRERAVVKHVRVGVTLGNRGLRKKHEEEHSTEKLESKWNTINMQEEDSLMVSVDASNGYVGDSQSEDECDNAFDIELVQVISKSVYI

SEQ ID NO: 992648 - protein, 69 aa, Homo sapiens
LRMAASREPTTNVVDPFSKKDWYDVKATCYVQYKTYWKDARDQEPRNHNGICWSQGSCVGSLSLADLHK

SEQ ID NO: 992649 - protein, 84 aa, Homo sapiens
DEAYPGKKLLPDEPYERACQKMILELLTKVPSLVRKLDEEATDKEDYAGLLKKYSVKESLPSVEEVLTDKKTNCFGCADSISHD

SEQ ID NO: 992650 - protein, 150 aa, Homo sapiens
EEAWIPEREQYAGWAPWLVSPPSRRVKLQDPVFCRQEVDDAEELSWALSSEKSWGERRAGNTLSADGGSLNRRIHAGGEKSWHRAQELLVIAPVYSVECTLNKAADESERGMKVIDIRAFVDERTDGTSRKSNSKDAKHIAGRGRSEMYE

SEQ ID NO: 992651 - protein, 195 aa, Homo sapiens
YWVLRISEYRCQYAAFTPEDADVPSLRPMISGLHGPWSSGKGERDLAPDYPVLWCRKACDLVKNKRPCEKTVDSPGYPFSRLMQPLRHNAYALTLILLPSFALECHLQAARSSCGRTPWGATCDCEDRRQPKQLVLRMSAGESLDVLCQAFVTDVLCMLLVPYTVCTTRLVAHFPREHTEHEKSEVACSRSLQVY

SEQ ID NO: 992652 - protein, 392 aa, Homo sapiens
VEEEKVRYFGKGYMVVLRLGTGFSHPLTQSAVMGHRSDVEAIAKLITSFLELHCLESPTELSQSSDSEAVTLQARADSPTVPEPVHRPQDPWHIPGVPEPVHRPQDPWHIPGVPEPVHRPQDPWHIPGVPEPVHRPQDPWHIPGVPEPVHRPQGPVDTFPVCLSPCTGHRTRGTCPVCLSPCTATGPVGLASVGGSSRVGLLPAHAACLHTALKQAGPDPGTSRSFSIREGRGLAVLQAGKITQPGNPGLGHKKTPGELEKEGTGGTYGSKQRMMGPDTRVTHRGDIHRVRGLKGRGGNLQAHEAVITSLHLREGAHTETHTSVYKEMRETRCHQPYKNVPNKPVIGPKKQVMIWSTRDDHLADAAVVKSTLIVCRCRARPPRARSAHKKKG

SEQ ID NO: 992653 - protein, 133 aa, Homo sapiens
MAHTGSRSCVVLYRYLRLGNYNFGNYSQRVRMLEKSTEPGLAGSVVLRAQFLNLRAGGVKQAPDGKGAKGPNKTNHGRVGERAKGEHPGRVKNARAAIIVGEAHRGNSHEKWRGHDRERIGRTHRITEKKHTG

SEQ ID NO: 992654 - protein, 382 aa, Homo sapiens
MRAATNTDLTSILPAEPRRQDTAAHQKTTTGQETQTKEAPRSNAPLEPVIQQELSAYSRSHMNNSTSKTQTTDAAAQQTKRTSQLTRRRTDTGIPNYRTRDITEHSATTDTHMNSATTAQRPRGETRARSERAAESTTTDTRTANEPDNGRTGRRGRDEHPRRDRHTARGNTEPQRSTRRARGHRKDQTADSRRQEASERTAEDRKKDRPTDEDTGRRTSEREEGRRELKREESSGRKEEDERGGRARERRDASGEERTHAAESKGETRGRTSRETRRKTAGGDAGAATRQTMRGRRDDKNTAEQQQGRKNDKREEEQQLTRQNEGMRRQQNEEKHEHSNAATLSAQALSEPAQTSNETDEHPTQGAARRRRENDKTSKEVQ

SEQ ID NO: 992655 - protein, 77 aa, Homo sapiens
LISRCQSYTGSIEPSMLGDLRNNRLVSFYNCASILDLREDLYTCNDGMVLTRQGILLKSYIFTVMCNDDYLHSKEID

SEQ ID NO: 992656 - protein, 102 aa, Homo sapiens
LRVCWYDLLDLWTGCLKESVSRNCLRMYVCSAIIHETAVSPQGTSWEKRPLTCVVSRPKRPSINAFYEDNGDIVQGLSVDSSLPYEIGYYPTIIYRQRFVEY

SEQ ID NO: 992657 - protein, 225 aa, Homo sapiens
MQPWSPEIYCLVPACVGRISSHVQLLRDNDHAEIPKTLERLLMPHRLPVQALLRQKESTGVTVRATRTGMDMPLTGVTVRRQCCWERNLPVYSGSLRRATVEQSRARAGTEVPCGDLKLGFAPVPIPVFALYVLSGKLGTGLLFPAVMRNPTVLFFERLCLDADHKRHTPGRLAPDKFTVRFGFPPHMSADTASLWTERRRNQSFATEEPGNECTNNTRTPQYCR

SEQ ID NO: 992658 - protein, 206 aa, Homo sapiens
FYDRERRPFLCFYFLFIVFIYFNINNGENLFFLIFSLYCYIFLGEKRSIPVVCVNRTGVRRARRLLECSTQPMRRDNTPASTEGEEEMLSRACNGPPPCVASGGDHLSGQCVAHTTRVGETNVSHKYVFGKQKKREVNQTRCVVCEPQWVCVSEKTLTGDSPPRERRHVSLARSVRGEVLTHDRGCAGGRYKREGVWENAQVCPHA

SEQ ID NO: 992659 - protein, 288 aa, Homo sapiens
MENIIAGSEMREDVDSEVTIARAKIEGFDVLKKVKTLCLRSKFNYSAVDNLEELPSLRQLNLYDNQIKKIENLEAANRAGDSRYFFESAEKLSIGVDEVEHLTVDKSVYLRLATDSTFSTHIEELTANLHQLQMLELGSNRIRSNRIDIDTLTNLESLFLGKNKITKLQNLDALTKLTVLSMQSNLVTKIEGLQNLVNLRELYLSHNGIEVIEGWRTMCTTGSVTEGSVLTEPNLPSGSKSTWSAQCVSRTIKIFLQQKKARAKYPRASTTPEQAAQRVKGRGTGKTV

SEQ ID NO: 992660 - protein, 386 aa, Homo sapiens
MRRFWYRPKLDCTDCHLGLTATSLPDSPASACRVPAIAGTLATTPDWSSYFFGGDGVSAVLAGLVSSSYTASDLPASASGGAGIADGVWFTQCSMVPRLECSGVISARYNLTSQPPALAPKVLRVQPLPGRQPVWDVRSVSDWLPIAWDVTEYPLPGCPVWQVRTVSDRTAIPSRKCGANNRPDAQSNEMRRTAKSPKNTLENARKRHKNKTRTRKAQVKDNATGQEYQNRQRLERTTEERTDRTDRRETQKHPSNRDHKRERNEKNTPPTHETPTETTKQKQERPPANEPIPLRKKRQTTHKRLERATPKCKRGDEVPTETAETHRSQVCTSENTASTKTLQAENQEAQHKQIRDDSDVRQAEHLAQKERKEHTSKTAMIEIRTQ

SEQ ID NO: 992661 - protein, 133 aa, Homo sapiens
MVQDAVREKVSKQKYKRSPLTRMKNPGEAFQENRRGSMVPRGAAALTHYVKLSKIFHLPVVCDHGGTRGYTCGGTNFYTKDGPYSPREREECHSYTLTDIISHTTPSTETPGCGCNQTKWDTHKKAGRANKYA

SEQ ID NO: 992662 - protein, 121 aa, Homo sapiens
MNEFLQQYRNAANGTRCGSRLRQGAPNFKQVSMTIVQVEKGIVVDSDLSKEQKSIVIMVHIYEDGIPWTEAIECGCMICLACRVPKLSSSAKVEELSYCAPASQYHQECSFLRLARYYEGG

SEQ ID NO: 992663 - protein, 320 aa, Homo sapiens
MLRGHRKNFDEQPVRIPGRMPRHNHEPKCRPRGRPKRSVGGLSERKRHPGLAIIRGRLKDPPKTLKPRPQMQTRPLAGTTRVASFVPTLSKHGGNNREYPGRLLRAPNMRVHSPKEQGALRSPRRKTRQGPSATPPDPWQEQDIGNTEHCRIVIPHIRLTSRHTHQHCCHTHWQSPHNSTIASTHTRATHTRSQQNSAGPCGMTPPTPHNLSSSQPTSNPNLAAASSPTSDPAAHTTALPPSKQGSHTTPYYKPTEPNQTTAEDSTRPPPTATPLSAATPSRTPPPPPPPARPDTRGCRNRTSLTRATRPPPRTSTHNTP

SEQ ID NO: 992664 - protein, 393 aa, Homo sapiens
MLLLVFGGLQGSGKLERHADPNPGRLLLNASLSSFDPATLNYAARWPTRLRPLPNSATAHATPPPPSLLPLRTGRVRTRPRPPPPPTATARSPPRPPLRVHTLSSQGRPRTAQPLSTRAKPTVHARRQPTRGPPLLDPRRVHPSAANLVTRAPTHATLCSLPTDTIDAHPSLPSPSPRAPSHISRTTAPSTLARSSHPPPPSERCPPPLHLEPPSAPRLPMPLGRPTRTRSLRPPPRTSTPPAHDPAPHTRPPRNCAPPTERRRSTLPHCALHSTPPRPCAPFTLPSPHPHPSPHLPAPPTLPPPAPPRCRRPAHLPPAPSPCPPPASASPLQPSGPAAPPPRSPCPPPRSPHPPPTSSRPPSPPRPPTPAPPAPPSRATRAPPLPPPTPPAP

SEQ ID NO: 992665 - protein, 143 aa, Homo sapiens
MCTNSATLSPLKSRKVDAMPIKIIEVLQLQRSMEEQCSWTQCLPTSLERVSFTNHARFECLSVRKEILIGKIESKASRSCRGDQDCQIEMEQHVTRRTSEETESQQARITNWHRNCWPTLEDSYLLRSPFNAQTNVGSVLEVP

SEQ ID NO: 992666 - protein, 32 aa, Homo sapiens
MSCHRLASTFSTNYRSLGLCLRRPATGARTVS

SEQ ID NO: 992667 - protein, 101 aa, Homo sapiens
VFHITSVELHCIAVHMRGHFRGLDILISGVHWSFYVCEHARLYAHSLSIGSYYHGKYVYVILLDLIALLYLHAARKTPFILQVHSARYNQDPLSGNISSLG

SEQ ID NO: 992668 - protein, 247 aa, Homo sapiens
MSDTNSHRQHEPSQRTHQTRRTPEHIDEHTNRHKRNESKRTPLEAEHTTTTKTEPSTAKRYQRHQTTDRPRCLRKHTKDADYHTQNRARAATQTTRTARQTLRDTREPPRPGAGSTDTATHSDKTMRRLHETHTTHHHTRGWVRTLTCRAASTTRRTRRRRHGAEDTDNQTRRTDRHHTSLLQVREAAHSKTLEHRRRESPTENQQRTRKRRQRQPHESKLTQPHYYRSSTIKDRVELTSQGETQNS

SEQ ID NO: 992669 - protein, 421 aa, Homo sapiens
KTPNVRMTAGAAGVARGCPVWPWDGEPAGGIPRRFRQWHPGAWESRTVDGAWWPMAAELCGGKAEDKELDALSPSWAALVKDMKIKSLAGDLYSYSLDTIKESEIIDINFHGRPTLKALRVNEAYMPDAEQADPVTGQRHQGFKDIIVDYSGTYKCDKIRYWGVQDSSHGSVATRTYRWGTSIPGPRLIHRTHVRQRQPGGGTTHYAQSPAKHGSSLHTADHGPALTGIQILGYGLQYPLDPEAHTGDFDPDTCCHKKACSVQIALDLGRTMGRSVKPRGTDIARAMGPVSAPRAHIMKQFLKNLTDNLDPRTIRDRRTVIRTKTCYHGLPVATRTNPNRKPRTGARPPRGQQQSVTLGRDGLAETTQRGANDPSGRTHATTQAASERYSGPKAEKRMENPTEPPVEIKINSRITAGVTTN

SEQ ID NO: 992670 - protein, 96 aa, Homo sapiens
MRTRVWQTDRQKHELTQDRREGPNRQPDKEETAQGRKNIEHQGDNGRKENNKTRNASAGHKARKEKKKREPRRHRVQQRGSAEPQSEKEETTQEKE

SEQ ID NO: 992671 - protein, 500 aa, Homo sapiens
MEILYLHGRLPLVMQSYEVALVRRTDDSTCDSDDSIREFSSWIVSPDTLSLSRRVPHEIYHATATQHIAPRDKVASHIFLYARKHKGDTLAKVFPMQSRGYVRRIRVLSAYRDIVFGVYANDGGRNAHIVCRGQYPQHFVLKLPKGVLGAHHVLWGRKHVHRDEPYTLVSEGNSTCGPHRSVAGQHPLFPFGHMTYDHGYGAGKLGLGELLGLEVAGINLIHNGLPLSEGQAPRGNYPAQIGGGPRFAPSFSAYRRAPSFSTMTTYPVGKGHGYPHNFCHPCKNGTREPSQLYSLMRLGVGDWSAVENSLQVGRFARGPLRTLVQSGFLPPQVGSNDPEPEGRLPGGGYIKNLKARHLQKTHEEPTSRSGGSTRALSNEATEEVDNITLQRGRHDNIRPPEAGARKPTRKGGGPRWSQPRVDHRRGKKTKGRRMQREEQRATTHKQSGGTKQREYLLAKRVRGPSKQREALTHDSSARTTKKKPHQEHDAATAEERQQTP

SEQ ID NO: 992672 - protein, 326 aa, Homo sapiens
GGAHLAVLFLGPVVWYPKSLSIVALGCAKAHSGAQGLLAAQQRSRSASRTSSRQTGTKIELPAASSTAGPASFPQTIYCALRPHGRLASLLRLILLAPAGPVSFSSERATTLTRAGGDGATAAPWETRAARTNGTARRLRTTSSALRAQRAEPLRPSGLEAPARLLTQPALSTCMGAPGAPLPLCWHPPACATHKQPPGGLPAGPRAGPSPLRTLLTRQSVPLPLTSPEALTLADVLLPGAPGLYSIPLPALASGPLRRSSPGPLPAIPQHCRHPPAPRPNPPPPPHPRPPRTQPPPAPADHTRPPPPPATPPRHPAPPPTPPPPP

SEQ ID NO: 992673 - protein, 341 aa, Homo sapiens
MRQAGCKGLCLSLFDYKTDKYVIANNKKVGLLYRDDCKATIPRRTLVAIDGRILTTRTGYTNRTIDHLPLTPDAMYNTTKVQRDDEPYNPNPPYGNPESQAAFMGQMLHRNNRYTTQPHRAKTKTILQQDRIIQNTQNTADPPNNHMRGDTTTDPCLAWTHNMHSWPLTPWTSERPPGHHKRGHQGRTSPTPTIAWNNDARYTTLGQTTGQRNNEPTEPALHHIGPQNQGEETIGAPTAGTHTPVPNDYPIAHPSRLATESRTTHAASQAASPTSERTHHHSTEDQHTENNTHHPTLSTKASITPTRTQERPPADTYHYSHRIGRQLHNDADQEKPRASRT

SEQ ID NO: 992674 - protein, 161 aa, Homo sapiens
MEHAVDKTKHTNNRNTQKKNNEQQETTTIETTRRKRGSVRQRDERQKRHTRRNGTDAHDRAQRRRERAQEHTQGERRGDRRRKDEPNGERERDKGEGETESATRKEEEKAARQTGDKKEKEKERGERHKEERTGARQEDRREGDGSVVDGRRREPQTRVRS

SEQ ID NO: 992675 - protein, 230 aa, Homo sapiens
PFKGHHRPHGKKLSRFRLRGKPGPPDFPLSLVPLGQGRKRIRLYMRSRQNLQTSTYANTINDYTVTHHYSKLHNNTLESHNNTLVYRTTRRERMERSKKTERATDTHEPPMDAIEEYERHTESERGERGEEGKNEREARDRKRVQERHTTDERNKQKQTNKLNTPTPTTPHSDHKPTTRSKQPKTHNPNNRKHVPTTPPLTRHQDINTHNSSKHTHNTTTDSIPHTQKTK

SEQ ID NO: 992676 - protein, 171 aa, Homo sapiens
MRLSAGSPRTSQAALPRSIPLAGHLLFCVMALTLIHCPYTTPHQGVTPPYATPPPCPPIHSPLPLPPPHHHPPPLSASSTSLYLPTTTHSRPTATHPSPPPLTPLTTPPITPHDTTTTYYTLPPALSYSAPVPRPHTLPPLLPPQLRLPPSALPYSFSRLLPFFFPPPLPP

SEQ ID NO: 992677 - protein, 121 aa, Homo sapiens
ESGRREEGACSAEVNDLPRKNESSRPHVTTDPMAQAIHGAHVETEGKGSRNNKTSRHGVSRTRCYSVDPRKNSIPSLRMSSHFVSTFYHDLREPRDLFDRVHSINTCKLIFVLLLVSRGGE

SEQ ID NO: 992678 - protein, 120 aa, Homo sapiens
MTLVGADYGGLTEMFPVRGVRLRGRGAFLIYSPLGWLQKDVRGFPGHGLCDREQVPFMILGSFALVFEYVESCKVDAHSKQTASQAGKEYLLRTRNYSGLFRERSAQVARTLYFPWASRS

SEQ ID NO: 992679 - protein, 304 aa, Homo sapiens
HPGRSWLAQPECLDPLLRPPPPQAQLLGLLFVVFCCAVGERGEQALCLLCPPGSIPRTPEASRRERSSHISRPRGMPLDVCRLLLRGGAWAVGCTASLEGQEQYITKPDDSQETDHTYVDMIQTRSNHDALTCGDVPRRLTSSNSQESCMSNDGLPSPIPRMANTGEPKGHESSEAGDSAQNHQVTWTGSRPHIPWTGLMEMGFREDRREKQRDNKSQYPKEQALKAWTRTAIAEMTRGSAKANPEGKKEQTHKRRRTDRTRRPKENPDNREERREKTKDENTKEANNANKTRPTERQKRTSHA

SEQ ID NO: 992680 - protein, 197 aa, Homo sapiens
MRNWSQPDGCPLFPGQMGQTLIGIAHIFLKDTLQGRNAGRPRKASCATAESTGNINTTGIATPIYQCRIKRGGHPIQSNEDRTHKQDTPEEHGNTTTNERVGAQPTGADANREKGNAQLKGVDNQQNTARRPKKHQRGQRTPRRPDCRTGHDASNKKSAHYTRDRRRETINEENDGGDRTHERASQDDESRKQATSQ

SEQ ID NO: 992681 - protein, 64 aa, Homo sapiens
MDPGLQGGEGEQHLARMRDHEDMRRRPQGHSRTEDPGTTQKTRSEYQNTGNAVTVGDKNCTTPH

SEQ ID NO: 992682 - protein, 156 aa, Homo sapiens
MPIDPSWRIYLIAEGGDLHTGERASVEGKPALPHGGLVPAAKMLWGTEWPCGRREPVFSVAGDLRAVSEVSPCFIPVSVCEPMAGRALRVLCEGAGSCALRGSAGVPPLWELCWVYSVPFVYFFLEWRFGAVEVAGGEGTLSVYVGAKGCWVRLAA

SEQ ID NO: 992683 - protein, 245 aa, Homo sapiens
SARRDLSFPRLALLAVSSKVVTFITNPSFEPVLTELFTGTGLVWLAALVLLLVRSHPGSGTFNPQLISAVSSLVSPLFTTQYRNDAVLPFSESHGLAGLGSDNASHSTPVLASPCSPLAILIVYGLILGNTLGIPRWERQLARPSGSQDPLYAPPCHKDIEYDTSGWSDSSWIVRLNATDGTVVRTKQRRVVSLEESPSRRNSDCCHSVQCSGDEESDINAQMAIDFARVPSLKQPEEAVLKTVA

SEQ ID NO: 992684 - protein, 262 aa, Homo sapiens
MQSGAADRCSLLWLRDRGGPGMRTGGWYAVKFKWGDAKESSKVKTLDEMLHEKKRKKETGGENRDPMLKKNSDDLDTIGRSNCLVGGESSDRSPALVESTYQGYLRLYYAHEKDSMEDAEERENDPLASKTRQECVGKGQSSIDSKFDELRRANRSHLYHAPEGGSPATVKRKKELRRTNDENGIAKTRIGASPCEWATTEARLGDGTGQHSEYENRYPLVPMLPREAGPRSPNLGRQKTGPGWSGMKRKRAEGRGKKGVRR

SEQ ID NO: 992685 - protein, 103 aa, Homo sapiens
QHSTFSISGTKRDQYNSPLRNHPPYIQSIRSSLHNLYYIKSKIRPSAYTISSLLSLMTLTLFSPDLLGDPDNYTLAKPLNTPRPHQARMIFPYSATQFSGSVA

SEQ ID NO: 992686 - protein, 167 aa, Homo sapiens
MCGNSGTQQGRSTQRAIDHQHVGGNRRREETRPTNMARRRQTTREPGAQRRDLNHVAPHRETLLEDEKNPEGGQRPLTTGPTGRTHSAPRAPRVREGNTKHTRVTKTTSHTTHKRRRQRGRDTPRDLTEDDMTTRDNHEPPEDSPGRNRSNNSMQQREQKRDDTKHN

SEQ ID NO: 992687 - protein, 149 aa, Homo sapiens
MPASDYDIELIRLTVQYLLSTNKSLLPSHVNARHMSRSAHKERLNKVPGYSENLWTPSLLVPKISPLASPVLRGQPAAQVIHMLNGTRYPILVTEVDYNSLVPLHRDLYEWLHEGSAVPLTLNLSEIDLADARGGTLTAEEDEKTLWSL

SEQ ID NO: 992688 - protein, 70 aa, Homo sapiens
HYTLRYLYFIAIPTGVRSIWLDLLTPQVTKTSISMKMVSRLTLDSLNTCYSSVLFVGYRLAGIVSFHILI

SEQ ID NO: 992689 - protein, 368 aa, Homo sapiens
REEVPRRSGLSDGAQGMCFYYSAETGMEVPQLPRAGALAGSAPWTLITFDFRIVASMHDDAEMNNELGSGSAAYGYPSNRKVRGDTALNMKHQAACPVGPSSWRPIRCESESQDELRRVTETITRGNRRIRELSPQIGVWTTTRAMFFLERTNVCIRALKQPFEHCLKEAGSSIMWTLPQGTWMGGRVTWLDTALRMRASQADPAKLPHDDDYSDSMHPSSGLQTLPAAWWSRESLRSNVCETTIVSLWCKSSSVVDPDRGSIQGNAVHAVWCRGMVRESAGWMGKRLMGRYCGATLEGGWSPRYVGEAQVENGLVMKRSNKHNTGGRREGPPGRRIGPFVEEAVDHEWFDDGKGYPVRGRESTLWPL

SEQ ID NO: 992690 - protein, 138 aa, Homo sapiens
FSSLPYHIYPFIFPLHKVVYLSLYILVNIWYNLPFTDGDFLCPPRFLQTILLSGFEHHHTDHHMFFDYNYRTISSLLWDRIGAPLFNQILHAFEVEGTAQLCEGDASEGTYAQVVHSRQYGCNNDRLFNGRVSRMTVI

SEQ ID NO: 992691 - protein, 64 aa, Homo sapiens
MATYSCTYLEAPPSNINIKLPSTAYHLHNSNSTEYLEIAGALIQAYVFTLLVSSTCRKQIYIHH

SEQ ID NO: 992692 - protein, 186 aa, Homo sapiens
MPGLLIPEMKETYLERLRAAPEQGISDQLNLGSWTPVTCVLPVLTPPDHVLSDLCSPVGMPREHGSRFAHLFAAGGFHAPMDFVAAYTRPHQSAVTCPHTGCAAPTPAPLPGACANPLAMSPSLCSVQRLSVAQSTCQSPAAQDGQMVHHDCQIVLPIARHYPLSGTVLHAPSQRHTVSSLCPRWL

SEQ ID NO: 992693 - protein, 111 aa, Homo sapiens
MVQWTYYAGNCLASAIVERWCRNSPEVLWSTRNASARNPRVVTVCAVKPQWSLGAHDYGDKYSGQRIIRKGTSPLHLGTTTNENSHFYVCCRGGRLAPFGVAGPIVTHTKL

SEQ ID NO: 992694 - protein, 83 aa, Homo sapiens
MHITYCISHKHRKQMSPEPYNSEYGAPNVCFGRNHPDGNITYIETSILILSGRLHSILRPRTAEDYLPLFCEDTEENLFVLKT

SEQ ID NO: 992695 - protein, 311 aa, Homo sapiens
TFVKPAFEEFCRGDKEVCRCDSSHEAVDNMVAIRRVIVAAHPGHSEIGDICIDVHRRRVQCGGCYNADRFLSRGITVGCMTSGKRSHLESSSGPTEGLSSLEGKVVPARGNVCSGTEPGDAQTQTHCFLSGQRQGSVSSEAFLTQEWKLRCVTQTQLAGTLTGVPEVFSHLGSLRFKDPSRSLRNATECAGSLGGFCEECEAHYRAQIEETAKTLAGLMFVDSEPTVGREFFQSDAGSYTLTHITQTVCEQVSSLFTCYMVSGFRVLVHNQGVVWAYKLIMTSGCVTVANDIGTCGVSPVCQGDQASVTAY

SEQ ID NO: 992696 - protein, 329 aa, Homo sapiens
MPSGWHPWPRCWPEAWLVSLSVNWREEDFRGRSPPLGIHATMRSTTSCWILPAVARVCRADRWRSPGQAHSSSGASACAWQGSMQLSPVGTALTCPCLSSGIGLLHGALSARRRMKTWCRDALEEKPGASELAPDLTAWAHPMPEHCSPVCRVTGVRDIPLMKHIQQVVLRGCNGSGSKVPKLSSEAGCIMMHEVHTLSGKSRMRKNGQYWSRAVLDSACTEQRLRADSFLVGQEDGRSLRGALCLTAEPVGFGTVWGPPGRVIAGNQGAAHKWDVLNKKGRREISGRDGTLKGARDNRRAHSGKQMNPREPQHRRYGVQTTGHWETNS

SEQ ID NO: 992697 - protein, 224 aa, Homo sapiens
MAIKKHMRPQKKPTRTAPITHSHNGLNRRSENTTTPTRETRPTYEQTGDKKWQKRPPNKKKRQHAENEKQSPTGTQRTHTENTKQQEKNTATTGHQTHKKKRERGTQTQARQAAQTAASDEDSSRTQHEHRRTNTDKTVTQIKGTNNREYGTAKNHTTRSSRNEKHQHDRRQAETHTTRHQRKKHNQKPKRPHDAGTTEGTTHKRTTQRTAQEITDMRKTDTPK

SEQ ID NO: 992698 - protein, 159 aa, Homo sapiens
MAGWDPVHVILKTGGPFKALIAAQYSGAQVRVLSASNPTFHFGLNQPHPCNFSCEFPAGQGPYAFDEVMMDSVCSESNVHGLLCEQSTELSGKYSTSARSSQVCAVGVRLLADFPESKWPSQAPVILGVFPQPVRAVMSTTRENTVALRNCRREEVKAE

SEQ ID NO: 992699 - protein, 170 aa, Homo sapiens
MASCSITCATIRGFTLCVNSGLSSWSYTEYVYDISRPSVSDVPFGYAPLELHPITIEESTLAQRKSSDNRSTSITVSPNEFSPILLKKTLTRLKIVGNTTPLSNFKCYQCMGSIRPCFWRFIEESWASPRIQIFEFLRKPVLRPNGYIRPVGNLAGEYIIALMGTAVAVA

SEQ ID NO: 992700 - protein, 75 aa, Homo sapiens
ENTTGLNSGNSYKSQMADTEMTRIDRHLLVCVVMARTHIVNKHHHWLTGRSQQDGCDFNSMDINEMTLTHTKRSW

SEQ ID NO: 992701 - protein, 134 aa, Homo sapiens
RPTSSFLSGMKAPPRRTSVPRTRVSWCEVTWSRLSLGGSSRYCGMLDATPAEREHVASARASDVTPEHGPESLLCGPEYADGLDDPGVFTPGSSNGPEEPWEAIHEMCIPGGLQGTKAARECTAPMPTIAGLGL

SEQ ID NO: 992702 - protein, 245 aa, Homo sapiens
AKNLMYLKQILYLLDEIRGCARGGTLVQNPNTQSLSQTGMELRTTINDFLFQSQIIDINLSKVQRYCETSMISRKLFWLHRELVRSSVLIPGSRPKRGVGFSNSLQSLQPRTTESVLQCSADESQARRSRNQLPQLMHIEGFLADLTTANQDGRVILSRQGQSQSEHPEDFCSVNSSCDTLPHVVKEMPGSGHCRGEPCSRCPDFRAELLGCAGVEAERVVEVFLCVFTDTWISSSALPGLQVLN

SEQ ID NO: 992703 - protein, 395 aa, Homo sapiens
MGGTRGTHEKRKKDKRQQNARTGQSNTRQHKERQKKGENTRNDDQRTRKERQNTEEREKKRTEKKHRQENTNKEKHRQRKANGEINETKTQTAEEKKRSTAQENEHNDKKKKKKQKRDDTHNNIKPDNTKKTPRHDRTETENTEQTRSTERTTRGGARQNRKKRMKERERRTRQPTTEQKRESRRTNQQSNKRASEHTKSNTRDEDEQKKERGERKTDREERETREAEEEEKAAGRGREEKAEGRERNERRKRERGERERRDSSKEKREKTKRTRQSRSTRKSEEKEAERRQGENRRREGRREQRESNTEQTEEKEQKRGETKAGNRQQRQTGQHKKEEQRSKKARQKRRRRGRREGRNKRDERKASKEKEEKGVSAKNAKQERETEEKPDETDH

SEQ ID NO: 992704 - protein, 78 aa, Homo sapiens
NCLHLLARVYVQVELTNPFKYGIDLYGVRCSTKYTYETKNDLGYVDDSMKLPRYGSQSIQGTYRVLCVMGMYKYDNDR

SEQ ID NO: 992705 - protein, 51 aa, Homo sapiens
MVFCFKADFLCHGAGRLVITPRATPRSPHGKINPRFIKKHYGEHPLAQAKR

SEQ ID NO: 992706 - protein, 227 aa, Homo sapiens
MTDVQVSASVTSMMTQVLRLQPTQRTDSNYVVPAQKSAIRFPGPFTMLACNRKFRRPRLYASRTSGLTKANHHCTRAVMKNNRSLTHIDRRTRVSLVPRYSSARYLNYLVVHDIPPVIEPEEDLRNIGGWAKDPLEGQGGLLRVFAQSAVNTAPWAMLTWTRLPGQKPPVSLIFHSGDAEGGEPWQRYQQEPWAMTDEEKEGRAIIHQEGKPGSTREGHVKEAAAKY

SEQ ID NO: 992707 - protein, 66 aa, Homo sapiens
GGERGWRTYLPELMAESDSLDPSFISHWPCGLVIPRNRNSFKEGEGTGRRNTYIDVVINKNMKLGR

SEQ ID NO: 992708 - protein, 122 aa, Homo sapiens
RSVRHVKIDHLHVGWYQSTYYGSFRYPGTPGLFRFSLPACHMQGICRLSFSDPINNMSQGISLTRGYTDVTSYTEWKCVNEIGLFPAWKSLIRSKYQYFDDTMFVDEDVRIVIKRFTFDQLS

SEQ ID NO: 992709 - protein, 249 aa, Homo sapiens
MKLNGAVLEGETDDGRYSTIFELCSSDVLDTYRAHDSAWEWSQRAADHATCLECKLAKSEHEITGLEQTVIRLGESEVSRYKESDWLTNAEYPEDDILRQRRGGNSMESSARVIGERAEELEVSNGQLVKRLEQMKASRSALWSHAVEFRALIRHPGWVQLDEPCFRVALSLSCVGAAVSSPGFRETKTVASLALRGSRAMAHPRSPSGPPGASVCRALAGLAADAQNCRYFISTPGPRGSSVSDRTEL

SEQ ID NO: 992710 - protein, 104 aa, Homo sapiens
MMDIMEEDNKKAGPSVKYYEVKRQDAEGEEDEAMRMNDEDEACSELAEWKEEVGLSYLMKEDIQDEEDDDDYVEEGEEEEEEEEGGLRGEKRKRDAEDDGEERR

SEQ ID NO: 992711 - protein, 111 aa, Homo sapiens
MEVKPDARFAPEPRSPGRRQSACRGGGGPVIHKEPEQLRKLCIGGLSFETYRWIVYSNDCGENGAHSQMVLGNERAPETKRLPGCCWCIVTLCLVLKSVDAGNVCIELQQG

SEQ ID NO: 992712 - protein, 221 aa, Homo sapiens
MVAYDVKTSLDLDDMVPCLLLGLSDLRVTWAVVFIHNCKTRPLCFHYSLPFVGIPTPISIIITIPHTSPLTVCLTHSLMLCSSSCFIPLKRDSGQIPLLRSHGCPYPPWKRLRRGLFFVMCRRSCCRHFWGLEMVEPWFSTNPWSKPPDRCLPACGSCVAGGARDLLVGHTDSWNFAGVGYAPHLGATGVLPRAGRGVAARGTRWPRDRGYLEGPPCGPRR

SEQ ID NO: 992713 - protein, 286 aa, Homo sapiens
MTHTECLMYLYSPSLSPPPPYLTSWASSGTVLGVPGVLCQSMTITIHKLTPNPETSAFPQRHINASIRYHEGNVCPLVLSSPLCTVTAAPIGDTDGEEMVGVRHPLGVIRQRGCRLVTVSLSGSIAPRMLQSVREHGRLLVVSASGTFGLFGPEITRSCAQVLERKWCELGALMQTLCLREYRVRSSSSADIPLFGSVTGVVPAQSWVRWGVLGSLQIVRVFTDVVLVKFCMVFIGRVIQPVPVALQDRWGLRLACPCAPPGSRCDFLRFQRPPVAPTAGGGAAPP

SEQ ID NO: 992714 - protein, 345 aa, Homo sapiens
TRGSRTRVVEPRVRKCNSLGRAVPRSTESNEQYKVIACASLLTAEELSNIDPAIEEGPRGTCSEVQAESCMELASRMENERTKGSNHGAKISSHNAEGRRVNGSVTIRDKFTRESSLTCQTQAQKSDNSPASRGPYEMQVEKLHKKTCRRWWLDLGVTTSYTSFRYRIVTNSNAYGISSGKGARKPEDMSRGRTDQTNIPDAVQRENTQTRDQWIHQQAKQRQTAETAQTQDPDAIRKETGEKNKTEGKKDNKTLTKQGTNAGKDTKSRKNHAHQGQQKREQAPHTADRTEDTQEIETKGARTAKRRQQAKTTQSPLTPEEQGQKTDDPGRTQSRTKNSTSSAKT

SEQ ID NO: 992715 - protein, 202 aa, Homo sapiens
MHGRESDGSEIIITCWEKAPSREGKVTILWAAAESVFSQKAGKCKELRSPIRSKGGTMLGYRVGPRSIQACCQGMIANGCYTMTLYVLRLGWLLNQRTGVSPLVRTTTQRGRGHKIFPRGQHNSDEMWSKRGPRRRATSTKEARFKQRGQKETETGGNHTGGTTNKNEETATTCHEHNERTLITETEIRQQRQTTDNAQMST

SEQ ID NO: 992716 - protein, 231 aa, Homo sapiens
WKRSQCHPGWKCSGTISAHCNLRPWVSSNSPASASRVAGITSARHQAQLIFGVFSRDRVPPLLARRGPRTSRPRLTPPASASQRAGITGVNHLALPRPHFSLFFENGVLLWFTQAGVAVAQILAHCNLMPPVGSSCSPYSASHVAGITGVRKPRPADISSLVRGGFHHCGQADLELLTSGSSPRHSSLPKSLGLRGVTPLAPGQPPFFKPGHVVSRVGVSFPRDKPVGTFL

SEQ ID NO: 992717 - protein, 177 aa, Homo sapiens
METPRSCAAKWKPIRRRNPMPNLLTTGAAGHADRPQEHLRALELFVPSNCVPTRRSCQTMRTASSPSWHCLELCDGHTNAARQDALHRRATDTLALKNPASLIHERRPCKTSSTPCPTACEQPTRAIAYRGAPPHGIDTERLTARRLETGTELPPPRPTTTTPAHHHRRQPQGTPSL

SEQ ID NO: 992718 - protein, 188 aa, Homo sapiens
MTLWRKFNLIWTYIHTVLLLADLKEDLQERSVNLDLHGLRRFHRGRNFRFEQLANNGPLIFDRRVGQSVHEALAIPGPRPTWMAQGDRSGAVVGTMYHSRIGTRVAFYTRNRETLKCHVNHFTRNVGAGSPTGNPRAREPEAIVGGRGCDTANCVTRVDIRPLSHRDDHCTDGLNPALDTPHGPSIMG

SEQ ID NO: 992719 - protein, 235 aa, Homo sapiens
SGPTFISFKKEIITPLGEKIVDTRVPEFPICVCSTGGHKTVPPYSGGNVPFRGRPKGVLWGPKGGVQVVKPCEKWRNTEKRAVTQSGGTYSSQLSVRCAHKTLPEFLTEFINNGGSLLCRLHKVGENRGPWQRGEVLSSHLYSAGQNTVGKGYRLNTIYTSVRLAPTRGCRGAAINNHTTLYHKEVPGENTLKETRDGAPKEHVGDNATKRGGGDNNRGITELAVRVRTNPGHNP

SEQ ID NO: 992720 - protein, 293 aa, Homo sapiens
PRSLGKSCEKYRHLNQKEDVAYAVNSWDHKLFSGYCVLKAGKSMLQLSVASMVDPDGAVSSGNLVTFVLYQMRYNQAVEVRALHLTQSQKAVGSSEKIFEYLDLDPSLATLGVCRLPYSWRAVVQFQDVSLAQPKRPDVYVLQGLTFTLRPGEVTALVGPNGSGKSTVAALLQNLYQPTGGQLLWDGKPLPQYEHLVSAQSRWLQWDKSHRYTDRRSFTNTHGYGLSQKANYGGHPGCCRKGCGTIGPISGTPSGAMTQTVTKGWEASSKETREKEKAYGPRHGTREPGRTYT

SEQ ID NO: 992721 - protein, 112 aa, Homo sapiens
MATFSHSYIQEITINQIAKSKWTFPKGTGWEDPCRNKGTPYQDRTANTQINGRQTRYHKEKGKPNKIKAGGGTKRRGREAQKSKEERTSRTRQKRRTETQGETRNRKGRKDE

SEQ ID NO: 992722 - protein, 113 aa, Homo sapiens
MSRVYQFMKPDRANRSNLTKPFAALASPGCLARLRLELVPVAAAEADRRFLSQGGRHVGPVKVTRGGRVLRLPWDIGYRRLGGAASGGTVFGRFPEEAGDKAPVGGPRLFLNS

SEQ ID NO: 992723 - protein, 116 aa, Homo sapiens
MSSLTFDRRMMWVYGKELLTKEFSSNNLIEREGHMLRKLMKLQRPNEVVRNLPSVISDETLGTCDDWRERAELRWTVHLHLECCIVTQSLLEAAQNWPLIQDDPHLCDFIENTLPE

SEQ ID NO: 992724 - protein, 283 aa, Homo sapiens
RFRDADSASCMQVPRVLGSSVAGLRAARARLTFPAVPEAWHPGLCTRTYRAVSACSAGSERRQGLLRSLGHLPLVAVSLLASACTTDEETNAFVEFTMTDEIKEERQTYRKHKTLPKMSGGWELELNGTEAKLVRKVAGAKNHWSLSTLTSSIPPTFDGEEEPSQGQKVEEQEPELTSTPNFVVEVIKNDDGKKALVLDCQLSRGLRLDKKTRLRVTSFSIREVSFQRHWGRRSEWKDTNYTLKHRIPWTVPYMTHLNGFPLPTEGVDHPFADDLVELRQAWT

SEQ ID NO: 992725 - protein, 183 aa, Homo sapiens
MDHTWRDYAFKQKMATPTPLPSINSRVYTLKIMAYSLPLNSPVRPFLLLGTMLAVANTSSLDINGRILRLNRVPGSQKLTQEKAIFTPGVAVFRFPNALEPGHLQWRGPYKGFRDVANTLHNFVEAHHIETTPPVYPEGHQHINTEPPYLDSFTRKIPSQSLHVVHAEKVIALRLSGRKQPRA

SEQ ID NO: 992726 - protein, 114 aa, Homo sapiens
STPNQVWNIGRPSLPGPEVNHGSHTSMYKARVPWRSSLLIQRFKFGSLMTIRPVTSVRRTRAQLLRKSHPHGHKCIRDALLFLQPEVHMRLLLPVPLCPRSSWVSMTCGLSNGA

SEQ ID NO: 992727 - protein, 286 aa, Homo sapiens
VGVVVVCIDWLVKRFVLDAYYCTLEPGPLGEMSFILHRSNQSTTPNVSRKQDPSSLQVDYVVVCEHIAYSIALDLDNLENSHKRVEDNLGDSLVALGCPHYSLIRAAICMRLHYCDGSPFVDYLSCVTSVCAPLRGARSRVGSLHGQSMSELVMWGEHVDFQGFGPGQWREVALAGQGSLNVKNFGMRMAYPTNAKAPNWATKHGVFVRKGSAWAGSNCHFRRATAVGSPRAPAYGLGSGGQCFPPVRSISILGLTRVRPGPRGGVPEDSGISSRIVRIGRVVGAS

SEQ ID NO: 992728 - protein, 195 aa, Homo sapiens
MVVLARAPVALTSRVRGMAVLAMLQFVRAGARAWLRPTGSQGLISLAERGMRVLTDEPGWQCGRSEGSPGARAAQSRAPRYPTHRLPSAGLGRVLAWASSQELLWACATCIPDVFATAPRLDISVPGSYVAEELQMRISYAKDQEESQMCGAVAGSLGAGKGTEGGRDRNIRVFGSGKEKVLPNAPGGPQFYYIW

SEQ ID NO: 992729 - protein, 256 aa, Homo sapiens
MAEVGEISSRAADYPCCGVEPGTTRDEWPLGEILSVKDISWPDSIFYVHYIDFRTIRSGVNVVTHERRGPKEDPVAPGKRPENPLLMNGLPGSSSLALQRERCHGKVVGWFLPATPSAQQMTDPGLRSSSPENGMLGPVGLVACLETGSECEPSEWFRAERDEDSQDHVCCIGILTVQVSNAMYVGRGLADLDRKPTSEHAYYLGNERTLECFELGAGSRPQGRGGSVAPLVTRRRLDQIALLLLTVGEFWLKYGA

SEQ ID NO: 992730 - protein, 138 aa, Homo sapiens
MTPNAPELVRLLNQTSAKSNTRKLAYYVQFRCQLSLEHTESIVDPYGTNETQVSIAQSSTYQADTGFYEPTQCSRSRDDHRLDDRPALLQMDCGMRIHSGPYQGPLRCTSDALKNSASESQGSVSSSATFDKFRRADT

SEQ ID NO: 992731 - protein, 589 aa, Homo sapiens
MCSYHTFTQQIQTQKHHVAHVAGQYISHTHLLPRIDNTRWGVFAREQHSHMGPRWDHPHGGTSCCGYISAAHAGRHISFEESCVIYNTGAHIRGVVYISSPPVDTPLKENISHTLYVREICEANNHTHVFDDESRKRQKHNGARMTRSVLAHHTKHHNTDKRRHPVGVRSCTTNMLSDDDHAAQRGGDAPNYSTNNPNRDGSKMATGQPHSASSYSSTTYRAQIERPHAPNNIWRGTQTAAGDNTPLILHQPNTTDRTQTNYGRRAETTRAANNKDGNENTPHRQRRSGGTPTAAVTKNRATILNHDREHTQALGVPPPTRGGGAPPHKIREETTAPRDVRRRQPPIEPPAWSTTGQPNYTQHRLRTARHSMAATTTTRVAHTTDSRGTTTHYEMMKESSETPHHYQTHGETGDGDPKTMEDDRRRHTRSIRQRRNTIQNDQQREGGNPHSNSTRYRRGRNYELGGYNPNKTRSTANSHSRAGRSRTDIIETRPDARRSRRHKYRHHIYLTGAAAAHIKTLSTAQHHDRPTDTDRQPSRPSPASISKRYVIARTIIRRPTNKLPNAIQDNKHDKTKPRRTLSDHKDTQQ

SEQ ID NO: 992732 - protein, 216 aa, Homo sapiens
RDAWVDPRVRAWGLVLCLVPPAAPCRLPWTLLPLPGAAGGEMPLTSPVTACPACAMVCSLACGCCSAALCLLASWPLVARAGYSEERCSWRGSGLTQEPWQRGAAGPGLCWRARLSGCTLAGALLPDPGRARSQSAAGIACLRPVRPFAGAQVFAELRSGGALELLLAEGPGPAGVPVAVRWGPTRAAGPYYLQGTPKPGHSDSRVDSFRFELARG

SEQ ID NO: 992733 - protein, 88 aa, Homo sapiens
VAYGGTVLMSIDAFRYGCLTQGGPYLYTLKSERRRHYRESSESDIRYVGVIRVQLRLVLFTVHRDVGGWYRNNQEILRLEQQIFVCRP

SEQ ID NO: 992734 - protein, 120 aa, Homo sapiens
QELVILHHLDQPIGSYFSRSRAVDESGDIVATCSLLVPGMTKGLTMLHWWDSSTGGEPFGGTVLAKGWLQNEASVYSDIDLKKLAEMRRANPRILRQNADQTSSAVEMKKALKFMYLMCH

SEQ ID NO: 992735 - protein, 493 aa, Homo sapiens
MTNSIETENQRDSKRTTRGPSDNSEKSPRGAEQRGETESGTDTKNDREMTSNADRTDATEQDRTPKKQKPRERRNSTKERHNEEKVNKKEEAQHDREEKQERKDKSTTQEQTSTDPGGQRHNRSENEKLENGGHMMYGDHAQGSNHGEEIEYNDAGQDTRGPITIEEEGTQARSPEHRTSRIVSQHDNRENTVDRGRNEESEVQRVVRGREREIRTYDRENRRERQQEQLDIVRETAEAPGRGQREHTNNEQNDARRDDKETWRDTSNRSERARSKGQQRRHSNRTDTQATPNEIEHKKHTMERSRYPQNRKPTKHRNKRAQARRQEHNTTKRELQKKRPRVEKNYTRMEHNKIVRTKRREDAEKNKKPTQKQHRAKRTTRKNTRKAEKEDEGRRAEREQTRTNKGARERRESSDKTAEIDPQAEMHEQTRRNTSRAYKATTKSKSEDKKTGGNIDKRLRQEQETECKRAEKTDRREERRKRDRNTDVAHTSK

SEQ ID NO: 992736 - protein, 547 aa, Homo sapiens
RTRGLENDVQKWAPRKGKEEEGMKRVIETIGPQDELKETNGNSDGLLNIIVLVLSTDHLVGPIVMVTRYLDKESRSAAVTWLGMDWLRGRADDSEVLHHECLLMSDSTAGMCAAARLTMVRMGICTGPYQHQISLGPNSVRTDMARTISLVDTLRRPLDSRSLHGGLFGPVSEVNDRIRAGKLTGMSSPLYPARVNQPTSAEEAGRVEHSSESARSLREARQLPPRIYIPCCQIRLDRFHVRDLGKARIHREIHTQGGCARAELTKERKRTPTPEGGGTPKGARAAGKTPQGHLPVCPKNRGAPPTRWGKLGDPIKVKKGQESGHASGSTDNGSGEQRGVTNGGKHVGRTTYGEKKGKPPYTCPSRRGATHNTLGDVRHTPPSSEQILQEPRLGGRKLEKASKKGGSTHRRLLKQVKRRQTIILAHTRRKLWVFTTQTTTTIGPNSNYTEQTRRESHNNTRRTNELAKRRQTQRRNKTSGRGRNHTKDSDKAKRRRAGEERHTTKQTQDQHNRTREKLETRQQETAHDGQKRGHEHNSPRDAQAKRE

SEQ ID NO: 992737 - protein, 247 aa, Homo sapiens
MGVDRTQFSAGAEVRGNHGEYVEYPQWDKVTSIESVLQANVVPFSVSLRDLEKDVQWPFSDIEGGAHFCESASLRGAIGIVDIPSWATIDIPSFKRGATIKGQSGSSKDIKISAGLKKSILVLKIAYTGVDAPWTRTLKHSSEGWQRTRWNFGTLGSKGWTRVMGPPKISGEVLATRHQARDTPEGNPQRAGKGIEHGQMRDLGRTGQENETLNRMPYRREIQGDRAAKQGENIKGGARQQKVGEHT

SEQ ID NO: 992738 - protein, 225 aa, Homo sapiens
MSKADAVWKHRTPFGMNAFLAEDIFPTCGIGLTPGVHSPIGIYFSFVGSRNNSWGGPDMGANYSWGAQQCVEKRTTVDIVVVGTKHNTRVTSTDYYGRKKVGRWNPSKNYRECSGVETKGGPKCGGSSPPGVATHAGEVFPPEKNGETCNDVAPLRRKGGRRQPRDGSHNTTGQLMRRHKKTNDTRHIAMKQQRGGPQQTAKVNNKRAEKIHRTRIDRYNMNTHN

SEQ ID NO: 992739 - protein, 217 aa, Homo sapiens
GGFQNRVGVQRWSEATTDEVFNVQSECGGYYAMNQYGGNNRTGNNIQLLTYQRLATTGAPQQIMLAMLLLGHPTTSSHHPFSAPVTTLSYMACIENPPRGHAPTIITVTFPVLNAPNILATPTVKHATALHSRCYSLSTLTNHGEGYIQGLHSPTVSISTNICLSTSVELIVRITMPRPPYYYRSQRLEIDFSDLTEVLVDFPKVLYTLYSGKKAYE

SEQ ID NO: 992740 - protein, 107 aa, Homo sapiens
MDQGRGAAQMDLILGWLRQEKQCERGITDINQKLLTHIILGYGRSRHSVTRERQQIAEIDKQTTETFQTDWQTTDSHCLNKAMRRMKIITSIQGMGTMETQSFLIQD

SEQ ID NO: 992741 - protein, 136 aa, Homo sapiens
RVGWRCISEMKFAMRWYNRCDSGNSGAAREHCGSPKRNYWRKCMMKNYTILKGVTDNIHDQERDSGAEMKRLNELERSLAGSQDNQFRWSQYSKSRVCNRPYGGHKGWQLLPPRQAASRRLKLNYMQVQMHEHKTS

SEQ ID NO: 992742 - protein, 58 aa, Homo sapiens
MGLHRTQQITVPKGLPHATYKQAEISMCDPLSRHLVHNYKTHFGDTKCGQCHLGSRTI

SEQ ID NO: 992743 - protein, 257 aa, Homo sapiens
TEDPGVAMGRCPGRCYRCMVRTSRTQSLAICRGVPDAKDSAFLRLGSEKQCKKWMSFRLCGHMVSDEYEQLSSEALVGCAEIMLAKEVTVVKSCGKDGFHIRVRLHRFHVIRINKMYPVLGLTGLQTGMRGAFGKSQALWPGFQLYGPSYQCRIRTKLQEQGACGLRPCAGPQFKFPGRQKMHISTEVGLHPEFNACMNLRDMVAEKRLIPDGVGSSASPSAWPLGRVAGRISCTAAKCCCPLFILMHSCYCGSKKK

SEQ ID NO: 992744 - protein, 252 aa, Homo sapiens
GGHLSDLYSRGCQQDSTAKLWLLEEADAIFLGLALWLVCYCWLQPTLLLWRPNPEQSGQDPESTYLSRGIQLPQTLLYVTEPLIPKVKADGVASPVEGTKVNGVLLKAVIMTQAQREDARVTCWAGRQARGVNPKRIGVCGSPLHLQQRVGDAFCWGRGIHGYGAEVGAPGTAFREFTVNTMRRASALQDQTSPNYVQKTLLGRKRRTTLYFYPACAPVLAVCPKRFSSLPGHSKMIGIGGFPTPLGCPNLG

SEQ ID NO: 992745 - protein, 342 aa, Homo sapiens
MEAQLCVVYGQCVMCWWNNSLQYPLSFVAHVDLGSALTVDRLNDKSLGSIETEDMGDEEVAPGVMCARGLVPTESENLYARHNIIPALQLFYNYSCRTMVHADRGKWWNLIASCPCISRLNQSVCEHLHVYPSVACRLGFASYEALVPLLETETTSLYGWQEAPRHSVYHSPEPGPMFPNAESADIRSVEPLKTEQFGIILAIVELERPSGLLALWAAPPLLRYLTRLADLELGEGIGRNHRHAGPRRRNAQSNAYMTGIGMGPSKLQARDAPDPQVQTEVRWPPCPRDQRGSLNPITGRNVNPEKEITGFYLEEREHDARTHSRGDKQHTTQEVHKRTKGH

SEQ ID NO: 992746 - protein, 337 aa, Homo sapiens
QRFWAMEDSAVEEPVPEVVPVQLETAKSPISRLEKLSDCLFEPEGNVCWLTDSTVEEHVLALVVDYVSCLKLGDRDQHGSLRRAGKDGGLVVTEGNVRIRRRPCLVAGVAQYGRRRTLMRRMTHPVDLSSVSSALLAGFTHRWSSRDEQKKQDVTLSLQCHYVRFSMQNNSVFGDLKSDEMELSLLSLRKIKTGAAVCAEPARAVCEGCCELQKKSGGTSSWTQIDRRGTPLGGSSHWNRQKLVPMTASDEAMVGKAYEKEHPWSGVKWMKPIRISWIAGSSREGKARRTGIPVWRSWGPPTGPAHYISFPETRAFLEAPISTRTHYLGKPPFACML

SEQ ID NO: 992747 - protein, 108 aa, Homo sapiens
TPLTGHAETNSELREMLPTDLRIDVGAYSLTSFKELGEDSGQNDLWMEKRQLASGEDDDDEDYQSTMLEEVSLLERYPSNEVHIAASWMYILSRRIRDHEESITREAG

SEQ ID NO: 992748 - protein, 234 aa, Homo sapiens
ENQELANSRMAQTVMKLQASNFRGLCGPMSASEVALRSLPEEVVRETGEYRMSAEAQFSLLYNDVSVEVKTQLERGSGPAACATIYVISRIGCEHYSSHMWIELSRDWGLQEVSYRQPEVISGWRHNAGPAYDKDVSACLRIEFEQESGRCQTDAWPGAHSKLVDDAPPDSVVFKIATETTMLKRVIAQRIHAETFEKYKLRFGKLRAQATGICPIPPRKLGSLEDSGSQWPEP

SEQ ID NO: 992749 - protein, 193 aa, Homo sapiens
LPATCETIYRARHQGESVLRCPGLRAGDGPPTHPPLASGEETSICPLAMSSALGNERFPVFVGACSSLSIPWSSVICAGIPLMTSLQLPSLIGVMVNHSATYDHVSANQRVSVVAEAKPSGIRGICLSRMEECETHRPWRLSIGSEDQGSIGYTLHVGVKSNIRACCGSVLRVSNRLAPQRAPTLTQAEDSGD

SEQ ID NO: 992750 - protein, 292 aa, Homo sapiens
MVNALPFSVTALYRRGGLTGGSPPLGGVWPETLRFVGARYTRPAIAPTSFEGGCPLCGFHCRCNPPPWRVPSVVLMVAPRISRSHCKAPCRRGAPFPFPTAFPHQRGGPLSEVRDTVRALGLDDTSTAESNAVGGYLLSFSKHVSGTLVTIHGYSCSPHERIKPTFTILVATLYENTSVVCIHPSGRNNGGREHTTQRGGALPTPREPRKTPAANCPPDTYTPCPPRGGSPRVLDHDATARPDAPQQTQWPPHEPYSADIPTHVGATRAGLQTTRTPTPDTPQPPDRTTPIP

SEQ ID NO: 992751 - protein, 153 aa, Homo sapiens
MCFGSEHPNAKHVVVLLNYPRNRAKGRPKRAWDIVPLKKGFLKPHMWALVPGGTPFFTPMCARNLHHKTSSNRNFLGGQLSPHALSSPHDTAEIHSFFSFTGSQPNILGFGTCVRPPVSGQLPINRGGLLTPGGLILGPGRLVPGINSPLDAS

SEQ ID NO: 992752 - protein, 400 aa, Homo sapiens
AGRQLAAAGSSRGALRLAVQGGHGIALQEQCRESQVANAGRRALCVGYLRILVIVTPGERRKQEMLKEMPLQDPRTQGGGLAQDPGIVLREPTLSARTSRARRRNVGLGGQNWTVLASEWRVPAGGHRETGFASDGRRTLDWAQESEAAFLLRGPSRRVRTEIAMPGLSWGPVSYPSGEHVSPKPGMTAEGPQGEAGPRREIGCGELKETINSCALQPEVSPAGRDHNNGVRERDGPERGARTGAVDRSEAQQKRMIRMGIVAKYGRSNERERNTGPRSEIRTENTTHDTAREQESRTQNTNQKPRSDEPDNEVEREEQRRKGKNNKRTERKREEKTDTHRNKKGMKNERKRRARKETGTENETRRIVEKERRREREDRRRKKREKRREKEKKEKETGRA

SEQ ID NO: 992753 - protein, 318 aa, Homo sapiens
MTESSSNSNTIIYMLSPPQKKKQRLGESDTEPSEYRSRWSHTTNLVIRESGELEFDPGAPGKWPWLVCLRRFNSVDTGRLPLRRNSHLEESITSTEESSEENVNFLGQTEAQYHLMLQHPGCSCVSSPSAGVCISQRETSGAGSMWTESACPIMYGQLLQTKIFQELVEGVFYIPNMGIVHRDLKPRKLFDFMARDQKEKEETIGQACTGHLQKEHRLDQTESGERTQATYVQSEDMSERYHRTGGATEYYAQTDMVRSGEGRQEKAARTNNEAPTVQQLKLAEDDRTQQGRPAHNRNRSTSKPYRGENTGKTHAKTT

SEQ ID NO: 992754 - protein, 427 aa, Homo sapiens
MRFKNTERRHTKTTDQWHEQQRRSRSTGHRHKQTTTETNRRKNNQKQHRQRKQHKRRQIHHEKKSNKKSETQRNKRHSEREEKEYKHDKRPNKNTDTYKRITQRQQDRKKRGQKDKRRKQTDREQEKKERKETGKTETKEKDTAKQEKRKEKAEKKEEKKSRREKKKGRRTRKRKTRKEEKGKKEREENRREQKTKKRENEKKERTERKDRETEKKKKRPESKRDSTEGEAERREREKTRKEHTRENKRRSKDEEREQARREDEEKEGKSEKARGDGKHQQEQPGKKQREKEGGREQVRGERQRARRQARRGDEREEQRTEREKKKRRKEKGRRRTRREQRTKEKQKKEKREQDEREGKTKRGQKRQRQGDTDKRREEGEEQNRGGREEKEVKRRSAGNGGRRRKRAEREEEKKRKKRREGGQGPDG

SEQ ID NO: 992755 - protein, 348 aa, Homo sapiens
NLEVEKYIVHKEFDDDTYDNDIALLQLKIGFVPLLPRRAAWCALCAFPRWTLQLSDWTECELSGYGKHEAFVLLSISVAVLKGGHMFRAVPIQAVWHIRQHLLNRNQSTDRTCCVLETLRRRRAPGQTCHDDLPRRLREGPLVCLEAMGRMTLVGIISWGLGCGQRDVPGVYTMRLPNYLERGFCDNMLTVSQESTRLLKSNEIPPLLSSEDHCTLAQVLLYWFLQTHKRKKRDENLRETEECISQILPFGSFRTRSDSGYSVGGESDAMALKNALPGRNGLHLLSKANSDVRTVEQDQKRVKEKTTWERGNKNLSKHAQGEEGIKSEIHREGEDTKERIHSYKSSGP

SEQ ID NO: 992756 - protein, 86 aa, Homo sapiens
QSENEPTVSDPSLVAVRVTSLRRYETIRNVSLTAQVLQGSPAQCPRHEQRDMRGGEFIHESHKHPQGDGREQISAIRGEYLRKVGQ

SEQ ID NO: 992757 - protein, 67 aa, Homo sapiens
GRVGDPLRPKYSQMGQTALLVSGIPKARSLVSALWEKLPLSSFGPRARYSGSSSKGPRSHFGYRCVC

SEQ ID NO: 992758 - protein, 69 aa, Homo sapiens
EKKEQWYVPKRAARTCSPIRCTKLCPMRAQGQGQLRKFVIRNIVEAAVSQGTFLKRASFDAYDASRSCM

SEQ ID NO: 992759 - protein, 113 aa, Homo sapiens
MSEDLVLVLRDFWDSFLASLSTEDGAPKDGKGDMSCSAFVSRRFVLVVRFSRLLTAPVYSQPGQLPFFGKVLRVTVEAGDGRTGGRRTGSYWSEGAEAKKTVRDHVLNGISKV

SEQ ID NO: 992760 - protein, 259 aa, Homo sapiens
HASGRAAGGDGVAAAARVGTGDPVHVMQTHAERPVPTLCLPERRAAVRCHSSLRAPIGCSVVLEGPRASPAAPCVLLWVTWAWHAPCGWALGSRRGDCTIDAAHSCPDECPAQPCAAATFSATTTYDGDSSPDGQTVRLTAGVIPPAIQCVHLDVLLMDIGNSEDQVQIHTYFKPPSCPRTIQVSDYEVHYNGTYLDGTLLDSSHNRMKTYDTYVENWWVIPGMDKGLLGMCVGEKGIITITLFWRMERMENGKKFRSG

SEQ ID NO: 992761 - protein, 554 aa, Homo sapiens
SKKPKKKEKKHKEKERDKEKKKEKEKKAEDLDFWLSTTHRRGDSPEQPRKQTKSDYENDNTRTERTSKGESATTRKQQKQRKQHYHSKYRTSTQIQTRHADNTTGTKHTQVRGQNNNRTAQHNKNTEKDNERNTHANHQTKNTTRTHKQKQKEHDRGREEKRQQKTRATETDKHREERKAQRGEDRRKNRGAQMTRARSADDDNSRRQRGSRARTDERYEGRQAQDTQNTESKNNNRQKAKENERTEAKDRQQQKEKTSSEAQTRKQKTTHRTRHRRTARPEYNNHQKRKQERDRQPPDGSPRKRQSDDADTPKQHEERPQQNERRHTRTDTNDEQQRRDRRAKTNKQETTHRKKEEEEGGEEDGRKGRRRSERKRDSKKGRKSERSQQETGTDERKERRRRRTERETRSKRRRSAEQAAASTDSATGGGNAEGRDADETRRKEAKRKQVTSQEHRQQEKRAKQQKREQSEEREREREHSTRAKGRQIDGESKLRKQEQDRERRQDKYERLTHAGDENNPDRGRQEQGPTNERGATRAKRDSRRTDAKKTKAKT

SEQ ID NO: 992762 - protein, 299 aa, Homo sapiens
MDTTSRPYRAITDITTARAEYPTLTPTYTITHATDTPTLTRRPLILGTTPLHQLGLHTLLCPQPTALSTKQLNQDHQLTQATPKQTPNKTRKPPTVQPITTIRETTYSTKSRTTTNITSERYATITAIQTHHSTQITYQAQMNQVDQASDTRLRIAPLRCNNQQTMSEDNETPLATFTTTSAKTCNTIHNSVDQHSMNTNAHTNIRSTHSQLTKCRYNPLGTIHISLPCNTRAHTTSATTTTEQSTKSQQHHPKMQHPSAHNHISTANTSNTHDTHTYPKKTPIQTTYLPHYPNTHNHQ

SEQ ID NO: 992763 - protein, 244 aa, Homo sapiens
KWRMTPVQRGGARGPWWPCGWVNRRVDFLLAWFRAVASGGRGSRPWTGPGAEAAELAEARPRVKEWMPVTKLGRLVKDDARSSPWRRSISFSLPIKAYREISVISILAGLSSTADDGFANDLLPTCRKQTPLPGPRRTQVSRAYCVLIRGLTNARTYGSLGVKVASKGRLAPPTIPWGPSSLCQATRIGPPLRRGLLGGNKIRQATTLFPFAQVTWPACVTPVHGYASFPCTPGALGIVSAPCA

SEQ ID NO: 992764 - protein, 324 aa, Homo sapiens
MARAGPRYWSEVSVDSRQIRRETAPGISVSQAGFMDHHFVETSLGRSTDERSVTRTNGDRIHTETYRLDYGFLDPFRVPLQQGHNTASQGKWSECTPHGAESCDPEIGARMTDIASLTDGKHVTDDRGSRCSSWRYHRCDPTEDDFTLGSKSPRTTSSFSNTFAQGFPRRYGGLIIRPSRVFANAQAKAYSAAPTRKFTRTRCHGPHGNNGEPTWIGAAIRAPMAAAAALQRKLPRLSSPVLGLCPTHEIPILLADFLLASGEIGHASIPRGIESLPLTEPILPAGDITLHCEARPGICADTEDPSWVNHVAFSNPLWCTKRSQ

SEQ ID NO: 992765 - protein, 281 aa, Homo sapiens
MKRSCLRSPLGRLQQGVWLDLTCIIFSTFFLEVKSRNEGMAHGGVDGYSQDIGEVKRGFPGCPGKSRMVLTSPLLCTGRNGNLCQGIATDDPPYQTIPVHWKVVSGGTIPGNRNWYGQKKGELVGGRTPPNVIPGLLADQEFPTHGGYNGLRGHQRPSCKSLRKHVETPTKKARNPGEPRRDTQPGRTRVPPSRDMVLKHTRAQQERGPHMDSARSKKDAQKPTYERSIQTKKPENTTRRGEESVRSKSGHIRQKTDDEYAHEQLLTEKKENDATQRGALS

SEQ ID NO: 992766 - protein, 146 aa, Homo sapiens
MFCILEFLYTGLDCRVVTGAGVVSYTSVTVVHCEGEHRLQSPSGEVNTCRTYKKINCFICHPECASVCTLDSGHDLHLQRDWRSLVNMGGVIRASHLLTPNSFVHGSRYTYLRVVYILLKSAQCIEPIRVSLGEGTEAGEPKTEQL

SEQ ID NO: 992767 - protein, 342 aa, Homo sapiens
MRKLFEKYGIGRAKFLFIRIQRIWRLSALEIPRTLAEIAKVELDNDATPWEKAGWRVRFAVRIRASLTVRNLPQYVSRANCWTESLCMCVAQVERAVSLSVDDRGKVLWKKGIVEFLREASMLGKLWTDAVRGLPSHGVTDISLVLLTVEPYGPGYMMKRDFQISGFKIASNVTWNDEHADPDLHSLGSFEYDYAMRWKDSFEMEKQQQDQVGRKDEEAREKLEMEMELRDEHQVMVNEKDLMEGPRRNFGRCRAAIQRVHKGRPLGAREAETDSARKECGGRDMLGPRTVRTSARKRAPGHAGGRRNKNPSVRPPRAQRRSDHTLRRGAATDDQNVTPIPD

SEQ ID NO: 992768 - protein, 99 aa, Homo sapiens
RPKPSRSGTMLLPNDPAHRYIRGVGKNAHLAKNLRQNQVLNIHLTVGDFELEKSDQSDIMDVLASTASPKKQCPERMQQMMAQILKDMGITEYEPMSYR

SEQ ID NO: 992769 - protein, 343 aa, Homo sapiens
PEPELSPSREGSEARAGPLAPAPPGSHSTPGPSQSSPHRAARESMEMRICAAEVLGSPPRPGGAALKPLVLLSGRGADPGSWRWCTHGVCMEMNELLRPMPERGKVHHWLAQRPSAAPTYVIVDFLTHRWVPNCKLPRGRLGLVIPCTVRESCLGHMSSALGAWCCAGRCHSFAATLSDGGHRFEYVATLTAEGYCCLRRPIWHYLESESGAVLKRGPVYPLWDYARARGASLAVREGTWSPCLRNGRARGKTSAVGRLFPGRGGHRCRRNSLGLSPGGYPKDRVPRIGGLRPERATAHNVPVGYDCTVEFAAILCAAGPLAPSDGMRTQDRLTNPEAIFVAK

SEQ ID NO: 992770 - protein, 281 aa, Homo sapiens
GFQEFSKRWSMAFPVSSIFLCILVLPPISSLWVRGRSDGGRAATLPLPVCLYCGLNPEQIIATPIPYLGMCEPFSLHFIPLCLCTCIIYIHIIYTTIQTLYKEGNASSLMADCCPLCECRDLVSVVSDNFSLAQLMMFYGYKTLVTSQKYNKSFHQKRMKSCRRYGHSSPGVTYYLLITALSLAMAGAPPTLEDPYTSAIRACPGLLIAPTRRLDMDPGVVLPTGMTHRPLGGLAHTRLASPHGGLIDLWGLISPPRARHARSPGHCSWSVQPIRSRSSYE

SEQ ID NO: 992771 - protein, 353 aa, Homo sapiens
MSLEDPFFVVRGEVQKAVNTARGLYQRWCELLQESAAVGREELDWTTNAAAEWPAQHSSWDLEDLEETTRYQWNANPGKFKLPAGDLQDRKVFVERMREAVQRNEATILRQPKQPLPSFAQTELTRETSSQGKPAAPEAHPSDLLDASSSSRAHISPTSHGSSQATQQLHHGMTQASNSWRTGLSGTHPGSEAHVRPRWSTQPGRSQGIMLRCLRPSRWTTPSLAWTAVSGKLAKVFHNDELTADSGCAIAEPAGVPPSISLYHLSLNPALPGQAGPHKPGKHQSTLGPSLPPKREEGPHAHTANDEGPQGETPEPSPNHAGTRNTAQNTQRAQRQSVDEAEHEHRPSQTPVD

SEQ ID NO: 992772 - protein, 112 aa, Homo sapiens
MPIWLQVATDAAELACSPKTPGSGVVMLSRAVLNRVAQSMLSYPWHSYWLPCRDEFDGRRTGVPGDGPVSPFPLRPCGSRKPCRCFLSGRPPVFLFRVGARGPSVGELLQGA

SEQ ID NO: 992773 - protein, 224 aa, Homo sapiens
MSISRTRKAEEPLNVDLCDRILRSLTGLNRALAFYSSAAGGDDGGAARTTTGLDKRTGKDKMQLANETHLTSPSPQAQVGVKLLLPSPIQSLDRRHRPSETEERNLEGALEECETGRKREPAQQIQGIPATGWQSVSDGSTERRSGVLGPVTAGLSISTLRNRFLLWAQRPAGRQTYTRYQTLELDQGVHYNRYLNGGGGASEIAHALCLTGEADPDMGPEPDA

SEQ ID NO: 992774 - protein, 228 aa, Homo sapiens
LRLDLAGAGPDYDYLMTILTELGYSFTTTADRIIVREIKEKLCYVALNFEQEMATAASTSSLETELRAAWRPWSVNTFGNCCGFLLPMRHLFHYFLFTGALDVLWHPQKLPSTPIMKCDVDDLGTVRTVYVHIGQVLSGGTTQCTLGNCRQCMQHAASLPMDTLAAMKDQGSLLLLHATKYSADGIGALHPVPRPVPPSSGCGSASKEYDESGPSIRPPHMLLVRTMT

SEQ ID NO: 992775 - protein, 144 aa, Homo sapiens
MGRIVPHAQTVAADPLERAGPITSAHVRTPGEAKETARQAATENTRGPTNTAGTPKTAKDGNRAHNTRHEQKTQRGKETTTDETINKQHQRATPPGDKNTRGRQTAHAAGDTQHATHSTAARTTQGECRQGRGPHGQQEQDRNA

SEQ ID NO: 992776 - protein, 316 aa, Homo sapiens
ESLPEAVRNVPGMHPKTCPVVLPPETRPSQAGLGPPSSPAPITEGYQSLSDRPPGSRVFTESEMRPLRHRNVATRVVGGVPRWCPRTRAPGLVRRSCVLWVVWELTSRCRTAAPGFQGAVNALVRVVNWYLPPPLLRLSLVTRTVGARSLGRPWVTKLVTDCSSSCKCKRTSLLPIPDNTEISSMEPSTVLVQYMGACPRLVRTVLLYVSRSPFVLHPSSPCVHLNETGEIGMALSDTGAPVHGAPMCAGAVIPLGLLGPRWAPHHVGFLPSDYSVAPVGLVTGDFGPWVAWFPWRYPMFWSAVPPRALVLPGHTV

SEQ ID NO: 992777 - protein, 73 aa, Homo sapiens
PGTRNPDLSPTRTPAPDSTAGPGIRPSPDLDQTDHGRTLINYADLFLRQLPSEWRPEMFYENKPTISMRYEIS

SEQ ID NO: 992778 - protein, 238 aa, Homo sapiens
DAWVHAVSCCANSGWKDLGVLVSFIHREEYSLYLIPFDGDLLSMESEGAFKECYLEGDQTSLYHCSQGGLMTLQALYGTIPQSLCGNSENALGTVANMHDRGGRESLHGSQNSISPVLDNLLLLDRNVDFITRPRVPAQADIWNGLIDDKFLASRTVYGEHYLQQKFAPIGNQGDGGQGPPRRKQHEAAAEFVQRSSMLRIPMMMNLQAAVGRLGAQAQKRNRSILWSAFDGKGGTMA

SEQ ID NO: 992779 - protein, 288 aa, Homo sapiens
MRRLSPSRVGMIRSADGSSRVREILAWRPHAGPCRPSAEKCAATGFVTRPGMLLRSVTVSTVTKTNGNEGTDDSLAARDADIPFSRCRSKLNLCHTCQHLLPISGGKGDEHERIPGGGLTCVYCHGYVGPKGVPKARGHKKAEKGRRMVHNGQRCGETGSLGPLGDETFSQAGEKCGGTPSSNLTVGENNDRGAYGGGAPQRQLVGANEGICPPDVFFRVRHAAREGTMTKDNDEYRDKRASEYTHPTNRESDAEQQRQNYAEDDIEDKEQERANSTRARRITRLPEA

SEQ ID NO: 992780 - protein, 269 aa, Homo sapiens
MDNYADLSDTELTTLLRRYNIPHGPVVGSICVVLYEKKIFGDDEDTRRAADFSCTAQTLSAVSIVHSHSLNVDVRCERGMLMCMYPSRVKDDGFESDSEVKGFTMIGHTNGSRSLLLATQRAYGEHRGSSRAVPGAECSASSDDVHFRRIVGSEYYSYNSGCMIEDSRVFFLKERGCWRYLETLHVRHGDSAYLEHSRTEPPVSRSPGSSAWTLSYYAIPPAPLFIVAPRLIFCFMVTQLLRFRLKSRVPGGWAWAQNRRSRSWGASVF

SEQ ID NO: 992781 - protein, 105 aa, Homo sapiens
GRVGRPRVRDNCSGGDDDWRPSVFKMKWTRLQVNSSALQMSESERAKLSGPLPGGTHRAEGSCLVPPHLPAQRLEPRLIESLSQIAVHWASLMKAGWLTRLLHDQ

SEQ ID NO: 992782 - protein, 33 aa, Homo sapiens
AAAYYYYCSEFKLLTMYGDMHMIKNIKKKVVLH

SEQ ID NO: 992783 - protein, 31 aa, Homo sapiens
AAAYYYYCSEFKLLTMYGDMEIKHPHCPGPL

SEQ ID NO: 992784 - protein, 30 aa, Homo sapiens
AAAYYYYCSEFKLLTMYGDMLIKKIIKKLY

SEQ ID NO: 992785 - protein, 85 aa, Homo sapiens
YYYIRGRVDQNLSDVFDWFSQMYGYEESNSSNKGGARGLVVVHKSERHGGEPTSKITDFLHYKHIVLTTSKSHSKLNIRRRTLRV

SEQ ID NO: 992786 - protein, 39 aa, Homo sapiens
AYYYYCSEFKLLTMYGDMTLVKRCLSVELTLCIELEVLK

SEQ ID NO: 992787 - protein, 39 aa, Homo sapiens
AAAYYYYCSFKLLTMYGDMQVYKHTDFWPGDQAGDQTNC

SEQ ID NO: 992788 - protein, 38 aa, Homo sapiens
GFAGAVQLGLIGTAEDLEKALELTGLKVFGNEIKLEKK

SEQ ID NO: 992789 - protein, 51 aa, Homo sapiens
AAAYYYYCSEFKLLTMYGDMEVPGSSKGPLPLLLPPKWLGLYINKNKAVRK

SEQ ID NO: 992790 - protein, 34 aa, Homo sapiens
GAAYYYYYCSEFKLLTMYGDMEIKHISLPWAPAK

SEQ ID NO: 992791 - protein, 46 aa, Homo sapiens
AAAYYYYYCSEFKLLTMYGDMRKAAIKKDEPLPCPLPEIKNSLTEK

SEQ ID NO: 992792 - protein, 48 aa, Homo sapiens
GFAGAVQLGLIGTRIRASNSRLEFEVQNTPLGCLLRNLPTLQLDQDLK

SEQ ID NO: 992793 - protein, 39 aa, Homo sapiens
AAYYYYYCSEFKLLTMYGDMMGRVCKSFKIKSNDLETAK

SEQ ID NO: 992794 - protein, 33 aa, Homo sapiens
AAAYYYYCCSEFKLLTMYGDMLIQECKKKKLYC

SEQ ID NO: 992795 - protein, 58 aa, Homo sapiens
MDLLVQYNRLNRDMWRRLQEARIAPLRSTLGDRARICLKEREKEREGEEGERKEKEKE

SEQ ID NO: 992796 - protein, 32 aa, Homo sapiens
AAAYYYYCSEFKLLTMYGDMLKKKIIEKVVLH

SEQ ID NO: 992797 - protein, 34 aa, Homo sapiens
AYYYYCRIQAFNDVTGTWYVFSSMSEQLNRFISK

SEQ ID NO: 992798 - protein, 31 aa, Homo sapiens
AAYYYYCSEFKLLTMYGDMLIRKRIEKKKLY

SEQ ID NO: 992799 - protein, 48 aa, Homo sapiens
AAAYYYYCSEFKLLTMYGDMIVPLHISLSDRERPCLKKKERKREEREK

SEQ ID NO: 992800 - protein, 96 aa, Homo sapiens
YMFHGGTNFGFINGAMHFGDYKADVTSYDYDAILTEAGDYTAKYTKLRELFGTFSRYKQGTDSSIHLGSCFCYEPLEFLLSSYPTSTLANPYSRMS

SEQ ID NO: 992801 - protein, 29 aa, Homo sapiens
AAAYYYYCSEFKLLTMYGDMEGVSYFANY

SEQ ID NO: 992802 - protein, 40 aa, Homo sapiens
AAAYYYYCSNSSFYDVRGHASRINHRYLFSNKIFKLCTVK

SEQ ID NO: 992803 - protein, 33 aa, Homo sapiens
AADYYYYYCSEFKLLTMYGDMLPQSCKKKKVVL

SEQ ID NO: 992804 - protein, 32 aa, Homo sapiens
MDLLVQYNRLNRDMSLHSSLGDRVRLQLKKKK

SEQ ID NO: 992805 - protein, 73 aa, Homo sapiens
AAAYYYYCSEFKLLTMYGDMKTVAGRCLDVQYNLRCNGKVRIRRLKEMKDQETLLYSKRHDWSIINGIMYVTK

SEQ ID NO: 992806 - protein, 45 aa, Homo sapiens
LLLEFKLLTMYGDMPLPISWTERESILRKKRGNAKLFSRDLKVFE

SEQ ID NO: 992807 - protein, 38 aa, Homo sapiens
AAAYYYYCTEFKLLTMYGDMANYRKPKKGEKSKKKKLY

SEQ ID NO: 992808 - protein, 39 aa, Homo sapiens
AAAYYYYCSEFKLLTMYGDMFLVLEYRRCSIKVDVRMAI

SEQ ID NO: 992809 - protein, 38 aa, Homo sapiens
AAVYYYYCSEFKLLTMYGDMKIPAQFNAFWLPGDDWAP

SEQ ID NO: 992810 - protein, 56 aa, Homo sapiens
AAAYYYYYCSEFKLLTMYGDMEGGQGDTLSGLNWSQVQIEILCQEEVNEIKDCFKD

SEQ ID NO: 992811 - protein, 34 aa, Homo sapiens
AAAYYYYYCSEFKLLTMYGDMAPNKGSCLCSLLK

SEQ ID NO: 992812 - protein, 32 aa, Homo sapiens
AYYYYYCSEFKLLTMYGDMEIKYIRCPGPLRK

SEQ ID NO: 992813 - protein, 56 aa, Homo sapiens
AAAYYYYCSEFKLLTMYGDMRITSNSSEPDLYKSEMEVQDAELKALLQKFCKEKPK

SEQ ID NO: 992814 - protein, 45 aa, Homo sapiens
AAAYYYYCSEFKLLTMYGDMCNKLSISKESLSCSHFFPTLVWNEK

SEQ ID NO: 992815 - protein, 33 aa, Homo sapiens
AAAYYYYCSEFKLLTMYGDMQWVWMNKKKKVVL

SEQ ID NO: 992816 - protein, 32 aa, Homo sapiens
AAAYYYYCSNSSFYDAGDMEIKHPIGPGPLQK

SEQ ID NO: 992817 - protein, 38 aa, Homo sapiens
AAAYYYYCSEFKLLTMYGDMVFLLLQVVQVLTQLLVPK

SEQ ID NO: 992818 - protein, 37 aa, Homo sapiens
AAAYYYYCSEFKLLTMYGDMEPGRFQAISRVHNQSHN

SEQ ID NO: 992819 - protein, 36 aa, Homo sapiens
AADYYYYCSEFKLLTMYGDMPLHSSLGDRVSLCLKK

SEQ ID NO: 992820 - protein, 90 aa, Homo sapiens
AAAYYYYCSEFKLLTMYGDMRGKWNFQARNARTAAHNQERPTVVVTPIQVQNAGGLSPASEGLSHYSLACPQPAPMMPGSATHTAVMSIR

SEQ ID NO: 992821 - protein, 68 aa, Homo sapiens
AAAYYYYCSEFKLLTMYGDMLLAEDVIHACNPSAWEAKAGGLLRGQEFAISLGNIARPPSLQKIIFKN

SEQ ID NO: 992822 - protein, 237 aa, Homo sapiens
DPVPLTLSPVRLLPAGSNHGRPRLFSHSVSRLTLPGAETQDSRDCDPVVPSELLVCQLPPRCRCESMGSALFLRSSATPTETCDGRQRSVQLPCESVMRENSRTGVEHRGELRLRVQPGMMTPVILVGKESFEGMEMQRNNLLPRCATVVRVYSGSSHVVTCVRSSSCFIHRAVAYEAAAAALQAGSPDTESRISHKVTLSVNDMTVLQLDPPPGVHRQTLSRFFDKSPGPGAETPM

SEQ ID NO: 992823 - protein, 31 aa, Homo sapiens
AAAYYYYCSEFKLLTMYGDMTPKKSTKKVVL

SEQ ID NO: 992824 - protein, 31 aa, Homo sapiens
GFAGAVQLGLIGTRIRAGNRETLEFEISHPK

SEQ ID NO: 992825 - protein, 36 aa, Homo sapiens
AAAYYYYCSEFKLLTMYGDMSLYSSWGDRVRPCLEK

SEQ ID NO: 992826 - protein, 154 aa, Homo sapiens
MIGRSNVLKVDQDSAGAQTASPGYLKEKEGAPSLHFYLSFSFLKITCPFDPPFVRVVSSKSFSWRVCSGGGGAISHGNFSAENRGPGWRAAYSIESADHATTSGATLVKGKARAAVWSQQISIQSDKSTAVLQVLGAGSTKKNGWYTDPQNEDG

SEQ ID NO: 992827 - protein, 114 aa, Homo sapiens
MTATAPRRLRSLALVQSIRHSIIPASMSASIDGMKCSTRYLSRPMDAFKEFLISRHLHYTSGCRALSIYGVTFLVLQKILTYHSALIRSCLQSYYDNRPSLGICPPVRPQIIEF

SEQ ID NO: 992828 - protein, 33 aa, Homo sapiens
GFAGAVQLGLIGLEFRDQEIETILANTVKPVST

SEQ ID NO: 992829 - protein, 39 aa, Homo sapiens
AAAYYYYYCSEFKLLTMYGDMRSGVRDQTGQLGKTPSLQ

SEQ ID NO: 992830 - protein, 109 aa, Homo sapiens
MGSGPWSRSSMVALKTTYASYSVSRPEGKLGIMELAVGLTFLLLLILPPCQPVSWILFIDLGSTYRESPSSAMAAPLSDTLHNCDLDSAPPGPSWFMLLAFWLCLARLP

SEQ ID NO: 992831 - protein, 41 aa, Homo sapiens
AAAYYYYYCSEFKLLTMYGDMQGLQTPRTFGQGTKLEIKRT

SEQ ID NO: 992832 - protein, 41 aa, Homo sapiens
AAAYYYYCSNSSFYDVRGHDCFTVFLRSIYCTFDNKIIFSQ

SEQ ID NO: 992833 - protein, 90 aa, Homo sapiens
MRSMSGLSPRFKLPSDVMRPVASSGSFERRIKLGAGHLCSTGVQYQKSDVAASVLPLYLVKPPLALGGTVCAPCREFVVLAPNGGLAARD

SEQ ID NO: 992834 - protein, 116 aa, Homo sapiens
AAAYYYYCSEFKLLTMYGDMYIRPDGLKQVKNHKRSENGLFLPELMTLPCEIPSPGSSWLKSSPTKQLVTPTSARQRTTPFDCNFLFTNPNPVKWSQPYLPSLTVFSDSASLHPGD

SEQ ID NO: 992835 - protein, 51 aa, Homo sapiens
AAAYYYYCSEFKLLTMYGDMRIAVNPGGEVEVAVSRDCGLQPGLRSDSLSE

SEQ ID NO: 992836 - protein, 36 aa, Homo sapiens
AAAYYYYYCSEFKLLTMYGDMNGLFLIINKKVFFLL

SEQ ID NO: 992837 - protein, 335 aa, Homo sapiens
MSAGHTERKHTKSLGSEILGCLSHPCLCAMMLANAMRTLERKWGGRAGRNVAHNEMHSQYLMILYRRSQFKQARDAKYDGTALTQAVLVKIDVTYTQTQVIKGNKKQRHNQPQTGDDTDADRHTTTTSPGQTKTKSRAAQTRENTEKSHTGQPKGKQETGESDTEERRQLADSEREEARKDSSAQTARLQRAENHNYRDGQRRVTESETQKDQKQAISKQTTSTAKTNEDKVKRNKETDIQRAKKQNAEKKKQKRRHKTENNNKARTKYNKKRDGKCGMQEKKTKNKRKVKKEKRATKDTEQLTNENENKTKQKQIETDTDLRAQQTNRNRTIQW

SEQ ID NO: 992838 - protein, 524 aa, Homo sapiens
HIGSGLDVPAWWSVIRYSTQCGKTKSTVINRRVIKFWYAVKTVVHWVWYRRAWRIVGEGEHTEPGGLRSSAQLLVAVRELYALGNWYSRTGDRSVSVRQIHMWCHGLGEGVTTVVPAESCPMAAARMLVHPAMSGNIGEAIDSEASMSSLLCYRNSHFPSHSRRTLGSIVHYSRLLMVAGNGHSLYHARFRYSPFPLFGTPSDTYPREQRTLLALMSEGPKSAGALVGNKWQIGVADTRHKNGVSHSIVSFPQCRGKVSDLGEWDCAGTECPPQGCSSKEGNTWKNTISCILGDDGYTGSSTLVPGVVPCDDCGVVTSQKALFPKKPPYGPDQGVEARTAGEKIKRADRLSSGGQSGKEIHHRPLMKRPCNQAPGWATPSAMGRRPGTLQPQYTETTASETLHPRWHQSGAVTNSEKGTKEQQGREKQGRTAHQHKRGDPTRSNTPAEQNRGETDKQTHPSERQQAKPKAHTTTHARTAQEHPHTTNHTTHTNPKHGTRQQETATHSDDDIDTGKALATHTTTT

SEQ ID NO: 992839 - protein, 34 aa, Homo sapiens
AAAYYYYCSEFKLLTMYGDMFHCLNKNCLPLLRK

SEQ ID NO: 992840 - protein, 66 aa, Homo sapiens
LLSAAPSRQALAQPAECGGSWASPRGAGPLYQAHMVRTTPSGPPHSHPWGAALMPGAGRPTPCIGC

SEQ ID NO: 992841 - protein, 60 aa, Homo sapiens
AAAYYYYYCSEFKLLTMYGDMCEPQFLICKGGNDTYLTGVLRGLNVRRIVPKIKKKSCAA

SEQ ID NO: 992842 - protein, 512 aa, Homo sapiens
MEGAQVLIRETCTLTNTVCCGITEEQAMAGGGASRMSSCKESFFCGHKASLTDSVRDALLEARCFRGGMCIHGLVRIQGKQMEELDTEDPYWKGRTVTRWYVPVRTDQYTRRGAMRTNALFFASGPTRKVSFSLQPRVDNEISDPGDRCRMLAVNATRSEDSTISCLGGPNRSPKEQRGIPGPEAKGTSRLKEGGSASGARRFREVHEEEEWPYWFCNPGPRKYVEKDHVGPFQGRDLKRDRSLSGAQLGRGKELSEGVKRKRGPWRSVWLRHTWPVGLERYQGAHNRIPNFPEFMVPLEGHGLPCGRPSTKFLARGIAKRKELAPYHIPPRGLCWGHSVPVEQALATSWSPLSFPIFEPVLWPRPFVVMERPGKPKGRYGPSAMALGWLRSATQEGVCSDNGGRPVTTRRRGTPNGRKTPGHRVSRGKLGTGPRGGELDPDEEHRAVRAPRPTTVRRVSGPQHTRGTEDATDVEGRRVPPYRAGRRHKNARKVTPKRMLTHKEEDKKAGDR

SEQ ID NO: 992843 - protein, 49 aa, Homo sapiens
AAAYYYYCSEFKLLTMYGDMWTQEVEVAVSRDCATALQPGPQSETPSQN

SEQ ID NO: 992844 - protein, 451 aa, Homo sapiens
MLTLLGHFARRAARLVMLFIVRLEELHDRSGRVAVKSVVLTCHTVETHYLNVDVSLVVSPRMRTLLSTENASIARDNSHYPWKHHCAESMLVVNMRPSTGSVDYHHMYHTSSGIEQLLNRFQSLTLTNNVGLASRQAGNYSLIMAGLLVGGNLPSSTNAEKTNQGKPPRQAREYREVKVGRRPEHPRRKRARRQTRSVTKFPRVEPDPSGGRDQMRRKPGKTHTERNPLVRVFLTDPLYILGENPPKILRTGKDATGLTRGYHTVQSDPETAHGISKSARNECRVHRGTIKGSTAKKTSRVLTGGAYNHKKMSTHDTIYNTSHSKKGRPYTAHKKYIYPTNKTNNSDADNQRDIKRAMIIREAYDLQGAVSATKKGDEHQAAAILRLNLYNSTQNEYTGTILHLVFRTLTLVARSDRADNRNKSNDSMIDSHNKYTKQRKNKTIDKAYRTE

SEQ ID NO: 992845 - protein, 303 aa, Homo sapiens
MGGNSSCASQPQLVECSSERSVWYNLRESTCRSHYISSRTFAPAVVILNITDVNSGAAVEIVTPQDSEISHKKAAAHSRIYPVPELCVVSLSQEETGISQDDLESSVIEQCKTFKTLSKRTHFVKGVLARPNMSTPRYKPLQEHVVLQFSEKPLALHDVVSHKGRTPPRGVLQNIIIPATPGRVGLKTPRAFKGQIPFYTENNSGHIGAQVEALLNILMRSYFTTMICSKSPREQILCESEKKARWKGTRGKTWDNSHTFLQQIYGHVVCPPPKCFVDAPPIKEDTGNFPHHQQRGDHTHHKR

SEQ ID NO: 992846 - protein, 36 aa, Homo sapiens
AAAYYYYYYYCSNSSFYDVRGHVLFQVKRIKDFQPK

SEQ ID NO: 992847 - protein, 106 aa, Homo sapiens
LVKDGRASMSAAVRHNPTDQHDEKSTDLIVTRLLNAQAPRQVSLLVTLQPFIAILSFARHRMLEKFVSTWLSLLGLTLFSLAQAYSFWWTTTDSQTQYRSKNSYRT

SEQ ID NO: 992848 - protein, 35 aa, Homo sapiens
LVQYNLEFEARIRARIQASNVRSLNSTRIREILRF

SEQ ID NO: 992849 - protein, 35 aa, Homo sapiens
AAAYYYYCSEFKLLTMYGDMSFPIKKKMTSCPVEK

SEQ ID NO: 992850 - protein, 141 aa, Homo sapiens
MAIIAPMWFNSQKDSVPTGGASGTMGAQGYASLLTNGGVQALCGAKRPCGRGNGPAPLRGAAQGDRATTCRREEKEGTTHRETISPKGPKAAENVMVAHLEERGPLVIVRKPPVACPQGRMGFAKPSNQFSRALPIAPPTP

SEQ ID NO: 992851 - protein, 169 aa, Homo sapiens
MRNTVRFAFNVRTFRKGEVVDFGANIFKGIVKGFCWVALKKLNTLGDLEKTTMMENNTEKIKKKTKGDNQPTQREPMNEPKEEETGKDGIQTEREQKKEKRASTKAENEGKQKTRTTHADTTEHDAKEKWDAEKEIERKEERRGNASDRRNHQTNIKKKEEKNKQTEHR

SEQ ID NO: 992852 - protein, 32 aa, Homo sapiens
FAGAVQLGLIGTRIRARIRARIREKIEKKGEK

SEQ ID NO: 992853 - protein, 34 aa, Homo sapiens
AAAYYYYCSNSSFYDVRGHVMSGLNAQAKRACKK

SEQ ID NO: 992854 - protein, 35 aa, Homo sapiens
AAAYYYYCSEFKLLTMYGDMPLHSSLGNREDLVSK

SEQ ID NO: 992855 - protein, 69 aa, Homo sapiens
GRVGEAGGSRGQEIETILANMVKTPSLIKIQKLAGHGDVHLESQLLDRLRQENCLNPGGGGCSEPRSCH

SEQ ID NO: 992856 - protein, 39 aa, Homo sapiens
AAAYYYYCSEFKLLTMYGDMPNFHSHFICVNNKIFNFPK

SEQ ID NO: 992857 - protein, 240 aa, Homo sapiens
MSSGSEDCTVMVWQIPEKRADLPRLTEPVVVLEGLTKRVGIIAWYTLTETPETVLASDVRPVGTNCWILDRGMWCTDGVQLVLSPVNALHPMYLHRTDCQSCDTHKLVHALFLLMQCNGQELCCIIRRPVGDTLDGQTRDEGLMRGCPALRAIFLADGKVFTIRLQPYMSESAAWRSGDPMKNLEEAQWPCMELDSSNGALLPFYEPDTSVVYVCGKGDSSIRYFEITEEPPYIIFLNYV

SEQ ID NO: 992858 - protein, 33 aa, Homo sapiens
PPPAGAVQLEKIGHGVAVVTTYHHRPSILATSK

SEQ ID NO: 992859 - protein, 122 aa, Homo sapiens
IQSGIKKRGILANGPCALPIHPWFGPLWPIALYPGAHPKKLGTSPLACLCFSPNAFLEWGGKDGGRGERDLPPSCQAFLGGALAPSGLILLSRGGFFFPDTFWLIHQHRDIKAIQRFNYEAP

SEQ ID NO: 992860 - protein, 33 aa, Homo sapiens
AAAYYYYCSEFKLLTMYGDMEQAPAVALPPTHK

SEQ ID NO: 992861 - protein, 39 aa, Homo sapiens
IIIMDLLVQYNRLNRDMAQRGLLYTKPYTHHNSKTISKF

SEQ ID NO: 992862 - protein, 54 aa, Homo sapiens
AAAYYYYCSEFKLLTMYGDMRIVGTQDVEAAVSRDHTIALQPGRHSETLSQKNK

SEQ ID NO: 992863 - protein, 37 aa, Homo sapiens
AAAYYYYCSEFKLLTMYGDMTNNYEENILKVVLHQQI

SEQ ID NO: 992864 - protein, 35 aa, Homo sapiens
AAAYYYYCSNSSFYDVRGHVSCVFDTNKFVVAKTK

SEQ ID NO: 992865 - protein, 180 aa, Homo sapiens
MKTNEPLKHTHNHNTRTTPREKNKEAPQRTQNTRSKEHTRRRGQTIRRPTQQTTNRTEPKPLNTQTPTDKRPYTHERHTQRHTKTREAKRWRTTTTHRELDHTDATSETQQEAERTNINAKKEPNDKAKRRQHTDYKQNTNNPTDKHPNTRDARTETHHQKQADTTALPQHIRNQEALDE

SEQ ID NO: 992866 - protein, 37 aa, Homo sapiens
MDLLVQYNYGLIGTRIRGTVKLISITNSTIHSKILQK

SEQ ID NO: 992867 - protein, 49 aa, Homo sapiens
AAAYYYYCSEFKLLTMYGDMTQESEAAVSYDATVHSSQGDRLKLHLFKK

SEQ ID NO: 992868 - protein, 37 aa, Homo sapiens
YSVLEFSGVDIDHHGICVVHVPTRLNLEFELEFEASN

SEQ ID NO: 992869 - protein, 30 aa, Homo sapiens
AAAYYYYCSEFKLLTIIWGHVIKVFIVLFP

SEQ ID NO: 992870 - protein, 362 aa, Homo sapiens
NSNGNQESGGFWANGCLVALPISSLGLGPLLAYSPYTLSTTPTDLGDQPPRRAVVFFFPQTPLNGEREKEREKGRGETVPPSIRTFVERARPPVGFLPFPRGGPFFRAKTFGVKTQHREIKTTEFYICEEPPKKEKRTNKRKKQTEEKKNKNKNTKKEEGRRSTKKNNPRGRHTKKRPRTQDNREKGRHKEGTTNKQTHHTDGGESIKKGIVNERKNNAPTRRRQTRKSATTQREEGETQTRATKHKQEKKETQKGNNKNRTQRGINRGTNKRKEDGRKTGYNSNHNRTKPGGAHDTRKSNRNERTTSKEGEGERNGQTRRRSAHQTNTKTERTRTHAAKKEEENTTQKRTKKDKSERRKRR

SEQ ID NO: 992871 - protein, 35 aa, Homo sapiens
AAAYYYYCSEFKLLTMYGDMYWSIYFIYENVMFPK

SEQ ID NO: 992872 - protein, 36 aa, Homo sapiens
AAAYYYYYCSEFKLLTMYGDMFLNNQVSEINNWTTK

SEQ ID NO: 992873 - protein, 233 aa, Homo sapiens
MGIIVLEVCNFARILGTTETLVAHIPGVNATMRQTVSCTITGTSTMAAINTTVSTASKCCAVLVPFPLVIRHPTIFIHGDKMWHDQRALYNAAPYRSNIAKNLFGGSWTRQTRVSKSPQDADYWSGSPTNSVLVWEQKTVALQGLKHYGSGASLWWRGGQHIYSSCTILFASHNWPITYHYRWERSTLTPSFEFYTLARERAYQNGPLFLAAAIIDGVSATQDLSAPKVVEPL

SEQ ID NO: 992874 - protein, 107 aa, Homo sapiens
STPGTMKLYRRCKLEEMGFKDTDPDSQTLQFTWRHMRPHKEDEFLGELQKKRRGDETECSSSESKRIEVGGSEEAEKELREKLVAVLKQTVARTERNKLEDMEEIPG

SEQ ID NO: 992875 - protein, 393 aa, Homo sapiens
VHSRVSFWSFDARLPVPEQASLVARWSHATTILYYPFESPVGGRCNARLDVHLVYQAGYKVGPHYSVVLSRSGVAYSSTNALGIIMQSSASMTGSTRIPELHKTRRSVRRGDGYLPIGRWTVKVECVERVERNLRGGIISRFARTNGLSSTRFARGICARRENRLLQRYDFVLRRAPSSACGGQSQNRNCIHETKLALRSKIIRGQARLGDPTNGCGTSSSTKEGRYLDNDTHSMNRPRHLGEVALHDASMVAPRFHSSKHEEGPCRLHPIGGHTLRRWDQRFHSLHHPEEIRTVVPGLWRSQPQFLWQDSTPCDRKVGSPYWFTFSYLERDASCRVIDRAKLHPETILSGYDISHTPCEYPERERQVHYSSVEETQTATTAGRQRTEESPIT

SEQ ID NO: 992876 - protein, 43 aa, Homo sapiens
AAAYYYYCSEFKLLTMYGDSSSLTNVCLANVIKVVNLYECIPK

SEQ ID NO: 992877 - protein, 226 aa, Homo sapiens
MTKTEKKERRTTSTEQRKTRETREKTKGNNKQQKETSREGTRKEQKQTQKTHNRAGKPEQGRAKERQQQKDTTKSKAADEERQRKGEKGGEGKKKEEKRREARSTDERKRQEKKKGKETRQTQPGAKKPEENTKEEKKKEGDKKTNRRQTNERTEKRQKETRTENTRETHDNETTQDRKQTRRKQRNRRTDTGHDSRGDEENDTNKQRQPENRKTKGEDRPTSKQQ

SEQ ID NO: 992878 - protein, 32 aa, Homo sapiens
AAAYYYYYCSEFKLLTMYGDMFISYIRTGTFY

SEQ ID NO: 992879 - protein, 124 aa, Homo sapiens
MSVHGVLIFTYVKISSILNEPNFRSMALPRGMPSILIPSSQTYWLGLSNCRAQGCLRTNQNSFINCCRIPDLYSRVSRSLCSTQTDVAETVSPGTMGSVQRYSALRKNFFPRSQKIWERNRNKK

SEQ ID NO: 992880 - protein, 34 aa, Homo sapiens
AAAYYYYCSEFKLLTMYGDMPQDTPNIAIVVFQL

SEQ ID NO: 992881 - protein, 161 aa, Homo sapiens
MQPSACPIPLLHHDVRVPQHADPDWARFRCLNQNWPGWFSILFRVGCSTEDTPFTSFASETFPVFSKPYVVDEFGLRVGSHKNGAWRCCPNYVWSSAVIHDQFIIKARGGRDPGSLSWFLANTRFVDTHLFPQLIYVPLFNSLTQFCVLLCQHTNSVRRTF

SEQ ID NO: 992882 - protein, 31 aa, Homo sapiens
AAAYYYYCSEFKLLTMYGDMLKGIKKKKVVL

SEQ ID NO: 992883 - protein, 74 aa, Homo sapiens
RSGQRDSARPSEYDGPAGIIEGQRMEVCRSVHTYALVLVWKRLACDFVLRREPCGLASYVACNDHAKRSSIRPV

SEQ ID NO: 992884 - protein, 36 aa, Homo sapiens
AAAYYYYCSEFKLLTMYGDSYYTPDRRQSETVSKKK

SEQ ID NO: 992885 - protein, 30 aa, Homo sapiens
ANMAAAAAGAEVPPPRAATGNPPASPPSPA

SEQ ID NO: 992886 - protein, 123 aa, Homo sapiens
MQRGSALARWIHRVLSDCWKVSPLPYPENEAALTSCHVHVIVPWCAGSHASLLGRRDCREVWVCERGSGCACLSTEATSLSCRRSRARRTVTSVLYVPSDTLTDGCCFACNALEGTFCWSRLC

SEQ ID NO: 992887 - protein, 30 aa, Homo sapiens
AYYYYCSEFKLLTMYGDMTFPKIIKKKSCT

SEQ ID NO: 992888 - protein, 153 aa, Homo sapiens
SGLPRHQARDSGEVRLQSMVFPAKTVLHGAIHGGSCAGSSVLSGTVARRAEPEWHAGSSADSHTALKSQERQRDGTSYDPLATGTRYGQPMAGRSVDDERANECARRKLHVSSLEINDGELGEEKGAMRGKTQILWRNGTSVGILYRRSFESL

SEQ ID NO: 992889 - protein, 157 aa, Homo sapiens
SGAVVAVDGSYLALLMYVGQAGGVMAALRTLDLLEVRGRERDGVGDLANSQECDPGVMLQLLGAASFKERLPTIRLLWGQLVEAIDEYQIYSKTSTNRRPKLNTNNSEFTEEQKKTIGNIATCYGIAEVQLLQYHTVYKTDYNLEDLKQLEPILKNI

SEQ ID NO: 992890 - protein, 42 aa, Homo sapiens
AAAYYYYCSEFKLLTMYGDMKQCIWMNAVGGCKYLVSPQTAK

SEQ ID NO: 992891 - protein, 292 aa, Homo sapiens
VKTMTTLRQIDVHMFNAVFVALDKAAPGEVCQSVGKLLWYPTCDYGHINASSSTDTVLLRGGRNDGRRGLQCAPMPLTVYTATSGSLPPSVKGLVPWWPGDGHSACVRSANDLCSIIGGVTEQHADMFFQMTFDKQYTYQHDMGTLICTKGSRCTLVGIPLSHNAGKSMYVFGGRVDRFVSHSIPTMEIYCKRIRVFELQNEGLVEWPPILCAEGPEHSALGTMGSCAPGGDTCSERVFPYSSVSLCPYRAKTARGGACPAGQLRPGYMALGAASGGRTAYPAWGSADRRGY

SEQ ID NO: 992892 - protein, 71 aa, Homo sapiens
MLTNAKFRGLPPRGRKHHPGRAHCGKKNVSIHSGRARGLQRGAENITRQGPHRKNERHPGAQKSGGTLQHK

SEQ ID NO: 992893 - protein, 42 aa, Homo sapiens
AAAYYYYCSEFKLLTMYGDMVFYVTSIVTLVKWLSIKDLCYF

SEQ ID NO: 992894 - protein, 289 aa, Homo sapiens
MAVTGVCACADVGLAVWVREDHSKPEAIGSDQSDEESDRERGLHPGSLVGPFAKEQSSAERGTTTFRVRLSGVPTYQTLGYYPNRTLPIPIKLATFCTTPRIPNTRQHYGVRSPLPHLTRKHTLAPTKYRDVHNTLTHTYELLPVHSSCNTCTTGAPSPGVKPHETAKYIASSMKHPPLRPPGLYHNTALTTNIHKHNKLTQRAVQHITIHYNTTSKTKSIAPAVRYGPAHLGFHLQQGLTISSDTDTLVATNEIFLAGSHRGLRHPSSVPRNPGPQKQIAWQVTASDT

SEQ ID NO: 992895 - protein, 34 aa, Homo sapiens
AAAYYYYCSEFKLLTMYGDMLEISTSSLLEITMI

SEQ ID NO: 992896 - protein, 52 aa, Homo sapiens
IQTRSHILELLYVSNPPALASQFFWIIGMNHHAQPITEVDAAAILVGVVGPP

SEQ ID NO: 992897 - protein, 40 aa, Homo sapiens
MTSTEEENETKNKQPQEERSRTRTEKNHGEQQITIEKERP

SEQ ID NO: 992898 - protein, 215 aa, Homo sapiens
MNDPTDDRMFHVVYCIGVARVNVGASRIGRESVVGTNRSITPMNSDTDHWLRPYDKGHKRKLDQEQLGEQTLELETPSIKDPKQQHTNSDATPKQRRVTHTHHNIKNTRIPHPTHTSSPATHNGPSSPTTGDKQRPHTGAQRPRHTPMATHKRDSKGPNTQSTVATTQDRATYKRYADTHIAVETQPTTASQRTSNSGRDTHSDQQPTHSQPDTI

SEQ ID NO: 992899 - protein, 74 aa, Homo sapiens
MSNNTHTAITSRHTISRTLILHIHFLYVATYSNRTINESSQLTTTYRKNIALTKNTTIQTNSSHSLYVRYNDTL

SEQ ID NO: 992900 - protein, 40 aa, Homo sapiens
AAAYYYYCSEFKLLTMYGDMVSCRTISMLPVKKINNKTHK

SEQ ID NO: 992901 - protein, 36 aa, Homo sapiens
AAAYYYYYCSEFNLLTMYGDSHYTNAWRQSETWFQK

SEQ ID NO: 992902 - protein, 256 aa, Homo sapiens
MYDVVHVHMCCVSLYPHYVSLVCTEATASTVCLFPHASAVNLPETHRFHRVWPAGLTSLYLLVLMSMTPYKRTHLSYLCQVCSMGTCCEPHQGSLTPRSSLPAFPSVYPCGYGFTSRSAGDMTAVLSLVIESEAGGEQEDTYITGVGLPKSAGEHRAQHEAALTHRAGTTPVIPHGVSRNDRPEEQGQMPHEDRSEPRDVPMEGNGPHDNPTRPPTHSRDKPKHYGRRHNHTDKEHTNEKGKREPRTRTNTATRTH

SEQ ID NO: 992903 - protein, 38 aa, Homo sapiens
AAAYYYYCSEFKLLTMYGDMCTCNIIPSYLKVKSLTAK

SEQ ID NO: 992904 - protein, 333 aa, Homo sapiens
FRLRGPAAAMILLEVNQPTIIEETLALKFENAGDGNNTGMHDEVTFADFEWGPPIISFNILMAAEKPRKLHGPDILFDNSTTGNFQGHMVLHELLKGGCTGVALRKSSNQDTMSLCYMTLYHSSGNPKVCHCSINAGDVEAKLVFASVFEKYFHIPRQRARKERTGPVIHYRDDETMLCPSLKHGQAVTVISGTESTADERMLVIVKGVAVRRKFQRNDGRSPATRRPTGVLFKATGDTLPAGRLETNTRRPGGGLNNHLARHSPLVAGCPRHTQLAVVREQPSTSDPQRRATWTYPIKAMKRVSPPLIDDKGFSRVSAAVEKIHISGEEHRM

SEQ ID NO: 992905 - protein, 250 aa, Homo sapiens
MVCYQDFPSVVLVGLGEKAAGIDEQENWHEGKENIRSCCCRGAKADSMTWRPLVCGGGSLWRTLRLLRRESVLGLYELRMILKQTTEDVLCRATALWTVGHSRRVRGHAPRMSCCALWARTCATSPLPGDSQRASDYDWRPGFARHYLSKNSPKCYLETPRVQYSNQVFRFEEPGTGNIAHFVATRFHMPQVCGITTKGDAFARTPQVVDKNHTRGNTQRHRIDAKEGDVALFRTLFKYAAITLNDEKNE

SEQ ID NO: 992906 - protein, 30 aa, Homo sapiens
AAAYYYYCSEFKLLTMYGDMAKKKNMKVVL

SEQ ID NO: 992907 - protein, 149 aa, Homo sapiens
MGALVEDSLTTHPPWAAALYSPPVKEDEREKKGGNSTAQANKPEEKTPGSGGDRENQEGWRHNKAIGVIKTRRGTNKQIITNQPTKNDEYIDSSPERKPINHKTNMETATYFNQKKGAKNNASPQKDVRTLQKVKEKHLLIRTQRETQQ

SEQ ID NO: 992908 - protein, 40 aa, Homo sapiens
AAAYYYYCSEFKLLTMYGDMEKYIKLYSFMCLIKDCKTQK

SEQ ID NO: 992909 - protein, 31 aa, Homo sapiens
AAAYYYYCSEFKLLTMYGDMLFSVKDQIINI

SEQ ID NO: 992910 - protein, 33 aa, Homo sapiens
AAAYYYYYCSEFKLLTMYGDMVGWREGVIKEVK

SEQ ID NO: 992911 - protein, 33 aa, Homo sapiens
AAYYYYYCSEFKLLTMYGDMNYIGMKNSRQEEK

SEQ ID NO: 992912 - protein, 44 aa, Homo sapiens
AAAYYYYCSEFKLLTMYGDMEIKAAVSCDCSAAFQPECQSETLS

SEQ ID NO: 992913 - protein, 97 aa, Homo sapiens
QEIRNRTLDSYIPKYVGNESLSTYLLAEHCRRGTLHMRKPGSLEGHRFNVRTSDEWWDRAKSLTNRRVRFEHDPTDNYVIRSLVPISYISQYIISVQ

SEQ ID NO: 992914 - protein, 35 aa, Homo sapiens
AAAYYYYCSEFKLLTMYGDMTKENKMDDSFLSAEK

SEQ ID NO: 992915 - protein, 313 aa, Homo sapiens
MAYRVIWKIRRVVRVRHRHVIIWNDVIPDVCAMASLNKSSVLLGGTISDCVSRQHRYSQGLVETLTRGVNDTYAQNAYLRAANLRRTGRAIRSMDSGQVATEHGTSDRAVAASLVVYTKITKNSQTNGGFAHTHCLESRRGTAMDTQRGICFQTLIVENGERRTFHSPHGPLVPNLRNFIHWLGDNPRDKEATPGMPHQYSVTPNCDVKITPLYAILHTSTLGDTCGKSFTQKVFLGERTAMHTTTQTNITKNHKMCCVNRNQIQNVVNSTNTNRRRWPSKSDVCTVPYYTQQEHDESELSTTTRRRPPAIND

SEQ ID NO: 992916 - protein, 328 aa, Homo sapiens
DAWVDPTRPAPGQQRQQQQRQQRAALSRRPPPLRKKPAQPPPRPDPRAWIPAPRSRSPKTTTAGLRQTLQGMTSGGPRDPASRAKMVGWHMLDVKTYTRTQDHDSMKLTSQAGGETSIQRKQSQRKAHRIAHGLGAGATRDQGIPPAPSEPRVSASPHEQHNREDTSSTDNHETPHVTESKNRPRSLDHQTQTRASPGNHRQPRSATRYYDGPQRLATTPVLIAQGRMIIGTTGHCRQTRAKPHPVNNINGNGADPTGKQNATRRRTRRLAPQRLGRDIYHREPKPPGAPPHATPSWTPEMRTATIGKHLGHTRGFCAPETQAPQLTR

SEQ ID NO: 992917 - protein, 43 aa, Homo sapiens
AAAYYYYYCSEFKLLTMYGDMNISTHLDFKQVNKTFRKRLKSK

SEQ ID NO: 992918 - protein, 411 aa, Homo sapiens
MHAGTEIHANQAPRQLRMPSLTPPHDENQLNTTWTKRSRPRPQKTETHDRPGTLLKYNDSNQVLKHSPTPPPHTLQTPTAWPPPGQADTPGTTGSGPPDTKHRSRKESPGAQGPTQTTREPRAHPTGITANPYSEKPRGSLRKRGTQTTDARQHQTPTHRQANHPTLGHTCTGQRHRRQEHNNSRTRTHYHTCTHVTTPNTGDTTHNTPITPKPVATPSHRHTGTQSDAPLNTPLAHTHQRERHTTPVCPPSPELEYPGSEAHKHSTGNTQTNTGTLTTITHTTPGSSRYQPPGRHSQRLGADSQQRATHNTPQQPTAPKVNQHAHAAHETAEGDPQTRDRPHNSKPATRPANDRNPDPPQRHSAARTHATQTTRPTHTKNTRTTGQTHTRSTEQPHSTTTEPARAPHPHS

SEQ ID NO: 992919 - protein, 106 aa, Homo sapiens
DRLCFSFLFIFLKYISLFSFPYSRDGTRIVMLENPALIKSSHKLTSENLYLNLTPLSLPWEIGQIDPVAVRAELDDAESAWPAVDMQNNSCYFRQSPSREKSLHAF

SEQ ID NO: 992920 - protein, 305 aa, Homo sapiens
MDSDDDSSDDEQEEEVQKRPKLSKKIVAREMNRFTVGELKQLGGSDLMSWKMHDVTAQDPKLLVHLKATSELCACATSIWMMKRKYLQGIRGIEKPPLRDCQTFIKRHRQFRRCERPCHGEGRTEDHEGQECERKFGLRWATIEIDYHKLNDAFFKVADQGKADIHGDLYYEGKAFETRLEEKKPGDLADELRITYGECQKNDMASMCAPTRVHGHVKKCDNPMDSHFKSLGEISYLKRRPGGPTRGAEGDPGAEQGTPQWSRCKHQLEIRDQGATKLRPGGRETLTKLQETTSRGQQTAGKTGY

SEQ ID NO: 992921 - protein, 31 aa, Homo sapiens
AAAYYYYYCSEFKLLTMYGDMYLKLGTRKTA

SEQ ID NO: 992922 - protein, 46 aa, Homo sapiens
AAAYYYYCSEFKLLTMYGDMEGCLGDAVRCRYDVWLEIKAISEVEK

SEQ ID NO: 992923 - protein, 114 aa, Homo sapiens
SDVMCEKRGRRLWSKYILIMKSYLKHFQMCSEEEKKEIFGRAWWLMPVIPALWEAEMGGSQGQEIQTILANTVKPRLYKKYKKISWTWWWAPVVPTTWEAGAGEWREPGRQSLQ

SEQ ID NO: 992924 - protein, 33 aa, Homo sapiens
AAAYYYYCSNSSFYDVRGHVPFFLAPQIIKTQK

SEQ ID NO: 992925 - protein, 71 aa, Homo sapiens
AAAYYYYCSEFKLLTMYGDMHLVPGREAAPALCHVTWACYKRGLVKKTKAHALPTALCAFAVTIKYILSCK

SEQ ID NO: 992926 - protein, 83 aa, Homo sapiens
MIAHLTCSLVGNDIIISTNSRLSLYWSPACNTQQFETHSKHSSREDNSQDVLSVIAAITGSLQDKLKNKSRSSVYEAVRSIID

SEQ ID NO: 992927 - protein, 30 aa, Homo sapiens
AAAYYYYCSEFKLLTMYGDMPQYIKPRSTN

SEQ ID NO: 992928 - protein, 396 aa, Homo sapiens
VLQTGGLPIHEANVQGVSVCLNGIPTYTLRGSQNPVCQRVHLPTQRRLLTVPRSLGIQNVSTYAGSVVPTCLLYPSYTYLNCRPVFWQQAVTRPATLNQEAHILVPGTSTRHGNPHDLLCDKLQLSLYMHLCTQAIGHHWHTLSPVVLPLLWLCREQAPLHGGRLFTHIYTYSYVSMPTGALHYMTQYRLLAPGTEILDAYGPKFILTHSREPPTHTANLSSGTNHTNTGLQQRITRGPLSSGLHSLNIPLAGPPCYANMGLSVRMTRQHKLERVPMMTTRDSNTSASARMGLQHRAPTEAQPLQDPHLCHRNNSQADCDADSPAAPNSPLAPAPICATDSNRERNRRIPTEPLVDRRSDPTAHTGISTRTHTCITTRSGRSRLQTRSHTTTEDKN

SEQ ID NO: 992929 - protein, 208 aa, Homo sapiens
MGFHGAAHTPARSSTAHNPQADTTRKRAPAATQRRRPCQPAKATTEQERQYGKPHLTTPLKHAHRHIRTYTQGSPNARDSLTRAYPNTRLGQCSRRTHLRGNIAAAETHRAGTPPGRGPTSSSADKALMTTHCGTSKTLSDPQTYNRRAHAHTPQKPSNRGDVATIYTIVSTTKRTQSRVITPKRGNRTNGQNRLVTRSGNPTTAPRR

SEQ ID NO: 992930 - protein, 40 aa, Homo sapiens
AAAYYYYYCSNSSFYDVRGHGIILKYIGMAKREINKLLKK

SEQ ID NO: 992931 - protein, 73 aa, Homo sapiens
MPSVDTPDLIALQGIPEYQNNKHSLEQATMNDAQINSHHKPHPDEKDGPHTRDNNAEGTRIKSATAPPSTENT

SEQ ID NO: 992932 - protein, 30 aa, Homo sapiens
AAAYYYYYCSNSSFYDVRGHVIKVFIVLFP

SEQ ID NO: 992933 - protein, 134 aa, Homo sapiens
KEKEQFKKEEKAKDEKFKTTVPTRRLKHPTSSTQGTQSRRQPIRAAKSIIATGTCKSKENVKGRQHKNTSFWVLANHLFPDQIFQSLKGNKNAAKLILTLLHHIPPQLKDSLIELKESSAKLYIESYSSTTVQE

SEQ ID NO: 992934 - protein, 45 aa, Homo sapiens
AAAPAEEKKVEAKKEESEESEDDMGFGLFDYTAFVNMSNKELNLE

SEQ ID NO: 992935 - protein, 107 aa, Homo sapiens
MPRRNNTIAVHYSYSSVTRQLTHSLLANIVPIAILVFAACEAAVGLALLALNLQAQYGLDYVHNLNTLRPMLTTTSSQPHYTHYQLTLTLQNNTYIRINTTTHSLIY

SEQ ID NO: 992936 - protein, 67 aa, Homo sapiens
TREYFPYPNGKPSSNVSPSSNADSHTRYHCGCCTVCHSCCLILIFIFLSVCSYSYQPLHCSYTCSRR

SEQ ID NO: 992937 - protein, 334 aa, Homo sapiens
RIVATWLTGMSLQPPLEEVSCGQAESSEKPNAEDMTSKDYYFDSYAHFGHPLKEMLKDRGVRTLIYRNSMFHNPALFKDNGGAGTVEARAAGNPLSLFAAKAGARYGIGIECASISDYAVKIVNSQQVRPRGDQSSRGSGAELRLPGQEVGDIIHTREWMALLVLFYDDLMTQQRDSMPVDKWLAPDGLIFTRAGPLLYVTVIEDRQYKDYKIHWWENVYGFDMSCLQTIGGHLSEPLSGMFVEPPKQVVTKRLLIKGGGQFYTVKVEDLNVDFPRFCLQVTDDYVGRLEAYSTRFTLPEAGCHNPAPNLETVSGRPRKREDLPGAQTATGAVA

SEQ ID NO: 992938 - protein, 431 aa, Homo sapiens
RHALGRPHALRGTRWGAATDCRCCLVFTRWLFVRALSGSSSLPCLVRDSPVAWYSTVHHVYPDRLEQQWARRDHCPLFFNNDSAIPAGSPLRNASALASSLHTSAQHSTVNRATHDQYGSSKLSTHYGTTQRKRTQHARLSDNATRHYTHGHGLLRAQTGIHRHRPLPERNRLPNEQPHNASSTIQDKARSNAGNATRTLPTEPKKERRACIGIDTGSALRTAPRAWPRASHIPRTSHPWPSHLHTPPTITHSPTHTNSLGQAKIKCTFLKGATPNKHAITNPPLYFAHLLDTANKLDIPYNYIKMQTQQTHTTHTQTTNKPSRYHKHARNAAHSTTHPIPRHHPTGQLRPQAAPTIAPLRNTPHANTLTSLFGLHIAENANTYSWSAHDKRPSVHTHDQQRSVQRTTHPTLVTPNAHQPHPPTPRTHHPT

SEQ ID NO: 992939 - protein, 300 aa, Homo sapiens
MNTFSVVLQPKVSDTVVEPYNASLSVHQLVENTDETYCIDNEVLYDICFRTLKPDHTNLRGSEPPCLSHHEWCHHLTSDCPWTRLKCCHSAKLASQHGPLPRSSILFYAWTSAPLTQHVCNARQLSELSQVPELTQTRSSMPSNMMDALLTPAHGSNTSPWLLFFRGRMSMKDVDEQMLNVQNKNSTYFVEWIPNNVKRAVCEIPTRGSRWQSSFIGIAAAIQELFKRISEKYTAMFRREGLPPLVHRRGLDDMSHRAEHLDRPRSAIRSRMPGKRGSESKRGKKPQSTKYSLSPNGRNG

SEQ ID NO: 992940 - protein, 162 aa, Homo sapiens
RDSSMKYCTSGSHTCVCGYDRRRICDLLLSSYMSYRCYCTHSSALAELCPVCIPLSFHPSWSRLGCIVEVEVFHSSQFSSLSYGRLSSGPPPNFSHSRSQAPAWLLVPVTCQEAPCDYKTVQLDRARWLTPVTPALWEAEAGGSRGQEIETILANMVKPHLY

SEQ ID NO: 992941 - protein, 161 aa, Homo sapiens
PQQPLQPRMFRLANAYSTLQLVPTPRPTIDESQILGTSGQNVSDIFRYSSMEDHLEILEWTRVRHISPTAPDTLGCYPFYKTDPFIFPECPHVYFCGNTPSFGSKIIRGPEDQTVLLVTVPDFSAPQTACLVNLGKLALQALKFLGFGAKDDDLGGLGLGP

SEQ ID NO: 992942 - protein, 73 aa, Homo sapiens
KQGYAKEVTVKPVSLAEQKQLKGYIPVADSLGQNSKSVGQRFKKYLGWEPQVNDSVEDDIANVVRSKAKSLGL

SEQ ID NO: 992943 - protein, 68 aa, Homo sapiens
QTVIYSTIFAGTLNHSAKLALIYYLSRPRNKDASLYSSANQKNKPSFHRSWHQGISLTQVNRIHNRFL

SEQ ID NO: 992944 - protein, 110 aa, Homo sapiens
ENSLVYSPKVWANILSGNSINALVSLEIPRLVERLRRAFKEDGDKKPLTRRTGWKILWDVRRSKVVITEKDGSVWEQKVSELPPSVQEIIAVKGLENWVKSKLQALESES

SEQ ID NO: 992945 - protein, 105 aa, Homo sapiens
AYTEALGNHRQYGPHWETQMNKVNTALSFNKNKKKKKKKKKKKKNHKKQKKNRENNNTTLTPNHTARAHNPPLYTTLRRNRATLTNKQQQHHHPPHSPLTPHSYN

SEQ ID NO: 992946 - protein, 341 aa, Homo sapiens
QLKTWSSSTACFLEEYDCNHDRNKVQWWTIHDGAVMCMDANITCDSKLQAYRQKENLLIYGTGTQEDERYKDAAKANLNYIGLGWKYRLPSKWCWFGYGHNGYNENFMEGLQPTSLMFGGGATVHQVTEAFKLITSDTQGTGFLVNIFGGLMRCDCHLHRVSSWPPTDLEINNTCRGTATTYTESTDAKATDSGPVDFTNYLLVTDFGMKLLTNGRNSSLKSVTFSEASPMWLFNIQLAHMICQPSGLPDGGKMCYNITKSGSWISTLLITGRNWNWHLGTNLQALGPIIAPQRRFHAFRPLSRCAARYHEHAAAPGTPAGLTTTLCPHPPLIHHPPFTHQ

SEQ ID NO: 992947 - protein, 35 aa, Homo sapiens
AAAYYYYYCSEFKLLTMYGDMWNAGQYSECCPPSK

SEQ ID NO: 992948 - protein, 114 aa, Homo sapiens
MALLTRRLNRLFINLPTSLETVNNGLNHPLPYIANGASIFFICLFLSHRARPILRIISLLEKPETIGIILLLASIANSLHRLCPPVRPIYHSAGATVITTSYYPVHPYTNWDMT

SEQ ID NO: 992949 - protein, 139 aa, Homo sapiens
LALVQRESVAVKKAIAHYDQQMGEKVEVAMETLRELLDLCRTSEREAIEVFMKNSFKDVGQSLQKGLETLLDAKQNDICKGNLEASSDYCLALLKDIFGRVEEAVKQGIYSKPGGHDLFIQKTEEVKAKYFGSLGKETG

SEQ ID NO: 992950 - protein, 37 aa, Homo sapiens
GFAGPAQLGLIGTCSYTYLPFSSYPSTPTSLPGFPRK

SEQ ID NO: 992951 - protein, 86 aa, Homo sapiens
KQTAPQGQCDQVLSATRLLQAVARLTPQPLAHGGPLPFAHWFSLQLICSLSKHSLTTHHVLGLVLSAGGMVVDQTIVVPALSEMII

SEQ ID NO: 992952 - protein, 257 aa, Homo sapiens
WSRILCLRVLRLCGRVGGIHGSHSRFMGGVLLLIRTFRFEAKVSQIMEIFINYNWLVRKMDMEPTRENVASPGEAPSPSCENIRGGGFPPHFPWGQAFENHSHVTTLAIEATVRAFFHGPPFFREFIAAYSWFNPPVDHFFTAHFKTHLGEIRSVGTEGSWGELIEFAPSVGRGDRTSCGGQAWSLFRCTLGGTFLLENFSGWFSAWNPGPKDVFSRLRGARTLGPESKAWGTNTRAANFFSQKIKFPGGGRKGPRG

SEQ ID NO: 992953 - protein, 127 aa, Homo sapiens
PTRTLLTYYQSNLKAKPFSPYMQTLYGDYDIDTPWLHSSCHLRYPGPGVIACRQIDQLISIDDERKVTYTRIYASCHRVQSNIANLLDKARSPKREVPPIKLDSAYALRTSVKREVTTRRSLCSAIT

SEQ ID NO: 992954 - protein, 193 aa, Homo sapiens
MNETVTYPVLESSLSKPYYVQERRHRLVIECSLHPGEVRTGAKPREIREKNQPIIVQGLDRPRMSSPCAIWAFTHRLNSRVRGNVANHVLSAMTVDGSLPLGVIAIDGEKNWQSPNSSSTYATELVGLVSRAQHRRVPPSNTPMETGNARDADMTSQRSCGGTWTNGAKSSSVASEHRHGMMPGRPWTHEPER

SEQ ID NO: 992955 - protein, 188 aa, Homo sapiens
WYTIAEIDYHELGRRLQGNNIGARFRKLTWQSEDFNGVPTGISPITRRILPRAFPHTLRESSELYFHPFRIEYVSALEGRWISTNCLYEEDYHIHVTQYPFIVNARELLHTVTKKSVLGALRYPNSRLSNVMGCSKKGTMFLISRADYPKYSLFQLVFTIVYTLRIDARIPILNVDTKLFEQGTTFLK

SEQ ID NO: 992956 - protein, 263 aa, Homo sapiens
TELLLLEVCQKTYIGQNLNLQRGPHVRDFETPIWGNDPCRRADHSGTICLYAVNCAEELSTDLTAPAVLLLRCPKVSTPTKPKTIRHATQPVPGGRRGGCVLPRACTTILFSRLAALQTCCTQTLQVPTLRAHTATMRHVDAPHSNPNDAILMSDGTTTTIHHLPTEYGYTNWTLTQIHITALTRPATHLALPYSTHRTYPETHTTIHSWDTYHALTLDHSRTTPIGTTSHFRLITRTQDLTDTPSHAPTAANKYSTSALLTL

SEQ ID NO: 992957 - protein, 330 aa, Homo sapiens
MTACHPQSSPLGTRVQGPEHPWSFQCSRGEQTDLTSNPLASHDYILKIVPTGFEDKSGKQRYSYQDTVANKEYVAYSYTGRIHPCKSWFRYDLSPITVKYTGETGAAVQIHHHRVCAIIGGTFAVAGILDSMHLHSTLRPGRRSSMGRECIDATIRSLIVRGTLGIASLASSALSPLALNLCPRSGCCPPGVCGRGWGTVKDGRCVAGYLFSRVLFDKLPAEVAFPFSGEPPEPVPARCESRYLATLLRPIFLRNPNAIVSQQVESSTPEGDIRLLFRGPAQAHRVIDSAQTKTAKKIPTNVKYIDLNKDNLLHTNKVPPFSAADSPSTN

SEQ ID NO: 992958 - protein, 245 aa, Homo sapiens
MKSHITSDDVETLGFQSMSTSRVQLVYVCSGINQVNHRGIGYQRLGEMGEGSFKVIPEVCGMKVLQLGRERWWCYASRSITTLVGNMEKPTHISYVNYDEECATRESRKYDRNKVITGVESVHGLDVCMVLIVVDSVGEGEDWYVQEMGTIPITQWPSGLYTPGGIEEQRKLVSVINASVEFRRNTASLTGRENLVWICKLSVERRNDWLKQKSGATPDKSYVSVPSSLGCTSSDHDAWQAKVVT

SEQ ID NO: 992959 - protein, 30 aa, Homo sapiens
MFSAGGFRRAPGVDRIRSTGIATQTVEGIK

SEQ ID NO: 992960 - protein, 149 aa, Homo sapiens
MWLFEQWSQQVIGNTYFRSLVVNRGSSGKRPTVCVSCTPFQNSHILCQLMATPVPRGHPGCKLMPLLLAGKSIVRKSIHSVGAKAGLHDRGHTPMLSSVRKTRIPRSKGVNITPMVPPQDSHKSVPWLRSLMRRSGNWCPRGRVNEVGG

SEQ ID NO: 992961 - protein, 145 aa, Homo sapiens
MHNSMHIMSTLASNMSISSRHLSKRPNNTHVRTLARKGAVRTLESQGVLHDLNTAAGPIRHSYSFNSPRYIITLYCTRINQPLISSYQYLPEGTSYSDLHFVPMNLLDNHYLVHPKNLHSDLPDSYEYEPGYPPIPIRINSINLL

SEQ ID NO: 992962 - protein, 429 aa, Homo sapiens
MVCRQARMHALYALSSPVSQPFSQQQARRWCVPASTADNMTQNHRTVGAAMCKLFPNTLWTQTAHARRLRSTTSLIWLPTLMWTHGTNEAFTAQSSQRTNGQRHVLHHTKAHHDCTTGHCTELLHNTDTHLESVQRPQNPTNLMTAAPIRTKQAQRCAASEHPLGNERLGRTYPDQPQTNRYTEYPDMQFNNTGHTQGLTPRTKESRDSAPRAPQAHDDLGETAPDAYVPAPRTANATPEGQGRASSMGQQTMRNAHKSTPATPCSSQGDELKQTPGQNRPTPRLKKAIRIQPPNKLKTPKHTHAKQTTKAQDKPRRCWPRRHRKQRTRHFEKILKTPHRTSRQRRHKPRTTQQNTTRRTRNRTDTGEKHNQNGSAKKKTPQSERAHNKKTSPRQTHSRTTNQEKTKQRERAKNTDTERRITKHQTQSH

SEQ ID NO: 992963 - protein, 171 aa, Homo sapiens
MFPIGLLCLWWCMVAIHYVSPLKDRACAKFCVGGSTHVVDEAGAIVTLQGWGSYIRGTLGRVGTLFSHFSSGSLPESQGFHLEGLVLVLGWAGFKTSNKNPYPGILVLAGGRSLWVINPFYQGDNFGYHPVGCHPRVAVNILDVPHRQKSGLSAIPCPDYRGGSTLHTTNK

SEQ ID NO: 992964 - protein, 339 aa, Homo sapiens
VFEVFEVFWNSLAGDYSWHNPAQGAATSTRRERQSTQRKKRTTEQESGQTEKEHTSKRPQAKTQAITMNTTDTQAEHTNNRQTNTDNKRTPKPHRTQGPQNRNRTTQKNMKKGKDKPQPGQKTEKQARHNTEANTTKKNSKSRATQKKELRSRKRRAQTDRCDKRARRKRQRRKERTERERKEKEEEEQDEKQNHNNRQKKEHRKQRKAQQKEKEKETGRRTTNERNKSETHTEEDKEMRKQSKEARTERTRTEKRERNRRTKRTKQHKHKNTQRKEANNENETNRETNQTKKNSRGEAQKLQHGRQEKARPEHQRAERKNANHDTHKRAEATQKSKTT

SEQ ID NO: 992965 - protein, 456 aa, Homo sapiens
GLVWKWSFVLVAQAGVQGCALFGFTETFCAFPGFKVILPCLQPSRVNRDYRRPPPAPSLILGYFVIKNVGFSPCVGPGCGSQTSGPSSVIPPNFGLPKVRGIIQALSRQRPSLRIASLFYNKCDKVPLSVYSGGSHRNTAGHFSLRKTKTKHKQQQQQNNKRGGARAPTKRDIPQRKRGSTKNIIHGYITPADILCGSPNRRGAPNKRRRRRITKNAQTRHGRPDRVSNTPAPPRQRATHNASNNQGATLLGKEEQPPIQPRGGGGHPTWGATNTQTDRIKGPTGENYNHFTARSKGGVNPQGENNSPRPPEQTLCATPRLAHLTHYFRERRNITSYRTRHKHTQQPPHPRRHNPSHEHHQLNEAEHRRRTKHTATTNQNTDHTTPTQSENDDRNGPDEQTKHNKRKNNKTSSQKARKRTSTTHTQANTTAQTDNTKQTNDEPKTRSSRRTKIDRN

SEQ ID NO: 992966 - protein, 129 aa, Homo sapiens
YFTRESKRGGSGKRGLFVCPLPTSSPCGVWAPVVALLALLPVSTHPKESVGTSPLRVPCVFFPQTPFNVGEGKREEKGERGALCAPLSLGASLWRGALCPTAVGFTLSLWGSFSPRGKIGGNKPKPRGD

SEQ ID NO: 992967 - protein, 343 aa, Homo sapiens
MVRPHYLQKTNKNKHRNNNDTGARDERRAEEATEDNLNNAGTPRGRDASTASTTPHAYHNPVNLGSYRANHTPSFDSKENNKPNPVRRKYLTTAAHSRGAPGAAGQHNQQYREELSRGEGKAATEQQPPQHNAEEHRESVKTTIAHNRPPNIAHTTPPPHNQEAFAAPAEQQIEPPTPRGHTSTHGRAANHHPGSRWATETTDTQNKPTDPGKRLSLPTLPYKNNPNIKTKLTKTPTYKHQKPLNITPPHPKPTPHTLAPNHNLNHHTKYTRLPLHTRNSDNTATPIAEWRRANKPTGAPPHTPPSKAPTTPTHRHTTRTAQRHHPRHTTHQHGTTAHTPTTN

SEQ ID NO: 992968 - protein, 115 aa, Homo sapiens
MICLRPLSYPDSDVILMCFSIDSPDYLTRTIPTKQVEPQKSSISVPRCSIILVGTIIRIFGMMITKAGAYAKHEAIDPGDIYLNHRLEYLAKTSALVRLYRSTLELVVHATYDPK

SEQ ID NO: 992969 - protein, 174 aa, Homo sapiens
LLHSAWTEPGARSPPRRPTIASPTVTSSPHPSDLPKDPAPLQRRQHRRRRRLSLVAAMTTASPRRVRQTYQQDSEAAINRQINLELYSLLVYLSMSYYFDRDDCGFEELCPILIFTQSHEERETCLRTLDADAGRNPNERLGRHLPFTDDSRNTKHCDALVNRRGWRWQLALCH

SEQ ID NO: 992970 - protein, 116 aa, Homo sapiens
MLEGGGLHRRAQQGYRVLKPYGGWVGEWGSGVATLRMGAKATDVYLTVTLHWGNLKNFIPRGNYNDVALLGKIMGIFRKNHVWPPKWLPLVNLWVVKWFPLDFSGGIDFGWWSHKS

SEQ ID NO: 992971 - protein, 391 aa, Homo sapiens
TWLLKAYQELLATVNEMDLSPDEAVRESSRIIKNNIFYVMEYRELYPGTIIRKFDERCQRPNRIPFDDLAGDQTTSFLKMWSDSVGADGNLVVQKKQKKRRKTKKKVLDQAIVSGTVPSSPEEEEACVDKHHGMSQATRAVTPELLETQHGTPKEHTMTADTERAKWHRTQSERQQDQWTNGKPKHWNHDKDKAPTRDTMTTSMTRTSNGNKIERPDRHECRKQTIRAQILSKRAQKKHTKDDTTTQTLGTRTTRKHKHNKNPRATTARQGKTHTRNADIHTGNSDSRKEDQRESKPDDDRRRTKVRQRQESDNQTQRTKKSKATHRGKEEQERQTRTRQKHRQNPTSKEGRKQTRGEDSEQETTRGSRRKSTANPSRKDSRTDTGARCRR

SEQ ID NO: 992972 - protein, 89 aa, Homo sapiens
IDAPDGHRDFIKNMITGYISWLSCADPVSSLARMVGWLNFECLSISTELVQTLHERLPVLGLTSRAVVKTNRNMSVLKHRHEIPPEVHR

SEQ ID NO: 992973 - protein, 102 aa, Homo sapiens
KTTPKSQNGNGKDSYQHVVIGLGRLRASPPHTGHLIYKLRVDIDEKKPLITYLRRRLLRWERAPSSMPGSWIKLKRLERRNCRLSPIDHSPMSENHETSEVL

SEQ ID NO: 992974 - protein, 414 aa, Homo sapiens
MTEPPRNMGLCEETKPITDWVTQKRQGEWNQVGKHTWDIIQENFPNLTRQAEYSNSGNAENPSKILHKKICPKTYNHQILQGLNKRTILRQPERRPCHLQGILQTNGDSQRKPIRPKNGGPFTSFGKFPRNSHRAQILGERIEFFDTRLGDSPARCNPRAQQVSSTDTLYRTNSPTRQRSEVNASPQEERATTTIYSQRKAPPTTPHRRLTAHHSHPTTAPRSASPHTHAHNTAIQHSTNNLTTQRTRRDTQRQRGRVRETVQAQRAGDGARGRSSDKTRGDSGEKKARDAQRTDEREERIVESTSTHAPREQNGHGHQAGDESAEKNELTTEQCTRNNTEQSRTRRDENATDQRTAEEARQYEKYRRFHERPTGSESAENERKRVRRGERKRKERDKGGPHTDSEQRHEGAKN

SEQ ID NO: 992975 - protein, 77 aa, Homo sapiens
SGVPATYIHQMLLMTVRWFAFVRFTTGDAMSKEGSNACAHQSTVDRVDDTVQRVLLDCVQKPCDWIKDRLDVMEVWY

SEQ ID NO: 992976 - protein, 447 aa, Homo sapiens
MGFFLLRNAGGQLDEAAKMHQVRSLSHYIDSRLTKPERNLFGENATGPMGELKRPPCSIPLFGRRTFLYTLFITRCKNVDDHSHRVLAANVAGVIPERNEERDVITTLGVRRNKQGEGAGESICTARTNLWWRSADIHASGFLIHVHMYTHATRLTHAHHPHSRQHTTRLALAVTPRSLPSPPSAPHHQPHRPPRSTRGGPATPRDGPERTRGRSARSGAGTATAAGSRRGASTGQRTQGGGRVAEGEARAARPRGSERRRRGGRGGAQVGESRWDQGRQNRARHKQPSTGKNGKSGREQQARREGQQGQVGNEEARDSQQRKRDERHRTELQRDRRRDTERTQSTGQAHRAEGGQARRGRRALGGETDQATAPKRGEASRQRYAARDRGDQARTRAKRRSGGARRERTGEDGEIGTRAQGRRGRSRREARATNENREARAAERDSD

SEQ ID NO: 992977 - protein, 389 aa, Homo sapiens
MRPPYLKIIRAIYDKPTANIILNGQKLEAFPLKSVAKNRDALISPLLFNTGVGSRARDNQAGERNKGYPIRKQRQVEIIPCMAEDMMVTCRKVHTVSAQNLLKLTKQLQQSLRTTKSTGAEHHKQSPITSNKTDTRRRAQIQAGEPSHYNKMGTHKHNPHKHGRSETKKSTPPRNGPQTIPRHTTENTCDTQSGEPIINNTPHTHATETHETQRQTHGTKTVRNTRGTKELTTLIGHAEHPPTTYERLHTQQREDNKDTHTELYDPQTDTRTTTTSTQQQPHTTTTTDATERRRLQATRAQRTAEERYTRAPPGNTRAAEMTRNHPQQDPHDAHTRTHTHAHAPSNTKPRAHNHHTDGATHQPQAHAPRHTQSAHTQTHRSTSDAAPDT

SEQ ID NO: 992978 - protein, 232 aa, Homo sapiens
MAAGAAAPTPPGARHLHTPPIHSHRTGPDPPNVEAGTDTTPHRRRAAETTPPAEENKHPPHHVNPTRRTHTQGGETPHTTHPPPARKHTAHQRPKLTTRPLGCRPPSTGRTLHAARELKIKEHTAAHLTQTEVQQQRNGRTATTPTAVTPRPKHPPLPPPPLELSTNLSSSSHRSTARSPITRTPRPPAASRQYNKKHNSERDLGPKSSIPGFDAPPPAPRPQRARSHAPPP

SEQ ID NO: 992979 - protein, 284 aa, Homo sapiens
KGRCFVSAAELPDRPRAPAEKSLEPQHSDGTTAQLVYLDDCGHRVVANVGPTVCTPEVQCPCDACCEGVEFVTKLVAMLPQFCRRRLTRRTCGMPPRSPDRQAPPEKICHEEEERRVDDDDQGVRQEIAPEQKREERALMVVYTLNDAIAETDLTVRHIKLLKISVVLMERAYALAMEETERKARRGTDVDVYCFPVSDVVECEERNISYYSEYRMTLGDVGAWQGGGESGVPDVFRGLGYAATGTLRKRSDVGMLEDTQFSSDSGTDETFGWVRHLMGDLGSC

SEQ ID NO: 992980 - protein, 267 aa, Homo sapiens
RTLFFRRSVVAFLCRSQWNEEIAALVIDKWTPDMCNSMVLAGDDAPRAVFPSIVRAPQNTSGVMVGMGQNGLRTMGDEGPEQALAVLTLKLAQLRHGSRSLNVGRHWRRLVASTTVLQASCAVGPEEHAQLSVERRPSLNPQRRNHERMMTQIECCEDHSTDPGLVYTWPSRPVLSPRTPLGATHVALSWTLETGVTHTGPIYEGYALPQAILRLDLAGRDLTDYLSVKILTDVRVQFNQPRAMREIVRDIKEKLCYVACFELAMGT

SEQ ID NO: 992981 - protein, 71 aa, Homo sapiens
GTDEETTNSFCRIVQDDKYRKNVLDGKDKTVMDGRSESTLMLTGSGHNDCHLMGHAIDVISNTNIAINIWT

SEQ ID NO: 992982 - protein, 115 aa, Homo sapiens
MPRSLKPAAELGDNRGQVTGPRHLGTIRDRNQHMRQGLLSRRLENTRKGLNRGPLSLPTEPACCVVLRLASGRVSLGQGLSGGDPTWMSGAGFPTRKAGQSRDAVGRSGACPLPC

SEQ ID NO: 992983 - protein, 70 aa, Homo sapiens
RLLRTRGGVAWGLPEEQSGRAPGSRESSLPGANPLPGWRLLTQVGAQVLGRLGDGWVLALVPRGNSRHTS

SEQ ID NO: 992984 - protein, 316 aa, Homo sapiens
MASNVTNKTDPRSMNSRVYIGNLNTSVVKKSDVGGNLYEVWHKLVGCSDHKGLAFVQYVNERNARELTDSRQRIGRMIAGQHNRYKPGLQQPKVEPERKSTVKKAEQTNGRLVRDTITDKALMNKTTEHTYTKGSTRKPRTKIPILTTTPKKTRSADKGPQNTVKNHNKGNTHTKNGEKKQATQTINNGATKRHTQNDRHEHRHTTHTGRRKRARTPTTHKEEHTGTPEQPQGQPDQRTQPEKNNHGRTGKQDRPINRDKEGERSEEGAETDNQRRNTSGHKRPGEKERQRGELAQSMQRPKKKNSEQRTDNGYEY

SEQ ID NO: 992985 - protein, 107 aa, Homo sapiens
MEKKNTKKVWSLSGLPTEAVALKQPSASLRLGEISLALWDIRLEGITARFSSQLGHTFPMCLCSGERGRPVNIVPQRSHSNKRGQRGGLILRGDSVPKKYPLFTQVD

SEQ ID NO: 992986 - protein, 355 aa, Homo sapiens
GKGTGGVEWRRGVAQGPGASEATRWRPGQRQEIMLPLVGRHPTRAWTLAGAPTMAGCAKPVLLHTSSVLPPRAMPIPAMTKCPQPGSSQSFKQHRAHVFQNDPDTPSRNWIPSRASTHYTDLLLTTMTTRNVYRDHTDIERRTRPSSTEHVTPNMSYNQNISQKYGQMGRQVAPNTVYRAIGGLCHLNRNICTRDCRERSRKCRQATKAGQGRHLKGWRGSYKTDTQTMGDTTHPRQGCPPRSTYSTGSHTGTEEETRTSDRAMMPQATERERIRTLRTGDTENTDREKQKHRTEETANKGGRAHAKANATEPIEDREGQEKSEEEQEEQRDRTNGPHEKPDDETQAKKDRDQRN

SEQ ID NO: 992987 - protein, 236 aa, Homo sapiens
AVSETVPALDVPGLAVMLVVTAGVCCGLVCVTCWLVAGGLVCSEWVGFGDQSGRLLLLLPGLWFPALEQCLGPGLAAGACHGCPLLGAGICDSLRRYRTMLAWLGERVALDHLSGADPKILFLFYFPAAYYCLPACVGISGALDHASSPMWLNLIFNVCFYYLETWPFLVGSMSLGYYSPGSSPVFTSSPSSCEDWSRHALLDTCIDHSEQSSGPVIDVAMSYRMVVHSRPRSPME

SEQ ID NO: 992988 - protein, 473 aa, Homo sapiens
MITVGRSDQWWRLQTDEHSRWLRATRQGETSIERKRHVVMYGVGDAGRTYKMYLPDGNPSEQTHYDGTPTLLGPMAGTTQKRCNCRETTIEDTNGGHMDERRGHRAMNRMVSLNGTENEQQGTEPESSSTTGDKGLEDTTQEDRDQTDTIVDPPTESHRKKMHQNQTQDSAPEADKRKRRQETPEKEKKTKDPGRQIIHTPKQSTDREQETNKGTNTERKTEQRGARMKNMHHETLGNTGQGSQGRATGEKGEVGDEKEENKEKSRQRDKREHTGIQQRDTKSGKEAQREQEEQREEAPRQRTANHTTAAEENGRRHESREQQNKWKNRKAEEAETDSSSNAEKAEETETTQRADKQHPGSSETDAGDQRREKRDKEQDRRQTKRQGKGEQDGRTDRRAGQPTQAKREPAAERDYENEKRKDEEKQADRRGTAGKDRQKNARAWKHTEKGNEESRRRSKRTRNTEQATKRQTK

SEQ ID NO: 992989 - protein, 147 aa, Homo sapiens
MAPDYADIRYHIAERADARDRSDESILSYEETIQQSYESVSADYVRRHASGTESYRCKVPRTAGSIISVKRPCEAKRGSIRYHTREDRSVAPLACSGPSMSLGIKSRIYWHMLGTLLNHLTCVHTVIVHVLFGGILSVTKVWMRHSA

SEQ ID NO: 992990 - protein, 390 aa, Homo sapiens
MRTAGVSKMLATGPANAAVQAHDTGAAMTGPNARWPCGPFSTSSRARRTAESDGSKDAEQAFGAGASGAETVTPRSYLHSADENHNDIYYAGMGDLDSRDIYDGDNRHARHGQKRAKLGECIRICIPQGISEAGSPPTSTWTLSHDDPSMRCDPGEVAEQKQHPMNTGKKLPGSIKVWASIGGSPRLGAKKPEINSDWAISFQLVSGIRNHKNGYEMEELRVDQRRVRREGVEERANAHEGSRSTTTTQATTWTDEHRQGSIPAGEMARNQWDRAQGPGNESKGKALGGHHRRVKERGKQEAVYKERGKARNPEPQRKRGHMETKRTVGSHHECLITRKRRYQREGNRSHREKNEGGTTAATQAQPNTTKSKRTEEETRSPRERGTKRTD

SEQ ID NO: 992991 - protein, 303 aa, Homo sapiens
AGLANAWTCFGTARPIPPPVWPGNGWAQFLLLWCGGAAACVLRCPGVLCDDLLPIPDSPVCTSHVATAAHPWLWSHWKPLCWLTTCSMDQLLSWTLVPGSLPLCVCACTPAGLSACFLLLVTNVGFAWVKHDGTLAVVLQLMDVQCNACSHLHVMMQHAVPSDTTCWPMTEQHLNNLMAQLDPLFELCDYSVLEPSSELLNMKLWTIQKLLQDSKPDKGYGRLQNQRPCRPLPEDFLVTRRHQEDIGGQSVPAKEPKIGAQMTFHLANSWQWGGNNGNVRQLWRRAPLQSLGWGIGCIKVIGR

SEQ ID NO: 992992 - protein, 111 aa, Homo sapiens
MDSTSSPRTVSTMTTMYSLVCLLLTINGDLVRRGHYTMLYPGSTKTMWFNVDDAIITKASINGLSWTAEGYLLFYHKHVPGIRVMPYLQLVRKTNGNAFGKPHKVILTLGP

SEQ ID NO: 992993 - protein, 69 aa, Homo sapiens
HASNEEKIRVDILENQTMAQAYAVLGMICYDPEFGLDKISAYMKSSPDSSQAPVFSLGWLSGANQDRAV

SEQ ID NO: 992994 - protein, 353 aa, Homo sapiens
MALDWIAKYNQFIASMQSSKVNLCMCRTQDVALEMNHQVFYNVPGGLAPKARVSTKAIRLLTIVLVFTVLNSQGGTFGYSQDWDLPDWGVRFPYPLGRSSNFVSQTQGELPSGTHWSHLLETLEGVLRVQWNPSTVIGDREIRVHGPLRVGHWPFCKHSMSLTDSVAPPRIKRRYKRRESATKPRGIRLRERKPQKKPLEADIGKHNFCSPSLLGVGPEPPFGGTSDEKNLIESLTPVNAHVGPISLKKKLLTTHRGSLIKGKETLKLNLLSNIWIPQHESFWNPIPETNSITPKGGTTTRLSQNPIYYYKEESPVIPKRGVGRHIQETHSQIVLEQSQETISHEVGCDTSHI

SEQ ID NO: 992995 - protein, 150 aa, Homo sapiens
QTWKNIPCSRIGRINIIKIAILPRAIYRFNTIPVILPISFFTELENKTILKFIWNQERAQIAKAILSKKNSWRNHATRLQTILQSYSNENSMVMVQKQTHRTMNRIESPEFMLHSYNHLIFDKVNKNKQWGKDSIFNKWCWNTWPAYTED

SEQ ID NO: 992996 - protein, 86 aa, Homo sapiens
DSWQYQTRAMRASSVSSDILFYKSSYCTNASPYDIISVPAIRLLLLRNENVRTLYCVIDTACEHLTVLIMLSISHINKVTWNPTCE

SEQ ID NO: 992997 - protein, 84 aa, Homo sapiens
YVFPWSCRHEVSTTRGSQSAYILGQNSSLSSLDMAVDTLPDGLFTFICCRARADADNLARYKDLPLDTERRYAQDRRFFVFQIS

SEQ ID NO: 992998 - protein, 327 aa, Homo sapiens
MPHSTDTAPSQRETHTTMTKNHGNTTAMQDHGQHTSASAHPRATWHHDKSTEPTTHPDEHTNPPSEQSNEGQPTKDTSARCTTRRETTKRRKQEQSKDTHRTTQHRTEPNGTRIHTEGIAITIDDTDRRTHIGTQGQPISSPDIEPRRSKKDDNEDQAEYNKQHQSHDSTARYTMRDSNRTHTYPEDPHRPSGTHEDDNPQKRSASEHHRPNMPPHNRQTTNTKQPLHKGQNNDDTPMSSSKHNTTQATAERRTAAQRRTHAQKQHDEQKHDRGTGKAQATPDKHTPRHTRRTRGTKQSTRENSNYKQPTHTKQGTEARRRTQQKTQ

SEQ ID NO: 992999 - protein, 189 aa, Homo sapiens
KICDRQPQTCLLPDFCSRWQRSFIRSEVSLFPPPGPQLVFYPITEGQHSKSREVAIYLPVRSTNSAVRIDGREARSCWSAVSIPLRALSDQSYIALQSWKGIMITTYHTCYCPQQITGSPEFDRVSRAQQNCVEFDSYTSVITLVDGWVVFHPGFGYLSGSGVHIGLTYSFWGDIHAHAATNDGSSVSD

SEQ ID NO: 993000 - protein, 536 aa, Homo sapiens
TRGITTTDMTFQKTHNYESSTTTHSLIISISPVYVLFCNQTQQASLFRLFPEPFSVRARVTDPPSLDTRHTMDIPYRDRQAESSGRSHKRPSLIRERNRRIYDAEEAPPEPIVTTPKEFLPHTHKSSPCTIDVQTIPNQEERQTKRKDTRTHNHYYPSDNGNTAEKQRVPRKQVENPTQTSTDKHATKRRHQKHDPRQAAKRPTKIQNTHNQRTKAHNKAGHPREATHDTARSEEDKETKPRQHNAQPAHQKAHKHKTTKSQQKTNQNYTQTQGSTKKDTSEHHDSNPREDTQPHSNTQTQTRRTRGTHTQKYKEKWTKGKDPHTRHKKNQHKHNREHNTPNKEPHKERKRHRQRTWRNQEQNKSTDEQRSNKTTTNEKGEKSNDNKHADHHRPPATHKTRKTTTKKVNKSTKESTRPAQRHAARPKQQNDDKKRNISSRQEKANDKRAGEEQGEKKQRDTERDERAGKRRRWTKERMPKQVGATHRETQRQTRTRRPETQRKENKQEKQTQEERARRRQQSGPRTTTRSHERKHE

SEQ ID NO: 993001 - protein, 111 aa, Homo sapiens
MGPPGGKHGRVTRPVLPLSHWDSGLTTGGVGSLSSRAFGGWWAPAPSLFAPCVNRQVPGQGAGEEGHFWDRSLQLYGGSLSLWRGYRGEYSVPRFWLLRWAGVTSVSLTRP

SEQ ID NO: 993002 - protein, 117 aa, Homo sapiens
MTQFVVVTRHGPVKPYITRRGVELLMAIPTCEASLYSASNEHSVGKVAFKVKLRTNVSINEQLGYKPQTTVRTLVRNIPRYENWLNNIAEDAIVSNYAYGFNADGESRPRKDGKCQV

SEQ ID NO: 993003 - protein, 318 aa, Homo sapiens
MWAGNLDLSLEIKRLLEDTSYGSEICVTKFEPRALRQSSVALGVSESKHAHKGKEPHSQLAAPVSRKYLQIGFHSRMDKLRQANQVFKYLILTLYTLWPSEPVIRPLGHGDILNNIRDPFGPITMDKLISTSIVKLNNYYSTLYYSSAGKRSRPSRAGTHRWMKPPNERPSRQQRAPRTARETHITHAKPTKHRTTNTSTKHQHPHGAEIQKKTKRKDNSPRWGHITHQTPTLSKMNTTLRAPTRHTNMNQTTKAMPEQHHTRQKQPHKERQTMTNDRHNNMRQTETGTTQYEQRTTTNGPRTSATPSSSIQQMRRDR

SEQ ID NO: 993004 - protein, 81 aa, Homo sapiens
MGPGALLQAISPGERHCDRRAITRETNEVQRDSGRCTERTVTRYREMEARSTTTNYRQLVGDDDYAIAGKGRDKDKGRREL

SEQ ID NO: 993005 - protein, 114 aa, Homo sapiens
MRSNICMHSTIDMQRMATFVGNARIDSMKRDDNESKGADIEPMTSGESRLLPNRPKPRVILRQTALSEASLASLEAVEDEWQWKLWHTVPGVNTSVATISFSSNPKTQIVLESK

SEQ ID NO: 993006 - protein, 171 aa, Homo sapiens
MYILGRKTLREHSGVRAFPLDQLYRHAWNTKPPQRSPTEKLGSSTATATRPCETPRNGPDNPDNKQEITANTENKDLVGPKHHPVSKGISSSKYIGLTGNPLNYNNNKPWRAKKKTNEPGTDQPINKPPRENENTIREHVEEDLTITKERAHNRPVAPHGSRPQKRNTRHH

SEQ ID NO: 993007 - protein, 107 aa, Homo sapiens
MKVTQELDGISIAGTKSRAWSPTNKEFVTYELEDAPTLCLVSTQDYLGSGVAFNMIEDCRKRPLTLKSIQFVRTTYEVIEIVKCIGNQCTVPAGQLGDGQHVGRYAF

SEQ ID NO: 993008 - protein, 282 aa, Homo sapiens
MSVHGTCRDMCTVPRVPVRRVHSPQDTGLQRHDRSRLFSTNTRDCSGHISLDRRLPTRTTSTHGIRTTSGQRRKEPDYIPPSDNSANSWLETASRTHRLTPVGLNHVLFNVTFTLTGPNDNISTPINAAHNRLMDVAIKIFLYASPDRNPTDAGALIPWPASPQPHPHESTIVHPTPSQPGQWQTFRNTNAMGKLTRPRSLHSTRNSQHELFTRLPTRLSTTLENTPKREESQLGVAAWNHALKPIPGPPTLYIVSRPNTPIVTLTKHYQELATTALVPTPH

SEQ ID NO: 993009 - protein, 214 aa, Homo sapiens
MRISSPKSLIYCAGGTRPFGLMSNTGNLHPIVERPIVCCNTARHWHSGTYSHGKLQRMIVGYHTRPLNDLTPTSNPRSSLMANQYHRDVSKGDTPWMPYHNNERTSHPLHTGGDSRPLSINTISPPHPKRQVRPQPDPITPRHSPAAELSFRAVTNQTVPSPHAQPHHKLSRRPAHAHPRPHTHNRLASPEQHDYPTEHTYPHGKPPSPKPVID

SEQ ID NO: 993010 - protein, 305 aa, Homo sapiens
DGAVRVLYPASRAGEQNASPRIPGIPVLFHCIPPARVGPRWTWIRRGPPYVEVKGNIELKRPLIKAPSQLRLSQEARRQEEAYQMEDGREPEKKRTMRPWVRRAKLPHPTQRVPSLTTVPQHTEGRPQLTRFPRRTRTPVYHSVVATGLEEPEARSCCPCPEVWHMMVCLPWQEGKNTQDKRSAWDLQGQPCDLDAATKTVPREDSRVDQDENQQLSGPAQEMPSSQVRPGGAERTPPAGVLQPRLRAKADHGTQELKDLPAGPERNTGTRQKACAPPRHATRERHMFNTTRRGNTTHDTPPGPQ

SEQ ID NO: 993011 - protein, 147 aa, Homo sapiens
MRDMRHTNWSFDTTQGWRCTQPLVENICWSNRKRPRGGVTHNTSVAAVSGGGTKRSQPGAVKNGVCGRSSPPRRREIHVIHHICCTRRERLSRTALAPNRPVADERRDHAKRQPTTEVEGVPTHTAAGRTHVSPNTARRTTKNGGVW

SEQ ID NO: 993012 - protein, 310 aa, Homo sapiens
MGTSCNISPQRGQGAAHSHTTCTKETRWQYTDAPWSTQERHRPKWEEIQMLVTLQVDEDIPEECQLDVSQTQGELRDPQKHDVGSQIRKSECDEAAHKQHSAEVNRAHIDLAQRSPSSQQTEGSSQEYTGSIARQTQGTGTHNSEEMTTKRRVNKVRTGIDTYNNNYTTKTSNTREEKSSGKRKNKDKPDKTTENAKSTRTRKKNANQERHKTQQHHNKKDKDKKDGKHRKRGRAGNITQNEKENKGPKKTHTRSEPKRTGTETHKKEQTHTKTEKKEKEKREHQTGNNKNTNTKKHTTRRRKRRRQKHD

SEQ ID NO: 993013 - protein, 151 aa, Homo sapiens
MTVMIIALTWCLPGFFSSNTGAMRTCFFLFFFSWDTDFSLGPQGGHSRGHTSALQWHFLRPEVQGDPGPHPHEIRGYRRPGTPPPGNCGALGETGGFTPVLCRGGQKVRRSQDDAPKAGTGQATARALMKRDELSHETFQKGRTTGWASRG

SEQ ID NO: 993014 - protein, 124 aa, Homo sapiens
RPAGDPLRESKYEADMCCEEISSGITSRWMKQERTVVSGFINCTRRRTRSRRYIIRRACFQSEQFMPARRPWDPPATSCPGATISPVIRLFRFCLGRHLPADQALLILTYLGVSGEQLPLEFAD

SEQ ID NO: 993015 - protein, 245 aa, Homo sapiens
MKGIKKEGNTPRTKTTKQPTHNSTILDQKRKQKITYTHFPLITPEEQQTERLRYKTIVECNHTTSINQGGSRTTVRERRPITPCETHIQREGHNAIRSHGNPTQTQQAIVRHTEKETDGRYHHQATLMAAQRNENGPHKTSKYDSEQERGNYNTTNTDKPHAASANTKQLRHNGTNQIVREEANAMTETQRQQNNTVRSTSCDDNTPNTKQSSPTRSHRVDHTQTTQTPQNSSQISKKDEQPEIT

SEQ ID NO: 993016 - protein, 149 aa, Homo sapiens
MCMNAPKRVRINCENLYSSRSRTKGRESSSRPATGESRSSAIDSAENMDQGHPRIIANRESPTEEPSRDKISALLHVLEFLSVAYNHRFSIIVLLMALATMESIEEKETHLVARTLRELLPNQIRVAALFYLHVRYFLPAPTLGQTSIR

SEQ ID NO: 993017 - protein, 197 aa, Homo sapiens
QEASAVAVREPRGEGAPVLTCRAGRSGLEPGTFRKMAAARPSLGRVLPGSSVLFLLMTCSEKFRLQTSAYFPQMVSVAARYAQGGPACLRCQIYAVRSQIPYKVLGPTVPRAEWLRAFGRMAKTCFSMVPALSSTELDRSAPAALCVCSVAIEDSRPGILNHEPGLSLDRGLSVHVWWWTPVPHRSQGVDRLVALAR

SEQ ID NO: 993018 - protein, 229 aa, Homo sapiens
MLWAETIMVQFQRLDIVWLVTLVLLGLILVADVEVLYVQRSSGKISPGTWYNRPRACLTPSYYMTKKAPWIKHVSGLRVYIDLPERVIFHCRESLFQGAHDPLIQHMVGAGTGIQHVVSDYSVCGIVEEVSSVVRCDCGHRMRSIPEMLFVARFPDPPGGLDSPERFTGRVGWAESPIPISRVVYGLVSVRSHLPSAVLGRWVDIAVPVSQFGLVLRLGLWRIFSIMTS

SEQ ID NO: 993019 - protein, 401 aa, Homo sapiens
GVPTKSLFTKTGKQALLGPQTGESSPSSTLNGYSDDRAGLRGLVGPVLDSLVRWETTLGYPGVRVRRVHTGRNEGTGVGKFRTKGVTAAGQKREGVCVEIRREPSFISNTNVLNLQAQGQLFPSDTYSGSRAGTCPYWAPRSSRACVASDHQTHLVGEWPSGEDFFAGVQSAASKRVTSEVLMRDDRSFTNPHSQAKIEDKFQDSFSSLAAKETGNHIIGPCRANGTKGLDRMLPKSQVHSWAKPLDITEENPCKPAGDTSRRGPQGPDQLNEDDMEEHIYTRTYRTPDKKPRNKTTRATYVSTSDRIQPKGTQGMANTWETPTKPETAKPNGGKIIPTKRNCPRHQAVHARHHGGPNTRIGTDKRQIKSASNQDNRTLYDESNKQQVDGTHKNKTNNKRT

SEQ ID NO: 993020 - protein, 104 aa, Homo sapiens
LKRVAEVWMDEYAEYIYQRRPEITVTSPLGMSQSRKSSASSLNCIEFQVVYDDSIVLEDLPMILPNRGMAPGCRHVGGDPKVWAQGCVAELLKSAGAYGLSTKG

SEQ ID NO: 993021 - protein, 131 aa, Homo sapiens
MTETPRLRLIRLITAVPTSPISAQSCWVGITILSKQSATRTTTFFDAREGGDRILYQATYSEFAGTRKFYSFILPGFGIVSHMVINTRAPKKPESLGKAEDEIKEPGLWVSTQYTEKIDRELSVRKRTTAK

SEQ ID NO: 993022 - protein, 532 aa, Homo sapiens
MTRSRLSLTITSLLTELRTRPEPHRGTNTIHATTLSIQPQNTRTSATATPNTKHAQASAAELSHRTHHSPAAEHHDSTTPTQPHNKDIPLGADDNTTHTQPTTPNTPRLLHSNTTATSHRSLEHITTMTSMDHDTIRQNTNEHTGTTQPRAEHQHPTEPPRQDNPSPAHAHYTTRPHTIDLAARTTRAHTTGTPHQISQLTLTPTTNSTPTNTLAHSRHTLHAAYNPTHKPHPHTHTTARAYQMHPKKRKRATTRRGETTSRAQPNTAPCHRRVRRRQANHNATAGHYPHSHADTNQTTSKQRPPRRQHRHVKRTTRRGRDRTRREAGREGIRGRECIEKHAAYGRGDERRISADGEEESENGQGGRRCGVREGAEGRRQAGAADAVRHDDARMIRAHRENNPTGRRPRQRPGQRRRGPALDRSNADHTQQRRRIAMPRPERPAGLAPAGERATRRAEPHARSGGRDAAGSASEERGETPKPAGEDTGHRPRTEPAIQKARPEGAARGRGGGGRRRVGDRRRRAQTRDGRRR

SEQ ID NO: 993023 - protein, 186 aa, Homo sapiens
MKRGPPKDKTMAGAPENNLLRRDDADIDQRDQPSMAEQTTPARGRRSAATSTGRRARQHTELASHTGRNRHQWRRTQPTAEREPKQRHRRRANKNRQETRGKRRQQRSGGRTRQTADAAQRKQDQKKSKRDGQRRNERKARSTSTRRDTTDSRRNMQASAAGGRRPRRATNSPTSAARTEGRRGRS

SEQ ID NO: 993024 - protein, 436 aa, Homo sapiens
CDWSSMQLTVSCIVEQSHSIQVTGSEDTSIPRESYHLYLTMLQGSGGATHYRPARVKLSYRDLSTMRYGDTEYKPYTDWPRARTTLSVSSCIERSERNVVVVRVPCSYTITRVTCAELVSVGPPEVTRGVHCGIEVHDEMMALSPLAGVSCNDACLHLCHVLPHCTGNLCSHYTCSCYCLSGPMQLIIATQYVTRLTLYKCVHFATLPSYNTSSRHKCRDTIEISYTPSSDMLSDALIYLLKVRTRATRVPNLRLGDDCRGKAPTVFGSVSLRNYSMCEPRSSVQGATYCGLLVVVASVRCCTLVWYAIEYKLHVLVHTVRFARCIRTTVGRTERMVIKRGTGVPMSAPQGGPLGNAGGRGLGITLPLMGGGSDHCGGPHPSALRGQPGGGRPTGRQGASHLHGRAGGHRTSYKMRARRRTGAGWRATHLCGVWVR

SEQ ID NO: 993025 - protein, 260 aa, Homo sapiens
HASDKATQTPLSWQELEGEELRMVCTETVSAVHGDGGMSERENAECAQCEERDQTCSGRDEAPGEQHRGRERQSGDGGGRAQSCPRGACERASETRGETNGAAERMPHMRREVTNHHTALTQNATDKTNKTHQRGRGQTRGPGPPEKKRARQTPQSHAVGSRPGSIKAIENEKTRRGPTHDSGRTLTKHRGDRNTEIRVPPKKRRGDKKQKRKQRKRRHGHKPKKRIGKTPKERTAEKTRHSTDTQTREERHQRDKTNNK

SEQ ID NO: 993026 - protein, 486 aa, Homo sapiens
PRKLKSRVKCPVTKTSPRGKTNSHSRGHREAPTVEMGGGCLKALEVWHPSGGPLWGQVCGRVSPRPCTRPSPNTNGVGKPKRGVAKPQNKGETPVVPARTHKALPHKQQRGNPPIRPLHRAKEMCPTPPRGPLVCGGFLVTSTVKKKSFSGNCGPLWGVECAACSESDTPLQRLGPAPRLLSGALRVSTLSVTHCGWPSPFITTPMLCERVCPPRGLREPLSNKRREKVGERHSGLSPARVRPLYTTRGRGKLRRLSSFFPKTLPAVKAPRERPPATRGGHKKTHRGTTQRSSPRKIPREGERNCNTPRAATPEEAPPPPSVVRVRQTTPPPPPEEDSYPHGRTHRAGRAEQTTHQDRGTTNSSKTRLRTPQPTPARPSSQAEEATPRPHSGERRGAEETHNPPTPPPGVHTTDEHNRHVSGAPRQSLHTQTRELERQTTSQPHTTTHTTHAPTASEQQATHHATEAHPQKQPRATTIHTQHTHPP

SEQ ID NO: 993027 - protein, 272 aa, Homo sapiens
MEGEKVYRGANTQTQDRRESKRTDRRTQRRPRQIRRRTENNKETQEQTRTTKQKQNSQGQTTHTENMRRNRTRQEETEHGREDERATAQHRRPEDTRQEPTSPEATQVERVRQEDDRTSVAAARWKATTSAAASRRTQADGARAPDNANRSRRDEERTQSSTENGTDRKGDRARRGQEREQARTERKKTQERERHRDEEEERLRRRRDERRDGEEERVDELTGDGHERGESEATTINHWYEAERMNRQQKQSEKANRSSSKRWVGRFARSSV

SEQ ID NO: 993028 - protein, 216 aa, Homo sapiens
MTYTHITNCMAADVDRRVKRSYRRTTTHHLSKKAFEYGIILCITSEVILYLRQDCFMSLLTTSRPSSLTPKLGAARGPPQAGISTPVVKSPYKSHSLIHIRYYFCIRTFIFTLQLTIVLIENNRNRSNSSTAVYYKFYWWSRISPFLQASEYCESPFTISGGIYGSTFLVATGYRRTFTVISWLNLCCTICCQSVNISNFSFTIQDIQFWPSKPAS

SEQ ID NO: 993029 - protein, 288 aa, Homo sapiens
RQDVGVHDARAGSELEPGVARRDSEMQAARMAAEAWGVHAADGCGERRCSSVSLVGSCGLTPARSLPGEPICLVGCLASRLDDFLDKSMIPHSRLTHREPSEKNLSQGRNLMSFCCGNVQRTMLTEQNHGVPMTRPCSRSTQTQFLKELSGCLCPCFFDGSESESRSYDEVTALGDGVDVMSHLVGPQGAAGPLVCKCPVSWVVWAFATASTPVVVEIVGMHGPCACALPCGAHQSIGFKVHSALLVQRPERKIPPQGWHLGETVALFCLTEPPSGFTMSSIKLWWGH

SEQ ID NO: 993030 - protein, 73 aa, Homo sapiens
TRRLSRYQFDAFYGGEEYSSGSSMQVQCHAHSLEALVWKGRNAHDVLAYGSHRELVQDAHNCLGARPDELDLV

SEQ ID NO: 993031 - protein, 198 aa, Homo sapiens
PELRGIRHKNVSKSMMGHGSDYSLSEGRVGRVPTVVVGDVQLQDEIIRRIMHVHQVKTTPHGNDSAKAQPGTGPKPRESPTIPRNLHLNLTAPDRTPEGAFDTNPCSYRRYSLTHQTERLRTLNGLHPTERIPTHTPPTPPLLATTPAPAAPPADTKRNPDGTSSHALYPRLAPPPTPHSDYITLRSLIAHHHSTHNP

SEQ ID NO: 993032 - protein, 185 aa, Homo sapiens
MDDWTSSSSCQHYTYIGPSVPTTAIKIRSRCVVSLPSIVSVCLDGSYSWHNGVRARDSSWCGYLRFIKTNEHSSQDLSDLIYSSILSYSNVERLNTYTQVQTLVVSVAFREGLARCHLMGVSPVSDLSAGWRHRGQVNKNDDEWWIHRHGILSEHLAELKIGEGKKILFERNTLIERKEAVGLMA

SEQ ID NO: 993033 - protein, 301 aa, Homo sapiens
LFEALDCFLPPTLSTDNPLSLPLHDVYKDWWYWYCTCRPSVDWLFSDPVMVVTFWLRVNCFKRKLKSVDNASHENAFAVAMPLLWRDTLLRDSHCYILAASGQGMFARALNGFAAMTSANDATQPNVKADWFHMPQAVLSCNPSRSMTIASGYAPVIGIRHHGLTVCMQGLLELSIGETIDPPIWLKSLEDGPEILEMSGDACRIVEYGSLAKAHCCVWTSFSRLSSFWGRVAVRDMMTDSCGGVSSYQWTKKSCVELVQSPSLGHEAQKANEYYPYTGTHLNQAGRTGLPTVCSHWPQVA

SEQ ID NO: 993034 - protein, 146 aa, Homo sapiens
MSRQWHLNSLGVDRTPRRTRVFLKNDHTQHKHHTQHTTPPISFRKDSTLNTAEIVYSRTRGPTLRRIVGRINQLEGVHMPIRKVRWRNCKGVVNPEVFRTTVQLMVVPPTTISQQVFGKNPVNNVKNSKQTRGGELERPTKGGLTS

SEQ ID NO: 993035 - protein, 96 aa, Homo sapiens
GRWEEFIWNYYPINGMLIKHHSCELLRRSTKKAVIGERLVRRGHVSASVSRVLDDESDWWSLHQVLASNEKTLVSVSERLDLSVEDLCPSRHRLGP

SEQ ID NO: 993036 - protein, 136 aa, Homo sapiens
MTQQRNYYTHGPYCPAREHKKLTGGPTQQPARINPHPTYRRPHPDPHTDHHQSTQHHSATPIIGPTRHPYTKRLHTQPPTPSPTHTPPHPTNTCTTPQPLSHPPPPYPTYHQNRPPNTSTTPLPHTLPNRPPSTPH

SEQ ID NO: 993037 - protein, 136 aa, Homo sapiens
QGSDPCRLLAIHADLSLLALECSTAWPSHNITYHCKNSRGLHGTSKTGHLKKALTPHRALNRRSRSLRPEGIESVFDPTSVILSGVSMHQHVHHTVKSHGANELDAFEVLRYHPEQPFPDSAAIDIGIVAHLIGTA

SEQ ID NO: 993038 - protein, 449 aa, Homo sapiens
LTCMQQLRGSPDIGHRVSAGCRSDMRQGNRKLSSECRDAAQYSGSSRAQMDTMLTARSVDEGPWVLGMDGPYEIAQGTAPSAKKTWWHATACMNTAETRSTGRVALQLLQPWQNRPTSDYRGNTDFLTCETSFPRGTPKHMDRVEKACSYDDIMALGERPVENTPEMSLLQWLIRYGDVSPFAKSFHCGKLEEMTEGPNYAWSPWFKLSLRTDRHCNKPFPGTNGKWGEHGVRRVGSHSNTDMQVDYLDTASNCSSNRSNNNAPPAQGEIPSLHGHGRKILSLVYLQPERNETLGTGPWHPKSAAQDRTKQHTDRHNRPPPPTPREEAHPTNTPPPPTTEHDNPQAPRAQPAQHTPTHALTRSGDAKNSHPKDKTSASTHSGETAAAEEEGRGPPQARHAPTGSRTTTTTHTAVARRPHLRDPAAEPGGTDRAACGASARTPRPHPRDT

SEQ ID NO: 993039 - protein, 119 aa, Homo sapiens
MKHTKEREEKRQKRGLDEGCRNKEKAKSRQNYTQHHKRGHNKRDQDETIDKKTARGERRARGHPEEEKNGEETEKNKKETEKENKREQLDKKNSNEHKTKSKTDRKRRRKEEKKKKNDK

SEQ ID NO: 993040 - protein, 179 aa, Homo sapiens
MSLLVSIIGDVAGQKACRKWRWSWRNSEDMRAKIHDKYVTGLMIRQQEEPCLTTTFDTACAATVWLKTRDSSWASSVKIKLAVGPNHGNHVARKEGPYDMITRDSIVEAKDENTVPTTPNRKNQTGWESQKQAWQAPNSTHRLTQGLTWASWNPGEPPEAIHYEKTVSHNSGRRTQKTT

SEQ ID NO: 993041 - protein, 82 aa, Homo sapiens
THASGPTQIAGPPSPPPLDRTPPSFHHVPSPPHYTDTPARCRAPMELSGEQYFPLSHQLPKLTPARPQQQIHNTDPSVDPKA

SEQ ID NO: 993042 - protein, 66 aa, Homo sapiens
MRRVHRENKTKEEVKNKSRTTQKNANGHTTRRHTLPHTYASAQTSTSSSSHNEPPRKDQSATPTIR

SEQ ID NO: 993043 - protein, 130 aa, Homo sapiens
SLLKNALKRKDAGLYGTRAPAPPLSHSVRSECLHERASGRLVPHSAVSQTRVRSMFWLRETRVAAPVSMTRATGPYRVAAQPSRNGGCARDRDSLAARGGHTPKYVSCKESCQNHLAPTERARQPDNIPH

SEQ ID NO: 993044 - protein, 135 aa, Homo sapiens
SPKKVFFFFQKPEKKNQKGAPRGGTNLWLPPPKKRAGREGAPNLSLCGALRAPLLTYGCALFLRGESPTVPVKRCFVQPHSVSRPTLFFPPNNFFVGGGGIVVQQQAGHHGGSTLWGVWYPHLNVRCCSKTVVPL

SEQ ID NO: 993045 - protein, 320 aa, Homo sapiens
QCQAHSSSRRKMVQAGSIPLAAASDPIWPSRREPLAAMRSWLAGQPRGTCPALLPAHPQDVDELLLLIWIFSLYLSEQPCGIQRSTQLCSLTKCGRAFSPQQAMHLLATRALPYITTRPAGMSPHAHPAFIHVHHCTQKAHSRAYPNPHNLLLLQSTNQQRTPTPGTSTRAVEPEPHLSRQRRNADSACMNPQHSGITQRDMLGHYPRETTLRRPSPLYSRLAVAIPQANVHSGAPTQARLTPTSTPGPGHSPMLNQPWITAHKPKKAFTTRNLRQETVTTVYVIHMPPPSPTPSYHTHRTTIKDNPYTHRQPPILSFQT

SEQ ID NO: 993046 - protein, 487 aa, Homo sapiens
FSRYTDTFCNVHQILDFSLMNPHLHVYIGAVTLQIKIQNIARSLKHSLISPPTQYPPEATTYFDLIIIALALSLLLRFILKMELIHIAQYSLVEFTHVTVCLRTFTLFSLFSAKAPRRLMPCKSQTLLRDGPQREHTPNIARIKRRPPRQSKPSTCKHNGNTPTARKTKEVEAHTHQTTQNDTQNRKENASTHAARDTQTTSSKRPTTEEDITTERECGTTHHHTSQHTSTTPPPTNQHRTTQHKETLTKHQRDRGSDITKHAQQPGARTEINFNPTEAKSDDLELQIIKPQTTISRHSRATEMKAHDKKEKNSNSKVTYNGPSRRCSKTTETVHIATTLDLHTRLATSAPITTPHSPPPTQSKDTNSHTNTATVHTTDCGAKEGTRRLRIHRTDSNRHNTHHEHNVNHVTEAHTTREHTEEKRLERTARTKQRPNDPKTTQYAWTSRSHTRDDPHITPRTTRATKNESQERERARTTRQNQTDLTV

SEQ ID NO: 993047 - protein, 30 aa, Homo sapiens
DAWVDPRVRGEMAEAEGVPTTPGPASGSTF

SEQ ID NO: 993048 - protein, 97 aa, Homo sapiens
AATIPDLIVTRPRRPPDVHSRFLKGSKSNMATLKDQLSYNLLIGVTDPPEKITVVGVGAVGMACAISISHWKGSFVEDESLRLVSTSQYERTKLIGE

SEQ ID NO: 993049 - protein, 305 aa, Homo sapiens
MISVVRARGARRSDQWPWGLAAKRQRESEGQQMGNPNSPKTLGQPGLRYPRPNELRNSGSSDKQRSGRRGITLSRALTTGAHGSPTAGGPRGSHRAHGSLAPRQGHIARPTRCSSAPNREHAGGEHGRGTTSPPPYSGRQHPHHTPPLVPYTRQPVNTPPTGPNQANLDPREWHPHTNGGHPHNDNPRNRHTTTPQTATTGDPQALETTNSFHNHQNYSKTTTPGRANITAQPGENHTPWNNPNGRKTRQPSGRRATNTPIAATEHARREDAHQQRRPHTTRKQANPPNPHNKERAAQQKTAQSR

SEQ ID NO: 993050 - protein, 403 aa, Homo sapiens
RSDLWGAFVVSSLRRTGPCRPGGRCPEADAAAAADSCRVAVWEVGDHARGLLSVTDATGGAVGLRTDMYFLSGWPKRLLCPLWEPWPEAPFHVQSDPQRAFFAVLAEDRLSIWYSRTSVLICNLQGACKIIYSVWILPSKLNGGQKYHDSCINRQMGYHLGTLHITSTRGDKYLDEPVVIPKGKSPNEGGTPHSHREEPVLLHALQLREMRHHTWTFQGTPSMSMARPAVARSSHASLQRPDRDLPATHSFNVGHKGTAPPWAEKRTTHHLGGSATRPIRRDTPRTTTQHKGHTTSGAHNARHNTREQRATTGSHPHGRGKRPQDPNSKATTADAHTGATHRTPSADERPTGTAGTKKARQHAHRRHPRDPRQKNEREQPRKRTEPTQSAHSTKAHDRTHTQE

SEQ ID NO: 993051 - protein, 343 aa, Homo sapiens
THDVRGRVGRTTTSGPTRPETCLILWPLVLSVFSSMVCVKLPWRLRAWELLTVTLMVLSSRLAFSLCVTTLTTFLGARLTLSVISSMCDGRRVPVPGETLPYTRSEYRALLNSDVALEYLARVSGAGAAMMPELLGTGTTWTSWEQKRGQVGRIDMQTRTNGGSVEQLQQLHAAESILTVTGVSCQRPIPMQQPQPPGLLCEMVFYPVPDIWSHGGSREQVRQAEQAGGWMSAGPWIPSTEHNWGTLSQQPHGLDCLAQTTSLPQSRRKAFNQHWPPGAQATARQRSQRGPHSQSRNIATRNRIHFKHVRHVCTTMTLKVANKRGDNDMAEETVCQSNRRTTA

SEQ ID NO: 993052 - protein, 338 aa, Homo sapiens
MTKLWVVGAVNSCVRWGTSNYGRRTLRHLGALKDPPFEDHVCSWLKQGDRVPERGPDKRRKKLIGRVCGFHVDAWGTYPLGTLHLQDRYVSITHTLLGQGLIPGHTSRVPNVETTIEEPIGVGKMRTTTQPFFDNRGWPYRTGGDVSLGGWAAKTEDNCTIGKSSDTPSLGTHGRQVRTHPETPGLEKLGRDNDTPSRDCGANSTQRRDTRVETLPQGSRSDQMGERKLPQNAKRTLEGTYQQKEQAAGATRSHTEEKHPSMRRKRENRVESSKSIRREGKRREKNRTGEENRETKKTKRRETQKRTTKEKDTEQEQQDEGANSKQNSSNTLRTVDTP

SEQ ID NO: 993053 - protein, 144 aa, Homo sapiens
MLPRLASKLLKLKKPPVQLPGTKITFMQPPPRADGSLGPQRSNGQTSCARHQATAHTDTKTAHSGHTTEKHAYHHAPRPKHGDSRGCPGQQDQDGTRPPRRPTGGHHRWKPERVQHHGTGTPPPTPDATTPRTPWDPTIEANTK

SEQ ID NO: 993054 - protein, 126 aa, Homo sapiens
MARTKQTARKSTGGKAPPEISRWPANRRAHGKCAPSTGGREESLIATRSGTDGASERFVVNQKSIELLIRKLAFQRLGEGDRAGFQAPRPEVYSSASSSVRCKEGIANVVAGWVVCEDSQPVCHPR

SEQ ID NO: 993055 - protein, 138 aa, Homo sapiens
MSTGNNPIGWKRYAHLHGPATHHSQERHYTLITREHKHKRKRPPRPTECAGGAHEALPSRQRRPTEGEITKAADKRRAHERAACSKTRAKLTTNTTTTTNSDNGSDRDITLTQQQQPASDKDNNLATPHTSSEGAKRA

SEQ ID NO: 993056 - protein, 107 aa, Homo sapiens
MATYSVLGKKPFPSQLTYLPKSRNMTLTLSPVTHNTMHEHKWKHRPARNQLYTGTTPGSIQIPRIRGQPEKGYPPKGNSTDQKHRGIQRTRPDVYPQGKAETKNAAA

SEQ ID NO: 993057 - protein, 104 aa, Homo sapiens
MPSKVAGAILMGTSSSDSPTLQALTKAGFIGLRDSLRAEHLSLWVIMDPPTLRPFKSLMVSFLSYLLSLLSTRKEENTAEIGKNDKDVQGGGTKQERTHKDITA

SEQ ID NO: 993058 - protein, 195 aa, Homo sapiens
MTSASAMLRRGGQVDLHVSRKWGKGQMTRLAGKTYMLDEPRCTLLVYSWHCLLTGICCGAGKIILETSGGKTLRCVIGSMIRDSLHEQEELTLTLAWYEPNVINDAGMETLWNIKPGLPGNLNEEEGSHLGMEHTYKGDTHTFRSTQGEARDKHRHHKGGHTVNPNSTKTQEKAKGQRDAKTSETGEEHQQNKCG

SEQ ID NO: 993059 - protein, 564 aa, Homo sapiens
MSESDTPKNDQQRYSEQQIARNDPTPMSAQTDAHMGSEIVLTRRPARERSEERQQSSSRAEPTPRKTRERNKREERRRKPEQQREGERHTERRGNTHSEEKKDMFTTHTLVTCILHSFTPLLNDRTRAVNLSDTRVSASLLLFVYVVELPNRTIATPPLNVEQNKHKNTYVTLTASGESIEPDGAQRADDRGKRQGKRQTEGARGTRKGNGSKQSARGGRRGEARREKNERELGRDRASTDQREARRQKRTETKTRDEDGGADRRHKRMTSTASESDGAGREEDDAQRTRERRRDQAASGRERGSRQRTATAEEGKGERKTAKDEKERDTGAERRERGGSKTENGETKATKADDTRERRRRKGHKTQDGIKQRAGSAREEADQEGERERRREKKRERSEHEAETGTSRMTGEARTSEEAQRVREQQRARRDSHGQKSEQRDRSEGPAAAENPESRETGDEGAEASERKRADGERRRDKEREGERWRDDEEQQCSGRGRGEITGREKGKRSDENEERASGGREDEESKEREGGKRENEKDESTRAEEKEQTESRRMRQDEEEAKD

SEQ ID NO: 993060 - protein, 259 aa, Homo sapiens
MRDIVMLDQLDAWTPQHRHGLLGATLSLGREGHVGYLDRALSQSRSTLNRRAYRGPFRRNHATADGKLGPATTCTLCTTTRRAHNWPEVITFGKQTKTLRCGGHLLSIHINRPTLHHAPCAPSIDTKHRLTSPRSEQHQFCTSPNGGMLPTISQAHAHTTPLPTNSRRTWPGRVRIPPKRGQEVAHEEEQFTRTVFPPVGSCENGSCKLHLVRSHSPEGKTKLSRLGTVPRKAPVIRLRRGQRTTTNVRTQSPTSYTTG

SEQ ID NO: 993061 - protein, 121 aa, Homo sapiens
SSSSVGCPDVINTKCIGGAHSSGPLLQDVLLEYDKIHLSSGRNVAFCHAGLTAHNYCCIDKRALHDTLASSQTHHHPLAKDPSYSLESRSHNAMVILDTHFEVTNRKRGVPKRTGAKNNLG

SEQ ID NO: 993062 - protein, 105 aa, Homo sapiens
MVISIYLVQDFRRTTWTLYCLHLSVAVKQHNKSVYTKMDFPEDKPKVQNELCCTMCHKEVRKLRFQKHRYKPDTVHSAKLGRKGDEELWRRELKIPWVQVNWKYP

SEQ ID NO: 993063 - protein, 314 aa, Homo sapiens
MARQDDNIAGTQEFIGRTPHLLTYMMTFNPIAYLSTPWQQSRSSQSHNRLILQDHDHLLQLPQSSLQEPYSLAHFLVPQHMTCSLITGIAWMEPPYNAHAANVDKIAKHARRATGPPDNQRGKTRHSRYTDTSHTPRAQHRPKGPPPPHHWTKQGLTRKQPAQTNSTDTHNDPRQPQHRKKKPTAKPNTQRAHNTRRKSKASQPTDRTHTRTPEVHGSRISLTRWSCTHKLNIRLGRRTYRDREHARYGRRKGERELKRELRAAAERAGGSDAEGAMTAGEDGGEMTSPSRGGRPMSGDAATGGETRMRTGGKG

SEQ ID NO: 993064 - protein, 429 aa, Homo sapiens
GILTRNEHCVPWRRTRDQRPYRQAYELPRNCGKDLKRDDEQTSGSVEKAFEDKIPKRRFSEMQNERREQALRTENEYIAQRSISETQRLFHYFIPTSDLFIIITFYDSFWSLMLIVELCQKESIAYTARMATHTPSTAMETAIPFASRDYNHEVEKTRLLNGSTRTAQVTHVCHVHPQASFLTNSGHATQVIDRSADHSLERTTSLPDAPTTKTSGSVSTCSPFIAHMDRPSYTPEHALVRTISLLTQHYCDTYRRYSAHRIASHTYTLTTSSNPHKHVRSTSDCPIQRTHDHSEDMATCKTVYVHREAVTPGLARARYLNMRTQPEPPRTSLQASHSRRARPPHEPHQEELQTDPPQTRGNKESKHGARDTSRLARTCTGQTRPEVGTARRLTNATGHGGRDDAARGAHGAGSEERARSEPSHPIGQA

SEQ ID NO: 993065 - protein, 431 aa, Homo sapiens
MTEDLRELYPIQHECLITRRWIAGDGHTHLLTAYHGNLHGSRTTNGYDSHGSRSTCTMVCFTPNTQSQCIPERTANLATWSCKGMILTRATTTHTLNYIADASFAFESPYTPCISHDSQYHIEDPRGNPDTGHNSGAKEKTTRHEDIGTHRNNDSRLYAAHSTDNFLADNHSYKLIDGQRVQRISTPTTPHTAASMTLRTTKHDTHQTNETQTHVGTTHLTTPPQSAANHKRYKSNTTESEANHTTPTPPPHEQTKAPKPNDETATAKMRHPNHPSSVPRTTTTQHTHPHTEYTRSTVTQEPHPEPVTELPLQLTQQSHYTSTSLRTHERNSTRKPTTHTQKSTKPTSKDSQLMATPHSHKSCLRCNTRQPSKQTNITDRSKQNGPHQPDPDLNHNTRPHNAQNNILTSPSHTPHSTETPTQPARRATQRT

SEQ ID NO: 993066 - protein, 417 aa, Homo sapiens
THVLLGSQEAGRLPAHCLASRKAPSSRTSRSMDGRCAPAPRHYMSFQDSRSFWPEQIVHCLHHGTAQCRGHGAVSPPTPLYFHGGGHLHALYLNPPPLIHPISMEPTVLYTGDTPGSHLDTNPLQRSTLALCNLAKRWRVMSGQDIWRAGYPQPYYMPHHGLTLSLMRATTDPRACAIRPHHPQGSPNPQDHSAGSTGDEEPAQNPWPDQGAAGSDTPTAENRPLARMTSPGHEEATQRPQTTQRTTQRTPHHQANNEAQDNNTTQPQPLERRQRQRKPKNRARHRRHRRKGHHRIQTTKHIRQPKQRTHRPRDSSNRIYSGSANAGNYDRVTTIKTYTPRRRQRETRRTAHRAPHPHTDAATANRTRATPATEPPAAHRPHQEAQQQPQHAATRPPPKHRHRPGESHPRRSMPQRE

SEQ ID NO: 993067 - protein, 484 aa, Homo sapiens
MTAEHKRTMDNNQVTDPTKVNSTGKQEHCMRCKTQAGSPARQATLPAARDDNRWPLAGTHRLTTRSDDPQTYKDTRTKTRQTTTTFHEHHTHPAALALDCKAERTTAASLAMAEDTIADDNKPHNERDTTPHATRSITQPQHAHQRESHQRTENARYHVQRTDLHRAPHYRGKQRNTEHNGAKKSEQRTMKPQGHPTEQHKHITELHTPNTPGIRTTQATAKETREQHPPGNTATLTQENTTNSDKPQAATQPQTSASTTRARRHHKLTEEHRPTQHARETTKNRAQDTQRTSHGPPPTTTDETHHTHEPNETSCPPDEPQQRTIANCTPADTYNTTHPNDEKRRKHKPKPTIHDKDTRPRYTRKNATDGTGRPHDGARRRDACKQCAQTGGRRQREGEQKADETATERKQHKKRDGVKRQTDRSQGRKAAADDARTAGAAQTRGRPDARARRERARRRDGEETDEAQSHHQPTKRERDSEGES

SEQ ID NO: 993068 - protein, 192 aa, Homo sapiens
MSSTKHVELCYILIKGQFLRMPLDKHMEMENTLISILTGSYDEDFSDLVLGTDNVNNDNLWDITDVVNDVAWAETTIALSCLLIDVLLWTQTILLLGVECRDETTVNTPYTAVTSVMLDAVAFYTLLDGVSEPKLPQLDSMGTTYCIHDSASTRSHTRLNDRMQLVTRSDTHIVAHDKHTQQHQTPRSRHYT

SEQ ID NO: 993069 - protein, 404 aa, Homo sapiens
MRALPGHCSPTAHPRPHQSSSFPHHTQHHLPTNILDITPHQPRHTSTALAFSKPCHHHHEPTTRDCYSRADTPPRNFDSPTLPLAPTTRARTPHGTSPQHVTPYPPLQPTHPLDHSQHATHPPSPWHNHALPRRTHEHLPHNSPRPTSHPTHVRQSIYLTHTPTTPPPPYPTQYMLTTPTLPPTPPNPSTNPHNHTHTTPLTSHIPHYPTHHTPHPQQPRHPPTHIHTHTPHPTLHPTTLPLTLPHSNPSTIPLPNNNTTSSYNQHPPLHYSPHNSTTYTHTLPYPNSLHHPTNPPPLTPTSPPLLHSPPTALPQNRAHGVRSVLPYAHSSTHTAPPPIYTLNHQSVSSLLALPALTPSSPPPAREHTQPAAPDAGTPSPSPVSPGRPRPDGRTLADWRRRTRH

SEQ ID NO: 993070 - protein, 261 aa, Homo sapiens
MLRLQRFMEMSVEQEILVTGIKVVDLLAPYAKGGENWAYRWCVELAKTVLIMVVNQQCLPKPMGGYSVFAVVSVRGPVKAMIYTMNSDVNLVLSTLKDATSKVALVYGPMNEPTWCSCPGSSDWADCGWILQQTKKVHDEYCLVLSDTHLIAFTQAGFRGVWIIGPNSLTAVGYQTYTLASDMGTMQERIYTTNKARDLIQLCTGYIICAWLIDFDLNAGPMATERIGPLRIASQLYCRVAMAERGQRIQAGGPLETELFV

SEQ ID NO: 993071 - protein, 425 aa, Homo sapiens
MRKKERPWRKAGERIYCSGPPEREERGDLSTRSAERATCDHVALKCTRAHVMRRQGSNSTAQEVTTKDWSHKTGTVSSTEGMENSDISIVVGLVHIGCPDVGVGPQGLTESSDRGAMDNRIDGTKDAQENTVKGLHRESNHSHVTHERGNVLMARCYPSSPSLGCQLTGRPKINRGTGPKNRGGNLDERPRQNILKHGTKHLPFDEERHPGGQFPRGKTLHEEKGPLGKRQDTGSEKPRTQTQWTRSQNNCATRRTKDPGPKELGAHEAWSHTRVDQRKSLGMKWHANHTWGQRTESQTGAEPQPRGGNSETSNEDSGQSEQTTETRRANNQRNKQQSSDKKRTNGVTTHRDQASSQRAAHQGDNQQADTTPTQPRISGRPDQRQGKKGTNNTKRNEKNKNKRKQQNERRKQKADTQEQNKTERQ

SEQ ID NO: 993072 - protein, 529 aa, Homo sapiens
KVDDESLKELFSQFGTTLSVTVMRDPNGKSKGFGFASSRTTRGMPHKGMWQETATGQQNTNAWLTIILTLAPVHHKANARHGQSTSLTHWHTLLHTSSAHTRHAAHFSSALTPRARCTSLDTTLNAHLCATAPRHSATATASTYLSHAHHQHTSHLHSTILQETPHFSPPRLPFKRGYTWHRDTGQLAQTDTRPHNTGAYTRATNPDYTGQYTYQTYITHMTKKNTGPNPEQTANPPTPGRTSTNWGTRQTCGMKAPITESPANIMNLTGLNGAPPWGTPQQETQATRQETQDTPPQPTHGGTIPNHRVGNPHQTPHTRNNLKLDTAKPTQKEHGSDNRAGNNLGKTQKSQHHTYDHPAGTTHSTLGTAQRARHANAHHITNEHTHAPNRSARIEAMTPHRKDALRQGHYKPRFTIGDERHTQETPHGFAPRYENGEAPYHKTRREQTRGHPSTTRAEHFYTYPPNPDRFRTPPQRLLHTAHNHTRHHLTNHGTTLYTQRLTHHSNHRAATPNTPQHTPHVHATTEQQR

SEQ ID NO: 993073 - protein, 322 aa, Homo sapiens
MQEVHGCWQAQVNTHKAADGIWPGPRLSSKLHLLGQDPVGCSHQTTMDGSHSAALKLQPAALPQVAPGRQRGLLLHTRNNLIGALLAIFGHLVVSLALNLQQVLPHPPGQRFQGIPGPISRPRHGGWDMSLDGFLGCNWVVYDFLRIQRCLSTHPWPDPSRKKLRTATGTSIQNIHHSYRRQEETRNTTEHHKTRPQKARDRTAKDTHGRNQSTPQRQTAPQGHMNRDHHQQTRHSRAQKDDCNCQQLATPLQAHNSPPAEATTGTEPRTHRHKTEQSQRKRNRDSRRQAEDALAIPTTAGEPQHPQTTPTKPEVRRHKRDT

SEQ ID NO: 993074 - protein, 570 aa, Homo sapiens
DAWVDPRVRASLVLKLYFTATQTIGNSCWHNGLYFTQVANKSRQHWRLRRDWTHVHDTQISSSCNSSTKHLLPLTEQHATNCLCHTRTDGHYRTAHMTARGHQATRPTAHRASTEQRLHTSHTSPIPCSYTHRCALRQPLNTAHPLHLPTDTCPSTHALQNRVGPPNALHEATTPMPLKAHALAPRRSRHATKLHPRRPLNATRASNSVPPSSLHDPDAATPSVPTGATPPKLALPAMARPAHPPPPRTLPPPLQHPPLHTPLPPPTLHSLYAPPHAHKMPKTPHTQPGLHHATHTAQTPHTNGPSPATSQEHPGTHNAHGHRHHTSPQQPNQTTDEQAPTRTTRHPQQPTERESPPRAAGHTHQARPNIASGSRKNDINTPNWPRKPHNSHTPHTAKTKESDSDMQPTHTKPLAQARIYHHFGDTTHRTRPSTLTPPPTHPHCRTPADKQTQTTATPNPRTTPTPATPPRPPHPPPHPPHPPRRAAPIADRPRRHHSPPRHTLRPHPDTRRHNPHTPAQPTHQRAPHPTHHPTTRHNHPPPRTQTAPSTQQRAHTPPALHHRPRHASPA

SEQ ID NO: 993075 - protein, 474 aa, Homo sapiens
MRFLFSSNVHMAYTQLAAFGISTWYGLVSCTPLVLAIAAQFECKHNHPYISGSDYNGCKSHQPITAQMPTSHFAICPYPAPKSGMAEHHTPSILIHSHRKRQRHIRQPNTPQSVVIVWRHWDSRYWPIYVYHIGTYLPHTHSNQLYPCELNQHPPPPPVPQKPYMLLQPTPLCTSTRHGGSTLGPWQLLHTKRRTTRVTSVQHISAHSPHTGRHSPHFSSTNRSSTPLSPFPLCEPPHLKRVHRGTRQHGAHNRVTQRLVTHTAETHDDTQRYSPSPGHRENDTPHWPRDPRYTDTQLVRTATYPLSPPDRHGTTTQNRDTHNTPLQTPTTNKMPYTTTHTTHTSQRQRQSAPTTKRHADTTHRRSRKREPQQTPRTTNRTAPHQRPRRTHNRGTNGTDQAALNSTPAPHSGQTPHRPKRARPRPNTTLQTLEHTGKIATLEHRARPAQQHEPPELHHAEAAAAHTSPTHHPTQ

SEQ ID NO: 993076 - protein, 454 aa, Homo sapiens
MHILKTALDPQGPMNTDTLLIISTSTLHDPMSTHERSQSRRRTKRGHQCMTSTETSMRTCGIEKKLPLNRWNNGNNNGNPQGDREQQNHPKSKSQGGIPHRQDNPIEHRHHQKTQCEHRTRRENHSNKNAIDRTVHPDHKRHHGHPTVTPLATIHEGTTANGDQPTQTMWGPHYGTDHGAGDHATKRGEIPRNANTQRDHKTITREIGRKHQHNKGEATQREKRGNTQLGSAPPEHWKAKLAKNDHDQMEHHRDSAAKQHKRPPNGPPRVRKCASESPTLRKRPTNELERKAQRESQADTQHDDKHTKRRTEQQRPHKNTKKDAPEDTPVDSTAASGKATATQGERAPNRRAVQTTHSGISGQKPTGGSHNRKDVEASRCSTRASEPQTHTTQRGPERRNQEYQSESRRFDEARHTRGLGHLAARTPREMRHAEHSQANRLAREQQNSEVRAEH

SEQ ID NO: 993077 - protein, 397 aa, Homo sapiens
MWCLPRNAHAREKRENSHQKLTRHSVDTKWKTCKEAPTLSTPFPVMCAPRVWDHTLGIPKFGTTERSIVQYNPHSPYKSSAHKFIPLRHKDTRECRIFFYFARVGIRESTPRSKYIKRTRERTEQRTHWGRDEQHLQLEKDRQPEVITKRKGNNTTVRSKTKWRGGHNNPQRTGEKYGNMEDATNSKTEFFPPQDWETPRSHNQKEGRRERTQERSSPPTTKKAATIMGASVATTYESPSPRDYLFGRDEENITTPVWGRETTVSSDMLCTHPGWSNKTTRQEEDNKNVSENDSCEAAEHPERGETRSHKSEEPRERYAGHSVVETIPDGDEQSERQQGGTKRRVETTKAKQGRLYEQEREVSRERSYPTVVSDPTTRSRRKTRGEDSSAAEQDRQP

SEQ ID NO: 993078 - protein, 396 aa, Homo sapiens
GTGSEVSGYRRRSCNNGLWRRRRYAVFQIHQALRSLVRRGNRYWYTGAPVRIFAIYRRRITDRKNVTHAGQTLNLVIPRHRLNREVQAGRKSSIERLCVQAIPGPESEPYLGTTSSDRYELWCSNDVLTTVSCRSEKVKKRGRCRKGRDALMRTTIIQPLARLSDSGVTGDQRSAWLGLPYSCVGIEAIRQRPSRLLARVRPFTNIDAHTRLGNSESGHPWNEINGSLKTAQQQRLITAYGRRATSGLNNAGFTHRYKLQQIGPDPLPAKTTITTYPSSIMHHSTATTHSLTNFLTPTPNPQTITNILEPIYHTYANTILNHTHHTHTTQPSFHINIIQNPTVHTRPPYSPNHPQHTRPHHIHPFTNKTTHYSIIPTHLNKKSITTESRYHYSLIQ

SEQ ID NO: 993079 - protein, 103 aa, Homo sapiens
MQQIDFGTHAFLDARVSKELLFVTLQVRVPEARGTGGYSARNPSLGITRAHSSEGFVKDEGGLVNGPDTHLRVQGARVATCGGKGLPLRNEQGKAKDWREAKS

SEQ ID NO: 993080 - protein, 333 aa, Homo sapiens
MHYGTFIFHVILYIRSMRVTLYKCHSITEGQIFCGNKMVYKGIRPAINVADSISCRIRCQTRGYEAGTRYHEAGMRLSIARLLLQPSPDLTSMLPISTTFEIDGVRLTSVAEDKDRILPWLLNNTSGLSSYDGRKREIYESKLAPTKITNRFRKSHSLDSNVQTATHTKATAGTTNTEPDAKDPATPQNATTPAKRDSYKRSIRPPAQNLKPTGAIPHQHYTQPHTPPRSQTTTAHPDTGSHHQHSCLIQKPTIEQNTRSTTVPTATQPPNPTVRDPQPRHEHANNQKKAGHLTPNPTGHTTPTPKHNPREINTAEHTTSTGRREDDTPSQHK

SEQ ID NO: 993081 - protein, 267 aa, Homo sapiens
MNIRPELQEDTSREIPPHKGEPGKGRITGIGERMRPALARHGETPEYYQKIPGWATAEEETHMLARQQRELLTDEEAHSNEHHGAAHTRTADKDGRRTHNATATHGHATERAPLPPATPTRSTQKQKKDSRRGSQMRTEADDRQNSAEREHEPRTPRERRRERDKARTGGPHKRDVSTEERRAERERNTRDSRSTRGERRTAEKTEKRGDTGERQPRAEREGTQSTAGEERQCGTSTEKERRRRKEGQTTGWRDTRSGGGVARSTAG

SEQ ID NO: 993082 - protein, 276 aa, Homo sapiens
MMKLHLEQFKLDYWKMYQGNKLPDYTSMAMASSAVTKCVAMVRKMADNELNAHDWMSKTYRWFTWLRSVRVYGFTNKNADNQIRKTSYAQQQQVLSNPAEKMMAIMIREVRENDLNRSGQCLDSRQHGHTTLNTLANLSILSMMSSLENERMLKKTPVWDWGQRHGSSKVKARKLGTGHGGRNGAPQLNRRRISSTSHAIGQRPTPLEARQKGTRGTHPHTKSITQKNPRRQTTQIEESQPPNKQKDINNIYTYLTTTKHNTNIEITTQHSSYQTS

SEQ ID NO: 993083 - protein, 234 aa, Homo sapiens
HFHRRTTRRRLCCSHVSYLIPEKFQSYLWQTTHTHKNRLGGDKIWLCHALPCIGVSGQNDTASWLDVEGKAMSIVTYTQSRGEDATSCRRSGGWVIGCWNSPLIKCQARSHVPDTHRSPRICVFLGTRTRISDGTKATAYTDTQAPVVPSRILGPGPTNAHAGMTVDVGLRVTSSRAQLRWLSVHRFVGGLFLFPKDQATNKDATGGRGPQPLGCVQTPEDKALLRPWFLLNKH

SEQ ID NO: 993084 - protein, 375 aa, Homo sapiens
TQELSRKIRNQSWIIIASLSPDNEQLPMLEAAPWGPGYQMQVLRSPVRLGGLPSLDDSCSLVGARHITGVDSMYQLMSRALAWTDSLRVTLPDEYRAGLVGKSWGMDSVPQKAIRKDCEQEMRMCHPGVVVNSRGLPDLIEGSPLPPGGLRCKKWPTKVIGAMSDRRWIHVMASCVPGDADPLKVYPDTLKGCMLSRKNRFDDDLNDIDPWRHYRSGKVFGARWMQHWLLCDLDAMHSLLGKSTVTLRVRVLVLEDPVYLGWVVCIAVICAQVSQMSKRQKPDQNSWQEQTCTAFMLTFDRSDPVRTFRLFGIHNTLALALANTVQTPRKQVARRLRRHHFHRCYAPLNYDARSPATCGLATRSDTHNTPVQALS

SEQ ID NO: 993085 - protein, 71 aa, Homo sapiens
KKEGNCSIRDRAEIYSKSTVRPDRVYTETQVYSERRRKRALVGTYADSSQESYKSLEELKTATSILTHPGT

SEQ ID NO: 993086 - protein, 263 aa, Homo sapiens
NIVDPRSRQYLGLQVLFTTLGEFFVFLVETGFHHVSQHGLDLLNFVIRPPQPPKVLDYRCEPPRLPSFSYFFTISRLQNNSFIKLTTQPEIGDLHHTQCFAHNSIDSPWPPPTRLLNASLRGAHHVTNKPQKHSSRSTTMHIPTQRTGCATRDWHTPKKAPGRHHTGPIKTHTPAPELTPTYIRNPTLTLAPRTQTVKNSHYTSNAHKARRRAYTIVIHHTREWARNTTITYTTIHRTPSTLNKRPHYSHRQHAPHSAALSST

SEQ ID NO: 993087 - protein, 172 aa, Homo sapiens
PTMAFITYVLLAGMALGIQNKVLPGGCWCLCASTELVWVVMDGAGPAPGPLPGHRAADDLSTFHLLAYSGYKYVGMILYVCSRGCWFGSDGYYVALACTSSALMYLHCALFADSSPGDPDQHGGPRPPAASPVYLTSGSCSLPAPSSYTADVMHLVRMTLDGPQMALSLPFH

SEQ ID NO: 993088 - protein, 193 aa, Homo sapiens
MEKNCGASSHSYAQRNRHRTGNSRTLLPIPVANNFYQPMCSLCKLRRVVHQRAPGETFKVPQSESPTLGGGTKLFSKACDKETRPRVCRKIPFVTTPPTKGGANLGGHFCGWPFPAQEGPVDTQRGSATTKNAPLSVDTIPESPNVWPKSQKEKLFGGPTGGPVFVLPPRLCLGSLQPGGSQGSMGWDAVVAR

SEQ ID NO: 993089 - protein, 369 aa, Homo sapiens
MGAIPARASWQPGLEHLASRDGLGHGTPTLVVSRSSKRVDWVCTKDDLGVESVVMDICRHEMVKRLSKESGVGRVPFFTLGRPLRLGNPLITQGRKGLDSARGAANTLARVKAPVKPQELSPTHCETRGDNSRRPSGSKIIPSYLADAIYGYCIPCGENRGETDSLCKYVGPNGKLSKGICHKYKKRQKNIKPENHGHWGGIILICPFPGVAGRIPRGYYTNSVRIRLWVGKTKVLNRQGISNVVGDEPDRPGREKTGGHQRIYDSPGGGRPPEKLGPIHWLGKTRGKENPGPQEIPWARPEEPTRRGVNQNITPGRPEEKAQLAGYLGARARGKRLKRLYGKPGVAARDHHITVAHPHDSRQSWPYNQ

SEQ ID NO: 993090 - protein, 78 aa, Homo sapiens
AQGVGRQNTGVVKTTPKKPKCGKGKDLITQHCARSLGHVKFRASSTTYRATRDSIKCGGTRQKTPYVQQYWQKEESCA

SEQ ID NO: 993091 - protein, 264 aa, Homo sapiens
MQRCPSYQGLTGCTRNEPRRVLACDCAHRTRPQNTPPDDHPAKQRGIPAGANTQRTRDTTRASHGRDVSPSHTVAHHPPKNSSPRHHSHEDRYTAPTSTYHTQSTRTPPAIPPARKHNTTAPRQYVPPGTERQVTRQHIVRTQNHARETQQRDLRSAAKPRTTATTPPDARQTLATGAPRHASAESDNARAQTNTHEPPQARPPAPDQHSPTTRPPTQSAGEREQRTTADREWDDRSGGEHDEQVRTRKATRSRVNHNGTPHTT

SEQ ID NO: 993092 - protein, 107 aa, Homo sapiens
SNFIVNLQFKHAKDSRFKAIREKMKDRSKPLFQMQLCGRCSGKHTAESKHSHRHRGEQAFNIGISFDTHSSQSITMDQSVYDGRQSTKHKVSKVDPTYTKPVDQFIT

SEQ ID NO: 993093 - protein, 296 aa, Homo sapiens
RSRKHGLQIVAVTDGVIKVCKRHEGAEVFNASEEVKKAQEGGASYYALSEDQCKNIDAWRRARRSMVGRLVGAQSCTEDAPYARTLVQDGWPDKELDAMPVYDCKPYEIATDEAKTVTDSWQIDYFLGTRRRDKKPPIQTAEIEGNETMMPTEEPNQEHEKRDTGDTKTMDRRARARDHGITGKEREHQGNAAWTDRKGENEAQEGEGKKGPGHRSNTRRGSGKKAQREESQRHTQTIRGNHNTMGHRRRQSQRDQRTPKNNAWTPQRRDGNETTGHGATRNETVATNRRHGEGEG

SEQ ID NO: 993094 - protein, 433 aa, Homo sapiens
MCVRERECVALKSVSFLTIYSRGARYIVCGENIVFHNILCGYKIYIFSTHRGTHKFSERYVWWEKIYKYKCSHIHHNKTKQREGGRAPHKDISLPRGAPKYLGGFTRAHILCVTQEGAPPKEKGRRTLYKPKAGHGGRGGYKNNGRWEQRGTTVRQKEGEHPWQKRRTHHHTREGGGAHQQQAGTTKHPNTRRDTKQATIGGDKTITNPLQRRRYTRWGSNTKTETNTQPRCEKTQYVEHTREENINNLRQTIFLIPPGASSYSTLYTTHRTPTSQTQKEHNKKHKHRKENRETTDRRRSNRSRNSDTRSKGHSGREGGDAKKQKDAQTEERRTKRRETHTQNKKNNKDMQTEDTSDSDRRDDRGQEHEEEGHAVRKAQNRSCKADHHREPAKDEIRREKQSENGQRKRDDEQSTGSRTGREGAANESYEVTT

SEQ ID NO: 993095 - protein, 148 aa, Homo sapiens
MNHCTSAECPRAHPCVAHVGGCLLSLVNMYSFHLSLCLYCSVFDIHNLIGLLSCLSGPGSTLTVMPYRTGCSGLRGQCPPVSASSRYVAAGRDFAQRGGPGRPSRGDSALVPHWSDTCPHFTFARIAGAPAEWPVLTLPRPSTFFSPQ

SEQ ID NO: 993096 - protein, 307 aa, Homo sapiens
GELDVAEVSMIRMAKECGADWCQCSDEDSVAMKFKFNRDKPMREAEYTSKHSVGEDLYGEHKRHLEFSHDQYRDAARAYAEEVGIFFTAIMEWMRWQLEFLHEAECTSVLTTVGIWTTAEVILPYLGKDSQQNRSPNWVNLQSGLHVQIGNRRWKAKVFIEDPVKAHYNPQTFLPVFGQMVASDITPGIQRALEGPVPEAWQRVQVLRANEFKDTDSLSLGPICPNKAVNLPWGPLGQPRAFNQNNYIESDRATTAHSWRSGPQGKDKDNKRNERIERFWGPQGNPGSKCRKDVNPTSEDVPHGEEP

SEQ ID NO: 993097 - protein, 226 aa, Homo sapiens
RTRGSTHASGETKERGCASEIITPHIYNYLIFDKPEKNKQWGKDSLFNKWCWENWPTICRKLKLDPFLAPYTKISSRWIKDLNVRPKTINLGITIQDIGMGKDFMSKTPKPMATKGKIDKWDLIKLKSFCTAKETTIRVNRQPTKWEKIFATYSSDKGLISRIYNELKQIYKKKTTPSTSGEGYEQTLLKSKTSYAAKKHMTTMLIITGHQRNANQNHNEIPSHTS

SEQ ID NO: 993098 - protein, 325 aa, Homo sapiens
MYGDLVIGDTVPEKGAFFNSFFYDKLRTKGYDGVKRWTKNLDIFNKELLLIPIHLEVHRSLISDDDESDATSPILTQAAYPKPPLPKHIAKYLQAEAVKKDRLDFHQGWKGKFKNECGQAELVDSDCEMISCVADHAEHSGHLYQTFQTSTQQDMTNLSSEEQNKGSMSHMQNPTEMRPRKPKKPQSPYSGQRHMREKQTQKHQTHKHHLTTPTPKNQKKTDEKAKETEKHHRNNKTDKEDKEDKNTQPQRRAGKADEHREAHAHTAGAEQGSRGCKGRRKTNKKKSRQRTEGGTQRRERRRRKENNTETTEGGRRPRVKAKTES

SEQ ID NO: 993099 - protein, 72 aa, Homo sapiens
MDHRLETQARRRHYNVPHINSARPTPARARLHADEHTNRYTTGALCSGKPTLRCRATRRQKARYGQSTRTPD

SEQ ID NO: 993100 - protein, 73 aa, Homo sapiens
MTVPNSEENGDQTAKESRRRSKAQKKHRRRTTKDRTTEQGDSDRDANATRKDRQHQKVEHEREHRETRAQKQR

SEQ ID NO: 993101 - protein, 344 aa, Homo sapiens
QNTKWRMTPCAAGGALGCPVCALVMGEPAVCFLLEVSGILASCVAWVSLAVCLVAVGRCACWMLCCDVQWPAVTKCSVDAPDHPMLGACFVSTGTLQESQYHKAGRIYSTIYPCPHITDIEMHRSDFSITGGTISYKAVTVLARINDQLPDSMTPVPGQAAPRIQMALLFAYYRVDLTNMATVEALGVLQTVLPMDAESPDIPLVSHIILATRSSICPPVQHNGYSGANNTRQFPNTSPFAHVTWPAAGIMCWYALIPAPHVGTGIELRNLCLTSCYNDGCYRLNWLNLKPGTDLPPLGTHMAKGQRLHSIYKELTRYLNPDLLERNHVIHKVSFYRFMTPIKS

SEQ ID NO: 993102 - protein, 433 aa, Homo sapiens
MIQEEGELNNLVNDFGGSLNADDGNTTLHCDTHNYEEKHQIMHPSKETTCLDTHTIIKLDRFIQGGNEQQDDTFIAIHGGQDNNHGTVATYHGQEETRTFETDISPKSNGLNYTQRTHDAGSQHNKAKPKNKKGQFIIRPSRVIGGAKLRGHKDRTSYTASQPTTWREHTRRTDPEPPRNAYSTTRRDATGSTHDARSLKPKHYNSQERQTQQELNEGQCHRSTMINGKTIKKSATTDKSHKLEKSNAHTEQWNRDNLEPRDRCECRSATTISNKEEQKPDGKITMHVVVTGTQAEELRGTKDCDAYQIAQQCNEREQHDTTEENKSNTRKQRGGIENTTGTERHGHSGPRAERTSTGRHATKREKAGNSEKQRQQVDKKSTKTQNAAPRAHKDTRERNSASTDDQHSYWLTHARQPRRAEKQRQSRTGSSGQ

SEQ ID NO: 993103 - protein, 340 aa, Homo sapiens
ARSEVPSPETQPRSHPPYDPPSPSFASSPGASPAPRGGALMPIATLRQPCPPGPCPRSSYRRMFGGPGHAASTAEAHRPCSYADVLSTRTYSLGSALRPSTIRSLYASSPGGVYATRSSAVRLRAAECPGCGSCRTRVDFSLGDCHHTPSARTPGLNAEGGACRSMNDRFRPNYIEQGGRFLEAGRTPILPAPELQPVSPGQGKLHAWGDIYLRTTMRRTAPEHLEPSNPTIQAAPTPQRDKHGRRNITPPPRNNYTHRQSPNTQDTRKTPENIQQGSPNATRPACNYTPTGTHAPHQDQKHNHTPKSRHTPTHRTTVQREKIDHQNNAQTPPTTRPQTT

SEQ ID NO: 993104 - protein, 367 aa, Homo sapiens
MDAGRCKQVYEVTVLVRDSSRLPSEGPRAGPRGSVEMFLQADDVVQLSRGLGRTAVIVAAGHSENELSPSDEDVRVAPGTLWQAMKAHGVDKVVACNSALTCSGDPTKVPPLTAELWLIDHIRMAKVLRASGLKVRGCDARQHIGDQTITGAYTSDPWHGSRGLQRGPSPNIDWAISCCGCFTTDEYDGQSKLNQTRASNQIGTLATSWEEWTFQGPMTGKTERGNKLERQQSRQTPKTNKTKQAQRTKSIPQGETRIHRYPNIVTQEPQNSAHKAQAQKRQQHRQRDNETGTETRTTARGDRGPRPAREGQGARTPEQGKIGQSEKSWDERNNRHEDETEDDGQTRRTARQKRGAGNREHHNSETE

SEQ ID NO: 993105 - protein, 310 aa, Homo sapiens
MKHIHERLGTPERCEQLEENQLTKTIRAQHRQQMDAKHPTKRHKRPDTTKETRTTSSRPAPTPAKRPSKGRVQIHDETWYSQKDNEERWTSQGDRQLHNTTKTQRRNKEHNRKKRQNRDEALTEEQKRGREKQTRQERRHPRTRQRQATQRNTQRWEETHSGQSNEYEAARCGTREHPKRARKTTKNTRAREPTDNTQEQRRGNTGSHTEHARQSTNEPQHRRTGAEEMRGASARRKDKRGKEAQTRNKKEERHQNGKRTDRHNTRGGKRGRTNTERKEKYPRGPSREIDNGSSERDRKNNKNTKQTKEQ

SEQ ID NO: 993106 - protein, 286 aa, Homo sapiens
MGFKEKIPENTRGYASADVPTHKRKPNTKMNIPAQRHSTRRGNKTDRQAAKHDTRESNKSHHKPKQQTTHTNHNTHTQNNTQQTQQHHPQPKQNKQNKGHKKTESTIEHNKACNTTKTDHHKKQATETHNKRLNEAEHPSNEDRISRQRKSKQTRRNETTTETNTEKRPKKEKKRTTQHEGKRQTHKHKLAVTAKRKEIEKKKKQGRGGRGRSAGRPERGDGRARSSSQRNERSKTHRERQDEQYTVAHRHTNGERRAESEGETRRTTRARRQRAQHGTQNTTKER

SEQ ID NO: 993107 - protein, 368 aa, Homo sapiens
MLKQAVKDHNVGSPPKSPTHASPQHTQTEKDYPSERDMQNTFRYYLNNQQLSKCLDSDCGLDIADTQYIPGLIQRNTVSDYTPKSMIQLQYKNPYIFHKKCKLTISTYTDISLSRMERITTFQSSQTSYSLAETAHTTHVTCCELTHRTDKFLHGDSTHTNITEALWGIITPHHTTLYNTTDHTHETHVTTTPSHTLRNNVYPETLHAPKAIALRTRIPYLNHGRSTRRKRVMATLRYTQPLHHSLAMVTYHGHPTQPIHPHSPISKSPPSKTAYDQHKHNQAASQEPNKSRQHTHTETTNNTYRHETNMTTDPEQLINTTAHPNTPRPYHTETTEREQHRTRAETHQPNNQQPSTDTKNINNTDSPT

SEQ ID NO: 993108 - protein, 192 aa, Homo sapiens
MNNTDSDHRDAPPPTHNNHPPHTSTSHTKQPRPTQHDTAAELPTPLCTLPLRTSFFDSRNNSPVTAHPTQHAEQAARTLTSRQRHTRRREYQRRSRHTKHHQCSDAHTHRCRTSAAQTHDAKPSTHTTIETERAQTYSRPTHSARYYRRLRSQPAPQMRRNTNSNAQPHTHSGAATSHPRTCQTQHTSTHAP

SEQ ID NO: 993109 - protein, 439 aa, Homo sapiens
HKAQERLQEEDKYDKEEYRKQIKAKHREKRLKKGKPAREANKRQAKAKDEEAAFLDEAVMMHDDDDDGFDPSTLPDPDKSPDSSEDSDYLNDMANITIHADYPQQASQGMTEEEHTSASGQTWDTPNVITHDTRQARLRTNYTHAITRTTAPWSSAKRMTADGLVTTLHSDNLQATYAYTISLERATAHNIPLWTTTLGSMDHAVRATTRLQHNRTEYRPTTTHNRPPINDTQLPHKRGHRADQGENKKATTRKSHKASATHTQANNRTPAAQNNMKTTPPQTPNDTAHKTPTNQRKTRATRHDGPWTETRPQVEAPTRAPPKTQAPEAQNATNTASTQGPAERRRRQTSRHKNETESPTTQLQSPGKPFRRAHMQDRTTSHSHAAATHRTKSQEKRPHDPQDHKPTTRTTPARGRADARQPRNAGVRPHRTRERAQDK

SEQ ID NO: 993110 - protein, 108 aa, Homo sapiens
MISTYHLIFRAISRPHAIVIIDLRTEWNGNALSCYDGGEEVYSKHHMDRITKDVVLTMGQKCPRSVGYIHSNQIMGWGSKAIEIRSVETGHMDGVLMHKRAQRLKLLV

SEQ ID NO: 993111 - protein, 399 aa, Homo sapiens
LRSVCTRNCKIWCEGWPDNIHAASHIVLACCWPAGFSIGLAMDQASHEGQVEVQLVMNTNVANALMVSQGAFTWLFWMQALARTTTGNKVLRCPEGSLLDGRLWSIPQQYQTISLDYDSESKELKCRRYIGTHIHGPGMLTELHCGYLNGHEDERCLQRNRYSQYIKENKRKIQEMMEGDVVNDKAPWLGTTSTRHPRSTGAQKAPNETRTVTHSKSGGQHGAQKMLPLATKKHRIPRIASTIDRQSFRSRRHTEKGAGIKSVATQAKCPNDNNPHIQLTLTVTLTHSRDKAKNSGGQQKEIDPQREPKHITNTRPMLTKKGPKKNKHTKQQQSRHAAIHTLQEGENQHTRDNRRGHKKQRGKTSGKTTHRSKNRETTQQKYTGNKQQRKRQNGRATTN

SEQ ID NO: 993112 - protein, 386 aa, Homo sapiens
FENLKIQKKSEEVYDPRSLYEQATGNSTGTGKPAGVRGNSSNIRTNHGQAGFSMTDADPHFLACSVSPTQPGTLTSATQPTAHEHRQHTCNSTLHRHITSTHHTVHRTRYATFSSHSSTPSTGHSCAHTAQLGLGATAINQHTPHSKPQVSSQAPHTLRSATRAGMLQSPITRQHPRSTRGPTTLVTHKSKQHARSHMKAQYVHQRKPHMHVPSQLSWHTVLLREHKPSTCTMATIPIHSAHYCYPVLVLRANPSSEHLEVPYHHADCTATSRSSQASSITRQQHAITCAPGNSLVRPPVFRTPTPFLDGHLVSPFRYTGQLLPKGLDSDRLIARLTSDFMVPPNQQKLLWTGILLHHIEHSHPPPLSTRAHTSTTHINHALRHKH

SEQ ID NO: 993113 - protein, 222 aa, Homo sapiens
QEEQMETEQQNKDEGKKPEVKKVEKTARNINGFSTSKDTCSDYTQFTHNIASHLDVNSMPLRPWHELASLPGHNANQAPANHTAACIHYHCTHKYRRIHKFSQGNPWHTQSTNVVSTTVSSTMFLVGEGDSVHHPSADITSLAEQRQHAGKRNKTTRSRAHATGPNQKAQKKATNQGPQTSTMAGICMLQRWSISHNHNRGAANEKNSKDTHASQHEEKAIQ

SEQ ID NO: 993114 - protein, 55 aa, Homo sapiens
MAKGEIEPFESTFLWIGNGHYACPQEGAPKTSRGLVHEGRTPSTDGRYTYPQRNW

SEQ ID NO: 993115 - protein, 30 aa, Homo sapiens
GGSVLQVWCIKTCRNLFLGVLTSHNMKFNC

SEQ ID NO: 993116 - protein, 415 aa, Homo sapiens
MAAETLYTYPEKTERAFKALIAAQYSVGSWSRVLSGPPPALPISGTTTNPASPENIARDTIIACTDKDPRCSYDEVIECDFVMMYRGGKRRICRTIVMPMMRACGADRYFRECKQTSRVVHDEAAAYLHDSPDYMMPLTHGNLGDVSPTFVAINASNNKTGQLRMQRRNVRRHSGAAGCLLEDEDFNLVGERVTLGLTVTVCHAPCGGLYKQVLEPSCRQAFPKYQPLVPHLPLTSPVPGCLGRSENWCDERLAQVDCYKQFARPKLKRTHNGNEKGSREGAAAAPAERTDEHNGGWPMAPDGGNMVDSYSGVAFEAKAMDLSVTLHKRTQWVRQLKRQCPTCEPRSVDKDKYGDPVTRSEARGNTGGAQQHHEKRKEHLGQPTEAQKRRYLENEPTEMSTASWSQVVRRDSHSY

SEQ ID NO: 993117 - protein, 89 aa, Homo sapiens
TCTCDAPARLRTESETVLQSERSGAYSCTTTSVQRTWTDVLTLVRRKNPLGSAGPHVLTGAHEMRLAKHTELAPRLHIKGKCAIDYTAF

SEQ ID NO: 993118 - protein, 83 aa, Homo sapiens
GSSLHASSWKMGSLFLDYDIQKESSLHLVLRLRVAVDSSVMAFGVPSDWRLLCTIDHVLPTYSLEDDHVLSNELIPCIKTLFK

SEQ ID NO: 993119 - protein, 35 aa, Homo sapiens
MLLTSPRPLLNLGCVGPSVDYFFVAPFLGDMRGEG

SEQ ID NO: 993120 - protein, 32 aa, Homo sapiens
REAKRREGLAWMSQECREPALGRYERDATVAS

SEQ ID NO: 993121 - protein, 240 aa, Homo sapiens
THAIGPTRPKRTIELTDTCKERESDTGKKKENYEISRSEMVATARSSCVLPQTATKSRSTKAAVERKIDQVPGRLSVVETTNAQNTRDQDCRRFGRAGQLIMDRVETKLVEATEARSGLLKAKNFHMEQSGSMLNYEHDRQMEQPAAWPEYLNRHNSTQEDLDWTQIGAAGKPGDDASINSPHYVTLVIQQADATSFINTKTRSRYQGTRFHGCPGMHKWPGPPGFPLGWSQRIQHPLGK

SEQ ID NO: 993122 - protein, 448 aa, Homo sapiens
MDNILYEWEKRSADNVTYQTKYCKNHVYAEYDTKFHIVVDIHDDKLYDGPARTRITIKHKDVSLTSMIEYICMEHVHKMNSPSSILKTISQSTYSEKIRITYTIVKYTRQAQKTTDNHVAKRVETVNSKQEQQTTHTQEERNKRRRENHNTKTGTRDTEKKDKQRKQKTDRNTANSDKEQTTRRDGQQKRKDEPTERGKTPQQKGPDTTRATPQKTKEKQRQNNSKKKHNTGNKNTRETPNPKKEHTTRAEQKKEKKKTTKARHRDAQKRGNSMRERRREQEEKQRGGAKREKTGEDRSRQRRNGTKTRGSEVVESNRGQKPESRQRRERQEDGREEATREEARRKARSGRREETDKRTRAREDGPEEEKGEGQAKQEDERQQRGTREERSRTRRHTKRETKREGERRARKTATEARAEREENSEVAQTSDEGEKRERRREREEEESE

SEQ ID NO: 993123 - protein, 403 aa, Homo sapiens
MLNTHTQAPQGRTSTSTVTTINRDGERGDRSDGGQERGSREDRTKEEREEEQEECRKEARKVREGRTRRGEGSRRRAKREGTREGSRGEGGEKKEAEQESKEEVRKKKTTKAEKKKRKKGKERETRRSRKKRKRREDREKRTKGKETEESEESSSKERQNKDEKTAGGEKSTTRRAKQGRRREEERNGIQKEKQQKTEPTTERAKKQKEKKNEKSETNSRKERGTKSRRRRERKEKKQPDRTQREQRDEKKQNNRKNTKKAEQKHRTKKNRRTNSGEREQKRRRINTRRNKERKQRGNNKREKGKTEKKKKRQTEGKQEEDKARTKHRDQVRERKENKRQTDREKKEGDKAADKEKKQQAREERKKENKEKRREDKEENKNRSHASKREKKRQKRHSRNTKQR

SEQ ID NO: 993124 - protein, 441 aa, Homo sapiens
MEGDKGGVVNCLEPHPTPACAGNQVDLDHDVKIWCTRQLKLSTDADRVYKDVINEEQRGERDEEACTNTDLSVNSSHAVVSLLHSPEYRDAITGAGENLGSGATDADSECSLPESSDNTQDEEEGPDRRCSSMPILRPSYQALHTATKTHLGPSKAMKEIKRQNIPSDEETKPERSETKRKIPYDEVGRPQPQATGRLHGKQAAIGPTRHAMRQQPPTDPRTPHHAATHRPPHANPAHRAHRRPAEQPTHTPHHTTPQHDSERRGNEGTPRDPPPQHTGEQQKNAPRQCEQTQESKRTDPQNHKTSKATKHSTPTTTTNTTPTRDERPRGTPGRRAERRGPKRKHDNSDEGTQHHSPQGGRAADAQRAAPRHHRDAHDDEKEKETGRTRQREKKSGRARQEKRKKRPGGAQRGDTPAARATPRRTPARPPTPTTGRGGRRQ

SEQ ID NO: 993125 - protein, 191 aa, Homo sapiens
MTQEEKSKRTKQSKEREEAETNEQTGEQTTKHHRESRDAEQATRRQRDGRAGKQRAKRDERSRENETHDRDRQKRQNRTDSTNRPRERQRARSRRARRLKRARAQAEHDHGTQSNNTARREPNRRDAATGHTKRSRQRETEPTRRIRDDKKEQRQTKQQGKRRRTNQKRKTDERERTNRQTQRQQQRSSRT

SEQ ID NO: 993126 - protein, 63 aa, Homo sapiens
MKNDKSEEEQSSSYLKKDETNDEDDESEERVQIALLLSKGDLLDDDDNEDRGDDQLELIKEKK

SEQ ID NO: 993127 - protein, 230 aa, Homo sapiens
AEQTMVVSQTLPSGQFVVTDVEGGKLWCFTVDRGSGVVKYSCLCSAVRAKFVTVLDAEGTVYFIAGVSLHLENRPKVSTTWEGGFSIGSVGPDGQRGSPVLSHFFSENEDFRCIAGGGVDARGDLIVADSSRTEYSPFASGGGYSVLIREGLTCPVGMKLLTPKGQLLVLDMSEIIASKIYSYHREKDEFQPIGDEKSSVSSAAQANFRSLKSGEKWTVQIRLRLCPDSS

SEQ ID NO: 993128 - protein, 677 aa, Homo sapiens
MLSFSPKGEEIETELAHDVEEGKAQRVQEASVVKAEANMGFRSELEPIGLNIYCSSSVVTIIICFNCSCCCTYIQDVPPTTVRLINTTTSTTVVHAPYPQPPSVPPGTLDQAKQGYHTMTHYRQGCQQHPSQCSSHHLYPGQPMGPTGTNTENLAGGEDRDQKTTDSQSLKAGTTLVCPEGGPTENSLDSLAATRECRECRVIWCAAPARIRGPGEQREIQARKQYEPKKGRRGDPTGNQGKHRQLTTMGDNQTTRRNKREPRQDRRKTKQHNSEKNPQDNTEPQQGDPPDQRPRQEAIGRRDEERASTRSRGSHDRERGIDRERREREREEKGEKRERKRGERRGDEKKRRDKKRERKRREQRGEEKRTSAGRRRRTGERRGWRDGGEHAKQEKEAQNDQEKDTDRQRQKRGRVKRREGRKGQRARHRKTRNTRQGTEQRDRKGKEKETRSAHETEKSKRKGTKQGTERRTEREQETEATRRQAGRTRNKKRNKETKNKEKNERERKREEARKKRTANKSKRHKDKRGEDRGSRKTRQTGSRKREKRDKRRKTTRNDKKNSETREKERQRQRTEEEKEEERDKTRERQTGQREAHRQGGKREREAGTERRRRAKQSRDAGERGNAAQQKKDTRRASNEERETAQRKSRQPRRNRGKKQDSEDANNEARADHSAKTP

SEQ ID NO: 993129 - protein, 251 aa, Homo sapiens
MDTRGGLSCEFSRIGGRCYDRKERRVRDIIQCVKPCTSESCDVETTGHHHDPSSIYYLYCRGTISQSISRETSPDRTLHDIHSAVSLSMRMMCEPRDKIDGPKPAEEAETKATDMTDMAKTQGSNGHRRSVTRFRIEHTVGLSAVTIYRPQLITLPNVDHRPQIGNTAEEGLPRTHLDFLSLYPVGPWPHSPPKRQDLIIRSSDEHGHRKTERGSPIPLMADVAYKLAKTGTVTLHATEGGIRYPGLVRRA

SEQ ID NO: 993130 - protein, 322 aa, Homo sapiens
LQGSPMGRWSLWMMLRPFQDPDLSSLSGRFCVSGQAAGWASGHDSTHHPHVGQSASYTVKFDSLVLRERRGCATGDGNPVPPSCAQMCSQSPTQTATVLGDSSLMHRSGGVRVHGGLVGTCSSALAGWEVHRRGDMLEHYLMRKMGYDVGQGVSGRDLRKAGEAAASMSDGVALECKVAWTSGVETLAVSTPRVGNRWLPDRPPEVPGEYGPGWGPPASSANVFDFLSANSCRSGPGARRKPRAAPAEKGSTQGMDHCQQECIGPEASGSYRCRTQLATQRTNRARRTRRSWRKPGPTNNGHTRRRTRLPPETPPDRETPPA

SEQ ID NO: 993131 - protein, 124 aa, Homo sapiens
RVWLAASGGREPERPECTCGEAAARSAVCRETTSQPSTRLNALYSSLRWPFGWLLHYSSPGPGLGMAGIAVGGCGRDANGVPADLEGPAESTDWRLSNRVRTRTDHRVTDGRTTAKARLDAGSM

SEQ ID NO: 993132 - protein, 391 aa, Homo sapiens
EQGERAGEVGRTGRFPRPVTPVPSANVPQCPVELAGPPDGLRTLIMGVSWCWLLGWCLDKSGAEKVHVTIEHLGPLNFLLCVLQLCTWLCIHTFGFGALRSLMVTHISDTNSLLSGACEHLVLTLVGSKSYGRDTTVCNLDELVGQHICRLTVTFYVYQTRYPPNGPYTDRVCIRGPNSLIDVDLLSAVGTGPLADELKGPEPPKFGMQPPKALETGTVAGSKAISWVPSIMTRLQFWDQESLQLGFNPLQNIPSWVYRFREKRSLTYYPQWRFQEADVTGGVHGGGMTVTELPQPKLDKTKSKDTRLWMVIEGFKWHPIRQEGNDPNIEGRNEQEETKQTRGARQTAEEENYNADEATAQAEARQQRKTKEIVTQHRRIEPSEKVEQDMH

SEQ ID NO: 993133 - protein, 82 aa, Homo sapiens
DAWSKPIRPSRPCVYVPQLTSVYLAIRNFDLDSNETIVYWPEQLYEQFALLELDASLVYIFVREAYSCESPSYEKASYLADA

SEQ ID NO: 993134 - protein, 329 aa, Homo sapiens
LLRAGGRSWCVFRSSFDPLPLVQSGWAAGEELAEPWMDEVVRFAKKMDQMVQREERGGALDLLKELKNIPMTPGITGSPQESGMSVNAIREQSTDEEVDSLGLKSLSQIREKNYYMGHQREKDLEEKKKEPADYICRTSPVGKRRKYFQKATVSNQREDETKMLEILMFHPFLGHQALLILCGGSVGRCLLPALRTGDDYFALELDEEDLGSSTWEKLYYPRTKRVRPATTENRVRSRHIQILKMQTSHEGPCPCARFPRAYCVNYGGKRVLRLRDVRKCGQHAQATWRDRRPPLFPVGIDPKLLPPPLGYRPCGSLHASCRTYPQGLS

SEQ ID NO: 993135 - protein, 85 aa, Homo sapiens
PIPSEQLPPASRCVSIHHQQLPHGFTNMAHVTQAHVKLEITAASAFNLELLTWSELMELPTSRCLSIHSHYQLSRNKTKLLYCVL

SEQ ID NO: 993136 - protein, 503 aa, Homo sapiens
KPPPPGAGDCGSQVIYYVIWGGVVGIVGGAVEPKGDLFFILFLMCHPRCGDGEGGFRDSHRFSLPVWPFVILHKGLSCVAPQYNKVCCGEPLSLCTGFSCEVLVRYRDVAPTRASGGGGDQGRDKCVVRAHTCTMALKETLLGATKRAGTTSLWGYTAGRHCGVCALSAQCVRENGGRTRVVYHALMCVPVYKCGRNVRSCVVAQECVGARECESVTSTRKESFLAGARGGPSQLLTSWGSGGSLIGEALPYIGVLPPRRRLKGCGVRPPYYILGSITRGGEEDYHITPAYAALEYVKQGTHFMLWGGPPLWGGGSGPYWKGGNKNDSEEDQHNNTQTSEKKQANEPARDEKEKKQEKDTDKAEKTRDKHKNRRKKDKAAQKQRGGGSGAPQRQRECNATAEEGEAKHEEGRRRDHHQTQDENQKGRAHTNREGEGGEVTKKQQEGEGAAGERQTNNRRRGCAEQAKGDRDERKDDSEGEGEKQHKLSEEEGARNQEGGQQQK

SEQ ID NO: 993137 - protein, 105 aa, Homo sapiens
AELTAAAVETEAAGRKASRQAGRGSSASGTQEARGPAFAWAEGLWPRSSLGGGPVPKPAKGAPRRWAAECGGLDCPRPRGRGRSAVWPGGRGLSPLRKCAPGAVL

SEQ ID NO: 993138 - protein, 46 aa, Homo sapiens
PKPGACGTCWASLARLPVPEEPQNFDSLVGFVTAPGALLVTMTEKK

SEQ ID NO: 993139 - protein, 146 aa, Homo sapiens
MLTMETRLADKMLKYADTLSSVSRSVCLHAAARAGTVPQRQVLPVWELLRLQVGRILCFLVAICVLVSRWQEGGEADSHSEDSAWQAPRGEGPVIYVFVTLVEKSGGRCTSGAVQIHPELGVQPPCRAVNGHTPARKNLPFENDRF

SEQ ID NO: 993140 - protein, 173 aa, Homo sapiens
MRAAHLLTLPTGQPAHTEAGPQGAGLRTAPLHKLRHSRAEQMSRHVNEALQRPPASSPSCRMGSCPHPWHHILHPVAPPAACSRARDSSATHAATSSQLIRLPTHTPPTVEPAPAPAPHPLHRALPPPQATLPRLAMPLINTPFHPPTRAHFMTHSTHVQCAPTYTPLLSPPP

SEQ ID NO: 993141 - protein, 119 aa, Homo sapiens
MVHVDSEQVPPLLAIRSINAVAIDTEEPLKNLRRRLAEDEDKGSFKYAWVLDKLKAEDERGIIAIDISIDGKFETSKYYVTIIDAQDTENYYQKHDYRDISRLTVLSLIVYCVDVRVKL

SEQ ID NO: 993142 - protein, 102 aa, Homo sapiens
MVSELETLCTEEFEPVPNGWKGAIPLKNEKSFSILTQRGFVKANIALVKNWNVPIRVLGQHGRLLKHQRANCPGPFPRFGAGIKSMPQWGVPLYTAKSRTPV

SEQ ID NO: 993143 - protein, 377 aa, Homo sapiens
KAKPKKLSSVWSDGSVQNVPEWAALMPMMIPDRARHPPTAWTHARSLPSCRLKLEWVYGYLWPETAGPTFILLTTWGRQCTSVASVAVLYSVRGADVQRHYLGHNDAHQMLAIHPDMVTIATGTGGREPPEGKRKPLPPHDAGIWDSDHPSSTYTLLGLDGVRQSRVLVWAISKSKDCNLPVLHLHDIPTDTHCSPLVRLGQMTTHVLAVKSPMKARHAGTLNPRNPNCDLITLRAQSQHSTPDPWACEANCRSGQAPLDKHKQADTIVRGDNIWHGCPHVPGNYGKHLSKGLHIVKLKTALAEPPTDARLITSSRRCKGNTHANTRTKKQKAKNKEQHSRTNSRRTQNTFQSTFTTITINHPPIFFKSPLTLNLNN

SEQ ID NO: 993144 - protein, 107 aa, Homo sapiens
MSPGTSGVVKTTPKSQIMGTGTTTHINIVVIGHVDSGQVHHYWPSDLYNAVASTKEPLINLSRRRLPEIGEKGSFYTDCLGSWIQLEKLAGSEPCVSTIDISLDRKL

SEQ ID NO: 993145 - protein, 342 aa, Homo sapiens
MKLLLGIALLAYVASVGGNFVTYELSTQQVYPGKWCNSKIDKHRLKQMVEPLKSRKSRSIRQKKLYPEIPPVNVLIEKDRKTTLDNRRRTGSWASHLTDKLMMDGHEVTRGWTISSRGRKQTRGDTGSDIEELRVDYTTMLWRPLYIEVDQEYKQQGIHQHPVQTTCIILSRDSRPIRLGTYNMEALGKKELRRRHGTRTTTSDGDRRIMKTHYKEADTGSTIHHKASGRTEKETDYKNQAANQKQEDEIPGHKKHTWTGGNNRGRQTDKTEEGQGDHTRHARDHAEQNIEQLVENNKGTKAGTKRSQQQDEQNTSMTNTARGRPSADSVTDSTAKEKKAER

SEQ ID NO: 993146 - protein, 196 aa, Homo sapiens
LFVYFLLLPHAGGAIMSGNRALAGRAVAGTQQSEPSLGGESAMSSGIDPTGYLPRVTSDRVSWNASTCTTMRPPAARYVPRAVLVDLEPGHQWISDGRSVDPFGTVSSGRTTSFSVSSGAGKQHGPRGTTQRGAELVDSVLGFVMKGGCTSCVRALQGFHADPLPVVRADWSLGWVPSSSARSGRSTQTGSEHVSV

SEQ ID NO: 993147 - protein, 35 aa, Homo sapiens
LFMLGLYSLQGFPWASAQNCLQNKPGTVSLRTVQG

SEQ ID NO: 993148 - protein, 448 aa, Homo sapiens
PRDRGRVVSTTRRAADATDGGRGEQPPWRIARYTWCSVDGMCLSQGGGRFHLGIHHAAQNREHWRWSACLLSTRTGGRQSPGQWGVDGPSIWACRATRHIEDDPDMLNDDGAAERSTIIDNDGRTIWPATGAIHSPEQTDRQSKRKITFMKVTQHENTSIDWSQDTQWEKQPPHVNKYARQRRQRRNPCTWQMHRKVHWYNSGSQTNEDVAGNKKTKKEPQQRGTVDIPRADTDRKRHKTDINTPHRKELQNKEQWGHIKAKPDKRTKGITQCQENGETRRQREETVAPITEEDTHRRSDTERRPRPQAGIIPQQKHQHKRNRQQDTDVIETEKTTTQVEAEHKKDNKAHQQRSRNGKKQEREEKTQTAQTQKTTESDERSKKDKQRRKRETATTEQNQRPEQTKTATKTAKTRNTEPAKGRRRQKDNRQRGRHNTKAGNVDTNTQPH

SEQ ID NO: 993149 - protein, 56 aa, Homo sapiens
MCELREHPEFSFLYTQSVAPYKKRASDNNQRKYEQGLRQRSYIKVSGNYGGQHRVY

SEQ ID NO: 993150 - protein, 514 aa, Homo sapiens
MVAYSHTANAIHCTAIAARYRTSGIRTFVLSMRRAGRELVRASWTVFTQVRVNRTSLPSATTMHTQEFGGCIKGLCISRRAETQCASCFAKALFPVSLWCVFVPLIISCMESFSPYLLPPESISVFAYVMPHLPSLVPIPERLSFPIGCPLDSDDASYQRCVARTRDHATRDVAPYVGREGPVHWRAVSDHRGGQRETWSRRFTFPLYEGHMSISMRVVFPPRVHFNFLCEALACVVFAPSVPGPPLLVPGENVIGLRARGGPLNGTFFLPQGVLRSKTRVGPRLSPRRVWAIWSKRLSPPVFVNFARLVYPAQSPQSGSPTCGWLWPPRGLAPTHIGERATLPATLGYRATLVSKSVRGYIRNSREMRTRGTSPPQRHGKRWGSPRGVQRPTGAKHIEEQRYREQSVGSAKKRDLAQTQPRRGRVPPKEEPRWDSREKSRQQYKNRRGGGREELVAALDNIQKRTPRSKNQREHTKRRIHNNGNAHTHNTERAAETQPKQRTTRQKKGSDAKK

SEQ ID NO: 993151 - protein, 42 aa, Homo sapiens
MRKERDGEQNRRAERKRDERKQKRQITQGARKERKHKGGKGK

SEQ ID NO: 993152 - protein, 186 aa, Homo sapiens
MRSVPDPYSRVPATPGLADPLRPVEPAHLAPEPLGPNSRPRVRGLERQCGGSCVWRQRQSRRRGPAVVFGGVSRIAPHTRQWYIPKELELASWAYASPHCQHHLRLYLCICTLEHFSNHLIPLPAGSHIANERTEEMTIPPWLSIACPGSSGVFSCLRVWLLLDPFLVPPSPVLHSEERLEKGTPF

SEQ ID NO: 993153 - protein, 378 aa, Homo sapiens
MVHKRRERREKKDKKTKQKRNVQKNTTRRANDQAATGQDCGTSHLQRPAHATRQRTPESKPAQGQPTRNHKGQGTTRNKRTEKQEESRKCNATPGLHKRGHHKYNNPNNIKQKDKKHNTRQPYETTKTTPVKHGRTTHRKAHSAAQRRTCGKADSGMRLQPNWGSKKNDGKTNPRSQDEKNANTEQRKAENKNTTDNAKRKHHTERKTKTRPTGQPHGNHEHRDKGDQHRNEKGKPTHSTDNKTKTTKERHRQEEKRKRKKGDNEKQKRHEAEKAEADKATEAQEERQEKSMTDQKDNNRENKKRKTQKKRREHKDRQRKKQRGQRGDEAGKATNENKRQERERHGGKRKKAQATESSRRTPSAAGHTTPHGEKQERA

SEQ ID NO: 993154 - protein, 47 aa, Homo sapiens
FWRDYGYCENGVRLENEGKLSGRQCGIRRECFVCYLYQQVLAGSELL

SEQ ID NO: 993155 - protein, 545 aa, Homo sapiens
KTENKGKTGDEEMLKDKGKPESEGAGNKQGKVRSRAGQQSAAGRAGIQQQQQGNNPAASAGQSREQCTGSSPGQCKQVAARKCAHADGMMYRQDKPITTKLSTGACAHFTVNGRTKHDGTEHMSPCTLSPVHIASARLHPSSTFSHHTHRASTELLRALQATARTHHSQDPRTHLRARQLLTARACRQWYRHSTTRNALMILTRLRRGSQYGATCHAGDETLPGGHHLRNRVHHFANETHLSLVLAAYSMDSTLVALRPHFLQHQEGPTLNSPPPNPLLRALTYHFSTYHKGATTHVPPWSGLRPSPLLDCNAYINSNNAKRCSHFTYSGAKHGIQLHQHPPLLANKRKGTDSAETHYASHTDYPQHNHNVERKKPDTTTKNNTERQTDPHTAHPHTHTAPPTATSNASTPPSPLNKQEAPPISADSYTLNRPTRHARRPTKTHPLSAAPNAHTDTNTPGHPTTNASPPHEPTTHPQTTHRSRADQSPNQHTPAAHTHPSRADTGARLTQTRPDSKDAPYTRPHLPAPDLPPAIESIERPSPATA

SEQ ID NO: 993156 - protein, 291 aa, Homo sapiens
MGGVQEGSYTSFEKANVGPLEGPHTLDYACKHKFSVGLYQGNVTLGHKVGHSMDARKSPSPPRGHHRVATDVGRSTAGEDSSRSNHHTLGGPTKRSRPPRECPLWRGGPPQQDRPVTCDLHTFTGESASLKYFLSHRDIFLYKHVTMGHKGSPLKRDTKEYAASLGENTSEKRATMPKMDRYLPRETKPRRGDVNPLCPKHGSMGGKAHEIAKRQQVPYDKRTWHKKPPVRGPLMPAEGYPTEKGQQYTTRPLQGVERLSIGIRHSECQLRNTHIHEEIRQTNEKRRQLDT

SEQ ID NO: 993157 - protein, 362 aa, Homo sapiens
HAYVWSHMATMKFQWDLNAWIKSAEALGKIVAERPVTNSKQALYLMAPSNDAPGPLSKQGSWQLSQPMEVQEGYGIWVQEMIPTQCAEPHVSGVKRSRSGEGEVMRLMRKVPRSEPVNAWYLDPQQLTASAPDLQGTSQAVPLRTTSLIVLERGRCLLQLPVSQGLRLQGTPGDPTLAGMAIVNAGGEEASIGALLLPLRALRPYLCSWLIAEGPGAERSRLAHLVAAPAQGWNVVHLEGTSAQECGRGTRDEHCHHWQVCKAKGTRERSPKVIRYTDGHSRLRIQGTSVRHPATARNHDRKANRPPGTNTGAAKHTTTEGRVTTEKRSTPGPHQKAQQEKTKNNTKRASNNRPANQTKPRE

SEQ ID NO: 993158 - protein, 246 aa, Homo sapiens
MSPRALDSEQMRTHYGNPEARIDELRLFPDRTEFDLYDQIHQSRCSDLREDSMNPRHHSRYDGNTQILNKHIDIADRQQAEDRSNHNAEVKRKHEQEKKKHKTAEGKIDQQQPLGETDMKQANRMEHTLTQSKYRSTTKNEKKRKEQQKAPRLMHRPGLTDKKRTHQNKNRNTIQPKIGDRTHGQKERTHQETTQDEKRNHDKTMEHQHTQQTQKESTKQNRRHKETEKQTRQPRDTTTPLHTHQI

SEQ ID NO: 993159 - protein, 88 aa, Homo sapiens
KTGYFISKKEKKVGSGNRISPIGPSVSLVVIKSFYDDVDNESHDLTLHPGPSAADRRYGIQAQMVTTDIQKIQPMGDRLYIGLAGLAT

SEQ ID NO: 993160 - protein, 164 aa, Homo sapiens
MDPYKHVHPMITTKENTSDNYESKTQAQNLIARQQQQKTTEPASNLRKGRQNNRKANTIEIGGMTLALIHRGRLPPPLYEQPPITPPQQKRQKGRTHYSTTSSAPTTQTPCKISTRVGHDNPINIRTTQKRQRNDSPYKKTPTGATISERNSNKRTHHKQCNNS

SEQ ID NO: 993161 - protein, 76 aa, Homo sapiens
EKQIRDSYARETGLPAGTALDRGPCCDLGDAEPAWTTCAGDDVVAMSSQEAERAERQEAQHTLSVTLEQWLRQRPL

SEQ ID NO: 993162 - protein, 265 aa, Homo sapiens
MSAEPAPDGGAGASRCGHCSPCTVEDALNKVWSLKQKFWEMLCLPLDHIPSPFSRFARCDHNDVVKFPARNGTIIWNGQTYFMAVAFLSAHEKQRSKFPGGACIVNFMKTRLSRHSGTNEDCLKWDAGGMNVVDLGRMDTQTNKLDTRYPYVCHAELNAIMNKNSNDVKGCSMYVALYPCNECAKLIIQAGIQEVIPMSDNYLDSDEATAARLLYNMAGDDIPGKYNTRSAAQHCPLTFDHLQQTEYKSFGVHHIQSPEDRDHGS

SEQ ID NO: 993163 - protein, 74 aa, Homo sapiens
MHFTIIFIGGKSNVSVPSNTLSRAIRNAPTKYYRMDHHNYPDTALHYASSPQLKILNDKLPPTSRHQEPIKCKK

SEQ ID NO: 993164 - protein, 376 aa, Homo sapiens
MGRPTRTRRGARVCVETGLAARGKPRQLRRKVPRTLGAPVTQSKPSKKEEEERKAALPSAPYQQAFGGAHHCELRGQAPSSGTGVPTAGGRPQTRGGRETRADRWGRRTRQAPWVPQGQRRIRLAVNAPSFPENPRDWTVCGILKKPMVDQALQQSMLAGSWCKWIYVRRNHGIPQDGRIWLLPDLVTLGNRPALALGICGNMPWIFKGEDKEDPRWQLEIVLDNGWDIHRRVSKYHEDGENLADGTGTMAWRAHRTKAKKQRVHLVGPSLCESSAQYDRGQLTTRRPFTPANVTPWNRRMALQHQGTQPGWKRIDTRGPGIPVTRDLGATLKGGVQHTVETGTLSTPEPAADTEHNQQNHRASKRHTTAHTKGSA

SEQ ID NO: 993165 - protein, 419 aa, Homo sapiens
MNVDPSAIRYDIPEWRSDERDKVKYTVHTKTTLPTCQRPEFSVTRQHEDFVSGYMTLIIDNTQTYARAIYIPPCILRKAQTYDWYLEQKMQKAWEKVTAALMTQTTTLTPRLTPRNWKLEVSRWAKQKDLVYNHNDSLNITDGIMSYSTLGYSDKRIAHNSPVNPEDILIKDYYKDAEGRPTHPYQTEQIQRGASTHKTNKWKGNKVALQSNAPIEQPRDSSPHRDKHATPKGRPTQTNEQRPLTSTLQSHKEALPRNDQGGEENNVDQHATRHLHNNEKGRHNLTVRQRAARLKQTRDNRKRPKGDHKRYPNTHSRRNEIRNTKEEKRKTGPRTPQNKRRGRKERDTREEQVTTKVTRYGIKAELTKHNGADAQQSTEQPNQTNCWGMHHQEERKTAQTRKEKTYSSEAEETINERRH

SEQ ID NO: 993166 - protein, 249 aa, Homo sapiens
IAAELGACSVELESLDAAMAAALELWAAAVAWAELGPVREAMDLLGALAYAPADACLADVCPHAVPLLLACCLLHGCCCSGMRLPGLPASRLPEPPSPQEILIKVQVYVSWGAGAPGPGLSGCVGNRTLLAAGTTDSEGVATLPLSYRLGTWVLVTAARPGFLTNSVPWRVDKLPLYASVSLYLLPERPATLILYEDLVHILLGSPGADPSPWCSSSAGLAACLSDPTTASSGRHLRLAGPAGKWGYPC

SEQ ID NO: 993167 - protein, 407 aa, Homo sapiens
MLATPRRALHGKEVCDCREEKRQQTSCNMSRAIVYQLAAGQATHGQQQQQVFRTQWPFQQSSLRTGMVHHFIHEGIGGTNYAILDHAYVISKDALQEAWVAGGITHVVNPQQIQGKHEAGIDHHEKSQTATDHAMDHTLVQTPVISHTTYTNSAGQQLARHRVIPGNIEKADGQAESTLNHRRRKIRKRSRRSGPNGTPSQGESSSKNNSRHTQNNNNDNNRNKHKHKKNTGEKQKAKNNDHKQRGHNTQTPGTKDTTTDHKEKDNTTERNIKMKHEHRSEGSDQQPHRQPRPGHQHRQTKKEENNVGTPRANTKEHPTPAKSEHHNNGTPNTTTTRHTDGRNRQLGEKTTTDNHQNQRTIHRSHTNNSTTTNDRKTTRERQHRKKPTRKRKETTKQQHDETKTPNT

SEQ ID NO: 993168 - protein, 394 aa, Homo sapiens
MIDQQTLAGLVKFMRVISQYTVMLDLIRSEITSGDSGNGYTTDRLKQQYVQEVIHEDWKTRRGPREEIILGIEDVLLGECRKYNVQYAISCEYHIDVYGLLWSGNVSKGNNDVRLPHGNNDTIVIYDVDIRSLGYCEDRIARLEQHDYIGQYMGNLKVVADNFKLGSRTSMAMEPRHFEKSEEDSGLEGILSPYGKGLLLWHNMRGGSINSMTNFLVPPNGKGLGAYNYIVFFTHNSYVKTQDKGNMRESKAVEKIPKGHKDLTQTQSQGKERKGRNNKEENRGQNKMYHGNSRSKNTAQREHQLRVENEQQHKKPPNKHNTGHRKEEKKTRKEKPQKQTLLGTPAKQKKSNDENSKKNEHKRQKSKRNVNQRSTRHKREGNTKKVRRTSHKRA

SEQ ID NO: 993169 - protein, 75 aa, Homo sapiens
SLSAFGAEGYLTLAEARELSCGIDVIVHVPCCVLHWCCAVCLVMPVMLCCDVMPVHACLCLLVLCASHVLDVTVF

SEQ ID NO: 993170 - protein, 175 aa, Homo sapiens
MILSFLKPFPAMLNCESINTSFFYDPKKKKSNTLTTIHHKKGGGPQKITPEEGEQSIVGTTIFGERGGPEGGMHKTQDDGRTPPTLEGNINGGTVRGPNLRGPIRDHTPSKEDSGKKNERCSGHTTHDACEQSSDTKMRNETNTRARRAAETRRRDGSTNTRTPRAPRARHRAEK

SEQ ID NO: 993171 - protein, 96 aa, Homo sapiens
VVLSLNPLASPTPSAACTLNTLPHLLCQELATTSTMPYQVSSTDPRSSTDRQLSDICSPHRWHHGTGALHGLHDVTSTVDAYAIAVLQIHLRTLTN

SEQ ID NO: 993172 - protein, 170 aa, Homo sapiens
MLDPPQDLRGQRRRGRDLCGPQRNTKKPTHKKQNNKRPKQQNTTPTERTKRVSPREILSPRKELFHQQDGHIASGLERKGATGGSTMNSKDRPARSVSPVRNDVGEIPTWRTPIGVNIEREITHKPRETRHHSQTAGIPQPSTKPPRGEHTQPHAQKRGTHLPHNKTKKQ

SEQ ID NO: 993173 - protein, 359 aa, Homo sapiens
RRQTVRTPPSSSTADRPGRQTAETDSPGASGPHLRPPASASRPQPLPALPAPRPPAPAAVPTMTCRQYGPLSGDRLRWSSSPSAAWLAVWPELPVGRAGALDAAGCRDCPAGRETSMLGRLQDAADDHAPRQLRRNCAPSASTCEPHTRASIMRTTAPRTNRNDRPCAPTKSMGSSPGTSTQGQQEVHGQRHHEPNPDDTTAKYHVAQMPRNEGRRDLDCPHAHTDKENEHAQDTRPTYTRAHVTRTARATRKPQGNNSKQTETAEQPWTTGPTRAPNPPWELGHTPHRTDLHQQTGHKQKQTTGGPKKPNPHGTTHSPHMDRAARDSPTKKRTAPTDTPATQSAKYDTNPRHEPTHNT

SEQ ID NO: 993174 - protein, 336 aa, Homo sapiens
ASAGGLPVGGRGRREPNEGAITWQPPTSPRRCPPRRGTYYPAPSRRGETAPAAAGARATVHPARGVRRLAMAARPTLFRPQLSGVLSASAVDAAAVYRTPHEGAPLLARSSRGPAFFLCLAGPFCGRMRKKEGALSHRCKVYFEIGMADEECRQGDIWSLRKDVRETGIIMWDLVREEKELVKEGENHGVNGGVHDHRRRFTGDDGQAESSIYGEWVPGWRTCTRKQEGALAGLEQGAGGDTRDRAGDRDVMAGADAQPGRHVHDMECGPGPKGRKGARAVDSRGDRGNTGGGHYTATRRATPAEREEAKNDEGKAATQRERREASSDGRGRKTAK

SEQ ID NO: 993175 - protein, 309 aa, Homo sapiens
DLGSGITCSPPRPEPEHPGSRQPRHTPSKMGKEKNHINIVVIGHVDSGKSTTTGQLIYKCGGIDNNRTIEKFAPEAAETGERDSFNDLPGMLDKAERTDACARTHPLDHLPLEVRDPHLANHSETTVLHLKIQKHNQQAVGQDARQVNPDYLKRETQEGRNRRIRAGGQLHRSRDRHHCTPGVHRERTLTQTNTNTHKPADRTTKETKRTENRQTKDNEEDRRRKQPRPPTTQQTPRTTRTHKQPPHKHEHLAAAEARAHNKPKRQRNGATPQAHKRRATETTYTNTTTDTHTGTPTKHPTHKTPTRHP

SEQ ID NO: 993176 - protein, 424 aa, Homo sapiens
MLEEDHDGGPPIYITQSTRLARGKRNKITSCQNNDKGGEEKPTQYEPQREKNTDTTQSEHTHKQPCMTQNTEETNRTSYTDQRETHTTKEAQTTPTGSAQPNDRDTTKTRRKQTHYTHTETIKAEGKHTQQQKNRPKTDNNKLRHKQTNDSKTNTQKENSTQTTQQINIRRRTKTHNPLNKARQEKRKNHRQTAKRKEGTQEKNETPRHKHHPTKPTQQDNHTHQPPQVEPTHNTTRQRENTNTRQARKDQHQQAAQQERIRHNKNQRNKAQKANSKQQKTRNETNDRNGKKEKKRDEERSRKDEGGKNKHKEERQRNHTKNQGDSYERETRKRANQRRIKNTRRCKKDELIRQTTQNGRRKEVSKMKKQREQRRQGSNHADTDKNYEAGERNEEPKERETTQETRTKYKTKHQSARRYGGARV

SEQ ID NO: 993177 - protein, 112 aa, Homo sapiens
MEVGDVQGTTPGPRIVETPVFYWKYTNKLRWGMGGVGPPGISAATVRRLRGRKKCVETVGSVGGVQCEPENVRPVGISTRGCEQVQELHMSSKTNNKTNVCGRSLFHTDFYI

SEQ ID NO: 993178 - protein, 303 aa, Homo sapiens
MSTHTAHPTALGDTQAAEKRRLLDTVKRRVSAKDRRKGFYSKTRGIWLGLLSMNKQSYSDSSMDRDPHRELIQPSHRLIRQHVDPRQTEAQKTHERSNSERAGKTPQAIQDVRDTNIKTAIGKDTHEERGDRETETKGRQRQITRHTEEPNKTNKNHQEKHTQRKWQPNYTEPGNKKTETGYDKKRTRQKTTDQDKHNQRKTHKKQKDNNKNQRKRNKNKQSRKKQNRKKQDKRREERESEQTDEGKRRQTKHTTKEKKKKRRKERKQTENNTKSTREKAKDKKRKKEEKRRKSKQNKKEKKE

SEQ ID NO: 993179 - protein, 514 aa, Homo sapiens
DGGLKEKQSMGTQATGVVHSARGRPRDPRRAADEPQAPPLLLGEGRDLERGCSDDPPCPLLPRVPMDSPPALEYGPRSDLDAPFFFTQVKRRRVRRPMAPGEYREPWMSTGHVTERHGSAMPAQTWGQSAESPKREPKMQQRRARTGAQDPEKLLGPTEDLMDTKDHGSDAQTDPPRNYTTKQTECIQTLTTKGHGNGSHSHYQRSTEGMDHRKERREHKLQAPKTIDTRRDVPGKPEGQEQGTPHKPIARDRNRGAKNKEATETGRPHARHTEGHTGNRHGAHTRARSQPQRQEKNGIPGDNHKHTTTGQHHTQRHTHKADQQKTQERQTKHTTSQGEHHKTDHKHTQPTSNDRRTQCATIRPMKGENLYEAEDAHHKGDNTERKKTTGPVTQHNQNGRPSTQTTHRHTNKHERVERTQTTENAHRKAATTADRQHEERTTTQDTDSSRQQHKDAEELTPTKTRGPQHREKTPTHQEQTDKRTQQTRDRYTLREAQTRRNQDEEKQTRSTHRQ

SEQ ID NO: 993180 - protein, 328 aa, Homo sapiens
MTRGEQHRQSNAQHDKSETDRDKHTATGRKEQGRSQREKQKRARTHHAAHHAHVGGHRHREQRERTSSRTENREDSKAEDNRRDQNAARDEQHEDRGSADEERTEAARTRESKQRDEQKAGARGSDVGSKAERRASGDQTGQERRERKKRGGTDSDDARQRSRQREKRDTSQHDEEKRRAEAKTVEAQAKRNEVAARGEPRKRAEPSRAGEQERRSKGEETRTARGKKDRGKSKTRETSEDDARGAHERESEERGERTERAEDKDKTRRATDGSSMKRGAAEREETSGDGQNPKRKGNRQTEERTSGRERGKSAAEHEGAAEDRMQDE

SEQ ID NO: 993181 - protein, 441 aa, Homo sapiens
MRNAPTGTGKTHMEQNRNRTKRHAAPTHGSGKGPTMSEQKTRQNKANTLAHQRGHSAAHTDKGQRRAENAARENENTEEKETDEKETKDRQKERTTKRKTEEETEKESKQKDEHTDKTEEEQQQSKKKRGRAENKNEHRTNEKSSEKKRKGGGRADRGEEKKSTRDRQAERETMRSERGRRRQEKQRRGREEEQKEEKGKREGEEQKEVERSAEKKTDEEERERKLEGDKEQGKSGEIKTNREKHTAHDEKTEEQEKSKEQEANARQDRRHSAPKRQQSKETRRADDDNRRREKESTRTEERRADEGEHGDKQTQQHKEEKQNEEEQEARQRETKSKEGEEASTTSTQQAANRRHEQNGARGDTRNNDEESGGREHGEDDRKTEQNRKRNNRTRARPRKVEHNNNEYRSRRADTAENEHDRATGSARSSENSDITATRPQD

SEQ ID NO: 993182 - protein, 127 aa, Homo sapiens
PKVTHLVFLKNWKKTDPPFLAALSPFYGPPPKQGGGGRRLRFWGHPSPHPCRAVWALPRVVGAQGPDPRALLSPGFVGVLQPHAKAQGVVCAPELWGCAVGETTSKKPQKNPTVPRERNRARGGRGA

SEQ ID NO: 993183 - protein, 104 aa, Homo sapiens
MEPHANRSWRNIMMVSNQTARSTQKEGGRKRSPQNKAPREKHKVEKHRHTTHKEGSETKDGEPPTDWMNDNEGGEQLRKNRSRADRRKPLKQAAQRKGHNNHEK

SEQ ID NO: 993184 - protein, 183 aa, Homo sapiens
MGGPGGIATFVGQAGHFTPLPPTTLLRISWGALRRGYTDLPALYIRGPGGQREPDVQHLAGVLLCVVPPFHGMKKGVSRFGKAQLGMIVYPGPVLKGYIPSRGGAQSLYERVTPSVFVVTKVGPHTSEGRHLSKPKRQVDTPEYTQSSVKGGKTRSRRTCVSETPTLGGGTTGHHTTRIRRLA

SEQ ID NO: 993185 - protein, 229 aa, Homo sapiens
LAFETVPLVSPTWPVGSGTSTVLGSSSGGALNFTVGGSTSLNGRCEWLSRLHESAWCRTNTTLCVGSVATEVPLSTTGPLLQHGMVGPLHSSPESASALVPNDDAIRVCASTRRLATPSSSGADPDRCERNKTYRCIKQRPAASKGFQQLAKPAAVTITQHMAHLGVELSEPAATWAGAFLSGEPEPGQRCSHWAPAAWRCSTYFCPRRAAACHVADILVVPPVTQRST

SEQ ID NO: 993186 - protein, 45 aa, Homo sapiens
APVTWNGGQADFTMPAATGDSAQTANAVIRSDRIPLASRARKSGE

SEQ ID NO: 993187 - protein, 85 aa, Homo sapiens
WDRTPPDLSPKITSFEYSPVLHTPTVSLGSNSHLLPAVMALRLSLPAPGWFGTIEPARSPLNALDGHQEALLMGWPSSTGALGIT

SEQ ID NO: 993188 - protein, 501 aa, Homo sapiens
MLHNVGACEPEKSGARKSESVRETRRAQLSAVKHHKEEPPKIRKTIRQRNEAGTEKHNNNNQSAINTRATRTPRVTSPRSTRTHYNYTQHATARRRPHHRSTPHTHTTGTVENSAPGETKHKRMSRSRRAAGGQHDQPFDTALLGTVPQRPIRTKRHRGDRSRTTTPPTTPSATIGQTDQTQGRPYSPLHKTARGDRRDTLSAPQYEKVIAGTKPMREQKDKQGTHTTSISKSLQTTYREEDRNEETEHNSADRNVHTGTHNTMTYTPSINAPRTRKYTEHTYPDENVARPNHIKRRVRARRMVDRTPYRDEERVPMSNESQHRRGPLPQNYNSVSSSAQTTTTLGKQRRRELDVEIHTRTNKAKIRCTTDEIRKRKASAPPSGKALRHEPPRQTTPPRRKQKVTSQLEHHSTTTIDELERYTTQSRRRNAQTKQHEYGTKVYAETKHAERQGHVHIDEHRRQTHKTNTGENRHEQQRAENAHIQRRQEDSNVDRRQRHMR

SEQ ID NO: 993189 - protein, 91 aa, Homo sapiens
RLDVEEVCWRENTFELTEDSGHAVEAPALALPCRDCDERLEQRLQVIFGQADEYVLEPKMRCQGSPRVSTGNSLAAEASFCATITDSGTIL

SEQ ID NO: 993190 - protein, 289 aa, Homo sapiens
SSMQYFESSRRPGSQQERAHSYGRMERPQADRMSQDFDQRPWKEVTKEVQHAMGREMLKLHEESLQKGQVADDGFKAGDWPRTDTSIYGGPGGGRLSQTRKSRRYFSPCATCPEELHRKAALEQDLAFWYGPRLAWRSSPNTPAMQRYVKRLHEVGRTEPELLVAHANNRYLGELSGGQVLKKIAQKALDLPSSGEGLAFFTFPNIASATKFKQLYRSRMNSLEMTLRSQAEGDRRGKTGVLVNIQVFDEVAESCCPNATKQPKPLHGNQGVYKVGHEQFGGFWPVWNP

SEQ ID NO: 993191 - protein, 48 aa, Homo sapiens
RIVLDEGNKNVVTRNSTVEYWVSAFFFTLTLNIISATSTLMKVDLVDL

SEQ ID NO: 993192 - protein, 163 aa, Homo sapiens
MLARPSSGSHPSLVLAVLLVPGFQETNFPKHKRRFSPLGCGEERNKDLWYSIIGMVRIQYIPDRWFSDNPFMELAGKHYTGPVVAKMWTQGKANQRTTNQTNTKRHKTRGGGAPLPYEVTHRARGRPTGSRRDNTQQTVLVTQTSGGHPTEDTPSTQDNATAR

SEQ ID NO: 993193 - protein, 196 aa, Homo sapiens
TIFNTSDEGPILNSAMAFLIAYLNRINSRLYTDIRQKGARKRWGKAPYGCVTTHPFRLSASENLCRAKEPLKTAASIYPSPVVHTTAPPQPLRPACDPLPPTYPYLNGKRAARETRVEAEKRARESANAANPYAHGALMGVAYRHEDLHKARDGHAHYSPQCACVRPHARREHSKRAMQHRYHSPKRIRETATIAE

SEQ ID NO: 993194 - protein, 274 aa, Homo sapiens
MPYQYRSTDPGSSKQGAVLTSLTAIVWHLATVHPESADVVHWRALVKRVQSIGNRQNTEENRRFYRQLHVGLVDDRSKPLPFGGVYSSSMITVYHKAHDGRPFLPQVSQTHKGRCVVRALKVYNGGDPPEQGRTGDELTPNGLDWAGCPLSPAQIRTERDFAKDGIVLLEQIGDYTPLQSLANTMHNMPNVTGPVDAKNLDPWKCLFVAHSRTAEYPTLIAGPMNLDRLENVHRERGGAAAKGVIDTIYLMAGIHCFPAGSWISKESRRKTPSP

SEQ ID NO: 993195 - protein, 341 aa, Homo sapiens
HASRTAWVDPRVGIGVDLVLFPSSTLPDPSPPCFKWIILDLLTLPGYFDQIFFAAPSSQSSDSTPSNRGRTSCVVDQRHTAMTISSMHQPYSGRPQRDGHKQTGCDASSSKHQQMQIDGQDTGGLHTSLVNTPYRYTSTLSPTRNWSHYRGTDDNRPSTTNGPHHTDKKYTHRNNTIVAKFTITLGDPQTKRQHNGVQPSQRSTYTQRDTTYTDTHPALTAAQHKKHIKLTHNNQPAHAEPRSKHTDAEPEPTNEHKRTHIDRTPHTQRVTTGDTPLLNNIDRPDANEHVKGTGTTHLHTGALATTTQTTPAQTTRTYTTTTDKRCIYQTHNRHPPPSQHN

SEQ ID NO: 993196 - protein, 196 aa, Homo sapiens
MIVKMSLWSMPFLTGGNQHSAFCENRQSGIAWSDLVLQSWLRIMSSSNSVTKFCSETVRGVSNMTPVLTARSGQHVSDALAKYAKKFNIEAHTSLPWLRQRRVHVGVDLGVSRCVYLKENVRCQWFTFGGPELLVHKVMWARVYEIAVIRTQPQALLTSRFLRWVLPYTASIVGEQLRRSKHYSDAVCETLSGISN

SEQ ID NO: 993197 - protein, 153 aa, Homo sapiens
CLSADVSAPVLGLERAEHVGEVSQKPRKHHWCWAGQPAAGIAFSGAEDPDPASRNGMVQSASVMDHVGIARRNTQWRAEMNYYANTSKEEPVKGSMFPTEPMFLHYYLAFSSTTAVPVDKPRSVPPPSAPPQTHVDVKTTRMETLIVPHSHLE

SEQ ID NO: 993198 - protein, 316 aa, Homo sapiens
MRRRQWCEDAKRQIQPPYASEDEAMSAREEEDLCLHEGIGWVRRQKQRNRQAARVKTTEPPEDATKSCSRSEQGVTQGPSRTVMAIRLGERVDPNFAPFPSEPPKKAFSSTGKDYRRSRWAKPVNSRESNRETEQEETRVVITGTRKSQQYSSPQSEQTTERAKGACITMLCRNNRALITETDHPVRDRPHTSLPRYRREPVTNSRESQVNPPHTSGGRNLHKRDTRAHTSGHRESRTQTRQRDGNLRRRETATRKDEQTKTQRMLAHLCAGDEKTTRGTTYNGERDTDNTRVSRPEQHPLFNTAVEARDKIPHKN

SEQ ID NO: 993199 - protein, 108 aa, Homo sapiens
MPQITMRFRISCSLDLSGLYCGSLIIVLRVPSCIDGYVAMTHTDVSDIWDAVVAYLDPPLPIYCELARTYLGDTFTLSRSVTSLGGGRQTAQVVNIKAVRVNLIGSLC

SEQ ID NO: 993200 - protein, 145 aa, Homo sapiens
MWVSQEAHLVENYIFLGILCGITTGAHLREKAGATRYVCSGCDTTFLQKKEVHLSLVAYMCDTTRVCTSQGRHLSVQMSQKVCECRPLSITVWRRQRSHLCEKRFPISAFRVWGAHIETTRFFYSEISRGSHLSRDMAFIKVCFA

SEQ ID NO: 993201 - protein, 33 aa, Homo sapiens
MKKTVGTINLDKKAGRWQRGHRKVIREKRDGQR

SEQ ID NO: 993202 - protein, 126 aa, Homo sapiens
RTRGSEPLCLAASLESEERLCPAPSSEMWGAPLPRAHCLRCGEHLCPAARLGGEERLCLATARLRSEERLRPAATPSGREVGGDQPPPGSHPVWEVRGASARPPLLGSEEPLCRPHPVWEVYSTAH

SEQ ID NO: 993203 - protein, 243 aa, Homo sapiens
TSSRSRAAALFIFFFIFWKRSLVLCGPGWSAGAQSQLMCKLRPPGFQCRIYPCHKPSQVSVGHIQVCQRNQQYPFIIYLDIYIDTTMWGQTTRKITTTSENGSIEKSSMCTTSANTHNNQQNYATLTPTQRAKSTHQKRANNTKKQQQPHETNKNNYHTTTQTKKTIEHTKKLSTKMNTQQITNTTQHTTIQQSYITHIKKTIVETTTQLPRTKKKKEQHNKRERQNKTATKKREHKTRKKNQ

SEQ ID NO: 993204 - protein, 85 aa, Homo sapiens
DAGLGRPGEAQAGERWATPAPAQCRPHPNGGCQSLSPETEQASNIDRYVENNYTCKTEMHEQDLDKAVRMWSYRGGIKYSHTTHD

SEQ ID NO: 993205 - protein, 167 aa, Homo sapiens
RRQAKPVGGGARHGDCLRLPRLRKPLWALAGTPASVTGPRAGIWTLAPLAGRSLAVAGAPASGSPWTPGLAFPPGPVLPTPCGPRGLGAPGPRGQGGRSRAPVSESVPRTATPPASGHPALSSSKLVFGRARWLTPVIPALWETEAGGSRGQEIETILTNTVKPRLY

SEQ ID NO: 993206 - protein, 478 aa, Homo sapiens
PVINMTFYWAPDVAIQNLLWQVGVWKGSLLFKLLSITIVRPKGRTLAARPHKPPKQIILLEAPCVTYLQGHRHFGMGDHVGQMLKGSLFLTPLNSVFSRGRLKMCQGAITNAKTTCGTTTPTSHKLIYISRGSLCASKADTILIFQNEAEGTVITYEGDCGPIWPYFLFPLSFLNFYKTETIFYSDRGAPNFYVFAPKPTFGASPECKCVVQNLQTPKDPKGVLFLGAPHSIFYSKAPREDIRRGEKNRGQTCCTTHKCLPTAGLRATFAFLNLNTACGQIYHVLAPHRCTGAGKHMSTPHDSNYVLRVRTQMATPSSRNERPTANPLRPSTAGHPLLRQGGAPPPGGEKPVLGVPTTSTTLYRRRRNKTKIRRDDTPPTPPSFANDYPQTTKIIGRYGIDEDKSCVNKHNALFEHTLNGVPRSDVTKRRRRAERINYSSSDQTRTTDIITQTQPSCVNRNGEIANHHIYRGQSPRSR

SEQ ID NO: 993207 - protein, 132 aa, Homo sapiens
MTVRSALRRTDRGATWMLSSRCSKHYPGRQYGSTSYGQQLHEELIKRGVPLLQNLFDNPGGLKRGFLASNYAPTSQSYPSLRQINELLSGKLAKDNGEHCSPGLWSTFTSNEVIMTIGFSRTVEAFLKEAAE

SEQ ID NO: 993208 - protein, 589 aa, Homo sapiens
FHDRHSRLSPAIGAVLTEDVTGLDRQISVALAHTRETARKSATMPDAGMPDIILDGRETQVGGQTQRIRGVSIGLSVVDEFYTKCELKALGELDSPSVGRISSMWMERRGFVVDVRKARTRHWFDMTISEALIGLEQIIRPPAEARYLSRHRAQREMHTMEHLQRTQRRGGIRIYRRTSIISRPYGRNLSAALWPMSSATSRVYINPSGDLKMGAQTVITQGAGSPVGPGVDPSVVPWHVLRMQRYAHLRMSWWSCSIPRGSLPTVKANIVLARCPGNREGVPREWGYPLVVHSQAETNSRAERKVNPQKKSEISWKNQPFSSLDPMAPSKPQKAGPRTRGGVEKPPLKNRPKHTLRSGGSPNKDVGLGKKQPEGVKKNLNVGTFGNKNGKGPLGNLRHNFLGFARQTSFKKRFESTTPTRDINGEGTTFKANPACVVRAHPLYTGRHTQPSNLGREPGGARGEIDDNPLSKRLSGGNPLGGANHWQHDQHLNRPTGAATHSYTPGEEPQETEDTRTGGQNTKQTSELTTQQKIVETVHTNNTTKSRNHLARPQLKQTGNRPSTHNSHYGQTQNYENTVAHNSTKPARE

SEQ ID NO: 993209 - protein, 293 aa, Homo sapiens
MNEIAGLVIEQVVSESVMQVHGFGWGADVIPRRLVFSFHRCEATPDTRSVVGGLGQKDSYVLGDEASEQSWRFLTHEVPLRLSMAISHTTGDCFMVKDLATRLAFYNGAWCVAREELTRGCFRVAEVPLGKPRGRYEQDDSMDSDYVFEERFKPPRDMCSVTIHDRCSRSPSELRYVVGATQLVIVHWDLVEMGSPLHGGPMLTSGLVPCSPKSILSLDLLWRGPDRFDLMKILNERWLPLSGTLRSVKSCRDVREMCAWLPDLAGEWHRRSSTVWRKSFEVPMAGLAWHDGP

SEQ ID NO: 993210 - protein, 244 aa, Homo sapiens
NNSPFLTITSMTRVMEVSHWGNMAVDKKYVDLKHTGAVLKGPFARYDYQRQPDSGISSIRSLKTILPGAAQGCLVTRDEIGQMWTTSQPPYGGVIVCMRWKVRPRYPSLRRVERPITSVGYNLTKAMSTSIIWVTSDALIDEVWWTTVCGVEQVIRFSDCEDHACLKEPRTLKSIVAYEISRCPEMSWTTTYLDTFGRPVIVAYKKNLVEQHIQDHCGPLQQFNKVLMLEGALLVVAAFLHPGL

SEQ ID NO: 993211 - protein, 151 aa, Homo sapiens
MDSRQLRILDSGPVKLTASLWVPASVLRMWTTAVLDFSFPRNGIPLPGSEAVQEMRVLITGPCGQKFPGNKGAWGATWTGDYSPRALRDGARGHSQGWDTQLGVEPRDLPLYVHSRGGTTRASEGDSEGDRSIEVEGGSNKHKERNAHCEE

SEQ ID NO: 993212 - protein, 166 aa, Homo sapiens
MGSVPEGPSGMGRQEPRSFCHCNKLPDAHRGAAHARRTQDGRHGGPEDRLVARQRRANNRPYLVTEVAPHGGAQTHEKGLPSNSNEGPHYASQPTRRDPERQRHTTRGTRATPKEQHQDITTRKRTRSSDEERNDARDEHRTTRTPPCRPTYRSIRRSTREQEQEV

SEQ ID NO: 993213 - protein, 245 aa, Homo sapiens
MAVSKSFLHNSLYQSTRTHEWEITIILIIHSNAEKAIKVYQPYSFGPSVTGAGSERPNIGIEQGRRKRRAQYGYGIAKRSQSTGPPITREIARRIMVADYGTNKPKGGRTTDAHKRQTPEVPTRNFESTVGGTTWIAHGFNHKAYKQKENDVSEAKVVVPRETVVIALMGERHRVEETQQRGEKNEKQDQQERQVTTPQGHETMKKTLEIISRGDSEPRGKKEREKQDTSNEGILPQHPPLHEKQ

SEQ ID NO: 993214 - protein, 416 aa, Homo sapiens
MTEAPVLASGLLYLSSHSAQMMGKGSMTSKYLWDQQKLTAEKYSGIRRATDKAHDRLTVPHHNYMKMQPQPTVTQQGKQDHNPGDQHGHQKQHRHKCHGRTLAHKPAGTARGSRQGRTTTTAPQPHRTRWTPPVQEADPPTHGHTPDSGAATSKITNEKTGKQSNPDKRTIHPKSKTNTQTRNRPLCLIRKQPKTKENTQHTENSERSKKRTKEDKTKNATEEADAPGKRQKDADRRETDGKNTKSKNDNRNTEREDKTSNKHKRETEEEKDKQTNTEKETTRQMRRARRGRHEQTRDQHRKERQRQKENDNQAKNERTKHRQTQKTEAGERRKRARRTQQRRPGQEQRSDEHATTGRTKRAESSRNERPRERTSGATRRRTGEKAAKQSREGKRKRRRKDNGSREEREQLTAKQQ

SEQ ID NO: 993215 - protein, 247 aa, Homo sapiens
MRDPCSLMEPAYVRCIKPNDAKHVAGRFDEVLIRHQVNVPGAVGKPAACAEPALPICLQILNAFLHRYNVTCAHADVDHSVCKCQDEEMGCAVLESRHTEDYNAHEEYNDVSQWTKIFTYRHSHNDPDKDNRGLTMEGPAAGAQDQKRIQSLTGRGVFAWPAENYSRGDRDQTSLATPRSWVAVWQPPGALQLKGRRQEGSVRVQTHSGGGSSAGYNTAARSPVCPRNCIVKVSMCDTYIGSSYVAL

SEQ ID NO: 993216 - protein, 281 aa, Homo sapiens
EAGWNGTQLSPLLSPWPRRRVYRKTQREISEDTMMFWTRPQLHVGLMEARLSAIYQHRQHQQELLRGVQQRLIQAPFQVTDAAVLNNVAHSHLCLNGTTVKQQVFSTTARQPTVEPGRKQPVSLITLSRLAQRPVGAQQHRSTAQASQGMKNLTTVHTVVLTAFVSTSHKPSKKAPAPCGQTTTHMIFEPFSSMSSSLSITRHLHPSTQSTQVGSVNFCSGGTSFPKVSQTIKPRASTDLVNSSTTMSLLAINTHPANGTTEGIPLAKETSHTETVNVTSL

SEQ ID NO: 993217 - protein, 342 aa, Homo sapiens
MKSTPRREKEVGTRTGDEDEDTERHSNQARELTRGAEAAQRHNATGSARRSDTGRKKRETSRRETKRKKKKAEKTQQTKQEKQHKDKPTKREKNTKRKRGAERQRRNRQKKRREDDERKDTQKAKNKTPDNRARKRRRRRQTEAEAREETHTKDKHTKRDGQRETGKAPTQQARRREKRPDREDSRRRPQHQKNRGQTRRATEEQRRRTEQRASRTRDQRSRGENEKRTKQRGRGDDTPRNREKPREEDRTGEKKTRRRKKQNQRNCAQKNRRGRSNRKKREGKRKNNTEERRHDEERQEGKGETEKTRKRRQRGEKRSRRRKRKDGKRTQDRRRKEEREGK

SEQ ID NO: 993218 - protein, 731 aa, Homo sapiens
MIDNMHATQIHRFSRTQAQHISEARLHEASRYATYVLNARSDTLTLTDKGQGVTKFTQINQTCAHTSMKHNVRGTKAPNGIFPHMGGGQYCNDFHHTHIGLGLHSQRVCNVRWACPWEQLMSIPKRWGTQDHRHRSRHRRGRDTEMPRKPKDKKMNRAVLRNSTRGTRHQDTKRSPGQDRTGSTRPHQAGGGRREGASQQRQTGRKHSIDRSDKDRQHGHSGMNGQRGLETAARTSRQSTARERKTQRRRERDERGKRTQQGAPRQNKQKKGADKRRRAGDRGEGVRERRELHGSRDKKYETHSSGATAHAGNDSGTAPPPRGGRARRPNRKGRREHDTEEGQTQTAAGTGEGEDERGRREQEAGEQSGDTRRAAEDREDTKEDGERGEERDGRGRERQKEEESEAGAEREGATRERQRGRRAGTERSGEKKAKDEAREKSEPRQRRRERARQQTDTTRAAKKRGQRRQQTTKAAAGRRGQRTRDREEADDERPEQKEKTPKNQKKEEEMQQETKKKQTEKEKTHEQRREKDGGERDKSKEATHQAHEGSARRQAKKTTEKTRTSERGTRAEAERRADERARERDKSNKREQQKEREKDDDSKERMDAETAAEETRGGTRRARSEQAEKTRETREDKKSEGGDRRARATRANERREARGTEEQQEAEMSRQETSEKTSTNRQKDERTEREEDRAGVERGEAERAREERTGEGSPEREEAEAREQSEQEHRQ

SEQ ID NO: 993219 - protein, 745 aa, Homo sapiens
YVHNPKATPLLKLHRPNNYITTTDMTLQKTHNLNQHNHTTSRNYYIIPHTILLTQINNNTFRMIPHNYHPPHPLTTHPSIILHYLTPSPLTTHGKDQTHNCIPGESQHISRIQQHRNRLYYLTRPLQKSSISRYVTTLHRSIEQTYSTYLWSIVSVDQHTTLVTRRTMGENKMTATNEGADNTDQENDQKTGRANKKQDTYVHITHPMRVEHTTNHAITDQNSKRKHSTSRHQNRRIGNTRKKQIQTLRHKCATMAHNESVINKHQTAQQQLQHELTQQEKKKNKQRTPTKGTTNKDTQQRQIKSTKGEKHTHTDTDNKKPESRRNSPSHSNPRTQTSNQPNTRHNKPQPTRTYYVNKKDRRNQARERHQITASHRLLLTVENNEQDKETRQKLDETTERRRHNTQKNRRKNQNNEERRRRTEEEQKQRKKKKRYREGKRSKEEQENEETSKNDETKNKETRREEEQKRKTEKKKRDKRRLKHETEQNTNRTRRGGPPKEVKTGGDEEPNRKNRERRKHRRGDEREGRERTRTEKPKKEGERRNKSGRDEKREKETGGEREGESERRARGSEEKKSREKDEKKNENKRCDEKQEESRGRDSNKQKKKHEKTREDNDERARRDEETRTRRREKRKKPKGKQTRHTEELSRKTRPRKERSDSRKPKRTASETTKEENEHERPNKQNKKEQDTYEQEQGDHRTERNEQQTREKLRTELSTEDNTSNEERDAQHARQSQTTQQHEKKPQ

SEQ ID NO: 993220 - protein, 118 aa, Homo sapiens
MGKFSSHLCPDWPEGCNSSTGLDRRAFCYQVLRANGLVPPGQGKFVHGTPLRSEVCVIPCVARNFQARAPCWVSPHLRETVGHKCRVGHRVTAHKGVKTLPQKPVEIHRGDSERLRAS

SEQ ID NO: 993221 - protein, 105 aa, Homo sapiens
MMNSQRHTTSYLWGLSTHTIYTKYHSQYNNIKTHVNRRSLHAYRRRTSQHTQRNYVRHTNRREERAYNTLLRDRPKACAIYSTEGMVHRRTIYIEGETKELNRPI

SEQ ID NO: 993222 - protein, 457 aa, Homo sapiens
AGAAAVLQLAGLCRGAEVQLGFPRAPSSPKKQLPERRVVNRTGKYHSKVDSDTRSRAPTIATRKAWRNDRISEQSTTYEEELLIRDGQHATAYMVNSIAKQNTQDKEDAADQTQYKNQDHHNKRMQKETNKREATDTGEGERGQDDEQTKNRQNRKKRQEQGRKRRRHTIKTHRNNEKHTREMRDKKDNTKTGQQTREAMSTEYKERTDQTHATTKDKRDSKQHHETQLNIEEKRKRQRKKRKQQRRRGEEADKEKEEKRKKNEEERTQERRGQNENTHKQQHTTHKHNIEDKQKEKQEQQKKRQERREEETKTEETKHTKEEEQRNNNKATQKEKEQIKKRRVEESKESDNNKDNEDKKEERNSRREKKRNTQRRDITYSRKTEEEKKDNEEKTPRKRQKDETQSRHNREKKYRETPKRRDKTITDENKKREDTTSAASNNGRHTEDERKQTGRQG

SEQ ID NO: 993223 - protein, 110 aa, Homo sapiens
MGIKGWLRDDTTGHRGNRVNTKIERAEKQNNSKYTPGAQKQATTRGDNSRSAHPEQKKKTDENKKQTRDKERKNTERKNKRRRQELKKKQHKEHRRPTTLYTTEEGPPNN

SEQ ID NO: 993224 - protein, 327 aa, Homo sapiens
QRGFPDEGILAVYSTGPPNLGEMLYTKRFGPNAMSGEPVPNGQICNGGLGSRRISAVTPPLEHMVAQVFKLNRPMVETTSMRKCETSFIPWPADHRRHVSINSARVDCLRPVAYGLSLWYLTKGELVICDHEALNLVVSEYYMETSRETETVFELSHSNRRSSERPGTSRATWRTDRDMGLMNAIGASARNPATSVTISGHPDSGPSAAEWRNTDWREVRSHGQRSVLRKGQVRVWCQGGRSARRIRGWSEGDGTGAGSKDTGSRGLGKIWSPRSEITDGRVRPTTGPLGDQRMRAHQTGHGRGHTHRNNTATKEQRSEQHTQTHGQ

SEQ ID NO: 993225 - protein, 103 aa, Homo sapiens
MAIDVSIALTHTTCSNGYCPKVVSQGIYITYHLDMEVLKENTLIGTLTQSRPGVPKIMMDHSPYVCVIPKVNQGMLFSVYRPILRSPSKATNECCPFSNTNYA

SEQ ID NO: 993226 - protein, 491 aa, Homo sapiens
MLHETTITMSWRTKTERRSLASKIDAVPANGQTSNPEKPIKPDVRSYNHHEVYNQATDYEDLPDTTLNDNARSIPMLSHRQPHTDHMMQPSNTEVILDQTQPKYPLTALSCAHRTTLPEIYPGLTVIQGMRKHWGSHVHQEERWIPTRKPRTLEASQAEPNILDTGTWNTPEDNRNIIAPRHWYTRTRDKHYTPRNEQKPHSIGDRETTRTRAHRKAIVGSHKTHHSSIVRNPRRYPHRARAYPRQVPSQQLHNAQIARIGDTLDMESENGRKKGTHRGEPMGEANNNRKRATIDERRSNQTKDGYQRHKTAQHNNGKGQMTSDTKNTRAKRDSSDLRGSQTRDVKDDDNNNKVKETTTETKHEKTKTKRHKRTKEKTEKKKNDKNRTTRTRAQVDCTNELRKHEIRIQTERRLRERNRRKRHKPAERHKADSTAEQRKGGEENEETEEGDENTGKKKKSSRKRREEKEKKELKKKGKREQREMMDTDAKR

SEQ ID NO: 993227 - protein, 275 aa, Homo sapiens
NVTRVGQMRLTSPLIVPSPAAHLTELSIASPLSTDENEKKPTWTCPVCDKKAPYESLIIDGLCEILSPCSDCEIQYQWKIGSWCPMKPKKERIYTEDTPTRDNRSWMATRYRPKPQGADPNRSNKNEGTEVTRTRPPRQSDYHQHRRSDLEHTNHTTAQETEHPPDLAHTPVTEDMRNAKAKIQGRTPGPTKTKHLERRTREHQWRMAQPVWDRKQQPWINRITTKKHVNDEPNERRRNELGKNRKITTGTSKMNRTKANREEEKIHDNNGHPSD

SEQ ID NO: 993228 - protein, 244 aa, Homo sapiens
VTRGRDRVGRQLQEVLEGFNMANVLAFLSDDEDDGGGGVKEKMEEEEAEEEEEEDEEDEMDEEEEEEEEDAFSSEVQGDEVSHALTEDSGPLTLGEPAPDAMSSPPPADVSTFLGLFPRPEKLLRLGPKSSDADSPGRLTRLNPEKVDRLPYLKVSLVFKDEATVSDRPCRMQEDALMQKAFNSSSFKAKNYLTEDGGAHEVMVKKVKTRSRPFTKLITAPDGAERMVQQDYIPRPCTPARGRR

SEQ ID NO: 993229 - protein, 291 aa, Homo sapiens
RERGCKEDVRDGVDHIDIYADVRCEEFNQEARQYGGHESDRVCSDECHISICEIMDDAPEDRDDMASSPQRNMYGDDVGKKEQQPETVVYIIYLAIGELHYYEYGNLIMVDNEMKDFNSEASVTSVSGVKCEYASEDQRYYYATNPGQNWAHVRKGGVSPYSQRGPRSSNAIMARQKRHKGTQAHASNRASYQSVQKIPDRNSIPRQIKPRGRLKDQSTQKQGPQGKHVTHKDQGHNNGPGGTRVKETELPYHREGQDYTVTGAINLSKGWDKGKGQPAKTRGRMEPREAD

SEQ ID NO: 993230 - protein, 311 aa, Homo sapiens
MESRSFAQAGVQWRDLGSLQPPSPRFKRFSCLGLPSSWDYRRPPPRPANFVFLVETGFRHVGQASLELLYLPVLYSSCVVVSLHAFVVSFIDDFYSQCPVKGYAIQIPTTDSLLFKSVSPEVRKSDHSESLTPPLGAQCDFVNKSAIHSFFAASVRFICKVRYTIAPDSLTYVCDTLLWQNAHTYHSSLCARSRPHYRRDGPRGTMHANTWKDVDAKAAEAKRTRLTRAPEQRHTLSAGHGRHADRRRPTNDQGARFNDHEVTNVKGQLPTHTATQEQKSQKPDDGTRDTNKRRTEEQETNNTTEKPLDPH

SEQ ID NO: 993231 - protein, 197 aa, Homo sapiens
CSSEPESEMSSSVHCQTYLSYITDLKHSISLSIFHKPMQWPCIPVSGTDNFLSFNPCNCRRSSAQCSKHRSIKAGIVAPRQCKACKTRLFQHLAIPLWLYSCAAFRSSGAALIITKLGCISIRNSKHLALASLAHHMCSQIGTSVCTPLVNSQWPSFSHLHFTATWLAFQPQPFWLPHLVGQCLERLEPMHTQAGHW

SEQ ID NO: 993232 - protein, 262 aa, Homo sapiens
MRRSIFESERVKAARLVGVEPGGDRACCECPQPCRGLQWFMPVRTFFIHNRTGLRTVAGESSNPEHAVSSPSEPSSPRCLISENIRVVYRSALEASVVTADAVTEKGPDARSSRIGQFGDGHVQVERDSNMDAKQFMDHIEMVGPRSLPDVMEQPVYIHLRETPETRLPHRASELPFRYRGLQQTCQAQEYIRSPACAEHPRVVLWNACDGVQSPCPERKKGAADCAKSALKWNKLVCGSICKESVRKVPESTFLLGVEQLT

SEQ ID NO: 993233 - protein, 111 aa, Homo sapiens
VTHAPLGQSVGVVSCFNRCYGLESWRSFARHTRDGTLPLLAEPLLVASPLSTSNHVVSCLARGTAQYEQFQDALRLAYTELSVTTLAIIAFKISSDTISICTTTVSNTYWQ

SEQ ID NO: 993234 - protein, 287 aa, Homo sapiens
MVLTKMTTTTAELLICGKEGYPCQLLLYQPILICCSNAKSINRRWNYRWPKCYARIITSSPTRQPAYSASLALDSLGDGATRTHSLCFDLWLRRNLFQTVLFYPPTQYDHTWLLVPHSYIGPTYIAQTYLQLLRLRTQDLSEHKSLSSHRIPSFLTLSHLVYSHSQHDKNEVHITGIVSTATSDSTIHALMPIYTVSRSSRTGRITRGPRLRSDPSGVLYLTAHIPTPTRDHMELIWESTFPPHERARNTNTSTLKQTPILTSVGAICIRLKGKRSSHIADVTGVSP

SEQ ID NO: 993235 - protein, 79 aa, Homo sapiens
MTSICLTSRPYFLGLYRHWGIQPSPAISRIFQVPGTQNDAGVKANRIFTDKASRQFTAIRKRAWTLLHGMNGRRQRLTS

SEQ ID NO: 993236 - protein, 234 aa, Homo sapiens
LTFCARFLSSSFLRSGYPAPSHALLDSPGPSHGVSCPNPRPGFSMTHPCPRHSASSPFGAFVAYLSLQLSIPPRSPSDLFCSVSADCEMAADISESSGDDLQQETKEREPSLDARLPTFRVPLLVESVTLPTELPVTICLMSLHKKNHRPETTYPNLESCTNLLVQTHPNHKSCTYREASTNPRDSTRDKHHTINDTLHGATSPTTPQTDHHTVTLANSPTHTTQCTQHCPPTP

SEQ ID NO: 993237 - protein, 288 aa, Homo sapiens
TRSDCERSICVIRASAAPNRLTIHGHLLDQGRLGLTNQAEAETGWAVAQYERLLHPCTWSIQRVDTPWLLVRESLLGAREPSRRQEEFASPGMPSQDVICKSIIRQSICPLYLWGGHRHMQRRSLPCLCCGGSRKEASWMDLLDADGRTIKAVAVLTARTLRDMATLSQTLWKVRWEEVFLPVGGDTTFCVKNVRDKDKLDVDTGSVDEREPLRARIVVSMVRGVETIVILGRLGGWSSVVTEIETKDAIKNDRGGSLHEGHGVSRTCLWRGRGSPQAEWRAPDGVLQ

SEQ ID NO: 993238 - protein, 330 aa, Homo sapiens
MEPFTQIFVKVYRVATIDLVDRMFHSVREAWLCSARSTIWQMCKELIPECLYLPEKYLIQYPNNFDLGCRHQNGTKLGVVYPSNLGHKGSHENSSESIVEAWKCDNGEYAIYMSGIDLMLRLKNSKALAAGRKLVECLPISLTLLSGSRGIIYENQVKRIEGRHDPIGGHLLTSARILNRYLTTAFHQSVSAHSSTPVGDQWPQFVVVAGSHKLCRIFVVRRNPLQSLTYNPSGAQNLEANLFRTEILEVNKKKGYSTRTWKQNSIVAAHTNVPDPICSKATTLYTVHRAIICETQNELHEDTRHSTQTKLAKNRRPTICAVDYQLMLLF

SEQ ID NO: 993239 - protein, 269 aa, Homo sapiens
MTRRSRDAWVDPRRSGLLKRPEQLRKLFIGGLSFDTTDESREEPYLSNGERSRTGVGYLRDPNTKRSMGLWVCHICHCAQEVDAAMNARPHKVDCEESVEPKRADLQRRFSKTRCPLNCDTHRYYVGGIKWKTLKKHHLRDYSEQYGTTLDSDLTVMTDRGSGQGHKGACAFCNLNDDHDSVATIVIQHYYHTVNVATNLLTRSKRPCHSHEMAKCFIQQQRSKWRSGTLWRGVRGRWEQVRIAQLGDVSGNHQKPEVAFGDTRSSWIA

SEQ ID NO: 993240 - protein, 105 aa, Homo sapiens
MAKLQHWRLHQRARRASHGIDPFIVNTFINKPTDRPPFWNPIGRRLITEKRVGQCDSKAHRHRSERTPYNSMPLLHLIMHVRQHKLRSTQSPHQERPQRQCPKHL

SEQ ID NO: 993241 - protein, 109 aa, Homo sapiens
LSGRAAVVTFLQSVQVPEFSPKSGVEIHVSDLELQSANASVDDSPSRGAHSHSAAMPRLAPWIQDVPQLTIEKDDDRHTYHMDFIVACSPTLTGDRKSMTFLLRDRGKS

SEQ ID NO: 993242 - protein, 427 aa, Homo sapiens
MQHADCSVPPGSPRRLSADESPWKCRKRHSCIMTLSVWKMYHYHDMQTRWPAAEPELCRLNAWIMTQSPGDSTLLETRMRGHHRSPERRISSTRHGQHPPSRNPIRTHMTTRTTRRTTGDHTGTGRTKGSAPEREEPHTEYRRDTKGTNDKKKSATEPGAHEKDHTTTIGLRPQEEPTAKQNQTETKRTPDSKALKGDRAARHSRETGSPEAKEQRATAMDTNHPDQKQADRGKPQRPRTEHTDKRPMQRQHKQAPQQGKSENIKHRKMRPRTNLHHPGSHNPRDTQDQGKNPKTHTNRKETSTKGRRQQPTKAKQEGKTGEHEKREKQTKQQSRKPKQERKEQKKQDKAEDHRAQHQRESSPKAAREARHTTRSQQEPSQNRKQRATQNGRESRGERTQNEEKRKEGQEKRKRQRGRRERKRKEDN

SEQ ID NO: 993243 - protein, 598 aa, Homo sapiens
LLIPRVHLGYTKSRLSAPPRVYVTSDTSLGTSSAWHPCTIQYDADEIMTMAATASQTGRYEALHRNSAMVLTDIGSIHHCLYKGSHIIWKVSFVTVVFSRNDEAPVSMWHEVTPQLPLHFETDAGNCLDPIACARRSFWTTLGSCPCQGIASSSTFPLPLAASKLYNPCLTLTNCLARVGRSTCRTLNTHCRAIPRPAWWGTSCRELTQTCETTLGLHSEANPPVNAWATYDDLLGRAWGLWATLLTVASGYWSRTAPMRYPVGPNAGRTAGARPTEFGRGYFIITGTWRQGGPRNTGRTRRGDPKGGPTDPRALFALGVALTLLDGPRNAYDDWFRRVAIPIAPKKGRESHMRGPRQGRVVIMETAREEKRLPPHISRAEGATVVGFIASVGHCSVTTITQLCGSHFNRYNRGLHIGFHTILGAHHIFTTASQQTNLTRILIGWGARTTGDPPNGLVATKRGRTCYGSPRGGGEHNDEAAIEVRTSTPHKRGVPNRWHLHLSGTRKYSPTLWGQDKARAAHKTQRTAPERNPDSTKYEEHPHDLDRVSGAIIPRQQASKRGKNQAAGSQRDDKTEPTTTARKVSTRTQARQHTETRH

SEQ ID NO: 993244 - protein, 107 aa, Homo sapiens
MRIRDAKSCAHRRPPVHFRILGFPGTHKLPMRTSVPDYHFLYPYVAIVRGNEARIELWAWGDSSLNNRVTVRPTGTPGTTRPGARQPLYFSEDLRTGIGNGQQRAIP

SEQ ID NO: 993245 - protein, 440 aa, Homo sapiens
MGYSSCFSKWHYSRGFPEFLSAEEAPTLRGLVNHFSVGGTTTCEWTLEEAVNSMDNIVVHPTNPVASFQGKYISLKQRNSPLKSFRSGNLSSIFSKVGRGVWEHVRTCGGPVNSPKSVFPCRPWSPSLKNSRFPQSFLQRTRRGWEASPEVPQRRRNIADQKRAFRRGPGLDSPDCKNKSTKHERGGGTGTHRESTSRGEGGPQETISGLIPQRAFLLVVLPRGSRPPNKGERPRASIKKRRERTGGTAPGFTPTHRGAAYMLGHTPAGAQPLGGILLLDKENRHTPAAAGGGTHQLVGTTESPPTREDLQGAHKGDTVNKQFIKRGNTTVVVTPTKRGTYALPRLEQTFALTPDEYQYEKLTGRAACDTTSDTPQLAAHRDNVRRPQQRVAQTSRSRPYSMQDNHYTIKSNSTLSRSEQTTPSHIIMTITSTVKDTNDA

SEQ ID NO: 993246 - protein, 43 aa, Homo sapiens
MYPTYHRHVQRDSRLVYVPLLLCVPTNRLCFDACCNRLKGGDE

SEQ ID NO: 993247 - protein, 70 aa, Homo sapiens
LSDSLHGQWINSVKVYTGDAESPCGKCLAWLSALELEVRCRDFSSTMFGLHESGGSSEVLSCPCSAVRVI

SEQ ID NO: 993248 - protein, 134 aa, Homo sapiens
HASAHDVRKIRPPEVRDSSSPLIHRPPPLPIATIIQSIDETFGVLASVERLSHGSILNHRNEVLLPKRDVTYLHLDASIRPFINQIAHSSHIEDGKSYWHEVPTYLFTSKWTAVKKFVVFVPSFRTCIGAKAYS

SEQ ID NO: 993249 - protein, 66 aa, Homo sapiens
MKSEDRYSGMCSVQEISPGRLQHLLPMVPWLLGPHPLWILQAHWGSSRAACTDRRTSGLWHGSNLS

SEQ ID NO: 993250 - protein, 36 aa, Homo sapiens
AAAYYYYYCSNSSFYDVRGHVLNEFDNEIILLSFLK

SEQ ID NO: 993251 - protein, 328 aa, Homo sapiens
GRVGRLFAAEAGERSRLVLLSLVLGFVEHFLAVNRVIPTNVPELTFQTQSPPPSPTWRLTYFPWPTVYHRRLYALTFTAQIRGAVDLYPSILEKEGVIQPLSWVKEGLRLSYGTDFSPVPYLNGLGPTSSPSSSYITGSPPSRHPTWTRSGGGALAAEGACQAHAAAPAMPTLRPDQRESCTGDPCWATHGDATTRHRPPRDAKQGHRRNRRGTESTLTVRTEPTLAQPATHDTMRSGPGLTGRGPTRLKGVTHPSPANDPKGPRTGGQRSETHTGQDSTGRRNSEHRKTQARRSKAKTTRPKPPQGQRRTARRTDDENKRNETGTAH

SEQ ID NO: 993252 - protein, 34 aa, Homo sapiens
AAAYYYYYYYCSEFKLLTMYGDMYLWLINAYETK

SEQ ID NO: 993253 - protein, 35 aa, Homo sapiens
GFAGAVQLGLIGTCKEQEKTSDVKSIKASISVHSP

SEQ ID NO: 993254 - protein, 39 aa, Homo sapiens
AAAYYYYYCSEFKLLTMYGDMFIKRIIFVKLLKVLLFSK

SEQ ID NO: 993255 - protein, 36 aa, Homo sapiens
AAAYYYYYCSEFKLLTMYGDMFDFYTEKEKNPGMFK

SEQ ID NO: 993256 - protein, 33 aa, Homo sapiens
EQTKAGTVKKRHIEKVYGGMPPSLSLNPLKRPP

SEQ ID NO: 993257 - protein, 433 aa, Homo sapiens
MPLGAGAGGGGVPGKPPSQFVYVFTTHLANTAAEAVLQGRADSILAYHQQNVPRAKLDQAAKVARQPQNRYHAEHAVSRHPRQSQTTPLTPHASEKDTMSKRARSAKQPRTDAATPHPRRTTPDHARQRTHTQTQTRAQRTPDNERTEKQPRHHTPQKHTQQTTATASNTHTARHHRDQRRSTHEKRSTERQPTTHAQQTHSTEKANRPRERRRRETQAETATGNVREDDPEASHDRLGNAPRPRTHTTHKQPNRPESDRDRQAATAPSGRPHTRPTHRERGNKRRQPPPGRTSAAPNPRKNQRAAQRQQTEQKSSRAQTPNNAAESAPSGGQGQSDTRTQSDPRRQNKAPTTTQRQSATATTRRKDAQRKEKGRGQQTRTTNRHNNGEKDQHADKSPTEEADRQRKNETRRQPADKKEQQQRRTKRTRGRAT

SEQ ID NO: 993258 - protein, 148 aa, Homo sapiens
MSSPGRQGCSEAMDHDYCHSEPSTCHNNQNSSAEHIKSNAMDGWHQKMCNPYSYKRINEYRVRLRGHIIAGQSLSRQQRPSVQLFENLAYDQVKQYMSRKIHLNTSADREATIRSSVVVPTTCTSTSAYLCAHNRLSPFTSLSKNTPG

SEQ ID NO: 993259 - protein, 187 aa, Homo sapiens
AIAPYSGTEARAGRRVRFAASGNDASCVSRQYGRAYGRRALVYVRTVGSGAVLGAAVAMLARRRGAGSHLQQERGCSEASVTCDASLSLGTVWAWGPGNRGPSGVRFWEASQPSAVGAVLRGARTPPMGGAVGRSPAARGARRGRSGEGPVITALTPMRSPYVFPNLPVIAITRKPVFPRLIKHYRG

SEQ ID NO: 993260 - protein, 138 aa, Homo sapiens
MATHGYAEAERVIVLLSSLTFLEITYYEDDRTLWLRAGAVYTLGCCIVRSVIGVYGRSCGCPGREPQSPSISRSVERGPSNFLWKNPTRRVLPFHKISQRGNLDLPKKVKKPPCVGPPPPTIRLSVVSLGVGLGGLAF

SEQ ID NO: 993261 - protein, 39 aa, Homo sapiens
MDLLVQYNYGLILEFEALLDAAGVASPVNYSRSCSHRNS

SEQ ID NO: 993262 - protein, 74 aa, Homo sapiens
MTCGSYCLDGWASFLCSSCCYGVFWFCGVVWIAVVVKLLLRAVCVTCYLLCDKHTRHQTTHTRDNESTLLRTEK

SEQ ID NO: 993263 - protein, 36 aa, Homo sapiens
AAAYYYYYCSEFKLLTMYGDMILQYICKKEKKTKPK

SEQ ID NO: 993264 - protein, 30 aa, Homo sapiens
AAAYYYYCSNSSFYDVRGHATNSIKLSCEL

SEQ ID NO: 993265 - protein, 28 aa, Homo sapiens
GFAGAVQLGLNRHATYTQWATECDPVSK

SEQ ID NO: 993266 - protein, 38 aa, Homo sapiens
AAAYYYYCSEFKLLTMYGDMRNKTQYFNKVARFLLTQK

SEQ ID NO: 993267 - protein, 43 aa, Homo sapiens
GPYYYYYCSEFKLLTMYGDMVTASAQPGCAFDFKIKVHPVLCV

SEQ ID NO: 993268 - protein, 302 aa, Homo sapiens
MTRRNPCPRAGGPVLTCGVKFKVLLEQLLQVLQQGPRPHYIRCINSQQPGPEQQTLCSQEECPVATSGGLWPRGDHPYSSAVWLPHSGSLTETLYNWYKLLKGFILAHALSPTAQYLCKGLPEWCPHSEEAMLEALIQDQFSTFWAVLTQAVAITGDSSEAMPVPMHCGRTKVFMTDTMLELLDVGVPVLEHVPADPRWRGGRHRTESTSRVGAVMSFRAGIRPCELGTIPEVVGLPSHKRCCRTEIEWRCLNTDWLPNPSPHRSIPRNSAEGKPARDLSRISATTRAHPGRIQRVSPGNKM

SEQ ID NO: 993269 - protein, 36 aa, Homo sapiens
RPPTTTARIQASNDVRVHVIKVFIVLFPHLCCLNKK

SEQ ID NO: 993270 - protein, 231 aa, Homo sapiens
QCLLPSRCVARAAHFMEPVEAPSLMSWDWSRKPLLQTQAFCSMEQAGAPPSWAGLQPPKLQLWIRASLLLGEPGTGRIVPFQMQLQPRRQEPGQVGALPLPSWRGGSSQVQLWLPPQAQDEGISAACTIGHPRKDSPFTLHPCRLRGVCFHCLASLHSSNCSDLGGESEPRPAAMNGSRRKGVGSPVRPTLRPGGPEFWGLAASPSDQSGNSWSFSGLQWPNQHTLLPVRS

SEQ ID NO: 993271 - protein, 82 aa, Homo sapiens
MNSYRSAYNTKDRLTTIHHCPPTLAAPIHFRPPLKPTTLRRTLHNLRRESHKQRSTSIVFDPDAGVDDQVPYDTRRIYYPQG

SEQ ID NO: 993272 - protein, 96 aa, Homo sapiens
MSTETTRGRQEAQKHTQHQINSADQHTQTGVNDTSGRHEGDYNQAIVNERLRRPGDRQAMRAATNASSSNSHSPLFPSEPRRETKEERRQSRHNNY

SEQ ID NO: 993273 - protein, 87 aa, Homo sapiens
KDYFVGLVPDVTRRLWSRPFMASSEWTVSERCQVFCKAIQPASTKISEDAIEHRVLNRTRRLESRCLSCFHESRGSVGIRTRYVTLG

SEQ ID NO: 993274 - protein, 38 aa, Homo sapiens
AAAYYYYCSEFKLLTMYGDMIPPLHSSLGNIARPHHCK

SEQ ID NO: 993275 - protein, 172 aa, Homo sapiens
MSGSTQPCGGRSTRFSRRGARAKHQTIGANPPGGNHKHEFSQPKMGARRNKVPCEKIWPTGDSRSVVAHEHHDRGPTTTLLAETERAPVIQTKQRGPGRKKTTGAAKDPPPLLKGHHVSAIHNETTSGHNDSKQTHVVDRPRLASDSTHQRTTRSIWWHIPKERPVIAANDG

SEQ ID NO: 993276 - protein, 194 aa, Homo sapiens
MRHKARLRLTVTTGTRQILPGLFTKNISSSITSLEGRLASDACFNGRGNPNGAQVPNHSVPKKRTVMNAVTKGQQSPKLTRDMTYREKEAEHPVEQTPRRRHNEGPQAIKPAGRDSKTSGLTKPGEAPTETNTSTGVRINKPGEKDSNNSRGEQHEEQRITRRAPKQQTQGRANEQIDPIHSARITPHKSMSRT

SEQ ID NO: 993277 - protein, 32 aa, Homo sapiens
AADYYYYCSNSSFYDVRGHVHVFCLNKCKNCK

SEQ ID NO: 993278 - protein, 75 aa, Homo sapiens
TRPELRDIDKLASSSTGPCLSRCVEDRADLSWYTDDFPEKLKSLRQHMAALKRVIRWRSECEAGTEGENKGLPGL

SEQ ID NO: 993279 - protein, 32 aa, Homo sapiens
AAAYYYYYCSEFKLLTMYGDINKELLFLLQIK

SEQ ID NO: 993280 - protein, 222 aa, Homo sapiens
PGSAAWTEPWTRLSRNDCRLAAICWQSHSNEINGLSQTLPGYMRANTQVHNHMSSASIHVTACACATVSSLQPTNSTPWTGCIHYVPQPIVLRRSASDPLTCPQATELSSFDVHTPHRGPPDGRLPMHSYTCEIVGTVRVVGLLTWVQPGQSMALGSKTLERVDAILGAFPYTCAHPRVYTQRYSREITKCLVYYNRTRVVSYFCVCTLCASLKRSLLGVAP

SEQ ID NO: 993281 - protein, 33 aa, Homo sapiens
GAYYYYCSEFKLLTMYGDMLPPSVDNKPFSDAK

SEQ ID NO: 993282 - protein, 135 aa, Homo sapiens
MQEGGTYLFLPPLVSLLRCLVYLVHILCSAYTIMTVHNIYEIQIPMCVYPIIHIWVIIEKSEEVVGTRSINTQCVVVNVPRFLVSHIEDDIIYETDEFAELLSLIYQSNQRHAVGYDRSLVMGATLSCSVVYQTV

SEQ ID NO: 993283 - protein, 35 aa, Homo sapiens
AADYYYYCSEFKLLTMYGDMPLHSTPGDRVRPCLK

SEQ ID NO: 993284 - protein, 280 aa, Homo sapiens
MIGAERKPEYGRVVEWKILVPRTTTAEHRRRGAAEAVIENHITPTIVAVCQVTLPTRVQAPLGEVVIKRVRAEMTHHRTFRTSFLADFFAQQWCDLCDVSDQDRDTQVSACDYIWAFDYSSPLDLGYSELTRSSLAEHAGLAQWNVLVTRCSEERMRVQPPLLGVMIAEAVALMKILGRNGEPACDAGEHRVCCWARRSRVSVTCRLPGTWAFGPWVSPLGGPSRRGGFLCPRLPGAWLPGFTAAGGGVPEMGGSPRRFRLCVNLTPGWFPGPAKGGTRE

SEQ ID NO: 993285 - protein, 32 aa, Homo sapiens
AAAYYYYCSEFKLLTMYGDMHLAKINKCWSAK

SEQ ID NO: 993286 - protein, 33 aa, Homo sapiens
AAAYYYYYYCSNSSFYDVRGHVIKVFIVLFPQK

SEQ ID NO: 993287 - protein, 271 aa, Homo sapiens
EVDMQLLNPAVANPLTHRRDVQEDRTTWKSNKFLKIIQLWMIIRNCFMVGADNVGSKQMQQIRMSLRGKAVVLMGKNSMMRKASRAPVKDNPALEILLPHIRGNVGCGFTKEDLTEIRDMLLAVRCQLLPMPGAIVPHVKSTVPCQEQVVWARDRTSLFQAGGITTRNLQGRIEILSDSAKLINEWRESGSQRSHAAEHALHLPRFSFGLVVQQVFDEWSIYKPEVLEHEETLILRFLEGGRMVPVCLQNGPTVLVPIYINGSTSRAGWGG

SEQ ID NO: 993288 - protein, 278 aa, Homo sapiens
MALPPFRPNPFQGLGGRAVSWVAKQKSCGPGLQGPQQPRWAREFQGVDRTGQEKLIQEKGHFRGRRAPFSMACPPREGVGVRGGLGLQFTVGTVAGGAGRTPWALKRRLAMLWAIVDPVGLRGLSSQGCRGALCCRGTRLSRRDNRDSGRGAGEPRAARVGASWLWDLSSEAERLASMGPFIPCGTGARGVSETRLNARLAGRLTPPGKAPRATRVGEWVGSNRAQGADWRRLTGGAPEDFYSRGATSRGEPTLGDTRRVSENPSGTTQMHGAHDRGH

SEQ ID NO: 993289 - protein, 30 aa, Homo sapiens
AAAYYYYCSEFKLLTMYGDMLKRKPGGANR

SEQ ID NO: 993290 - protein, 368 aa, Homo sapiens
MQGDLRGDYLSSLDSSCDPDRIRLPEERAMGVQVGSGLPSDHARRESLAMGNSGRADPMKQQQRACTIVHICRLTQQPSWARLSQRGDQSDAAQPWGEHRRTNQGRALWKQANTIHRATAHTGGMHSTGAPTKRTKASNSVRHNSKRPETHFQLRKGTPLGTGALHGTSFPAKESPWLANRKSAPMQIHVPHRKRSFAPQLGQLVLRHKPCRRTYSNNSVQMKSKEPKEGIEPTSGQGQRRTSTATDTRGTEYPKSRARSTAPDGAPGVDRSPTPQLNSQRAGTHGHGTSATAQHGKDKSGTSPPTRTGARRKARAVPNPTCDAHTDDPNENQYKDKITDTCGPLPQRPPQTCSHSDSRERTGTTGGG

SEQ ID NO: 993291 - protein, 71 aa, Homo sapiens
IASAEKEFTAMGVRYNRICDVRQPQKPLPDLSMGLLIFMLCTWYSFRQLQLNGEGSTAFFGKGPETACLIL

SEQ ID NO: 993292 - protein, 70 aa, Homo sapiens
AAAYYYYCSEFKLLTMYGDMLASSVFSYLRRAQSTGLNGVLFIIIAKIGRACDSSIFGRPRQVNHLRPGV

SEQ ID NO: 993293 - protein, 61 aa, Homo sapiens
AAAYYYYYCSEFKLITMYGDMDKERNCKERQSQTSTQINLTGPEMGDCDRESLIKWLFPPK

SEQ ID NO: 993294 - protein, 32 aa, Homo sapiens
AAAYYYYCSEFKLLTMYGDMMLKANNKDISYL

SEQ ID NO: 993295 - protein, 173 aa, Homo sapiens
MGRFYRDKRARCLCDPPLGQACGERHVQWAYTEGAWRVEHPLCDTVGPTFSVARSDRASVSTWREKSSVGPRERTKKREGAVYNTRWHNQPPHVAYTRGRPTQGGCTPSERQHNRGYNPYKHGETHPRKRRAEKQPSSAQHKHTGWTLTPHKRAPRNTVGTHTGGEHKHPIGA

SEQ ID NO: 993296 - protein, 120 aa, Homo sapiens
MGRPTGRFSPQSFRKTPKDKFLQLEFSLTFHELPIVRTTKEAKPLSGKINQFVPKVLPRVFQPKTVLPLRIGFRGKLNPLYVNVPPSYAFIVVQGYNCAFPQEMCSSLAQEVSFGWGRTQ

SEQ ID NO: 993297 - protein, 33 aa, Homo sapiens
AAAYYYYCSEFKLLTMYGDMLKLVLFPLKTNQK

SEQ ID NO: 993298 - protein, 311 aa, Homo sapiens
GQLTRTADYYHSFWQLLLPAAPLFSMAAKLNWTNISKIHDCHSAHPLSTHSSPSFKHTQLAGLLTPALQQNSPPTRPCHHPYFQEQRNSPLNAQSDATAPNEHATRTGPMLMRTLPKPNTLSARSWLSTLLAPYLPAPNACPAPDALAHSWQNTHCDTTLPALPCSNPLDTRMPLTPAAATRTGSRRHNQAFILNRTALTFFRNPHAPKDPPPPAQLYLDDPSVHFCLPILEPRNTAHPANETGPLLHAPCPPRTNDQSMARHIAPQPNYSLAAEKGHGNAPKTLNAQPPGPAVIETIPEEQPNHPHAPRN

SEQ ID NO: 993299 - protein, 34 aa, Homo sapiens
AAAYYYYCCYEYLLITICDDLDLMTQTERTMHVG

SEQ ID NO: 993300 - protein, 36 aa, Homo sapiens
AAAYYYYYCSEFKLLTMYGDMAEKKIIIKWLYFLEK

SEQ ID NO: 993301 - protein, 536 aa, Homo sapiens
MDQGNLYIGYSAAGRQLHPAPQKHHHCDSVPPRPPHIWAQVFLREPGRPGGALQAGRPGVLEGSTGWAASSSGKRQYAPGKNTATHASASASAPPCVVCCPPNSLLQMDKQDSRAGAHPMVFQCNPRAAEPSIRLLHPNRHTISHPCAPQMDIMHLIADYNHLMRATQIGHGPIPNATAHMGHLTPSGHTTGLRREHAAPGTQDQGPSAGPANRWLQQLPKSHHKHQNIPPQQRGHHRIHRATQTQPQGAKGVKSHHRWENETHNRQSERSTVGRLWEAMMAPPHTHNTARAIIHPQFQQPGEDKASREPQERATCKADTSIQYTHQARPQHIRVSEKKRGPHRKPGHDNPTRGRPWHVGGSDTHRATHSDSPPTPQPNRYTQTTRRTPPAEQSTTNSGPHTPREPVCKPPRRHTTSDNRGTHHPTQRGDRHTDRGHDECDSAQNTTAQTEGTSETPPASTGGRTTHGTRKRECAKATENRRNDAEQRGTECLPPRPYLFSSDHTIRLHEATSVTPTAAQRSGKTSQHTTHENQHS

SEQ ID NO: 993302 - protein, 174 aa, Homo sapiens
RKHTEKHEWFAVNPIVQECSMKEEYHDHCIVSYRKLTLKLQRIYSRVRRETGSSVALNDLAEEDYTEKPFHSRKLTSVPRSQTLPRNVPGKKVMGITSNVPCQGMKEIIVKDLKKVDTKPSSEKKIHKTSREDMFSEKQDIPFVEQEDPYRKKKLQEKREGNLQNLNWSKSRTC

SEQ ID NO: 993303 - protein, 107 aa, Homo sapiens
MRDCTYMPKDKKLLEIDVAKCITSCKRNMTQERHVRQQCQHGNKNTNVRGITMKCTPGPSRSYGISALSKMLPVRMQDITHSMKGSRVRLIPGMAARCTREPRMEPG

SEQ ID NO: 993304 - protein, 122 aa, Homo sapiens
MTQDEFTKPVQQHSVNVESAQLIRDKVAGQQLGYGFVNYVTAEDAERAINTLNGLKIQSKTIKVSYARPRLRGDQRRQLVHQRAPADHDPEGRRRHVLTRWADHTTRGVLVGSRLQVVQREA

SEQ ID NO: 993305 - protein, 337 aa, Homo sapiens
VNAPQMGFLVKSPGSLLEIHSPAQAPSDDAACDTRPSPVRGTCYYQHMPYQYPALTPEQKKELSDIAHRICGYPGQGHPGLQIESTVDHCQKRLRVNIGTENTEENLALLPSRLLVTELSTGVNPLHMGGVILFHDDTSTRKAVIDGLSAYPQVDHKSQGLSVGESIDRQTTGGVVPTLARDKWGENKPNQRVWHGAVLRRVCPVYNEGTETEYRQKWPEVVLEDVGEQQPRLKYLAQLTWDKLPIWFRGGRLLPRYSWASAKCRVCCPLRVAHGESPREGRPVFDILLQYLPGTELVLLKGRIRHEFTWNAFRKPTRSPGMWHNTFKRDHENHTLD

SEQ ID NO: 993306 - protein, 31 aa, Homo sapiens
GFAGAVQLGLIGTRIRRLEFDASNSSRDHIS

SEQ ID NO: 993307 - protein, 34 aa, Homo sapiens
AAAYYYYYCSEFKLLTMYGDMWLYYLFKINNKWA

SEQ ID NO: 993308 - protein, 467 aa, Homo sapiens
PEQRTAAASLRPIPGMFVQRVAVMNHGLLLYAYDFLVKNNMSSMDNRMLMVGVYYAKCCVGGGEGKRSLTSLSSGERKKVALMHVEGPAAATERLAQGQTTMEPSSSGARIRGRTILPGQIVVGRSDTHRHQQWHVSQTECQLQYPESYRCSGLLVPGLLVAWASEDGTSHDPHKHVGSLRSSLECAGGRGPWPSPLLMDAFHARVYEPVSVESSPGSQVNNRLPLSCSIILNRSRSSYSLDETDGRYILLQKHIRRHFPSEQLLGLNGDPGLGQHGGLPTVITHSHRRVLDTPPKATNVGDVAVTFIQQAIQTCTTQNLVPTPPTCEHPLGQTSSACGGPQGPLQIGTPHKHTQTFWATPIEGGIPPPSQKVGTPPGGPAMSGEYRGRYPTAKGEPEPRTGPPGATVHQRRPTVHAPRKSSNPPATKKQARRQYHRSRTRPHTTAHLDHPEQADPSHTSPAHHPPT

SEQ ID NO: 993309 - protein, 149 aa, Homo sapiens
NSYYLISAVGTLHPSRTAGGGGGGGGAAPRPQFHPLCHSAHPRLPTTAKTPALNEALAYRVVGLNLIHGAWTSGWNPAPYHALMAAGIWCWRQPVQPRRALCLVDLVRLFLNHAGLPPAQPHPPWCDAWSQQRLRVVAAITSPASLLAS

SEQ ID NO: 993310 - protein, 30 aa, Homo sapiens
AAAYYYYCSEFKLLTMYGDMLISSKSKILK

SEQ ID NO: 993311 - protein, 60 aa, Homo sapiens
AAAYYYYYCSEFKLLTMYGDMYIFYIQKQERRFEPLCQAHSHTVECTFIFNKSPYSFLTK

SEQ ID NO: 993312 - protein, 334 aa, Homo sapiens
MLRTLDIKHEDEVKSQSRVMIHVFSDGEQTGAGCDSHFLGAFVAQHLKTINQERCIEPLAESITDVLVNGHNGHWLVKPTAGWDGFVEFFPCQRHLSTGGQSRNVLLALAGVAAVGAGLAYLNKHSLPVSANQLTSTNPPQHKTSFMQMELHKLYNLPRVAPIGNLSRNSKWPEALSANHGTYIHGKECSPFDVQAVTVWNSITKVQVSATNKLSLRKPMEAGLTDITEHRTPGNRLQYPGREQDRGPQARTRLASEPRTNLIHTPDLTSTATTKATDRGTRPTTHTTAHHRRHTTHDHKTSNPSNQSDQPAQDNRHNKQPHSNTHKKTTQQET

SEQ ID NO: 993313 - protein, 35 aa, Homo sapiens
AAAYYYYYCSEFKLLTMYGDMGLFLGTIKRLNLSK

SEQ ID NO: 993314 - protein, 122 aa, Homo sapiens
MFFTTKHRGILMDRYHRCRKNLNPPQRNDDAARYLEGDPKTTQWLHLPFENIQLGYPETRTDKGTSTKLEGRKRNRRKAGQQKTNKNRKQEDKKKTQDTHNKRQKRKTNKKKKQNEQRETNK

SEQ ID NO: 993315 - protein, 45 aa, Homo sapiens
AAAYYYYCSEFKLLTMYGDMAESALPSRYMPLHSFLGDRVKPCLK

SEQ ID NO: 993316 - protein, 42 aa, Homo sapiens
MDLLVQYNYGLIGTWKLNNLLLNDYWINKKMKAEIEMFFLKP

SEQ ID NO: 993317 - protein, 102 aa, Homo sapiens
MAYKQKPYLKQQDWETGLRGETYDRERNKRWDEETRHSTLSTGKGPQKNTNGDDAKHTQKENKGTEADKNDEGENKKKTDRAKANVQDDPSQNRPTRRAIKL

SEQ ID NO: 993318 - protein, 34 aa, Homo sapiens
AAAYYYYYCSEFKLLTMYGDMISMCFHIKLFSTE

SEQ ID NO: 993319 - protein, 42 aa, Homo sapiens
AAAYYYYYFCSEFKLLTMYGDMLLRSSFLRPLPGINICVCVC

SEQ ID NO: 993320 - protein, 34 aa, Homo sapiens
AAAYYYYCSEFKLLTMYGDMCNSINDLILLNEMK

SEQ ID NO: 993321 - protein, 201 aa, Homo sapiens
QNLIQNTNIENGQEERVMDPVQRFEKLPWKSSMQLMETSLEHVAMRPWRIECLSQGVVTRAKQLSRTLVRHEPPKTPTASCSRDSLPYPQYLAVIKAQISCAKDIHTALLDCANKVTGKTPAPPAGPGGSSVKWGTGSGAGSGWWVVCKGMKSVLGLKHSSLLSSCLSTEAGASRGQQRPTGSSQAGPLRTVPFFLITLLA

SEQ ID NO: 993322 - protein, 149 aa, Homo sapiens
AVYLSWRTRMQVLTDGFDIIHQSVSECGSGCVLVLEEGDDTSSKGHKLGAVLGLKMIPGCSEIFNASADGQLYPNRLRPHRPWIDDYYQTWVKPQIVLLIEWTISLNSSAMLQWLTLLRSLQASDSGRKQRPQGGDFIEIPVPSVALIG

SEQ ID NO: 993323 - protein, 149 aa, Homo sapiens
MDGQRERARSESITDSREGQHFEPHTVCTGGKGRVGIQTHTAEPPPRRARDRQHDHRNPRQDRKQNTQWTEQTPTAERNHRGAALTRSTDQKDPKKTGRPGTNRESERGSNTEERQDEPERGEHTAEGTKKRARQNPQGQQTLRGTPRA

SEQ ID NO: 993324 - protein, 366 aa, Homo sapiens
MEHPNTGTVNTSVAHSKFIGFSGLSRCTSNYQATLERIPNTNSFWATSDSVSILKEKEIFSKLEKRAAQETERLLKESEQNANHPHRIELQNIFEEAQSLVREKIVPYYNGGNCVTDEFEEGIQDIILRLTHVNTWRTTISLRQARYHTLTTNLCGARDNRRLHEKADFPAAIPRMHIPSVATIRFVMCAGEQGQRGPDEHFCMGVNKNEDLAGTSIPGEHTGTARMSRDRLQCVGPEQETPTNRSTAEKRHNTPRPNGNGTRHTEREQRNGTRTQATTDHIDGHKNARKRGQKKAKKKNETQREARRKKQQRKETLRNDRRQQTKEREHRKRTNEKDDDEAQERGKDKKAAHRDKRQHDSHAKRE

SEQ ID NO: 993325 - protein, 163 aa, Homo sapiens
ASGLNVYSALTSRLSGRGGYSAYSKDTGLLTSSSREWKVKFPECYVSGFHAIRLLKIDLLKNGERIEKVEHSDLSFQQGRVFLSLCTTVNSPPLKKDEDMPAGVNQCDLVTAQDSERGIETCKRASNGDAAYGLDEFQILLALLWNIDMLIHVYDFYAQNVGL

SEQ ID NO: 993326 - protein, 72 aa, Homo sapiens
MARKECGCRQDRRLVAMDRPLQEEEPPRCTKQEVGYMTGKCLANNTTHYGTNEQKKEGGGGRVWVVGVLWVW

SEQ ID NO: 993327 - protein, 63 aa, Homo sapiens
MSGIGSLGSDVAGRDNRGKEGTDTTRDEGAYGAARDGDKRDAGGEERDTRTEGDERGRPWWVT

SEQ ID NO: 993328 - protein, 226 aa, Homo sapiens
QWCRSVIEFFVMVIRLLNTPGPVLLVRRMLLSSDLRSLVSGKPVLNAYRQSTSTPKELCQAKAQALIQNLSLLRSGLPGFGAPIQCLAEKFSVDNVAERHELTTSSRPSCCGQRSHRTTGRLLYLWKRCTYCHGLLWAIDLATEGNATNNFVAKPHFTITTWMTHSGLTEHTIIQPGTLARPGAHGKSRCPLAICGQNILDHRRKHASILVRSSVSPPPREERIQT

SEQ ID NO: 993329 - protein, 377 aa, Homo sapiens
RGLAQRREQLNFKHKQLHERASTAPEPCPDPRPARPCGARAETPWPRRSSGRGPPSRRGPSEGRERSGAAIDGRGKLWALCFPGPARSPGAPGAPPMSTIQPAEGVQMRGPGGSPSMKGYPRLGRARMDEDAMRLPEINQPNKYQVVKRRGTHETGHPGPKDLFRYEESREKLASPTRGQGHARGCGQIEQHPTVTGFRAIKSSQTEELCGTGALNQEPEAADVVTVIRRGNAEGQAGAEGRGTLVSLMSHAKATERTTGAVDNDTHGDMPDGPHHTGPRRRNTGGSDKGSHLKAKGPSYRGNRRWHTETALRGGTQRTKTGRTDKQPAQQRARKRKRVDKAKGQERKRNTTEQRRGPTDEAAPGVGNTTTKCADQH

SEQ ID NO: 993330 - protein, 375 aa, Homo sapiens
VAPQSTEPRLCRSAAVTPARSSPCDDDISLRSSSTTGSGMCKAGFAGDDAPRAVFPSIVVCAPGTRASMVGHGSEGFLCRATEAQSKRGILTLQVPHRARHTSPTGTTMRAHIWHHTFYNELRCGSRGAPLCLLSEDPLNPKANAQQDDPASCLTTFNTPAMYVAIQGCSYPCNASGRTTGIEMDSGRPGSPTLRPSTRRMHSPMPSCVWTLAARPLTAYLLNESHPTRGQQPPPTTRRTGEHGAATSRHHTAHRTPRNTRTSAPRRTPAPLAAAPHHRHHAHRTTTADHRTAPQQHSHAPNGTRRPGPHHTHNDTTRAQPPHNQCNNRQHATKHRPTPQQHHEKAKKRHHQPDTPPPTSPAPHTPHREPAPTAH

SEQ ID NO: 993331 - protein, 344 aa, Homo sapiens
KLPRAAGMTPLYAGSVCTNMGSGPPQAQHCPDSGVKRTYSEVYPGSSICKEASMKPERQFGPALGGTCPPLLTCGTGMTIEACGMHQSLLRDMDPRDLHYKTTRYHYRATANSPHAGKPTETHETKASSDHSKDVTKTRRCKFHYYSRDLKPKLNSLDNSESRLMRRRAMRRSSRQDAYPSGKRQGEYGTLKNPNRQAEQHETGHDHMINPEENTSEKEHCRNKGRNRRRRQKRYHQKDRRITSNRHTREEKNCNDRNEREGTREQNAHEACVSRQTHKHETCKTTQAEKDSHDRAKSRHRHAERGQETNTATRPPQSRTRGSSTEPHDKAAEKQNRHRRTNTK

SEQ ID NO: 993332 - protein, 321 aa, Homo sapiens
HQRTGEEDVEPECIMEKVANGFRCHTTAFIKESGRFQDVGPQAPVGSVYQKTNAVSEIKRVGKRQLLGQSTRRRRRTVGWRKSGGRGGTSGMRGSRSRRERELREAARREQRYQEQGGEASPRGRGSRSRSGVQGTEMSRSLPCRRGRSSRQEGGGHVNNCIIQSSGLEAEEPLLQKESTNQRPMFGKRSQLLPVSRAEGRSSLLRSWAKGSPPMAAGSAKERGWVLSEASRGRNLVRRSPNGGKQHVVGLASNLATPFGAWAQGRGLARPDTTGSENKILYTENHKAREEQRGDERRIARDPTQELMRETAHTRHYTREK

SEQ ID NO: 993333 - protein, 243 aa, Homo sapiens
MTKNHSTHSTHQHPAHEQHKQQPNPNHLITLDETEPNVKIQRKSERPCEAQSATRAQSNHNKAQATRQPHNIYQSPRHHDNNRPHRSAPERTPPDNYEPGGRRTTPHTRARPQITRSNTNRNQHEKEKHRTMTRKREAQHRNYPHRTTLNPHTEQNQRQKKHKGAKEQNRTKRTTSNNPHTLQEQRTNPTSNANTTGTLKASKARDRNTKTKRHKTHQTTDNHHSYLHPPTQYNTSRLNTDCY

SEQ ID NO: 993334 - protein, 363 aa, Homo sapiens
VKDLVFEEAAGTTSGGVCVVPSSLQNELRHSSTLPGSSGSGLHPPGTTVLPIMHCYGMYERPELRDYRGLEQLKAQLVAGDDEEAGWTELAEHGSAHALLRTELIGDQLAQLNTVYPSPSYSSLGANLRDPADYQLDVEWQAEVPKHTTDVVEESVRGNNRMDRNPPTGHTDHLGTPVPVSVPAGASMAAPFVELGTSSRAGRRLAGAGGPANDTCIAKHTGRAYDEQRGPQTDAGTTSCLMNQRRTAQQLCTKRRAAGAQANRDTGPAAARPTTLTTPHRQNPTCGAHCPNRRPSTVPLRNVPHKGPGPPALAAITPEAPHTTHTQHAENARHTGASRTRGHTATHTSTHQDNEKPAYTHRP

SEQ ID NO: 993335 - protein, 144 aa, Homo sapiens
VGPYPAVCRQSRVDGNGGDGARARRVVLCVGGAEEASDRHDETTREAYSRLTSATEMTERRTTDKRERTNYTRQRPLFYETISQSIPCYRDVRVTQLEDSTTCTKAYEPPRTPRSSTTDPSTRETNCANPIHTPMRGTPQPINL

SEQ ID NO: 993336 - protein, 33 aa, Homo sapiens
MDLLVQYNKALEFELEFEARIRARIRARIRASN

SEQ ID NO: 993337 - protein, 254 aa, Homo sapiens
KPPKESALRSSWSRKDPDARAVEQMTLETFFFLINGPEIMSKWLVSLRAILCKALEEAEKNASLSDHHSLIELDAILLSIQLRERLMATVRSGAYVSRVVDASMDGLRCSRATCELLWQQPTDPTALTQCLRRFGRFDREVDLGEFHDATGRVQRFFQIHTKNMKLGDDVDLEQEAIETHRHVGADLSETCAQRLFCKTIRKKMDLIDLEDDEIDAEVMKSLAVTMDDFRWALSQSYPSDCGNRGKGAQVAGEE

SEQ ID NO: 993338 - protein, 314 aa, Homo sapiens
REVRRSVGITGLQQSNSGPQEAIGPGPWTRGAQSAPQMPLHVGYEDRGGLRMSAPSPLTDSQEGGSPRSPSVNKEFPHKSIFLCTRICPSCTQKINHGARLCEAIGTRSGGIARMEYPFLDPQGLFVAAPGRFPKKEGTAHYTAAEDHLAGAGQRLRMRDKSGQRSEGSQDQEHNNVLGRCRLHMRQTRPYRGDIASPQEENNLHNLHSGGDPPVGSNEQRHVVACARARKQIMDHAGNQERSSDTSYTARRHPRKEIKSGGDTTTDARHPQHNPRLTQPALHSTSGTTQHAPEHRTTHMPRKNSRQWPHTHTA

SEQ ID NO: 993339 - protein, 425 aa, Homo sapiens
MTAGKIARQRAEKKLTLRDSERGISQKLGKADETKDEQFEQVLSRISNIAADGGRPGLQKDLRTIPGLRLKPMHEASQEADMQLLCTERAMSPHWPRPGCRQHKIAEQQPILRVRLASYPPRSWWHPLAAADHLAQRTCGQIPRTVNVNAVANRRGANLRATTTAARNLLTNGPFQTATTDRTERPHHGPRPDARATLDPNAPQSAAPEPQHCTLLRLMPPHAKPCPNPPGHTTPQRNRLHTRLTHSRSPSKPLRRPHNGHAATTPRAPTAAATCQPKELRHQEQPLHTHRLTRPRDRAPKPNHASRHTPISPRNKGRSPTQHHQPTPATHRTPPTGALRPSQHTSPGPATPGAHRSATTTNATRPPRAGRTRTWGPTAHHSPHLQPPHRATQRDRPPPTLNARNAPPNSNTNTPPPSKQQEAPH

SEQ ID NO: 993340 - protein, 212 aa, Homo sapiens
MPIERTWLPMNTSSVHSCGAFYWSQKGFHTEGRKAYCRKDYLRHVLHHNVCAWLRPGHPERTISQTLNTLWHPECLCVPGECFTPFDERQPYFEHDGQTLTVRCQYQAAARIAVYHGCQKPITGRSTHRPMAQQDTQPRDTNVKRPYSHQSSHNHGTHYTPDAQHTTKTITCHEPCLPQRLLHSSQWHLPPCPTAPPYHPDTDIPLNLGRSL

SEQ ID NO: 993341 - protein, 30 aa, Homo sapiens
DLLVQYNRLNRARIRARIREQQSKTKSPKK

SEQ ID NO: 993342 - protein, 469 aa, Homo sapiens
ILSTTTEPTAALGSEWLVLSPGLVIYTPVYFYFYHTGHHCAHKRSTSSGIGAPNWVQAVPVFWHYGAKQWRLGTSSMGKGGAQASSCTSTVSFALSSRTQCCGSIRGTSYVQQGQAHKQHRGIHHCYSTTPGRHAHPSHDTVGVTQHCSTAPPKCSTGKHSGHTTNRTIQLLTSSTQATTTDTQQQLLTAPPCTHTHQPLLRHTPNGTLTHNHTDTPPHRNHTPPNAQNTYAPRYPPTGPQRHTTALTGLPTATLHHSQSHKQTPYGPPGHKLTGHPGHSPDINTPPGNHDPVHAPHPLNQHGTISPARQHTTWPAPGTNPSPHTGNTNKTTPRRPPPPGHGPHLAPTRPRTHATGHAKRTNRHNQMHSPPSSRTPTTETNRRTPHTTEEHSRPHNRNRHDRGRHTQKGRPAHRGEPTPDPTHPHNQPRQAKKHPAKPTTHDTKTTTHKEAAHSKDTKQQQHRHADSAI

SEQ ID NO: 993343 - protein, 44 aa, Homo sapiens
AAAYYYYCSEFKLLTMYGDMKSYLCYKFFETQYLQETGMNNCIK

SEQ ID NO: 993344 - protein, 353 aa, Homo sapiens
TPPPASPPGLNTITITTSKQQQQQQQRTSSITETLGPPSFLETFPTRHLEVRIDIRNTATPLAATDHATSAWRSSEGPYPDRAQTTRVPPTLQQTTVIHTDTTQGTQMGPFQCHHIHIIYKRRILLSDILQGVHNTSVSQPPFHLFPQRTHQRSADPIAHIHQAVDHTEISRPSFETSPCNPTRSIGPTTIEALPHPANGQGHYKNTRRTITPPHGNSNEPEETDNAKTPPRTHQDGHPTKEKATNNKNHEKIEKNTKRENGTKRTCQSTKERRETPTQHGRPKQATKTKRTRHWQRAPKWENRTNTHRATEPTRRQRRQKWSQPRHKASQAKHKKDRRQHGWTPTNQQMQRT

SEQ ID NO: 993345 - protein, 301 aa, Homo sapiens
AQVRVLSGPPHFHLGQTNRTPEISPANVLAGRIPGIERVMMDSVCLRATPIAYYVSNEELLGKYYHEAADPKVVQCEVLSFADSDIVPPDPVPGCSLYLVAIMHHKKRPREVMQEEDVRRILGLLDALLEDEDFSGGQNELTSGDITVCRSTLSWLYKQVLEPSFRQAFANTNRLVTSLHKASPSSGLSMGEVRLCEKMAQFDATKFEKPNLKRTHHRHQRRVHGKRAEAQAELEEEKRRVPWSAGGDGDVTRAGVSPGHDPRSLADTLCGEIAHCPGNRGGQIGDGKRGPGPKAKNPTRT

SEQ ID NO: 993346 - protein, 35 aa, Homo sapiens
AAAYYYYCSEFKLLTMYGDMPLHSSLGDKARPCLK

SEQ ID NO: 993347 - protein, 34 aa, Homo sapiens
AAAYYYYCSEFKLLTMNGDMQSPSVRAAIKAIFS

SEQ ID NO: 993348 - protein, 316 aa, Homo sapiens
IPPKSHTHLVKINVLHRDQDSAHLPGSPRTLLTGRHPHELVGKDCRDGFYRLLSSEPVLAWDPTVFQNSGESPLCAEKPGPGARLIESGAIQHQMKQPPSKFSIEQAVAGEYRAEVLVRVWVLEVGLDAGNPYQGRRASGLPHCSRCISPIFGLIVAAHKDCAKLKICLSDTENVWQLPRCGMMIYRYCVTTVRKEDIEVYVTVTSAGEARVLLFAKLMCSARVALCSRNPFPTWTCRPWEGSVCVLSSASWGGLASAELIDAMGGSSTLAEYRRLARVGVNVKGVFPLGGSRRRSFGRRPGVPGVVGARKSCPQA

SEQ ID NO: 993349 - protein, 35 aa, Homo sapiens
AAAYYYYYCSEFKLLTMYGDMPLYSNLGDRVRFCL

SEQ ID NO: 993350 - protein, 214 aa, Homo sapiens
MHVKTYRLVNLPSILNMTDRNNTSQHTRPTTLRNNETAATYNDLTKNHTRIPHKNPGQTACIGEHIPVNPRKQQDDNAPTTQPCAQKNKLRITLQHREISRDTQITPEEHKHPSAKLNEAISATETYSNKSPFDTYRNLTPSRIQEHNSVRHESARKRTTPPQGILTQLDGHQASKRPRQSQNVADTAATAGETKVERTRPRPGATQQRNTEVR

SEQ ID NO: 993351 - protein, 38 aa, Homo sapiens
MDLLVQYNYGLIGFKLLTLEALNSRARIRARIRGVFQK

SEQ ID NO: 993352 - protein, 106 aa, Homo sapiens
MQQKHHSLRRRRPNTHAHPTRIFVEKGGRPTYRRGSAPIYIYNPIEERGARAHINKRNGRGGKQEQPREHLGEERTPQSLGEGGEPPTWREHNTHPKHKKYYNKTP

SEQ ID NO: 993353 - protein, 310 aa, Homo sapiens
MPERSGVCQVVSIMFSYNMFDTLFPGLPKPFTPHSSAASLCPCQQALMTGLDVETGGKIIMPPRPGQLSRLNMLFKLTNKNSDLMTALWRAGVCGDERHLLLPHWMMQELLLERRRLIQVERRKHSSGHILQISTTEPGLTEQFNKAPKANKKTHTTNIASMTTEEGRDNKTLMKRHQTNAEWTGEPQTDKNKEPKKEENDNVGKWSTDKATKNRKEPTQEGDHHNERTNTETVEHRAHRKPRPRTEPQEQPGQEAPTDPATHTQTHTTDTTPTRHNGAHNNSKTTDTTAKKKEPKHHTKQHPNVATPQA

SEQ ID NO: 993354 - protein, 48 aa, Homo sapiens
AAAYYYYYCSEFKLLTMYGDMGERVKAWPCALQWGQLGRQQNKGNKMK

SEQ ID NO: 993355 - protein, 243 aa, Homo sapiens
QKKARKSLLFWSPKRGAGTEEGCEGPEARGTSRTASLGVPPIPGHVQGTQLAMPHEDNRKTQTRSPISERGDHPRENHQRGTKRSRANHRNAKTTSQAHKHTKGYPLIRPPHSQTWTHRDKTQEAHQEGKHRRRIREEPIELIEKKGKVQPIIDRNNTKSKKHHREGQYHIDIRHQTEFRGPITTPTVDKRPLRQTGTTSAIMTLSPLEDKQTGNEAQPANGNVSNEHQRENHNADSPWRDPQ

SEQ ID NO: 993356 - protein, 542 aa, Homo sapiens
MRIYLRTRFPMTPFRVQVVHGTGRMQRPQCDNALQRSSESRRLLDPRREAPGLAALAPAPKETRPRDRAMDILTTQGLGLQICVARCVRALLGKQYPPCNRKGAKWHLTHQHGSFTLLIPYHPPATPYLISPHSICRLLLLLLHDHARRTFQEKINALNRGMRDTGQEEQATIGRRRPRSSTRGHHMAAPAARPGDSKAQNPTRARGTTTRTEQTIILPRHNNTNTPQRTTHTHATQRGRPNTAHTAILQTHTQRTHTPHRANMFIITTIAPNTQQHNTNATLTTQATASTQQNTHTATHPPQHNHPHKKKPHTPTPHENKDDNERRRTTQRERQQRPTRRETSRRNQKPKSSKRNRSNHERDDREKNKSNKKRPRTEKTRSNETTQKTGGQGEDTRERRRRERHKRPQKTENQTEPTGTRRNDATREEQEKTQQEEEGQERRKRRRDPEQGKRHRRKQQERGDQQDETGPRGTEGSEQRKSGRERDESGHDQKTSTDKESKTTEREGTQTQKSESEERGGNEKQQRKAREGPKDSRRRTQE

SEQ ID NO: 993357 - protein, 173 aa, Homo sapiens
ALHMLAEENAVIQCQCPPADTRAKRFTTLVAKSLKPVVPDSTAETWTTEKFSNGVQTELLTTTKTKDTLRAMTNEQWRFLVEGGTLRIHVVPLLYHTLSGRILETLHTEDIERQQTGPKREETISPKMTLYLYKSTHVDIDRQKLMLKAKMSSDQAQDISTVCFLHVLPPPYP

SEQ ID NO: 993358 - protein, 36 aa, Homo sapiens
AAAYYYYCSEFKLLTMYGDMQRIEFPITFGQGTRLD

SEQ ID NO: 993359 - protein, 263 aa, Homo sapiens
MLETQVAHLCAGAIVNKIPRGSTYSQGPVVTRTISKYPICILKTRLLIWPKIQASGTEAKIQWNMGRMVEDQTTAYHQRAENYNKARKQHNEKVYTHADRHGKVHALEPERTYQKIDKKGLSIEQLPTRDDEHKTHILTCRKEKSNGRPSGPSTHSTGIGTRKDIAHNPPLKHTTQEKSMTKAPTKTQDCHEMDKHHTHKRTTDSTTGTPATITWNTLQPENTHRKTQCQARQLHLKKDRSEVPRRSRLRAQTRQNMTDKQQY

SEQ ID NO: 993360 - protein, 455 aa, Homo sapiens
MHPSTLQAISIRQTDDFLVIRCPTGAPLTPPTVPVTLNAAKLISIHKRTRTWPNSARTENKGENKTHPNTIMYTNTTAHGKQGKRQKKKEENTVTKHKDRQTGEQREKKRTPPTRTTQGTKDYNSKQQTKAPQQDKQEQKSDTETRPPNRQADTVHSKRHTNKQKREAEKTQKQENKRRQKQSEGNEAETERGTRKEKHHGQRAQKAREKQQPAGERRRQTRRHKKSRTGRENKGEEGSEERKTRGNRTEGTSRAQGGNNRRQRRTPQGEQTAQKTSEEKGKDETMRERARDTDKQQTENTHEDSKEQTEEKSEKPEQRRERRKRQRREGEGKARQKKERERKSKEKRRERAREGGSTHEARANKRRKGKATREQRKAETRRGRQKDRATKTRGGKPKREHKGKQKRRRQEKANTNDNEQETRETDEKEQARKKTRTDETKKKREKKRAKSRKKR

SEQ ID NO: 993361 - protein, 627 aa, Homo sapiens
QNTGVVNTTPKSQNGKGNDLISTLSSLGHVDSRKSTTTGHLIYKCWCDRQKQPLTNIRSKAGCCQHGQKGSFQVMPGYWITLHSCSVQRGHPPIAYLLVEHLQHKPSHYVTIIDDPKDTEHFIKNMITGTSQADCACPDCCCWKWLNLKAGISKNGPDRSSMPLTGVTTTGRRHHRNKSEQHTMDSHVRPPYTPDETHEATWYRKAQHVHKHNGDNTRHKEHGVPLTGEERGQTSWEQRRNSAGSREGNIHDRRGRQGTHAQRDPRGTTTRPTEQHQPPHEVTKGRQHAHARQSKGCTQKAQQTNTAQEHTTQEDTDKTTATQHNKTPRYQHVKNRKGQDRRHQSTTEQKQPKQKNKETTKADKQQDRQHHATKKNHTDKPTDRDNKAASREGRMTNRPHGQPTRTAQARSADRGRGRQERQERAKGQSRRRATENSDKAKRESRTREDQAEGQQARKKARDAERDDATAGTADTRGKQPRQQNNGRKSDRNREKERRRTRKKGKEKKRVRTKSNETRSGRTKKGQARTEKGKSKTGEDTDTKNERTHTQGKRHTEQRKPQTEKQEKHGEKRKRHDEDAEGDGAARRQSESGRRGESASTERGDTRTNTQRTRRRERTKTAQSRRAR

SEQ ID NO: 993362 - protein, 49 aa, Homo sapiens
AAAYYYYYCSEFKLLTMYGDMLFCHLLIALLVMNSDDETPINILIDNQK

SEQ ID NO: 993363 - protein, 83 aa, Homo sapiens
SADAWVDHAIEKTPGSPDHTTDPDHTKTPWQLPLLEAESAFISAIRRLLGQMRGQAGMREAVFIIPEHPNNHTEQTTRNKTGE

SEQ ID NO: 993364 - protein, 866 aa, Homo sapiens
MDQLSAQSSGNRAMSIIAGALTACMHVVRLGMQEYPTTSMGSKQSFYQIHIHKQQNIHISTVPTVISHKTSSIVGPQGLRTSRKEQQEGSYHRHSITRIRRKIKHRAEIPPTRPPQRHRHTLTQHTPGPWRRSPATQEEAGTPNNTVLYANKNPTLTSRQTETPRERHTRTAQGTHEDYEPIDHETITQQDGVKQQTQTPEITPDDMAEARPRSKKQIPHKGTQQGRGSHACPQTSHTKLRHRSRGKITHPYTTNRHQSGATTRTHGKQGRQPDNPPTRRRDVSKQSEKRKGKEKLLQRGTQETDSQLHTSTKQHTQWQITTTESGRLDKLEEPSTNTTDDTTMRNQKTNTSNNTTDNYKQTEEKRTNDEPSNNTKLEEQQETNQMKEEKETQQTRGNKRAHDTDETHTQSKESQHTTDINAQDRANERKNNQTAERSNAKRRRDDATTDTRHHTVTRATARTRRNTDRQTAARQQTVHSSNDRGAEERAREKTSTARERHETRRRTTDSTSTREDEGHTHDKPRRSTHSESRETKTRRENDTTRTAQESDEENSHRAQGTSRVDSAGHLQEDYTEQHTTTKTRRRLQKESETRRQCSTDNSRVTHRRDVEATQRQDDRQNTRRREAAGREQQLSTVHCDRDQQHRSTYSTRGQAQQRDLTRYDNEQQDTRETSTADTETDASRADTEADTQAAPSASSLNGQMRQRHDHERRRRSTDEQQTAESRQTKTTQHRDSRRQRRKSQPAKNERALRTTQTRSHRQRAVDMRCERQQATARRTSTTREPTQDEHTDSKRAGRANESTHRNDSEETNRSGQTRRQHSGGSNERAQIAASTRAAREQHDRRRRTAHALETTTRTRTEPESSE

SEQ ID NO: 993365 - protein, 408 aa, Homo sapiens
NPEDTPAPLQRVRRGPETGPGICPRLEGAHGSPMGKPLKTPHDPPSMRGGGGHETGPWVCLTSEVALRMGDRGGLDVCEIAMILTFLPICDNGAHTQGQARRDPSPYSYYNKHQKTRPTKPRECGHKSKREDRREPNMRKTENKGHKTTNTRTTNNKTKLEEKKSRNKTKNNRKEKQRTKEKEHHEHLNSTKTKTKPENTKKKKRPHREIKTKENNQAEKGSDEEKTTYQRETVKGKTEDMKAEREDRTKKGRTGERAHDRRRRDSQNTPLQNEHHKTEKHDATNKFRSNINQKNRQITERRYNIEMTQINNLKQTTRKHTNMERKERKRKKRKTKESGGAGERDEGEGRNGREARQGAAGKSGKKRGGRRGSRESESRGRDEQGKGRRGADRKERGQERGRGRRGER

SEQ ID NO: 993366 - protein, 48 aa, Homo sapiens
MDLLVQYNYGLIGTWYWSRNRYIDQWNRTEASEITPHIYNHLIFDKPE

SEQ ID NO: 993367 - protein, 469 aa, Homo sapiens
DAWARQEPAQEGSGVIATPVSAGAWLTALPHAPFLSSRQPEDRWCCSMCWCLGRYMFCDRSSCTANRPCMASDCCSVLHSMTLCGTMVTPQVYLARLGVSVMTMHWGHPMTQRKSRTLLARLWLGTNQIKSTLSCPSASCRSSRALGPSNSLPCCNSHPPVAAASHASLQCDWALLAHDAQCVPALETPWNSGARPSYPTAKQTHLGLNIPPRDHNNDSTVTGRSQDPPLTRLVWHNPLHTLTPMRQLAEPNVLHWSQHGSTKRGEVPPACLTRPRQRVRHNTSRAHSLPTQPYQHSQDGHSPPHGGEDPERAPKARTEGNRPKNTYEAPRSTFDRPITNPGKADAPRTTIDANTRRQNRHRKAWYPGRGSPMAHGTRRHERADTQQKDNKGETPHRSSVGSKRCTNKLQQNRREKRLDRSGQRENRDTEETLENKQHHRVVRPSLRTPNTTSTEQSREQERQGATTTR

SEQ ID NO: 993368 - protein, 46 aa, Homo sapiens
AAAYYYYCSEFKLLTMYGDMEDGVLRPPGRSPPLYVSPIKPFKNPK

SEQ ID NO: 993369 - protein, 71 aa, Homo sapiens
MELNISAHRPLATYNSSTIRPTHHKHYHSHTQNPLHSYDAPSHHHNHSTMQTELQIQQRQGHTHSSTSTTN

SEQ ID NO: 993370 - protein, 34 aa, Homo sapiens
AAAYYYYYHCSEFKLLTMYGDMEIQLLASGLPSK

SEQ ID NO: 993371 - protein, 107 aa, Homo sapiens
EISGSMTILFLQLSKLACNGEPVMVDPIEGHSREAHTRLRWTRANDEHESENSASGAPALGHRKHAYARNGWATSIVYIYSRRAPLSERIQNTQLSLQLEDSHKTTD

SEQ ID NO: 993372 - protein, 314 aa, Homo sapiens
MRGRPPDRAPPTSCCVQGGGHIGRGHYYTHATSAAPRKKTRERGEKNSAPGGPRRGSHPTTGGRRTTSGATNTHTHTANDQAPREHKHTTDPKGNRGGRKNPTRTPGRRPPKENTSHPTAATPPAGDTYPPARGMHATKASTEEQTKENKTSAKNKNKENTSKNTEKTKTQKHERQRQTKEKRKKKKRKRNRTIKRNTRQRDTNETAKKRKGREKKKNKTAKQKKRKETTKSKKEQQTGTRTQPAAARGQRDRRRRKQRGESQLNRRASNEKEQQEQQDEDTREKREKEPPPRQGRNPNKRGRGQGAKSAGRRR

SEQ ID NO: 993373 - protein, 408 aa, Homo sapiens
MTCGTTFQGRILTVIQQSKKSTLGRLPLSVVMIVGQTFSQNSVLNKPDIDSHMSDDTLTSAANVGKPSEGTQPFSAQSHHSSERPNNVYLTVAQPSARPRAFNKHQEVHTLTLTKPLLTCNAKRDRLTRQDAHKRPTNYSHGIQPARRQRKSSSAAGAEPGTTEQTALHNPTIHTTPQRHHQSDRRNPPANQRAHTRPAQQPTQHTTDTPHAQHDHPTQSLPPPQDTTRKHHTEAWYHATAQQTDANNEHGIPTHTTTHHQKMIPHRRPKTRQRQTPAHWQRNTQQTTTPTPTTTRNQPPTPTEPNAHHPRARDGDTRQRRAQRAQDSANQPTAHTDNTTAQTSRPHKHPTSPAHTRRTQPTRSPHRPRRKTKNEEETDSEHPAAQTDKPHNTPPARATSYAHTPSAA

SEQ ID NO: 993374 - protein, 33 aa, Homo sapiens
AAAYYYYCSEFKLLTMYGDMWNAGQVKRVLPPS

SEQ ID NO: 993375 - protein, 95 aa, Homo sapiens
MQSNARTNGVTWVNHEYTRSLVSGRMKSYALLTVNLVIILLVMDEAIIKKVSRTAWVRIQSRDVGILDPAYARQELLYQMALNARRTDNGGEPSA

SEQ ID NO: 993376 - protein, 45 aa, Homo sapiens
AAAYYYYYCSEFKLLTMYGDMIFALRPFSLGLLSPLIHKIAFKLK

SEQ ID NO: 993377 - protein, 35 aa, Homo sapiens
AAAYYYYCSEFKLLTMYGDMPLHSCLSNRARPCPK

SEQ ID NO: 993378 - protein, 68 aa, Homo sapiens
RELNEDDSTDCDDDVQRERNGVIQHTGAAASLTASSGSLMGLLIIDGGIVEYFMTLPKWSNILATVMS

SEQ ID NO: 993379 - protein, 35 aa, Homo sapiens
AADYYYYCSEFKLLTMYGDMCFGMSVNKTGLWLGK

SEQ ID NO: 993380 - protein, 324 aa, Homo sapiens
SLSAPALSSSSSSSSTSSPVLGAPSYPASTPGASPQHAGAPQPLSSSRARRARRSQQQCQTVANMSTQPWSSITQGVPLDTSKLSTDQRLPTYPYSSPSLVLPTQPHTPKSLQQPGCPLSLVQVQLLRWAAPKARQSHYGTHVPNMGPGGHMGNSTYHRPMSDFNLGNLEQLHPGEPIRPTWCWIPPWHFCRAWILSGVRGHMGWPPGSHTFTHPEMTHRSRPGLRPNTALPGDRPHQESPTGNAPALRHGLARRRPTRNGTHRRPTNNQPPGATRACTGQPVRAPPRRSRLTGSDMPRRVHPHPTPPHGRPRNSRRTRTPLRS

SEQ ID NO: 993381 - protein, 105 aa, Homo sapiens
AAAYYYYCSEFKLLTMYGDMILAHCSLHLLGSSGSRASVSQVAGITGTDSAKKTASTPCDFIPNQSALLAHWLPPTHQIVLKNSALQTLGETDLSNNKTLVSCKK

SEQ ID NO: 993382 - protein, 295 aa, Homo sapiens
GSRRQWKEHAHGETWPRSMVLERCDTGAGDQWPRHHTADLCREKLVVRLGPALLADPAFEGRIYEASVTSLTLQCRDRSSPQPGGRDQGTVYPLRDAVEGGVTWTATVVDTAKMHTSSPASSPPRPNAPIQACTRPQPQDGLHCAYPGESSHCDMGTLSIFAPSTPWLHQREVTVYPGISGNQGRPATRYVLNPQTRAIYLHRGSGTHVSIERTRLPFGEIKRWPGSRRPTGASFATLVLWHPFPEHWSQDPPVSLIHTARNRCTCIPVRSSPRLYSGTMVFVAGTGHPGGDDQG

SEQ ID NO: 993383 - protein, 36 aa, Homo sapiens
AAAYYYYCSEFKLLTMYGDMTSYCNKSSLFSAVNNK

SEQ ID NO: 993384 - protein, 35 aa, Homo sapiens
AAAYYYYYCSEFKLLTMYGDMLNPIHNFHYSIYFK

SEQ ID NO: 993385 - protein, 39 aa, Homo sapiens
AAAYYYYYCSEFKLLTMYGDMKKIKFLIYYKMNVVPEPK

SEQ ID NO: 993386 - protein, 256 aa, Homo sapiens
LCEDPGAAASLGPRDPHTHTLIAEQLCYECVCVCVLFLFFFFIVSKNSPEKFRVLAKLSKMSVLGKLNPIKTFGELWKQTQQKENKKQKKKPKTPQQTPQTKKKKKREGGRRGTNKNPAGGARTKSPPHPAFFCHNTGRPPTNGGRTTKHGRGRAGRGPQHTERGGREPNTVRRATLGEKTPTPLGGGEPIGGTTPHNEIRLHSVRGEHTPWGGWTGHHHSQSFSGAARTLRAPTLISSQTLFHPPPPHNNPRHDN

SEQ ID NO: 993387 - protein, 35 aa, Homo sapiens
AAAYYYYYYCSEFKLLTMYGDMLYRHHHYSIFIAK

SEQ ID NO: 993388 - protein, 265 aa, Homo sapiens
QSLSSVLTLSPDSMSFSIRSHLLHQATGSLRSLSHMPTQTTGIPCPRQSSRVASRSNARPRGWLWFLGISRVPSSSQLHTDAVHAGHWVPGASLVITPGVVSAIELGIASPATHASETVQAPWSGADLCRSYAVHRVRGWAWTMRREAQGCDVRKYAGMQLWEEQEGDAHVFKEYLGSPVNFIEINAEGSLERAFGNPFNRITGETDDPHLLLHAIGRMPDACDARMHVVESQRYEEQQLCDVSQSCGRDRHPMGSCKVLLDDHQ

SEQ ID NO: 993389 - protein, 186 aa, Homo sapiens
AGYQGEITSVSTACQQLEVFSRVLRTSLATILDGGEENLEKNLPEFAKMVCHGEHTYLFAQAMMSVLAQEEQGGSAVRRISPGSAALCPREKGPEAQARINQGPWGKPVCPPYHEGLTGSRGHAVQRSLNPADITVLFKMFTSMDPPPVELIRVSSLPGPVMQSLFQTKGYGSTRTTSTNYIHILA

SEQ ID NO: 993390 - protein, 39 aa, Homo sapiens
AAAYYYYCSEFKLLTMYGDMFMSRCSFRILELNCLNSQK

SEQ ID NO: 993391 - protein, 299 aa, Homo sapiens
MSVGVGESVEETVEILTRKLEMLGAERHGTLCVDCESYHTVDSTLGSQGGVLALMVVARDCWSLLLEIASRDPRRQPHNQGLPQGVGTDHDAVYGPSSIPMGPSTSGQLFKKIRYDTQQVPVGMGIRLSDEQRCQLSLVDTRGTAKEAASADLSGSLDPRNSGRHGHLLIFTGTSDVAIGTEEDEFRIQKKQRSSNKVGTQYLTGITPGTIVDFVAVHNGTYAEGDKWHGPLLRQPCKTVRADKGATPDPTSEGTAGETTNNGLENTSIHNVGTPNAYKEITTDDNKEKEVTYEYDECL

SEQ ID NO: 993392 - protein, 36 aa, Homo sapiens
AAAYYYYCSEFKLLTMYGDMILQYICKKEKKTKPIK

SEQ ID NO: 993393 - protein, 331 aa, Homo sapiens
TVPDTSDTMASFLKGAHVAHQRTGRRQHVEPECIHGSKVAKASVCQLQLSTRQQWPLPVHVVHPVPPVGSVVPSTAANACVLSIHHRGLVTHAPGLLGAYTASSTGSREQPGLCLAGTKAGCVAEGRPQDSAAWEARQRRVEAVEASVAGLAPARGQTAGSYRARQGSAAGASPTQGRARMETPGQATGNAGVFRGKRRQLQAATLMGRCNPRTGPNILKRKARAAGGTNWSRTQRHSQISSQGNRLEDTWEQKAGRARPPLIPLDRQQGKAVQTTTAASRKRNIIRGDTDGRPQGFGLGTQVLAEGGPPSVGSKAPSSTPVTLVRGLATR

SEQ ID NO: 993394 - protein, 158 aa, Homo sapiens
MVKKHRPLYHTPQGTANNDMISDGPLQIQHGRAHTDISFNLALGDTDDLVREEGNTCMAEQASTRSSVAVICRKANLNKAHLRTHLIESEAYHNIPHDEHNYHGLQTDKPVSRSTSTSWHERHSQTTEEKSTHIGNHTTDQWHSPTTGPTTDIPRNTR

SEQ ID NO: 993395 - protein, 37 aa, Homo sapiens
AAAYYYYCSEFKLLTMYGDMIGFKVKEIKVKSLQISK

SEQ ID NO: 993396 - protein, 37 aa, Homo sapiens
AAAYYYYCSEFKLLTMYGDMGLGCECQGAIKVSVVKK

SEQ ID NO: 993397 - protein, 36 aa, Homo sapiens
AAAYYYYCSEFKLLTMYGDMLTPPLFLSIKRSCKQK

SEQ ID NO: 993398 - protein, 332 aa, Homo sapiens
MEFVARFNMVKVSNSSKKNLKELFRKIKVGGQNFSIGLSWRLLKGSPKTKGVTQPLWRHELAAGGQSSYRCLKQKQPPETQVEPTKRKTFPPQEKVNLLCDTHGDICGRKQAPDPTAAIERSQRGARCAHRHGVPHKVIVGRQSCGAQPPHQASGGRYTYGAHYGGVQRENTGESDEAYNKTAWCSVHHQQCGEHHVNKTPRGAGVHPTNPLRSRGAVVTRQWFKEQKTKHRAAEQKTVSNGLDSANTSRQAKDRPRRGRKHNERERRGGDKKSRGEEHKHCKTEDGDGERAERGEKDEEQRANDERTNKTDRDRRHSSSMTAKATDRDGEE

SEQ ID NO: 993399 - protein, 122 aa, Homo sapiens
PSFNVILADVFRRLFAQLAGEDAEISAFELQTILRRVYGGDRMVDKNQEQEDSGDTELWIEDAKIRKKIYREIGVKGHGLHEIPTEMRKDEKKQESRMPSVNPNKVIVCSSMQMSSSVIESR

SEQ ID NO: 993400 - protein, 32 aa, Homo sapiens
AAAYYYYYCSNSSFKMYGDMPQEKLASSPKDK

SEQ ID NO: 993401 - protein, 363 aa, Homo sapiens
ITPKLVGIDGRVTAWGALSGASCVVPMRNVGTQRMSFAARGYRAVGHPASLEFVVPERQSVAAGRSAVEASTEATRSAGVLEDGIAQFTHSWRQHWYTGALTELNDALEGRVYLLYVTVGPVYTEHQEIQLQCFLYLGRALRRARELKGVIERIDAGLRESTNPVPCQRHLGFNRRILVSVSRRLQSRTRRTVMGCKLARNGSVGAHGNPVEGAYSTKGTEAFSNTDRHCAQESILRRGSEESSRGPKRQFAYADGRRGSRVRGLPVACVTGPSSSSVQLQGGQRGLLCATRDPGEPYRKRLDSIDLAVELFRSWSAWGTEPSKCPEGGYEIEPNTCGPETFGPTEADPFWDVASYAKEDLKG

SEQ ID NO: 993402 - protein, 115 aa, Homo sapiens
QNTGVVKTTPNKPPMGKEIVLISSLSSLDTLIPGESTTTGHLIYKCGGFDKISIEKFEKEAAEMGNEGSFIVLPRSLVHKLISSSVNVVSPLIISFLEIGYQPMYYVTIIDAPGH

SEQ ID NO: 993403 - protein, 191 aa, Homo sapiens
MGLGDTILPRKRRGDGMHNKLPGPILQVPTLRGAIISNDIWLIGVEPNRSNGRITGCWVGFITPPQFTGALFTRGAPGVNIIPRWARVLWNMAAVYFLWHEFLKAPRIPIREDPCYVTSREYHPHVQVTGLATHPTTYVRGEDECPASGQEHLLIQYPTERKISTRTYTQCEAGERGRQLVYPIRELNRFG

SEQ ID NO: 993404 - protein, 410 aa, Homo sapiens
WDQKMLILEFFNFKKIIPMKGVCYGNSQITNKVALLKPDPHWASLWWLKQGLSEKSAPSRSKNTSSSGATSRDTEFRERTISPSVCHLLCGKRHHHAAQRVKCAAKRELWSPSLSAGSPSRREEEVEFLHNKSVECGPQDVPGNEAVCSRGEPCGGGDTLVGKEHTTLLFCGTSQHLLYSPVYKCDLNIAVTLCAAHCVYILWGPQKCTINTAPCVRGEAARGSPSESGALYTGQISTRTQQWRCISLYPKSGAEREAHVSVFYPMWGTQKQPRPRGFCPVWGPQGAPHYCARVQPRSKQNPFQALVGWTKRPNAPKAEETSKVVAPWGGGPPNFQENPRGAQRGRGLSQQGSFKVTTLAAAGRDQWEKGAPPKKDPPPGGEHVGAHTGEAEGRTTSGEDKPPRDLCRRP

SEQ ID NO: 993405 - protein, 231 aa, Homo sapiens
LQAPGCPATGHGHLRGGSCHVPCPPEPELPPGSTTNSSTDLFSERLRVGNELARSSVPKYCAIVRPAGACGGRPMWRRFADTGIDFAPLKRKQDPARTSPAQQENPAPKAATRRKNTEGAYTSPTDQDARHDPPTETQRAQREANHAGKATHRQGRKSHESTRNKNHTGNNADQPGTQTTNSGITQEGGETPKHGTTPTHTAEGHTITKDAHKNTAHKNHQTRGSRHANPP

SEQ ID NO: 993406 - protein, 179 aa, Homo sapiens
MGNAQCETKNLIEGALGWDPNHTSIGPMDTGLGAGRLSQGVRLAHPSGGHSADTVPPEGYTKRDTGGRATHTASSGGDTPWIQKKGETGEHKKTPKDTDRRREQTSAGQQGEPGQTIVTKKQDHNWRPRQTTQGTKGQHDDHQHTQNKRQIGRVKNRQAESQQRPTSRRMAQYIITHRD

SEQ ID NO: 993407 - protein, 155 aa, Homo sapiens
MTWKSSSEKEADRRGPAGKGLVTEPNSEPQGWIYQIDRNLLPSGSPKPHAKTMKFIVLEPHLSGSSSACMCPALSMLVFVGVLLYSLPTIVSVDRIVNAYKCVDKQARLHFPRVIQGMENPAVCRRTSSCDLCLRTDPSSHGYAMSPSPLIPEGS

SEQ ID NO: 993408 - protein, 47 aa, Homo sapiens
MPTSRLNQTQNTSRRRNDAKNKRNNSNREEDTTVVINTKQVNQTFAN

SEQ ID NO: 993409 - protein, 536 aa, Homo sapiens
ELHVLWNLLQDSQSLIHLHSQHSPKNLTYLMGSIFFFFKCASTSIALPPTRLHIYSIAPVSNATPALDVFRAHISTFFHYIGHFTIFIFINSFLHRSINTTQHPSHCMHQHLTHHFRLLLCRVHHYPTSLFSFTNSLSLALCSQVCPTTLSTMICLQRAHVFSHMAKFAFHRQTPHSHTDYHSTSSPTSPSPTMVIQHPIAVHYLSNKYTRPYHRYVCIFAHHLIFIYFLAYLTRLAYSRFLYTLAPSFNGAPYSLGCSVTITTHSSLSYFPSSTWHYGPTTVHFCPEPELARRLNLTTGGHPQLLSDNNNIQQPEPTPILIQHPYSPPTLHSPSPSHHTHYDAQRASQPNPKLDEQERTGDADGDARLRRDRPPHEQRPRGEVRGVGDERASGTRASSRPTAVCEETRCSADDPWEGREHPIGQDEQRRRAGTSETSHRPRADWLQFNDTLRRIFRACLVSALSSRRRVAVAGDDEIATIASDPVLCGRSEEQVAVLSCTDRITHHNSHNAVMVGLDVSTQRRSYKIESTHTLAT

SEQ ID NO: 993410 - protein, 86 aa, Homo sapiens
LLDALGLQCLRERTVGQSAPSLTNHRPLSPAVFPKCRFLTKLDCMDHSLARSTSGQLRSFISSMSALHMFLMHMTPTQHNQHHTQQ

SEQ ID NO: 993411 - protein, 148 aa, Homo sapiens
RAVTNAHKMKFSDLFSLCVRTMRTLPPMPPNEPAENACSVQALDSRNDMPHMPPNCRTTESWLQQVLHEGGMTSDNRMPTKYGNDKPGPLARLELVTDELDVPLHFHHSTHHRTSDLTYYPHYCGDFQQASIHAALQRRIATGATPPL

SEQ ID NO: 993412 - protein, 298 aa, Homo sapiens
MLDAITALTTLQATAASMLGFTAVVIVGLAMGKLYVQRLQPDDHFPASRPYNLSFKNMCKLKPLLEKWLNDAETMSSGLTALPSPNQLSSPSLGFDGLPVPETHDEDQHRDKRPLRLTATSSSSEPEAYLRGDPADRRARCTCPRKSIRVYVCNRRQTDNPLHPAEAAHAARPRKPASYSPIMRHPKERCVRPYRVPKTHTSLDHTVTYRISQLVVMLYQQHTHEVIIQCAVSSPHALHADLASYRTQPTAGSRKDDTARVTTRYSSAHTCPVISHHAIYPLGLRVSIAPHPVWYPEH

SEQ ID NO: 993413 - protein, 350 aa, Homo sapiens
MTTCCPPRRCCQNYHHVTHECLPSTCHDQPVSSTASYCLPVHVLLLLTAMMWLLKQLCPHTFFTQSHEEQGHMLQQHCMQAAATTCRLAAHLPSGISRQPRLVLTWDQRGCTAPALVHEHLGTTHVTSRPLLDTGTQLAHCPTPCTLHCGADFTMPTQFTLTFIQGELAITTTLALNYVAPACRLVISRPPNSGVAGIFALRKCHPHATHTGLTSHPQSIRANFRHNPMRWPFRIPQVGYVILGDFLYLSHLERILHIPSSTSTRSPLSQTNNISPPPPHPILTHITHPPPPPRPHPTTRQTTLSPHTLSHYSIPYPPQLSPHPHPAITHPHTSYYISTNPHLFTSRPFA

SEQ ID NO: 993414 - protein, 113 aa, Homo sapiens
MSFENTLHTKCTHVQIHMKNRTVEIPYTPMYRFTSLPTYLHFDPHITATPFYTPSHTIHNIPEVPPYFPYSPITSPLYLSHIHSPQTKTYVYTITMSLTQPTPIIYHNHALYQ

SEQ ID NO: 993415 - protein, 159 aa, Homo sapiens
MDPLNAVALQTADSPRIASLWNAQLPCFAAFSLCLITMSTNENANTPAARLHRFKNKGKDSTEMRRRRIEVNVELMEQLRTDDQMLTEAHNVSSFPDDATSPLQENRNNQGTVTYGLLMTLSNVHTHYCRPCGNTSRSNATFNAASEHYFYQQTHTDPA

SEQ ID NO: 993416 - protein, 363 aa, Homo sapiens
DVYKEEMNENEEVINILLILRQNEILTEQEELLCHGMQFLAAWIALPQHNTASSISNALQSVSIVLKIPESPSEPRAKLSTAGVLLTQQRSSAAVECMQRSDACLDLFMRHRTFTSRQQHTAQAACATITMTPHHIIAPSTSHISNCMASLLAVPTYDSCMHGRPIAIHCCVLTTPAIAKTEAPKGPRQAYALAAAKSRARNSRTLQVGLAESDVRPRYQAPQARIDRNMSRTPYERHKHRTRLLTNSNANNGQRAPRNARAKSRHTSRPNDNAELNRHTGRHQSPIPLEAPVTHWRYETRVIIWNDTRDRHTVVHNEATPRYANSVYPWLTLPLDAGALTRDRRTLSLQHIITTLSFGQQTS

SEQ ID NO: 993417 - protein, 106 aa, Homo sapiens
MQCTGMTTSAVSGPISECGLLSMDRETQLCPGVFGFITFTNPEHASVAMMSHELESTLDCVCQILCVIMQASLLWGTRGGGFGAHGRGRSYSRGGGDQGYVEWQVL

SEQ ID NO: 993418 - protein, 162 aa, Homo sapiens
GRAVGGGVVGGPEPQDGFPSEWTRRRRRRRLVVSEEEEEEEEEGDEEEEEEVEAATRTMREDDDEGVLGRGAGPRPGAADRLQSPRLACSPSSPPGARLPVCRFACRRWPGVCSPASRLLFPLSPHSVSPRSGRVSPLLGRSRRVHGPPVSLPAPPSPPPPS

SEQ ID NO: 993419 - protein, 526 aa, Homo sapiens
ARRCELKGHNTLPSPWQRPSHGVSHCCSLRQCAQGNAFQSGDGHHYVHAILADARMRKHWHPVRLSQSTYTPTPPPHGCTNWCIYSPPYEHTTPPALLLDIHSTPHSTSTFTSCNPQLHTSPRPPRTAPLPNPSCPSLPHLPTLRSRPPTLAHPALPTLAGHATRAPAPSHSLPTAHLPSLDSLLYTHAHPLRSPDPFCLTPTPLAPAPCWPSPTTLPPLPPPPAPSLPPTPPTGPPPACSPLPSPALHPSPLPPPYPPPAPLLPACPRAPHPTPPCPPARAPPAPPHTPPPPPPSLLPTHPSPGCASPLPRLAPPPRRAPPPPRPPTPPPSHCLPVPPPPPHAPSTPPPSPRLPPSRLALGPRRYPLRREPSPSVPSRHAPLPDGRPSARRHTRLYPRSRPPLACHPPLRPPSLAPPSHRPQQPPHPPSPPHTPPPPPLPPPLHRLPPLLPPSPSTITHLPYTRLPPPTNATTSPPPTTSFATHSPPLTTTLLSSPPPYTHLHLHHTTTHPSPNTPHPPHSPQPP

SEQ ID NO: 993420 - protein, 548 aa, Homo sapiens
ACACAELDVWLGRCRWETVRLPWGPVGPLPPPGPPAHGPSPPRLRRRTAWRVQPVTLAERRRRSQDVARRPCPKPTISLFKFLAYWKCRELANILLTSSDILKKNSKMTQIITIGVELGTKIINVRGEICKVTNMGYRNGQERYRVRDEKVITGGRRQGAPPRTIDITSPRHLQCRLLIGFTDCPNASEQKHVIILVEKEGTWKQIDEDNQQEGTKNAPEHERQYGNKGPTGAHLHSAETGAATDDTNRDGPKKAGKRERRKAVVSATKQTKEMRSDQYGPHTRRHQYCHQPNECKQEANISCVAGADKGRRRKKQRKTTENIEKRQGKRRKQNRREQKRRRAKSRHGRNETQGKVKQEEGRGRKRKEKEGEKPQKKKRPQREQETKGGPRERTEDTEEDEKKKDGQKENQKQPERRKTEKRKEKGDDSKEKQPREKIEGTKRREGDRNRQTSTEPKNDDRDKDNEKRRRKQAETTETGKDEGKEEKEQEREQREEEKIKTEETEDQTARSKKTENETKEEKKKQTDRRRQANTRRKKEKGDTQHEDE

SEQ ID NO: 993421 - protein, 280 aa, Homo sapiens
IAHLKDIVDEITSGKGKLTDKERHRLLEKIRVLEAEKEKNAYQLTEKDNEIQRLRDQLKARIKYYRMLEQLEEINERRQNMAGQQVLTSLHLQSKDVLKQQFVCCNLTDIAAYLKAKPITLRLSQTVAPNCFNSSTEIHIHDHGYIQLKDALENNQQWLCMITQRDVYVTRTFSPRSCSRITKHGHQLLLHSHSRPIKPELRRLSSHERDARTVYDRISLAPGAKLAILSVWTEQRNNLALTILTLEVGRMKRTHCRNPLRMFPLNPVTTYQPKGTCRNL

SEQ ID NO: 993422 - protein, 70 aa, Homo sapiens
MAPRTLVPATLGGPGLTQTWAGSHSMRYFSTSVSRPGRGEPRFICRGLRGLTRMFVVFDMRLTCEPEDGA

SEQ ID NO: 993423 - protein, 220 aa, Homo sapiens
MTKAGKSEREREQKRDGEARRAAGEEEDKRKRNEERDRARRGRAKQTGKRDKRAGNRTREGKRTEGRERASAEGEREERDTNKKRRRRRQKTERKQEAGEEKRGERKEREREERGGEDRRETGKRRRRQAKRRKEEESERERQRDSSASERRTKREANKRKPRQQRKRRRENKQRTHEGESRTSRRRGERVKEQDEERRETKQQRAKEARSTARGRRETK

SEQ ID NO: 993424 - protein, 352 aa, Homo sapiens
LSGLAEALVALHLLLMTVQGRPECTPPGPKKSVWHGSVTPTGLQADLRATCETVCWTVMCSLWPLGHVPPRCLGGACAPVGQDVAAMLAITAYICALHFENSFMTCLPSSPPALALRMCREAGPGLAPTRDSPRPWATGWRTVPGPHGHQVTLCLPIPLPSNEDITVFPVTSVQTHAITHGRHAPNLNGGYWVCRPMVLNSSTNTDTRGRVRHPLGSVVPLRRGGRPTAIHGLYAPAIFLICDYLEACWCPPFTYVDKHQVIHIKPLVGPVVYPASVYVTHSVIVLALGVTSTSRLRFWCDLSRCKWWQAFTHLLVWVCWKHYILWKRYISFHVVNIVEHKKGERMMMIYIK

SEQ ID NO: 993425 - protein, 280 aa, Homo sapiens
VGGRHQGQQPRRRRRRSCGSSKDINDAEPAQARVISASQIQTTSSTFNAGSSCILTAAASYKQLRKLCCFTLLNGWDQGLTHALNPTTRLTAADEQMATITPERLQPRRGTRSDTSKQSIMSRHLAQLSITLTDLTPHSNVILGPCEVVVDSLRSPHTTRETPTAAQRNGQQHGSMHDTTLAGMITAARHSATPHHNAREAWAYHSGIQPKLMKPASTDNYAQGRTTPHPMPQAQQSPLRHPPCQHYCLIWTESTPGRSRRANRAHVAGSRDEERAQYPP

SEQ ID NO: 993426 - protein, 348 aa, Homo sapiens
VPSPWRDAFPELKKDPDMVKEDALMKKRCSILKTLSRGRRILDRQIQSLGESKTFPEKLLWLLYDTYGFPVDLTGLTAEEKGLVVDHGWLSHEAEDTGPAEITGQGRSWWGKSLIHAGTILPLSKSSGAPGSATSQMPSPKVKFTMLDSSGRYVSDETTVGPPALMAHAPADKQTVRGPTVSHTATHVRSTLALPTGTSPYWPAPKGAARIYERTATPGEAGMTAPNSSHNRSTAHHRPPARTSRRPTPRTHIRRPKRRNSTPETETPEPRPTPGTTQTHVRTRTHAWDRTTARDRPTQNTPARHQQRDDHHPTPPPHHRTKHKPQQTSNSATPPNNQNTNTEHNTRN

SEQ ID NO: 993427 - protein, 71 aa, Homo sapiens
EELLFMKKNHEEEVKGLSKLQIASSGLTVEVDALAKISRTSARMIIGMIESEVPNIDLSLGSARTREGSYD

SEQ ID NO: 993428 - protein, 96 aa, Homo sapiens
MCLSPCAPRGSQVPGVGAQEPPHMPVGRAIPTLQCRLWDAGPHLSLGSPCGQSELQSSPKLDDSLRTLWQDVWGPEPARERESRDRGASQNHKTLG

SEQ ID NO: 993429 - protein, 270 aa, Homo sapiens
MYEHVGSNVLTDYLLTHGVNIMDNHSQHCKGPLALMYQHRLLKIVSSHTSFTNFGIQDRQTFKAILTHSILAERYEGQLYMAWQLTMPGPGYSGTHTTMHFVSMAGSTPVAHTQPLANYPASTRNSRHHLRTTRLHTPAAHTVTHTPQPLAQETITGTLGHQDEHLHVIASAKFWFAPPSRSSGPTSPTHLISDTLNSAYIDTPPTNRFISTSGHQFLVYTTSGVRQSPLSHPPLQPWPYNSTPISGVLSPGPPTFTTGTPHPKSVGPLL

SEQ ID NO: 993430 - protein, 35 aa, Homo sapiens
MTTQKTGSRTGSQQQQEDEKTPTKKQTITTRHEKH

SEQ ID NO: 993431 - protein, 346 aa, Homo sapiens
MLRPLQTERGESSLKTRLAWAVTIDTLQAPDTMQAIKCVVVGDGAVGKTCLLISYTTQCLSLESTIPIVLDNYSMRQVVAIVWVQGNPRCNLGVLMACTVARGRGGTTTRHRLALLISQTERFPHLLFPRLTPVSYENCPDVQDGLPTKWRNLLPQQQPSSWWAPICWTLFWTINGSLIRRKREGTNERLAPMNYPEVLASVPWRLTSGEIPGVHQILTQRMLKYRGSTESSGPCCDPHGQAARKKGVLGLASGVWAEAPTLSGFGLRVRSLGCRAPVAPLAPVGSIRGGSWAGTRWRPSARPGLLVCHPFLFREGPDYTRGVRVIRSDRILGVVTRLPVEAVDVS

SEQ ID NO: 993432 - protein, 59 aa, Homo sapiens
DSRYGPGLGQPRLRAAPVPPVAPRQCNKCQESVKTDVVYGSYRNSKKWWVVVRDTRCGG

SEQ ID NO: 993433 - protein, 169 aa, Homo sapiens
IIFGHNRITAEMAGENNTKKSSLGVTVIRGSSVTDQKLQGVLWLKDDGNEVLEKALFTLASIWYLLCSLKEKHKVSRDLVCYSPAGIMSTLHYGAGLSEQLQSTYRLLSGAEASTKSRRNLNISIYLGCDDVRTTASVGQWDPAIGKYGKQLYMKLPMKSLDRGRDVKL

SEQ ID NO: 993434 - protein, 229 aa, Homo sapiens
HTVRIYEGYDHPPCHPASGTWLGGICLHYLMNDPQRATGYSFTTTVDRELVRDIKEKLCYVALDFEQEMATDGCRSSPGRKRYEADLTAKVITIGKERFPVSWGDSSSRFLAWGMGGPVGIHETTLQLHHECVSVDIRKDLYAQHSAVGGHQPCTLGIADRMRKEIICPGTPAQMKIKISCPPERKWLRVDRGSMLARIDVPADVDHAKQEYDEFGPSNRPSEGLLSGL

SEQ ID NO: 993435 - protein, 155 aa, Homo sapiens
MPVIIYMAMYVKPNATCRIGHEHHVTTKLIGAHGLEKLGEVHLHTVNCAVESYCKYLSWDGQSESLSRDFVYISHMNVLSIVEIALHLDNSWAKTSSCPPRFLATIFLFSKWFTKICQVHCNRVESMSKNQFLSISLTILVKHLYSFIMCVYQTD

SEQ ID NO: 993436 - protein, 373 aa, Homo sapiens
METPSGPTSSCNEERVMWGGSTGQRVGRGLSGWTVGGGGGLPQPSFKFIAIPCDTQDNMCRVCLVQETKGSGGLFNVQQRGKGPRNQSSVAFPRSAHQGAAGATTSFTRSGGRRPLSKRPRGPLVQLGFGEPWEKCKLPLPISLYTGSLVSLLSTSFQRGEGDHEGPRGEIPPGSPEGRKTRGGPKDKGGIGPQRHVGGEPRGGARGGKNTWGLSPHSSPSGEEGGGTSGGTEKPPTNGPWDTTVGGSGVVNYITGGAPFLAKRKRVHPNQKRAVSPHPLSWAEKGVAQSTPRVKRRPMEVFPTNKKVARRETHRESIGGGTTQRTYPGWDLNEGTQGRDQPRRRERKHNPIGMSPTDISQREGATRSATKNG

SEQ ID NO: 993437 - protein, 276 aa, Homo sapiens
FRVESIVQAMKSQFERDSAVVRDLSRAEDEEEACWSDRCGRWMAELEDDEEKQSLDGMWPPGMKLEMDLNDLEAHVDSANKEPGRSHQTAAEAAGPDARTACASLDDTRASREEILAQAKENEKKLTEQMEAEMIQLQEELAGPRSVAKRQCLAGAGMSWLDCRSAKQHAAQGPWRKRTNRGLEGPELASLHGGRLAERPGATRQLDLRPVDARPTCRIDQINSEPELVAQPGPKRTSMRRTQLERPEPGTLKVKHAGRLTGPVNVHINRASITRP

SEQ ID NO: 993438 - protein, 132 aa, Homo sapiens
MAFRGLGGKRAGLAPCVTEDNYFRGISASLMEEDGTQPFVRESQNYYRHTEGADTPKATGTKGHNVHNARPTRGSFPTGNLTVRKRHYSKQVVHMQRHTRGTRRKISRPTKKYPDQKQSDAAEEHNRESHIT

SEQ ID NO: 993439 - protein, 129 aa, Homo sapiens
MAHKRNRSRPEQQTTREDKRGRHKPGADEDAPQTHNDGQRSRTHTHERDSTTVPDKNRRPSGWHATKGRGRKHRAREERRKRRSDARKQQSRGQGRESKRRRKKTKATKTREEEAGDEQQRGEHEKDTG

SEQ ID NO: 993440 - protein, 72 aa, Homo sapiens
CHDYAICKYAFLISTGQRDTVLDPSQKPLQRLSFQTCEITYDNSVLPEEPSVPDNTTNCICWCQTSASEDMT

SEQ ID NO: 993441 - protein, 358 aa, Homo sapiens
PVQVNVGGQAQAVTGSIQPHQCSGQICNTAVVKTQEDQLFYSLFFTTTVYHFQQLSAFGISVPNLDYLQTEPDGTQTLDLLCNFSIIQCPELMMDRHLDQFINVCHICDGKGHHKKHHVLPATFMRKHQDSAAGPEPRCIAQCKDKRGTTNREANTRQKGISRSRSGMLPTASKKKIRTEHESPGPSHEGPSTHTCQDTKRPSKGIHTQQHNSAHRCQKTTMGKKRREGRTQTDHTRKSLGVNQHHEHRPRKYAQGTHARHHQSKPHPPEPPGPTDKNETQNKQDKIAPNTPGHKAPPENKGCETQPENNPTGSSTPQGNHSHEQPTTPNRQHPPQRSNTTQPTHNRHEHTKTQNNAS

SEQ ID NO: 993442 - protein, 169 aa, Homo sapiens
MTGQRSITHQYQMNATPRKTLDRHILPQPYPNPLVHLHDPCWQFHQRTTLSHVTITMNIVDVEQSRPHALGTGKRTKGDIDSGRASTKPIGYPLVPLLHGQRRTSHNTPQLHWTSGNTPAHHTEPHSRHSVDASLHDSDQTITPDACNCDKPLKSFLPTQDYPISNNQL

SEQ ID NO: 993443 - protein, 146 aa, Homo sapiens
MGDCSGKLWSVCVATMYCEASVFISGWRHGHERQECPVCKAGISMREGSSDFMGEGARSPRIPAFKNSTPTTGPETQLRRARGAHSSHTVIRGSIPRYYIMDSRMTYTTLGLINNQRTFQCHMSPIPDREYQSCGILGNHGIHPRP

SEQ ID NO: 993444 - protein, 30 aa, Homo sapiens
MAIEKPGASVIYRHIAGFRAKIPSVRAIRG

SEQ ID NO: 993445 - protein, 259 aa, Homo sapiens
EKAEKGAPWFRKITNASIPAPPPSRSAFFALTRSIVIMGRRGPGLIPASQPQRFPRRISQLIGYLVDPRMLCIQWAGNSSQSYLPHAPAVPMFPQPALWHTRPKLPSTGLAPNAPDARYLLSTGARSAGSIPRVTNWPETPFSPEPATASPQQVPIAPVWPCSPGLSHKCFTCHTHLGRQLSRAKSAEPPVHPLLKRVQSAEKLPAATGRSEKKLASSRKHSFDCPNADLKEGTGGPGTEPPGKKGTQMYLAGQRAVQE

SEQ ID NO: 993446 - protein, 242 aa, Homo sapiens
MACSFSRTAISGAGRCRVSKIGATRLSTSSSRKGGCATCGSFVDGTAVKQVILPPVVRGMDSCSLEIANCEEPPGDFKYQFDAFYGGEEYYSMDIYAGSVQAHPNGTCWKGRMPVCLAYGTHRELGKTAHNAVASPEHTWGDPGGLSWTFLSAPQGMEGAEAVHGPFSVTIVLPRDLPGERYEDLLEPCFRDDPGNPRRLPGGIVLIPGSLPERPILVALLHFEREIPASKYEIGLVGSHPG

SEQ ID NO: 993447 - protein, 350 aa, Homo sapiens
MVAKLDQGIEDQSYGNIQQAGLQGGSTTPYVGVVRCVELYSSTNGPGFGALLQGSPGETGKTSGRLWGISTQRGHHPQKAIFGGANTQGDCGLACVGLTSLLDNPGTDLVFWDPQKDKTPYNVYGEHYAVGAGVGTHTHRAPRGRQDAPLQQGGDDQGKHPENILPPNKRKPNPTNNGPPQGGWGNNAWVQRAHGTPRGANVDHVQITTHTTFGGPTTGANTETKGGKGLYPGIVITLLGRLPGRAKEIRHSGHGEGEPQRKLANTIYTRKRAGGNQNQQPPECSPNNRKMREDVTRPRTILGYNETHHKITTTTTYYTQKQRTIDHHSQSDDTLGQTETKDSPPNTYKK

SEQ ID NO: 993448 - protein, 151 aa, Homo sapiens
AHGFDVSRDRSDADAIEEANKGRLELPLCIMAQLMEDKKESAYGEYSRSYSHVQYHRQLHMGVQLAIYILGAISVPFDTTGATAFGSSRAVKLLARHPDNTYSDVTHKDLLGLCMPTPMRAMPCKGKAVAVVTKHGPRYFNQTHSGASAHL

SEQ ID NO: 993449 - protein, 116 aa, Homo sapiens
MLDPRASDLCIRKRERAQDMNLLENATMQDNERYGERVWALVQIKDQTMQEESESPVERPLNENPTNKMTQERTSTESSTIGQDQTLMERDTEVVQQQHYIAMECIASHLHLYSEQ

SEQ ID NO: 993450 - protein, 69 aa, Homo sapiens
DREVFGPYSRIQRVAHDEQVVESRFTYVLSGGNYTSHNPTLYGPKCIIIVPISIQARSGEATYTKYERV

SEQ ID NO: 993451 - protein, 348 aa, Homo sapiens
MSIHAVRLIMVDGGGCCGCDRSPMVMLPQALSQPILTTNLMAPGASTGPPANAEPESIPGAVVSTVQSIPDQAKQRTVVTVRDGMSVYDSLDKALKVRGLNQDCCVVYRLIKGRKTVTAWDTAIAPLDGEELISRGPVTMSRLTMHNFSTEDLLSAWRTVTSALSYCTMDFRCQTCGYKITTSIVPIQGPHRSVLNEYQPPTVLTTVFQDTRRRLQTAMRHPINTATLNDKAKTTQSTRSASKTRHTEASGEGEATEPRPGAEKTRRERRRPGRGARRGEKRRDEKRGPARTLRRDTEKRRRKKSGARAGTETGQNEGQQRQMRDADGAEAEKEGTNAGRRQRGEKGA

SEQ ID NO: 993452 - protein, 320 aa, Homo sapiens
YRPRKLGDIVGSRPSGMSSVLMLVREKERTTKEHTIDLNSLLVLLVVCVTVISGSPASLTGDTPLRTSSVTEPTLPPYVAAENLVAPRRELERTTLEWTQSTTTHDHSLPSTETQQAKECAGTETITKKGHTEATHQSSTQQTQNRATTSTAIRDTTERKNSRTKTDHNKNTPNTQQTRPPNREHHNSPPRRTTNTGKTAGCSRTAETATTDRRKRDTREETTSHNPRTHAIQKQHNARENRTKTPTATRQTNQCNEQHTFLDRDNKTHNQNKTHEMNTKPRTTDQQQHTAPGQRINNTQPDKNSNHKKLKTTTRQRETR

SEQ ID NO: 993453 - protein, 78 aa, Homo sapiens
GPGDKFTGDYVEPASITITLLGILVYRSDLMFLPTMPRRNNTIAFILATSHNPQQPSLFSQYSAYAHTSLAACEAAVG

SEQ ID NO: 993454 - protein, 164 aa, Homo sapiens
LDQYVTTRSPASISKSIVLQQELYKTTMSCCHWYQPSPVNVVGSNVQLKVSTPSISSLAQPQLPYTQAVLQCKVPFQGHHQPNSYSMDKSNQWFLHRWPQAMFKSDDSKSCFRSMYNMQPILQTAMSSGQPVLQEEEQDNNSDSCGLSHRVSSCQCSQSSPRHN

SEQ ID NO: 993455 - protein, 114 aa, Homo sapiens
YDSFVYLLYYTFHCHFRMYFFYLQNKKVNCKMALGRSFRRYSRSHCYHRRTAPCVLLPLKTVGQDVEVEDSDTGDPDPNVCNVCVRVFILRKRFVQMYSVFEFKLSVISRVKKL

SEQ ID NO: 993456 - protein, 36 aa, Homo sapiens
AAAYYYYYCSEFKLLTMYGDMLLPSSLGNKARLCPK

SEQ ID NO: 993457 - protein, 33 aa, Homo sapiens
AAAYYYYCSNSSFYDVRGHAILHLNKACFLSVK

SEQ ID NO: 993458 - protein, 48 aa, Homo sapiens
AAAYYYYYCSEFKLLTMYGDMFLKGILVFENLYSKSNFFCQIKMRNTK

SEQ ID NO: 993459 - protein, 126 aa, Homo sapiens
MLPGGASPPFFKGGPQMSGVFFNKNQHARAALIKHDWVRSSQQGSYTPWTSVGDDRPPSMVGGGATTSCASTTTIHDSDLIPPLKRYLKYKLSVDGGQMCVATTPVTISFSLPVGGSNTFVAYSSS

SEQ ID NO: 993460 - protein, 437 aa, Homo sapiens
MLLKSHHHSLISSTQGHKNCGRPQGPLPRKARVKVRSSVVIGGQVDERSRGRLQSALRHLKFYNAPIGACKEKHLRGARRHRQSSTVDSQDEANMVTSEQLKLPSTKKAEPRDSGNNYSKLTQCSYDKYLEQHKGDHKPREQYAACHHQLTRYTECSAESNPTKLREQTTEPPSNGPRLTSAGHRRTTDKAGPNRAHDQSTAERLNIAHRVTKSSHSQRHTLTEHPPPHALALTPPNLPADAPPQPHPTPPNHQNHPGHHRTHMPPRGQDASSPGQTRTGAQQPPRQDTKELNRPTATQPPSTPPHQPPPQPTAPTNPPRHTARTPLASEPSKSHGTRLTHRDHRNNAYGGSHHYTSSRNPSTVLVYNSITPEKSSKQSENEARPHKKNRGGNRRRNDIDTNPKREYTTHNRQTYRESQQKLHTHVNSRRLTLTTPP

SEQ ID NO: 993461 - protein, 313 aa, Homo sapiens
QTSESTNHAGAVGGPCCQDPHPRGIGVWQMRHRSRASLRAKKLVELSQASQRILPGCGGGKDLLERDFFCHGETGFPEPYLFLGRERGWEATLLGTYAVKDQQRCVIVTEQVCWGKVRCPLSLRTSGHCVVVITRGAGKVPPLGGSESGVLLDQGCEAAVGGGGEAEWGTASHVLLYLPMLNSKVFSQHVSGSMVPVHESILSTLGNLTVALLSRLELLIQTAVLAERESVDRFRQVANVRPAVDLCLLTMARHFRALSQKRDHGKAKALALRECRLYNLVPLIVQRRSARVPEPTQRRPLYIHGAHPLPSFK

SEQ ID NO: 993462 - protein, 104 aa, Homo sapiens
SKGMWCELRLDGIHTPPLTHIQIQVRKAGLFQAPFQDALASRFCRMRGRRCVGSEGEVPGLAHSRDIWSRHGLRFFQSPKPLLHRAQRLVRKPRWTQPLEEWSN

SEQ ID NO: 993463 - protein, 330 aa, Homo sapiens
LPCHPSGALSSRKAYRKQFWVRYACMTEEVDRNERGTDGKAKIRRNEKLQCRERRYGGAPAARILPRRRPRTSISSAYRDLSNIAIEILRQQSIDSNTQPRKYVPTRYSTTNNTAKSRNLRKWTAIERTKPCHIDRQRQDARHELAPHVRSTATAPISQKRNTTQTQTAIELTNRHNELQRSVKQIRGCTKHNDNSDAIGLTQHIMSTKTNSIGAGQHEPRTDAAPINSSQTQTHLSSSDKQPRYTNTSRQFQATPYGAYSAIKQDYLQSEVQSMHITANPQRNDYVPDHVNNRTKPKSTNTYLYSNTTQKIIRPASLPPTLQSHHHHQQ

SEQ ID NO: 993464 - protein, 185 aa, Homo sapiens
MTEQGIDVPHLRKTTKTHHTTKPQQRTAPTTHTPPQHGADTHTPATPACSHTPPPPHPRPFDTLNPHPTSRPTCKRTTTHRPKNERDQHSSTPPERKPNHNTNTWRQTAPHTRVNIHTTHAQAYQPLRGTQTQHEPKQKTTHRRYPTHHPRTTSYPRLHQPTTRHNCATQTPTTTPPNPTDLRNN

SEQ ID NO: 993465 - protein, 164 aa, Homo sapiens
MEGQKEEKPYRQAQQGDATSYNTTATDSRTGKKRARRPLGGQHLCGQPENHCHQLSVEAGEHHTRAGATKPHTPTERRTYNTPPPHSAASPSIKQEVNQKPGDEKTPERAPPQQRGAQSHIRAKSDRAPRTPTPISGHTHKRESRKGNHLIRQTTQQYKTLTTT

SEQ ID NO: 993466 - protein, 217 aa, Homo sapiens
MHNANPHRTHPNPPPKHRQGAIGKPHTNSNGKPGCDSETTRARIPGGQPPIIAKPSRHTHRTTRTTRSNDTRSHRGRRRKRAGQTTRRHPAHPRSHAVTPDAARTRYEGKPVGPERRRDKERRDRAYDHQRSYSVDEQERKTERQKRAPITGQYISMRVWLQLGQRKQGDDKTRRRTGSGGKDARGEHGPQQRHTTKTRTDRAEQGERVRTNKDQGD

SEQ ID NO: 993467 - protein, 250 aa, Homo sapiens
MTFIFTEVEDERPWPRHTGNVVHHKLSYGLPTDRQDLLSLQRWPWKYDRSSSPAKESGSATWTMTNYVNLRGPVAAAGQLAAHAGRLRRQAQPGQGAIPRPWSWVMLENNVRPVHFCDFVTGGRLASAIRRGLALKMSPWCQRGSLHEYGGRGSGLPDDCEASGYHRGGLLWCAPHTQAGSFHSHWENLQQGATSEAPRAGDASYGCLKTAEATREGAFRGGEQQGRPAMQLTESGVAQAVRAGEPPGPV

SEQ ID NO: 993468 - protein, 225 aa, Homo sapiens
GALRKPLTGQPHYFCTQMQPRSPCSQGPDTAPRTSPPAGGSQRPPGVTTENVRVRSVAEPSEEEEEKRGGNARTKRTQVGSMVGPREARSEAGSTARRKQPQAEHLTLRNRELCSPPLIPLLFPPLEGAALKVDCYRGARGKLSITPRGITFHGPHTLVQNSWQTIPKATHTDTHLRSRPWGGLPSKHPGTGTHLTNKQARDGAPKGTQQGSAPESAPTGCVQNS

SEQ ID NO: 993469 - protein, 320 aa, Homo sapiens
LNDGSQCCWGRGGMVDSITQAINQLDEGPMGEPEGSFVDYQTNYGGTAKDIAVTVQEMVTKSNTRPEELGPLANQHEQLTYGLSGPSEGQACYTVAAENEEMRFPISNTGYRSWAMAVPCLVTKARRLGVQPLSDAYTKKELKSVPGEISEKGLPRPGVRLQAGESVGTQACITVAIADVWYHLLTSYRQHHVRSCGTLNREGTETFADHREGILKLLKVLVEETRSGCTRSVEPGDSWRRRPMLRENQYRARGCGKPGVASRDARNRKPGGIAKEEKVTKPATTKADAHRNCETTVAKNALKTRHRKTEKSRTEETKEG

SEQ ID NO: 993470 - protein, 72 aa, Homo sapiens
RAARLPRTVTLATWPHDAQKCSDHSKHKQPHEHSIQVLPRTCPVTPRQAPVPPYASPSTRSHKPGVSGPALW

SEQ ID NO: 993471 - protein, 124 aa, Homo sapiens
MEKAHHTACTKNSVTKDKQHTTSPESTHGHPHHTTNQDGRNTKPRHPATSARYHSGAHLRVHDRNQEMAHRNNNATRPHHSARTAHKNDGPPTGTPTAGPSTKQITTNNRPNRRATTCNQRYRP

SEQ ID NO: 993472 - protein, 105 aa, Homo sapiens
MSEAWKKPEGVRTSKSHCYRMWTARKASIGRENQEEGELSRARARRVPENTEKTPWRLHRIRGPSRRWERGEKRKARPGIKPDAGRAAQTGQQVHNGEKRGAKKK

SEQ ID NO: 993473 - protein, 153 aa, Homo sapiens
MTRRAEDSEHETTRTTRTETEREQKEKKRRRRKNREEESRGTHKRESGDTQEGGGGKERRQGRGTGEKSKEGGEKRKEEEKRARARHERERDRERTKPDQKRRDEQRDRRARKERGGQQEKRGRARREDEKEEEVKRKRGGREEEERRERGRE

SEQ ID NO: 993474 - protein, 117 aa, Homo sapiens
MENQSNEIRPPRGNNRALRALKDSKTRGALRIPMASERARRGKGDKRPDREQAQGVPTDENRRVGIRQGARQSPEKRPQGRKNHKKERGRPQASHQRRCKTQQSIDEQMKQPTHTRT

SEQ ID NO: 993475 - protein, 32 aa, Homo sapiens
MCPTRRYNTENREGGRKRANDYLREKPAAFLS

SEQ ID NO: 993476 - protein, 194 aa, Homo sapiens
MPHASSDDKDNPHDEATWIRGPLGLGPKWSSELTLGTPEQRGLSVKRLCISSGGEFGGETESPLSLAPGLSMTRETSWAGARRGISPLLLLLRRAWIAPEVETEKPEEKDVQDPLIIFLQSSQGPGRPVGTGHLSRIRLFLVPAPGSAAGWWVSAATSYCVASRGTTSRGGGGRPGRTSRVSRPQTQGALRPFV

SEQ ID NO: 993477 - protein, 146 aa, Homo sapiens
MQNSYRCPHLPKPCSTLTWPTSALNFLASARDTGTQPWATWSRGGLRAPESDNDIRTARSELFQKGNITVSLYWSTGLWGPVTGPMWAQKILAREKHHVTVVNRKRLVNSHPEDKTSKHNCLRSDNDSINDTEPHCYVPTSRRMMR

SEQ ID NO: 993478 - protein, 148 aa, Homo sapiens
MTAVSWVNLHRGIRVNPMFFVCVLSCDHSSAKLREMSVVAEVKECSQKCIVLCKWFDIIIEQFFLDVDHQKHVPSAYHQDGDQMFHQMTKKSYDVPESLVRCIGRLRLGLLAVYKKTYTSHLVKDTFNRGASHLETWGESIDAVREGS

SEQ ID NO: 993479 - protein, 71 aa, Homo sapiens
MGTEYTKYDRSAGDTTGLYSYSETNQGHLNGRLRGNPTSQRDCHAVILLPIMGLGMNYSIIMKLNETRQPR

SEQ ID NO: 993480 - protein, 250 aa, Homo sapiens
MLTVETGFDKALSSSWENRGQTTQNTRGCCTNREAHTQRQTHHQQPTSNTIAQTRETKKTQTQNTTKTPFNNKTTRSKHRHTTKIKPPAYGKEHIRRDADNNRIERHRNSNKQRNKASEIRRDVDQPTIHKSQTRTARTHRKHNYRDNPPTRNKRQKQGTTGRHCAALHTDKAEAQGKKQSAVGRQPPTKKKKQTTQASINNDHDTYDRTRQANRTNNTNTHNDHRYDNPRTQDTEPYDAIKRNKSNDNT

SEQ ID NO: 993481 - protein, 297 aa, Homo sapiens
CEERPAGGGWRRAAMAAAEAGGDDARCVRLSAERAQALLADVDTLLFDCDGVLWRWCETCLCLARPMALLWLLLSPAGNAPCGFTHQATCSNDPLLPTAEKLAAALGFWRAPAGGPGCQALAGLLCTCLLAPAAPSLLPGALAWLPPAAQRPYCAVAAQALGLRSCEACGPSPAVGVGARASCRCEGSGDWLHAPLEPDVRAVVGRALTRTSATLKLTKGLALPAASPACLLVEHQHWTTRASLEHGPLTSRGTVDDQGPKPCDNCLPSGQGRPSSGKAQPVYISDFVFQEYGIQPE

SEQ ID NO: 993482 - protein, 283 aa, Homo sapiens
MQSTQSKTLMMHSTGIRPRLRDVCQSVGAREVNRRAVLDQLYRTTKTTSGSYCRRMDEIGSTEQRQLPARPLHLEHRQHQYETAVSRTDSSNNDRQYSKRAEQSETETDKGGAERLQTQHNATITVDNNNERETKRELHTGLTKDTIDGYEESEGVGNERHEEMKKTETVRPAGRTKCGKIGEREAQTRKRMSTAGWDGDSDEEEPRRSHTDIIQSSRVEKDGTHGRDQCDQREKDQGRIGDPGRRYETQEQNVACRERRKIDTEEEKKRIPQQSIKQKATEH

SEQ ID NO: 993483 - protein, 167 aa, Homo sapiens
MKDELHALVGSFSTHRSCFGLDLQQDSLRHYMWSEQTRTPALSGDSMDGRPGISELVELRQGCVKYCVAEYPRNESDSARFDGMGSYPVVGKYTCVRRQMVHTHFTRHAKGSRCPSKGSAWQGYEVRIGNYRVKCGTPCACAEWERTLILYALVVHVQYPRMHDTNL

SEQ ID NO: 993484 - protein, 443 aa, Homo sapiens
NGSGSAFLCASETSMHGNALHSVVCSSPNRVIHVWCGGAGAGLRSVDCCRISNLLFFDSCTFYMSHSNAVSQQWQASSIHSHDTVLTSDRQLFSCWLFSLLSRLRLHCAHTIHTYTRHTSCPRYYAIRLYSNTPRIDCSCICYICYTSTSLNLVAAKRFNQSSPHTKTRHNATCERSHAKLMTVTPRQTTHVSIETEEHTRHAQATAASQHVTTPNTQGGTPTDHTNATQGPRPRTTAPHDHIPPSYHRNLDTALHKRGRSTTPRPQFDSPPRPLMGHTQYMHRPPHVTVRYLHLSLDDTGTIRTRAHESAIQYTSTPRVSNQNILYKLEAANGGNDCVYTGHNTMITLPLLSQHTMTFATLPPSTTPTSPFCHPGPQPANNRLYNRGNHNLIDTKPSPLTIRATLHPGSCMHNNGSILVPHAIPVGCQVSTLHISEHGYTDT

SEQ ID NO: 993485 - protein, 251 aa, Homo sapiens
MRLLVAVHTGVEIAIAAEVIVAPCRAGVVLHTGDHDVYFVNVTLQTLCQGDAIRIGQRSYLRANGGAIVLALPLRETLVIRIPDNTTRKAKRVALNGWGPIGVKPPLWGRNPMNENTTELWVGCCNPPEGRRGKPILATRHDGGPRFNSKHMNTWGINTGGAPPKRGDGHGGSTTGGRPNKNKGRPPACVGVTAPHIGCNAVGKVSRSNMLRGERKFTQRENPVGGRTTKTSFPINTVDKTRKRKEHSTTA

SEQ ID NO: 993486 - protein, 105 aa, Homo sapiens
LLLDRRVPDSKSPVLSGSQRMVHLHGVRAESFLQLYCYYQELTIGLLSPSRKARGSVPGHVQDGCSVTVHRPLLSMSVVCPYCTVNHATSVMAWGPGPPLGGARR

SEQ ID NO: 993487 - protein, 67 aa, Homo sapiens
MKTTKRGPKINGGQPDFVYNTGPTSDTHVYTTETRTPRTHTHEERGHTRRRHSNNKRHDNHTNHGGG

SEQ ID NO: 993488 - protein, 119 aa, Homo sapiens
MVAPKGLPKQTSRDCARHQAAIRETRRTGRDQTVYWSRCPLGSTSGQGLNHSAPPENIARGTSTNRQTKSTWNDSYAAAYDDRDGGGEPPIREHVPGSYADIPQGWTTRRGAPAGPLAQ

SEQ ID NO: 993489 - protein, 317 aa, Homo sapiens
CGRISQFDRLDHPRRSIEEYYILERSVRRFCVEGNRRQAFVGIGSNKTGLTWSSRRGRVLKLGEHRNLHTEGERSDTETESYQAWMQNGQYNTEEGPPSVEKKYRLGHEEPRNTILVDIARSPREDVAVGRHRARGSPPIRGIRVKCQTEDKEQSRRDSVANGMMGWNVSQLNATVMPHVAHEEEGAVVQRPPTDVNPVSEALGIEETWQVSNAAQTIPGNAKCKKRMCVVCRDWGICRLTMGQHSQAAVSHCPVQGHNLVGIAQFREKGKSVGTLLATRKNSGQGAYTGVAANCKPGTLVARVQSRNTSGGGPGAN

SEQ ID NO: 993490 - protein, 110 aa, Homo sapiens
MSVKMLSIARVRITLTRVHAKEVRSLVSTQCRLAACKRGYNEKSVAKERQREPRFQIERLTPVLTYEATGIHLTDDLANTLNTITLRTTDKPTNYRSSYVHTQIQRQHYH

SEQ ID NO: 993491 - protein, 251 aa, Homo sapiens
KTEESRRGRSGTRSCTMHWRLVPNARGGGSSPAFTPAPEDRLDSVPYPTSPPGHDYRRTTGRMETTSSEVAHAECARGYAWNPWDYLMQQQEDNQDRAEGHTPRLMNARTSRDVPEWACEAVVVTLIDEKENVFAITPDVCLSEQELTFRERVQRVLHLSPVRGLVANQSTCCLSSGPWMPPYPNSEGANRLGKSREALVHLSPISALSALASGQTAMKGTYEEETERSQNIINSNATNSLNNKPIIRRRP

SEQ ID NO: 993492 - protein, 35 aa, Homo sapiens
MRQRHDLDTKTRKKAEEKNNKQDVPLTYLFREKGR

SEQ ID NO: 993493 - protein, 322 aa, Homo sapiens
MGQNSGLLKYTRKGTPQVAIRANERAASGPVRRGGGAQADRLRRGDIRGHLSIQVTPFQEISDSLTRTRGLWAGLALSPRQSGPVGIIPGEPGKPQSRNPAGDPFHSSPVVVGGCVNSGFNLPPSRSPIGNSISTLPGTDHTSQVTNQQQQKSGEEKKYTCTVHPPGVNIVALQKENTHRGETTSVTVESATSQTNISRHKNQKNQKRERAPQEQKRARYHRKGDPKKGLGVNPCDKQDAWGTQPQMKNNTIRHITQPDRYFNNTKRDKKKRRRDVATRNTKRDTTDEDHDNRHDRTRRTTNRERRHHKEREETNTGTQKNQ

SEQ ID NO: 993494 - protein, 74 aa, Homo sapiens
DALGRPTLIEDALGYKAVLLRRTCCVKEPNESILSDMSTYLTNVNICKEQASYLSDFDDLTINHVRRGVTCYSH

SEQ ID NO: 993495 - protein, 392 aa, Homo sapiens
LNSRTGWLERGAQMVSSAPVACCLDPVSEPATAAAVPFWTNGHNTEQASGVAPCQVDAHCSCRTLLHLLPVSGHFQIADPFPEAVACWGWPSHSMPTGDIPLTDADWAILHSKDQDNNILWVPSRCPDRSVSNARTSHTVADVHGTTGSWRDADPMPPGLYLLVTDQGSHLAVTATVTFYRTLVTKARTAHQHPRRHPAHMDNRQLPCHSRPKQGTEGLGTDSGTVSATPQAQGAPDGTYPCIESMTQWGTEGHDSHTEPQAHLQDHTQLATGRTHKDTERRQEPAEGATHRRTPKDTQRQKHDNQRGTQTGHSKTDAAQAKTKRTGTTTPPTGHVTHPRAPERAKKIDHTNSVRKTAQSTRANTTENRRNTQLSRKQSAPATKQRNKHNRS

SEQ ID NO: 993496 - protein, 184 aa, Homo sapiens
MVAINEPFIELNYMVYMFPHMITIRMAELLDGYRHTGENGKLVQSMEIPITIYYSVSEIPPKIQSGADAEDAEYVVAVHWRFLGIHGRNGWVTRFVMWGSLHTGSMHSSDTSVLPDAPHVSLDGVVKHAVSMTSMLVKIIRRMPPVTHTNAYIPCDQGQFMTNLWYRWQSELIDHSTHDHDLTI

SEQ ID NO: 993497 - protein, 71 aa, Homo sapiens
MQKQKPTQVPKRTVNQISDSQHNQDKKTYNTNTTNTTQQHHQTTSHNNSSKTPTINTHHSQSPHNCTKHTR

SEQ ID NO: 993498 - protein, 60 aa, Homo sapiens
MGGCSYPDQQHNDQRQDQNHTHNHHTHPEHPTQEKNAQHTLNDDTTETNTTQTDTHNENT

SEQ ID NO: 993499 - protein, 313 aa, Homo sapiens
SRATSRAGSSVGSLVSPRSGLPGYPPSSPSCDSRTASPGEEAGLGFVPEQWLPSGRNGDVVMEPCGKNACHSLQARTSSQRCMCPQVENYVADIEVDGKQVELACGTQLGRTDSDRLRPSPTQIRCYTDVLSIDRPDELENIPRKWTPEVHAFSPNVPHHPRGALKTALGNAEEHKRQLATMKPRSRRHPDEPADLPGHHTREQGYHAGHAKTQHATCNHGTGNAPHPARPHSGKNTGRPGPATLADPGRKPHHEAAPPRPPGTHTPDHQPATTPRHHQQHHGKQDRTKRTTTAQPTEQPRAAHRHPSEPRAH

SEQ ID NO: 993500 - protein, 136 aa, Homo sapiens
MCEHNSLLLGYNYVNWKANWKHDKRLDPLMRTQRAASTCFPSQTNVPSTLDAGHEQLHTGQQQKRNCPLLEHTQNKNLASTRTLLRPTKARDKPQPKTGHDRTEQAKLTAPERAHHYAREGNLGPEQPGASHNWPP

SEQ ID NO: 993501 - protein, 215 aa, Homo sapiens
MGPEIRDPWEHAAGGHRREDSSPQRAEQYTGGRTSERVKIAETMWVSQYGPKNMKGPDTRTRGGGRAPIGRRGHHKIGGTPTIFHKGPIIPEGHKPPPRFETTQEEWPPKEEQRMNKRNQGGATHSCVRGTPQGGVAHQRRGEDTWDNARAVGLPARRLFVPQPHRWVPQGGIEIRPAQVNMPYGWPSDMVLTDDQGECGQQHDVPVNKETLERA

SEQ ID NO: 993502 - protein, 107 aa, Homo sapiens
ITLREILSHWYLAVDLLRSSHGGVSMFGAGRSGPSAEKYMRGEAQLFYWRCHWMVHMVSYSRRLDSWLRTAVGGGLPLLQRCNSILGTIKVDWQRVEQGHEEEPKSS

SEQ ID NO: 993503 - protein, 72 aa, Homo sapiens
MEKANDPITIFNQKYMELNTPKDSSEEAKRSDNEASHSDSIYSNYLPQIEQSTHTTANRSKAQNLTLNNGCN

SEQ ID NO: 993504 - protein, 278 aa, Homo sapiens
MTLRSSLDTRPMQNEHSRRLLSSEGNIVRSHTPKTRIHPHVVTVSTANTLSWTSDQITLAKRHYGPRCSANTICGTSTIEDTVHTTHGRGHLVDTMKSTTFESKFGPGDNGITIWSVVTLAHCTREHVTRSFYTGNLLLVDCSILALCQCAHDQPRFEDDIIVEARHHHPMRDIRIPQAQPKERRRPRTSTLQSDLEREKGAGSDNTIQRHPVGDTRRQTGQRKEPTAQAAPASGANTNHRHPPNAHHKQTAQLSGSTTAPTSHNTTHPKPATTRRAH

SEQ ID NO: 993505 - protein, 108 aa, Homo sapiens
METEEPDPGSCSRELVLDNGNINMMAHLERLNQLKSVNLEYLSRKHVGLITDFKSSPSLPKLTKRLNSDEHYNHKEVLAHVSMTQLPNLTQSNTPSGHYTSNASSTHT

SEQ ID NO: 993506 - protein, 216 aa, Homo sapiens
MTRITSRDRPGTTHNRNNAPTSTRAQRPPTEQRMRTRHTSAQTRKPKREAEDANAAGRAAGHGATPSPHTQHTPTTKPTNPRPPTPRRPQPHATRPTNTGSYTRPQQDHQPAHPPRAPAPPKGRTGGTRPRRLRPAAPPPHTTSADAGRRRPRARPTTRPPAGGSPPHTARRHATRTTPPRPPHRHADTPPRPDARRHPPPPPPPPRPPPAPPRTH

SEQ ID NO: 993507 - protein, 184 aa, Homo sapiens
GSGAQSSCEVPLTYGWWAQPGDMLSYSERPDVTIYQRSRCETRKGKRPQVGGFQGRRVTVNLARLDSCPLDRSHPLRPTRQACSRSSGLHHGSEERTPFNNANNHASMVHRWVSGRTNPTRMHPPKGLSKTRAQAHTDQPPISKSVSYAQSRTREIRSTMVWAGTFSGRHSTIRNTLNYSFGPT

SEQ ID NO: 993508 - protein, 371 aa, Homo sapiens
CRLVEAVDGKAMNTSQVEALGIQMLPGYRDPYHGRPLTKGELGCFLSHYNIWKEVVDRGLQKSLVFEDDLRFEIFFKRRLMNLMRDVEREGLDWDLIYVGRKRMQVEHPEKAVPRVRNLVEADYSYPDEEGPKHWSDSRYEHVMKLRQAALKSARDMWADYILLLDADNLILNPDTLSRFSKMLPVDEFLPVMFDENQCPSTRPLLPPELDAFSVEPVLIYQKYTGDDGMLSDTENSSRMGPLSTSRTTVTRQVQKMREQLVPVVTEGFGALCDLGVAPERPRVGGGWLTKPLVLQHLVVQGTKYGGGHMLLHHRGVRGQSVKTPSLLYVETTKLDEQEQGHLNNRGDEHKTSRATDVKLDSRVQQEKKST

SEQ ID NO: 993509 - protein, 172 aa, Homo sapiens
MAEEGTEEYLTGLFRPHWMAIWNSELISWREPRREPCNLYGRVGTLIVDWHLSSSTGGPRSPKDGGQEWIDEHLGGAGSDIGWRNQIDVFHGRGWPRTKIGMVNHLMMGKAHQSKNTSCMSKYKRGNRYNDRDKTAGNQTSGGETRREGDTTGGRQKRRNAEETDKHKNSVL

SEQ ID NO: 993510 - protein, 112 aa, Homo sapiens
MWFESTADARLGYHHREAHGTEGGSGAVGVMYRHNRAMPTMAGWTTEPGTQVTTDYGPKVGRESRGSTEQGGDADQDEPRAQGRRENRRRSHTREEQRTRERGGKRGTSNHQ

SEQ ID NO: 993511 - protein, 542 aa, Homo sapiens
SKYSESRVEPFKNVTVNRPPVSSHVAMDFFGVMTSEKKSSMGACDRGPGLGVSGKRPWMSPTSSNYCGVFSLESAGYHSRALYRSSQIFRERVSIQKLEGVDITRLAVSYLDVSIGRACSFVRVVSAEVATRCYRAVHIVKTTICCIVKKSNGASVGVNGSRVYITSIHIVSCLRRAGSRSYSVHNRIYRGLIPKTPTAFQGRIWGATRTVCQPYYVDEAGKAKDQHCKLRGTAKARGKRDTATDEEGETFSHGAQKRTLPHTIPKFGHQITLAQKDRTQSRSTIEETVGTKEHHGNGDKHSGYLTPTDWVLVPLGERTIWYANGETTKTTGGTQIQDREYQKREHTLGHWGKDTARHSGTGPTSITTRGKRSLVHTRTPDKSSTRIDRLTRITQEGDMTVTRGVFHRIAVGEQQKIVREQQAEITFETNSGLRGGETQHSTHVDYGEIRTTRTMGTTHRWCAHHSSMGLGVKNEAKSTPAVKQADTPRRGPTNRGKLHKPRGNTNATQGNGSTQRTRRAKEMNNPVNSAEADKETTTKEET

SEQ ID NO: 993512 - protein, 451 aa, Homo sapiens
MKSYLTTHSSTSAQPDPNILRMMKLRLTPWRLPDPPNHHRTYIHRPCTTHQNASTDFSSIAHITRDAKLWLKSSATFNANWRHPYSYICPHSYTSKRGLYNGSISLLRHLKHRHYPPASNIYTTAFIGYSPPVRPNIIHAGSHSTLTQHLTIPPYPITLRTRPSSTDICRRHTQVDQNPQHNTTQPRTITANYYYATVPYTSQPHSTERRNSLMHATTHGDPKPKHTIAKVEHCHKCRDNTQSSNRDPTPTNSNHTTDNERTEHHNARYTKHTRRESTRQKKNPHHTTRLEQQSPANTYTKRPKQPDQTKLSIARDSGPRHARIETSRRPTHPEEETKDRERTEDNKRSTDRGTQKRTIAPRNQRDGNNDTPKADRQADEDHDDESRKGNANNDGTSRASAPHKDNYEKQAARPTPKETPTDPRDTKRGTTELRGHTESDETDITMTRRTR

SEQ ID NO: 993513 - protein, 103 aa, Homo sapiens
MAEEVTEDPTTARVSRRRRALKRTPIRREQKEGEDTDNTQGATKRKHEKSQERRERPTQQHTTEDKTRKKQHTRRQDNEERKGTDRQREKKRDDEKEPARKPV

SEQ ID NO: 993514 - protein, 155 aa, Homo sapiens
SSPPPPWHSLFLLLRLPRCLRCSRRGARSPRRAPGSRCMLPGGAEGWEPCSASPGLRCAVCLRLVRAPAWSDDGTRMEPLYREPGLCPEEAEQGVLLVHMPVGHAFSPSRRTATAHGARMRRPSRRGQTQPTEEEMTYWPEKLHRKGVWTSTHRH

SEQ ID NO: 993515 - protein, 582 aa, Homo sapiens
LSSHRNNEGVNIGTRMKKLTSGTAYSIQKSAPTCIPSPAVLQQQVTIASVSGGNRVYLSQSTCHFANQNLVNLHHNTVHLRRWHCQHLAHHCTMLQQLFTTQTHISQGTSSVTILAVNRNQRHQFADTTRQNSAFPTPIHRHYSHTFQHQFKPFCSHTSTPYINSQQTETRTADSQVTQIGRPKDKHSPSDAPGQQRPSFTDTEYDHSLHLISNQNKGKRQQAKSRHRQASHAHTHLITYPKANRAQPRTSRSHKRFFTQDIYRYHHTLGYTYLSRAYITGRLEQQHITNINRHTNWPIFSKRHNNTIAHTVEDIQPIPPKLQTNNPIMTTQNPPIMSAPPSTEQIYESLAHLHNLRIISDSESALAPSTHKHKSKHGAATLTTHIHTRTEAPHNIAATHGPHHESNTQTEITTQSATDRHRREQQPQNETTDENHDTTTTSVSTTPQRTTSTPQMPNRNTDAQLYTSATNTTRQTPQQHRSTPAHSTTEQQRRASKPTNATSTTPTGDRSTRQQQPSDRPHNHKQESEPPTPTMSSVTRHTSTITTRPTKPRRNANTPRAQATTARAITRKQHKRPNALST

SEQ ID NO: 993516 - protein, 219 aa, Homo sapiens
IGIVQPENIQPPLQMSKKPRLDQIPAANLDADDPLTDEEDEIQTDYSDVPEEVRNRDFRRELEERERAAARRRKIGDRPTREHTTLLFSVKKDDNYAAEANLVEPVPEVEGEKEKVIGGQRVKAVFIARDLPSHAKITYRHDYSGCPCEEVRKAVTCWRESEERERADCKREKVGYRSKPSNIQAPLSDSSGRRGFWEPRVVHGVCMIFGACCIGPRQS

SEQ ID NO: 993517 - protein, 119 aa, Homo sapiens
MCATWHSSRGATKEAKFSNLPQKQQQTKTHMRHGGVWELTRTFKKGAHTQISQTYNLYNKCVNKVGGSRTVAQRDLSTYRSRKTGRQPSNNISTRESPKRSRDETGIYEHNTQRETNST

SEQ ID NO: 993518 - protein, 84 aa, Homo sapiens
AAGSVRGPAPAPASSLALSRSEASVPYGSCRAEGHAMDGSQGACPWAKMVVGVLPVVPPVPDSPVSSHHFPYPGAPHPWKSPVC

SEQ ID NO: 993519 - protein, 236 aa, Homo sapiens
MSYYFDRDECGFEELAKYFLQQTHEEREHAEETDEGCRTRRWPNPTYRDIKENAELLTDWQRAGLNKQWSRPHYHLWTKQNVESGHYLELAQKRALDKNDPNSVNFTGDNNQLDMNTVKANKRNWGDTSEQLAHNNGSAPEIWLGEDYLQEKRNTRSKRNKAKPEPNAPNQRETHEHHSKAAWEDPTAIGTHKTPNDNEPTQTNAPTKTGDNTQQKHPKHQGKPEQPNNKKRKHNN

SEQ ID NO: 993520 - protein, 321 aa, Homo sapiens
YGARDLNGPALGLPLPPPALGQVFRIPTPELAASRSRGRGAPEDRLGLMGPGPLGGSAVLLSNRLRSWLTEWRDEATRSRHRTRFVFQKALRSLRRYPLTLLQRDRKLRSYSTFGDGLCRMLDERLQAAPNIGAGPLPRITIVERTVQPDRGRLREVKDSSSQCLPGPKREALGSYGQLGTQDPSDTVGASTGSTEFLMVTMLNKEECWRGVLSSPQVARECPPEQAVGSVVQRNWSGKEPAGPIDPEASGTSWQSSLSVTVDGQGPGEDARRRKLQEEAEHLRDADSVVMDRRARDSGTQAIRVNSKDERGDNKDQTIVA

SEQ ID NO: 993521 - protein, 231 aa, Homo sapiens
MRQGAPPEKDTKVGRTWPINTGVRQGGGTTQRTTIEPTGAHNTKHSRKGGTPKERRKRIKNTKTTKARANCTNPEHPLDTAEDTNERIHTQQGEAKKGEEGNNQEGDTQRIRLKKRRHNGPYNADTHLWIARLTAVHNTQRSKAHENPPREQQKPPFANKNNKGRPKNAEGDDTHTPVQDPTASKQRRRKARDKKATVTHSESDATTSTNAFDAVTQLDTSSTHAQSTPSP

SEQ ID NO: 993522 - protein, 96 aa, Homo sapiens
YSTIFAGTLITALSSRLMVFIGDVWHQKYDMLAFIPVLTNKINPRSTEAVSNVFPHASNRVQNPSNSYPLQQYTLRTMIPEANTDLMQVLIDVNRS

SEQ ID NO: 993523 - protein, 218 aa, Homo sapiens
MVVGAYGVLEPFADAMKLFTKEPLGPDDIKRSPVLTITRPDPVRVSPSRCVLPSEPSRGPILAKSLGEDFSNREAPTNTSCSAHVKNYSGCESIVRRGLQGCLVTTFGQVRAVQSSQQNGRRQMIPRRQGMAICGSRRSPFIHTIKIFVTEAGVPCETLLCRRSESSTKEADICPVFSSLVRFMHALAGDYNMMVVFATVYEYYPTDSRCVQVETEPE

SEQ ID NO: 993524 - protein, 99 aa, Homo sapiens
MRELTRDSGFDDYTLNFYIDNVYINTPKFCDAEFLFYSLIMTGEREELESIKVTPMERSFTSPPGNIMHVVHADLGEPDWNPDPFNSPANMGGRPQHSG

SEQ ID NO: 993525 - protein, 127 aa, Homo sapiens
MDATILLGKWVMKNTLTQLQTWIENSATERQEIYKPPYASSSRTIPETPTNPKTETYSTPGRRRRHRQERNITHHKHNYLKSQQTTPQEPSQYHNTPPPNWITTDSTHSNKNDTKTNIKVTDNTKNI

SEQ ID NO: 993526 - protein, 460 aa, Homo sapiens
WSRPADGALELACLPRSPQRVRSAQGCRAALLMKAGEPWCCPIWPAMAAGRGCWLCCGQLAAAAALCRCTVRNMLLVLCFRPGPAGAGACLCCACASARASYTGAVLLTCLGLCPERTPWAACWLFARCRVIEERSLALIAQTFAGEEAIGFGPHTIYPGPKRHRHTVQRPKTVRQEFPIANDQPVFSRDLQFHLVKRYGKTLGSALAEPCKPAGASLHFASGKRYKIKAPEPRTAPCSKQTKPHGALVEITLAPQVPQAGPRTTDEEEPPTRSYEVLGWSFKNKPWKSHGGPCGSAGVYEHNPLVLNVWAGTHTTRLSFCYRPCVYERPPGARHFGSHNGVQYSRGTVAVTEAQVVDYPHDQRKGREAPPEAGGIYTSASVNTPQYDSITPFRLTPQGRGCVDTAAIKFNSVRPGTAHNSNCNTGSNGRTTFGDPRSRVYNPTARVSLRSAPSGRDKHN

SEQ ID NO: 993527 - protein, 111 aa, Homo sapiens
MITDIIRKCFKRCTTQDTWVACHTKGPAQCNAPYDSLNNGNFFGTRLMWSPNYTYDIPTMRPTPSNCIGAGAPDTLTTQYHPPTHMCGPHNHVFSWRIQPGCRLPWIHNKC

SEQ ID NO: 993528 - protein, 150 aa, Homo sapiens
HDVRRCRCHAMSPHAPPPAVRLDVASSSPHLSTLSVHIREDRTRESPRKMLMDTISQEDYLHTPVHEPGSVVLLISLVLFGVIHGRITEIYALSDQRRLSVIDYLLDRCEEYPHDGEGALESRARRSRPLGHYALLFTGILVYGSTYVET

SEQ ID NO: 993529 - protein, 71 aa, Homo sapiens
VTRWGNASGSETLHPGCEAFDLLLAKRKGGCFYLQTVKSKFCGVHLAADPEVWLQEAKSKGGAERVNSDLL

SEQ ID NO: 993530 - protein, 135 aa, Homo sapiens
MGGHIPVDPSYWGDKRPEIRWTRETEIAHCTQPVTRAKSSQNHNRNCGSLTQIAGDTYRVPGGKENGGREVNFVTILFPSNRERHREGPGGGVRWGQGVRGGTPRRKGDGHRNQVGGATPRDRQGRQDSSRKGTE

SEQ ID NO: 993531 - protein, 148 aa, Homo sapiens
MNGPLKESYNTIDPPLRHKMAHEEYRTPICMLNRITRLQAVLEIITNKTSQALTVLAWQETLMRNAIYQNRLALDYLLAAEGGICRKFNLIGWARWLTPVIPALWEAEVGRSRGQEIGTILANTVKPRLLKKNKKKENLTFTQWWSTH

SEQ ID NO: 993532 - protein, 98 aa, Homo sapiens
ICPVTFGEKSRHRMKRCCDLFELLRWVHNLCVTSAKGFELGFAPTRTAWRSSKSYCTSLKKSSAIECSDVVKRCIARSLDVRKLVTELAYGVAHRECD

SEQ ID NO: 993533 - protein, 202 aa, Homo sapiens
MPGSFTAKARGGHTECHTFQGAYPFPTQNRRGPVSPPVDKAWTSIAIPVKKILRNLKSNPTKTPKAQRKQRGSLGVTETHPPNQGDTTNTQHNNYPLLTSTTKNRKSGRAAATKQRTPTKEGRQTHYDRPTARSLDPTKTVPHNKKELSKEYDETADECNKPFSRAEQNYERRERSSKAPPHGGGIYDTAHTTQTSDPRHKA

SEQ ID NO: 993534 - protein, 39 aa, Homo sapiens
MRRANVMLPSIASTTGRNHAPRSVASSGRNSLVRLTKIT

SEQ ID NO: 993535 - protein, 104 aa, Homo sapiens
MRLEFYHPVTHVELSHSNPCIINPGSSYTLLLIYLIHVKLENLTKVGRYIFLHDYLITPRTVEESLVSSALESANGTMLRIDDFGKINCAIHIHVLAHCIEHGH

SEQ ID NO: 993536 - protein, 89 aa, Homo sapiens
MATAKARARAQTKNPRANKRTPTGSSPAPPAKPPPTHPPGAHPPPATCETNPRQTSPHDTIHQPQPLHGARTRTDPPTIPPYPPATPPP

SEQ ID NO: 993537 - protein, 294 aa, Homo sapiens
TETSPRSSFYVTREKGTEPPFSGIYLNNKESGMYHCVCCDSPRLQILVGYPERSLEHHRIKKSFHFERQVAYDSEVSEKKYCSGTGLCLSFSEAHGDVYVRLMKDHTGDPETSGYLVRISSRQRLSASSVEAHLGHVFPDGPGPRCVRAFSIYQVWLKKFKPKGNQLTMLSRSPVPLSDALHVQPSIFHNSLGMTCVNTATKNLGLETCGKNHELGSHNTQAGTTAHSKKYSPPKGAQEHKALYPEYFVNANGGPLKTEDRNETQKNRGRRLYKAPGMHTLLTGHSRAPNHNHD

SEQ ID NO: 993538 - protein, 122 aa, Homo sapiens
MEKKQMMLCGSSGREEMWERRKKAESPECPYVYSDPNSNRCELMTEFLGLPAPLCDSKGSLVAMHAAGFAYTYQNETRSIIEFGSTMESILLDIKQRHKPWYEEVFCTIKQDAKKLMSDEDL

SEQ ID NO: 993539 - protein, 511 aa, Homo sapiens
MWIITTGILSYIYMCLSYFKTHSYRFVEKETPRRDIYTLYSGYQRGALAGAHSVFLYRHNLRQTFHISQFSLSPAEETIHTFIDGVSTPLSCTKHTPLFQKCEIERGEEKHTIAVAHYIASITHRGGVSQRAGPRDKRQHNRAWPPVGLEKPIPECGHPQHGRCPCWRTPQEQTENTTCAQVHSPIIILQHHEDKLTTLVLRRKRNSTVDTSRTARTQHVTSKETKRLQREADSDLIVQYDTKQHPLAGVYTHNRPSENTPDMRQYNHKLRSEERPITHTGAGAANETSTDETALSGVAYPTTTEPRDDIVAAPQYPTPFQSDWGDNGVKPPIVYTGRRGTIRTHQHHIVVSSAKSHIRASKPQNKQLGVSNRHTQQNNERAVETTTGVAETNDEGHKSAPQERENRDAPPQMTIGRRSIPSHSKQISVSSPTNMCPHQMMCRRYRVHRSGDNQRRTTTSATTNQQVSFDRGAHKRLDADISTYEHTATAGADSISSSDHNTIVAQCERNL

SEQ ID NO: 993540 - protein, 266 aa, Homo sapiens
EAAGPSGKAVFSLGTYRLYLLSHPHDPTEHPPPHYHYYSLSSCKVSLLNKDFTIAYEKEKKKGGTPHKKYIPQKEAKKTIRRVPHASNGYKKGTPKYGDRTVHLHTRQRNREPAQRHHTTHGSGNDNGQKTTQRKATYDETTMQRRRHTLTPPNTLTRVRTRADPNNPWENQTPKPPNPGKNSTKKSTQQRAQQQLKKNSPTNSVPPPNRETTQKPTARSKQNAKEQSQENKKKRANNRDSEKEHTHNTTTTTNNPKKGENQPANK

SEQ ID NO: 993541 - protein, 585 aa, Homo sapiens
PILTKFLNHLKAKMKVCVMYEHLRQFCLAANMALCSSKLPELTCHPAYLHSNMTSYLTPMAFYLCCSVIKTPNTAVVHSYIALHHSAPPPPCTGCLPWSFLAHQTNHTSYLPKTSGFSYHKRIIASLISCTHISAIEIIAQFSRISPPAHSSLSNNGVSIISHPTHGQAIHLSHSQSIAHTIAHPHISLLVPSRLFTSTRSYYAIAHIYDNLLALRSPQRPYTTLEYSTPHISITHTGSAHVTTKFPQVNHCGAHSCHSRLHTGTPPLRAHPTRGYLAIPIIQYTTHSHATWSSHFTPISKEPHTTTSTLVNTQSLQSALLPHPRLIARLLTRPPWRLGRLIGPINHPTNWPANHHTILTTLTFHIDSLDSNLHTTIVLIDHTSHLCHTSKTLTRPLNPLTSSSLSIHTLANSVEITHIHKHGHKAHRRDTHPQGHEHNTNAHQRARHTTPDVTATDSRRLEDNKQTKKRTKTEAEYQQRASPKIYRIPTSYRTREPSKLATQPRCTHGAERRAAANHTTQQPDESRPHSKRRYAGRQSSAPHAPHNVKTKLKQTPHDKRRREQTRAETQALRHRREQTGANNQM

SEQ ID NO: 993542 - protein, 147 aa, Homo sapiens
MHGARAHAYIPRGVQRSLPRSYPETQPPQTGGAAEKDTTKGAKASATRSVYQGSPKKERQNKPHRTRQRKNNGADEHRPQTTRASPQPTRSQSVHPHSDHHSEHQHSTGRTSRCASAAQNSPHYDCDTETSTKREPEPKSATKARPA

SEQ ID NO: 993543 - protein, 125 aa, Homo sapiens
GPGAGLSPPPLLVLTLPGGSIGGRFDPEVLGGCFYNADYLVAEPGGRRTAGRKRRKPWRGAGDWMYYLRYSGLHLFTGPVEPGLVQKFSLRDCSPLVSEESTPLPHHATWMGLVGGRAHAGYGSL

SEQ ID NO: 993544 - protein, 386 aa, Homo sapiens
HCFNSAWTEPGARSHTPDRTAHSQPIRSPLHRTLRTAPRTPPTAPAPTQHTAARPPTSPIVAASDRPRYTLQVRQNYHQDSEAAINRQINLALYASYVYLSMSYYFDRAACGLATTLPNTFFTNLHAAQGTCCAHCMQLQQPTQVAESSFRLIKKTDCDDWESGLTCNGLCITYGKKCESVTMWTAQTGHMPKMTPNSVTSIDATLPDTDPVKRIQSIGLNSDHIGANDGDQTNFLAWQRKITIDTENAGTHSDEVKAKPPGYNTKAEGLTILVHQDSMQGRGTPKPFHTVVPHHHVSSLGDYTQYKPRLDPKTPTATQENQKRTRTPTRPRGPTTTQREKSNRMTGERKKRRDNHKENKTHCHNKEQVRIYRKQSHRIPPTPKQP

SEQ ID NO: 993545 - protein, 551 aa, Homo sapiens
MQSERLWTFTRIVASFDTQASTTSTVWVPLHSVIKAHTVAHIRKSAAACMSQEHNVPCRVLIDFQYKAIIAFAFTYLYPGELSYFKNILTMNQLQTAGTDVNNLRLHSGSGFPTFTTAYYTILDKPISTHQFTPNFKHSTTQRDRDLQLYKTPIPTQTNDIHYINNSGCAAGNTETTITMEQLLTIPLETRSTHLTHTIVSTNNNHIPWKIITYDSPNTKRDDPPHRKDRERQDITTTTITRNAQSDPEDPSRAHIQTNDYAPVPQGCDDQTTTLRDQYTATANRSHSSDETGTAHTHYHNPRWSAGARATHTTQKASRTMPYTPHNVNEQVQSKPNARMGTHVRSHKPHPPSCDSQRSHVRPSRQTIHDPHTNDQRARRARKRTTLPNDHDTMIHEQHTSIPPPATSKTTTQARTHPNRPGWKDKHTHRRAATESNQHHERKTCVIHRTSTDPRQIEQHSLHEPNTSTAPSSTRRADGDQSKPATDRDAGPKSHVAGSETKPTRAKNTAASCSENQPQQRYLLHHCSDTHHKYEYTHTAEQDAKPASHTR

SEQ ID NO: 993546 - protein, 258 aa, Homo sapiens
VLDLLNAEDEIREEERERATEEKESNAFHSFNPGKQSAHGTFFQPFALVSIPNPGISLTQLPAHSFNATSNIMLFKQHSTTSTSFTKRQQHTALHHAFSVTTGTIIASPRGHSSNTLLQASCKLVFICSHFILVAHQAHNTSSFPTSTASFQHLTEDGKQQICGSITKQAKSNHGQKCSNGQQKCPKMYYILGGHLVDMRKDMWLHSYKERCTYYVGSTIQGVQVSEQFTMSVRDKNPKDIHSYHLLASYISFTTWSS

SEQ ID NO: 993547 - protein, 328 aa, Homo sapiens
MAHMGESIHQQEKRDPRRHDGTTYKKDTEDCQHAHNQGMTTYRTATDEREPKMDHTRDDQGGLGNANSKQEIAVANRVTSGQERTYNNIMDTRQSHKKNKGPEKERHITQKKARPGARGKHGPPKEQMTEMQPARIQPHIHKQGQSQIIGRRQQMQPGHNEHNDKEQKNNTETRRKQNTKGEQKALGMKPPQKRNNPNGQQERRKHTMKKKRTAKPERTNQTQTRQFYSKPKQQNREQKQQQPHTPPELKKTGNYKQKNETTRDTQKCTQDNKHTPQQTETKNRPKGENDNNGTPEPPNKTGTNTPQKRQHRTKKRRNKTKKTEKRKK

SEQ ID NO: 993548 - protein, 468 aa, Homo sapiens
NYLEEAAERLNSCGAWSGSPSPAARTPGVHALSNAAHLDVQTPLRPDDLPDPQVLGLEDPYKHNSLTGTLANHGSERALHECPEDYPRNVTQPLSRTYLYRLAHWLSPGVMSCTVYELQPMLDSPGREAAQDLLGTQEFSAIPVRLADTVPEDPRCRHRLADRGPPDNPQGHKPRPIGSTRGRSTPEKTQQVLWTPGTLRRRPATITRDTKDPGNRATRMHRASALGSRRSARRERDIEHNMPPERQRTETREQRHTAHTRDNATPTTDVGTQQHPQATNIPPPLEMHRNRKTANTQAQPSTPLHRPTTDNEESHEIDPRTTPNATAEDEPQRQQTPNEPHHAGGRPRGESAHTRTAARRKQKQHQNRGHKNATANTPPAAREEDTRDTSTNPADHTQKEQNSNKKQQQQTKAEQTTKGAETAQRRPHGERKPETRAQRRAPGSTNDPRRAPAHNEHRHRPPGHGRPN

SEQ ID NO: 993549 - protein, 187 aa, Homo sapiens
DPESPEQPSDAAGLVTITPRGGAAACRSLDPVTITCNLSSEAETQQPEDEPTRKKEQRNKRKEKTQDKGKKRDQRNKWNTQDRSTTHTHYHTDDTPPPQRNNNKKTATQARTRENKDKNETHTHPGADSERDAPNSRQQRTRNTPQRRDRAHTERKTQPRAPLDTQRLKKEEKPDNQRDKDQTQKAE

SEQ ID NO: 993550 - protein, 133 aa, Homo sapiens
MFLIKSSLLCPLVSSLVPSNLGGRGVEKPKRPEISVCLSVPGVPEEGRRKGVVCSEDAPRHLRKNGNITWRAISPTPFLPLSPRTGATCWHGRQWFPRWAHSVLNVPNLTTQNISPNHTYHFRVSSEKTTKTT

SEQ ID NO: 993551 - protein, 210 aa, Homo sapiens
MYVTALSPPCEVGYHHDVYAAGYNHSVYFRLRTRTRVGSTRRKDERRTRLIIAGIEGEPWVEQISFIPQSGSTSWENRCVYACGTLCEAKGRTPPDRATEDHTTTAAAQPHTNETTETAPRRKNPTTLGVLGAETPAKQGARRLQRSRPTQDTSRQETKETATRSCQKRARIASPQHLAPRRETANAMQRTKHDEDRKQDRQRRNRTTEA

SEQ ID NO: 993552 - protein, 145 aa, Homo sapiens
MKRKKKKEVEKRRRKGEIEGSENKGEEEEKNIERIEKNRRGKNEEEKQERKKNTRRKKQKRKIDEKKTRKGEENRHGKRKEKGAKRTEEKIQRRSKREKKRKRRQEQRREQGKKRRKKQKREKDKRTSKKETARKGRGEKKERKK

SEQ ID NO: 993553 - protein, 431 aa, Homo sapiens
PTVGTAQIPHIYSSSHSTAGQQAQIPTSTVRDHTAGRVQIAHIYSHGILTAGTAQIALDANSSSYSIGGIGANSHIYEHSMPLQEQCTDSHIIQYGTTVSVNSADSQIYSTAAQCSETAQISRDLQSQHLSAGTVLDSQHLAASSATRAGTAADCAKSSSASDPLAATQCQISAQSNRQTRDRHLAGTQCHEFTSAVAPQASTAKSINMNGKSTPGHGPPRPYATRGTKTNTTSAPHVRPNATHLRPDKYITHDNTPPRSPTQSHTSARTSMKQHKYATRMNDNKDRATPTRTGTKQPKPTMTTRHKRNAHCKRIENTHRTQKRKERPHEQRPQSDHPETPAQKQRRKVHTTRHAATTAPENKSKTQMKEDCKRDDRKAKQRKPREHKYTNNTDKYNKRIKAKTPASRRYNMPATTIHERTGHHNATRTET

SEQ ID NO: 993554 - protein, 296 aa, Homo sapiens
RFSPEVAPAARPHSDPPFPPPPHGARRYPPTWHYLTWAPRFPDPVPIMETCQLHDRPAHRYPGAQSFQNALSHPTMGHPSIAIHRRPHFLDSCLDPHPCTTHKPLTIGIPGAEDALAAVAHGFHVPSKTAGPEALAGDSRTSCETRTNDPPGTWLKEESSGTSEESILGIQSPGDFHHKTSLRHACGAPAQAGIQAHQMHTGTRARGTPWGPITHSHQFTLDETNTEQDLGQPAVEQHLCDRYKEIITHSVGHLPMGGHRSTSKGPKQDQSLEAETGFIHTIVPNRSGDPECNNAG

SEQ ID NO: 993555 - protein, 162 aa, Homo sapiens
TRRQEQEANLSKDSSPSVPKAKNAENRPLLICVVVCFAGPPGSLLAILCLCLTILVRPGGLAAVDTPSGWITGPLSSTPLNLEFVHLSYESFDCCDQNKDRRIECPVLETSVELYIDLKRHELCGDYIKDILWQDVLRPYASTNSYDAERNPEDLSGISRAI

SEQ ID NO: 993556 - protein, 330 aa, Homo sapiens
TGVNSSHAGCEETAGSRFLRSCGLGPRQPGSWCRTPVGTICTGARQLQDAAASRKLKQNAVPGTPSSAFTLPFQERSSSLRWGQRTRNLRRSQLHTINSIRTTRYSQFQVVSASNEPLALCFLWRRGISECHRRAQASQPRQQAIARSGESSTKGRDPIRVVVKGLGARTLVLHCTDLIMGRPGSDLKSTEKEPNSNEGAAPGKGSEAGIGTGAACTWNCPQASVPLELVNVPGRVSDYACWESLRRTESFAPPSGVLTQVGWVPQLADSYRGARERASPSGEYIVPATTGANTRHSATEGRQQTPRNRATTHPVCTTTMSRLNTTHATQ

SEQ ID NO: 993557 - protein, 410 aa, Homo sapiens
LLTMEDEGNSDMLVVTTKAGLLAVDNIAANTNATDTQDSTLFKVQLPVLRTQAQQHNFETQVGRMDKSNLTDAAKQQHVTNCKRELNRVLLKSTQSFNTWHHMKQFQEEVLVHATSKAHQLAGKMIVSSNTIKPIANKQTGNSAQYSTGHNSKQGTNHATENELDMSVLQDQQHRMHHRNYHNGTFHSNTETRKIPSLCPEVQHFKTNLDRDDKGQAVHHLTFTRPQIGPALQPMVGWTTAHLQTHTHLPYQPQLTERIRSTKRSQTSEHDNRETGYKSKARAHDSAISGTTETPVKSGQLDRTQDRRATPAQAPSANPAQANQHQTEQRNTSDHARTNHEQQAPVTNQKNRHANKKKRKDKTKKARRTNTTDENSRTQGRRSHKDTENRPNRKAERENKKPRKRHLNER

SEQ ID NO: 993558 - protein, 81 aa, Homo sapiens
ATGAEEGEMKPVGAGADAPPGEGISCCSDQLSPVPGRLEGGAGKRWSDVSGGLETESSNGKQITLEGGLRWMKRMADSWVR

SEQ ID NO: 993559 - protein, 148 aa, Homo sapiens
QPPTPHCTHSNRNGIPNVIERGKFVGYIQLREGPKRVGPYGLLLTLRCRHKIVTREPLKPVRSTITLYITGPNLALTQSLFYNETPLTVYTKSPGIDPSGIRAYHNLIRASVIGLVVNVQDTLESTGDASAQGYVLIGVLVEVESKAR

SEQ ID NO: 993560 - protein, 77 aa, Homo sapiens
MGAPNSYQRLGPEPHWVGVKRNANGEGGPPLDLQKGNEGKYTPRSGRGAETTGARSYPGEEEQKEGSAIEESREIYG

SEQ ID NO: 993561 - protein, 174 aa, Homo sapiens
TRGYDPGHRGVERGRLIWPVPSSPASCPTDGTAPDTADTEHPRECPRTTERARAMRARAYWGGQVTRSAPPVSVLCPRARMPFPRGLGGVLRLEYRKSSFPRWGRRETPGFEKARLVLHFSFRKADVQAHCIEGEDRQLRRRRGGTMGAFPLLVHSPDTIPSQNPLAQIHAIHD

SEQ ID NO: 993562 - protein, 111 aa, Homo sapiens
MAFLMLTERKILGYIQLRKGPNVVGPYGLLQPFSDAIKLLHQRAPKNRQASTITLYITRARAYPTHHQLFYYRTSHSHSYSQTHPEINTSTNASSYLFYSNSSLAVYSNSF

SEQ ID NO: 993563 - protein, 206 aa, Homo sapiens
NATAGLRALHVKLPHTWGLATRLDRGNASGQLGGIISTVLTWSADVYLRGRTVQPMRMKDMMAQQHLLPMALSQRGYASFDVRLRRRLMAIHDALGLIELAYFVLYQEGESCTGVMSEEARPSKGMIDNLFYPSLCVRRDEYCFYNPWHVSNIDWFRSSVPRVGVWAEGECALVPVTRLENHSIMILWPRHIDMGACSTDYVLWEP

SEQ ID NO: 993564 - protein, 118 aa, Homo sapiens
MYGLDYVHKSLNLRPMLKLIVPTIILRTTAHDRFQENGHKFESTQTPTGVIISSHPIYYCLNQIKNNLFELFPNLLLRAPENPAWLILGYSESISITIMGNANRRLIQVNRYQEEKRC

SEQ ID NO: 993565 - protein, 383 aa, Homo sapiens
ALTRDPQFQKLQEWYREHRSELNLRRLFDANKDRFNRRSDLVHLESPNSWAYPGGLLQKNLVTEDVMRMLVDFGQVQGRGGRPGAGCSMVRRSTDTEGEPCCDVALRNRSNTPILVDGKDVMPEVNKVLDKMTVFAASVSGGGDWTGDTGKSITDVINIGDWRLQTWDPIMVTEARYSHTRSGGPRVWYVSKIDGTHIGKTLAQRGTPESPVCIMPPRTVLPRETITSAETGKEGFVQDGQGSLLAGRKPFVCPVYYHNHSDGALADYDAQKMSQYRTGGGGRNNKGGNESEDPDTEVNTHRDRAPGGTESATEQYNHVLKTPPRSYSRQVQTHGVRPRCKQAPRRNTSRTANTTHDKHAIEYHTKTSTDAHATARGRDATDE

SEQ ID NO: 993566 - protein, 208 aa, Homo sapiens
SSARGDEVAVNVEEVFSHLGHMHLTERADRAVVQQGASVCARSAGQVPGEHGSPWEPLGQEGRCALQVCRVAGGLMLSCVRLGVPERHSLCVGDVMQHTAGSPECSYLSKRVSDPDVATYSVQEASQQWAAMNHQQRRAKDQVGKKAACKGQGPIMGALSGQSQDQGATVDRIGKSQKEHGGGNRDVQRTRRTPTTTVTVVLSNDPLE

SEQ ID NO: 993567 - protein, 384 aa, Homo sapiens
MGHYKDKGEGYIHIRVNAGEFYHYGGHDAKIWETPTIVGIWQALPHTSESSNILTPEHLYGRNYISFLQVLPPPKFSTLRGQSEKPSVSYKYPLKMVLSHIPLERRKYYSPSQNTQRCTEQSGPNIAHTLSLNRGGNITSARVVNKRLKRAQVGTTHRLEALNGGPEAHKDRQMRPYKRKNNSPRGTQGASPPSLVSTSPFGSFTPTSSPTLNHNQWGALRTYHPLLKNRLLQHSQGGDGGQHNGGLRPNIHQQGHPQQRALSRRIRGPLETLLETYSKASQTHHDAGTYKQGRQEGGPPFHEPPHNRPPPHYTDNQRRENNEHQHTTYHYKRVQQGGGSNKGHDTTQQTISNPQPQDQRDVTQEDPTHNNTEAEQHTHSHEQH

SEQ ID NO: 993568 - protein, 246 aa, Homo sapiens
MCGLKASLSSYFHKTWIYRTKVLTTKPCVPLCERYFFLSLFLSQETPHVEQKTPIYLCVCTLQNTSHPQSSLYTRIHPYLSTCVSNSVCRVCESLYTQCVCVFYTKRVLHTESESVRSVIYTQEWRDTGVGTQCVRNTLYMCVRFSVEIFSRDICVCVFIILHHTIMFSPRVYIKNTTPLRAGVHSPTIYYHPLFIYYKRRASYITPDATYIHQYRSRAIYFHPCVGRLSTTYISPPVSRGGYTGA

SEQ ID NO: 993569 - protein, 144 aa, Homo sapiens
DNSTNTFITKRSYSAAWEKEGLPPFPLKGIQRAPFPRGRPAGNKRTPGFASRRGTQTKGDSGLRGSHCDLCQNIVSLPSLFHLQKPPVERGPGVLKPRRITTEALLRASQKNTGLFCGPRGEPVLTEAGDKISQHLWRVSSGDS

SEQ ID NO: 993570 - protein, 445 aa, Homo sapiens
MDHKTQAKNVFWVWPGTCPGGTGPGMAGENVALDLGREKGDHAQVGISVLAAMNRGWFLQTIGEHLGYHGGGEITWVRMWANLSKIFLFCAAKGNARETLCGGVVLCGASDEDLAALLMSPTGTNSLRCGESGGHESPVGAHLREKIFRQRWGGLSRQTQRFIYITGGVRWELARNRQRWGAHRVLHKPKNFCLRASYPAITRVGHTFPRDGGGDSPGVLNTTRVDKPALYAVGSQKYRRARVDNKKGGTSPGEYSVTLKQPQGSRPKHVGRVAPKLLTGCSSFHIFPKGVARRKIFVVDITPREGLIYGCGPNPPEIPQLPPHIQGEAPPGVVACTGISRGVSPHNGGHQGAGGEGGHKGEIGGSRQKQHNLSNDVYARKKSTGGRRRRHLWNKQHTTKAGGGGDGWPLGTQDPTPRERGERENEVRKHDGQRASRRLDCTPTV

SEQ ID NO: 993571 - protein, 218 aa, Homo sapiens
CDWISILAGAMSCVGNYLWQASEVHHHVSLVLVLPADIQVEKFICHDEEDEDLLWHEGLEVGQFTTTASVSSKSFQLLMHETSGPLVNTDRFIRAPGSQVRSCLPMGTNELITVLEPAGVILGVRYGLRQANRYHRRGNGSYCKRQMSPKPWNRCTFQAYGSLASRPQELDGASMSTFWFAYGAGLAFVHLSVRLASEDDARGPKGVTFMNKDERDHG

SEQ ID NO: 993572 - protein, 156 aa, Homo sapiens
MCVPILIPKSLVVAVASTIYLLKQNPGELRNPSFRSTPGGREDEPPLSNLQRIYYVEVIPGTLGSSILGYPNQGVPGIVFQIGYLNKGPEQQDPLLDSTRGFDRSALGIHWGPRGLTACDANILRRHVRYPTDVVYVGQLYRRTHGDTDIATTATE

SEQ ID NO: 993573 - protein, 220 aa, Homo sapiens
MNQINTRSNTTHDNNTHTHAASNKPRHAQPHARKHEKSTTPSTQQAAPTNNTKTRHANNNMPGREDARQVTRPDTASQPQTHTHTTRQTSQQYREPAQHNTEHGKTQHTDTTTATQRPQARTRATPNTAHKHRQTDTRQTTNANTAQASEEAKPDHKYLTDTTQTNGKSHTTAAQTPLTRTPEPNAKRHYTTRRRPRRKEHDSQRQDQQHTKKQGVERAD

SEQ ID NO: 993574 - protein, 107 aa, Homo sapiens
MCHMLHLEIPNAGRGVVGSRLYSQLPKMLEFTGHEPSRLAYSLNSQQVQKVDQKSLENWAYKSSKGHVLINSSSQMVSGTVYIGIGHNDKLVTHILYYYNVTYTQHT

SEQ ID NO: 993575 - protein, 210 aa, Homo sapiens
MSSPQDSLSRGRRYCRTTNKGAGETQHYRQQRQNEGSTNKKTLGHPTQPPHLAYRDATRLCSILLHTLSMHSVTFVSNRHLLGVEGIVKTDSAMTSGHLKRHTPRGGMKNEIIDKRQVHSHARHMKIQGAGERRGNAEEQRTKGGERAEVTESSQSKRLPEMGGSEWAGDGRRREIPLEKEADAETLRETQRRGQETEREPDESHGKTEE

SEQ ID NO: 993576 - protein, 219 aa, Homo sapiens
LISMDLEECRWSQTWRKTDDQKCCEMMNCNTQRPDPGALPDDPIVGASTPHACKLHCLPNACCASALNVMWLSALEYPCGTSSERDTITPHTPVLFTPCLFTSAYTEFIGTGIHTPVHATLGGALFPRNHACTYFYHESVQSACYLCSGVSTASLPRGVFLLFFENSRLVVIHKTINPDHQGYLFHRWTIASSGNALSPDVVHVDWSREWTLVTQSRLQ

SEQ ID NO: 993577 - protein, 226 aa, Homo sapiens
VFLYQPESPDAHIPGFTLNGSMPEWWSTKPCRDTCLLHPANLYVAGPMSSRDTLIELCNYKASHPSEVAHVPPLTAGLESTPLLVVSVLHSGFRPLPISYLTQPLKLILNFTCSTSWAALECMRRQSGEVASLVLPVVLVSFALSGHTIHHEKQGLSGSLPNSLLKKTWQTPALLCIRCQIFIYIYRLSTSFKLQTTNVHHASSWTSQLCQYNNSLLLLHSPDINV

SEQ ID NO: 993578 - protein, 438 aa, Homo sapiens
AHLRTAAAGPAAPAGPTAALWKWSGQCQMALSVAYNVYVLVHVFPESQCAFQSPELTAAGPPMHPVVAAVSGQLCPSSGEQAILLWRVDALWPWPALWLLSLFCCELDAHLASSLPDWQRHCVAWLSKAIIANCWSHSDAAVAGAPSYGLARHILFIALSFHKIIHGDDLPIELTHSTDVKHVCTAHIQLLVRIPHVPQPLLLARCNGTRDNSDTSTLTIGCARQDQHNHTVFIRHTTFLRTSHNPPACGLSVNRLPHLQTAQKMPAPQPTPYFHAYTDNFLTVDLYPQLPNRMTESHLPDPGQPGKVGVHEMYESHDNSPSSCGHLRWGAEEHSLPPSFENRKYHHSRCINLQHVLTCRSLSQHRQRARQQMKFHSGPANPEHRLYEGAPNERSNVRSESSSSQSSHRGCLPAPPRDIVSPSRLQLSSPAFISLQST

SEQ ID NO: 993579 - protein, 241 aa, Homo sapiens
VTACMHASGVGWHTANRVTTDSARAAQAPLPTLPASLKSSINTSSPVLTPWQPLTPLCTSQDAEICAGPGIPEKLASCDIVVDCGGADVQTLGDTPDMTIHHEVFHRDHDATLYPWECLWQTKLSSCWDSSICTYGHKLAGPVCLGTSEEDQHGWAPYYAHSCIDNYCGGGGMLVDQWDLPVCQTGEPRKCTMTPLTLTCTQSATKYVPTRGTHTQEQEHLEGSDTTSVNWDTGDHQEYLA

SEQ ID NO: 993580 - protein, 147 aa, Homo sapiens
LKVQITPKRLVHGCAPDVWVLTHTSPVSVLSVICPCVILICIPKPNYVMVFRLLQITEEPAKITHGACAPRWATERAYEGRMQKQTGWPGSPSHASVWQGSASGHGRCPGNEHELHKTATSASMLQYSTLYFDTCSKSVIPRGITAK

SEQ ID NO: 993581 - protein, 211 aa, Homo sapiens
MGSSTTASEDGGAAHKKPSAHRPAGRHPNKARRRLRTQADSATQGGEERPAPTPGAQDALGNCCEPAERGGSGVCFSASGSRVAWLSHDSTVCLVDADKKMAVATLASEILPLLALTFITDNSLVVVCTIASRLLFTYDAAAGILSFGGRLDVPKQSSHCGLTARERFQNPGQESELRVWHVSGACLYSLHKNSVRHISVLSGGNDKCSQF

SEQ ID NO: 993582 - protein, 47 aa, Homo sapiens
NQSHQKTHGDNVRGRHRLDNGSKSGRTTFVGPDVSPRFTWRDVWDLG

SEQ ID NO: 993583 - protein, 313 aa, Homo sapiens
LKGYNTNYAKAPNVVSTYGLLRPFGDAIKFFTKEPLKPAHLPSASTSPPELSSHHRSSTMNPPPPYPAPGQLNRGSYGSSQLYDPRQVHSNSVSIRWQHEKLRRVTPLNQENWRAVAHNYSSYRSAPRTRMHNSGIKHELISGFLSAVSDLITDNLNDSDILLPSMNAWHNTTTTVQQRQEENESAAHIRTLTRRGSPNQNEATDIRPRREAAMSQSCKNEYGNMIQEQTLAESSAWKRYDAAPEVKTDGTRPSDTRGRTKAAQRETKPESDSRKEKYAKTPQNPQQHKQKTHPSTHQNDPPHAKHNRDKPHS

SEQ ID NO: 993584 - protein, 35 aa, Homo sapiens
MTADKQTTTTQAINLDRTPHKDTPKHNSQKTYINQ

SEQ ID NO: 993585 - protein, 48 aa, Homo sapiens
MYLAQQSTGTCWELLFLKNLTFTLHGGSRHTNNASNPYTSDGSKLTNY

SEQ ID NO: 993586 - protein, 338 aa, Homo sapiens
NQVWSKSVESRDGARDGAPCTVSQAHLPRARRSLSGTVQLGARAVMLDHIVLQALNRAKSTVGTILYRMPIVWLNPDFESRSLQPGSRSGVSGETLEASNMSTKRLSKAPAMTRRLRTCYGNDLLHGQSAWSSVTSVTAEGAPCEYPFSQGTKTVETKRRNVLPGQNSFNSGLAILGTLPLIDVTAHNSWTAGIEVHTRMEYVCCGNKVAIITEQRSNASPSNDRRAIETCCGHETTDGIDHSTNSAPLELHDENDHATEQRPVPLRARTALGVTPGQTQIERKAITHRWYSQMMPTARGDNDHSDLGAIKPQKCAEQNMKHRLSRHKTREPQHSQLV

SEQ ID NO: 993587 - protein, 105 aa, Homo sapiens
KTAHSLRKMILKRRKEVESILKKNSDWIWDWSSRPENIPPKEFLFKHPKRTATLSMRNTSVMKKGGIFSAEFLKVFLPSLLLSHLLAIGLGIYIGRRLTTSTSTF

SEQ ID NO: 993588 - protein, 102 aa, Homo sapiens
MTSARSTISPTKVYTLTGDQHKTSPYGRLKTRKGTGKTSGVQDNPTAPISRGPTSYPRGAHRRGTTISKTESTEQHKQPRKRHKKEDRTQQRRRTPKPRTPD

SEQ ID NO: 993589 - protein, 199 aa, Homo sapiens
MALGRHSVTILEHRDTSGHQAHGCQNTLVTPTQAIIMTGASEHQRCSHTRRHATYPTRIKYDNPKKGGRTANSAAPTGGRLRERNTSQLVPSGENNTGTKTGAENKQHIQRERAEKEPTHKADEIKRLTPRRGVLVNNNNVVVVLAKQKERKEMDDKTEASFTHNMTMSVRHFNNDAEVTQVLISLLLLLVFLFLSVLF

SEQ ID NO: 993590 - protein, 192 aa, Homo sapiens
MWPLSRKQLILENSDRYCNHWRNFAEHVVIPGKSITRILGPGPSILTPWEDMVACCLDAAGSWHYTPTFVGEWATIGHKGWNSQHSNGPLGTIRRHQTDVKAPAKNSETTPPTKKGSYQQGPCRPGAHTGNDYAGRPTHIAAGVHHAGMVSQYPSRKHTNPLQLVDATGRPRFGFSSFAFLLSKMREKRKKE

SEQ ID NO: 993591 - protein, 81 aa, Homo sapiens
LNCTILTNSPLLLRDRRESSAICSSVQEHAGLRCNVIRLKENEMMRNVGMSRKHRSLPKRQTRLPRSVNMNLRLVHGYVGV

SEQ ID NO: 993592 - protein, 51 aa, Homo sapiens
MVTRQNDHKSGAEQEKGRGEPNASSTTQEHQDNRGVRSSSKDANVVRPKRG

SEQ ID NO: 993593 - protein, 148 aa, Homo sapiens
MRAKEDQRSTVNNDTKTTSRGPPADQPTRKAINEYNNTTQAPTPDAQFRKRQSNITPRRQRHNTNPTSNNTPQGAQQQPCTTDNKQLPTGQHNTERTADTAQYHNHPAGVNPGSTTTISPHSTTQTAHHTLAGPTVINKRKKQGAANI

SEQ ID NO: 993594 - protein, 286 aa, Homo sapiens
MTSTHAKTKSTTSKSEHRTQPNVDPYRTLAPQHTEQSHAENPHATKRSSKYTNTMTKVHSNTATQTNHNHMQKESCGATERRREPTSQPQTLPHCQDRRRPTTTRRKAPGHPTRTLTPQSHNSSRKISGHTLRARLYRAPLTHPAHTAPKNNTHKDTLNQRKRETPPHVYAKHTTTMTPQRSTRQSQDNQQLCTQPPAPHHRTDLKHTRETERNNQQRTPPTQKEQETRQRNTTRKHQSQATDDSQPVERATTMSNPQTTTARQPTDTRATHTHRQEPKHNAPQQT

SEQ ID NO: 993595 - protein, 217 aa, Homo sapiens
KKKGKQKGTPRGKGGFPKKLGFFQKSAVPGNRGKSTGVPKRGWCVPLNSWDVFGERPCAVLRPVFCCAVAPAGAGAGGVGRAHYSFCQNVCGATPPGERGPLSPGQLCVVVGAKNHAILVFSPRKKGFRVRGWRRQQQFLGAVTTPNRCVDKTQHKTGGRARDKKITPRGGRQNHRLDHQVFFGTTKERPPKGGTVIKTTSGQRGRLKKQTEREGTN

SEQ ID NO: 993596 - protein, 87 aa, Homo sapiens
MLTAEKSSRPGVACRRHSSHGLCRHTLLSITRPTDKLGQHSLKPPHATRYTPYGQLAIPGPHTVIIRHYTASNHSTKKPTSMLHDSQ

SEQ ID NO: 993597 - protein, 207 aa, Homo sapiens
MEVARPLPAPFHSARGRHTGAGSLPGRPSLAIPGLSCTPNCPLPAPALAPCPARPPWQSLGSLAPLTAPCCSGTGPGPAPGLGPSQPHVPCRIPPHIPGPPNREPASPEGDALGPMTSPFARLAEQQNEIRIQWLPPHEDGHHNGTNCEATEGTPTPAAHNLHQSIHLLNDKGDSKQTSTLKATGQAHNPMIKWKRRSSATPSTRDT

SEQ ID NO: 993598 - protein, 146 aa, Homo sapiens
MNSRISYLAAASYSLVSSGRSLRTPIAQLHSMSEAVVRSAELRSPRYSRINYMYDSSEDCSYATSIEHGSPNKYGVKILECQFRGRSKSLNLVSTGNTTRGYYYWSTALTIVCEQNLRVCQCASRCLSNYIPAKKSCRTYGRVIYA

SEQ ID NO: 993599 - protein, 429 aa, Homo sapiens
MPAPCEPWLEMAAICSLGALQPCALSPAAALRWCCPMACCHGECVTFNSCSVPRRRPRMEMPNELCEEALIIPPDAVAVDCKDPDDVVPCWPNEEPGVGACALDYIYACRCYPRRSILVPTISHFNQMTCTTVAYKYTKADVILTWALCTMPQAALYQTIEEPIHTSLTAQNEVRHHQSCLSQDVWELSESLPTICLIDFTHAQLTCLSTILPLALRAHVTPLCNHFPIGPGQPQKTLLARYTLFTLQGPGTPTLAHMLPNTEIPDAPLALTHTELAIFDHTLCIYHHRAYYPHHSPRAPLFVSNLTHSGQQHTATVDRRLPAAHRLLSPRPHSRHAPFVAPLRSTFCLPAQSLRAHSAHPHDMLRVGFPHIYTPRSLSHNRICSEHSPVAGSTPSIYLVIATRSPNRVRPHIPMRTTCDQVRTDTRML

SEQ ID NO: 993600 - protein, 251 aa, Homo sapiens
SLQTFESYLLFEGEKKITIKKDTEMVPQCTVYFTIQPKKTHILVKHPLNHNISKRPATVHHICWTTNMSLSILVMVVTKGVHTSRMCHERRPRNYRLAARQALYTANAQCTRTASIQREACPLCYEERCPHVPRCGPNKEMTHRPRQRAHCDGQGVVRMNAGASLLFEALFDATRFWPKALLGLCNSPTGGYQCDKSKQPRTRTKAGVAWSFKPKVRNLGLPWHPCWSMWAQERPPPFAKETPPPLRENPK

SEQ ID NO: 993601 - protein, 35 aa, Homo sapiens
PRGGGGGVEKGRGGRAGGGGDSGREPGPSRDRPSC

SEQ ID NO: 993602 - protein, 82 aa, Homo sapiens
LRRGLRGVALRTPAPLRTYAAAEWCGACWALARAPLLLRSLLACLPPVPWLMATVQLGVVVCACPVLLAHLDPALLSVRKFT

SEQ ID NO: 993603 - protein, 238 aa, Homo sapiens
ESRRGVPAFNSARREPGARSPARAAAHSQASVTSSPQPRTAPRPLAAAPARAQAPRRRRLSLVAAMRPVHGSQVRQNYHQVLTRPHIEAPDQPGARTPPTLPVQSRYYYDREDVAWKNLCQNTCFTQSHEEQENMLTKLMKLQKPSEVAESTFRNIKTPDCDDWDSGLQCNECGINIMEQKCESVTNWTQHTNCALETNDPHKVLTSIETTLPELAGENASQEWMTSEPTSDKKGRAE

SEQ ID NO: 993604 - protein, 739 aa, Homo sapiens
GKALDKDRKSTERTERYLTETGYYKYMSAAIVHSVQTQHVQHSNVIAIHGRHATGTKPGSEHKRSRHLTHADLHTVLYSTAQTCHDTRLTSGMLTRKGYQHNLAPHPALGLPIAGKHNASKQQTETEIDNPSCMTAYNNHTPPELGDQSKDHHQSWTHTNMTPLKHIRQYTRGTYKMSQRWHHSSPRSTHPPPKRHNNDLNTPLLSTTHHILTTIARTNTTVHIDTNKHERPSFSTRVHQQCGHRATDLHIHQQRPQFTLLRRIMHEKQQHIGKVANQHLVQAQAHINGHKQIHDITATWTYQTTSNKLTIAQSRRSATPHRTHPNTKMSEGDEQQTHITRYNSEHYIATRQNPHHQYTHNHSPSPGEIDTHTRIYTSHHTAHNHDYTNTRTTQLGDSINSQHHNDDTYTHRTENNHPHDHRIATHTNDKATNNRIIQTIDNPQPTSREPTHPQNRDNHNTAHHDSQDKHAIRQPKTLQSTHTTHSTNTATNQMKASRNNAETRPDQHTTTQKRTHRTKNADQPSHTNHTNTQRPQNTHNTHTRAATTLTRTDMHYSTTTARTKTQHTHSTYRHQHNRHLPTPTSTHNADYTTTTAQTTPHRSTSAHYDRADTEQRSHRTNTLTTRTKHNKHQPTERRRTQQPYSQPRHQPHTTQPDTARQHQHTHTRTPQHRAHTSTTQQHKNSETHRQSRSQQQTTTHAVQHTTPQPEQHQQQQTQNTDQTHNTHSLRHRHSARPTS

SEQ ID NO: 993605 - protein, 103 aa, Homo sapiens
MTTTHALSRDDIVQRSYVAIPKVGSCLTTTISLDDGDIAEHNRPKLARTWHSEGRSFNPYGTGPPIHGRCTSGCKEDVKAPLRSQALTLTQGHLVLWRHEQLL

SEQ ID NO: 993606 - protein, 295 aa, Homo sapiens
ARRSRLRRGRPRSLALPPAVRVPPSVTLVSTTVWSSATRTSLSELLRLADGYPGEEAGYGSLPEQWCIRKKLVIVGDGACGTTCLLHESSDKDQFPEVYVPTALTNYVADIEVDGTHGRVGFVGQQLGRKIMIAEALSYPDTDVILMCISMRQGLIELEQIPEKWPQKSSISVTKVPIILVGTTKDLRNAEHTRGEIPQMKQAQVTAAEKDAHHAHTDGNRSIQEQTRTDHEAVLTVVPSSTQRQTNRQQHQTAARTLTHPRHKPHIQRAPPPKQPPHTTHPPPTKATNKLPHEQ

SEQ ID NO: 993607 - protein, 156 aa, Homo sapiens
FSSSLEKSYELSDGQVITIGNERILLSEALFQPSFLGLESCGIHETTFILPIMKCERWNILAIHESVMPNHKQLSCVRQNPPMLTHATIVRPTANAINGGIIMPYGDPWHKRTNQRIIRSPPDQHRYIRLCESGGLHVLAVVCFTLSIRMMESPTV

SEQ ID NO: 993608 - protein, 105 aa, Homo sapiens
MLPLTSPRVRSRRGNKSVSEARAQTRHGYLRYRQNTTVELEVSIHRIRITPIKPQAKYPCEEVVLLDIDKRKTNRKENLKCEEDQFECHYQDFGVIMYLYKYFLW

SEQ ID NO: 993609 - protein, 210 aa, Homo sapiens
QGQGRAKKTKGTKGKTKPSKTRKKVRSGGGSGGSGGQVSLKKSKADSCSQAAGTKGAEETSWSGEERAAKVPSTPSPKADLSNRVTVHSGLEDQRTEGGEDSTDGLLSCPRRPGEEAGVRGGAEEEEEEEDEEEEEEEEDAQQKPAYPPGSDQTLLQPPKSTDTQSESTKERENRKAEGRGQDNHGDIQDWGNAWRPERMRPGKCGQGDV

SEQ ID NO: 993610 - protein, 70 aa, Homo sapiens
AVVVSTEKVSEDSDIMHDYVVCRVLKAHTTYDRITPTLALDRTSFAPVEELLLMRRHTTRREISVDCRSK

SEQ ID NO: 993611 - protein, 126 aa, Homo sapiens
MDTSGAIILWYTWTQNGQETVCLASQSCLMQEAQCGCSQWKMRADARMTTTFQYQSNPVKEVEVEIRAGIVEFARARVALLLLRDPKGVATWSLALGGIQTLSRGVSPREPGGIPGGLPLQGANMP

SEQ ID NO: 993612 - protein, 393 aa, Homo sapiens
AQLRVSDGSLRVQVQATSATTFFTRGFLKAVTREFEPLLKPHVAVKKVPYVDEEGNLVKPLKPNGTTRLDDTLCVLTVFRFANEPLLPWNVLREEDLFPTDTNRRRQTDRDRSPHRHRTGPASPQTHTGWDICGPGHRISWMPNGGLDSQSCTRLPPNGDPPDICEISPIGCLTSGEGEEVYLQRPGKSQVHRLNPWMKTKAKGAANCKEIHDHDQEHAHRGTTQRENKKDHRAILDRHTKDTNNTPEQSTRKNQEQGRDKQDKDTLKHMNKNQHDSTTRGQENRTKKENKRQTHTPKRQGTRHDRQTRKNKTKPKAGNRGQNQRKSRTKRRGTETKTGDNEDKTHTKEKKTGKQSNEEPKEQTKRKTVREGPQSSENKQGAKSSRKRDTQKM

SEQ ID NO: 993613 - protein, 288 aa, Homo sapiens
MQGILLFTTNVQMSILYLHHFHETGHFLLWYCMGGSCAGKQPVAMHLTHNKQHAGSPSSRAVHFPNTNKHPLASNSTVSKESKVTRKYYSRTIPTTQSRGGTRLFHAPRNAHTLAKVHRARKNGPAHQQVPQCTKRHDHHQSTQGARSTQTQTCGSQASPHTEAGQLRTPHTKTPAQACHQTRKTQDQPIATTKTVTKSDAHKTHEEPRITAEKENKKNQTHKNRTVRTPHPPQQEERRKQTQEREGHRGTRHNKHQTNPDDHTHTPKTREQTNRKRKQRNNEQTAEE

SEQ ID NO: 993614 - protein, 321 aa, Homo sapiens
MSGHSSEHKAAKKTATAIEETPSCYPRYTTQTTPDYSVRTTNWHHYNTTRTPIQHPWGQPRRGQLSSTSAKLTTNRAPGGLNKNGHTKLAQTHSPVKNKQRHAVSGLTVERLTPQDDHHKIREPKLTHTETEINRGVHRDNGHNKNKCGGTHKYAIDAAKSDPTIATTITIHHNNPDDNRSDKATNVPATARTTNVGPRTTRSSRRTPSAQPPTEQRGYRDNIDGHRTVAHQTHLQVTANTYQRQDENTTRAVPQHNGEQTQQPTAQWKYNNVAKCAQQKQPSNQTRQKSRPDQNKLAEPTMVVDRHIGSNCSETQSDQKE

SEQ ID NO: 993615 - protein, 453 aa, Homo sapiens
SGDRVSLSHPGGSAGAPSGLTVQPSNPPGNFRVTPSLHSAFREYSLRTIAHTTRAQHNFFFIFFFLCGEKRGGWRQRVAQEAGLSKHPGATRQHPHPTQSLPKEAGESGGGEPKVPPRAPIVWRLNYTRGGDTKQQKTETTTHKCAPSSARTTWWAQRSEQRGLNHPRGITPIVGTTPRPHRRPLRGRSNTPVRRTESPTTGGENTPKTRDPARVKPAAKQARGGGTRAPKTTDHSSRRGGKRAQHKEAIGSGPTQNRRGRNTSEWDHTHTGEAHPTEQKDAPPGTTKTGGNNTDRGARERKKNRKSPKRPTTPALIVRERAQIRNKINSPDGEHNPPHQQAGGGNTRTAAATTSAIVDQPTSETNKDPPGGESTHTIKRQKRGVQQRETGPHNQTKQSRRARPNRDTTHNSTRETNETNQYTPRPNREKRRRRKNTNKAAADERKQHKQEGS

SEQ ID NO: 993616 - protein, 500 aa, Homo sapiens
MPTTFGSFNCGDAQEDSTLVRRTSHSFIGKGSTANGAVNEYRTPLKRRGIRTLRGEAMQCRWGDFTGPTLKKGNPCENPSFKGIAKERYSSTHNFFVVCHLNPNVNKPPPFPFKRYLQPTPVSLGFKSTTSFLVEGGMAYINAYAPEEEMAKWGKRTLRGRVPILLRADKSKPSKGCGLNHRTKNAISSRAFNGKGQTADGCHRNTNHDWLFEKIRKMSAQKFKRGQKERASFWIEKKGQKKEHQSATKNCIEGGEKTDRQWLFHTKGGVSQKKATHPPKTDWSCPLTHRRACVFRPRESYKIKFNKAVGKQAFRAFAKPIAASKILLGETTKRGSINFRSHTFKFKAKKEHRVKNSEIHKESMLNGFNNTQLGNYDKANIFVALDNIIRVDKYSKGAPLWAEKYHTANLLDSRKTARQLRNKPYRDTQHSDVRNERVPPHTLIKHRLGENIHQTRKKPNKGASHTIYFLKEPRVLHTMVGRINTPLYSETKEHYNRCRS

SEQ ID NO: 993617 - protein, 179 aa, Homo sapiens
RTRWANDKHTATLKDEPDRLYVVSLIIFIATDITSIGRPASLIDTKHPTIYEPSHGTSPYERARDDRLFARECIKNVPRRHFLPSEGIDLNRPVCSPITEYYYSKSHQAYSIYRTQIALARDAYSRLNDYCKATYRTMQRYMEARHSLDDINDEASLYAYRSSAISNTSRDYPRNRCRA

SEQ ID NO: 993618 - protein, 83 aa, Homo sapiens
ESYIERLLVRIMENLTQAAADARRDPPIVVLLSLTPGGWAWTYGDCPSLLLNSLMPAVGHRSVFGLVTPGSSPIHASAWGLLQ

SEQ ID NO: 993619 - protein, 237 aa, Homo sapiens
MRFLTVKVLAFVRAVWPLLSAVWVDRAWVAGCRRVAGMGMRGIDAARCSRVWGLHRHWGTRGLMNLNECGASESLKPLSVRCVAMMESSEWGDLVWEVKRRLSWNCTDGVWRWNCESLSDEYAGVTARLGVGIGGLAKDKKSKRCEIAEIRGSEEWQYHYAEKRRQKGTDRTEGPVTGKSDEDHVIPTGVLPFNTENTITWSHLNEKYKTRVECNTTNRLKSKEVTTGARHRTHAPE

SEQ ID NO: 993620 - protein, 140 aa, Homo sapiens
MANTPTRPRGKPNNRTLSEHKNDAANNITTVGEGRQHEERLLRNRNQLTKAKEAKQEWTTVNQSEPTAHGTRTEQDQKQKTQRQKTKKETTSTDKTTPTKTHNTHTDARTKQKTRTTNLENTRQTKQYKRHHARANKTEK

SEQ ID NO: 993621 - protein, 449 aa, Homo sapiens
MVRCRHLVSARGGCVGVEVTDKLGKEISRPTHYNFFNVNHSVQDGRITLHKHALGLGLLARHDITAKRGNYVKGRVDRRLIAGLLKYGDVPSENTSRDLVVRPFHSAFARAIYVVTEKGLRTMMLKLWHGGRTLLAGIRDTPSNASGRLLSVSCCLSMCSPLGLQGSRFRTTVAAAVQVAILWVCERNVGAVPELTSRVNHHQSCCLEYCTPRYTPSWLAWVEPVRTLAAKFEEDNRPADGCRSAKLHSGRPLEIRRVSWLLNPQEGTTYDPVDQQQAEESNNSVQPQNQIEFEGSPKTKPLNLVNEPPITRRLQYYLKGALNPKNSKPSSKWRTLSKTQKNREQHTYPEKNTMRHTYLPRAPQHNMTSKPNLANPLRLKHPGTQDTENQGKDEQQEHTITSRRQDTNQRRRQHVDVVSLLVNNYTAQTPTKKTAHKDKHADANNNTAR

SEQ ID NO: 993622 - protein, 249 aa, Homo sapiens
MRSLDSDSGTTAVVALIRGKQLIVAKRMMILAVWYRRGLAKALMTVSYDHIDLEDDKYETSTTRECWCARLTRGVGEIRRGSQASPGAIGDHILSREDKNRAEREEQDLQSFRDKSMVLDSRLSRGMQFNGSLALCSGDSGMWLEQPGEWYDFDSIREISAVVMINGELRVVSSIVDELLDQCLVPDSSGDGTGCDNIELHSSWCFKPLNRVESPGREWEAKTTRRCSSTEGADEDGDRTYKYEARIEY

SEQ ID NO: 993623 - protein, 357 aa, Homo sapiens
MSRHTLLPAAAQAPGKCLAESRGQTDSGPARVERTQSRSPSNRHPGCLDSQSIQDPLPSQQHYSSSKERVPCLTRQTRRLTTRLTNGSLHEPHDYPQTTSYPSEAPKRRRPRTLWSPGPPEDTGRPALQSTCPLTLHNDTRSPHGRYVTPSTPNCTNSTGGTPTKKHTNIVSPPIPKGASDTATRASTLAATAIRLWGRAPPRQAYLPTHGAPNARTLTLHITTITTHDYKRHYPATDTRLTPNHFLNSAQHHAPEHSTTTPATAPPTIPGRRDTTPPPTPTLNHDPHNTLASLPAPHNPPQHPTTHTNNPTPPPPPHYRHPNIRYHIPPHNTNTPYTIPPHKKQPTHHTLYHHTTQ

SEQ ID NO: 993624 - protein, 146 aa, Homo sapiens
MVDPAGPGSAVAWAARHAGTRTQQQGWQGAGPKHEMREQPGPGVPEQPGLESPHDPPRRLWNAGPSHWIGGRKHSKSNRRDNTWHKHETRHITHRPTITACFRDHREARRTNPGIMANARHRHSRGRNTGTNTERETADTPQGNEN

SEQ ID NO: 993625 - protein, 407 aa, Homo sapiens
EDPPCFRFTNSMNQEKLAKLSGSGPDRGQGYSSQTSKKVVHRTATADDKQASEFSKKTGCEVISLVLKQVNMINACMGTDSFHFNNPKVQASLSANTFAITGHAEAETNHRNASWNIKSACVLDSFNKPIGKLAATSSHGKSWPSKATNNPEAHCMQEACMHVRASCSKIWMRHPTHCKLHSTVRLCWKQAWTQINTNQLCGSKSPLQTIGATSPVHKFSHSSPLRASFTSHGRTDTRTHTRDQSRNNAHRDTYPPQEYTQRATHNEARTATRTQAHRHTAYRQNKGQPDTKRKQGEKQQTTAKRKKHNNKYKETDTGKQRKAVEPGAQRHANQPTRHGNSAQHTPMKKTGRRVTRRKRQHDKTSSERQERTNREREQPRQARARITRLANGAQMQNTEKQGKLTQQ

SEQ ID NO: 993626 - protein, 105 aa, Homo sapiens
EVPRSRIVAPYLLTSAKGLIFKLEVRDVHNKGVSARTQSFHVKSTRLVSFNEELQPTRRQHHMTHNVREWSLSEVWVLVYFSFSLPPTLSCSVTLELVDCKLGTM

SEQ ID NO: 993627 - protein, 95 aa, Homo sapiens
MTEPSTRQAGSDTHKDRKEDTGDDQKAQRVKGALEDTTRCDMKTLNTSQEQDQAELERKQPGERRKRRKKRAKTTTQKDSSKWKNEHKRVASYEN

SEQ ID NO: 993628 - protein, 471 aa, Homo sapiens
YRCDLSVFQLYSPAGSGGRNLTTTGHHSRRRHQQGGVLVTTSCTRPTDKEDRWGMVDDRVCKKCPPQRLARPRGTECRNVPAHTSSYNGLCSSTSTLRRSYATPHCMQTTHGPWNLNGSTPTLQLAAYTSHRTTGCATIHAKSASADHRAITPADEDLTTRWTAARPAEHPPNATHPTTCPPTPLAKRPGSRAPTDTTTGDSPKKNMHEGRIAEPVTPGQDTLYQTDNIGEADQYRRRGTISMRHTHAYNGPLQQNHAMPKQPPPHLDQDARPCTPGPPAPPRPHLNRMEIDNESGNPNGQHPATCENEHPPGVETVTTHYPRSDTLLPRTPQPRRHMPRLSKPTREHDKPTKNGARINTTCKPSPSLTAPQHTPSHDPPPPRHTTSRPHTCPPPQPATTCPMQDTDTHHPLPARTHTHGKNSTLDAPPPIRQPHAAHSTAANTAPQHRQHPSQNTHAQLIPHHKERHTEY

SEQ ID NO: 993629 - protein, 147 aa, Homo sapiens
MRMMHYTYVAVTFMLTINHIYAVWSTPHAVLVHFGPLNHHYDTTAACGADGQTYSGPTPAGVRDTPDRRRTQESHKSTRRGADATHRKGQTKQRLREVRSRATGYNPSANHTPHIPCGDPQRSGPTQAQTTQSVRPHITNDPTLCSC

SEQ ID NO: 993630 - protein, 168 aa, Homo sapiens
MPLEIASYLAEHGAPFLMDFQSTALLARERILPPCTMDVTKLLGPTGFSLYHLLCTYHMWGLLLPQRDPGPRWVTHPRGRPAAHISTETRREQPDPRHPAATDNTRTSALNMQTGAAPRHPIAAAVPDSRTTGTPPAPVATKCKPDRHTTKTTLAQDRTRPPNTRAAP

SEQ ID NO: 993631 - protein, 429 aa, Homo sapiens
MSGTSCETNGQPSTAHWTLELIGSLMEPLRYSCVGRKPQHNPTQAIAYEVAHLASIPRSMPACIAKSCSSVSMRTAHTSCCAWPQLHGGCANLYDTIASAHTPPGTANTHFGWDNIPYTFSRREHGTPSLSARMDLNPATPENARVTIPLPSRGPLADTISLPHAHQAAQNALILSAATLPVGNRQRWLRAFTSTKERNLQRQEPRTERSDLSRCHHTGRQTNHPSQPTTPGTTQDTPPPLHTAPPRNTSGSTERDFTNKNTGGKPEATRTHATSPHNQTAGDEPNARNKKTNTHNRNARTNKRNTRNQSPDTPPGTATEPPPHHHQDRDHPQPATAHHRHGPPQHQDNRILTLHRPTRPTDKPDANTTDTKRHNRTTETHLKPRQPERGNNAISARKQTQEQHATTTSTATSAQTPPHNKPPQTSITH

SEQ ID NO: 993632 - protein, 152 aa, Homo sapiens
MYIGPVLPSSICDSSNRRNPLANDSSTVTHLLSLARHWGRHQASYGTDLARLTIAQRPPHDTRGDNGVTWRMDQQPRIRTRSQVQIHNRPGYRIWTSSSTKRTPERRTEYTKEPTRRRPCVATRRMKGPIGQATYLSPTDTAPHHTPDTTHT

SEQ ID NO: 993633 - protein, 296 aa, Homo sapiens
MPGFHSTPHIILASSHSRSRHSCLDNSRSNNKRLGPTTESILRTQVGITQHGRYARKHNACLSPPPQRTHKPRTNTRMLRTHHPCSTAHSACAARLLQNDADKPITANDYAPPLRRLRHRVSIAATLNEVSYESETPPSPLVTTGKPLTPYCGPTCVTLVPRCRNISRSFPWSHDTRRGDKRTFYPLLTPTPSYLACLHTHTTEKYPLGHVLRSLIASPTGNFRPHTPGPSNAPPSSEIPSYHSAFGAVIPDLPTRFGSHWATRVSYALASGLVGYPGPSVARGPLGMVPPVDSAL

SEQ ID NO: 993634 - protein, 214 aa, Homo sapiens
MSLVYFNSYYTIVMTTGVRKRHERVNNLPVVDYDISRIVPKTGFTNDCRIMQWGSHHAAMNSLSPNPFSASLPPPSTALTTHSRPLSCSATPSRNILASTPEHMMSLAHLIFLPHSYTKPSEVSTNPLLRNANEPTNPEPSAGQPGAWTRNSMLITPMSSTVHTPQGHRLTPSQTVDPSAPHSGRRPPTGGRMSFDSAYSRRHPPGPPAPPPPL

SEQ ID NO: 993635 - protein, 202 aa, Homo sapiens
MGLCREMADLMDQLVEQRYDVFHTHMVIVETLSEDHNSLVLWSFQYIIITIIYATYDIDYCPLCFKEFCYYLIKAAKIMSYSYPDELVIIFTSMDTLVRGEMTELCNNNLLGRDESGGTQEASRREKTRCWLYLLVRPKNRKGRSWAIGPRAQGEELLARLLGMILRDVGHDGWRVEDSSLWRNSEGGSTKDYFVGLPVIYG

SEQ ID NO: 993636 - protein, 249 aa, Homo sapiens
MGKVKVGVNGCGRMGAWSPGLHFNSGKVDDSAINDPFMSHQLHGLHVPSMIPTQWRNSMAPSKAENGKYDRSMEIPITIFQERDPVQEIKVVALTVDRRRTIAIGGTSHLDDLSSANDWDDKGIGENYNFLHQGERRPQQKVDTSSSFHGSHKYPGDLNLDTQAQEGIDQITHMATNGVETTPKMGKRQTGSIGNHAAHHGDPAFPKKDQSHTASQQDNTVGTITPSASTHDPETLGMINQHAPVGPKG

SEQ ID NO: 993637 - protein, 445 aa, Homo sapiens
MPVLSGCSHGAAYFYLRPTSLLPKCVPTTDGRYDGHGHEPPEAPELLFSDCELKADTDYHFKVDSLMTTEHQLSLRTRPVQGLVHRMSRTLVEAERGCNYRRQSHLHSTPLRNSCNNVCTAQQVFPLGRHLGNNTHQLVFKVYSVRSRAHVHITCDSTLRSCGTGTNCTDVHEADPRQDSARDTHLYSIICEQRATGPLPTAANTTGTTREHSKNPACHACTECMTALTGCHPGMPAGRLPDSSKNNTKDATTTPQDNKTHTTTQATRTHPNHKTRHNAPKLATGSSHTPPADQSPTAPGPPKKATTHTTNRTRRPPRKRETGTTPPHHSRPYRQATHNATQRSEADRKTAGHESRRTKERHAARRPTRRPRRNTGRQQDGETETRRQSRERTGDRGRQDRGQGKRTTRTRTGPEPAASPHPTGEHAATQQHRRRTEKPTDLPEQ

SEQ ID NO: 993638 - protein, 376 aa, Homo sapiens
EGSQARLRWRGSRALTPDHGPRVPTTVWPGTAMIKAIRKSSSNARARRGLSKLLPGPTVRDTQQRHHQGDFPFWYLRENAHTASLTLPSKARTHHIGTDLTHNTALYYDIYRNVPTTALLCWTLFSRTADTLPHLHTHSTLPTYLCLDNPLSTTMFKTRLLPLQAWDLGLLTHMPHDPTSRFTQNQLTIRPTTTLPPACGGAQCATSAKNTTSTSTLKNLYTTKAFELDHHHTTRPGTTTSSHTQWASKSRPMTSRRPQVALGHSQRRSVTEQSTQNVLSPAEKIALRTIHTNHYGMTHTSSTYNEYAHTPPATISRNTHPTSHPHRGPPNTSDKNTHGHHQKAPTTRSPTVTPKQRTHDTQSADNRHTPHPDPRH

SEQ ID NO: 993639 - protein, 214 aa, Homo sapiens
EKVVSIKGNSLQVASTPPGTQGPPNTLESSPAVSSGWKELGPSRDETGLAMGELFPIPKILGMYAPIAHTTYNEMGDAGPMFWCFKQTRLYHTCGFVHTLDTQKCPHTYLWSHRCVRHMCVWTETALRGSPLYYRVDRVSQSPDTLSASRDIARGVCVYVCVDKCVNSRCGVHVQTPTKAMYHAGEPQTLYRKIYIPARGGPQESMIAAFNPQD

SEQ ID NO: 993640 - protein, 242 aa, Homo sapiens
MADDCRCSGGARGPWWTWDGEPAVASAGGFGSGIRGRGLRPVDWGRGLGRRSSAGGKAEDKEWMPVQPSWAAWSRHMKHPSPWRQHLISSPCPFRNQQIIDFFLGASLKDEVMKHYASARSQHPCRPSAPGSRPSCMHNRGHYNVQRQDLGVHSAPPEVATDTSSGAHPSMDKLIHRHPCAEATGRNKIGKDPKTCPFAKGEQAELRVLVLVRLIAGTTGGTGASYSGTLLPSKGCSMMGWI

SEQ ID NO: 993641 - protein, 135 aa, Homo sapiens
MTTASTSQVRQNYHQDSEAAINRQINLELYASYVYLSMSFYFDRDDVALKQHFAQITFIHRISMRQQGTMHEKTACKLQNPTQVARHLPSRIIEETQTVHALGSSGLECNGSVHYIKAKKCAIQSITGTRTNMDH

SEQ ID NO: 993642 - protein, 337 aa, Homo sapiens
MRAQNRRTTNKRKNQTKQQKHHETKKRGTREEGEPNQSDEHDEKHRENHRNHNTTQYTPNDDTRTKTKPKHHQAEKTAAMYHSKPQSEKTKATPKKTKDHHPTLDEHSSKHKHKRTRRDTPGGNDTEYERTHKEADTNTKHGNTTQHKEKNKPTRTATIALTQMETHKTTTKTEDENTAHTKAPQNQKTKEKKTKKRKTRQTTTHTQTPQREHTQKQQTPRTTSKHSMISNTRNTHKKEGSEDRTTRRHRKSTQSTDKSRQRRTDRKTSHTQRKPRRTERRHTQQQREARQKHTQPPDDTHAPQPQKQAKEHERHSHPHNKKRTARRTQGPRRRADQ

SEQ ID NO: 993643 - protein, 219 aa, Homo sapiens
TRTETCQTIQGQCCLNIHIAASSARMCCLDPQTYTTGVCCLDAHMCRYGIRRHTCTDMRPGHTDNAALTRTSARNIALEHPHTLPDEQILVVWHPRYCNMTEYGVPRTTSNVCAEQQRLPTGRRVNNAWPWHNDVKIMRVIAQQLSRKTILVRYHSHSYDTGNSRMIADITSSGEHIEQHCGTTTTMNKCLAIQIATSTVQGVFAMDRNKQCCSMSNAS

SEQ ID NO: 993644 - protein, 248 aa, Homo sapiens
NRVNGRTGIMSDGPALLLDDSNGTLALCLMQIPNREEGEEYEKISMDVFDDRRRCPALLGTLRNIHSPAFLFIPTRLLTADELTIEEHEVLASDDDGDHGQTGYRLEHNSWPSGYMCPEKYLQFPTSNSAPEHAAEPMDASGQTDTQRPAIHGTQNSYSGSLNGDARGMFVQAPHSNNPPGQDKTGCKLISAPEGRTKSRIIDTTDTTTDEAWLLWKANTNERMESTTRAKRKTTSNNKDETPRMRTP

SEQ ID NO: 993645 - protein, 113 aa, Homo sapiens
MSGQTHTTKEPKKADSKKNNNKKQKDQTTGEETERKIQEETEQRGGTHREGGTNTHSKTQGTDEARRAGEERRATTRETRAEEKNRPRERSSQDKNQHTDKRDRESKDANKRR

SEQ ID NO: 993646 - protein, 237 aa, Homo sapiens
MTVGPWEFKYNISQVAASANFTLFGGHTGVKLITWLNKNTNTKEGAAHGYQKRRVYRPLGGGAPPRAYNARLYPHTGYIPVGAPPQGGGPPLIIRAAEELRHNYTNESALKGPHAWGPPENRIYITHQQGGSESGKRVREKTNAARTHTPVGREHPPSRGSKQRRNHPDYNPIHVWSGGGVTPPLHLLGGRNNNNTTPIHQREQIFPTNGAPKSGGTHHFHHNTARPQQRWQPTWRL

SEQ ID NO: 993647 - protein, 387 aa, Homo sapiens
VEHLLPYSSNPANPKPKRVYRSAYDYEHSMTWQGNAVKRDSGIWINGFDYTGSFITVTPSAFLRSMIVSELTVRRSAPLCGCSVGIFADALSESGKNWISFLPQKFHPRNRSIISELISKRDRAPWDCYNKLTFEAHRTKPYVRSSVRAHKGSTHFSVVSMAMAPQSQVKEETTLYFNSHGLQAICMAGQDKKCRYQKNILTEWSPWTLLPISVWGRQEIPSTGCSEGQRSQIGHIHLPGCAHYEHIEFHSGGMKPKRIATGDSPMCTGATNLYVHDATTEQEYTDTSQERTARRRHEDTNRQGKQITHNQPENDSNRKRQHRKTNKKKNRKDRRKGDDATNDEAPANKTEARQGKGNSKEDTDNKTRKPRREHNKIETIKDTNQKG

SEQ ID NO: 993648 - protein, 142 aa, Homo sapiens
MTPEPFSSHGEARRVMQLNATIREQESIFSYDNVPYNYRTLELKSIATDAQSNLIQYYNGRVITNDPQVNSPQAECDHLSTDAVCIATKALEIGRLKAVEGNNIVYLISNNSLGKGSPIHRKRTFGYLNLCIINEHALGTFI

SEQ ID NO: 993649 - protein, 227 aa, Homo sapiens
MARCNTRKHIPRPPHTTCPRKACRVRDNPIYYLRSFLASRGFFMSLLPLQPSPYPRNIGGHMDPNRHHPVNPRRSPTPKHIRMTRIRSIKSPELHPISLIENNRNQIIARHHAILQLELGLYLTLLQASEYCRVSAFSISDGIYGSTFFVATGFHGLHVIIGQLSSRICSSANKYFTLHPKHHFGFEAAPDTGISLNGGRYFRMSPTYDGALTHNPRTGYHHLRAKT

SEQ ID NO: 993650 - protein, 145 aa, Homo sapiens
MELLPELWLRARSNEHAPAYGTKYSDCWPLDNHGVSTMPIQCSEALSGEKNSTVCILNLTYKSTCEVYEHCTVRTELNAMISMIFLRNHSLIPGLGYQSPDEAKQSERLKARQHTFPMSTTLVGVPVRLLNRQHDLGLWDRPRLS

SEQ ID NO: 993651 - protein, 188 aa, Homo sapiens
MACKKNTETSSQQLHSALDEFVDDNGQPLYCVKEHEDSGEAPFSSTKVKNKGKNKKAKDSKAMSVGVWNNFSNSKELRISLQVKNLGHPKFEYWKAHLARALSNLREEGNKKLVDAPLIDNTPRNGTNVARQSKTSHMVETNSDTKQKQGFAHIRSRTLNRGGEEHRQHHYYEQVDSRRIIAVNSKSH

SEQ ID NO: 993652 - protein, 248 aa, Homo sapiens
MPQLLPDFSWRIPRFPLVRGHSPRKHPAGVLPATKDISTELCAVPGSDQPCGYPESGKVLSAGVLLALSLFSPSFCFVFLKSLALLQVQVPHGLRLQKNPSVWQAYGEDHTEKMNAETPGHGSEPQRARHQTDSHGCHPTVAAFTFTWNFQNLRVHLHPCCPSAAPTHLYAVPAAFLVLSSIHLPILDKVLTHLCPPFLPLFPASLPPTIFRSTPHSPSTTLLSLVSHTLYGHTTFPLSLTYVSPRHL

SEQ ID NO: 993653 - protein, 268 aa, Homo sapiens
MVLLVTNNILIKNFCCEPVKKQSFSHTTSLILSHVALSDSIFSILPAPPTLSHTEVNQEYLITERDPPGDYRKSGCVLYLDSNTENYHHYKWQTSTYNDTLSKHVGNVNNGISAPVKIILCHVTYIFGSYYSYIIIYYLILRPTRYTPIILMHRTYCVLPGYKILVRDKTRDNTNTRRHKPAQHNERQEPQDYHDKGTRRETSARNAKSRGARKTREGRGGERRRPGRRAKNTENGQPTQTQQAEKTRRGGTKDTTAHGAPPTGAGQK

SEQ ID NO: 993654 - protein, 154 aa, Homo sapiens
MAIPNAYRTNKFLGLYYNYATGPNVVGPYGLLQPFLLTPIKLFTKRAPNNPCHIYHRPRLHRPLPDHYALTDRSFLLMNRPSSPQLPQSPCSKLQIICLHIYSKTASSLFRVSTKPSRSRLKASKIKIYTHEAGSSLEKRDIAEMKSFILKIIP

SEQ ID NO: 993655 - protein, 282 aa, Homo sapiens
MQQRAQEQSGGKNTKSGAKQQVGGQHTVWGERGETPPPTHNTEAEGGGGRGSQTYMWGGARHHNSYPKTKRGADLILTQTRPPDGRGKNSHLSSQNDFTTNEASGAIKPGGGGGRAKPPTYDGRRRGKTTTSGTDARAEAGTMQAQKKNHAGRYAHHTLRQGERESQLNIMLRYNKKHNFNHINTGGGGEEPEADCTRDKPIRQQNKTLPTQRKQDHTPGHHNQAKPNELAAQSAATDRTTRMRHSATAAATHLHNKRRRQNANDTSHRSTTHTVQSSQHKT

SEQ ID NO: 993656 - protein, 305 aa, Homo sapiens
GLTVARSFSDGPLPWARGLCSPHYNSHGAAGAAPLYPPSWPGRASISRSGPPAAGTRAMGGERWRMWSVGKRHMGGGNAADFISHDHHIPVISRVIHDRKVSPESVLSRSTEGRRLVLSGHRRTRVSLFIVPSHAIPTDHGSGKDKESTDLQLIDPNICTVNSEKLFKFLADILPTEDFTLVTLPDTIAYRDTVQKDMSDRRGRYSDEKMARGAWKNGGKRRTTQKRHENDRHDRKGCGGQQEQERPRELLARGATKKIGRLMTPQKIVLAHTGYTNKMQRRPCVRVFLPEHLGGTIYPTIGVLT

SEQ ID NO: 993657 - protein, 225 aa, Homo sapiens
MVLAARSKVQEFKLGNELIPALVFCTARNDVGLLFPSDETRCECNRLEDVEVMWSPEASMVDSGHRIVHESERIPLSGGDLVCTYSAMALASIASACCVLFVPYVMLRASYYSRHASPVRLCRVWTPHIKHRRAMIRTSRRREVNPTNWRKVRKRRIYAHSGQSYRPETGRHICLTERLVYREPSPRLHRTEPRITGLAKGSVSVLGVGAVSRYRVRTDTQGMFP

SEQ ID NO: 993658 - protein, 109 aa, Homo sapiens
MWAQSPVFLGVFFFILPGVPQFILGGRKYLVSNNYTGEKKSLIPLFVSRMSFYTPFSGLEQKRVCVEHLQHHTGAFCGGQKQKNSLLSLLALVGGKPGEGCYSARGVLV

SEQ ID NO: 993659 - protein, 113 aa, Homo sapiens
TSVLDGPDGGSTDTGKHIKENDYYTPTGEFRVDREGSPVHAQLPHVLRCVELSLGQVYTEAKRPPGFEAVSENAEDGNKDFELDVLEEAYTTEHGLVRIYKVKDLDNRGLSGT

SEQ ID NO: 993660 - protein, 231 aa, Homo sapiens
MHLSRIGRLWEGGYTLIGCHLTGEPPSSGNFFWSTLERNRSLEPVGHRGIPGQVSLAIPQRWGTRMSARVASAGNTTLMSTVWSFERTPVTNDSQGAGTTLRIKRPRGRERAARGHTADTILGSTRISQGNPAPGYSGTNWRQRGTAERGHLEGRDKTDAPTTKIKTNTSPLVPTRNTEAKAMRIHTTSDRPPHHGRHSSTHTQQEAPATTALTDEQATSRTELTPEHRQP

SEQ ID NO: 993661 - protein, 364 aa, Homo sapiens
KQALLASDAGRCNPWKEQRPAMSTQSMAWGLLNSERHSVLTWIDQTRFRHRLFDELNSDPFVGVCEWQQRTMKKEAGGGGVGGPGARGAARSGSLAQIQSPTSGTAKQRAHRKSQKGPAKNPYAPQRLAMCGRRKDGDVSACTVSGFDEDDTELNDDDLDTTWTVTRDNLTGVNGTNNLEGMTSKRSRHLRDIDSIRKSHLKTQGERTAKFSSMTRLDLLNRTYCEGQWVVLWNEVEGAVDVEWAEETGYDTRWKNGEVCIGIVEVEDLGLKHAGQTVEVGDLTIGEPVRENNCTGFTSMVMWKHRRAEPGYPKCRTCNIGDATLKRSPEGPNNTGPPAGRTNARRQHTHANTRGRQARATHKD

SEQ ID NO: 993662 - protein, 172 aa, Homo sapiens
QIRLLIRQEGRGGPEPGQEGRGDPEPGQEGEEDPEPGKKAEGAQNRQEGRGGPEPGKKAEGAPNQARRPRGPRTRQEGRGGQNQDKKVEGAQNQVKKAEGAQNRRKERRGPEPGKKAEGAQNQAKKAEGAQNQAKRPREPRTRAKKEREPRIRYKDRRGSGQKGRQESQPTQ

SEQ ID NO: 993663 - protein, 174 aa, Homo sapiens
MRATRREDTHQNTPEPPHATNTHQPIERAPTKAGERRDNHQEARKNHTPTNDTQSSLQKKTPTQKKYKTTSQTTRRGNNQSQDDKKRKERRPQKQKERDKRTHRDKPKRSGEKTNRHKKVAQASNREQATNKDEREGNKDTKGPDDTTTNTTTPNKTYFQHNQNKKKKQETTQT

SEQ ID NO: 993664 - protein, 329 aa, Homo sapiens
MAKTGQGVGVTGRYFLALWSTAEPVSQSTTSDYQWDVSRNQPYIDDEWSGLNGLSSADPRGDWNAPAEEWGNWVEKKELHILQSQEPIPDDQKVSDDDTTNRERELFQLGNPKKKKKTNKKHGEDNSTAQDTDRLQNHRDERRPSSESPLKTVQQPGKSFCLEDHKALVIQRSTRRTNSQPIKTLPSCYYYRASVILSKQVILDRSSYQVPHILKKTDNSHGRITSKEVCSLQTVGNKRIPCHYKEKQRAERKLSRMAWSEPCLKKSEHIGTVRGQTEQLEPGSLTADNTERNAESRAMDVYHNAGRNATRHREERRSADQDTSEILIP

SEQ ID NO: 993665 - protein, 479 aa, Homo sapiens
MVGVSGIMVVVWAALGHQGLLVKLLVKDGYLLPSMTPSVDLNYDGVTCSGMIAIPWANSSGRPVKVVTNGRALSVNRKIPSLTRSRMLRSPPEDQDGASAGADVASWSPVAVFDRPVAEGWRLICQGGSLERVDHLLSPLLDCRPMYRRCGVEPDDEVLSKRLKTRPGMATCDANNCLGTPVAKVHPMDHFGVFVRQDFIDTSPDAFNVNPKRSVGWAPSGENCGGEKGPPGVSQGKVFSLGATRGHGTRSEGGPGGKPRKIRNGGKTPNGDSALPRGTPQGRHFATMWGTTKTAVLRKTRARLLYETHTINGEDVHNRTDQQESLIQTKNNEDINHNKKDELPQAGRGGTATTRLDLSDKRTEETREIAAVRRKAAHSGNRDAGCLLLLVSFQWGLSRAVRGASERRYNYRQTEKRQLRRTELTREQHEQQNTAYTEETVARLQVGARLANDSDELSTSTERRGGRLRNKTQQRTYTQ

SEQ ID NO: 993666 - protein, 109 aa, Homo sapiens
ETVSGNTDLRVIEGVGLDTHLCVVPNYSITHEAEILRKSVEPEAARCDASIICQKNYKTGKGVRIIARRDNENIQGGYREKSLGGGISLCNRHSIEIWRFNGEDVKEII

SEQ ID NO: 993667 - protein, 50 aa, Homo sapiens
MTKEKRGKEGGQTEERQARTAAPGRREGERESGKPARPEKQADKRDLRKQ

SEQ ID NO: 993668 - protein, 104 aa, Homo sapiens
RPTRRHASGSQHLHYEFPHISSGCREKTEEDPNKKRKQEKKKEQEKKTQKKGKKRTKEEKREISKDNQNADGPCTGSAHTTVTPDGHRTKDTQVTTQLQGSHWR

SEQ ID NO: 993669 - protein, 358 aa, Homo sapiens
PPVTSPKAALHSPVSEVAPVNSPILCAPTFPPCCPGSGTPPAAADHCCLRMGTPVPQNWVTLEGDFVLMLASRAATYAPDLVARIRMQRIRPTCLVHHVHRDAVRRNHRGDMRLHDAILHLAHGSVGKTTSGHGACPATLAYSQKPPDAHSRHRSRRQQPSRGSSIHRMTHACSRCDAMRRLQATLNDTMRHREHRTPGPYPELPGCGEAPEQEKQAKANPARESRADNIIPDWKTEALETKAGVDHAQQQLAERSETRPPHSGTDAEIQGNPEQQIDAQARRQHNGTREQEAADEEADTEEDHATDREPDTGTERRTQPQPYQAGYVRATKTDTQAEKHGRKRKPDENDTKHQRHRH

SEQ ID NO: 993670 - protein, 342 aa, Homo sapiens
RTRSRKPDRSEEKANAVKREERRITAGGTESRDEDNDMMKVRKNIVALFKEEKPVCKIVKYNLKRSIQHRDPDAFLMRCTRPQPSPCRADHVRYCAGLLTLASEPASLPGQAGLESCPCTDSPLVFADWCTFYSLFISVSRFSQRMTIQQHSSRVIRAFTSYYFSALLANAYLHTKPSARHPAAVRLATFSQCQNHCVSLCPTNKLQHANHNGKSGFDFLPLTAELDQTLTHSPTNTHGTAYCVRILHSSTPDGLTPAYMPARTPLRRPITIKTCQLELTGPLIRLALSPPKWLHFKLIAIWEANVSQNTLLSITRHFKLVDTSHSPAPHTRNTLPTEHTLY

SEQ ID NO: 993671 - protein, 143 aa, Homo sapiens
MPPATAPPTLHHPALNAPSHPAPTTPPKPTQRPGTVFPLAPHTSTISPLQTTSPLPITTSRPLRFPGNPASSLGDSAHPSSATTAHLHRPALATTSLGPLALPLREAPHAHSSRHRVNSRTLPPSSPTHSCATPTQPTLPRPT

SEQ ID NO: 993672 - protein, 274 aa, Homo sapiens
RAHVHRLGAFRLLRECATRPEAWGYTLSRARCLPSVKVESLTDCCECNSSPNIPYALCSRPRWANSAPGLPTVFLDEVSPMLPTKNVTVTYGGSSCNPQRTNSGNRLLRWHAMYQVVQTIWLVMEETSVCKLLAIPNVFWHNLYTTSPSRLSHSLECFDKGSPGKTPVQRTVSQALKDLHMHLPRKVLSTWPTWPAVYDKVPCLPSFQILLYLCTRQQLRTHLEHNRVEFTVLLGTWEHFVITCQVTRGGRHQWCAHLLRLPNAEQLLSAPREQ

SEQ ID NO: 993673 - protein, 104 aa, Homo sapiens
MVQFGLRARGSHLVIPALWNDNGRGCTEVGVQTRRANGKTRSIKIQHSRLGGALTDRGRTEPDTGGGCHNRPRGRTSHNRTVKSGQQDELSTTRHAQEARDTQG

SEQ ID NO: 993674 - protein, 137 aa, Homo sapiens
AHAAIMAYQCLTVPLISDERVLGLRSASWCLGSSLRVLRRRKLSCTMLVTCSVCCYLFRLIAISGPSQASLGDPQMRKMKSHLVSEVSIGLEEEDMLYRAQSWRSARMRMPSRCKITLQSRSLYLDLPVRPLCALKR

SEQ ID NO: 993675 - protein, 135 aa, Homo sapiens
MRTLEGRRTLEATPKRRTEEGRHQEKREPIINKQHERRADETRDTKQEREDGEQTRGKRRRKREEGGPPQAEGEEWKQQRGEDNKQPRRKDTRANRRGKNKHPEKKERTEGAKNKKRKKKTGGRKGEKRRQKGET

SEQ ID NO: 993676 - protein, 44 aa, Homo sapiens
MPRCLQDHGELGASGKPLVPGPLKNKGENFPNWVETPSTGGCQP

SEQ ID NO: 993677 - protein, 90 aa, Homo sapiens
DEGGCNVTMIIQDLQILPLHPVREPRRNVLEFRDRKVMEYENRIRAYSTPEKIFRYKCAPGKVIRVTSLAGKQNGVFMELPSKTFSAESQ

SEQ ID NO: 993678 - protein, 230 aa, Homo sapiens
MFPMKAGSHLSLRQVWQCRWLDRDSRAFSSSLGSGDCPTLGLWQYLVPIGMHQAKTGSYGYEDDRSLTMLPKAGINSGLKQVLQPWAPKVHGIPGMKPFIMARKIHWKTWNTIGSLIKQKIGNNMNDTTVGENKEKEMETANEREVGLPQNKGGMKPQRTRKKNRKRAKKTRTKGEDTTIHRKITNMNNVQHQPQPTKATIQRRQKEAENQQTDTKQKGDQQQRDSSEAD

SEQ ID NO: 993679 - protein, 400 aa, Homo sapiens
PCRRGPSAVELYNAVLHCFHIAAPKVDNCVVPHMYLLVLMSAVIYGMVTMGYGADRHAIVVSALIMINVQQVVLASQKTGEGINMGLLEQIVGDTHMQHTLYTTKGFAIILIAYKLYLGTIEPYIGIGKRHIGYDQAAQQRPPVGPETRDLAIERPSPTFRSPARICLNVLHEDRCVEYSRRSKEILNTNSVVCGKLKRKINTLKRIATYTYVRKKNDNTGTPYRHTDKGHTQENRALWGVVPLHYIHCLKPAPFSQFAFGRNQGNPLKPSGNVVNVATRGGRETKEGTEGKTCDKTVKAPGGPPTCCLREEPPVAGGFPLPNRERKGRGGNPKFPEGNHAPTATLFLGGDTADLHTERCDGCRPQLFLSNITTPNFKPQCQRDFQKEIGSPPWIERRRS

SEQ ID NO: 993680 - protein, 233 aa, Homo sapiens
LREERVPPGFVASRDPQALREERGPQEGLGRKAAWVKQAPQDTKVAQEEPPVLLVLVGRAAWQEPPDLLDLPGHAAWAPMGPLGPWTRPLDLMTMEGSGGPFWSTARSADGPQGPPALRATYTGDPGVPGLPGATGRSWTQMESPGFPGLPGREGIAGPQGPKGDRGSRGEKGDPGRTESGSGLLAPGPRDLWSTCRSRTDRPERAALRAAGSQASRTADQGNWAEGERAPGQ

SEQ ID NO: 993681 - protein, 128 aa, Homo sapiens
AKNKSKASALLLRNKGFFKNSVLHELFHNVKEGPRIQDHLKDNVTRRVCSEAQRPPLCDKIEAQAGTCDSPFSIFCRYKRKTRRKRHSLRTRDVKNQRAWVSIKKHRIVGFSKKNTIEERTHERARDI

SEQ ID NO: 993682 - protein, 105 aa, Homo sapiens
MSRLSSYPTFLDTNISTQSILYNQSVDTLKDNLYYSTSEGENPQSSEIAVKIHPNARAIQNRDIRVRTLRTKCIRSLTSTMHFHSNQSRHLISISIDNRMAMGND

SEQ ID NO: 993683 - protein, 32 aa, Homo sapiens
KLGDDIDLIVRCEHVFLPSSTSAFVSVPSGFL

SEQ ID NO: 993684 - protein, 480 aa, Homo sapiens
HALDRPQHATSLRWSKYAYVQWLSSVCDKFYMASPDLEIQEINAANIQTADSQWSTSPHHHTEHMLFELFKNAMRATFGKAMRSSTHISHPSQVTGRPRRERSNWTIKIEVTRQKERDVPHIERKNKNQTTIQTNKTIPHANKTNPRPGTQQGTRPQETVPKEKNGTYHKHTDHYSKSKKPNERKRKTTIHPTGNRHTRKPQKSNKQTTKGHLVTTGTIRARRPHTNMEKTTKDNNTEDAQQHTQKKKQKERREDTGSRHPQEKRKTKTTRNHPQHEHQKKGQERRHHRTPAKQKKPGTDRTDKHTHKTETPNHTHPRQQPRAAIAKTRGGTSEKERNKKTKTENSNETETKRTVKQTDTKDASRADERKQSDKKADTGTHTGKTGRNTHRRAQTSNEEGNREEGGKTRKQDEKTRDDENRHSNNNHTKRGQHGTKTTTHRTTPKSTEDATEASETEQKAHSTAETQEKAEDKANRHNRE

SEQ ID NO: 993685 - protein, 206 aa, Homo sapiens
LPAPDVFGISENWQTNQTWGNIAMLRIRPCVNENGDAGEEHPGRPYETIEQENAGVKFPKILEDFRRHPSSFEHPSRDAGGRAHLQVWTRATSCTVNLGHSAPMPPDCGSLKGPAHPQSDCQILRYWPRDMIENYKNDPHLHKINSKTPQLDPPTDTLATTTDSRHETPGKKKLPQSETRRRHTPHRIPTVTRVKNQSNLQPRSPK

SEQ ID NO: 993686 - protein, 77 aa, Homo sapiens
MAWVAHLGLGGYPKLHSRKAGGEENIPWKSGEGGSVAHAKSGVSWPIWPSKPGRTQSKRLPGPHKQYKNNKISNKRR

SEQ ID NO: 993687 - protein, 130 aa, Homo sapiens
GQADLELLTSGNLPALASRNAGIAGVSHHAWPILLFIYFEMEPISAHCNLRLLGSSDPPASALLVAGIAGTCHHTWLVFGFLCGDGVPPCWPRLVSNFWPQVIHPPWPSGHAGIAGMSQPPRGLFFYFLF

SEQ ID NO: 993688 - protein, 148 aa, Homo sapiens
MSDTPLSVPHGRPYTALLQTQHRTGTPRRRQHTPRQHLWEGPHTGETTERQPPRKPRRHDTNTSRALRHPAHSRASIGPHTTTTTTRTVPKPTQQTPQTQPQNNKPLQQHPLAQPTAANKHSTQTRTKHDSNIHQHRPHNSITLTPHH

SEQ ID NO: 993689 - protein, 327 aa, Homo sapiens
RAVGRVPAVTSASVTGSAIAATRLVCPSCGATSPRAIRARTRQSNASPPDSCLVVSCACLLLEQRSLLLSSQKAGWVTYESQKITHNKVHDTRCAARAASRHYGSAHAGIIMVGAQYREFSVAVHMVCKMLVQHVSKVSPIPVQEVAQTGGCILPGTRKSNIASYLLETRPRTPHRSLDWDTLAHQKTVLDESLNRLFGGQPIIEANPINWQTICTQPTNLDTFEAIRARCHTPAKQAVGISPGSFPSRRNLERPHESGGQPHFARERTPTRKQAKSKVQAKTTSSPSGKRPYLALRKGLYRARPPRQGPRTFNYGGTPCNPGHPVP

SEQ ID NO: 993690 - protein, 183 aa, Homo sapiens
MSSQIEAKNMLVYTLQLTQESVTVHLETFLQTGSEYPRGLHNSTLAVPGTQMIFLGGGSALEWKHKRNFVVHQVSGKTQLCMHVGSRCADTKNVSEEWQVNAVPIDTEGTVVWLIEWKTLRLPAVQRPSAYTQYKAKGEEHRKAWGGCHLLIIFFLILLMFAVVTTTELTGPKLSCLQNSFQN

SEQ ID NO: 993691 - protein, 124 aa, Homo sapiens
MALTLRTIGLPTRQPYALCDQISGVGMVTTWLDAYVGNMHLGSQVIGKVHPVTDWKRHTGTHHWLKESGLNYSQQTVQMDETLAHSPYRDVPKIGRMAIVVYAEATRYTTRVRHQAQTYKTPTR

SEQ ID NO: 993692 - protein, 46 aa, Homo sapiens
MKRRARRIVTKRRTVGSHKHEETRNQNRFWTHKKTILLYTSRAGQN

SEQ ID NO: 993693 - protein, 126 aa, Homo sapiens
MLRAPAPPALHWYTANPAEPPKDNLRNPPAHRPRTNTRTTTDRARHTPPPQRRITNLTGNTHKRRHPHGTPPPTKPPSAPHSHTTALKHRTPPSHTTNRKTKDPPRKLPPPPHPRRPTHTRPTTPT

SEQ ID NO: 993694 - protein, 320 aa, Homo sapiens
FSEAHFIRSGNGASVEGFEMVNFKEEGFALISLAALKAEISMQWRFHEECAKRLLNLRKQIQMLCGPVYSGRPNRFKSSGKHRSWPFRIRSCERARPNSFWQPYIQTLPSEYDSSCSTLKEDEVRYLQSITRAIHDVFSQIIEITQLRQHAYFYKVIQTHPHANNYPGRILLTYEDYRWAVSSVMTRQHKYAQRMASRVTLALIPLWDMCNHSKADHYWLHLEDDRCDSVALRTAGWRRSTYGWDRSSQNRDPPARLTILSDRGISRGLSKHTHTPADAQIHQPADSTHARCTNGTQTRPPPAHPDPPTTKTTPQSRSRL

SEQ ID NO: 993695 - protein, 115 aa, Homo sapiens
MVGGPQIKGGSISCGFVDPPPLFSPCAIYSGEQQNTGLWASTEFSLSPPILIGGRASGGSCAVSSLSEGAGNLCDRYNKQPGGVLARYPFIPTTLWVSPRRSRDKENTREIFHPL

SEQ ID NO: 993696 - protein, 72 aa, Homo sapiens
SSGAKIAVIALQPGEGCRKPPWHTFNYVMELHILHMYPKNLNNNNKRSLEVRSSRQAWPTWRNLTSTENTGS

SEQ ID NO: 993697 - protein, 343 aa, Homo sapiens
LHPGIHRTSSPTVLEACSRAGWAGRARSAESAARVKIWRVIPADKIVPCPPSLLDYAGSEFPERVVVTYRRRRYEMPGALRAALAVVSRHPLAFFKASQGWAQVPRRQVTQVASRTTAGLIFQVITGKYTTGDCLNPPRMSVRHRVREIALCHDLGESKRYRDVAPICGTVLVRRPFSYTFWFFLWNTPGNAPLALSISGVLWRDGDVGVEALEGGVGRSRSVVLWHGVSRFRCADVARGVVDSTLAALLLKQDNCEGIPIGLDSLLGVGFAGGWSVVPVVDSDRPTWDTRCKLRRCGLNGRAAAYGGALRKPSDPFSTHLSTGPCTWVVPTRSSRSRFSPLE

SEQ ID NO: 993698 - protein, 301 aa, Homo sapiens
TWLPTLIEHRCSYEERGGFVRRLHEGTWPGHILEHVTLELQNLAGLPGGFGKARETNVRGVYKVVVRARHETVTRAALFAARDLVMAAMENQPYDLDTTLRKLRRMVDRLCLGPSTACIVDAADERRIPTIRLSEGNLVQLGHGCKSRRIWTAESDQTGAIAEGISRDKDLTKSLLETCGVPVPEGRLVDSPADAWDAARTSALPVVVKALDANHGPGRFIDLNTRERNRDRYKVRWKKAGGVLVDRFVRAGTPLLIVRRKLACAVVTVLSSARHPGRLCEPSDRRREKLCPLWPTAVMAT

SEQ ID NO: 993699 - protein, 58 aa, Homo sapiens
MRYTSTPPNTINDRNMTEQRPHISSRTNFALRLIPALRITTTRKRENYDARTRHIYSE

SEQ ID NO: 993700 - protein, 47 aa, Homo sapiens
METHRDSKRADGALTGTLHQQKPTDKEGEQKREKEETKQEHTRSEES

SEQ ID NO: 993701 - protein, 292 aa, Homo sapiens
MQSTFGVKTTRQISEVYNCDLPRTLPSVIAAEQPVKIEGFPTRDTGEGLGSVLITTHWSEWSPSTKVAQLLQGALRTAPSCWASDVTCIVILVRSAMLCICQKSPRLRTAMVGSDSQPSPETASMAIIIQDAQGSQWEKRSRGPRNQPSARHWQEVALKQAHRPGNWQHKTEKGMKIHTKGCKEMPIPGHQPEPSTLLAQGATHSNEQDSGQRRHKQKGQIKKIETQKQCKAERRHTTQRTPRRPKRDRRHKQEEERTKADKTTNDKEKGTEKTRKRKNKKDKNTPNKKTTQ

SEQ ID NO: 993702 - protein, 368 aa, Homo sapiens
MGESSEDKTKMFSTYMLVERWIFMTSEFRMLTLSLRPDRYSTQSVNLTTVWGLNDLNESLNALVKTEDLDALMADLGQQTISEAEQRTIQAQKESLQNQHHIEQLYKHQFSVVQPLLCYGTNVAATGIRQYEDDLPAPAADPVIRPSTAIDSIREPSLIRKRKKPKPRLIQIKVALEKLERRPRVKEARSVKGGNMNDTKDYNVTDVVDEREVAEIVLENIIRENVIVTGNVELVVYENLTGKVTNETVLKDHNTGSEESSNVDMNDATQIFPWKRRENAEKNRKNREATSTTNQATNENEPEPGPPEKAAGTRSSSKQHHREKAKQKRRKSIEDRTPKATEESRSTGREEQNKRSSPVANPPRQDHK

SEQ ID NO: 993703 - protein, 157 aa, Homo sapiens
MLVYPQLTHFSQFDTEDVGPLATIWFIICCLSGPDETSHLKCPFRSKWVLELYKTLRGRLSRETLSCGRPSWTYISFHGDNTTGGLQRIRRAHNDTRLDRGPKGEKTRGDKCNERPGMRDTSGTGQRKRHKSCSTAYYTRQARALCRSPPSASEEKE

SEQ ID NO: 993704 - protein, 143 aa, Homo sapiens
MTKCHMDNKGLVLSGVVVVEGDGEEVGRRGDSRRGRTPVWEDCPGCMTKLRYTATGHTDLEEADTIVTPEEDTHLETYTPPVDQRGDQDFYSAQKWPHRASRGTECRPQGREGSKPESMHPTVLVTKTQSVRLQSRGHTMHEP

SEQ ID NO: 993705 - protein, 256 aa, Homo sapiens
MVNPLVSSTQSSPDFGMLHGGTHRRPLRHYGYLAVLDRRFQTAWMIPGSQIHLLPLQFLSAEPERQRIIQRNRHVRRLSDLLGPAKYLGLVLYVYRCEDGRCSHAPFQRHFTYEPNYGGERPIGYRYRGPNIGGQQLGPLAMLTQNVPDPRTKVRDQRGTPRNGIRKHEKRRTPTTSDTHKHQDTCNRHSTKQYSHRTLTTQTTLDQGETNREEGALKVNDDREGREPLVRLKKEKHDQEARDKTAQSKRGEQRNI

SEQ ID NO: 993706 - protein, 168 aa, Homo sapiens
WRWRGARPTTLTLLPAFSQGPRAASVLHTGNCPLGLELIIVPIYPCVTCKVVRGSDKTTDASHGLRCSIARGKAECAPDICQLLGPLRGNTAKSDEVIRVLCATGHCMWPLVCRKNADVRNINAIKNDKGAVDVDEELQFTNVYGVNREIHVTTCAKWPEHKIHLVLD

SEQ ID NO: 993707 - protein, 403 aa, Homo sapiens
RTPMSLALTSPEWRLDQTHYSPLSSLDIVDAGWSTYYLVPLIYKMTVGISKDNSLQKEFRRTVRSHVWTIGGTWASYHVMPGVKRNKTEKPETVQAVSHHSMKTSLTLMGNIWTIMASTYGARFIRVAHREPTGMNLYTLDDYACVQVPTYLRMHPELVIWFPMTIVVPLDLEARFVDRYSSYEYMALNPFAKRLCGTQEHPQERPIGALLLGAFNNNPCGDGLHDSLNLNTLVSRDWPIIRHNKFAVPFHQPIVTNPKTAISKNSPGKPQGPFLEGAHNLGSLGETRDFTPRTCYIIFSRGKQHPGCDLTPQPPGTTPRYTTTTRVPQTKKPHADTGPTTGACTAHTVRRRKPPPGATRPIDPSGGAPTGRAHAHTTVPHPTGTQAPLRHEHRRPEFGRSTH

SEQ ID NO: 993708 - protein, 63 aa, Homo sapiens
MDPEMKCSPKHDRVVMIRVFSNNSWLRTGSKMQGDFGGVYSLAWVQWMIDYGQDRMGPGSINM

SEQ ID NO: 993709 - protein, 110 aa, Homo sapiens
AELNGEAHWHGLPDVTIANVSVVDLNCRHRNNPAQYMMTSMKVVNARQSEGPLKGILGLSHEQSSGGLLMSRSISDTLTHSHLRELGLAVALNDTIFAAKAQLSWYDKRN

SEQ ID NO: 993710 - protein, 143 aa, Homo sapiens
PRVAHAFGKVVAGEVVVLVLSKSIQLPSSSLQTDMTLIDRLRSGLVARMTHSVGPTSQRGVPTKTELRVNPQDRLTYSSEFSGDYDPSTRSSSEDYRSESSRLLDNRGTHAGIEVANIVGAILLTKPVCFWRRGSIFSYLSRY

SEQ ID NO: 993711 - protein, 143 aa, Homo sapiens
MFVSWFRSRNVDSPVHYIEEDRYGQTLLLLHIPYHTDGEQDEQHGHEKRLLLRFRRSSRPVTSPINPGRFPIPRPDTLKFSTDTVNWNFRQSHRCPSGSQQKVRANPWQTIDHKRQRVLRDLTPTQKRDNNTKTKRGAGARGS

SEQ ID NO: 993712 - protein, 58 aa, Homo sapiens
ADLAQHLNEVSRPALVQLRDVLAALETWDAAAINGAIKAVIGELKIKMPQLAIPLRVL

SEQ ID NO: 993713 - protein, 342 aa, Homo sapiens
TRTVAFLLPPICFQSFFQWGNSAEYRHRYEGEVTDGSARYRYEIDREPGRTAGYGMGHASRATRRAAAIRDPQAKNNNKEKTPTKKKTTQNNQEHPHNRKAGTHKRTTPEHQHTRTTENPSPTNHKQTHNQQQNTHNGQQTQKALKNKDPNKDTNNKTQHNHDAYTATSNTSTGQTKTTYPLKSIVQHDSITTTQHRSHTDPPKDEHNENAEKTGTAPDTPENAQDETQQQSTQREQNRKHDKHNSTATHTRRPNTTEPPSNKQQRRKRRKHQTQRIHMKITRTTQTRIKTTLTKHTECTNNKQTKQERQQALTQENITKDKHIKTTKEHKPNRTHNHNKDP

SEQ ID NO: 993714 - protein, 109 aa, Homo sapiens
MARRPCKICCTEICYESFDAYAFEPRTAEPPALCSVTDHRRTDVPLRITHSVLTQDGPSTNGSIRAESHFRLSDQSVMEELNSAPVQESPPLDMRSWGTHMVLEGGSMG

SEQ ID NO: 993715 - protein, 82 aa, Homo sapiens
MIFTRRIDVDPGAYFARYQNIIAITPGQDELTRKGRKQYKNRLSAGPKNFYNEGRGRIGPTDGQTQGATSKRGRKKSARQTK

SEQ ID NO: 993716 - protein, 314 aa, Homo sapiens
MREGISSPRWPWLVSRLVNAGWELYCLDHGIQPDGQMPSDKTMGEEMSSFNNTFFSWETGRWLASVPGSVWVDLEPTVIDEWFAVARYASGLPRREQPHQQAKEDELANNYSPRALHHGKEIIDLVWELNYVKRADQMLADLSGLLVYLPQLWWGKLVLGSACLLMEVSESDYGRKSMLEFCIDPVNAGCTGVVGPRDPSHYHTTWSDADGAVMGRPEVIYDSPRKGRYEGQQGNVTVIKQMCSIVVLDGGPGCAWRDSSSGATPRIPGNSRDCGTHGGWGRTTVWATMWGPRKIGGGGAQTRRTGQGGPDNSG

SEQ ID NO: 993717 - protein, 331 aa, Homo sapiens
MGRDKTRSQNERTLRETKKGTRVCQTTPIDQTPAHTPHNTTHPHAPPTPNAPHTHSPNPHTRAPAANDTPTPNKPTRPTHPQPTHNTAPPEHHHQPPTTQPDHAHPPTPRTNHNNQLHGTPTPKAAELNHTARHRHQSQPQQPPPTPPPTNNPRHTTTHPPHHTNYTNTQPPDTLPTTQQAHALHQPTPHTHTTAHPTPPPPTPHHQPHTNTPRTTRHPPLDPPKHHTHHTSTHRTDSTRPHTPTSEPLTHGQTTTSNKPTPQQTHHKHTTTHTNDPHKQPAHTRNDTHQQQPHTTQQPTTAPPTSRHTKHTPTTHPEPPPTPTARSYPRP

SEQ ID NO: 993718 - protein, 101 aa, Homo sapiens
NPPFESASHNETYRRIVKVDLKFPASVPTGAQDLISKLLRHNPSERLPLAQVSAFRGVMPENSRRVLPPVCPSVGRRMVPCHSVGCVCMYVCVCIGERRDP

SEQ ID NO: 993719 - protein, 133 aa, Homo sapiens
MRVRAKRHAWAPKWGETCSPTQARHREVGERQKIYPQQTVEYDQRRDTRPQKNYHLRNEQNGANRKTVAHTTMSAANEFEDANRTTRSEPTEQAGEEEARTQEDRQMTRRETSKLENLASARPLRASLASPSP

SEQ ID NO: 993720 - protein, 298 aa, Homo sapiens
QLESEDDTSYFDTLRSERYHRMDSEDEEEVSEDGCLEIRQFLFLLSSGFNKVYSQHGAGLSCSRSAGYQPRPMRSREVRRRRIIHMALAGLNEAESGVWVIGLPLGDITGMRHVVMSEFVSSTESDSKPSNDSAMPCAQASWMRLGSRRALRRPAAPSGGNTLGVGIWGPDMPHLKRGVSGPVTEALRLSNGQSWMRKLLAGDMWFQSIYGEPRPWDLKWPGGVKSMATVNWPCVGPPRMLSGDSKKSACSPGQGSSRRNKPLNPSGKPPGPGAARSHSRHPSGSRGLPRQAPPPPRS

SEQ ID NO: 993721 - protein, 111 aa, Homo sapiens
FPFSSDWLTRAQRVALSMLEQIDPSDDIPQDEDTTVTDVWARRTGVCPVKTRAWSITDALNDPDTVPVLAPASIPKAPTIIRGVMVESDSFMNAVLWLRTHLGTLKPCHSA

SEQ ID NO: 993722 - protein, 114 aa, Homo sapiens
LVVEHDFIMATVSSGSRHRFDGVPSKNTGCQTDPQIPYGLGTEYKIVCLSLKLHAARRSNINYRPRMKRNLEFNEGCRTKEEWKLLFSWMIRHDSEKYDKPFIKRSIYYEFLVI

SEQ ID NO: 993723 - protein, 156 aa, Homo sapiens
MACVCTSKLGAPIQFCPSVPAARCILSRAFRQEALLDEDEALAGVRKGRPDVEGWMLMLMIVPQATSTCTIQESYTGMKVGCISSALCDSTEGARDPFEANSNGHDEDVRVTSALSESTPPHDSYLVDSWKVESCARTNYVAMHAPLYTPWIPGPS

SEQ ID NO: 993724 - protein, 142 aa, Homo sapiens
FSYSRAAPGGSAASPCHRMRYIELHRKRYGYRSGFTMTKKRNERKVERLMNVQEKANENDWSEGYSVYHKQTSMLRNIQMKKTIKMHDTEKHRKAKEMMKRHHREQYLPICWTERDNLELKYFPTMIKQKRNRVRRENGKSL

SEQ ID NO: 993725 - protein, 165 aa, Homo sapiens
MFVSYSFTIGGGVDNRSGDIRDITEVGWYTGALRNAFELCVVMVLASVRFALDVCVELKTLGQAMIVKLDSCHLALACVLIVRCGLRFVPKGKARGKDDLEEAAWRIICGFQTSEPKLAWGPAAGPHFRFPVPGWGRLGPAPVFRPFHVPLWASATPGFVFPQRG

SEQ ID NO: 993726 - protein, 85 aa, Homo sapiens
IRKGVGLAPTVGDSGTRRAGRLQDDAVHAIIQPAGKTAAAKMVPGHSDKERKKMVASSMQVVLARKPRCAVPGIVGTLMLAIRDM

SEQ ID NO: 993727 - protein, 69 aa, Homo sapiens
LKRPTCPWLRADWYMYSASRGEVTYRAMPTVGVIADPSDLWDNASYCVVGNNVILVPWNIPCNLRITRI

SEQ ID NO: 993728 - protein, 81 aa, Homo sapiens
IAILGNVLVRGALARANPFKHAHICLAGARWSRGPPSVSSPGPTGQPRRPRSLAAGAVEEYKYVNLAPRSIYASVCGLVGS

SEQ ID NO: 993729 - protein, 65 aa, Homo sapiens
ETPVRGATWNRDIVTRSERLARGGAEQVRWSARQCNGSNPPTAFYKPLIYFVNFICFRQGKRFIL

SEQ ID NO: 993730 - protein, 136 aa, Homo sapiens
YSQQVRLSMFQKMSDVTLKGRTVIRERAPRGALRRDFNHINVQLSLLGENKKRLAGGHNGGVTERNLAYRFGKYLVEIMVPGTMYRRVVATGLFRLQDEVMCMHHFSQSNDCCAQREWVVVGGKPKFHWGEKYKSA

SEQ ID NO: 993731 - protein, 83 aa, Homo sapiens
AGPHGNPDEVPLACRGTNLAEYYCGVREGVLYRYVVVTTIKCSHNDAIEDRPSPSSHVKEAGYDCMVNMHLLLIIIVLAISSD

SEQ ID NO: 993732 - protein, 110 aa, Homo sapiens
MGIERGNSVYTTAILASAIEEALSSWSNGTDRIDTGCRDVVGGAKERTWVIWTVVRGQLFNKCRKRKLYRHRLGNFGRGVEGVEKNPLVQVLVERLNEIERKIMCTQWSL

SEQ ID NO: 993733 - protein, 369 aa, Homo sapiens
AVEECLHNRLFPVCGNKLTDPKASHYANICAEASFRVTNTGEDGFQELRLSDAFPPNGYGLYNIVGGTAWEWTSELVDCSSFCSKKQLNPKGPRFCGNDLVKKGGSYMCHRSYSYRYRCAARSQNTPDSSSFESGIPAVQPTDCPLWTDNQGNVCPQSKEQSVSDLPSGLAQNFERSHAMNPTLRWVPYLANGQRKPLGGGPTLLTGVSACRFMSVVHLRKPIAFLPFEIFQLTDVTWQRTLKLRSRIDPRSTQGMARGYKPRRQLMTLPWLTVASISLQVSPTDPCVVSATSPYHTGVRTFGGSTTAIHNVYVIPGRHVALPIHHQPVITCDGVPLTLPAHFHRYSFSLSALHPPKKLCYQISIRSRR

SEQ ID NO: 993734 - protein, 119 aa, Homo sapiens
MLILHQSKANYYTQCDPIALPTEQVTLGITAQSLFIEVLISYNRVHEPRMLDQEHPDGCSRLLKVRSFKIKVLRDLSSDRSNPGLVSIYFKFLPVRKDRRNQAYFNEVRHSPVNDIIST

SEQ ID NO: 993735 - protein, 313 aa, Homo sapiens
DPFAMGRVDPWTEWRAPGLCSSAHVKHRKGACAAMNYRLWIAAETARYIKGIVKDIIHDPGRVLPLAKVVFRDPYRFRKRTELYIAAEGFHTGHFCVLRLERPSSNIGNVLPVGTMPDRYNSCAAGRRSLVDRGKLVRCIREFASRYLPEPETKKTRVNSALRVPRRLSPQQESCAWCGGWNVADLTIPILNVAWRDHNYYRNEELVATKYGVWHESCGDILLDGGNHQDIGSRHIVEMPLWPHVGFIVPRLTSREQRGAKTRLGSKVGCQHQGGSIPRASSPVWRARAKRRHGGPGWDLEAQGRGRGKTQNT

SEQ ID NO: 993736 - protein, 154 aa, Homo sapiens
MGCGINDRVLGSSFLPSRSPQVERVSPPHHFPEEADFKYALTGDEVKKIGDASGSIKIDGKVRTDISQYHVAGFMDVIETLTRRERISVLIYDTEGSALLYIVLHREEAKYELCESEKDLCGHKEESLILVTHDARPIRYPDPRFIKVNDTMSD

SEQ ID NO: 993737 - protein, 142 aa, Homo sapiens
MRFHGDGKSPDKDGNARWEPRCLRLMDCILTTARPTDKTLAPALSRMSTHNWWYSVLVLLGPSATNLRVPQNPGYGTVNPLAPVNAYNPAATHPVRNCPIDAFESTLLPGETIVRPNCPSNVSRTDVPHAKFDADLNAPHLN

SEQ ID NO: 993738 - protein, 33 aa, Homo sapiens
GSGRQVPAAARQLGTAEGGGTGRHAEGGCRGDR

SEQ ID NO: 993739 - protein, 71 aa, Homo sapiens
LKHKASTSERHAATGKQLEKNQLEKIQKETSLLQELEDLGLGTLKIYGKQVDDQKSVQYTSTGKPIGIHMN

SEQ ID NO: 993740 - protein, 105 aa, Homo sapiens
MAKLKWGQMGIVQCNAITEHCKCKTEELTATSQTLDQGQGQLFLDGGGKSTAIFYLHACKDEPLLGGEDAFLILDIGLHIFDGVTGLHFKGDGLASQGLHKDLHF

SEQ ID NO: 993741 - protein, 109 aa, Homo sapiens
SRILCVKRSLLLLQVFWKKHLGKFIAKGSSPRHIVVRLSKVKMKERILRAVRQKHHVTYKGKPIILTADFSAETLHARRDWSPIFSLRKQNNYQPRILYPAKLNLIYGA

SEQ ID NO: 993742 - protein, 66 aa, Homo sapiens
MISNGYNQAYPINPAEPVIAIKLYPDKASGGYMTWPSPIEDTGRRGSPGAYGHAEETLIIMEALKY

SEQ ID NO: 993743 - protein, 99 aa, Homo sapiens
KVSSVLTTKFATPMTTLNSTTGHIPYPTDVADTNRRQGRYWVVEEQFPSKASSLETYGPKWEQAFLFLHPNVAFWPATPPILYPYKLQTPGSMSRRAEK

SEQ ID NO: 993744 - protein, 57 aa, Homo sapiens
MITMSAAYLLTALYHESWNTEEWEKSKAAADIARVYIGKIAHQKQISRNAFYTSNPP

SEQ ID NO: 993745 - protein, 63 aa, Homo sapiens
ACGTALAPCSTLVSNYNPKVFEILIQYYSGKQCGFNMRKLLQKKGKKSLVFLSNANPSLLERN

SEQ ID NO: 993746 - protein, 73 aa, Homo sapiens
RQICVYCQSVITRVEAHIPSHYGRGERRGLQACPTLELSPHTSREGRVIFEHISFILQTSFGYLEHCSGFQDL

SEQ ID NO: 993747 - protein, 64 aa, Homo sapiens
LSSTNDRACNITLQIPALVSLLRNFCNTLLKPEFDKISKLLYLYVDTTDKVPYLDSRSLTVACR

SEQ ID NO: 993748 - protein, 42 aa, Homo sapiens
MKLQGDCFDLGCVCLCRVRLCHPTGVSSPEAVRSDAPVQGPP

SEQ ID NO: 993749 - protein, 58 aa, Homo sapiens
RFQRVGYSTIAIGDPMCRPERKQHLQAMDRGLRRNQPTDTLVSSIQPPELLRKYISIV

SEQ ID NO: 993750 - protein, 67 aa, Homo sapiens
RPIQFYSFGICDVIMTGLAVKKCPFNFGGVAWMKNPKVPSWILRWFPGLINIRLSRLADLYSMAIIK

SEQ ID NO: 993751 - protein, 64 aa, Homo sapiens
EYESRRVCVVNTGSKQRTESSALTVPIFWCSNQFPADQNEMEPHSTVRGLTSCKPRPWKTLNKK

SEQ ID NO: 993752 - protein, 75 aa, Homo sapiens
PPRPQSSSILKLSTLHKYISAVVQRVTVLTTISIATQHVTPVAKELNYDLDTHTSTGRIKAAEKKEARNADSHTK

SEQ ID NO: 993753 - protein, 177 aa, Homo sapiens
FQDYSARIKFRCCRSLPVRSRTGNLQAGWIVLLLLLVGFFFLEPQGILVSAIAAAGAAVLFVVAKRGHSINTGKVLRGAPWQIVIFSLGMYIPQPAAIRRLREPLMISGLARSFIVIELMMASIRTSTLSSICDLTLSGICTMPGSLPIRLAMPPIFFIWRSCSRKKETLLKSINNW

SEQ ID NO: 993754 - protein, 52 aa, Homo sapiens
LEGLEMEFMLANQFSSTGLNQGYIKGAEVILNYGRLRGTLSDKIYWRHLYNN

SEQ ID NO: 993755 - protein, 101 aa, Homo sapiens
MGYTFAARTYNAFSLSLHGRPKCEKKVAGDLPHHSLSTPKHAPLKHAQTYVCEKKAPPNSIHRLGWRGGRVLCLLVLSNHSSYPWENSPLKANSFVIKTTF

SEQ ID NO: 993756 - protein, 120 aa, Homo sapiens
QTAHRFRVQIAASTGRYIIQNLRQVSMLSDGFEVLIQTFLRRTIVVRGYRQAADDTTVIEALRQANGFRSSVSAGPGNYRNAPISQIQRHHHHISMFVMIKVADSPVVPTETIAEVPLAT

SEQ ID NO: 993757 - protein, 226 aa, Homo sapiens
DWDWDAVQPGRSGPGADDGPRHCSAPGIARLLVSGDAVQEAARWEEYAWWPSWRELLLRARRARMLQSAADVALGGSARVSHVTLPGLGSWACSVSSPAPWATRGSGGHDEEAVQICMRQLGQPDGGAGLKRQKFLSEDLLQGGGSVWSLVKQVSHSNCTNEAHRMSAGDSKGQRLTKRSKKLPLTTLAQCLDGGVSYPWENDTLSLGRCLKTTVERRRTSLDSGS

SEQ ID NO: 993758 - protein, 215 aa, Homo sapiens
SPDSWNNPVMMTLTKSRSFTSSYAISAANHVKAKKQSRPGALAKISPLSSPCSSPLQGTPASSLVSKISAVQFPESADTTAKQSLGSHRALTYTQSAPDLSPQILTPPVICSSCGRPYSQGNPADEPLERSGVATRTPSRTDDTAQVTSDYETNNNSDSSDIVQNEDETECLREPLRKASACSTYAPETMMFLDKPILAPEPLVRDNLSMEQLNT

SEQ ID NO: 993759 - protein, 117 aa, Homo sapiens
MRDPNTQALQGFGFAHICHVWEEVDAAMNARPLQGGWKSCGTKESCGPSRRFSSVPGAHFNCEKRLFVGGMLRRLLIEHHPNEIIPNRYGETLDRELTISDVTEASGIEEGLCLCNL

SEQ ID NO: 993760 - protein, 53 aa, Homo sapiens
NELDGIPLILDNCYMSDRDPFLTQRVIYAVRDLTEDNSQNRHLFAKMEEQGLA

SEQ ID NO: 993761 - protein, 210 aa, Homo sapiens
MELENIGSEHGATQGAWEGGWWKSLKAKQEMVADAPVPSTSASAEELRAQRLEREYHRPVRAGEPYWAPGVPRSSVPQNGREHETSMRLSHFSVMVVAEYEVTPDDKRKACGAADVTARIYSEADSRSPDRLSLRYPPVKHGDERDPAAGAGSLSTRPFPGTSTRYDPREYLSVAPCCRTTSRAVYFQRGFLHGTVGWKWQPVTKKSLGK

SEQ ID NO: 993762 - protein, 204 aa, Homo sapiens
MCDKLIWRKHSASALVLHGHNQNCDCSPDITLKIHVFEASSELQLTYPRWNNVACIRQANPGCLRWNYIVHDRRLQCATHTPDGANALSVQMHLNSGVLGCCSIGAHAWVPSFNSGTAGEVMHRRSQPESVYSRSSAPMHLVLLAEVSLPRGTNLLCRPDVLLKRGLLEHILYCIVDSECKSRDVLQSYFALLGELMKFNVDAF

SEQ ID NO: 993763 - protein, 205 aa, Homo sapiens
ACANGFTARQASWLPTMIMASSPDMDLATVFLRLKEEMGVKLIEPHKQGRRCSTVHVLFLDCEVQHIIPFILVVKYGADIEEQNIIVSSTLTSGRERSTTTGIQCGRSKACQADYQVHVPRGSCRRDNGLEAAPSRWVRGMWGPPMYSPTGANCQQTLRLRKVTGKRLLCVGQCLASMARLLASFLATGRVAEKRDLEFGIARIK

SEQ ID NO: 993764 - protein, 108 aa, Homo sapiens
MRGVLLTQGQQRSCGIRTGPTTLRLTRGNGRTKLGLTKLGEYPRLASRAIRDGALAWRVARRQFSRLNNPKRVVASSKTCATLEKALLFVNGAQCATTCSPDAALVVC

SEQ ID NO: 993765 - protein, 31 aa, Homo sapiens
VYSQVNHVSSTCVDGEPGRVSLSCCRQGPKD

SEQ ID NO: 993766 - protein, 75 aa, Homo sapiens
TILYKPQRHGNSIPIDSAHELESLGAALSLLIRAELGELRQASVGNDHIYNVIRSQPMDCNNLLHSNTHHNRRLR

SEQ ID NO: 993767 - protein, 52 aa, Homo sapiens
MIKGKTPEEIRKTFNIKNDFPSFFVKQCLPSLFPVNFSDLLKVGIVNKTGCG

SEQ ID NO: 993768 - protein, 83 aa, Homo sapiens
STFFVSHRLPRTSRHNRLNLYSVSASSVKLTTFILYIHKHSDLGFEVGDVTTGHSRDCGCDIVSSMSPSIDEGSSITTGRASR

SEQ ID NO: 993769 - protein, 187 aa, Homo sapiens
TPSCPEKAIQIRDNPYCITSRSYWFFGMDLFVSLMTTSMPSSLQPAMRSEGELAPSSASRPPKHGHLVEVHTSLEPRVTLVDVAIEEVSSHTGVSTEYIYDSYQPDIPRIYSSDCFITSMTGVSIVSLTTERSEVASQSSLSPVCPNGGIYDINDFICRPSSASTVTSTFIDWTRTFLTICLQSSAT

SEQ ID NO: 993770 - protein, 61 aa, Homo sapiens
HGGNAGQTPMNINPQQTRFPDFLDCLPRTGGDLRTLESEDLIPLFNDVEAALNKSEPFLTW

SEQ ID NO: 993771 - protein, 260 aa, Homo sapiens
DPERSYRMNSRNSALQESCCRCCAWIQHSRLKLTTQDKWTSQQDPDHPTRLILRRDQTAAEDDDLSLVIRRLTSLRMAEVRGNNKPLLYAHTLKAELVYARPNSLRTHQRQVNVVKTSYNQLVLPCTLFNCALPTSHLYTCATTTSSTQPKDPLLSLLDMKYTVQCTHSRDAHLTHCPRQKPTADDRAVPPTGNPIPYPRPTQHTRIPPSDPPHTSKTPTHCRLHEHHTPNTTAKPQRSAPQAHTSTPRHKAQPPHEDSK

SEQ ID NO: 993772 - protein, 69 aa, Homo sapiens
APKGSSKQQVVRMDLALAGLSGRKSLGQDPPRLFFEKQSFIVSAIPIWFILDEYRRYGYLIQYWLSCIV

SEQ ID NO: 993773 - protein, 135 aa, Homo sapiens
SEASFLKPARSQTQGEEQTTLDLPPLRAVTLTAKVCGFTPEVSETRTHQKEEIPDTSEHLKEQTPATPFLRTVTLTVRVHGFIPEVRETKNPLEGINSRHSGSWHCAAYRSKTYRITRHVAEKEKGRWSRHVEHV

SEQ ID NO: 993774 - protein, 127 aa, Homo sapiens
MVDLKWARRICYEHLRTIDPETWSDVRWSIRTSIIEPSWGYMPTKRRGSHRFSRITRPEEPKSTCQKITRFLSVKDVRLCHDRMSVLPLKSGKRFPSQADQEAKELDKGRNKLKGKKVQFIRGKDYL

SEQ ID NO: 993775 - protein, 161 aa, Homo sapiens
MSRKDQERPGFDCTIRQTLDSFRVMADKMISARGTEHLSVSPEYSKMPERRNPPVTLRDLTQLRRLDLLVHIDIGTSASQNRLTSLVETRIMDRDGMREEEDLSSTYQPCGIGASMCDENCIRWIRLSQNLMVDNDAASVDGNRLLDAGADETDGEAPCFT

SEQ ID NO: 993776 - protein, 31 aa, Homo sapiens
MPCIMVNLPKQTTPVRWSCTSQPENSFGDTP

SEQ ID NO: 993777 - protein, 287 aa, Homo sapiens
MTREGHPTVRTEHHSGILLTERLGQQYEVEGLMTRLCPCSRVHASARAYGGQGRISYKEVSGYHSCDALAQVIILTPDVVIMLSQQMVTRGDNAVETRRTELCNRQGNKTRLHVVCGPQDRLSSPGGLIPIIFGEPGRQYYRKLSYIQHTGGKNATHKGTSPRRNPGHTFPTKTPEGPTQEGQRRTTYTRGVHQPGAPPGRECTTATQQTAQKPNEERANPPTNRSGPPSGNTPQWSATPGATHSSWQRKNEQQRSNKTDKTDTEEETPHTRRTTNAHTTPRTQHDK

SEQ ID NO: 993778 - protein, 68 aa, Homo sapiens
TPMKIIRTLRNGFCGTGGRRPQIICGSGLGGVTDKLTQAQIFDYGEIPNFPRSTVPGHAGRLVFGGGS

SEQ ID NO: 993779 - protein, 326 aa, Homo sapiens
MRTKRTQIKMVACRVKGILSRFSAFRILRLPRLYMPQFYRVFCLLTRTHINYGVKGDVAVVRINSPNSKVILSEERATFRVLRSYDMHLWASDQIRSAVLISSKPGCFIAGADLNMFSRYAKTLQEVPTAITRSTDEYADTLDERTTNALMWLATQLDPACEEALRLPLQIQLQNSNNQTEKTLLRKPCTLLARRALTRRHAGHHKGMPQRASQCMQSIATMKARTGYEPNAAGPSRGANEEHAAPGIEPPLVNTTWRPQDLIPLPEETGTQHTSRARSIGKKIHAKAQAAQAEPTPTTPGIAPPTTQPARDPPASEQDKTRRNEP

SEQ ID NO: 993780 - protein, 109 aa, Homo sapiens
PWRALLITACYYFKFFWKKHLGKFIARRSSPRHIAVRLSKVKMKERILRAVRQKHHVTYKGKPIILTADFSAETLHARRDWSPIFSLRKQNNYQPRILYPAKLNLIYGA

SEQ ID NO: 993781 - protein, 83 aa, Homo sapiens
PRIYKKSCTLKPDSLVQTSEGSPLNMGKGEFSLKLYLDKEEGAVICLGHIYALIRGNQDKDDVTNSIDIQALELEETGGVMLN

SEQ ID NO: 993782 - protein, 229 aa, Homo sapiens
MTKRRKARRLPHRNLQTGPLPMRFYNICELIPAHEERTRTAQTKPDTIPTKKRGCHEISRQGDHSDGAAAGGPQKEEQADRDSYRTTATHTQHHPIRPRRQRTESTPKSAKRQYTTSRTSQITHGCTPQTHAATSKPKKTTTEAKGETPKAKPHTTTQRRSKRKGPQTQGDGAGEEKKRTRQKEQANRKDNDRRARRLRQNRERTERASANGGRRRRYTREQSRKPDGT

SEQ ID NO: 993783 - protein, 68 aa, Homo sapiens
MKGGRWNEFISIMAFTAKIEAMKTDPNGRYEDATDENKLAHDGMELKNVEIIIHTFKHREPESVPDKF

SEQ ID NO: 993784 - protein, 101 aa, Homo sapiens
RMKDWQEIIALYEKDNTYLVEVSEPPGFDNVSYEIPSLERKQIAKCQQAAVKKRDRKGGGVCRPGAAEMRESVLPSSCKHVWLSRRENVRGELVALVKDLH

SEQ ID NO: 993785 - protein, 177 aa, Homo sapiens
MAQSYARVHINHRVYDLDVGSRHPDGACAIKGSFVQRLKSYVDLSSDRSTPGRSLSTSNSSTVRGGQGEITAYLHKGAFPRRMIHLNLALYPHPPKNRVREDGRSPGNRDTNFINFTSPNVQFLFLTNIHGQNSSFLICAILIAMGFLMLTERKIVGYVRIAKAHVVAQGNKTFVKP

SEQ ID NO: 993786 - protein, 234 aa, Homo sapiens
MAQSKSDQAKSTQKEHRRPISTTLHNYATLQISKDRTTTSRLHTHYNQYKQRTDNRRHYYTVANPIRKTSIIVNYPQHTHVNHSAEHNDNKHRTHMTDKTLSRHHHNKHNLTNLVYNYNRRTTINNTKTQTQQEHDKKHIHIHHQYRTAEEEKPKKHKIKRRKKNIGETEHKDHNRQAEHNREPTIPTTPQHTPQKKPHGELQQGKQKQETDDKDKELRNTKNKHKHTTHKQDK

SEQ ID NO: 993787 - protein, 114 aa, Homo sapiens
NVKGWVRKKEEGGQTTYLGELRRELPPDQAEYCIRRYGGPNSPLDYMCFSTGLYGESTSNPPRPGGLVLCAVPCPAPPASPISWRGGGSPSLHPEGAGPRWDRSSLPRKGQVTK

SEQ ID NO: 993788 - protein, 126 aa, Homo sapiens
MHCCPPSQSCLTRTSRDYAANRSTCPPPGPARPSPGTRKTASITTISYPVNPAGPPTGEPRMTHQQLGQTTADNPTKPTRPAPRTMRKHTDKRHRPGPTDHDSRTQQNNHHSPLTQDTTKHTNTHT

SEQ ID NO: 993789 - protein, 141 aa, Homo sapiens
MSVGHQLAEELEKQERQTKSKHQQRQEGTPNAAIAPQKENRRQKAPQLENKQQHKKTQRQHDIEVHKYHNNNNNKRRTTAGQNATHRNHTHRKQDQRQKKRTSNKENNKDNKPTRDTQREQPRNYTTTPQKQKKEARSSKR

SEQ ID NO: 993790 - protein, 95 aa, Homo sapiens
PAHQHLFKLCTVSALSYALKIQGDKEGACSHGASILMRQVVTDWKTYHRWGRCYEKKGSLLRGHSGIMDGHRCLGAKKLVHKLLSRAQSGCGAPS

SEQ ID NO: 993791 - protein, 44 aa, Homo sapiens
MRTHTHKSVLPEDAAGKATASLGSQIKAFCPNVTGIGGFLVLLT

SEQ ID NO: 993792 - protein, 73 aa, Homo sapiens
SETEAERLASSWGLYSGIMGTYYHGFRESVGGINISFFKVYDEVKNAWRTANLDNNLWGYIFLKMGFSCMNWK

SEQ ID NO: 993793 - protein, 160 aa, Homo sapiens
MSRDCATAFQPGQQPDSVSKKKKKKSKFSSPQKFSRQAISTGTSISVYILIWVSPYFSIDLILKFGLLKLDIRLSTWLFTGFNGPIPLVVFLEMGVSAWCHWFSKPGATSQTPVSKKKKTKKGKFPSLTNIYDRGERNILNGEQGYFSKFIMSNLGLHNV

SEQ ID NO: 993794 - protein, 72 aa, Homo sapiens
FRLLVDNPLGIRGGSVLFGLLLVLAVFSHSGHSLQCYTCPNPPADCKTAVNCSSDFDAWLITKAGLQVYNNV

SEQ ID NO: 993795 - protein, 246 aa, Homo sapiens
METEDPGRLTPFSPLGTRLSSPIHAYSGPNPADHVLESETQGLTFKDRGLCVYGERGGPQTCWNDCMLIQLSRVEASGPRLRTRVPCNSQNYSMNDPGHRMIRGKMGRNRRESRPERLRDERNREELHGSERLQKAWMNELKLYRPDWVASRPVIPAPWGGKAGGLPEVKEFDPAGNMVNPVYYKYKIAGRNSLKPPGSRGDTGGVAHTAQEPPKHNPVGTSDEGTSEETSRRTKKTGTPMTSKYV

SEQ ID NO: 993796 - protein, 271 aa, Homo sapiens
MDVAPYNRDITRAIYFTRRDPVCWPGTENYGTRGKDPGPLRPTLSSVIFWRTEERQVARGTRGTEGEHKRADRAVGWSRAVEKKVRARKRPHSHGVTQLSFTGKNRGPWPEDTQFVATRAPGQWGGTAEGENTGGGTQSCQKVHRGTVDKKVSTESQAVREREGHKKSRARGGKGERGKRGTRTQGPPTGWYTSHIEVGPPPREAHQEVTNEKTKWGIPRRSPRKEKEQLEGGPMGSHQEKPHGKRLCHSTVKREANGCEKHAVTQSQRCP

SEQ ID NO: 993797 - protein, 76 aa, Homo sapiens
RAYSAYTIIVRRTVHTHQATASACKTYKICYTTTTSPNTNAASDLKIIEMTIQAKNATNPPCQIIQLCMTSASSQR

SEQ ID NO: 993798 - protein, 235 aa, Homo sapiens
MHVTHLNHKSERLCGDTYAHTATVCRITLTLDNLGITDPMGAILTESSTNRNTATLLEAFELYQVYQCLKDTSHTHFCANIYHRRIILPRHQTMACATTAVQHDERQEYTKSKTILRGQTAEQNHQPDHTWGQRTRHHRTQQQRLRQPARHQVHHLAKTAPTNSSPGHNTRDCNETTHTTSPAETRNAHSNQHRKHTHNGPTTPPVTHPMHVRTAHNSNNDGEQRSRETCTAMRH

SEQ ID NO: 993799 - protein, 113 aa, Homo sapiens
SDYQNCHVKKQIKQIQKIFLFECIMGHKAAETTCNINNAFGPGTANEHTVLVVFQEVCKGDESLQDEKSSGWPSEVDFDQLRPIMEADPLTTTQEVAEELNVDHSTVVWDLKH

SEQ ID NO: 993800 - protein, 397 aa, Homo sapiens
TRWVDPRVTGRVGFLTLTTKLTNTNISDAQDHRTRLTISVPDNHPSPHRPSHPYASLYITDEVNDPSRYQSNHMGHHMVLTTYEYTEIRRTINLTTPYILADHNTVEPGELNIIERYEQYEIDTTRMRSTTYDNNNEQSTKQDLDNSMTLDTHHTYKTHITTPGVAKYTTAEPTSTPHNTHHYQTRVTHAADTRYYDKRDPNSHQQHVHSGDNDTDSNTKDIAIGPQGTDPSKDTVFKVTTHFKQSCICEKHIRASHRRIETHRPYANPTTIRKTHAYINKTTTADHRPDAKRQKKTRENKKKEIPQNKQQETTEADTRKTQNHTAVKGRTQTQNSRQTTTDREKCESTPERPPQQKRGERSTRKHRHQTRRTPSPIVKELRSEDVRANQTKYRRGP

SEQ ID NO: 993801 - protein, 31 aa, Homo sapiens
VISIKNYHPKIRIITQMLQYHNKAHLLNIPS

SEQ ID NO: 993802 - protein, 30 aa, Homo sapiens
WSVSFVSIVRSVRELQFYLSLDPDFLPRLI

SEQ ID NO: 993803 - protein, 52 aa, Homo sapiens
MSRNNQNNHKTDATLPTPPITPPIPKNYTLISTTTPASHQAEHPTELCKNRN

SEQ ID NO: 993804 - protein, 95 aa, Homo sapiens
SGRRAPPLRPTRPALYLWRLKAGRTGRLHILSTSERIFPGASLLAQPHKVTGFLHLDQQPHQPRRPLGVGGGCQSPWPSSGGGSWPKRERDSSGH

SEQ ID NO: 993805 - protein, 194 aa, Homo sapiens
MENHLIACSFLPSQPHRRLQRGEWSCPFISPTSPVARTGTPGDLYWTCLAWRLVTRGLGGERATKMKPLRKKPFQGGPQNKINQYQDITKGARAPFAESKVLYGRGPKATYAHVAPGLSLGDAEFWGPPKMMRAVSEFQEEEKGALGARTNLAPHVVVGRGEPRVAQPFGRRHSVVDAPARIHTLGGALPLDCG

SEQ ID NO: 993806 - protein, 72 aa, Homo sapiens
WGRMRFDACPGKERKNFRISISVLFDDVKVNQILKTLSEVGGVGGTDQPPKLKMMYEGVGVVETKVSMIPPH

SEQ ID NO: 993807 - protein, 357 aa, Homo sapiens
KTPAPVTDWESSLPLVFNHCRDVSPCLYPFSAFLGKGQVPQPLLSLSLPLLCFSGEGASTPTPSLLVSTPSLLFWGRGKYPNPFSPCLYPFSAFLGEGQVPLKPFSFTLSGKSRFLGQGQVPLKPFSFTFSGKSRFSGGGASTPQPPSPSTLVTSPAFSRGQEPPNTLFPHPKLLSLCHYPLFPVPKPPSRFSGGKEPLNPFLHVSSSHISGFASFNMGNFNPQSPSLPIPWFLNTLKLFNPPDLNLKVNTSCCGWTHNNRQKSNAEKGLDCPTWENIKFVRKIDMSLVPNIQELTNASKLVRKSQSLSPVPSHPGAYYINEPISTPVGSDNTTSSNSRRVPLISPSHISSSLLHDI

SEQ ID NO: 993808 - protein, 73 aa, Homo sapiens
RPPAGVGLGYRNPVCFMIILYLGGDIWVKENAVICQHRALHRLWGMNGVCGVPSSPQVRAFTTMAYSPGADNG

SEQ ID NO: 993809 - protein, 62 aa, Homo sapiens
GCLACLSVLGLGETGGSRCQRHGLVKMPGNTSLQPIFQQPPINTKEVPKTSHKGKGTRQGSS

SEQ ID NO: 993810 - protein, 72 aa, Homo sapiens
WDRKKKFQFSFNVWSLSKRVTYINTHTLYTTRTYSSGGSSGSDPPREEERGEKKKRITCLVIRNFGHTFKSA

SEQ ID NO: 993811 - protein, 69 aa, Homo sapiens
MVTFGHPSRTDSQRRRIPAYALLTGRPTHDQHLPTANTCISRLYVPLYSSKQILKQKLSLAIKTKNFGF

SEQ ID NO: 993812 - protein, 50 aa, Homo sapiens
MTRTCVANTVGPAPDKCRISDESLINRKHLRKKDSNPFSDSHGEDSPHYC

SEQ ID NO: 993813 - protein, 53 aa, Homo sapiens
LRELIERKTSSLDRNDQVDMGRQWLAIQKLRSKIHKIVDRRASRGRKLRVHVL

SEQ ID NO: 993814 - protein, 67 aa, Homo sapiens
LERVRIYKNVVAPYIGGSFLVQPSALDFQFCRNQAPYAIVCAFPYLLAFTTDSMEIRLVVNGNLVHT

SEQ ID NO: 993815 - protein, 101 aa, Homo sapiens
TGGGAVRSIAGEAKGLGGTVAQYWQHSILPHQKWGTSSPSGSGDRNQTSDLSSNIQWHPDCSSAWRTAISGRSHENERLESNKEKRQGWMINSENNGAIKQ

SEQ ID NO: 993816 - protein, 209 aa, Homo sapiens
MSREWQDNPYRPWAHRWSRTPGPCVETSARVIEWCCRCCVAPGTRMGLLCEILSIVQDWGCAFRGQYTGAVGRHCACHGGRSRGVSQKRYFSEARINVRDRARVFSGSESKGSIPGSGSRHVQCTYLIARSIQHVWQEYRGRSCLSFAFLTVRPGEVKFEPRTVLRQIEGGCSMAGMLNEKLAVLMNSGGGEVVDRDEPQCHFGAKLGS

SEQ ID NO: 993817 - protein, 67 aa, Homo sapiens
PDRDDAQVKEEQQPLKAGKGKEMDSSLTASRRNCVPDRFLLMGSWLADFKNEAADPRENINILNGHF

SEQ ID NO: 993818 - protein, 265 aa, Homo sapiens
MKKQQQKTYKINAPRHSYRKNNKKEGRKAQKRKETRKRRREEQSQGKAKREKENRRKTEKKKRRKTKGKRRKPRTRRRREEESTRGTERRKKKRQRSRERKKTKQNNGKKEKNQKTKKKRKKQKTTKKKKKRQKKKKKEEEQKKEKGERTKEEKERKEGKGNEARTTTKRKKKAEQRERDNTQERKTRASREKKKQKEKKREKEENRDNRKRKEKEEERKEKTKAEEKKKERKDREEEAREKKKRQKTKKTRKTERKEREEREGE

SEQ ID NO: 993819 - protein, 70 aa, Homo sapiens
LEDEGTYVQTLAFRRGGDDQPRRSTRGGGGYNHPGLGTNRKRLFVKKRASDLKHPGENLLTDLPLSLQNK

SEQ ID NO: 993820 - protein, 83 aa, Homo sapiens
LITMRLLILTCLVAVALARPKLPLRYPERLQNPSESSEPIPLESRGEYMNGMNRQRNILREKQTDEIKNCVVAEPEKMESSIS

SEQ ID NO: 993821 - protein, 151 aa, Homo sapiens
ETDFHSVWLRLECNGMILPHNNLYLAGSSASPVSTSQVAGIAGMCHHARLIWCFIVETGFLRVGQAGLELLISGYPSASASQGAGITGVSHHAQARIIFFGDAVLLCCPGWSAVAQSRLTATSTTGVQAILLPQVPAAGEAEAGEWCEPRG

SEQ ID NO: 993822 - protein, 429 aa, Homo sapiens
ASFRLRLTTLGTPRLLRKMKPDPGPAPEWTAPMMGVSVACGCVPLPHILLCNCNAMCSVCCECGCACDACLKCACASCVHVVHADGDADVCVKHLLHVPVMSPVMDVPNFVMHVAFPMWSLDGDCLCANDLLNVIARFLCALQMCMCCRSLKPCLLNPNAKEQDACVAVCACVACGCLVVPELCPNLSGLSGSAKSPPIAPVLGCPSMPLCGLTPGTHGLMLDSCESMPDEGTPVNAVLLLPVTHVACCWEFLPVLPLDGRTGLCTLAARVVLRRTEPDAAVSCCCRARVGLHLVMGPPRVPTVPSWAALVSTGPDDQRGVARSKDRRLSRLSLRAMAIARLPWLHAKHRGSGPELVTAGRCLRPAEVQHRDIEPAHMALQGPCVSPATTRPPPGTLSPRQGHGWPSQRTGTILRKGFPPRRCEHANSG

SEQ ID NO: 993823 - protein, 110 aa, Homo sapiens
YWFCINVKQLTSVTASNGQAASLALAAFPVNLSNSLFFRTCSVLLRAPKLGLQILRKTQYYSYSKLVQKSRVMKKPLVNLFNDVIVSASRKYERTTIPTSYALFSVLDAG

SEQ ID NO: 993824 - protein, 50 aa, Homo sapiens
LKETLCEDYIKKVAICKPGSEASPDASPADSSSWTFSLQDRNKFLLFKPK

SEQ ID NO: 993825 - protein, 413 aa, Homo sapiens
RDAWVDPRVWEAGAVCGVRVWKSCAVEPWSGQLSEGAIAAIMQKWGYKHKAQSSKLINILSHYYGGIVRRVIDCSCSDGLNTLSSFMLGDTARNPPRWSEEQLRPATCCTATTSQTHSLEHSCNHRTAHHLPTPSMRTPTVPRPSPLAPTPPAEPLAQLHLPLLPAPRPSAAAPPTLGPLPPAHPAHAPQPAQPARPPARPHPGTRIARTRGSVPGPLNGPHSRASPHQPPRHNRLPPAPPAPAQPPHTLPAHPHGPTRWPPPHQPTPLTPPQPQSPPTAPHPRPPPTPHPHTTTARLPAPPRRHTSPQAAHTRPPTRPPAPRHPPARREPPHPTPPLSPHLPTSPPPPPPHHLSTPPPPPPSHTHLPPPHTTAPPPPHLQHLSHPPTPPTTPPHPHTPHLPPSHPHTPHPST

SEQ ID NO: 993826 - protein, 63 aa, Homo sapiens
MRLAYQRDCLKESPEPVLSLGVGRNPIQSWRTRCSCCSRGWSKAKAAGGWEPCPDHPSRTSAE

SEQ ID NO: 993827 - protein, 122 aa, Homo sapiens
MYIQPLFLTCMFTLSINVIASRAHCPRRYNRPTATDLHSPTWLTPTYVPFTLLPIALRNGLIIMTYPQQTNTPTTSRNTHANTTRNKATTPARQNTHGTTQQPHHTHEQPGPTPRTHHPHQT

SEQ ID NO: 993828 - protein, 238 aa, Homo sapiens
TVSPYATLTVGDSCSENQGVIIRNTSDTLSGMRVPALGLSAGNATHMRSLEERVRGEGTGLCRVSLIPDTLVRDSLGADQLLDVDRWLYSSDKCVRGRRCYWMKLDAKEILEVPALRDVEAHSDSYSHSSSSLSDMNQELCGGTPLTLPLQPQSVQCRALNRCWTVRTMVSSAGLVEPGEYLILRDLPVEERKLGRALFMVCWCPVIDRMDRVSLLISMCQVGYWQTRSEVARGGLSV

SEQ ID NO: 993829 - protein, 77 aa, Homo sapiens
FLPKLDDSHCAQLKRMVRLGSCSSASWVHAILLPQPPDSWDTGPRESLTTKLRIIALAFRRRKGSLDMLLKGMIRLT

SEQ ID NO: 993830 - protein, 245 aa, Homo sapiens
ATRSKDSRNTYSLLFGAWSVESVEHSSKPPYSEPSGGQAGNLLGNDQIYNVIVTAHALVRIFFIVIPIIIGGLATELVPPNKSVPPIWRFPASKRTSKLHDVVDLPLSLLLLASAIVEAEQEQVEQSTLALAGNYSHPGALRRPNTCFSLHLAGVSSILGAIKFTCTNKLIQVYNPAAMNRNTPNAPLRLIRPNTQQAYFSYLSQSYCGHHYTTKQTELNNTLFEARRRRRAHFYSKPSSDFSVT

SEQ ID NO: 993831 - protein, 72 aa, Homo sapiens
GGNSHLTPRKGEGEGFVKSPGLRGTRPGCYFAQKQVTEQTYELQLPEGEEIRAAVTLASSLNLFRSSEPACQ

SEQ ID NO: 993832 - protein, 413 aa, Homo sapiens
AAQVVPVSPPPFPSPVAFPGPLHSTVPVPTCPRKPSKHSSNPAEADRRRQQAGHAGASKVICLSRAEAGKAQQAKYPSLGTTTPGRLRTIRPCTADSSKGKKSYRLQAALTPMATSHSMHRIRRLHTVHGTRQRTLAAPGCITIHHPNRHLPPRAKSISTVITDKTRRRWHKARPDCMNRATSDQTTMTHAHTHPSHPHRGYLTQETYMNTHTHRTTTHNQKEIQEKDATQNKKTQDKHRHNPNPHHMQQQSYQKTTMQQPQRRHCTTTQPNHPTTHPNRTHTPAHKTYPQRKRQTLHPSKTPGNKAQDDTHKTEKTADDHKHRHAPTQTASSTHSAKTNTTAQPTLYRDPNKATAEQHTCTTTETRNKPASPQSQPKTRATAHLAHAQPVSPNTPHPTNNTDDTTLTTTPQH

SEQ ID NO: 993833 - protein, 114 aa, Homo sapiens
SLVSRDPEYKKLGRNPRCVEEEKTSANPETLLGEDGGESTRELIARSNRTPLLEYIRNRLIRKAENYREEKREERRQERSLGQRHHGGAGESRQNTWKVRRERRKRAHHTEKQK

SEQ ID NO: 993834 - protein, 80 aa, Homo sapiens
GRGGGAREIGEKKVVPSLLLAHATHILWPPERWQKLESGGLGSAYYEKRNDCMNLPELLALGGQLLERNGKKKPPKGKNF

SEQ ID NO: 993835 - protein, 101 aa, Homo sapiens
MPNSRGQKELGIKRDFKGTALTGAESACAIQLESQVLRQDVQMPQCRVLLINTCSPVLISNLTHPTLKAHLALVWRSSASVDSATADGKYSENKWLASLAS

SEQ ID NO: 993836 - protein, 113 aa, Homo sapiens
MDLYSYTVMAPYARPHNHHLSLMLVSLDITALPYGLDLHYYAIIVPYDIAASLNSLSFGLLRQIQDTISSGVCPDRYLESRLTLMKDLNSGIADIVYVDKIGPRGLKLSLQVQ

SEQ ID NO: 993837 - protein, 104 aa, Homo sapiens
MEEFFTVLDLYSLTKDARFVILCGFSGGSTEVVVGRRGSIDHYLNVLCASCAGPYKLGARTTSIDSLTWPLESSRSYTEADSNRICCVFLDKHMCHRDTCHRNS

SEQ ID NO: 993838 - protein, 217 aa, Homo sapiens
SHVREIHVAGEVGERILGQLGELERLIIHHAARYALGFVIPCGVNDTCRGSLRTYRGNVEDLASAGHLLDYQSLPTCGVVLGTRIERGTKLMYHLGLTVFDVDLPASTFMHFPVAQHKPITGLASISISKLPYNSPSPSGSVMKPFLDSIVGNPIRTIPRCRACQLPIGGFNGKAKALIPIPRIYGDSGLDSKTDVIESNTVSDTLFSGKLGGHIQY

SEQ ID NO: 993839 - protein, 77 aa, Homo sapiens
RTIRYNFFKRKERLGGLIHCYTAILYLNEEEEEEDFEKEAEAAAAAAAAEEEEEEEERGRNFTKNLKYFKIFSLLCF

SEQ ID NO: 993840 - protein, 81 aa, Homo sapiens
CKHYPLYSLNVASMWVKLGRLYMGLHGRGGRKQLKAIAIMEVAHGKDHPYISEIKQEIESACDYAAFQFSFKHLVQKPGGG

SEQ ID NO: 993841 - protein, 73 aa, Homo sapiens
MTTDPRTRRREQTYAATYRNHTNHARSTKRNQIEAAGRHNERTAAQTSTTRHTSQGLTKNRRPDKRRSSPAND

SEQ ID NO: 993842 - protein, 434 aa, Homo sapiens
MTPTKEGRTQQNKERREKENTRGGGERNKKEAKTRKAAVKKRKGGERETKGGKARTKAKKERKKSTGERQKKKRKARTKSEKEKERNTKRSRKDKGAAQKVGGSDERDTSTRGRRAEEGGGGGETEHKKERERGEGEDGRERGTEGKGGEEGRKKRRKREGRDAKEGGRSAGREGRERRGRGEKKQREKRERGEREKRRGAQGEKKRRGRGERRKRSKDGRGGERRGEGETEQGRSGEHEERSRSRRKEGERKGGERGREGREEEGGERGREEKERRGEKKRRSRESERGEEERGRKKRRERGRRKEHRRGKRKRRRRGRREEREGARIEEGGSEDRKGRRREGGRERRKKERRKGKQEGRGGRGRNEEKEERRRERERKEGQRSSKAAGEGESKTRGEAERRAAREGRERRDEEGRGEEEKRREEGERQREAK

SEQ ID NO: 993843 - protein, 91 aa, Homo sapiens
VLWNWKPAWLHKAAVTPWKYHSILPYLSVWQLAMKKFSDLPCLIADHKTLVPERSCFTPRERNVIQKGQEESEEMLITFARGCPFFIEPKH

SEQ ID NO: 993844 - protein, 110 aa, Homo sapiens
IIQENFPNLARQANTQIWEIWRTLQRYSLRRATPRHLIIRFSKVEMKEKMLRAAIEKGQVTYKRKPIRPIADLSAETLQARREWGPLFNILKEKNFQPRISYPAKLSFIS

SEQ ID NO: 993845 - protein, 33 aa, Homo sapiens
MSAEQGFYRCPVNRKCSSLTGLLLSNRMVSRDP

SEQ ID NO: 993846 - protein, 328 aa, Homo sapiens
MSAGGASVPPPPNPGVYFPPARVIPDRLAPDILRTYSGAFVCLEILYRGYFVWHFWLPTSNVPLTYYYKDGLMKVYQLTAYPLLTLPLIWDMFLSGMVAQIDANWNFLDFTPTILQYIAFYNRSLSHRKQQPHPCMIRIAINHNPGTPLLSDNQYTHNRTSLNHRLYDDQLDMVAAGLALRTMATANTPYTLPRRHVTPTRSTHISDHPAYKTTHDANNTFHTVTRPPQRDPNPSSAPPSAAHQTTRPPTRTPNNPPPFRPRNKPPAHAPPPPNTNPQRLPHTHGPPPPGTPIATPNTRPTAKPRRKPQNPTHPRKTPTHPHAPCHTP

SEQ ID NO: 993847 - protein, 84 aa, Homo sapiens
WPATENPVVLAVLDEEKEGVVRRTDGLGHRIIMAAVAAAASVPSSLTSTKDLCTTLDRDRSVWDIPEKSALPSNASGVGTLSMS

SEQ ID NO: 993848 - protein, 90 aa, Homo sapiens
MPVGPEERLCATCSFRRNLAGVIRPTVGPTCIDPIHRKSPLGQEHKSYDLTAYRGNSDSASTPSHCSHPHTSHIYTRPAHTHNERPPHQH

SEQ ID NO: 993849 - protein, 74 aa, Homo sapiens
GVVGRERRRGGGALGETAPTILLWSSVGEVMASQDDPLGQRSRGTNHPGLGTNRKSRLFVKKRARDWNTLVETC

SEQ ID NO: 993850 - protein, 214 aa, Homo sapiens
MGKKMRWPSALEDSGPLVGGPAAPNLQAGQMLPGDKHQANRSQTARAWPGPPVPGPQPNQPGLGEERGRVRVGESGQVPKPKPGPQSIIREGGSQLKAVPTGVSGASEIQEIRTGPPIWRRQGLDFPVAGAFPLVPLGLQGPPMGSPWDVGGRRCVGGRRSPCRVVCEEDMNEERNRIRQGVSTDQTGAQARPDMQARNSRYSRVYNKTSAMGG

SEQ ID NO: 993851 - protein, 59 aa, Homo sapiens
MPLSRVLLINTCSPVLISNLTHPTLKAHLALVSRSSASVDSATADGKYSENKLDGYVSI

SEQ ID NO: 993852 - protein, 104 aa, Homo sapiens
VVLRHHRSTKKTTACVHSPGPWISQVSQNSFSWDSQRIQNCSLSSAWLSLSIYLVTVLGNLLIILAVSSDSHLHTPIYFFLFNLSLADIGFTSAMYPKMIVDMQ

SEQ ID NO: 993853 - protein, 57 aa, Homo sapiens
AVQADLDTLGSNHLPTLASQGAEHLFLKDEPAVIRRGGKTGLGKNLGQNEAKTENEE

SEQ ID NO: 993854 - protein, 148 aa, Homo sapiens
MRSRVYRKYVGRLCLHSREMLVDSSPDDSSSLSHNQENVAYSGYYSDMAFTNTRPGCQKPLIAFVEWRHDLTHEHSSRWFIEMFWQTKPVVYAHRSFFYTLKVVILNHTEETTLPYVHLEITTHKVSSNCRFCLKKEIEKYKNCAIIQ

SEQ ID NO: 993855 - protein, 279 aa, Homo sapiens
MLQHQTSQGTSRADAPNSTKPPLRAPSHADRARAKRRLTSAPCGLPPSKGHRKPHRIPCEPAPRSQPGTAGTGCQHTRWDHTTPMTSRPTTTPRTPRHKRGTQRSDSIERYAHPRTTHPTPGTTAHRPPTQTAYISSRVRAKTQSTHQPGHLTAHRATPHALHKTQHAPRAMMPTHKSNASPLSPAPWSRDWTKTQPSPKPTKKHTTTTHTHRLTTTPPQTGTQAQTADRSLLSVANRPTTDPQPRTPHPTPLTTHSSTTAEHEAPNNTHHTTQDTQST

SEQ ID NO: 993856 - protein, 321 aa, Homo sapiens
MFGKHQAPWANVVEHPHIFLTKQYHQQWLTPKRYVVDKGPPWEHPGGITHQGKRWETPGIATGVHKHLGGQAVARACLATTEPRRKLSLRQLGDTPQRSLGGTTAEVGSKPLRRSAKYKRRHVTTTTEGGGAHARHTEQELSPPPEEGGPPREIYQRADTPTRYYILVREPQKSGGRHQNKSQRSAANIYINRAQLEQHSGTHERGTSKTPRRVIGPVATTKTRTDPRGATIGGAGSSTPTSNTHTERRRTATPQLWRAKPPNAYRGKAYFNGRPQEAAHNTITNVLTRRVYSIVGATNKQQRQILTEQRAAQAIWPTTAL

SEQ ID NO: 993857 - protein, 74 aa, Homo sapiens
MAGIVILHMQALTGKAEWGEGYVTQKDEGPNQLWVQQRLLKRPVHVEVMDVGGPWMGLGGRSPYTLGGVGLWMG

SEQ ID NO: 993858 - protein, 559 aa, Homo sapiens
MLLSVAENREDGDDTKERRRQRHIQHQNATERRDTHEKKQQQQPQRGRARETSRAPRENKHNQATEKASPLHHSHVAEERTEEHAPHKKHTRSATKDTTQPTHTKEHDKQEEHTAHAGAERDRTTNQHTPPLTPQREQTHTRATDTTHTNQGPETSTTNTHTPAQAHKQETTNTTRDQTYTRQSSAQQRATHSADIEKQDNQLIITVDRQKEQDRNIQYTKTAGPPTATQGAENRTHQTNTPEHNTTPPKKQGNTDNTTTTTRKPENTQHSQTRTGHRPRRASHTSKLNNRHKAQHTHTERKKQGNATQTSPPQRRHHKTHNRTHNHTTHKTPTHSSNPPPPENTDAQKQQNTTSHIATRPPTPTQDRRKSKMTRQSKTKKARATEKTKRESSTKPGRTEGERPQKREHRHETQDTQDDRGSRTHDRRADAKTRTKTKHATKTHDREHEQTKQGEEQAQTTEQTEQRRETDEKKRNKHRRETRRTEPPPNTRTTKRTKGKNEKRKKKTERTRTHKPQTSEVATDTEDKSQKNDQEDTRTKEVQNNKRQTKRRRYNSNRE

SEQ ID NO: 993859 - protein, 125 aa, Homo sapiens
MRYESHPVCADLQAKILHDVTVRTPTSTLKCSGSGLPRYMHVCRIDAQTEHAGEGRINNFAGMSKRPSRVNSRDGSHFLYPSEKTRQFEEKTTNEKIDYRETIKNGFSRIHFTFLNMSSFEGPKC

SEQ ID NO: 993860 - protein, 119 aa, Homo sapiens
MKTIRNRIIHRTVNYKVYRVADCTAAYNASEYLTKSPLSALSDGMRRLSMVVATGLPTEFAALWAQFCITDRDSVTATKYFSFDNPKAVYLWVSKGSRLSTGILVEWWVWPNCVDGARS

SEQ ID NO: 993861 - protein, 81 aa, Homo sapiens
VWDFDALLPVLSILVSNYNPKEFVSGVQNYLENWLHEKAPTEEGKKELLFLSDAIPSLLERCAYLYSQDHKKETLTVGFCF

SEQ ID NO: 993862 - protein, 44 aa, Homo sapiens
AAAYYYYCSEFKLLTMYGDMNKFFSTQCFWTFSLKQKINFKKEK

SEQ ID NO: 993863 - protein, 34 aa, Homo sapiens
AAAYYYYYCSEFKLLTMYGDMEINTHAALGPCKK

SEQ ID NO: 993864 - protein, 45 aa, Homo sapiens
AAAYYYYYCSEFKLLTMYGDMNHHAQPKLNYYCVRICIKCDLSSK

SEQ ID NO: 993865 - protein, 41 aa, Homo sapiens
AAAYYYYCSEFKLLTMYGDMSLLTLFFSLCNTQTIKCYTNK

SEQ ID NO: 993866 - protein, 30 aa, Homo sapiens
AAAYYYYYCSEFKLLTMYGDMEINTFLEEH

SEQ ID NO: 993867 - protein, 45 aa, Homo sapiens
AAAYYYYYCSEFKLLTMYGDMVATLVEIVPLHSSLGERAKLRLKK

SEQ ID NO: 993868 - protein, 64 aa, Homo sapiens
AAAYYYYYCSEFKLLTMYGDMPLIPATGEAETGESLEPSRGRLWGAKIAPLHSSLGKKSETLSK

SEQ ID NO: 993869 - protein, 36 aa, Homo sapiens
AAAYYYYYCSEFKLLTMYGDMSFPIKKKMTSCPVQK

SEQ ID NO: 993870 - protein, 44 aa, Homo sapiens
AAAYYYYCSEFKLLTMYGDMIIIERSQNLCHYSTVLPNKEWKFK

SEQ ID NO: 993871 - protein, 34 aa, Homo sapiens
AAAYYYYCSEFKLLTMYGDMTSGNKVLDFIKAKK

SEQ ID NO: 993872 - protein, 33 aa, Homo sapiens
AAAYYYYYCSEFKLLTMYGDMKRQINDDFPQKK

SEQ ID NO: 993873 - protein, 34 aa, Homo sapiens
AAAYYYYCSEFKLLTMYGDMHPMGATINNRSTKK

SEQ ID NO: 993874 - protein, 62 aa, Homo sapiens
AAAYYYYYCSEFKLLTMYGDMPVVPATQEAEKEKRLNLEAEVVVAEIEPLHSSLGNKSETPT

SEQ ID NO: 993875 - protein, 34 aa, Homo sapiens
AAAYYYYCSEFKLLTMYGDMKTETKTHRKKVVLH

SEQ ID NO: 993876 - protein, 44 aa, Homo sapiens
AAAYYYYYYCSNSSFYDVRGHGETPSLLKYKKIAGQQSKTLSQK

SEQ ID NO: 993877 - protein, 40 aa, Homo sapiens
AAAYYYYCSEFKLLTMYGDMQTPPKSSILSCTINKVLCTQ

SEQ ID NO: 993878 - protein, 35 aa, Homo sapiens
AAAYYYYCSEFKLLTMYGDMPLHSSLVTERDSIAK

SEQ ID NO: 993879 - protein, 67 aa, Homo sapiens
AAAYYYYYCSEFKLLTMYGDMVARACIPATQVTEAQELPEPENCLKPGGGGCSELRSRHYTPAWGTA

SEQ ID NO: 993880 - protein, 33 aa, Homo sapiens
GFAGAVQLGLIGKKRQKKRRSKEGKQGEKEKGK

SEQ ID NO: 993881 - protein, 38 aa, Homo sapiens
GFAGAVQLGLIGTRIRARIRGNITIIDHFLGHKTHLNK

SEQ ID NO: 993882 - protein, 79 aa, Homo sapiens
GKFVTNTHLGCINDRKEQLRQLFRSLQVQKKASSWPPAGRNEALAGAALASSSVDPSTVHQSSPSSSMAAVLLERQPQL

SEQ ID NO: 993883 - protein, 88 aa, Homo sapiens
DHASPGWSPFGPNYGTCTDSLLGKNSEAQPARQILVLDNAAIVCNFGSELSLVYVPSVLEKLELKAGQLHYAFPPSQGGALGIATLWT

SEQ ID NO: 993884 - protein, 53 aa, Homo sapiens
VDGRSGCDICHPIDQPGLIRLIWLARRVSPSSLTAPCASLPKLRARSKRTTIP

SEQ ID NO: 993885 - protein, 536 aa, Homo sapiens
MATADCPHATVNSPHHNRQDTMTNQGTDIRPQSQHATRRQDTGYPADAHRTPRRTQSQTIESRSTQEVTSESTTQQVTKRVNTKHTTRTKRKQQLRDQKEKHSENSDKQEHKQETAQNTASPIARPPPQKSTPPHAPNSTSTTPQHYATDTAQQSRAPTNTKHHPSTHNPNTTRYHHRHNNPTTTMTNSRTQERAHTTKQTKPTTEKKHPHKAHDEQNSAKNRNHATDNRTQPKKHTNRKNTYQRANPKEQHDPTTPQALADKHSGDQTTGRRRRQPTRKEQNTKLNHTTTQVGKSTHQARGGRDHRTPEHNPQSKDETSAESTRSRPRVRAQARQQRRQKPTKTTTRTEEKIKHREKTTQQTNYTEQHKQTQTHTQRHNAATRTPQEDKQDKDTTQNNREYAQKQKKQRHRQPTTKQRGRRSTANYISKNEHTHTNGTTHKNNSKKHQQRVRPTANQHDSTRRHTDEQQPPHERPRTQYTRTHTQPQPYRPTTKATAQTHHNPNQHTKNTKQDTTIQTKRTQSKQKTRQQQNRKG

SEQ ID NO: 993886 - protein, 79 aa, Homo sapiens
LNTNEWPSIITPDTPLQLFPHQPIKNIKHKLTHSYRPRHTNNHTNNIRRIIAKPENQNERKSVRFIQLTPQSGRPYAGR

SEQ ID NO: 993887 - protein, 485 aa, Homo sapiens
TRQCKKFIYGGCEGNQNRLESLEKCKKMLVQRDNGKQGFIKKTTLAHKENAKISGFCGKERSWEYGQRLYYQGILITQSRNKNSGEPFTMYGWDGSGQLWNQFVEELWERMAKNLLVRKMGPRMVFPQGGINLWRTPGLQWAGENKSPPGSPRQSQPKGFPKLFWENFLSGVPLEWVLFNSPSRDQEGLGVPGAQCETTRISILYKFSSSIGGNVAAPYLEVYEGRSGWGGDTVPKPNFYNFPKNTECALEGASCYTTERFSIPKEQIIPTRGGPKSIKTQKRKHRAKGTARRSLAHNSPLLDTPTVAGSHHTLAATSCLINGQSWTIIFEMSPTIKHISLISGANRGPPRKWQKLYPKNNEACRKKTAHRTSTTSRSRNKRCDKAANGDTGRSLTHATQQQRGAGGAQKKITPPGEGGHRQIVAHPTGFCYRKGGPQNEGTTRNQSKQQTRYTTQLQSGAKATPRKRGRKHNTRGEQTKDRSKN

SEQ ID NO: 993888 - protein, 101 aa, Homo sapiens
MRGGSGENNSAHQADYLGGTDPTPGGGGKQTVAEHHPTMTENTNTRPEENKIQHSAHDVHQWRVNPTDQRLEDAPARTSSWRTSRDLSLEQTLYPGSDKEK

SEQ ID NO: 993889 - protein, 428 aa, Homo sapiens
ACPFSVNPITIFQEEIPPIFKLGTMSRTREYVSGVQHGRASPTDGMQGVGGYIMLRAGSHKRVIISAPFCMHAPNVSSMGVNLGRKYALTAFKIIRQSDTTLRHTNHAIATPCAQRVNPGLTIRIFVDRTHVPTKYHSTYICHTRIDCEDGALPEKLDAPVMSPAGGLTTRQHTFPDTTTCALTKADGATGQSLAAADVDSSTEHGPCHDVHQRAKNVIEYGVTVHHAVLAKIWQNMMHITERVSESTGVRKEPPVKGQILGYHCSHTGWNHLMTHRRGKPITQQPYDRKGEEKAIKRTQTDKSHHPWRGRGNKGTAEKEGGTNKAPTSRSKQEEHVTEGAERKQEETKQQEGRETGSEHARTRKTTEGREIDKEKETNDRRKERTPASKTRRDREGKQPARRKEVTEREELEARRKKIDTIRGEESS

SEQ ID NO: 993890 - protein, 239 aa, Homo sapiens
ILFSLSLSLSLSLSLSLSLSAVWGEEEEEFFPRHTFTRDTTSLHVSSLLQGASEAAPGCPTPESPCRERSLMRNSNSLFSSSPRRLFPSLSSLSTLPLVQRDHLPPPDTTPSAPRGGTRERLPSASLSLPPLPSLLGQPMDRCGIEGDSGRQYKDNSSPRQRASVALAPGWCFPAYITLSPERLLEQSQGRIEEKRVARREEAAERRQDERTLRARRGSVQLQPAGTILAAPSDSKRET

SEQ ID NO: 993891 - protein, 230 aa, Homo sapiens
GSLVGCHLRSIVTWVLHVVLRFLDDYPVYRCPTLLTGLVAVGYPAGPRQARGCTYVQTTTPGTVLVVGPAICSLLHPHAASAAGRSTVVREAAAEPPAFLVLFSYFTSAELVRAEADLVETQRPSSLHGAWCSLTLEETVLGVPSNQLKGEPAMLPFKDRCWITYFPDQLVNKLRVAFRDPDLVGSAAMEHPSKQLPACLSEQQPRGDAALQQTPGRACAEPLPCRCRKS

SEQ ID NO: 993892 - protein, 103 aa, Homo sapiens
MRHPRSHILVSLHFGRPHPHQSSTVVTVLITILLSRLNNTTRPIIQSQIDKSLMCLKVTSPQHLSTATYDQAFLCNAISSVHRPSHKPSSVSALIEFEPLLGQ

SEQ ID NO: 993893 - protein, 94 aa, Homo sapiens
KWKLTVCRRLEVRYQQQLRQLNSMGFINREGYSLQGLHCHRMGSHQRSYRETAGVPDSPNPWDPVPSMLVLPRPYESRAIQVFYLVKYPLTPSC

SEQ ID NO: 993894 - protein, 37 aa, Homo sapiens
MDEDVQEALLQIIQIAARGLLCQPLATALTVSCFTLA

SEQ ID NO: 993895 - protein, 48 aa, Homo sapiens
EERPEKIPDLKLLVEKKFLALQSKNSDADFQNNEKFVQFKQQLKELKK

SEQ ID NO: 993896 - protein, 173 aa, Homo sapiens
MVGCDYEIDSNATEDRCGVCLGDGSSCQTVRKMFKQKEGSGYVDIGLTPKGARDIRVMEIEGAGNFLAMRSEDPEKYYLNGGFIIQWNGNYKLAGTVFQYDRKGDLEKLMATGPTNESVWIQLLFQVTNPGIKYEYTIQKDGLDNDVEHQMYFWQYGHWTECSVTCGTDQRSM

SEQ ID NO: 993897 - protein, 200 aa, Homo sapiens
MLTMKFYLSLYFDTGKGQKASEIPKSKLDINVINNANKEFYLQLYFDPGKGQKNITNSLITTYALQSLYPGPPLATLFTPPYPTWISPPSPRAALQSRHLSCGAHYSPPASSLRQAAGRRPGPKRHEPALGRAPRSSLRTSRLLATRTPILSPEKTSDGPSCHVLASGVPALAQSRFTCHCLFFPDVSVPPPSTCQLPPT

SEQ ID NO: 993898 - protein, 85 aa, Homo sapiens
RVPTKNPYNPANAKKNLQFGSSCLLGDFAKPENIDLALHLKRENNALHHIPDVITYLSRLRNQSVFNFCAIPQVMAIATLAACYN

SEQ ID NO: 993899 - protein, 67 aa, Homo sapiens
PGETAENDTMRSILEDTFTCAIESHGVGGKVHYTNSSTEIPEFPIAPEIALELLMAAELLRLLNKIN

SEQ ID NO: 993900 - protein, 103 aa, Homo sapiens
SRENSSEHPSYSRSPHQVARWEFQTRAVSWDVDTAATLIGVGAAPVGVAGFGPGIGTAFGSFVGYAGNLFHKQQLISDAILGFAVSEAMGLFCLVVVFLILAT

SEQ ID NO: 993901 - protein, 109 aa, Homo sapiens
MRTVILTAEKADTEMGHERGGKGSDYQFEGLNLTSNLYTSVCVASIKKQRTISCHDCLTAPSSYAFPVPFCTEDEPEAKAIQMTTIFGIINMIFKEHFSHFEKGHSCEQ

SEQ ID NO: 993902 - protein, 34 aa, Homo sapiens
RALIFNRHTPHVCLVYFVPPRRLSQFVAHTLLSR

SEQ ID NO: 993903 - protein, 41 aa, Homo sapiens
VGSVKYLTWVCHQGAAGPGSSEGWCCCCPVQDGSASSSQKP

SEQ ID NO: 993904 - protein, 33 aa, Homo sapiens
IGIFFCPLLPFIQMIMLFIMFYSKNIEAFKLTV

SEQ ID NO: 993905 - protein, 32 aa, Homo sapiens
MSDVQENEEVKKAGMNEGRKQPQQLVPTREAG

SEQ ID NO: 993906 - protein, 53 aa, Homo sapiens
WLRNPGPQHDKRTLIGDMVCFLFITPVATILGTCIPQMKLITIMAISVVCFFF

SEQ ID NO: 993907 - protein, 79 aa, Homo sapiens
QNTESANIEQFLQERIKVNGKAGIPWWRGGDNRKEQEQDHRDIRGAFLQKVCDISNHKIFEEENLRDWMRVVANSKYEY

SEQ ID NO: 993908 - protein, 70 aa, Homo sapiens
MGVGANAGGGGGEYAARIRVYFQFICSLFYGFQTLQNTLQGAGGPNENQKNDAWNFIGGSGRMRKALLLV

SEQ ID NO: 993909 - protein, 77 aa, Homo sapiens
MRERVKGLKVEVRCRGWFVEMFKERPMDPLSVPSSCARENCRLSQQRQEKQLDIREKCLTSEGQLARRIFHEESQET

SEQ ID NO: 993910 - protein, 162 aa, Homo sapiens
MHPLYSSHLLQTQHRRLCRLCLQHQHLKLTLPLHHIVVLLWKYLQLQIRKFTVSSIPCHLPIALLPLFLHTMKLIRLKLLQWQLQQHKHLKELRRKSVHQQMTSAMQTSSQSGMMASSCSPLPMVLIFNWLGFCSSFCTTNSIPWKVRLYLRISRFLDQLDP

SEQ ID NO: 993911 - protein, 55 aa, Homo sapiens
EEGETASEETEEIAVEGAEGEAEEEEETAEGEEEPGEDEYTSGLSMRSFLTLYAE

SEQ ID NO: 993912 - protein, 59 aa, Homo sapiens
MTGLTNYQQKAEELGGNFKASGSTVCAPTHYATLPLTMRKQGHFFFFLVTKKIRVQVCG

SEQ ID NO: 993913 - protein, 55 aa, Homo sapiens
RYKYTASYGLHEKPGQRRPGDDFKEYSVFLTMLCMAYNDFFLEDNKSPGLPSTLT

SEQ ID NO: 993914 - protein, 71 aa, Homo sapiens
DSPNRAKKKASGLLGFPEVHSRPCLPGCHQQRLYNSEEGVLLLPLEASSQRSTCQMPAEPLLYEASVNPCW

SEQ ID NO: 993915 - protein, 84 aa, Homo sapiens
AESSTAEADEANSLLSHRYFYFNAGRVATLFLNLHFEGYLILSSVLQIKIMITFLSYTYNMIQVFKSKCFGLTGGAFYFVYILM

SEQ ID NO: 993916 - protein, 62 aa, Homo sapiens
ENTREEIKIKSQDSYERRKTSSSTRDPDDGTSLPSYQIQHSQSKRIAPLRSHHILANRQNTP

SEQ ID NO: 993917 - protein, 66 aa, Homo sapiens
LSEQESGLHYEPDHAYPRNIQIKPMSTHVAGGGEPDINPQASLIPPIREVEDECGLPGDQNYFFKA

SEQ ID NO: 993918 - protein, 30 aa, Homo sapiens
MTNSEAKFVDTKHPFHENKIKREIKNKENA

SEQ ID NO: 993919 - protein, 53 aa, Homo sapiens
LQGTILIASGTNQGKAAYVLDTPLMRRVRQTQRHISTVKYHEHFDKHKGCFTP

SEQ ID NO: 993920 - protein, 81 aa, Homo sapiens
DVASWDGDMGEKSNIGRIVVYFTWVQAGCPKKESAKGGEITSSYRFGIGITKYILKGGGEYIVLIRVGQEQITMVECHQLR

SEQ ID NO: 993921 - protein, 74 aa, Homo sapiens
LAERGYFVRVRTRAHDTASGSPDDLLPKVVRAQLGFIHFRETQDINQYSKKYTGFVHKGGENLKQGGVFQVTSR

SEQ ID NO: 993922 - protein, 47 aa, Homo sapiens
LAPAPMDHQSENNDIDEVIIPTAPLYKQILNLAAKQNAIEDTIFYLG

SEQ ID NO: 993923 - protein, 53 aa, Homo sapiens
QQGAATTVYCAAVPKLEGLGGMYFNNCCRCMPSPEAHSEETARTLWALSERLI

SEQ ID NO: 993924 - protein, 150 aa, Homo sapiens
MALSYLFLYLLVLLKLFKLWPLGALSHWLLCTFGMPSSTLYGSTSSFWHHRMLQAHLVISSPDSRLDLDISPRSPRPLLPFLSLSQTALSNPHPAEWSRLCSRRRQCCFPFSSDRTPHSLVSPPPPCFSPPAICPRHLLSCLTITPCIQP

SEQ ID NO: 993925 - protein, 112 aa, Homo sapiens
MWFLPLGKQERNGSRNRSSAGLLSVTQILNSSKRAIANQFEDRPPASPQGELNHVKSSFFISPSCILQPVIPHLGHSNSLKIPRPKRLRQADLRSPPVSLFGSLMIKLPSLL

SEQ ID NO: 993926 - protein, 104 aa, Homo sapiens
MHQLDRTTRGTEGGAFSADWGYYFNEFPDSWFKTAEFHFFFIWGRGKKCCITSLVTAVFSTHIEKPEKKNISLRMFSNLFPLFLKANISCTIYSKGGDRIFLML

SEQ ID NO: 993927 - protein, 223 aa, Homo sapiens
IIFYDTAGQQRWWEQELKINGNIQKGESFTYNLTQLIKPEAYEVRLTPLTKFGEGDSTIRVIKYSAPVNPHLREFHCGFEFCNICLFTQDDTDIRCGTKQTATRNTKYAPPTGPNADRSGKKEGFYMYIETSRPRLEGEKARLLSPVFSIAPKNPYGPTNTAYCFSFFYHMYGQHIGVLNAYLRLKGQTTIENPLWGFSGNKRQRWNEAHVKIYPSTSLPLNF

SEQ ID NO: 993928 - protein, 51 aa, Homo sapiens
KDPTLLCKHIMSSEWSSQEQLLKTALETYFNNTHDNTLQICLPSFMTTKQS

SEQ ID NO: 993929 - protein, 53 aa, Homo sapiens
PGIRGSPPQDDPLSENEQKNDDDILFGTKIPEVDQEALFELILAANYLTQSAE

SEQ ID NO: 993930 - protein, 106 aa, Homo sapiens
LIRAHCPASRTGSPPVQTPGQFSLDLSELTDTMKLSGMFLRLCLALFCFLTGVFSQGGQVDCGEFQDTKVYCTRESNPHCSSDGQTYGNKCALVGAIVKSGGKISL

SEQ ID NO: 993931 - protein, 56 aa, Homo sapiens
FRNLRAWIRNTLLRREIGKLTEELKHLTEALKEHEKMRPLLLCPMNCSASASPGRT

SEQ ID NO: 993932 - protein, 84 aa, Homo sapiens
FLGTPCTSVKRSEPELAKDVIELWICMCITLPCYKTPTAGRHKDVSVPPFDRYEEHFKRCSLWKWIKLELICHTRYECYDTYDV

SEQ ID NO: 993933 - protein, 47 aa, Homo sapiens
MQRQSRGEPPLPDEDLSKLFKPPQHDCQDGLTLLIAGQINTYCQNIK

SEQ ID NO: 993934 - protein, 101 aa, Homo sapiens
GGRLAEREPEFRDLTSTSLVVGHTKSQTPKSAAGPTSSGRINPYMSSPCHIEDDPYGKGTDVVLNQKEEVAQKKKISQKKLKKQKLMGTGVKSALKKMVLK

SEQ ID NO: 993935 - protein, 39 aa, Homo sapiens
MSLLIGSDALSMASSSSSSESTADSGNPLGSISPASLSV

SEQ ID NO: 993936 - protein, 115 aa, Homo sapiens
MREIVLTQTQCGNRIGAKFWEVISDEHAIDSAGTYRGDRDLLLKRIVYYNEASGSGYVPRAVLTDLEPGTLDSVRLRPFRPDLSGRRTFSWDSPVQHGLEIFPCSSVQIWLRFPA

SEQ ID NO: 993937 - protein, 71 aa, Homo sapiens
IILPSKRASLFDTPFFVRQKGLSKKQERNNSYHHRAFYKAPSSLSSPHRLRSEIKSAPPKKKTPPNTHTKK

SEQ ID NO: 993938 - protein, 51 aa, Homo sapiens
MINGIGVTEFELEAKLSGGTMIIKPATQQQRTNKGFCAAEIITEATVARWP

SEQ ID NO: 993939 - protein, 62 aa, Homo sapiens
CYIKEDLDPCARPKRRQPYNAIFSPKGRGRETTKKKDEGQFFAFLVIYSESVVLNIDFFDLL

SEQ ID NO: 993940 - protein, 73 aa, Homo sapiens
CCTPPRPTRISQPDGLDLFAAVDLMTAQTPEHWVLRGVPFCVMSRNMWGVFPPIALENARSKLLKTKKTAACW

SEQ ID NO: 993941 - protein, 153 aa, Homo sapiens
VSNYHRYRTIKGFKIAQHYVKRKKMKIMEEYEESGLLETDEATLDTRKIVEACKAVKMLFCKPELMTFTSLMINITRLHDYGQRQPLTVEHMYENISQDHVKKTVTIENHPMCSVHPCRHAEVMKKIIETVAEGGGELGVHMICTSCHSNNRI

SEQ ID NO: 993942 - protein, 62 aa, Homo sapiens
FQPHITVLMQALWMNFEESLQTTGTHSFDGIWKASFTTFTVTKYWFYRLLSALFGIPMELIW

SEQ ID NO: 993943 - protein, 51 aa, Homo sapiens
MTAVVKFVDYGNYDGVLLSTIKPIQTEAWEEEGTYDHLEFRGEVMASLDDP

SEQ ID NO: 993944 - protein, 103 aa, Homo sapiens
MSCCGSRPGAVGRSETPAPAVPYAGEALDRTTSDAMLPPDPTRLSPCNWMPKVPSRGNPRPLESPDLYSYLGSHISPFIPCGGGRQTSIKILGNKKKIGLSQK

SEQ ID NO: 993945 - protein, 67 aa, Homo sapiens
MTFPRLTTIGSVTVALLLILLLTLVASVVTSNKRATQGTYSPSRQEKEGSRVEMWNLMPPPAPERPT

SEQ ID NO: 993946 - protein, 86 aa, Homo sapiens
GGGREGGGRGKEAFSRDHGIVWLIRPKEEEVVVLFNVAEGAGDFKKSGSSPKWTHDKYQGDGIVEDEEETLENNEEKKDRRKEEKE

SEQ ID NO: 993947 - protein, 71 aa, Homo sapiens
LDAAYTKLSYETCHMHSIHEYSWKYGIPQVVCEGAERTAGHVQSTVWNETALSEDPTSGVIIFMEDDCVFQ

SEQ ID NO: 993948 - protein, 41 aa, Homo sapiens
DEDEILPVLLDEHPIFVVGLDFDRLMKGRGSINQIKSVYKN

SEQ ID NO: 993949 - protein, 182 aa, Homo sapiens
MPAVTYPKNESTPPSEELELDKWKTTMKSVRGEGVSTISSRKDEDPLAATREFIEMWRLLGKEVPEHITEEELKTLMECGSNTAKKKYLKYLYTKEKGKKARRIKKEMKAAAREEAKNIKLVETTEGDKQKNFLFLRLWDRNMDIAMGWEGAQAMQVGQPLGFAWVTKIYETKRIGNTGSSF

SEQ ID NO: 993950 - protein, 75 aa, Homo sapiens
ECWCIAPVCSPDRAPSYHGVAELSCVPLQCNPKGIIWFVGTDPSKNHTTYLLSEVQSVHEEWDKEPGSTNAFLSK

SEQ ID NO: 993951 - protein, 83 aa, Homo sapiens
TEVEYGRVDGGLQSHWSSRGSTRKGNPRSTSRESKQPRRGGNTSHWEKESQAGNYIFKLFDLIFAKCELLLAFTFPIKSTMIM

SEQ ID NO: 993952 - protein, 76 aa, Homo sapiens
LTYPLETDVDPMSHAKELSTTCLSCDRNTPEKTRRYESCVSILYGLMTITLRVPENGTTGGLGLAIISLVHGPQAH

SEQ ID NO: 993953 - protein, 71 aa, Homo sapiens
DSFTDILRAILLSLEVLIEDPELQINAFILIIDWSNPSLQTTAPNLTPFNPLNLAIRRGSTDSNPLAPFVT

SEQ ID NO: 993954 - protein, 166 aa, Homo sapiens
MGRTGLMGFDNLLWDWAALAQIVSGHGDKLRTLVLWMEVEAMREGEKNNGLVCPQRGELWRPVPFKGGEMQEPRFLESLGSVVRVGGTGSTPWKGGIRLSADIRGWRREGGVSQGAAGGGNGKGRVCWGFHERRAAGEVKMYAVMPGREAARLEETGRVPRSERRS

SEQ ID NO: 993955 - protein, 68 aa, Homo sapiens
FRTHLRLIYNICDMASHGSYYLILYLSTLRWRGSRSLASIAIVEDLLLTVILSDHLETYLSSSKRSEF

SEQ ID NO: 993956 - protein, 45 aa, Homo sapiens
MKPVQFGTVPLLCTETEKSGLEVEDAAHQDRTTVLQDGHQSETLS

SEQ ID NO: 993957 - protein, 48 aa, Homo sapiens
MALLDGSLTGWTDSVSLNHCMEDNWKLPGTPALDSYGTRNKLLASLAS

SEQ ID NO: 993958 - protein, 78 aa, Homo sapiens
SYQLYGPNSPEAQKFIGLMPFSGENYFDAEKNSISLCGQLFPSSHTENKGHRYPCFFNTLQCGRYNKNCHKFLIQSNR

SEQ ID NO: 993959 - protein, 81 aa, Homo sapiens
EVHMRKTSTKRKGLACERLHSTSRGYLQQQNHLLLVNSFGRTVRFNVTGTPEQYVPYSTTRKKIQEWIPPSTPYKKDNEEQ

SEQ ID NO: 993960 - protein, 101 aa, Homo sapiens
PFRRVTFSVVSQPQDPHQGSLQSCYDSGLEESETPSSKSSSGPRLGALPLPEDNYERTTPDGSVGEAEHMENGVAAITTFPFLPFPHGKTHGRRVLLRPLH

SEQ ID NO: 993961 - protein, 55 aa, Homo sapiens
MRTAPGGRCVHYCTGMWVYPFLDTLARSQIIFFESTTILMNFLYLLGEVLNNYLW

SEQ ID NO: 993962 - protein, 88 aa, Homo sapiens
ARNTHEVDGEKKKTGVGLLQQLRLSFAFTMQEKMVGCAFHILGEGGQRTIIYYLDQMEEYDKVEEISSSKHNCFCIHEVVSGLRQPVG

SEQ ID NO: 993963 - protein, 56 aa, Homo sapiens
PPSQCETFQTRSELVDFLMETLIMFKDLIGKNVYPGGWMAMSMVQNRVFLRAMNKF

SEQ ID NO: 993964 - protein, 69 aa, Homo sapiens
ALTCERISSKVVARVDHNDDNTIYESEESSEGSKTHTPLLDFSFYSRTETFEDEGAENSVSIAPTDFTG

SEQ ID NO: 993965 - protein, 46 aa, Homo sapiens
TQCCRPSPGTFWLWLYRTTVWTATAWLWVQHVRWSADPVVTYFGGG

SEQ ID NO: 993966 - protein, 74 aa, Homo sapiens
PPPSPPPTPKARQKAQHTQDPFLLVLPYLHVHTALFSSKDFAGKSQHRSLRGMLVEEMDCECAQDLAPCYRDPA

SEQ ID NO: 993967 - protein, 32 aa, Homo sapiens
LGGDILPDSWQHDPKEQWACYTLAPFPERLHV

SEQ ID NO: 993968 - protein, 43 aa, Homo sapiens
MWYGVFLWALVSSLGFDVPAGLLALFTLRHHKYGRFMSVSILL

SEQ ID NO: 993969 - protein, 33 aa, Homo sapiens
KYGYLSLPKPMKNNANLKSLKPDKPDSEEQAKI

SEQ ID NO: 993970 - protein, 103 aa, Homo sapiens
MWTLLDKYFGSVCELDIIFNFEKAYFILDEFLLGGEVQETSKKNGLKAFEQADLLQEEAETPPRVLEEIGLTYLSSLVDDFLWHFTHCEMVTPFMSMLAHGVR

SEQ ID NO: 993971 - protein, 49 aa, Homo sapiens
LLTLADGASLKGKFKVQAGCCSTGLRTRGCGYEGASAAMPLAPGEAVSV

SEQ ID NO: 993972 - protein, 56 aa, Homo sapiens
SGDAALEVGTGYGCGREKPKEFLLYWKKTGNWKDFVNGLKFFMNKVLSAVISSRYT

SEQ ID NO: 993973 - protein, 65 aa, Homo sapiens
SNYHRYRRHLTCRGDLELLSGDGAASASRSAVMTRVGTTEFHSCRPGWSTMAALGSPHPPPPRFK

SEQ ID NO: 993974 - protein, 46 aa, Homo sapiens
PYSIFENVPNKKNVDEDGESIQNGYTWNLEADDRAEQKVQAKTSAG

SEQ ID NO: 993975 - protein, 71 aa, Homo sapiens
MVPAQRSMTDHYINKTGVSHVAQAGLKLLSSGHLPASASQSARITEGACFPFTFTMISKFPRGLPRHVELT

SEQ ID NO: 993976 - protein, 152 aa, Homo sapiens
CVTLKYEIKKLIYVHLVIWLLLVAKMSGGGGRLLSHDQVAMPYQWEYPYLLSVLPSLLGLLSFPRNNISYLVLSMISMGLGGGRSTLYGMEMFPAAQQLYRHGKAYRFLFGCSGVSIMYLGLVLAVQVHAWQLYYGKKLLDSWVTSTQEEEA

SEQ ID NO: 993977 - protein, 76 aa, Homo sapiens
TEAEEPAQQKLKGDLVASFFVVIVNAAAMNMVGTNILKSPGVQCFEIHTHTWDYWIIGLPFPYPGPKKDQLTEQYE

SEQ ID NO: 993978 - protein, 31 aa, Homo sapiens
DYVYYLYTRVLLNNAKIIFLRKHNAISLIKL

SEQ ID NO: 993979 - protein, 61 aa, Homo sapiens
VPTMTTLSISARNSLPKVANATGMGWVIAICYAFVFSALIEFATVNYFTKRSWAWEGKKVP

SEQ ID NO: 993980 - protein, 80 aa, Homo sapiens
QARETQLLSLRLGVRTAGLLEGLGGESFTLLLLLVEWGRALMLEATGWTRPEVGGLIQLKEAFGNGYEKIGAWYIGIGTR

SEQ ID NO: 993981 - protein, 62 aa, Homo sapiens
SGGRKGRGGEDASAKDVVFFKISYSALGNNYFSDYPFNFGERTRFLNSNTVVWNKRMASLAS

SEQ ID NO: 993982 - protein, 52 aa, Homo sapiens
LKFLVFAFILALMVSMIGADSSEEKFLVELEDSDMGMDLIRQGQKQHYTHTH

SEQ ID NO: 993983 - protein, 46 aa, Homo sapiens
SFLLLNTSADSKHTILSPWMRSSSEHCTLAVSVHRHLQPSGRYIAQ

SEQ ID NO: 993984 - protein, 69 aa, Homo sapiens
NPSAPPPPPRPPPPRYGLSEGFYAFDKKSVDTGFAPVNEVLKAVPILYYEMWKRMKSTSKRNIKRKNRK

SEQ ID NO: 993985 - protein, 76 aa, Homo sapiens
RSRNMTSRTFLPLGKQEERQQKPQLCGSTFSDTDPEFQQKSFANQFGDRPPASPQEELNQHENAVSSSHHPVFFNQ

SEQ ID NO: 993986 - protein, 84 aa, Homo sapiens
MSGHLPEQRVSYGGTPGGFRSCSILLVDLLASFFLHSKNILLEKYGSEGCGGKAGAHSSVRVFECLQVLRPHACQLVCEGVCLS

SEQ ID NO: 993987 - protein, 58 aa, Homo sapiens
GFDDDGSEFHGHIFLGVTPGELFKTRTIFSPFMELVTCGLCKNPYLRVKQNGRTHQSG

SEQ ID NO: 993988 - protein, 47 aa, Homo sapiens
LDTVRAELYVWALCRDQDELNPYAASPAPGHLGLQYRAHSLSVVPEP

SEQ ID NO: 993989 - protein, 56 aa, Homo sapiens
VQQTLAARSLQLERKRRDFTSSGSWKLYIDTHALVCLLEDNGFATQQAEIIVSALV

SEQ ID NO: 993990 - protein, 59 aa, Homo sapiens
MQGKTIQRTSTLLCSLHGWNAEPLLGRSGYRKAKCSCCDLIQLTTPAAPPLHLRHLLPI

SEQ ID NO: 993991 - protein, 62 aa, Homo sapiens
LFVSDPLTIQRYRMMISYKGQRTLSWLSSATGGCSLEEFSYASREESLLNEHGDCESLSASP

SEQ ID NO: 993992 - protein, 108 aa, Homo sapiens
RPHLGTPMMWLICESLRCEGSNSLKLEPTVPVLHDGVLTEAMMDTHVLDAAQPHASNDALAEEGEAWALGRTNLMLVCMADDHTLTGAWTMTPSHACLCCPAHLGNAA

SEQ ID NO: 993993 - protein, 38 aa, Homo sapiens
MSQIFAYCRISTLDQTTKINAEIESAGFKIKPYQIIEE

SEQ ID NO: 993994 - protein, 70 aa, Homo sapiens
SRRALCGYARGGRKGLGGTDSCFVLKLTEMSLVLSDTLIRLSVGLEDEDDLLEDLDQALKAAPPPSGIHS

SEQ ID NO: 993995 - protein, 69 aa, Homo sapiens
MKFQDELESGKGRGPGQSFQEQVEHYRDKLLQREKEKELERERERDKKDKEKLESRSKDKKEKDEGGPT

SEQ ID NO: 993996 - protein, 142 aa, Homo sapiens
MELCSCFPGMECNTISAHCNLCLLGGGGCYLLLLGLQPQKQGDKGDIMVGKRNKTHMCHCCGSKGYHLQKLTWGGWGYPGKRKRKYNGSAKGKRQNTTGDWGEWRHLKIVEPTFRHRFREGTPPKPKRGAGGSIQVILRISR

SEQ ID NO: 993997 - protein, 66 aa, Homo sapiens
LLRDSLLCLSEATGTSVIVGVPPDFQNLSMTPMLLLTGRTWKGAVLGGFKSKECVPKLVADFMAKK

SEQ ID NO: 993998 - protein, 38 aa, Homo sapiens
NQEVVDFEKLDDYTSAFQGHDVGFCCLSTTRGKAGAEG

SEQ ID NO: 993999 - protein, 48 aa, Homo sapiens
SYNSPSCKYITTCLKVDTKMLNGLLSIINTNLAQVEKDQARLIMPSAY

SEQ ID NO: 994000 - protein, 66 aa, Homo sapiens
SQRNRLKILGNAGGIERKASGSENEGDYNPGGKHGKTTSKKPKKTSFDQDSDVDIFPSDFPTEPPS

SEQ ID NO: 994001 - protein, 88 aa, Homo sapiens
SDRRIIIRKKAKRKKTQHYLLITSLPTGGWAGDSVKASKFRREAGEEIEDFRLRPQSLNGSDYGGDIPIIPDLEEAQEEDFVLQVAAP

SEQ ID NO: 994002 - protein, 89 aa, Homo sapiens
ARGFRQEAYSEEYPRKAEKKFQATALEISYGTNSSRWSGHTGISYSQQSNVAATQVTRALKSSCGDPHDLTTHILKTGKCAFSGEEETN

SEQ ID NO: 994003 - protein, 114 aa, Homo sapiens
KAMAVSKFVAKLPEASETTNPPGETNNFRRITLRTVTLTAKVCNFTPEPPRPRTHRKEETPEHIRTSEGTNSRHAAFKNCNTHREGPRFILEVSETKNPPILDTPPCPSTFHRY

SEQ ID NO: 994004 - protein, 68 aa, Homo sapiens
RRTEAVVLGAPSEICLQFSPSRCENGDKHRELFLNFTYCLDYLVSYRGSFVRVLSVPERPCPMVLGFD

SEQ ID NO: 994005 - protein, 83 aa, Homo sapiens
GRGEGGGGKGQLPSLSFAHKRTTRDRAMMKWLCSRIQEEGADNYQLQMVRLQGKITFFPTIPFPIPHSTVSHIHCPIKSSTYT

SEQ ID NO: 994006 - protein, 78 aa, Homo sapiens
CLELHAVLGNRFWCSPLGLAVEHGPYVPDFLQRLLCALYGQTNCPKHFWITLYYTNSLLMSHGSSCHIIKIFPSRYEA

SEQ ID NO: 994007 - protein, 75 aa, Homo sapiens
RRTSSTAEANEAEPFIVTDIMIDAFEGYVGFAINHHLFNIHNPIFNQLNGDEDKIIVHVEQKICQFYESPGYYFR

SEQ ID NO: 994008 - protein, 89 aa, Homo sapiens
ERNVMECNGMESTRVQGNGMEWNAMEWNHPEWNGMECNGMDWNGINPSAMEWSEMEWNGMETTRMDWNIMECKGIEEEESECNEREWNG

SEQ ID NO: 994009 - protein, 170 aa, Homo sapiens
AWSTLNQQYHPNNYFTASRSDWKHNIEVLEGNEQFIYAVKIIRHPKYNSELMDVTLLLIKTLHTMPFINSPECPLISLPTTPSSVLAHELPPSLDWGNTTELLAADYPRRAACALDAPRAEPGVSMKPPYPGKTTNNVLRVGNLEGGTDALQGDSGGPKVWNTQTREVVH

SEQ ID NO: 994010 - protein, 90 aa, Homo sapiens
GRGEGFGRKLPARANEAMALLFFWYIRLLKEEELEALNIPEIVTVFFRTFSNKSLHWLMKKKMTEKGYTSWSSTILRCNLGGGVMWLDMF

SEQ ID NO: 994011 - protein, 92 aa, Homo sapiens
MRSFQTHGNYTSKLNSIIKEETLILPVITEYLSTLKCLNNLGFSRMVGKGFLKLCGSYTLCFLENTLNEHFKEINGIYKLSTSRHLKIIKAD

SEQ ID NO: 994012 - protein, 52 aa, Homo sapiens
MITGILLGVVTTDVPVKELLKTIPKYKSRDLTVIAFCNHKIYGHMPDVILDL

SEQ ID NO: 994013 - protein, 64 aa, Homo sapiens
LLRELSTNLTSPAPSFHACLLCSGGDTLSRITGCLTPQLVIAGAVSTARETYPWPEGIRGGKTY

SEQ ID NO: 994014 - protein, 33 aa, Homo sapiens
RTQRGALVPLSRLTGKALTRRPPSLDTVNFAKH

SEQ ID NO: 994015 - protein, 48 aa, Homo sapiens
MIIKDPLTHESLVRDNPPILPDDGLDHSPCHLDRLHIAARARTKAPHQ

SEQ ID NO: 994016 - protein, 97 aa, Homo sapiens
KFAAVHSMNAVTGVTMTSKSQMPASNSDAIMDEQSTALPLSQPHQERLAEYGDAAHYSDVAPDPTDCSVPLPMESISCVYGIAVLGNVSSIPTYDRA

SEQ ID NO: 994017 - protein, 109 aa, Homo sapiens
MRGRVDVIFSMCESQRKQNWPWGGHACTPPLWEGRGRDWLELAGEPAQATVRTPFLQKGAKILAAHGGMCLWYQLLGRLRQEDGLSSRGGGCSELKSHYSLSDRVRPCL

SEQ ID NO: 994018 - protein, 66 aa, Homo sapiens
MARLPKAIYRFNADSYQTTNVIFHRIRKNYSKIRLKPKKTQVAKAIQKPEIKPHTYSHLIFNKGRR

SEQ ID NO: 994019 - protein, 77 aa, Homo sapiens
RRDLAATSVTPLIARVDSADLAGLGGWSPSSLTAPCASLPKLRARSKRTTIPDRGGPVFGQGYTSSCAPLLEPPTSS

SEQ ID NO: 994020 - protein, 128 aa, Homo sapiens
HHPISDIGQPEVLGLGFYLETTLTVSCMGWNSPGHKAFEPGRRDEPSKSGPFGWCLRREQRTHPWQEGLPQPLIRWEQSPQPTIPIVGIVAGLVVLGAVVTGAVVAAVMWRKKSSERPKELLLRLQES

SEQ ID NO: 994021 - protein, 98 aa, Homo sapiens
CLPKTLASFPLSRWHLCATSHTGSRHTACAFGAEITRFTLLIFVLQVKPRGRGEGRGDHLRVPSTDLRLHKTSDFSSALKRVTLGTGLEPHLLIDLAP

SEQ ID NO: 994022 - protein, 33 aa, Homo sapiens
KLLTMYGDMTGIERVHSNGIKLILSQELEPEAK

SEQ ID NO: 994023 - protein, 68 aa, Homo sapiens
KLLTMYGDMPDLWISWDSEQGLHERGAERAAGVCHLCYSRHKASAPTAPDRSSWTFIQKTIKISLSKK

SEQ ID NO: 994024 - protein, 50 aa, Homo sapiens
QASNDVRGHGGLTNIMQSQKQHSNSFQSNASTHDFSSIFVKNKKKLNPKK

SEQ ID NO: 994025 - protein, 65 aa, Homo sapiens
MATPYCRACGITSSSRRRLPYLLQLLRRRRRGGVYNLVAKSEEVMNVYSVSQWDYVLAYLLRIYR

SEQ ID NO: 994026 - protein, 33 aa, Homo sapiens
AAAYYYYIRGRVDDLTQLIITLPVIQYFLSISG

SEQ ID NO: 994027 - protein, 58 aa, Homo sapiens
RLTLYRYPLYIASTLTLYRYPLYIASTLTLYRYPLYIASTLSLYWYPLYIASTLTLYW

SEQ ID NO: 994028 - protein, 32 aa, Homo sapiens
STSWALTEPMYPMTPQEERHAITTHITEEASL

SEQ ID NO: 994029 - protein, 84 aa, Homo sapiens
MEKSHNHGVVGNFHLYECFGSVWILFDSVYERVGYQDSGAVNDATDGEVRTDSSSGQWDDEYRPPGLGDGSVSFNYEEPMLGPS

SEQ ID NO: 994030 - protein, 113 aa, Homo sapiens
RPPTTTKFAAASTFDRFSLCSQAGIQWHDHSSLQPQLTEPKRSFHLSPPSSRHHRHAPPRLANSFVFLVEMGLHHAAQAGLDLLDSSEIGLPKCWNYRHKPPCLAHLYNFLIQ

SEQ ID NO: 994031 - protein, 147 aa, Homo sapiens
GRLLLLNSRPRRRLFQLTFVTREPLFMTTKSNVAEVLKSSLETLVKGDSSPVFGRGGNSEEIARESRRSHCRDYGTFGEGGAVTVHSRKQRNNGLYSPYFLIAKIDGGVRPILDLHILNESVATKGPFECLRQSICWNVSTTDCIKG

SEQ ID NO: 994032 - protein, 139 aa, Homo sapiens
ASTNAIQYSFRGLQLLLNASKTKCMLFNRSLPAPASPTSITTLDGSDLEYVDIYKYLGVCLDCKLSFQTHIKHLQLKIKSRVGLILNKTSFTHAAKLTLVKLTILPILDFGDVIYKIASNTLLSKLDAVYHSAIRFVTK

SEQ ID NO: 994033 - protein, 62 aa, Homo sapiens
RPPTTTKFAAASTDTILYTFGPSLDTGYLTSKLSFNAIQHSFRGLQLLLNASKTKCMLFNCR

SEQ ID NO: 994034 - protein, 46 aa, Homo sapiens
FRPGERGERERKECPTPLNTDKSNMTLTGSNDTGASWQSVVAVDAA

SEQ ID NO: 994035 - protein, 91 aa, Homo sapiens
MEVLLFHSSHSHLQYDDEQQNTFKDDVRIFPESGQAICRCEVVRGLLSISFIAIISKRIFNASSNDMKLKPELFLTQQSLSGHLPKYEQVR

SEQ ID NO: 994036 - protein, 145 aa, Homo sapiens
CQSGEPGLDGTCPQLVTQSLSQDSPSTKQRQSREKRRMAGSKGLAGFVCFLVCVIFHTGLFFTSLGFSKSPFSCSFSTISSGVPGVVTFVYSIRGAKGTDMQKVCSKKHFLTSPKRAFFPKCPKRVPLSSCELPEREGQRAEEFG

SEQ ID NO: 994037 - protein, 81 aa, Homo sapiens
VDLESWKLDYPTLLLQMDLEELLEVLAGERSYSYTLDRRPVLLYRGWSSSSTERAASGGTHMELVREEGDTRLASHISRIN

SEQ ID NO: 994038 - protein, 68 aa, Homo sapiens
KLLTMYGDMHKREVLVCWLRPLFLLPRLQEEKRKGLQEGMFRSGGKAAPKHSEVNDELGNHLNKHILD

SEQ ID NO: 994039 - protein, 52 aa, Homo sapiens
FKLLTMYGDMAAIRRASAILRSQEPVMVKRKRDPPPRAPEPCPQSNKVSWLS

SEQ ID NO: 994040 - protein, 58 aa, Homo sapiens
QASTMYGDMVKAVVLEKATGDEDRLKYELTLMEYELTRSTESLKVQTSKSVANKKCYL

SEQ ID NO: 994041 - protein, 42 aa, Homo sapiens
QASNDVRGHDIQLSLPSSPEPEDGDKVYKNEDLLNEINSLKA

SEQ ID NO: 994042 - protein, 42 aa, Homo sapiens
PPPPPPPVIPPTENEHDEHDEKHQKQLERAQLENEKKKREIA

SEQ ID NO: 994043 - protein, 180 aa, Homo sapiens
VAHTRWTNYAYPPWHQPSSVHIPPEKKKDVESNCRAHGIGLIVFADPLLSASYDILLAPTRKSPHPADVEDYLEKRLKAADLAALKSRIHELELSILMKIIVVFNMRGGIGKTTLAVTLAEGLAQYGGSKVLLADADPQRSASHRLCLLTTVNECGQPGSGRNISKYLSDAIVRNSLPDP

SEQ ID NO: 994044 - protein, 42 aa, Homo sapiens
FKLLTMYGDMYIGPDAFSTPPLDPVATLFHVFKVRQKPPQAK

SEQ ID NO: 994045 - protein, 38 aa, Homo sapiens
QASNDVRGHGETSESKVGQVDQTLIPAGKLVESRKKKK

SEQ ID NO: 994046 - protein, 33 aa, Homo sapiens
FKLLTMYGDMIILEKEEKSFFFADENKGVFGQK

SEQ ID NO: 994047 - protein, 39 aa, Homo sapiens
ARIQASNDVRGHDVLSFLTFQLTEPGKKPPTPDKEISEK

SEQ ID NO: 994048 - protein, 38 aa, Homo sapiens
MYGGHGPTNAQESNFVYHSSPTLRCENRINFTQKTEKK

SEQ ID NO: 994049 - protein, 34 aa, Homo sapiens
FKLLTMYGDMPYHKYLFYLSTPHRLGPSNKAVLY

SEQ ID NO: 994050 - protein, 41 aa, Homo sapiens
EFKLLTMYGDMRWFQQKDDGDHPFLNKFPFSIQKSNKKFSV

SEQ ID NO: 994051 - protein, 33 aa, Homo sapiens
LEFKLLNDSTGDMGLKQRVIVIENWSQKTIDQV

SEQ ID NO: 994052 - protein, 41 aa, Homo sapiens
ALNSKLSNDSTGTMTVTPLYTCSSDSTRPHNVSGVSRYFGK

SEQ ID NO: 994053 - protein, 48 aa, Homo sapiens
KLLTMYGDMRKEMLLPPKVQESENRTVLVSQRQGGSPNALSIKNIEPG

SEQ ID NO: 994054 - protein, 290 aa, Homo sapiens
MPNSEHFGLPVLSNLADLIWLRNGAPEIASASCQCYHWDCCGGAPNSWGTSNARSLRGGLPAAGSQLLPRGGGGRGGMNKQMRVAVYPYIIQHIDVLMPPDCVARPCCGADRSYCEVSSLCDCARSLLLDVLLPVLYDLTLKDTEHHESLSLKQRECSTAIAHKDLPVVLPTETRQLNGLGPKEPGRLSDGEPGHGQAGPRGAESSVSQRIWPLSIMTERAGIPSVPPARSACSGEPETAGSNLTHRTRRYREEDRNGTETHTNSTNEQPLRFNPCSATHHNGPANTPGT

SEQ ID NO: 994055 - protein, 58 aa, Homo sapiens
MENFKVAARSSPLVYTKRAKEYKRLLNYRYNTKREYFRATRMKYVPRHKYMVRDARCQ

SEQ ID NO: 994056 - protein, 464 aa, Homo sapiens
MCDPGSLQPNVRLTGVAARVWRTGFSEISRGRLAQKADALMRFQRRAEVSCLLRTGVVTSPDLVHGGECKAKLSIRYDESDEHCVCDLEFSSEHKKDLCSALMCRLDWTRLGSTVTLVARDFARNDREFDRQFGLSGGDGQGVAWDVTYQLSAGDRDTQIHFHKGAEKSMALEDQINVPNGAEEGSVNSHRRAERGGSGGEESNWVLDFIGSCWDGLRRGPIGVGPLQEGTGLVTVNVKVSRTRLQWEGVWLRETPLSRAHGGQLDVEGSLTCGGSPFDVSSRLWAFGPWFNTAERTRDGRTIPFGRGSDGLPFPSSFDQEGRTFAAKRAGTTQQQWCHFEPIPGYVGVTPRGVRAQPTARRVNFWEQQARRRMEGAPKRNRGGGGEGATGPQGGDHPSTYREERTRNFLRTTTREIDGRQQIRRLVRKTNKRRPGSERRESDTARHTVTHTRQAGEPQVSDAK

SEQ ID NO: 994057 - protein, 242 aa, Homo sapiens
MHRTKAPDAAQVPPPWEGKPIFKIRQAPFPSCPKGGPTLAPVGRQEVKGIKRLKKRATEVWFPSLLFFFQKKTREVDHMTRSHKHNRTIHSKRTSTKEDKQKHPGEGKRYSHQKRDGDEGADAAEHNKTGAMRDQSTQHTKRGHTTTQGACPEQQNTGRWVVHSRRGTAPSGENVISGGGNNQRARRGDNHKRSCQQAGLDPPPVTCRGAKGTDQNRTHTMDPATNDQAPRGHNSTPRGITH

SEQ ID NO: 994058 - protein, 206 aa, Homo sapiens
MVNNEGVCVESAVTIVEHHHPWVVVGIVGYVEDASYDSGGFCDCSLVHAQSVMNAMSACALIIGVNLRPKVYYQSYWDNIALDDRSVAAIEVKEDFGDSVDKVRCQSLVLVVIGLGNQMLHCFPLRQKEEALADREIQSEGEGLGAEKLDLGPRQTLDQRGILWKHRVLGSDEDDLRLLGVSMAKLQRCDQVLGNKEVRAEPRRLR

SEQ ID NO: 994059 - protein, 149 aa, Homo sapiens
METGLAAHVCVAFRESKPRVTQVMSITMLWWRLDVRPDMSYLLAVIAKRQCTSNTYGSVTRGTSARHTSGRRLLKTVGPTPAASASWRGTCTGDVVVPFSRRSVPWRILIYGNDLCVKGSDAMMEKRDPLCTYDPSQLTVARSVKTLLG

SEQ ID NO: 994060 - protein, 85 aa, Homo sapiens
RERSPDRPIARRRRCIPASSRSYIPLPIAADHQCPKRKAEGDAKGDRERKVKDEPQRMIRVGLSVINPCLRPNARRPTPKKAACT

SEQ ID NO: 994061 - protein, 122 aa, Homo sapiens
MLKGVRQSTNRQKEASGTSTPRFRRPEDTATPETSRKLSLVMERVPGETELDHVCYSFIVIRLIQLMSAIEEDTKDKQRQLVVLVGVLTRLSEAPGLIAGLSKQGCDDDVMLAEGQTTLIRA

SEQ ID NO: 994062 - protein, 104 aa, Homo sapiens
SERGSESGHERRLLAQIQVSVRLVVGADSMPKNGPRCGPEAGACNGRRVAHTSLPDGRWCALRTKRSKKTSMGVRRASGQQGMSAGPRRPGTGKASQELRKAKG

SEQ ID NO: 994063 - protein, 396 aa, Homo sapiens
MTCLPEDASVGSRNELQAIQRDKHANRGTCMLADIVLIMTFFYLRGCFITVYGGYLCSVRVYQYFQWQQDQRQAVEREAWKIAQEVMYEREEGFVRPVGTRVPNWHCLLEEDFRHVHAFSQAQTGLEPLMSYCKTLFGKKACSNGYLWFYARFDKSYGGLLNRNSQCRGVRVHRTSTVRINFARGPEKNTENNRRHNLNRPKRRKGGKKKAEKTQAAREDTKTSGVNCGPHSIEAKTAGPQANRGDPIGGGHHEEIAQEAQKKHQANKLSSDNTETRHRQHNDKAELNRSRASEPGPDEITAVAKQHNPAIPTPKDQRARETTRSAPPRATQTRTTPGAPARETQQRTRDPHRGEGTRDTKYPPDTAKRYARQKADNRERDTSNTPPRVRRQKVEQ

SEQ ID NO: 994064 - protein, 96 aa, Homo sapiens
MRVSLCIAQVSDEWISGLILASLQKTPTPGFKAILLAQTSRVAGDPQVGVHQSQLSIVITRSRWGLDHFAQAGLETPDYQITSICLRLSKVLALHG

SEQ ID NO: 994065 - protein, 369 aa, Homo sapiens
MERRAYKRGCNGLLPIGAPGPSSNVQGSNSEVSKSQWKVAGGVGWTVAWRIHGAFGSSSTTRVVAAAVGPSAVGARCVLLQCAPTGLRSSSGARNDAGWDIFLTWCLSRQALLSTLRCGLSGPPGPRKVFITRCGPSHIIQGGLGMLDRWKPPADWMAYNQVCFLFGLPHLGTSLKRLGQCSTQFSSGGRLFPECFKLVPEERDLQNTGGLGHPSPWDRTGNAKSRSRKTTLLGSTSGERNSTEPSPTRGDIRHKEALRTPPLWKKGNSSPRTGPGPLCLRPANRGYNYILFSHPRDGAATDTEYGYTCGHSENYSERHQKGETQNVMSRQPHLNKAVAQGQSTIRKTQRDTVKLVRPNDYLGADTTTN

SEQ ID NO: 994066 - protein, 153 aa, Homo sapiens
MKEESAPPQRREERNAHNNEERNRVGRGSPTRAERLGSKTNTTRNMTEQQHPTEQPTKQEKRTTYSSSASPKQACKTTIMYRSTRREAEAQQHNTMRAGGRQNIRRGGETTRVMSTTNRIMGRSNSQQQDTHRTTFHGRSTYQEVREKHPGAD

SEQ ID NO: 994067 - protein, 86 aa, Homo sapiens
QGVLVVRPKPSRVPMGSASRTKTSSCKWRRTTVREGSYEASCPIVNVNHLVPETTTLTGVPSRWGIMSCESKGGIPHMEVVDCERE

SEQ ID NO: 994068 - protein, 226 aa, Homo sapiens
MKLGNNPLVKRFLQERRIGTGFCLRRIWSAILFQTRTLVMSGIFYINDLQATVVTISTHRITYLSTGACVGVLIEEVRDDSGNTFLKVQKCLYTSRDIRAARGLISYQCREQSRYRRVTRFYVPISHGDDAMILYYHSVCFRLTCDNILSGELQKEQSKQAEHEECIKSREQEQSSSSVTGRDETNVKMRESEGACRVTLREGRRNMTGMKIDHASTGVARPAEPA

SEQ ID NO: 994069 - protein, 216 aa, Homo sapiens
MTFSARQDSNISSLPHATSGSSERSVQACQNTCVPVGSTKRPPSVLCPAHGWRLRPQESSRWFLGCGPSVQEGQAMWGSGGGTWPNTENYAGGVGWKWLQVSQIEDQMEHHATNCEQNDLAILPGSRSEGEPVEHREKTGHRSGMSWTHHGPPMLEQQGERNPAGVQEGLGESMYCKASHTSAPCKGSDDPFAGSGAVTTSSRQSVRAAFGEMCSC

SEQ ID NO: 994070 - protein, 53 aa, Homo sapiens
MPAVRSPVAGQYDAAPPKKYRMLRRLKEALALSRNLQGKIWPREPLGTGYSAT

SEQ ID NO: 994071 - protein, 125 aa, Homo sapiens
GRGVVGVSCFNSALDRNPGRSYPHPGPVAHSQPSVTSSLAPSDCPLGPAPAASMRPRSPTGLPPAQPSLLGRRSSGSRRVSRSRGLAAGTSLEPGLREGPRQSKHGTKDPTRESLCTPSVLVLPS

SEQ ID NO: 994072 - protein, 344 aa, Homo sapiens
LLVELPHITLLTQHGPHGPFMVMLAFSLELLHTGSGCSPSCLHPAWLSEPFASRPRNRTACLLGQAQMQTSIGKNYSPVVLPLYPIVYSDPRRTRRERLSHAHVRGEGCCVVTQGPNGGYRGLAADPTARRRIGLWGNAHWMVLVQLVKNAERSSVPRCDNPLRQQFTGHTMQRGGDNMVELPMNGRNTVGLARIIKPSGGNESKFSLLFRSWFNVCLHNEKTWVSSCVLMPAQWDFGAWGYFAANVPLCSHFFPTPGCTPLRFLGRPLCSCIAWCKWGHQRRTALLEDWFLSYKGEAGGAPEGLGTAGLVGLCPDVLNPPGSFGGCHDDGGCPLVGPMIRGPV

SEQ ID NO: 994073 - protein, 217 aa, Homo sapiens
MCSQSNLLTSCKTWQKLIIKPRCQDQHLSGEPKCFLAGYWSPTDWMHRSCCSSGRAESDGVKPLTFHIVAVIMIKNSSFCAMWEHCASHAKKKGKFAQCGFLDVVGIAGSAESTWRMRWCHYPREHPMRKGLCLLSNFLRRVLHRCSETQTMRCLLNKDVTRGISLNRVAPPDFQGTPLLWGTGFDVVKCPGLLLSSYLNIAARLGMVAAPPPLRLA

SEQ ID NO: 994074 - protein, 78 aa, Homo sapiens
VTTTPREPLWVKEKGLISHIVDIVTHTFGASAPLLGHRIYKCDGIDKRTMDKFENEAARYGKRASLSDVMHCSRLDKA

SEQ ID NO: 994075 - protein, 459 aa, Homo sapiens
WRCPGGARRAPGSAGERTRLREVSFTSRLNSPISVCRCVLTVIIPDHNIASVELCGARHPRPMKRGTRDTQRTEPGCPRTAWFSVRTCNNIGAVVTRVELANRVSLANCALISALTPRTFSRPRDDEPLVCRSNYVRYGSSPWCHCAGPHGGPRRLAFSVSGYYRIRGQEIASMGTTTRPWSPLPSSCRTEHGTKEQPTRVVNRQFGCRGTTSDDRSHSHSPNDVCLRNPVKRWVTDKYLAPITCALSLNGPFSKWTSDGHYPPFVRTQGRRQAAPARHTATQGCTHLVPPEDYSCICTRTGHTSAGHSWIGRTPGTGRHIELHVPGPPVSPSRHTSYPLEDMPDGRPSQDANHGGKYQTYNSDAVQRNISGQVTGDHHVVGPRPRPDGNGVHPKFTLWTPRNRGSHSGDTVFPGGTDGETPGRDEHKVALTTIPRRDSETTRVSDDRAKSVSSHTEHH

SEQ ID NO: 994076 - protein, 259 aa, Homo sapiens
DYVPLLLRSQYDVHIAQSTMGKVTVRSLPDLARIGCLDQQDKLLSTGEVDIVDINDPFIDLNIWYHVQYAFHAIGKITMVTRTRGMQNGQAVVIDSEIPSPSYRGARSLSKSSGAMLALSTSWSPHGVFTHHGIRLGLICRGEAKRVIISAPSADAPTVRHGCDTMTKYDNRPQDHHAIGSVHDQLLRPLARSSMTTLVSVGRTHDHSPCHHLQPEDCGLAPPGETCGLMAGGLSQKHYSLPLHGGLAKAVWPKGIPEA

SEQ ID NO: 994077 - protein, 154 aa, Homo sapiens
MRVLSVCGACVWLCGESSFFHLHAGRLTSSSLSGHHRCTAVIDVHGWSLASDAGVRDSSDGLVRSFRYGCTFWDTRGWPTHCSREAQEKGSTKARNHAEIPCVPANRAVAPLEEICSWACRSRRLLALDGGWSTTGAAHCVARRLCLVYITFYS

SEQ ID NO: 994078 - protein, 383 aa, Homo sapiens
AAALRPPIHHWTILSTEMVDDCSALPPLQADFVGRDPGVWWSGMTRQGWLDIALQDRSIPCPPGHEDLGLLLTIFRACISTHVQLKAAEGMDIPGTLEDPSESHCYVACICTWTYSSKVMRYWEPIPKGPVLWEARAEPWASWVPLLCFVLHVISWLLIFSILLVFDYAELMGLKQVYYHVLGLGEPLALKSPRALRLFSHCATSVCGAADSAVVVVTNLGTDVSTWFPPYTFNWAWVTGLIRRTSELRGQVQRKLHLGLHGPTDGRRGEEHTLVNRPDIASPEKQKRKTRPGSKPQRHTSRVEGERPSKQGAEFYQEKTHTVHRVYQRNRQRPHRRGSGEVSPVKRTHRERESPRTIAEARDAKRGPTSSAPPSELTLVIYR

SEQ ID NO: 994079 - protein, 271 aa, Homo sapiens
MSLSEQPIVCHGIQVSPSFRDDVMTPHIESCASSNDIRQNCFPCSRRCQTLHEPIPDYMPRVGCTRFITGISILVVGSVILLIVLHDLEAAGPGSEHTTVMTPNTPMALPVADLNPPNGEAQEGWIIYSGGTPLTWTLVLKNWPRFCSTDRRHRKGVLRTWWHKRATPRGASITSGGRKDGQGRRDNTTETEENDQQERANIKRGHPDGTPPTTLIPQQGETATDKNTYCIKRKRRTTINTQTWKQNTEELTTEITSNADDGRERRELRRD

SEQ ID NO: 994080 - protein, 276 aa, Homo sapiens
MSGVTSVDLRYTMSGFGGPSPWGNQWMETPSRDPSVTQLTKAPAGWPESECNRLSQSTKCKRRRMLRVVMRTLACGPSSDLEAGISKGIHDEKPNRRRCPPRCDGCSVSPQDTGHASGRDERRENWKQGKSVSDWKRRGAVRLTESELYDANLGMVRHETKPGSLSGTSMGVPVYKALSFRSHGCPPIEIPVEPIQRIVSMNGSTNLWDVTFSDLCFLNLVNGLGVVSRAHHVSNGKLVILSFCMAVETDLHSVWLAFGWYRTPSYKRALRSHKIF

SEQ ID NO: 994081 - protein, 106 aa, Homo sapiens
GYLRKDGAEAVGVQLVERTYACSGAWAEETGCKRSIRDLRWLKRAPPGADWSVIRVEGVGGAQVEIGNRPEAANHLAVRGSCEFFTVFHAQGCTTPRSSVVLVGES

SEQ ID NO: 994082 - protein, 195 aa, Homo sapiens
ARHVLGGPSALLAVTYERSNVASACNSLYLASGEEYATDVAHANQSSDKYVVRLSTDVVQGDATEQCKTCGNRLHVTASSCLPYSQVIVDENRILLLIIGMACPRIAGTSMRSDDVREAIDRFATSNAPIEQRPCVCVAVALALIGFKSALDDRWTGAKASSRVRSNDTWGSSFTLSESEVVAKFLHKDTTLDLI

SEQ ID NO: 994083 - protein, 119 aa, Homo sapiens
MIEKILSGGAAGGKMPTFSAGQATRTESVARRRHSLVAARVMTCHHYHNSRVQVVQTPGGSSTRSMALPRREARDEWGGHPWLRRRNLCQFATRTTGRPRPKGRWRMETGFSALACLKR

SEQ ID NO: 994084 - protein, 70 aa, Homo sapiens
ARLSAPPLWSFILNGLAGCRRRQQQLGARVGSGFLLQGVVLIGLLYDVGAVTVTTSQPKSVASVRAVGDY

SEQ ID NO: 994085 - protein, 245 aa, Homo sapiens
PVYSVQHGHAIHHGGAYPGGAPPHPKVVTCADTAGPSSPVSFAPCHCGHLSASLLALRCVASLPSLSSVVLFCSIITRPFHRSSSSSLCVLVHAGCSARVCAHPLLKSYSDSGRLPISSGSTSFSRIQGSQSHTAHVMRADDSASSVTICTVARLERPVGQSQAIQPHILESPVTMVEMGRLPWCGRVSRVGVCEIGLGDVLGSHSCSHGTQKCAACCLGYLSPQSVPTSWRPGLSYNPGPASLL

SEQ ID NO: 994086 - protein, 569 aa, Homo sapiens
ACVSCFHDEAEHLLPSHLRCQNTHCKWTDERKLRTLYEKRMATASLLLHALACNAHGNGLTLLRPAHSRWLAKRTHTTGLSPTATTRAAPLDPKRLCSRPALTDDYTRRITWPPTAPQSAAHMAPNRNTTTHLPRHRRASATSPGTRQHSLTPDPVNTLRPPTRQPPQRTTDSGKYFPHSRPIGPIDITSHNARPLRPRPLGGPTQTQRRLTASEHFPRQKNTSSTNTVRSVVQQTQPAPSTWRHPAGKDSFGQDKTGNTSPAYKKAKHNEHLRLKANDPTKRGRPKTSPTPPDGTFTTGPEPFRLQHIPQPGLDLPSARVATTKTPRPAPSNHERAYLARTTTQHRPINPRSRDTPNTHATAHATPPLAPARPTSARKPASHSGSQPALRHTWHTRHGHHHRATHTSPPPTDHPTNSRPPHRQATRHATDHRPPHSLAGPTLAYYPLITRSSEASSRHSARTDSSTQLPEESYDNTQTTTRHPRHAPEQDRHRSTDSKNRTPTGGTTKQRGASARARPDTEKTRRRQGKQAGSRHTTRRVARAKREETGQSAPHATARTHTPPEPQPI

SEQ ID NO: 994087 - protein, 267 aa, Homo sapiens
QEPARGHQGCSLQCWAAGRHATQPAPTSTCTCTLAAARRASLARLAAWPLLLTRRPADRSNPGPDALTSAPPAPLPASRSTPRAACPLAASAGHLPPHGSLTAQRCPQPLALFTRPTNHATGSSPHALPATAPPLHTAFTRPLLTPAWRAARTTSPATPAPFIDLAAWPCARARLPHAPPHAPQIPSPLPSPQSKPCVHETRTLAAASAWPAAPAPVLRHRPHTQHAAREPGALLHAETRPLRTFIGGLATPPNAKTQARSHRAWAP

SEQ ID NO: 994088 - protein, 38 aa, Homo sapiens
AEQAVKHPRLLSFTSQLKAGKGLTIVGSVLEGTYLDKH

SEQ ID NO: 994089 - protein, 278 aa, Homo sapiens
MLLTRQSPCGECFSYHAGHDSVCPYLGPRSDWRSFISGPETVGIPGWMCARVTAVETTYHRCCAVRQRTTLLRITTSLRVTISVNVTRSYSLTHAACLRLNLAAVSLRARSYQSLGIGHSQASLGRWVPPVTLDTETSIRLSCSLVITSPLRAYRRRTVFRADNYIVIVTPGGGATVNDHEYEATMMGKNYGSVKPPTLRLRAMRGNSPAYTPSSLGNATFADQGAPYTTRSFSSPVLGYPLTKDRSWVLAPCRQSLGTCVGAISKLFSNFHLGKLEV

SEQ ID NO: 994090 - protein, 112 aa, Homo sapiens
FLSFHREMGGACGCSPGLPAALGSASEARVGTYSTIGACELVSAGRRGRRHLPVTVPALGGHRKPQDFVILVSRAGRLVTRVVEPLCQSRVEVGHAAQDHRETPEYRGGETL

SEQ ID NO: 994091 - protein, 76 aa, Homo sapiens
PRGKNGTLLIKHTADNRMHLPQRNANGLDTTGASVCHLQKQQRFYNKYLRSNELDDKYDNMQQEGWLRRTAATHKN

SEQ ID NO: 994092 - protein, 303 aa, Homo sapiens
MAPSRNGMVLKPHFHNGLACCAACALWFNLCLALEDPADVMALAMPMAAPDSAPRPRCRVPSCAHRSAAPRFGYHTKVRAGRGFSLEVSSGWPAFTRMVARTIGISVDPEECGTMSTGVPAGQRAAGLKEYRSKLILFPQEALGPQEREHRLLLMKLKLGHQLTGRVMPRPGTSIRQDHSSKSSLEARARLSQAFRLVVRNGPRCTTRQGIYGTYRGKNAAQRNSTQNNRESETTNKNTTVSPYPTHIPICVATKRIIGVYPRVICGYKTSGATIYQGDRGQSIQTYCRPRLEPVVLKRKSNA

SEQ ID NO: 994093 - protein, 508 aa, Homo sapiens
WKKSWRPGGGLETSLGGFDSFHFWSRISCTSGFLSKCVRRVEKRAICAVKCNRAELSEGPAGPVGWVLDALVEQGRGRRTWSQCNRCLRYKLFLVACLRGRVLIKRCETHITLLRIYYRMLFSYCGTFFIKMLSICGCWERGSQRKPRHRTGERVGAVPSNSIFVAKGGGRKDISIADYIPPRFISWVHKGGPLSIRGTSVFTKRPLRTSGAPALFSIPKLARDASGIHTRAHTVWTNICVTNGRPPYPTPVVQAAHLLGRTHTLPDHEHLYKTGRPHRRTLSPPPSPRRADKHGVFTPTTTARPSLQCKSYGTTAFGNPPGHIRHLVNYATDISLPPPGPPWRTKTPQQRDTRDTPIHSDTIVANPYALHRNDTRDKLPIQRDIAFTTEQLEYKAFSVLTENIDSKYQKQYRQGDIKIKWGSTQRDTRKASGTNRQEARLSNTDRTLQQCTMQGAKANSKTDRHERYQMSTEAAARRLDRSNGMTTQTSSIRESNEVKDWVTQGDTR

SEQ ID NO: 994094 - protein, 143 aa, Homo sapiens
MSRDLNICTLNMLHTSLLLTGITSMYNHIDYLNCTLSLNYLTETLTYCSLTTGFPRNSPSTLLGLLPPHEDSGRENLTLHTESTTLALLEPLRASRALHPVSTSIHNKLISRSAVLYTDRTVLQNTYQSSHSRRHPGRSAGLS

SEQ ID NO: 994095 - protein, 187 aa, Homo sapiens
MDTDFYLTSPSFILISWNESRMPPRHWPRSPRRDAHNKRRKAPLTHGRQQLPHVTGPSPGSWPGPEVKGLTPGLQASGAPAPYTAAALQRTTKRSGSFTLPLSQRASKPTVCHRTCTLALPALLVKQHGPVRPLTLHRSPRPAGGSSAHPWQAPAGFPFPGLCLPQFSLSFPTSPLGCRPGSRPRQA

SEQ ID NO: 994096 - protein, 328 aa, Homo sapiens
MLTLYKKPQKENRTKEREKRTEEKEQHKKHTKNKETRGGEAAREREKDSPGKGEGPHSSMQGGTHPSESFVEHNTEGGAHQNKKDRTCINKTRDKETRRRHPTYKQPRPRTQTTEAKTTGIHNRGKNLLEKKNTPPTHEGGEPATTHMRRGNTTTHPTQEDKHTTPHSRGRPTSKHMHKQGTHGRPTHPARHNITPPHAKETCATKEKIIITAHIPGGTAHKLKTRERTTAPTTHSREPTTAAKTDRGSTSQTTATSRAAQARKHNTKNSYPQRPAATTEEDHTRADQTDRQKTRRQKTEERENTQTDTKAGQQKIKQLKKQRSANIQ

SEQ ID NO: 994097 - protein, 224 aa, Homo sapiens
TEGDRMPTVTAAPSVHTQRCSSPLSHPLPNPTVKDTETKVPLQMALPSSCKSSAHTQLAAHSVSFFQKHSSSAGLQKAWQGPLARASWLNAPSVLWPKLTSLTLSRKPHKNRWTDTLELSSQNCRSNQMPLWTRRCRVQPPLPKVMILTREPLAFLLTVLCKKSKHSRMPLSWGSPAGACELLIRAGQSWAPAHFVQLTCQVAYTCVLKYICIPKLVPSVYHSN

SEQ ID NO: 994098 - protein, 102 aa, Homo sapiens
MERLARALLVFPQKKSLFLRPLVAHRGGNGWRGNFVADVHTDDPICGERRWGPSFLELARPPVLAVEFIWGDRKEPLVEEFSTVPFLVAKGVRLNEGRPGGP

SEQ ID NO: 994099 - protein, 118 aa, Homo sapiens
MGSNNYSSHSFLSFVLRCGRHCTAFLHLSSGHLHRGVKPAFFFVHLLIGVRGILFRYTRGEFPQQVDAHYVLKFVGIYSCAPISSCGVSQILHDLKLRFKVFVVQLTHKFFSRCLYTR

SEQ ID NO: 994100 - protein, 188 aa, Homo sapiens
MRSLGWSSTRETCLSFLRSRAEQSWRRVLPVFSQVTVIGAFACHEVMGTSDVSTVTLCCVRVRTKEGNVNVLREAWTGREGSAGFNDWPQEKNWGRWCHLRPRKKLLPKIVFPKNITAKQVKAGIEGVGNQTGKTLAPHRDHQGLTIRCEAKDMVGVRGHNSSYIPVLHGATCKSNPRGVDNMRGKGL

SEQ ID NO: 994101 - protein, 423 aa, Homo sapiens
ATRQVLQRWSVLPCAYGSRIPDGIRKRSGPRTLAVLPRSRGSCYRSLYSLIVLSREDVVYVSTKMIVIRTVWKTVSQDVLGKRSTTRRRSVIEHQSRFDNTVYLDQLTSSEIVYRVKEHLRFVEERSKAQIRCTSTYHDLPSQETTFEESGVLLGRTLPTVGDSNEESTNKYMDTSRGITFPLALKDVTLCIIKPTSDESTEFRIAIGAANRTEGTYHTGLLKAIKAWAPPARLAKDCEIRHRYSLRGTYIPGNASQGQTARVGKVFLCLQSILQFHGCKLGEKNSKEPTSKGPVVYGLHRQGTLIGWRARQEAGGTRPNDAGTSFSPYPYTHCGEGGGGRGYTCGRLDRHFESKFRAHTTICGATQFEQNAFPHRVHQLGPLGVARRSKGNGPNANIPLLPFQRTMKENQHIHIMRGKTIKH

SEQ ID NO: 994102 - protein, 189 aa, Homo sapiens
ETEFGSGCPGWQWQWAQSWSSLATSGLTGSMWVLLAYSLLSTLGITGLRHHGPGNFGIFYVQKTETLAPLLAPGWVLEFLDLRWIHLAIGLPNVLGFNRCCRGTHTLWANLWLFIRVRRWGVFSQRGWGLWNLPDLQVDPATLLGLPQNVAGRFTGACRRHSVAPGLRWYLLEWIMENMGVKPALLKHL

SEQ ID NO: 994103 - protein, 217 aa, Homo sapiens
MASRASADSGTIEGEYVFMELSVKTVRMWNVHILNTCQNYIQWSREESDHLKHLNEIDLFQLYGIQMIPSIMEWTDQFYMVVNEIRRSLGQISVQRFKIDERVKVKWLSVDFHNWKDWEDDSDEDMSNLDRFSEMMKHMGGDADGRLYADSRWEQTDDSTRHGIADNNGRSRTQGPLGTHRARGENTQSRWRITTERMRTWIAKRDIVGIRPHKREC

SEQ ID NO: 994104 - protein, 294 aa, Homo sapiens
LLLLWNRGWAERLIEPLTNFCIHSDVLAVSLLYEVCEQTDSRLISLSSGPCPIHSRRAIRRLQCSEIKDIDRGLRSELEDDLGLLGDVQDPERSHPKSVQSHKDLILQCLEHEDECIRLRALEPALWDGVQRRTLMARMREEAVMIPRRQGYVGYHLPGRAVSMIIDICQSSAYTQYITNYEWYDQHPGGADRWRAQGRPTHRAPNSWTVAIRVKGIRKCAVSQMSARLTVHTWWPAAPKRKGSGKVSSWRLDAGGSSRSLWGNAPQLGGWGAQAQCKQTGGFGKGEAGQLREG

SEQ ID NO: 994105 - protein, 112 aa, Homo sapiens
LEVRIQQKYWGVDLPSGVWLPTTVLITVKADMKLRSSPVLTIKRRTEVPLMNLLVGDKRLPYEALDSTCVLTLLGVLGMRCGMSQKGDDANIARGVLECFSVGAIKIPCNWC

SEQ ID NO: 994106 - protein, 66 aa, Homo sapiens
YYRLSYSLTAVELLQPLYTDLYTCLITPALLPLCPLDDSMYLSTQLNDYTQPRGARFDLDGMAILP

SEQ ID NO: 994107 - protein, 569 aa, Homo sapiens
MCSWQLSGRGHSVTQARTDSPKIRVRLSQSYMGKGSLENSGCTRHGHDCCAGSLLSAYRYCGRGVGPETASLVTPKGGVMTPFGCQYNYQNGWRPNVPRWYTGWMALGDRTDTRGTGDSLEAAGDTDPPWERTYQTTCELEDERAYTRLVNSEEPPHGGASRGQGKPTEEIIAPRIIDRGIRYRALSPGGAQFIAQTSGVAKVCPPQARRDPPLGVHNQNTSGGIYTRIPPYMCVRKGPDCFKNKAVRSRVNPELSKRDVTFLDAQVFVNHTDSRFQTPNAIDDQGPQHVKFHTGFKTVKPSVRTALAQGHIFHKGHERTHFNQTQEIPQWFTTTKVTGIEPVGNRQDPGTHGKAREFRHWQRTGQHNMGPHSPGTGGHRKRTHGRALGHTVLWARTHIWNESDEHAEKCTLRNGNTKIDSKSTQRENRISHREALSVEQEHTAAHQCTTSKEEQQQNIDKTGPCHRGRKQRRPRRKRKIDRATLNTTAGQTQCKKNDTQNAVMDEGNKQPPQQWPHNETRTHTRHDTQTRHNRTNTGTTAKPHTTTKRDHATQHNETSNTRRRETITH

SEQ ID NO: 994108 - protein, 70 aa, Homo sapiens
MSPGSTPKHTGAIHPPSSHGEPVQPSSIDERTPRAHTNQRKTVNNHQSIRPYPVLTKRAHDSIESPMTPY

SEQ ID NO: 994109 - protein, 132 aa, Homo sapiens
MVLERRDISHGTSWARPTAAYLRISLEELTDISRRPSHDPTTGCEPPISELTPIHHIPTLLAHCAPPGPAAEGPPRCFGLPRGPHLPGTGPACATRKELARCNPPGAHARARFGMLCTPGAIWRPLGGSRQP

SEQ ID NO: 994110 - protein, 398 aa, Homo sapiens
LKFTNNQKILYFPTWQHISSKGIAAEQLQCSKNSQKYSIRHFLGFITVILDFTPQEVITEQHTNTNKNKKKTKTKKKKGAGAPTKRAPPRAGPHTHRTHDPPDDLRRPKTEGAPYHGGAAPLTIQPTSEQRATRQVNDNTAKTTVADTHLVVQRPRNPLTKQQTNNINLHARRPQTDPPHHPPPTKNDTNTHTYQRPTNTHKNKQKHATPITGVVHQNTRSRRTTEPTTHLHGNNAVPSHSRRDTLPSTIHTTNTCNKHHQGQINHPTSKHNPHNESWTDHKITPGRRLPRDVRRPSDTNASNKGTAESTTPHHQDAERDGNTSRAQTAARPRQNGRVTIASETGSEHALVTESPSTSGEREYVAVLMPSQEQVKNSMRRKRKNGKSRRQIRTHTTES

SEQ ID NO: 994111 - protein, 80 aa, Homo sapiens
MHNCPAISPKLARERQHVVTPPVRSSARSLRLLAHAHAGRRFLPEAAHVLPCHTLASLLALLTRLSTTSSIPYRTPTPFP

SEQ ID NO: 994112 - protein, 147 aa, Homo sapiens
MTDQWSRVTSTINAKRARSRSQCTLSHANNLRFPNAFLEVYFTFPVNPRSLPFAPHSVRHFSRQTVTQYVLRMHPNTATTRTASNFWDLHTTQKDKPGNKSKRTHHDAEGVALTRHTHTDYPRNAGRRTSPHHPSRHAHPTNKRYRA

SEQ ID NO: 994113 - protein, 104 aa, Homo sapiens
MAGPPPSNLTPRANDTRNSQGTPPPQLKRATEARYHHQTAATKELRRRDTLPHKRLRQHVQPRDPYKIVSTTMRDTAEHDSTRICLRDTTNRQQHSPTTKSNNA

SEQ ID NO: 994114 - protein, 184 aa, Homo sapiens
MRHAIANRRKDASYFGPGDGFGPTRRKRRIRTIFIPGALDVGGRGDVPPARSAPKRDYTLATGHAQNEGPRLTTSSVQSVTYHREHDIATQEKYQPRTAGATTPRLGANTTGAWHSGRTPHPQEPCRQRLNTPLQRGPLGSEDPPGLTAGHTTYIAHVGPSLAAYDGPRQPDNDNALPTTYPPL

SEQ ID NO: 994115 - protein, 158 aa, Homo sapiens
MLPIQHELAAILRRTTGIIFTSNILTTAGCLTKSPHLLIRLTTIKHVVEAFPNTRTYLRPPQGYVLHLNTPPVSSSTESRELLTHTTCGATQPQEARGGIKTEQSETADATRRAQLGSQLMDTYSTPDQHQSGERAHKHNPSEGAAKHILPPQPAYKR

SEQ ID NO: 994116 - protein, 256 aa, Homo sapiens
MGVEGPPPSAGSMGQGSRTEGCGVRTLLRFLPPRDQSTLAPPVPKAQRPCSRGPLHPNTGTYRDRWLSASQGHMSNRVAGGHPSCALLCCPGGETAPIAWGHPFLPTLGPGGSPTHWDSLTPKRPPRIAPAIVGTPRILTQHLFHLWRLGPNPSRRPSLGLLPRPFLFLGTLIIASNPRFGQPFTLMSLSPHCGHASQRPVSACYTHAHWLRNSTMTNRWLLNTLSLGGVPRVLNTPPLGPAYRRHYPASQPGLIG

SEQ ID NO: 994117 - protein, 185 aa, Homo sapiens
MPRQSTGKKVMQKETIQDQLVWLLKSSFDEEDERRLCYVLPVKRISSGNQRLPSFTFFSYKGKQLKETVQYLTHAPQKSTIQYGAAYQWFLTNFVNRTSEVTRYDNYCLCLGQREKIYVRFCVHKSTDMATNGPDEPIAGPMLSSRPLNSCARGLSDPGYRTPPHTKLPPLRNGFALTGDSKEAL

SEQ ID NO: 994118 - protein, 120 aa, Homo sapiens
MLLPSINVTPLPIASPQRALQPSRPVSIDSTPFLQELSGVNMTKDQALPYVGDPSQFTHSWSWGDAQPVSSTETTLLIQLAHFQDLTPSCQGEADPMTDYPLEPSRGRPTDGRTVIHVID

SEQ ID NO: 994119 - protein, 147 aa, Homo sapiens
LNGSNNLSIVVRYARVTGNAMLQSISTIGVDYKWIQESQWCSRTRSRSRSSYRDLDQTEAQPGSAPRIYGISTSLPCTHRPKKHNKASPLTKAPTPAQMISSSRVKVKIAHTHTKEQGFQTHKKNGAARIKIYTKKGTQGRHDAPTN

SEQ ID NO: 994120 - protein, 227 aa, Homo sapiens
MDHSTQNMPQHTAPPAQNAQDDAQNPPRPYNKRQHKLQNNHPEGNRTGNKDIAHTRELGRDQQKPRNSPTTGRQQPEHEDGKARTTEKAQRDQHQEAHLQHDAMHQKEGDEPLSMNAQGPPGEEQQERRHTRYDAQHKPNVGTNGGKKQASASAKGRYSRRREPTAKSHNGPKKATEPSQRQTKNEEEGHYSNNRETIEEDNTQEEPHRGSEKRDEQGTNAERKKQL

SEQ ID NO: 994121 - protein, 209 aa, Homo sapiens
MTSLYEPPQKKTTRGVLPLDTVLPGTTLEGTYTPVEPCKELSFCARKKGGQPRRVTADDSSPHGGPKENPFSPTKSANIMTPLCCSTSGGSSPRKPHIMLALCGRNHRLDTLGNNNSGGDTRDKQIKRTVWEQITPRGKQNSGLSHHERASSNNRSFPHHKRGGRPPKRKIHPHTRTRQQNRRNTLRHTHTLNDAHSSNTSSIGRTATT

SEQ ID NO: 994122 - protein, 216 aa, Homo sapiens
MADDAGAAWGARGPWWPWDGEPRLASAERVSGSGIRGRGPAVDGAGVEAGARVGKAEDKEWMPVTQVGRAWSEDMKYQCALEEIVSLLPAQLRNQRSLISSWGPLSGMRFGSIDASADSRPVPASAPGARHCAIGDYKWPRRSGVLSAPGRWQPDIRGAIILGRSLHRPPCHEATVGEQDREAAHCPIANVTGDAALCWYASSLDQVQCIVIGNCA

SEQ ID NO: 994123 - protein, 148 aa, Homo sapiens
LEVDREAEKKREGKQRAKEAQERELRKREKAEEKERRRKEYDALKAAKREQEKKPTEGSKSGPENLILAPVPASHTRKQTRSWAVLKLLLLLLIYGVAGGLVALSGDRAAAGRTLCTGVKHIYDNAVTGSLRTHEILQWGPPDANSQK

SEQ ID NO: 994124 - protein, 411 aa, Homo sapiens
MQAKPHHTNTEQTTHRADSATYEDQTHNTHQHTATTRSTRTEAKKQLATGTQTGNTTYSRQTTRDKEPTEGKQSRKENNTGQQTRATGQTEREREGSTKVENKQNEDKDRGTRDRQDSEQSQEITTRRRETHAKNKNKDTNTDKKADSRRRRKHKAAKRTQGPQQQEKNTKEEQREHHTAKKETQTARKKITADKQAEGRKKTNREERHDEDEERREPRERETDSKRPRRRRKKRRRGKKREKTKRQPHKRSERGDQKRNTEADAKTSKHGRENTRSEDNTEEKQQQGDDEAEEEEREKEGGRHERETKRESENRTKKRSKEEDEKQEAERAKAENEKTKRTERTQNNKKERNREKTKRQKQRKRRKTREHEIGAAQEKNRRDKMERRRTRRQRDEEEATGREENKNTEKK

SEQ ID NO: 994125 - protein, 150 aa, Homo sapiens
MSVNRNRNERYLQTDVEVHVLGSSSKACLGRQYQGTFMSDALGEIRIRTSHARAYESDVTERVDEQSVLELSDVLESTPVVLYNLGEYMMEQKGAIKKLDGHHKLKVRGEVEKDPWNEKVRSGNKPGLIYHAYLLKLCGGGIGAVSSSTV

SEQ ID NO: 994126 - protein, 471 aa, Homo sapiens
RSRGLKSNLLRYISITMSMVMVGHLKPSLVIRKIRHQTRVESIRRTERESHEYKEYKRGGASMRKGKGKIKRKSVIHHTASDEEPHSENTTAKTQGNDKPANEQPRDQQTPPTTPTQPPPEAPDSSRNHAPPKTQQHKTHQRTRQTRNTANNTEHTNTPSPPQHTAGKHRVTPHPHHTPATHRRKPTTTTSRPDPNPRQPAHTSHRTHTTAEPSTQKPTPEHQHNHTAKNAHPNNTHNNTTRPPHRLSPPRDNTRQEPQHTHARANTPPPRHDKQNAQPKHNTAQGKHHTHPTKDTRERNTPRASPARREGPSDQETSQQRTTTAQRKDGKEKGTRRGGERKEAEAEPHKPTPRPAAPGTEKQTSPSRPPRPKERRSADAAGPGKRRTDEQGGERTNDTEKKERGDTRRRGPSSEEQTKPPKSGKAQGQRSGSGSTHRQQRAAKARSTTDTARRRHAHDKTRRPTPNTTQT

SEQ ID NO: 994127 - protein, 175 aa, Homo sapiens
MRNCETITTRAKSRGQNRSLAWRDYHLVTLGGATRGRGEFPSTTQQARVGRQPTFSLVTRTEDMSGDRTYQDAHEWPTFLQLQKQINARTKGPSGIVTPSRTVTLGEETHAEREATHFEDGGTYSASGGPSDPKPVVQSMNHNSVYPMRLGAQQQLHDSEQNHGDTETRLVLCAQ

SEQ ID NO: 994128 - protein, 208 aa, Homo sapiens
MALRNVDARHETGRDALNKLFGVKVLQRQVTLKTAFTWGPRRERERTPGLNDDSFLEFGKPAHKFARFSLLHVGQAKIAPGKGDAALTTVLARKGRNCTCRWTERGMGLACTPIDTWTRKGPTNPGGPQQEKTKVYLHAAIGKGKAHRRVHPMGIVCTCREHVGRRNQPGRGEVDGIDTFLWAPENRSLSTRLDVDATRKTCRMETLH

SEQ ID NO: 994129 - protein, 269 aa, Homo sapiens
MAGGTLYTYPEELEGLQEALIACSVQRGSGPGVLSVHTPTSILAKANRYSLELSSVRISCPDKVPAFEGDDGFCVLESERHCAYYVSNEELRGMYIQRQQPEVVQWVSFADSRYSAPSQYLGVPHLGLHAIIRNRPLENAKEEVRRILGLLDAYLKTRTCLGGRTSDIELTSLVVCTLLWLYKQVLEPSFRQAFPNTKRWFLTLHYPAPVTGLSWAKVKLCEKMAQFDAETVCETQLNRRQPGNEKVHRKKSKAKLRGRRGQRGALSER

SEQ ID NO: 994130 - protein, 79 aa, Homo sapiens
PRVAKTKKAGLQYYSDKTDFKPMKIKKDKEGHYIIVKGSMQQEELTILNIYAPNTRAPRFIKQVLRDLQRDLDFHTIIV

SEQ ID NO: 994131 - protein, 387 aa, Homo sapiens
RRAHCSLGRGSRVSQARTVRGAWRVRARSGARFGAGVPEGDMERRRRGGTMLDQLERSCCDVLGCRQVHGLRVVTLQAEYHAAQRVWLISRGDLLIVLSASSVDGHTGAVDFIGRHGSPGLALVVWAACGARIFNRWDSARGYAGDSVASNLQSRGGEYVLHVLVGSYGSTVRTFHQSSGSDARIIHCLAFICKQRIVALGSSVNATLYPSQHRYLQLVRVPGCGQPKLCGLPLRCLLFTSVRLLVLLECRSPGSGCLWRRQSLVLGPCIIPAEDSVQNPGTGGWCSNVESRVLIVKARTVIGGHHVSELIRGNYVTEEEDIIRRHKEKIKPKRRDGPQRAGQHSERRHLDITMTEDTKDGTKPGTRTPKEAKKEKQRRRKKKEPTT

SEQ ID NO: 994132 - protein, 119 aa, Homo sapiens
MRNIYSTNNRGGEKFLKHVVRETRRALCAKQQQEKQTHHTDDPTTTQHRQETTLQNEPDPHQNNTQQRGTRHTPTATSQLKAIAHKSGAHEQELRAGSPNTYSGPHHDKTAPQPKRGST

SEQ ID NO: 994133 - protein, 322 aa, Homo sapiens
YFQIAAPSADAPMFVMGVNHEKYDIRLKIISNASCATKCLAPLAKFIHDNFGIVEGLMAQFHAITATHKTVVGPSGKAVAVMAAGLSRTSSLALLARAKAVGKVIPDLNWSERLTGMAFRSLTHCTNRVNECDLTAVLEIDCRNMMILNEGGEIRRQYGPLIDGVLGHTLSIQVVRPSDFYLDDYRISVHPSMLRLALPIKDTLSILISWYDNYIWVQQQVGALYDQCSRVRAWEHQPAEHKRRERALTAGVLPIWFRHMISFAPFPGDPERGGREDRASTWAGQPKNHGMRGKNAAKKAGWKKGRTSGTKDIETTKPAGQK

SEQ ID NO: 994134 - protein, 344 aa, Homo sapiens
MFAIEGTDRNGRFLLPGRSMSYYIPRVVLLWTWKPRVIHSILNSHPMPKLYKPENIYLSERGGRMLETNGGHGIFPGRKDASEDIIDITRTRVRQMVADDVIVGRIRAVVHLQYAGGGDEAHAHLWFATYYRTGCHDDVIVPTRRAWLQDYISDVCPKPRNEMSDVVVSMTIRGLRSLYHFEECRRLNGDDSVGWSAWTINQVPVTRIARDSVCEDAEAILLLEIIGWCGTIMSPEDTTLSLAWYLNNDLWLNKSSGFHPMASLLQDWVNPLRTPSEGTVIATPGLKIQGGVAQKFVVPAESETKRMGAHQGGAPANCCTKECCPGDRGGYRQGRASEHDGKKG

SEQ ID NO: 994135 - protein, 229 aa, Homo sapiens
MNATDKNEKGGDNNNEKKTNERLVYTRTEQKTRGRANRKQNRQEKKQRRNEDNHQKRADKQGEKGEREQERAEKEEKKQQRNKERKTENNSTAPRKRKQKTRKREKGKEDKTKARQSEGEKSDRKGESKDKKRENEKKEKRRKKKQKDEREKTKRQERGTRENRSNIEKDKNHNNNTHNNRREKQTEETTRKAGRKEDHKSSSGEQGKEGENERTARKHVKDEQTNPHD

SEQ ID NO: 994136 - protein, 108 aa, Homo sapiens
MRDPIRILVREGRVDPGGYPPVSTFNVDTRWKWNAWTHYVTCMKPWTITQAGIFINTRRKVDWFTLRRCMLEISCVSAMHGDMGPKRNEDVIYEGVPVLALAEIFDYH

SEQ ID NO: 994137 - protein, 77 aa, Homo sapiens
TRCRENYPLKVQNGKGKDSYQRLSSLDTVLFGQVQPLLEHLIYYNAVDSDNREPYEKMRRRRLRDMGKGSFKYAWVW

SEQ ID NO: 994138 - protein, 427 aa, Homo sapiens
MAAEHTLNHLAKNLEIHKITLYRGANTWAHNTILPAWGVAITRTAVYTSLEICMTQLPIVGQDPNSRGSLSRNAVRKLKRDSQSGITGPRGHGGACPWPPGQSSTTEVCASIGHPISGNVQHEFALIRLRFREERIFNRNTGGERHTFKGGSPVIANQVRYSEHVSHKNLTAFHAVGLSVSTRGLRNPRNHGEGRGQVLHRNRRAVPGSNPPPDIDTRNYFTSFQHPYERQSIVAPNFPPIPRRENKRGYELTLPIGLAIPKLGLPEEGLGATTKRGVDVWKPTMRQDNTPPVGKGPKGGQWGTRGTPRTTGKPDNHVAQDHGNPGNASPKDPTFSDCMGGGAKGRTPFPCNALGLDKHWRHKAYAESRRCRFATKNQWSAVKRAHPLRARTGDTRDKQAEREHTEGHRNNNHNTAKTRRVQKTNRE

SEQ ID NO: 994139 - protein, 220 aa, Homo sapiens
RVAYIPDMMCARGGLLGVGGQMQELRRVRPGVMSEKDHMVTMHDVLDAQELYDNHKDAESPCGELVYPWVKAVDDLDKRLVMTDSAVNAICYGGPDYVFHGVLSHMRTAVEVNTRRLWWISTKGEAICMAIALMTTAVISTCDHGIVAKIKRVIMERDTYPRKVGFRSKRQVEEADDQAGLLDKHGKPTDSITCHLETRSMLNYSESAKRGGAEVVKARR

SEQ ID NO: 994140 - protein, 156 aa, Homo sapiens
EQVRTFSMRNMGRALGIKEPGPGPLQRGSRVTRGLRGIIEGLLPQESRIPRCPVTLRLPERMVAGFLHVDDIVSKFYRSAQCLFLKDSITKYLMKMTPTDLGEEGESMRGMRRERRLLLNERIRVRPWDSEPGRCWSLINYIRERAHERGWQGHGF

SEQ ID NO: 994141 - protein, 136 aa, Homo sapiens
MAHNGPYKGTPKARRSQREPPSHSCGVTPRPKGTCAPKFLWWPCGAQVSNIVCSESNLWWHMAMECAENWGTFSKRGAQRLGGEWWASAQGQSPLWRAYKTPRLGPQRLSRTRAPSTECEKQPPVSRPSQDIRDPL

SEQ ID NO: 994142 - protein, 115 aa, Homo sapiens
MSLPSSRAAVSLGPSGSLCALLALLLLLTPPGPLASAGPVSAVLTELRCTCLRVTLRVNPKTIGKLQVFPRPSAPRWKWEHIPEERDSKLLSGPRKPFLTESHPRKLLDSGNKKN

SEQ ID NO: 994143 - protein, 113 aa, Homo sapiens
MLKAPQCFWAPVVFPCGVQTFNTNLSLEGAVSHPSGRHSWGEKDPFVGDSPSLVGLGPKRLGGALLSPLGFLGHSFAPPLVVCPGALCGITLGICVLPTAPFLERVVRRFISP

SEQ ID NO: 994144 - protein, 318 aa, Homo sapiens
MGTLRNTKPNFVRCIIPNHEKKAGKLDPHLVLEQLRCNGVLEGIRICRQGFPTRFVSHESGTDYEILTRNSIPKGFHGREARRSVLMAQSPGARQQSWSRIGHSKSLPSAARECWPTWIGGSNHWKDHPKSLLRYKACLHRCLPVGTGPSLLPTPRPARQAYRPTDRSPKRESAPCLTEERLRTPCGHGRTDTYTHGSRPHGMQCDTRKRQAARIPPMKGRTTWRKRRRTRSCRGPNQRPREIGTPGSHHEHETHMPATDTDPGQPPKPEVPRDKRPGPPDPHTPRIPDDSTRRKARKREDAPKHNTENDSHRRPHTT

SEQ ID NO: 994145 - protein, 275 aa, Homo sapiens
EPWTRLTRLVLVNALYFSGQMEDSFPDSSIHRRLFHKSDGRTVSVPMMAQTNKFNYTEFTTPDGHYYEILELPYPTGYTPQRCSIAAPYEKEVPLSALTNILSAQLISHWKGNDDQAVPPPGLLAKFSLETEVDLRKPLENLGMTDMFRTEFQGLTSQSLSYQVVLSTSAQAAAENVKIEVNESGTVAPHSQTVIDLSRMGPEEIIMDRPFLFVVAGQTPTGTVLFHEATVMGTPEPGGKDGLASGDKDLGMPRDTNTHSGEQQFGGERPPCGGD

SEQ ID NO: 994146 - protein, 175 aa, Homo sapiens
FVRKDLEILCFLLSTVNLHDASATRSMLLHPYLHGSPWGILIREAGRSHNGMTTGQVHEQSGQYGTMHVALVGLMVPRIFTVAHLLLIRVFMRGGAYGGRGGGLALPGMSPGGSSAWTLRDVQSMKRKQRRDRNCPHVARERIQDKCRILYPLRTLEARSVWLAKDQNQIPVMGH

SEQ ID NO: 994147 - protein, 191 aa, Homo sapiens
GGGAPPKFFYYTNKKKTPRGGGAPPRACGGGGEPPGGGGAPSHARGGGGKTQREREGGVGGAPPDKNRRGESSARESEERKKHSAGGGRSSRAGRGGAPRVASCVPHKEVFLPVGSKTKRKEARRAINTTNIFFFRRPVGEGVILHPRGEPCGPTEREPAAGEEGGSAAGGSTKSLSHGGTGEKTPERSAE

SEQ ID NO: 994148 - protein, 143 aa, Homo sapiens
AHRLVPRHSNNVAWEEGYSRSGEVHDLIYPEHRSKPQRIIDLFASDVSKWASVGIDHMKCALNMRTGSQGEKRPATRYCREAVQYARTTKSVLYSGRYVPRRQYGEDKPRVRVRGVRTRKCSERMPVLHVLDVTKSSRMCAIR

SEQ ID NO: 994149 - protein, 346 aa, Homo sapiens
IPKKGFFFYPINGKCREPKKGAPGCGTMILWVYPSPHERKQGNGVVAPIHPLYVVSYLSELPLVSLLWCAALSYMVAAGTPTILSPRGKAVWCIRLETHSQSRAHMCPRQCPLFLRTTKTEYTRGAETGVNLRDGPENTVERHKLAGDIDTHVCGRARVYKPNVMAHMWNAGCVFKHTNVGNPLVTPQINRVQNTPRWLCVPQERSEICRRLQTSQRGTHSCAASPQKSPCREPTAGERQPPPESGRRLMCATAPGRTGGVKRSSPLLYMSGEVGPPIYSSSKAASAAARNIGAAFRTVVAAREQTPTQRYKGGIQRGGENPQSRPPQKAHKPPSPERVVAAGPQQ

SEQ ID NO: 994150 - protein, 61 aa, Homo sapiens
AGVIISIIHSSLAEPRVASGGLGTVPPLPPEVTPPSPPPTQERRTRFERTVEDTCPKMSRG

SEQ ID NO: 994151 - protein, 268 aa, Homo sapiens
MAEVLVTPGCMGIEDVPAVTSCGIRGACVTSSLTKAISSPAYSEDDHEPERARRGIPAFLMAASICPPRNLYRASRPMVCQLREPKEKSSRKEPSQELMGTPDGYLLASTPVARQASPQNLGTPGLLQRHRSHSLRALISGPTYPVRPAVYTKDQMSHLFNVAHTLRIDGAKERSLNPEGEGHGSMFYEVSTRTSSSFACSHGPAGRCCAQLLGSHIGPVQKGGNRWLTPWQTMSWLCERSVRAPGPPSWKRGAWPPTLPEARDQAGD

SEQ ID NO: 994152 - protein, 328 aa, Homo sapiens
RELAWCPGCVLPLPMPMSPMYCSDRLWHECWQPRRIYEILPQRIQQWQQIPCIAKEQRKKLLERFPRAQSARTRLPDMERTITMSLRPSFYVPRQQAVREDEVMMQQRVTRDDTDLQIFCVACGHPINPRVALRHMDALLQPSMMSRTSFGSMYPTRIEGATRSSVMCIILRAKHTVSGSRCCAPSTHGTQSGSLTRIRVGPPFPECLTPGEFCRCPAMPSHYCLGNWGAEVDLERVVLCNSLDQAVEPWRKVGTGMTNTGGIVALMLTKNQEFPPEQLGQADVALRALTCQGGARRWPPFSVCTRGALRAHIGGDPPFITKRACLVP

SEQ ID NO: 994153 - protein, 107 aa, Homo sapiens
APPERKYSDVESCGDPVEITFNSIMKCDCSTSAEDLYANTACCQGGPIMYPGIADRMRRRITRLWETHEDISASIKIIAPPETQVHGVDRLASNLVLIVHRSQAYVD

SEQ ID NO: 994154 - protein, 133 aa, Homo sapiens
MTEPVGAMLGATATKVAALWYSPLRVLEVARGVNFNFGIDVDNKLFSKGMVGLNLGVHQLTHLGGLHQGNLRRVRERASLWPREKKAPEPRGAKAKGGRPEGNPYFTGEERNKGGDEEELSAFGLSTHKGQDV

SEQ ID NO: 994155 - protein, 114 aa, Homo sapiens
VNALQVLTAASVLRIQTVIDECTQIIARARAPGTSAPTPLPTACVPGIATCALRPVCPLLVRPPGTRLLQHSRKHAPALPRLQLPSAPKTPCQRLMGPEFLTLHVSQRPRIKTE

SEQ ID NO: 994156 - protein, 140 aa, Homo sapiens
MNGPGTDRVFSICSNNRSIGLPSPGPELRTECDRDRGTSSGAVPVRQAEKVIPSRSLGIENVRAHHLSSKPCSIEYRVLGLQTTQDVSHCRPLYGDVRERPWEARKAWTRAEEQSRTEGAINARALSTGGCTNLITCRPS

SEQ ID NO: 994157 - protein, 74 aa, Homo sapiens
AFGPECLAPVALCVPRAILSFWPGRLSSVLQRFTVYSASSSIEWKVDNFLNCYVSGYHPSGGIEVDLLRNGLEN

SEQ ID NO: 994158 - protein, 241 aa, Homo sapiens
MTPTDSAEKVDPAGERGEVNSSNEKYGEALLAMNRPVLVPYKLNPGQPSAVEGHGICLMNIPRSWKCLNTVRSLPPWWYEESLKGPESPCPHGQSLKRSLQTPFGLNICNEWQMGGLAKRRELIPKAQRKRVSEGNSVCSSLLSWSSSSFLSARLHVDLANPESHSVVTLPRLGFPALISVGRQPFVWKAVLWIWARGRGGLGWGDHRPGVKDPVPEVPPSGGPGRDNHRGQGGSPSPRVK

SEQ ID NO: 994159 - protein, 103 aa, Homo sapiens
TIREGWQESCTPCSTMTKLSDRYHSLILEVRLWARGKCTDRSTNTSADVYEPYPILLLGNKSPYWFYRTLVTGRISPRLQPMFLWWIAFESVEEIASECPAHS

SEQ ID NO: 994160 - protein, 204 aa, Homo sapiens
MSRRCETASGRRLSAQSSLLLWSVCDPWSAGGPKGARPTTLVFSLTCLVPNPTRLLRIDAVIPSWGHQLCALAVVSVLVFVTHAIPDWETTQLGPNQEFEGVLPRTLWSAPDAFPSSCIVGEWRTCWADSGTLNALALVCSGRSRWSLDPHRVLVSGSMCLTIWTGFWRAGTKAGGNSHGHSILCSFSRLLYLSRPYFAVTLVP

SEQ ID NO: 994161 - protein, 128 aa, Homo sapiens
HGSGNNLMGMAVHLFTKKLSPHPKMVRPWRKREECGSVNASYNGRAQTPEKETQESGHGSHTKRTRGINLITVAPHHWGREVRVARNTAGKKSLRINTFKTITNKPCAQAEPPFLETHTKSVSHTPQL

SEQ ID NO: 994162 - protein, 138 aa, Homo sapiens
LCDLKNPDFVSAKAPACVCGHGGHGGGVGKTKNETVTAKMTSAAHYKKREETKTDNKDTQKNASHIRYTKGEGAFFQHQQKHADKERRRKRKRERNRKQKEQTNKKQHVQKQKKKTEDIATKQAHNDNTQRNKTPHNR

SEQ ID NO: 994163 - protein, 242 aa, Homo sapiens
MPSNLILSFKLTGNLSKGRLALYSQPGRQAGIGRPFYPRYTLGVREAHIGEPLFIVTQAPKTSPSGGRTQKALRERSHRGVVYHTCRPQGTQRVETDPPRTAIPHQKANQGRQRRPLARRTTQGLGPGTTQRDRRSQTATSYQVTWVPPLKLYPKSRHHPLRCNGRPPGEDEPHEYIHTPILPTRRISPVWPRGTQERGTQIAQSRKETRNRSTPLDESEHEPPHTAEKPYQRQHQQTTQTK

SEQ ID NO: 994164 - protein, 329 aa, Homo sapiens
YKTLGPKINIKMGLRGVGPPFWAKLKIPPLWSKFSLRRPVLYGVRSYNCSIIGFRKFGAPSVPPAVWPYRPGRAYTLGTLFCPARVSQDRYSSRATPDSPRNTSLIINERCRPPPPQRWLPSTSRQYIVYQRQNTRGFSADCVGPNAREFLLAGHPHAGGTRAPLSGPPKESWLGIQRPLNPTFVPQPAPLQTPSWKKSDKFFAPTTQPPCGCVYPPPHFFFSRANTRVLRQTTEAFVVPLASKQTRQTTNPTSQSQRTTPKTGGRRPHTKTTPSERGAATTITTRPPARCVRSDRGRHPTYDEPRYKTPEPARAHNTARAQTNRLRRG

SEQ ID NO: 994165 - protein, 372 aa, Homo sapiens
DAFSRPERSWLLRYTSHPVNEPPTGVRRDPDKPSHPAPRVKRPKGEHAETRREGVRRWARAGSVRPFARGSREGRERLLNPWSWVTCGCMTPARTTSSPHGSASPSFRAVSRGNMLAASLPVCAKIVQTPGAEMRWTIDQKQVVILSQDSFYRCPYLESSKAKALKGQFNFEHPDAFDNELILKTLKEITEGKTVQIPVYDFVSHSRKEETVTVYPDRRGASLQGSWHFYSQEVRDLFQMKPFSGIQNEETRILRRGIRDIGKEEGYEDIISENKFGRQHEDPMKKKMRVNIPKDTKMSRINHGQNPAYKGKAPTNTGQKGYQDKRRCTNQNVPTQDHLEQDRIINERKKKKQNRDNKKKPVKKRPDMKKHE

SEQ ID NO: 994166 - protein, 335 aa, Homo sapiens
SSVMCCTRWSAVTHRCNSTCDVACLMCDGSDPKSFAHVPASTICITWTGYTPCLFVSSKDDLSEGVAVSGPINGRVWSAGRTGIQPSYLVVRYHPMMTRSTVAGARRLTHHFLFTQSRQHGRLRTLGPPPVVLNPSCLLGSRVSACMGGFRHGLWTVELGSPHLSRSSTFLTKWYHWVEKSHVKGPAYPKSPRPLIQWVVDSAAEVLCDREHKIGRAKPGLHSGKRLCGKDYESLNGIVICIAWLYAGHATSPGFCWLRVGRGLVAEAGARESCGHRCQGLATPGLMCVGREQLVWTLYPRLNLRVSPFLAWWPGFAEVAGVWPPGGGPRGSFNP

SEQ ID NO: 994167 - protein, 291 aa, Homo sapiens
MPHAQQQEKKQPAPHADVHIHLLNPHTIIFIYKRRESALRHHKKTTHTQRQEREQKRQNNQQSKQQTDTSNRTARKHTPNPHNEKKKMKKTRENQSSHKEKTNRREQKQPKKQQKERQHKEKQHTRREAKGRIQKKTTGKQDRHAREEQGERKKRRQEETTKTRRKRTARPKEAKSRQTDEEKKPQRTGSEGKNRAKRRTKRERRNRRERRTNTKRNRNCDKRAEYNHHQDKQSQANEVKAKTGARTTRRQEEQRKKKGAEDDRERTEEEDEATKRQQEGERSRGDTTEDR

SEQ ID NO: 994168 - protein, 69 aa, Homo sapiens
GRLVIPLVRKGHVVLPTGHTWCHCTIPGGEVYTCVRRGLYHLLLASPKLRMRDLVPKTHYDLTFGSLTR

SEQ ID NO: 994169 - protein, 137 aa, Homo sapiens
MACELYLTDHDKKPAMISRAVPMSSVWRERSGRVGNASVCTSRDMQSLSRVFLDARSHTSRHVSGIISMSQVVNQCVCGTSVSPPEISDARMWLRSHFWRCRECLAKSAFSAPKRTGPITVEVVANRYYHRHFMLEG

SEQ ID NO: 994170 - protein, 161 aa, Homo sapiens
AGAAPKGKQVYWAQLGKSRYAAKRFRKARSHCGRLKLRDDAGAKRQKLMTVRSRRQHAFEIIHPAHRRKPSAGPGERHHTHSGPREDIHHALGAPGLCDDRLWMLSPLGRVNQAIWLHVHRRLRRGCLPEALRHIAEMPWQMNINRLAGKWIHQTHSDLKS

SEQ ID NO: 994171 - protein, 105 aa, Homo sapiens
MEFIDVGREWNRMYEYENEFYDEAMLGLGETLAGRFDRNAEQLGNQWLPDMLDPFDIATVRCNRTQRRMLKGNEGFAPCLGHIYYAGMKKDEDAECVTALNARIA

SEQ ID NO: 994172 - protein, 275 aa, Homo sapiens
MDSTVDACTHQRTRDLCADYAQRKDINCEAWQSLTRIQTFRDISPGLWTDLGLHVTSKRLDSICCSIEKQTIGNNQQLTATQTRTVTEHGDEYHRPPPDLDNYETQDFLIQGLSGRVRDHTHAAKLPPKDQSHLCFIMTTSRRLAYTYILPKNVLKTVHLQYLTLRAQIAVIPIWGGAHQINPQAEGDTLTVTGRRNGATHQSVNLTCPPDQNDYIKGTLEPLRMESHIRPMSHRRYTTHGCHPPRRGSWLPTLLGMREEHYDTCNYSQAQINEG

SEQ ID NO: 994173 - protein, 348 aa, Homo sapiens
MVDIWPTLPVISPPSPRTNNTSTGASLKSPLTREKVKGNLKNHVIFHPLKEGLYYRGAVLIVALHFPVGEPLWGVIHNFSFYKKKIFPINPNGLRGPAPVFFYNPEKSRVFGDTYNLVVGVADLCTSKGHTIVASTCGGGNNPFWDCTTDQIFDPKVEVYAWLNCLPPPALLAFLKVGPVPVTLLLFTLLVFPMSFLTFGYKALKTEGGNRVTAYNLGTVNPALMEALKKVVLLYHGNELLPDNFVTQHRRRYKAATRKKKQHQPKKKGARAKKSPERRRMTQLLSIEGGTTEVKKRGGRKNSEGPSRLSNHPGCGTTAPPPTVCHSPEADTNQRRYTAKRPKDERKG

SEQ ID NO: 994174 - protein, 144 aa, Homo sapiens
MDGQGETAGRDRRKDARYARAGEQRTKTDGGAQERARQGREGADNSAEKAQSREESNNWMMNEDERGYKGEEREKEERGDGESRYNEQAMKWRGERDSNGGARSDEGDKEEDERRACTTVNKGGRLDGALIADLSECVCTFGSD

SEQ ID NO: 994175 - protein, 438 aa, Homo sapiens
HASAPPPKVPSPEAERTYGYPTSVPPPQLPVQTKQHYGGSTPARTAKPPIHRVETLARVNPRDRVKYVLSRIAMARTIYATSLANSVVDYLASQTPGSVLGRRCRSGTLHGEETRIHSMALLTSFTWPRYYSCDPIIATKYYKIPSTIHYYTIGVLVDRQCEHTEEAPGIRIQLHPRTLELSSSQLTRKRDSKQRLTPRTRSRPRTPKIRRKRSIQSTVGHRYPIGDAITTLAMYPICFGAVSPSMGPPKQYDEETSDSGRTAIQWRIDTQINGEPPTIPKHDTPVAQLQRMSHNKHRARRRHALPTRLQGTRYTDEKRNRNTPKYNPKTQPNHWHISTAEEPSNTKPTKANHNTSKQTKEIWERLNPQPRTGATHARTHTNTQTKDNQTHRQIQQNTHMRRLATYINNNANKKYSPQSSPKNGTNKDTADKAQDKST

SEQ ID NO: 994176 - protein, 267 aa, Homo sapiens
MHELKVLPRDLQLCSETASGVGCWGPGWMRRDAGAVWIPRLWVVGGATRNGETVPRCMNLCTAQGGDCQTVTAVTRKKDNRVCVWPCDSEQNSDPCEKTIRLKGQCEWPPTPGPSNGEIQPSLPKAYAFLHCKETGEENGGVYVCETATWCWLGAQEPRDVTNFTVGGFCAYESPDSSPMHPSAGGQRGGFGSPRWRQWWHEQGPGPGGTTELIGQTVRSSQGAFQRYIGVVTDAPESRPVWGCSTCRHSCRRPPVPRGSRAGGAPL

SEQ ID NO: 994177 - protein, 73 aa, Homo sapiens
VRAIYVRLEDFGIFSDFTIEYSQAPKKSDGHLRCTVTKDLTERRCRASRIRTHKELITSSMNSLPDLNSYHGY

SEQ ID NO: 994178 - protein, 65 aa, Homo sapiens
MLIRTLSLTTVRRRRNPPIEQHTASYQLHTPARTKHRSYTFTQSASLISNPFIFDKGTSKTRQYY

SEQ ID NO: 994179 - protein, 200 aa, Homo sapiens
MIDKFAAVMKSDEINDEPSHTSEACVLEMSKIHGSISDMDGHSRVNRKIRRVDKDELDVLGMKATRGFRLREFHNQEWLELEPAQARTHKVWTTHNPFKPRALQNTGVKSLVPLERLSKLNQLILRAHHFDFSPSTKGFPSTFGNTHGFKLRFGGQRTLLALKRANSNIFYPHKPKRGFPHIQSVDLSILWWPQPPYFPH

SEQ ID NO: 994180 - protein, 250 aa, Homo sapiens
MVRVSHFIMISDRPNQPSERSLVLLRDLYLWWVVTQCFIFNSQREQHNKPWVNKRAKSEQPEQTNSIFRGAHYPGYTLFCGVYVLPLTRVFPIYTRITVCRYVLYLTQRGVLHTDGATQHYTAGLVSIYISHPPLSCEYNNIANVEACVFSYVLSLCGAPVCESNEYMSVSAHTNYVVELPQNNYHHTEPPRSRHFYDGPEGRCSAPFTHRDSNTPTPHTREGRRGGPTDLAQAGDTPPPHKRAGAPPHR

SEQ ID NO: 994181 - protein, 359 aa, Homo sapiens
MVMLYTSWLNDRLHSALPPGALLRNHNRPPHHSLLLRWQLITRKTVAASDACTHTPLPLAPSHTAHHCCSRPAARAHSQHTLATPRAFTPTTTPMLRHTQPPGKPASATGAPHCPAPPLSRLGRLPTTCLAIGTRTHPCSPPTRRTHALLLHHSSCHASRALAMTTPCPPPRYVRRACPTPLRPSPPALPPLGLRACSYHLSLTPSCSSPPATTAQPFRLQPTPHPAHSHLLPACNPHRPAPRTTLPPSRLPPSSPPLPPTARAPSTHHAPPPPPATPHNPAPKDSTHKHNAAPSGPIRRHSLLARLTTRASHPPATARPRSQLTSLASPPLPSHALALPPHTADFPPPLLLPRPATPP

SEQ ID NO: 994182 - protein, 102 aa, Homo sapiens
QQPPVRRNQVEHRLEVAVLHLVALNSPLSGGMLAGHPSVAAPSSAVPAVRAARCAAWREPLSDALPVPRRLSSDTVHASLLPADTTRLYRTLMPHTSTHQRH

SEQ ID NO: 994183 - protein, 272 aa, Homo sapiens
VLIADGSSMICAFGLCILPILTTGDLNHLDHQHTMRWCHHHALRFPGQLNADLRKLAVEAWSPSHVSISLCLALPLSPAVEASSIELSQCRNSPSEVFDAKNMMAACDPRQGRYLTVAAVFRGSDVHEGGQTEQMLNVQNKNSSYFVQMDPPKMSRQPSVTSHLVASSMAAPFLGHSTAIQELFTRISEQLHCHVPPAGLPPPATPGEGLAEHGVHRGWEPLTDSSLSISRYPEPRRTGGRFACGRREDGLRQQPHTSRFQLPSHSYSTALS

SEQ ID NO: 994184 - protein, 101 aa, Homo sapiens
TASSENSGAKGERQIWTCKGSPASEHDVFDPVSVAWLAWRWKSMSYTLEGVMAGVIASTRHLYSFWRCLQSSSSKRDEIAPNIAPVLESDCVELITDTLFS

SEQ ID NO: 994185 - protein, 259 aa, Homo sapiens
ENYGGGVRQGTSVELTIVEDSTEDDSNRGFMNINKYIALQHFVHEKSQMYSRELPVIDFHKCLTDFPKLDDIHPFYADWMNILYEPEVIIDTVGALWANKLLPTNSSGTHVAQKITVRLMKYGDSLYRCQQNEACGPGTDVHSDQEAEAEFGLSGDKCVDAILSRLQTIDPNTRTLVWCGYPDVGSPASSTKVTRADVDVHALCVHNSSLCELGTWIISIYVGQVCRHSWDSGHPLEDTTHHRDAGMMPWGNYVLRSAL

SEQ ID NO: 994186 - protein, 120 aa, Homo sapiens
MSAQKSRKLRYSRNSPHLWWVRTICANNGAHVNRCKQFAVPPKKGAIYAMGFHPSQFSRDTTHGREPMMWLRSPRDRDTAVLCTTERKLVCNNSGAALRGHNTVSSLTLRDVVREPVKRN

SEQ ID NO: 994187 - protein, 365 aa, Homo sapiens
MSASCLCQSVTCLTDVCAALHAAGGTAVLSALSVSAGAYSTLFCVHHVHSGWHQHMRIALERPTMARTCSKDVIDMRTLLILIPRSCEVLIDAVPAWCTRAGYRCYSLYRRLVYLCLAQVRGVLEDPVWATTVFACGIYPRTNSCHAFDPILQSSQPGTDNGYLLPLRLFSLHCCLVGRSLARSAAPMLGCCGSSMTQWSWCCCFLSINLAAGASRWGWGCCFSSSRGTSSVEDECAALLALGYVIFSSTRVRLPVAALPKLRNSVLAFTWVRGGFLLVGKPWGTVRPLTLCAHSAPVANVGLPRGSCQRSRASVGPNRPRLPLRCVTGAISGEPPRGRPFQGTYPKCILQLLTLDRQLVLYHHM

SEQ ID NO: 994188 - protein, 326 aa, Homo sapiens
MARGPKKHLKRVAAPKHWMLDKLTGVLAPRSIRTGPHKKRECLPLQYICLEEQHLKYAPDPEHEVKNHYACSRCHSHEESDCVEGSEADSNATLTGIHWYVIEAIDIRRERISVWSMIILKGLRLLYIVITPEEANVLELCKVRKIFVGTKGIPHLVTHDARIIRYPDPLIKVNDTISDDLETGKITDLVKWFDTGNLCMVTGGADLGRIGVITNRERSWDLLTWCTVKRCAMATALPIDVPHFVLIGEATDHGFPSRGKGFRRLHGGEKGTKSGATNRDKGPGRVALRRGNVGGNNTGAKTHGGSPCEGQSLKSAAQKRWRLGHT

SEQ ID NO: 994189 - protein, 284 aa, Homo sapiens
MCTVCQHLEHSMTLRSCGAQGGGVGVARRVMAGAWARQSSSAALIIVSALTSGDGQSMLLVLCLLSNSLRGGEVLCHFLYSSYAVIITISICCYFPVELVEFPAPESGSEDMSDDFLIGRYVLSRTFLQQPSFLVGLLLGFYPFMFLVGRVYAKALHSVVTTSSGLLTNRVLSFIVMTLMSRKVTIQSPSFDMPQCLRLEEYLFHHGEQISGVLGSQKLIGKCPCGGQILTRVKRIGISLAPALEFHRLTGNNGDRNGSPPLGLGNHRPARNYKTTALPPPRWP

SEQ ID NO: 994190 - protein, 134 aa, Homo sapiens
GELVRHRFPTYERDQCNKRRTHLDNPSLGRYHFRATVPLTGATRPTDTMAAQSSKSNSDTGRSASTYYTYENPTLDIKDCSTTGDEPAARRIGGTQRVIPIKGNCHLGARYESYTQSADSSDTLCETLLEVTLT

SEQ ID NO: 994191 - protein, 273 aa, Homo sapiens
MLTGFNSISTNDPTSWCVLMDTKRAFQKRSVAQKRDPSALLEFFTSGPVSTSGLLHTFRTHQFLVPGGLPRVRETPRGTLFPTKLLVAPSPVCRKLVPPHRRAGTPCDAFISGSFRTTEISLAPRWVPRHQRDDRLDCHTLPDPVGMTTDSFVALRAPQCMRGHQQALLTSARACGRRRKYSIPCAVVYTPNGLKYWTFPPSETACPLTCAPHVMSRALTLGISEFFLRKYTVLDPPCRLVQPFATSATFWIAPPDRAHNTNYACATVRYVAG

SEQ ID NO: 994192 - protein, 262 aa, Homo sapiens
RDELADEIANHCSRLRSPGVRGERGVWRSRIAPELEEELEGGGMVQQRSLINDRLKKANPAEIDQINTDLNLLSRSHCPVRTENARQLAWKCQNKELKVKCCRVDVRALSIPKVLRSSIERPRGHDCSVGGAAGHSETNERSWQSAKQVRRTEKNLKDVLLAMVDDRSVRNCRAEYKDQVDNGIYPALEARFIAGRLEEAEEEAQRDQASSRAVNCSRELEDATETADAMNREVSSLKNKLKRGDLPFVVPREWAGKARGWL

SEQ ID NO: 994193 - protein, 222 aa, Homo sapiens
MSSPLTNPSTFGKAEGQADSTQVRQVPDQARGHEWMEPPASHKTHEQNCPRRRHARCPVDPSTTGEGEDGELARLHGTTTDGSEPTQAAPTPPPAPTAPHPTQQPTERNTQTPQPDQRQPTRRPQERGHTGPRPARQRQHRPQPTRARKAAAQTQTKHHTRTPQKRTQPACRQANPRRDATHTSGDPTRASHAKQLNAPNTHTTMTVIHTPPPNSRTDAHTH

SEQ ID NO: 994194 - protein, 221 aa, Homo sapiens
MAVMAEIGVLPKSDAEIDAQMMATNPEGIWGLQNMAKSYKSDVGVAFRYVSTIADDANRFIQAMLRKLLLMQMMCDMANPVPRVISLLCVSSPEEICYLDIAMAKKVKPALPIDQAIFRYWLPSDRYCLTAPKYRLKSLRKKALHLSAWKNNSPGCKVLVSVYQQNQVTPTSRQHAIHYRHDLFEPKSRGLPCPSTGSQVYGYQIAYFLQSSSCEQLRIPG

SEQ ID NO: 994195 - protein, 150 aa, Homo sapiens
MTGRSNKRREGRRKRRRRTTKGAKKRHGREAEQRQGDERERNTQKDKTQRRERKEEEEGKKGEGKKKRKERREERSKTKRGRQKEGRRRKEQAKEREEEEKKEKRKGGEGRKEEEERGEKKKRGEQGAEEEERTEKETNEERREEKEKKE

SEQ ID NO: 994196 - protein, 233 aa, Homo sapiens
ICVLVLKINTQALSVSLCGYYNQSEAGSHIIQRMYGCDLGPDGRFLRGHNQYAYDGKDYIALNEDLSSWTAADTAAQITQRKWEAAVWLEQLRAYLEGLCVEWLRRYLENGKETLQRADPPKTHVTQHPYSDHEATLRVLALGFYPAEITLTWQRAWRGTKLRTLSLWRPEQHGDKNPYKKKDQLVGWCPTGERAENNTCPMYTHDGVRRKPLTLKHEKPSYPVATKYTDRGH

SEQ ID NO: 994197 - protein, 182 aa, Homo sapiens
MHKKTRHTQKNTKKGEKKEKEKYKKKRKGDTKKKTKHREKQNTGQEKREQTNNTREKKKRKTTNKEQPHHKAEKPQQKKSNNKGQKHTPEERKRQQHKRRKNKEKNNSRKNKTTRTQQKKTNKKQQTTKKKTKQRKKKKDTAPQNHGKRKTREKKRKRKEQKTTQKTNEENQEREEARDRKR

SEQ ID NO: 994198 - protein, 269 aa, Homo sapiens
MLIDWKQKQNTNTKNNTQTQRRGPTKQHHHQRGPTTDTNAHTRAQPTRAERTNNKTHRQHTTRTKPPRATHTQPATTESKTHETEPNTANTTPLTSARHTKGQTAHKPNQLTARQHEQHTHNKKRQHTTVHITHDPKTTGPRAKHQQHHTTNRCRRNHRPRQGNTKQREGARSGMRADQSNAGQPQQPPTDETRGDSTTDGRESQSSDDEARAHGDHGKSPTEREASLAENKETKEAEDAQRAERQSGERRGTGAAKIERRKPEREDMQ

SEQ ID NO: 994199 - protein, 330 aa, Homo sapiens
MQTRGNTPVTHQTRALNTIAIPRQRLNSINHDCYATLRTPLDKTGPLRLPLHHTHTAHQPATTYDPTHTATTVKHPPTPPTTQHHCGGTSPHYQHSTTQTQHTTGHYHRHNCDHQPNNPNPPYTSYPKQHNTHRHTTRPTSHKRKTHIASSTRHSHHSAYTNKLAPHEQRHPRRQQTQKPTDETKGPIANINTLTLSKPRKQGSSTHATTEQTRDTAQHKHNGHNRHYEHKRKQQEAQIEANNNDNTEDNDEQNRSTHSNNHTRPGNPENQTHHNTATTNATRQHSNPAHNAERLGNANTQHTINNTHTQTIAHNRNTRHEIEPKKTDNE

SEQ ID NO: 994200 - protein, 119 aa, Homo sapiens
MKSGQETALPGSLYREEHKCSHVRRQWSLITHDGRLAPRNWQRRSHEEATDRYLGHSYLEDLTRAQGENVTHREGVREHDLRTQRDRNRMHCPLGRSRYQSSDETLCIARHVACAGCIP

SEQ ID NO: 994201 - protein, 100 aa, Homo sapiens
MASCLQGLWLAKGGALAEPRDDRCQGSHVDGALKKPGGQWPGNRSEKTVVPALQGDGSDHVTANKPKQRRLVEAGYTTVDNAGERQERRQDTNSGSAPDK

SEQ ID NO: 994202 - protein, 106 aa, Homo sapiens
IVHKRRNPEDLDFAASRRLTDKNLGFQMLQQDGLEGGPWPGLPRKGHQGVRSAWEPPRKGKGWVLTGRSTEKKTHSMCCLTRGMMQDVQHTSGAEHNSSRVTPVED

SEQ ID NO: 994203 - protein, 32 aa, Homo sapiens
MTDQVAAQSLAGRCGASRRRRSECECNTADAR

SEQ ID NO: 994204 - protein, 108 aa, Homo sapiens
RLFRSWISQIGFYTLIPHDLGMNKPPVLNNADSVQAKVEMLDNLLDIEVAYSLLRGGSDDSSKDPIDVNYEKLKTDIEGGVTEYSVEKPRSSGSMLENYSCNHQHKCV

SEQ ID NO: 994205 - protein, 356 aa, Homo sapiens
MDGSSDRQGWMLGTHAEVDLVIRHSARWHKGILVRMQLSDRVHTMLRYRDAGKLARAHFEARGEVVHRHCQVHVQGHDVVTGAPLLRCTEETTTLSSNETPGLVGEEVATQIEDVGLLGDKERDGSDARVGLRRGHGRRAPTAKQSDSWALRIREEDPSWLAVEPGGDNNFVTNFALWYRHRVSGTARHGSKEGDQLASISDKENWKTNGKKAQWWLIWEEAGTGVCMVGGSIDRARWLGLGVLPQCGYHQWRARTPPVGQPGNHPPKNERGGRHGNYGEGGLATQERAYSGTGENFARFLESRLHHPTVFPELRNLPGDFAMGRKDEPADHWRVWDLEGKGLTGFGNSAGGFSKV

SEQ ID NO: 994206 - protein, 96 aa, Homo sapiens
YYTNQDIMSGEGKAGPPWSAVPVQHFHKVRRRTVAAVPCAVPVWGQHFLGHQDQEGLPTFCRKFRSDILLQDTRPLFLETRIPWHMGHSYMRKYPF

SEQ ID NO: 994207 - protein, 135 aa, Homo sapiens
LGLGNETAPVCFKKMAEKPDMGEIASFDKAMLKKTEYAVRRSTLRTKETIEQEKRSEISYMILEDFRTPRSVFETPGRRVWRKSHAAMMDTSHNGCTVKPGSSPRRVPPGLWVSEGYPAAPSRHCPKVSPVVARG

SEQ ID NO: 994208 - protein, 267 aa, Homo sapiens
MCSSHYIRETAGEDSTRAKERYIRSRIGARHISIYLDLLSIIKNLRGKEAIKHQRRVLHTAEAHMSPLGENRRCFYKKFRYIALSPTKRCGFYSHRGGFSGGGAKLYKHIICTSSGSNPEAQSANERARITINTHTCDVNIHTGQGNLDNEKQLSKKQNRYRKDRDSKQKEAKEAGRREIQRDGRNERVGDKGQNNKPEARSSNSMRRRESTPTRYDRRRKPNKVQEPQHMKEERDAKINTNNSSDARGGERADKNNKTNAQPRRGN

SEQ ID NO: 994209 - protein, 197 aa, Homo sapiens
LLDGSRLLQEVVMSLSKCYSSLPGLDEAEIRIRWLEIVVRKTNYLTSTGLRRFLESQMSRMYTIPLYEYLLHRLPSSPSRLEVFYQTQGRLHTNLQQYAIQQILYPGLGLPAKSPTQSTSTELGQGWKEKKQNPDDKKGPCLACTDRVSTQGSDNPYYSEDVKCGLAIRHLIGRSLSHRNLSRTTPQMLAYPEGQRH

SEQ ID NO: 994210 - protein, 174 aa, Homo sapiens
MVTGKCETHEDTGGTISRYNQTIIRAGRWRYQMSGLRMTLIGDDEVPTYRLGLSTCCERTIMVLCVGPEVAGSNTVLLYDDSTIRLTGDVDEDGRTWFGDQGNEGSMSSWSGTESVINATDESITLPDVSPHYGRTPLGSLWTEQYYLTEGTCVVPGLRLVAASWASSPFPMSV

SEQ ID NO: 994211 - protein, 258 aa, Homo sapiens
GTQYHLFLIHKTNIFERYIQKCSTWKFPYPSVVSWLNVCLPRTFEMLAYLGGCTFSTYGWVWVYSLYEMVIGASKNTTNKHRANQASSTTTNKEAGAPEDNIPPGGSPTQHAPPPPETLLGKTTEDHPIRCGTLLTTTTPDTGATALKQAPRQRAKQRNEADTNRRRTTQKRAEANTTGQPKHRCEDIHNAQNATTEYTIYKAIKPRVVHNSASMTAPRRNEEVDAARENRLTQEQQHPPTAAASLENTRRPPSHPPL

SEQ ID NO: 994212 - protein, 529 aa, Homo sapiens
MSTHPTIIIYVSERRKNNHINGSVRRSQQNNNKKGDVTNRASNDIYFTATHIIISGDHEKKVVTTTNADIASRYAPAGAIHVGRHTKLQRTDEYKWRTLNNSKHPHSTRTATEQMMSRTTTQTTQRNKSARGPPPIPDDPPDDESAYQSTDERKRTRRTYTTPTTRGGDTKKQEDRPYPQHALIPQATSIATHTPHHPYLITHVDTSNKSGGEPTHEQDTSHTPKRGRSTTHTQVVSHRTSSAARTHSGHTDPKGTTNNDMRNHPRGQTTHTPTMRSQPHSQQAHKHTQHIVPPTTNYGKRCLHNKNKRAYNTNTNTPHGHTATHQTTNEQEYDGYIYNACRPPHTRITEARGGHRSHAIECKESILNNVEHNSMRTPAYTATRASNDRRAYCHSARLNTNETDTVTDIHCAAVVSRRAAGCTCDWRERHDTKTHAESQAYTTDRRSISTARAIEGHEQPCHRRVNDANASQAARTKHPSHIPQHRAQERSEQPQEPLPSQPTSTSSIQQQLNTDNQAHRRAQAAHSTH

SEQ ID NO: 994213 - protein, 241 aa, Homo sapiens
MNYKLWALRLTSHIYWKSIRGYDSIVGLYYPNSITPGLSVLKHKGLHPKESSQQLALRRIYPLQKIPQVVSPHTAKSSPLAHYHKRRKAGQTANHLLINPNNLSTQGTTPIPNPARHTPENSTNRCMPPIGGTPNKQILSELVLRTTGLGLPHGPPGSNKEGALTKKENPIQQAFILIVRPPHTHVRNLTRSEALHTLHKRPAQLAQNNSAHALRAHATTTTRAGINQSEPSHLRHYKKCP

SEQ ID NO: 994214 - protein, 237 aa, Homo sapiens
FDTHYKTDFDKNKIWFEHRLIDDIGGSGPQVFGWLCVAPARIYDGDVQLMTSWNHGFGSLGLHDCPVPWSALDGELSGPDALYVPLQMGPVTLSDYLRMPPDRVRPTCHQPPSAAIFAWPTGGLAATRGVNAWDGATDSISIPVLCPSMLVATVCSWSTRADELASDVPKATWRGMLSTALYDMLPAARLSCLRHHGLSSITHSMSHLCLDALGQGVRGVAPPMAAAEAAALPRGLS

SEQ ID NO: 994215 - protein, 399 aa, Homo sapiens
GDHEHDLERGSMTMARTGVTFTMAMTADESNLIKHRHRERCVSQPVLRQHTMSLPVQAADRHFQSRGPAHGTGTRDVNGAVRQAQAAWWPLHAAHERPELQGKQPGCTAASRHHRKNSWQQDTTNGPSIRHDMMETSETPPHPEGQLKNTSRMSPAKKAKQRENREGERHDKDNHKAMRTTMETLNLKEHKQGKTDRRATRKPKIDTHHTEITPMTTERTRTRTRGHQGTEDHAQRDRHTTEHDGRQHKHKQTKQRKRTPGNEKQGHGPDSGGTNQGAEPGQHDAVTKPAEGRNRAGGRGENRAPTQVRQQKQQGRQHNQGHQQHQDTEEKRQDQRQETRRAEEHLATPRQPPTAPHGHPPATPHTPITQPATTAKSAPPRATGPNTHKPASDHPPPGA

SEQ ID NO: 994216 - protein, 73 aa, Homo sapiens
STCYIIMTGLKVFAELRKPMSSVKDKVSQVYMNPEAWNTMVLKNIAASGKFSSDREAMLKNMPKTSGTWNLQI

SEQ ID NO: 994217 - protein, 293 aa, Homo sapiens
MRLPARSLSTLLSLRQKSRLQAPPVVAATSLTHSSTSGGSGETADVVQTAATKLPELGLGSYTPVGLIQNLLQIYALLIWAYLGGGPELHCTVFARCLILPLIVPGQRQAATLHNHLPEIHEAHPVESTEAKLARDHIEYFTRLPREMALSPRNNMVFNSINSHSPCDSGPNLHLLLHCSERHWPPFLCPAARQVALVVPDLPGIRSHRTYTPADLAPSALPEAQWLSTGFTRLPTHDELGPESPPGNLAIAPYPGARTTPPSRSSLATPGRTTEPPTPAYTLAPRSPRHAKQ

SEQ ID NO: 994218 - protein, 309 aa, Homo sapiens
SLIQTVSRSRSLAVASRGHSRSETYGEGERDQGDSNGIVVRIVRRPWIHPGTVFSHSSRVNSGILFGQSSDPFIWALQSYHGYILIPNDVFHSDGRNFQWYRCKGVKNVERPCSIKWENPIHASFQGARIPSREMLDGGRMSVTSEGTIAGSSSVAVVCTTDVRTAEALIMARGREPRQGSIHASEAPIIDWMATRYVSVHRGVNPVDATLLTRQALQRIIHVNSARWDPVETSPMRRTRLGARQGSNTLSEASLSGLVVGKGDRPMERNEDSPIVATPALAQCARERETRWWMEPPYLWGKTFGLWPV

SEQ ID NO: 994219 - protein, 96 aa, Homo sapiens
MVGARYRSANLVNGVSQCQGAYVWTDVWSNEYILRVRVLFERLNCNGMVTVAFKVYFHSLEEVTVGEHEARCDYQHRNVISRVFVPIKFPGPGVKS

SEQ ID NO: 994220 - protein, 184 aa, Homo sapiens
MEETAHFTLSSNRAYNHAFCTLIWPYSVSQLPVASVHSSVSELPLTVQPLLPVGSVPGLVFSVSRSKASYLKTCNVQFYVSGKTGGPTSGTGGTEREPRTWGREAGTQAPVKDPQKMALSYSWPVATEAVRCKDLNPSHRTHRPLAPKGSKGTGRIPMRLQGPAATHSAAHPPNTNPHGGSPAP

SEQ ID NO: 994221 - protein, 153 aa, Homo sapiens
MRCQGSTMRMKTQLRRRRTPRRTLLCQAYANQTCERERASQEKYRDLAKERRDGVNRDYEAKRAYQHHELTYRAVGPPLREADKSVWGEEKTVDPGGPKFLGGDSGYYSPLVKGLDFALLQKVRAEIASQEQEKEQWWKGPEGERQKAGDPDD

SEQ ID NO: 994222 - protein, 117 aa, Homo sapiens
LHTEILKLVPQAAWQERYSSLMACKLPVEDVHPLSQAFDQIKGSETAPSTWRNTASLRLPWSRCSLELCQEQALGNVDDKIDSNSSMETSPSRKILKQRRRLLTFKVAKSYCIITFP

SEQ ID NO: 994223 - protein, 315 aa, Homo sapiens
MDRQQPSETSSEYVNWQQQIRQQSWGIRCTIMNRHLVTHRPKHDEEARKNTNRKTGATQVKPQTHSTTRTQQESNPAQATATTQHHNQAAPRTGDTRHTQRTEHRHTHHTDAQATHTQHHTDTSTEDRHSAAQLSHISTHDTTHESIKRIQPRTNKPDRPNTPRSTTASATHDNTTPRTREHKRTRQPDHNKPRHHTETKHEANLTRESTTEEQSHKTKESESDKTRAEKDKNKNSEARRKHRADRYESTNESRQRKQKRGEQRQEKPATGRTSRQQKTTNSPTDRPTHSGAKDETEQTRNARSPAHGRKESNRV

SEQ ID NO: 994224 - protein, 260 aa, Homo sapiens
MKSLLVVLRGIVYVYTVDDSGKQQILIATDLREEKREKRLRENAMMERAEWSKYQLEKPKTIKGTRAIRSGSLHADVMKPRDSERGEKAQITKAAIERRKATRGTQLTGVNQERGLRQKSPQDKQARLGWDPTHLADKGSVYGANHLETRDNTTILDQQSLTVETTASREDKGKGTAQGGPCVHRIAWSVTKRDHLKVGKSQRNWAGLVSGRKFRCTPRPNTKTQHTNKEPEPARQTTREPSRTMQHSRHDSTGMRQGKA

SEQ ID NO: 994225 - protein, 270 aa, Homo sapiens
MTEQSNTEPPSDSASSWPDQATPLNRAPSHHSRSRRPWEGISEGEDTSYMHMPQVAPYRSTLSTCIVGTATPIVCPNTHLTILSFLSFIAILPFLHGNDLAPQILANIPVSLLYTMSFHVFEGSAPQFCPLTTFLTRSGQILLLTIRERNLGQDEAQAGIAQVKSSTELGTCSFLRLRESQGHRHQESLAHEDTRQQAKKQGADSDRVTKYGTAGKKQRPRTGAPAPKREQESSPAHRTKGDHGNASRSRAHPTEVAPAKRENYTGQERP

SEQ ID NO: 994226 - protein, 141 aa, Homo sapiens
MRSSHSEGQVVCRSQGEAQWVWELVSALVSEGPGLASLCWLLLLGLKMSEAIAQLRGRAVTKDTPDCAILDSSGGAPEIEDRSPEAPPPLLSPLQMLPWALLLQGARAGVVSRNVSLADYFKLGSICPDSVFDCENIFLAL

SEQ ID NO: 994227 - protein, 298 aa, Homo sapiens
MGLSWNGCRCRYGWVSEAIRECMTFSSVHSEPLDQVNKLSGQDHSTMVVGGHSDRVTVLVLQGGPKWMPLDMVYVCLSDIEQCVGMHWYGREHPGVQERGLVALAILAGMLNRHIYIKIEPIPGITRSSGWCISRIEFDGYRGYPYLEVILPGSVESTRIFHGYPSLGTKSKSDERRRKDDYILVGNSRISMTVMGPSGFRRLACRAYHKSTEVELLRVDNIMRYTEDENGTMGKTIEGQWSVKDNIKHRNQEGKRRDWTTQEETERKLECHVATDYKRRAKDVRKRGKVATRTGTGG

SEQ ID NO: 994228 - protein, 40 aa, Homo sapiens
MHHKQTDRQRSAHKSTHKWIAQIRCMRKPNKRNKKKRQHH

SEQ ID NO: 994229 - protein, 413 aa, Homo sapiens
GYLQPPSQTRRKVSSSIQACAGFTWLWKTLCKEETEQAPPGPPAQCSRRAHLDQTFPDTGTSLLPHPVLVGHVLEKTPNPDGHSRDVHQTQATGSRGGPQGSMRAFLASRKITCTRHSPNGTCAPIERAHLNYTDHNSVIHHKTDAARVPCPIFTRERPQHGPPCIGKDMKQPHVGGGDADSRHKPLEHPDTCIPDTGATPHCRRLRGTEHQTRDGLPHPPRDPQHHLDSDRPTIGKKFLKGSTIPEHQQKAIRRTRDSMNWTNYPIGINKAKPAFENDGSNRPGENVGPRSLSTDMQADSRYRARDANRTPASQANKGQQVQNPRTDDHAAATTNGQRNGKHPGGRAQERERKAQKNNKHAKEKNQRKKRADSEAEQKQVQTKKREKEREAANRNNDEKEEEERQTRHRTGR

SEQ ID NO: 994230 - protein, 308 aa, Homo sapiens
VHAGLGELLRYSGSSTARNVTWKLGSRRYGPSSVSFADDLSCAGSKQHYNCEHSKINFRDKRRALESINEWVRETTVRRRLPEVTKDVERTDEALLVNAMFFKPHWDEKFQPQDGGHIVDFMVTRSYTVGVYDDAPDEASIELSTMDRWKDKLQIVEDAPGPQALQARHPHAPSTWSLFERLEKLVSKEQLKIWMGKMQEEGVAISLAKGVVEVTHELEKTCCVALTEHVTEQGRLVGMSPACSWHGSQPRFEWTNGTLCGHWGRNGSPVVYAPFSMVTQGLDYGAAPSEYTNCGQKEDIQDKGDPQG

SEQ ID NO: 994231 - protein, 319 aa, Homo sapiens
MTTGRYGPSLQSLGETNDLGQWTTTDKRQHTRSHKTRQRHNIFATNLQPALDTAARNPHQTRQDHSHTRTNINTPGHTQEKERQGTSGRRQSTTDKNSGHSKCGKREQKLIRKTQHDTTPRTRQDKTQRRQQTTKEKTSDEQKKKRKRKKAQNTGRYKSKERRSGRPDKKMKAPSQHTIRAIRNEEGKKKKEKPREQQTAPHTTTKNKHDTIERQSKSEQKRQTITRREESKSDTRENQKLAKVKRRHRPEKKRTEPMSELQREEGTTTPRTQTTRHTTAVKQRAQQRKRSRTQTNDSASTITDTRAKHHRQKTQIERT

SEQ ID NO: 994232 - protein, 510 aa, Homo sapiens
KKVMPQSLQGGKVHLQIKKAKKKGGEKDQGGKNRRVRYIDEACIPRARTHIGSRNKAQKNETSERAHNGGEKKKQGETPRKIKNGRKEPDRPKNRENKQTKAEQEKQQQKTSERQTHKHTPEERYNSEHKGALSHLIPPHTNLHRAQHPRQSTRETQTGNNNKKSADSQTQQRPTTETRNTEMQKINHPTREKQISKEDKQQADTEAHKPHKHHRQPQHLTTDTLQSHDQNRENQQATQAQPASSNYSASPRNYKTARDHDTTQYEQHHASVARQPTTERENDYDSNPDEMIDSTANKTSHNISRDTKKREKQERAAKDNKTRHANQRQEQNTNHEKISDTTNTVKRLKTKARPEETNNTGRENTNKHEHTSRQTRTKTRTPRPTNTQKKKRKKERERTIEKKNTDESARVRQTTHDKKNSEHRDKERRKQATRRREKQAENNEKRDYGEQTRMRDDGERNTTMQNVHDKQRKKENTNKTKTTKQKHRATKPRQRSDEPNTNAAHRPTSA

SEQ ID NO: 994233 - protein, 240 aa, Homo sapiens
LFRWSSYPRDCRCNPIRIVDIKNRVYGLDVGSGIPMVQRYERFVSQRLKSYVIESDRSNPGRSIYSQYPPVYEQDEEDNKAYLTKRTEPAEKMSISAPTLSNYTTNSPAQNQRTDKTNNKTNGRREHKRSHEKGTQRNNAENPTPTMWLHNKWATPQRNGKHHTIKPAERTTWTETPCTPETKRDTPLTNKRDNSRKGHKETTVSVGTSYHGTSTNSTTNHKQQQRNPQSDSTHGAHQPS

SEQ ID NO: 994234 - protein, 320 aa, Homo sapiens
HRPSDGPLLPLPPLDVARVVSAPISHVNSDEPEAVLYVCQGGRVDEHLLSKDVVVDEVVFRRNGTTTWMSPVLAPLMYNADPPACNPVLQKVRLSCWCQTVMWSTSPEYEEEMSKICMTYLLRTAFARSKDEKIFNIKATEHVISPMGSGLLHSWTGSAIGACSCPSTGSDWNDLLTTHRELWLVLMPAGENFTIHGRLQPDLEVLRVGKLVKNRTVDWALTAVHRRMEPLLEQRGIPPPVLSGAPNVESGPHSATVTMFLHDSDRGPNKPVSIEPISGPDKGPYQRVKPPRTRNPRPASDRLPATNPVSPHPFCPTPPP

SEQ ID NO: 994235 - protein, 270 aa, Homo sapiens
MTPVQRGGPGALVALGWGTEVCFRVRFRQWHPGAGGLRPCDWAGAVWPWSLAECKAEDRSGCPVTNVGARLVNDMKIKSLAVEIYLFSLPIKESEIIDFLLGASLKDEVPDRLCQCMKKTRAGQRNQVQGIVLLSGTTMATSVLGVKVLHRSVATDIRVGHHPGQDSPSSPCAKATGGTKIGKAQTVPCKVTWPLLALCWLRPNPVNPGVTGIISRTLCLKEAGHDGVVSIDWYTSERRVTCNHWGNLRQMAALMQFKNYKKLNPDTEGD

SEQ ID NO: 994236 - protein, 309 aa, Homo sapiens
VGEIHVKTLEEILLGKEPVRNVENCYTKLKTDGPCKILMISSFRSRNAPPLSVSKPSLRSWLKTNIGSRKQRDNKIAKSGYNVASQTSKVLEYLRIKENSINLPSTVVASESDNERAVLVKTKSMPEVHGYDSWLELKTGRRQLRVKKSSDEQQQVPDLKDEVTPEGEERLMRDAAIRTGDATEEKNLQRRTMHSPILQTQVIRKQKPIKKGSKVADHPGRLTSTKTFPCPRRWSQSRAKKQSNMRGQPCRETGTVQSSGHAHAGQNEALAKNPRWQRNQRSHDEAENHTGRPGVPTRHPKGRSPHGWT

SEQ ID NO: 994237 - protein, 33 aa, Homo sapiens
GRGRQDARAGSELDASGARRDSEMQAARSGRDA

SEQ ID NO: 994238 - protein, 115 aa, Homo sapiens
MVCGLLSLSLMCAKGMNYLVVVAPYNGETVGHGLDKSRTAERPQRILNKQTCMCHKEQGPCKEDRETDDTRGIRPVREGKLREPDYHKKEEMKEGGRGTEEYLRENHDPTRHVTP

SEQ ID NO: 994239 - protein, 81 aa, Homo sapiens
ATAQTRLRSYSCASLRFLRTFDNRYGCNEIESKLKKTETRENPLPSKETIEQESSGESNEACAAYALYIHKHAFLFTSFSC

SEQ ID NO: 994240 - protein, 97 aa, Homo sapiens
CPELPCGYCLTLLLLWALCPLPCHLECHSTYPHTQSLSYNENDIIDTYNNHRKRNTTKQNNTIPLNIIYKQQHTNHHYTHNQKIHNKNTENKKLHNK

SEQ ID NO: 994241 - protein, 430 aa, Homo sapiens
MLLEDEICCWSLLWSEDGRLLKSDCTSIVYATEKKQTKGGVTRRPGLYAGDTCNQYSKYEEPQGWNRRTLTNRRIHETANTDGHKREDAITTTMDEGTKEAESGIDAAVDGRIQQSKAALIDTETQTYNQKKPGQEVPRQHRTHPYIHTQNTHKNTPGPDDNTTLRNPMMIRDMTNRDTPYPGIHPIEESTWDDITKNGNQTTKTDIINDTGNNRNWDKKRQQISKANIGQPQEKQDEHHNETDKQTQNNRKHTKGQHQTKTETHRTHQMRKTTQLGQTTRGHHQHEKTHKETNRDVKRTRRKQKNKDKPQREGNHKTNSRRQRTTRTSKTKRQTKRHERAQKDENNKRKRTIKKRKNNEKKRRKQIRKATEDTKENKRRQRKNKQQQNELSIRYTKIAEQQIDRQEGDKKEKNTHPDVSSTGHGTGTRG

SEQ ID NO: 994242 - protein, 375 aa, Homo sapiens
MRTTSCERHAVQGDERDKGELVYTRLCAHACMLPFLSVHCSVHGSTMRAHGSQGHADNQRKSYGADRVDGGHTVSGDGRMRRGVLVTPGGPPMHHAIAPKTHRALARRNTEDPVWDSRNRPRLSQRVGTPEGHSERATGDAIDRRAVAPSCRRRGSHKRYTEVGQKGPDTLHAGYETVSHKVTALVVLFANGPLWGFCFSATVRVLVFGTTVGAHRRCDFMGREKSANFLCREDPKKLRAQRLGSKGGNTPFCITGQWAFSVPPVWNSPFDTPGWNAFAHPQKRIGIRRTPVGVGARSNAVGKWRWANDEQKTSEISGTKTPPKVGLKSNNPGAVPNGGPWFRADGQPWTCGSLIQGTSHEQLRLLTRWESQLGP

SEQ ID NO: 994243 - protein, 173 aa, Homo sapiens
MGPMSPGTEAISLPERGSIGPQDEASGPGKPPDPCTFVGAPASPGSSPLCIYTDLSQNWKVSPTPHLERGSPHVQMGQDPDTRAGRDGHENTSKPDPPRTQRSPIRNLTVGLPPQTDSGSQAPEKMRSMASGSENQEKHTYRSGILPCTFNTASNAITLIWNYLGKGGRREGA

SEQ ID NO: 994244 - protein, 52 aa, Homo sapiens
MERRNETEDRKATDTTNNNHQNEKGADMRSKNNMKGRSSTANNAIARTKEHE

SEQ ID NO: 994245 - protein, 71 aa, Homo sapiens
THASGHHPPAPPPWKRNHGLRFLFQSILISQISCHPIDHPHDHSRLMLCNHQCRKLELLEKSTVCSSMCGG

SEQ ID NO: 994246 - protein, 95 aa, Homo sapiens
MRITRLTRRSTTIQRRGVSDQGRIESAKVAKHQQDFTQHDGNTTKDALHVADRAEFAEQKAHNYHKRSTEEIKTTVMRTRRKRDSQRMEDYPHQR

SEQ ID NO: 994247 - protein, 241 aa, Homo sapiens
EIVFGSVARAGVQGHDLGSLGPPPLPGSGNSLLCPSPPGIAWDLQALHNVHVHNLIFVYFIDKDRVFAMFVAKRGSSNSPVGPQGDSAHLTASPKQCWGFLGIKATRVPRAQRYSPIFFCGLVQVCKKALQQNMKYMVALTLKHVRDKTPHIFILPGVPHKSPVWEERLTTQVIIYTLVNVVGCAKTNLSKVILHLKCWPEGQTLCVSHKLHHKWVEKPLHEVGAKGILTKKKTKRTQTNF

SEQ ID NO: 994248 - protein, 137 aa, Homo sapiens
MVPRLECSGVISARYNLHLPAACLCLPKCRDCSLCPDATPIWEVEAPVHPSWTNHIVQGPSERTHRQAMGKPRRQGRSGGSRRTGPGPTDHRFSSQPDANTHSTPRRTINHGEENNRDQSRDKTPMTRQTEGDTQRN

SEQ ID NO: 994249 - protein, 136 aa, Homo sapiens
DKELLLTNTEVLCPQHTCVWRSCGIDVIVQLTCFLLSIGYYTRIGAKKVHDTEIIMDRLGRYYFHNYSEIPTKYCASAWIHVAPTAQRRNPNVSSDNRCRSLPTRLFSLSHGASATLRASYFSHFASLVLFMIVGT

SEQ ID NO: 994250 - protein, 134 aa, Homo sapiens
HEDSTNRRRLSELAALSYSPSTGRCSMTLSAQSMFLAMQGDTEVHLLHHCADEQQSSVANSASRATPQLRAHAAPSARCAPTIDPHARPLHELLLLSVTPSPAPFALAHRTPWLLYPLPQSPSAILPALPPQHN

SEQ ID NO: 994251 - protein, 302 aa, Homo sapiens
MYPALEGGRRGSIRILMQRTPPAWHNGRLTGHTMPFTTGDYCTPPYNQPALTHHCPDSLAPHHSPPTPTQPPIPPDPPPLPTLSTPPGIPSSHTTTMSPQLPHPPPPPLPHHSHSSHTRLSIHTHTTTPPRPPPPTPHTNHLTHKSIPYPQPLNNQHAYSSLLITPPHPLNPINTNMPPTLIPPKQPTSPPTHPTHSTPTPHHHANNNIYHHPHLSTHHLPRHYPTNNIHSHHSPTHHHTTATHTPYTTKHSTLPQLSSPIKLHHPHTPLTHPPLDLSTTSSPAPLYYHSPTPKHTPHTNNT

SEQ ID NO: 994252 - protein, 348 aa, Homo sapiens
ACCCLTVPARDCLLDPRAPSPDPDRPPGCHAIPGFYSSGHPWMATGGPASLAHAGCSCGRVVQLQAGWLTGQLFLEVIDCLHARLWGPDTGDTVNIRAGCILQVDHSYSESRTCAQQNYIFRLSWLTLVDTASKDGEMQQRIYIDGKDVTLIGPSWSLFDALLHMQRLGADHTGRSNTFALVTGHQLTPDLKQRRDGSVQAQAITFAPVCSTCNPREVPQPLILQRFGTRAAQPVHRLLSAPPWLAKQRDAACSMDASTKVLPHPYSNKTLLTNYIITHNNKFDNLLNKSHPSNTNYNFQQHNATYRIAYITPLNYALTQIISPTNHLTTTNSTDYYLLNHTHHTTTN

SEQ ID NO: 994253 - protein, 82 aa, Homo sapiens
SGTYMSKQSGGEGGIIINYVIFTRTHARCTAVRLIVLQSMAYLDSHAQQPWAANLMNSGVRLNADLSRSLSNMKHPLNHLLT

SEQ ID NO: 994254 - protein, 574 aa, Homo sapiens
MTTDYVSMYALDDSGRGDPREELLQYCRNGDSSGDNGWYRHRVGEVSQQAPGIRRMRENVATAGRRDSRTGIAERQRREYSAHTDDTAGLSKVYYSKCSDYVLAVMRRYSYFFFQSKRGPFQNWTLTGDTLFRRVTPKGDRCNTCEEQVEVDPKDGFSNSLEPAEVTRHAYPRWCTAYGRRSFSNVLFYTASSLGLSRITRREHLNWFLGPYTLGAPIRSPRIPRIGTRTNSNISFGNAGPCPNVHMEGQRYTHVLHLPGGENRASFAKLTHSLTYIALAYSGRVEKRVAKGRTHLRSHFLAPQGAHQRHAMGQRARCSRDRFGELIALGSPINGLAWSTRLRILGPQNTHAFTLPKRYGTSWRTHLDHSSGHLVRWTRDTERDVRHEQRCFVCIRPSIPTRSSDMLTLELYPLTHPTTRATRARATQKYPFEHDTYPQRSNSDVNMNYTETLWKRHHRRGQASGRSQTTHMTSRTGPRNDTHAIHETHSQTRDASSATPAGKHAAGAGTNNHTQEGRQHSTQKNTEQQQLAESSNHTDTKTKRHTAEQLQRTEEDHSRGGTQMLVSSHNTRTA

SEQ ID NO: 994255 - protein, 118 aa, Homo sapiens
TRRSCSVAQTRVRWCDLSSLQPLPPGFKQFSCLSLPVYRMYRMKRSQVRTPIRRLIRNVNLDWEDSMALGCTTVIERGTLRRLKRATLNTFLDSPVHVLLVMPKLIPEHWEKWEDVKR

SEQ ID NO: 994256 - protein, 152 aa, Homo sapiens
MESAKKRPLTFFTAKCVDRLINSRPPPNRGPGSSFVSPLDGSDMGCILIGNLLGVPPHPGKTDFWANYSRKHPRRLYNVVPLEDFNGVDHLNALEQKDESFSGPETSVYVGVAQMIFTVGQFGPHAQGKASLAPLLGQTTLSLNLQGKDLLC

SEQ ID NO: 994257 - protein, 163 aa, Homo sapiens
MSYPHRRGGPPPTKMRRKPLTTFKTKGPSTPHEAAVAAYTTNHAARRSISAIHNNGDNHVGKNTPLDRTKDTAPPYQPDEEEEHAQHKVARAKHHPPLDDRRTDTALQRGEHISPTAVNEASETKRGGIYHHTRDDIMSFSDAGRRKNVSPPHRNYKHENKIL

SEQ ID NO: 994258 - protein, 250 aa, Homo sapiens
MCGYTVCGYPKTKQQHTDTHTHTHNTHNTTNTTKQQEREGAARAPSRHTSLCASGARAPRPHERAPRPPSLVKHTRARALTQVRGRATAQTNNKTALLAERRARAPDQARPHTRPRAQPGVHNNTTGRTTRGATSLRASPRAPPLHHINIAAGGAVTPPPPTRTQPHSPPPPAPFYNKRHLRRQHKQSLSTKLSYKRLCPTTRGAYSPPPKPHDTPSPTPPLNHKQHSSPPHTDTSTARPPQTNDPNYQP

SEQ ID NO: 994259 - protein, 252 aa, Homo sapiens
TPQGQEGGQNGPGEEWRVTSMPRSDMYARKGYCTKRTVLAAQLRSNGRNRYHTIRRRVLDNRDYRNAVVLRDTRSGAYPGDELNIIAQNCRSNISPYVHRLIAVGKTCLQDHRDAKEPRIRLRHGDREHVSGRPKTLTHTRQRGDRSPVGETEEADNANSRPAAGEADRRAEERKHRGEGKDVGAIKHEEESTITAYRRGPRVDVYSYSLATLPSIPTRGLIPSRNRQPENNQPAHKGQTVGKAPSRAQRIT

SEQ ID NO: 994260 - protein, 384 aa, Homo sapiens
IYLKHSKNKKIGTLVEIQWHKVHCHKLAGTLYSKKATKSTEHHNRTKQNSPVPQHCLHINFTCPNRPFTNIHGQYNCSTIHNTSISSHSTSHNCYSTSQHTHRVIFTHATHNTNTTTGTWHKPYNHPPSTPSAGSPRPEALSLPIFPPTTLNPTIHVHGQDSRSHHIPSRRHPLRIPPPYTWTPDAHFPLPPKKSEHIAQAATCATHIPQFNCGKTHPVLDRAIAQGSVHHSPHVIFNASSINPFLVVPTERPAHSQQQGMQNNPTRAPSVSSPHKGTIHPHKGDNRDTYPAPHPTIHTCPLYSPLLTTHSLNPYSQRGYSYPTTLLAPPPNEFLHPLQRLYKHTPKLTPPPIYSLHTTLSSTPTATSLLNHQFTTSHTLTHAP

SEQ ID NO: 994261 - protein, 371 aa, Homo sapiens
QSFWMSYGKEPLYRATDPRREGAEGSRHGVQGRDSGLQLKECPRLRIFIALQMCSQLLVCLPCLHLLLILLSSHTGCHMESLYNVLHEGTNIRRGPEPGCRSYAIRTHGQGDIGPSYTHSQPLIPLTCSPIAVAVNDVMTDMTARISMADAHVLFPMSWVACMHPCLRKTPERICTTRRLHHTNQTLQQTMWQVLQAASVRKLVTRSSEQHLALTLSNHSSIGNCTAGIMNMAIPALTTHTRSLPHVRTRSMHSSGLSTTLPTYNTPPPYTLYFYHNLITHFSHKLDSTPMSTLTIFLNCPAIFPSTPTLFYSPTPPLHPPSPSLPPHDPSPTHPHPPHPAYRPIIYPPPTPSPPTTHRTPTPQPTTTSPH

SEQ ID NO: 994262 - protein, 379 aa, Homo sapiens
MQALLARRGLLQSCGCELRRRATIMPGALTVTGFGCVVTNRFDQLFELTNRDPFEVLNGSREQEQKKPAVGAALLVALGANERTLSAAAQTHTPTAAGNTAAQGSPMKDLQTNPLPAHALAWLHTDKRSTAAALWRLNNSKAYSTSLARKTCSTTSVVACATHSFDYDRPRNKGDHTFVHLTRSLNHALTLHTETTLRLNAQRSNSSRLHLSSALLCAEPTLDRSVSCHSLRQHVSGVSGPALTDDTLGPLRRSATIAFIQRHTPSPLARAYHVTPDMKSYIYHDSPLRPYTPRYLSDALVSAEEPLSSWWRPFLNAGLTLICLATTSEHSHTRRTTCETSDHAYLLPHPSQYAAHIHRDVRATAQPPAPPVGPRAGVR

SEQ ID NO: 994263 - protein, 138 aa, Homo sapiens
MLCHISRNLLEGERGGARAGRRRVRRHCKEETHREEKQAARRAHGRRRGEKSGHKAIKTNGERTPPATQRACPAPLTHDVVGNSQRGRGAWKTTEGTRKMHTQTTNEHNKRKRTREDTQQPNAAKKNNSRKKQQRRRQ

SEQ ID NO: 994264 - protein, 127 aa, Homo sapiens
IIISSAPVCLRQRDLKSLIAYSSISHIALVDIQPFSSRTPMYSFYRTTDHVSIESAHRYFTIAQLSILALWQNSRASERTSQSHHNPRLKDFKLYSQLSSFLMTSSKPRLTSTLPPTINLLVQNSLC

SEQ ID NO: 994265 - protein, 102 aa, Homo sapiens
MPPGGHRPLWDRRAPIWKELYIKTEARARRVITKPACSEEKQALLAGNLLGKRATLQSVGGGTTHVGTNTTSTRYGTPPTEEHNTTVTTVIWCANTPPTQFD

SEQ ID NO: 994266 - protein, 110 aa, Homo sapiens
MLRRDFNFAVGRRFDEPSVRKVASFTTSQRTGPETVERSKRFEGSRQEITGRTQNHASVKEFLSFIQKITQHTHYNITITGVQCARSWPITKLNVNSKYEARFEKHAYTT

SEQ ID NO: 994267 - protein, 104 aa, Homo sapiens
MSLRDRGSVLELAGAVVSAMPKAKGKTLEAEVGYSVNAKASVNRNARRKVAPWIECSHIRHAWDHAKSGTGENRGRRWGWMWRPEQGGAHIRYRAKVKAHGGGR

SEQ ID NO: 994268 - protein, 431 aa, Homo sapiens
MMKMVFLKNLPSKNPHVSKGSRETPPRLCASHGHVCSYAIILQRMDTSSGLKLGHKHGTTRTQRLHTHKHCTRMQHSTKPRAHTLHNCAQTAPTPLNHSSAHTSLLPPKHSRLDAPTTRHTHTLQAPATADTQTFHHTIRTRHTVAHAKHRLKHDTTLAPHLRTGPNATRTRTPHQLNHTPAAHSSQLHMHLPAPHQACHATLRNTHNHHTTMYRDRTPTPQHPHARHHRLTHPHDPATTSSAPHTAPCSPHPPQAAAPHTATNPTTPPTHMRPPGPPRQRDTPTPGKNATSPPHSKLPPPHNARHNHHQGTASPTTAAAHHTHPPPPTHPHQPPPPLHRTRHRAPQTDPNLTNARLFKPWINNPHPIDASTHPTGRPPIHTPNTPSGRQHAHSHLSTVLSRRCLHHKATNHADRSTKQVEHTNHAPSHDT

SEQ ID NO: 994269 - protein, 319 aa, Homo sapiens
PLAVTRHEAGCGCFAEPPWPARCPGLRACGFSRQLQLSDSGSSPASELRRIRARWTSTRSILAVPDLHEAVPGLRISELLVNKTSFMYLRQELPVRLANIMTELSLLPDESSQDTIRSNWYKAGLSRVFRSFLILRTKSAEAATRYSMTFTRYCDTDQKPTPLHVIPTMAQGVIDYQESSWGADPVTSPQCPTYFSCDRFYMSRISIYECYSIPDTPSMARVRTTAPQGSFHTSIAHTPLSRHNSQTDIVLARYTPTASRTTVHPPLPGHRNSSLHSSRNIDLASSIKRTIPPERAHYHSRLPSPNAPSRNMRLHTSTQ

SEQ ID NO: 994270 - protein, 345 aa, Homo sapiens
KTCSIWWCALCTVTLNPQGLDFVQYKLAEQICETRPRTQWPLTMNAAFPIAACGIRASGSSTPEWRDLILCSSTLTSVLTLLPFYPTFHGRDTGFGRLSAGCYGYPSTRHSQTCEQPHDNFTNNACQRHDPSLRCYHPAPVDTMETDQEIHRYMASHHGMALRLAQILKHGSTVSRMLTSHPYLLMHITLEVVMRTCPTLNQLPTPSASRNHCLTFLTPNEDYSTPQSPPSHTASRDRLRLLHTPSTPVLRHHVRTPLNTPYAPTGQTSLLYLMPASCESAHPIHPTNHKKWTAKHEPVTYQGHLHQHTLDITQQHLPSSALPETMARYVPLHAYKQRNRVKPLA

SEQ ID NO: 994271 - protein, 212 aa, Homo sapiens
MQPFPVNQRLKFVKLGGIPIVCKQNQPIPNPEVLQAGNAFKCTKKPECECRNIQSRYTIYISQVCEDVFSVFLLNSAVQLAGLTLLTNMTVTNDHQQHASPVTFTDLFQVLLTGHMETRKVQVLKTAFELWSEYPAHEPEGNLLRCPKWISSIPFYPFIAQATIGHTGTHLYFADTSRLYTRSNSRTALTNTKGHLSLVQALPIPLERYTGS

SEQ ID NO: 994272 - protein, 250 aa, Homo sapiens
LGEGVTIQLLVWRHEKALAYALPGPILCEVMEGQVLAFTWVSLGQPGEGHRCEATPPSPTQHGNTRTGDGNQAKGSTGTSDEQTTTQKTKTTTQKQRRGERTHTETHTTTQQNPPTKHTATALDITYAITTTTQEMKNTDTGTTRDPELVKRQRREEEHGAAGESSRPRRKREQNTDSVQTPTAPETTSDTKQKRTQEGADAPPHNTTKDRDPRHEQTREHKQQTHHAHQTTQIPHNNSHPPEAATQAKQ

SEQ ID NO: 994273 - protein, 228 aa, Homo sapiens
ASSYSLLQPLSLSLNHFLLSTLQSLPSLNFNSFHFLGETKETRFIHGPKTPAPVTDWEGSLPLVFNHCRDASLIIYPHFKGVRPRRDTCLGPSLLAASPAFLGKGQVPQPLLSLSLPLLWFPGAGASTPTPSPSPLATSSAFLGQGQVPLNPFSFTLAAKSRFPRGQEPPQIAYFRTPTSYLCAPIPYFRTMTLISVPQSLISVPKPFSAFLEGKDPLPRSPCLYSCW

SEQ ID NO: 994274 - protein, 299 aa, Homo sapiens
NFNSFHFPVETKETCFIRGPKTPAPVTDWESSLPWCLIMQGCLSDYSPTFQRYQTTQGRLPWSFTLSGKSHFSGEGASTPTPSLLVSTPSLLFWGRGKYPNPFSPCLYPFSAFLGKGQVLQPLLSLSLPLLCFSGEGASTPSPFSPCLYPFSAFLGEGQVPLKPFFLNLSGKSRFPGAGSSTPQPFSFTFSGKSAFLGEEQGTPQKPFSFHPLVNKVLALLGGKKPPIPLFSNTKLLSSDALIHYVPGAPKPHSQAFKEGIETAGAHDYKCIGPIIRDANHQRQLPHSKFSLYLSTVYN

SEQ ID NO: 994275 - protein, 260 aa, Homo sapiens
ISGSMTILFLQLSKLACNVSRVGSRTGDERRIGWMADSEMNGDVGQRSTASETHFDGMKLTRSDGYEMKALPREQSEGEMTKNVDKQGEKDEDNKEGEIKRTTTIKRRRTKENRQKRHTKKCNIRAERKNAKRVRQKTEIDVHTNGARHGSRLTPTSPQLTNQVPGKRRTRSNQPEETMSQQINAQDRKKTPRTKKHKKTGTQGILGHRTHGRDPHTEHNTEGPKYERNKTSKEKEKTSKEWQKQETTKNQQRNEKRRKN

SEQ ID NO: 994276 - protein, 147 aa, Homo sapiens
MACAPSAVNQAAPHQQNRIWEREPAPLLSAQYETLSDSDDWTAQSEGNRCREGSLVFGGFFLVAVQKLRLLCTYSLETFQGETGPQDDEEMYGQFTLAQSQWRKKTNKKNVLWIHGPFTWTHYYRWEGLEHVEDFSKVDRLPVLTFC

SEQ ID NO: 994277 - protein, 109 aa, Homo sapiens
MAFLMLTERKILGYIQLRKGPNVVGPYGLLQPFADAIKLFTKEPLKPAIYHHLYITARLESHIVFYMKPPSHTNPWSKLKLGSYLFYGTLELEFTQSSDQGERSNSNTP

SEQ ID NO: 994278 - protein, 112 aa, Homo sapiens
HVIMYLYYGLSAFGPVAQPYLWWKKHMTAIQLIQIVLVSLHISQYYFMSSCNYQYPVIYSPHLDVWHIFFMLFSNFWLLTLYTKGKRLARALQAKWNSRLLAQSRQLEKPLP

SEQ ID NO: 994279 - protein, 102 aa, Homo sapiens
KTIDDLEDKLKCTKEEHLCTQRMLDQTLLDLNEMENAPVPPCCCSPSDQTSAEGSWGKVNFNWRVGIFNWKGGFFFNNPFFPGVLFRQTGLLCFLPGKSNWA

SEQ ID NO: 994280 - protein, 149 aa, Homo sapiens
MEIMDSKRKPKSNAEKGVQAVFSLPQLKSRRRAWATWVPHRPPALLPPPTATLGSPGAAKEFALITERGEPPKFRATLGRSLSVFWKAMGPKEPGQLAARERPGWGLGLPPVRNLQGGLFSVFQKEETREVRGESLAWKALLLASPARK

SEQ ID NO: 994281 - protein, 67 aa, Homo sapiens
LIWMYGTIFFMLGSNFWYHSYTKGKRLPLHFSKMELQVLQGQATESMANEAPTNAQMDLGGQSVPLN

SEQ ID NO: 994282 - protein, 289 aa, Homo sapiens
MPDPGPASLDGEGATSPLLELAMGVWEGLVLRPRTMQNRQDFTEQVPCPSGPWGLLRPEKGHWRPGRKCRVISVLDLRLLQGEKLPNGGPGGGSQLCCLTVESPSRILLNQLLKGLVLPADFSETFLKHAYGDEATVEFRRSVRLNGQITDPYTHKGAGAIPLKEEGDWQNLNRLLAHLSPERSISSVLQGRSRDDEPSEGLRLKGAATLWRSTIQKTWCQCQQLGTVKMLEGTRDDAADRLEISIAAYKRKQRQETNKAEGGDTRTSVGTKQQKLKRSDKTRQRAKHP

SEQ ID NO: 994283 - protein, 406 aa, Homo sapiens
MRAVNNNTEEAIYFEEERENSSITSHASEEQTHKRRGQQNQKSTKTDKHLKESTYTEEQNNLTKETSKQKEGIYSCGVITKNKQQQNKKNKKKSTKTEHKRQNPEHKYNNKYDRKQPCNITEAGRPTSTTINTATRRKHSREQRRSTQGTHEENNKQRRGRTQPTDTTEHTTRRLRRKRRRKERRETAEREKKERKRQKKREKNKRRLETEKEMRKRHGKDNKNRKEKRTDEAKKNKKAGERAAKEEDTRSKNTGRRAEIERGKKKDGRGGRADVNEEDKRALERREKGYTESERDTEDDKRKEAKKEKRRKADLRRDADTYQRYRRRRERNEERTVTARRRRERDSRRRRGGTPRTRESEEDRKGERKGEEKRKRESGKKRGGVTRETETRKEEKRSRELSRGRM

SEQ ID NO: 994284 - protein, 94 aa, Homo sapiens
MNTPPYQQYTATSQQQGTHEETPSCSNYEYTQCTHHRDTKTCEPVHERSKRYYTKTQRIMHRAEHLLSKQHLRHLTPNIMNTKSQTNHNSKYLS

SEQ ID NO: 994285 - protein, 235 aa, Homo sapiens
MLDKGDRGVRPVVSYSRGLSWKSTQIVPSRLAKPPLDEAEREEDGRLLRKPGCEHTGHRSLAVPSAAAVAAHPVWFETSITEIWQQWEAAQSQQGQEPDCVGQSHRAAPSKLKPEDAFVDFCIIAWTRLTKDTYRVRFLYREQQLGCGRQHLILRQIVDDLESPDEPIAHQPWHGRRILEVLLVLADGLVSRGEPGAGKEYRRDIELLYKQKDGSIEWEAEPGPGRPDEGLNVEL

SEQ ID NO: 994286 - protein, 155 aa, Homo sapiens
MTDPDTQPVVNGYTPRPEGHEAYNCWLETIRWAPGPYSNSMYGYQEQAMSPGDSGATPSRREGAETSKGQGTRHSEYRQPRRDEWNVCQTGGQQTVDLRPPEEGGREHRKRITEERRRRAAHKKKHESTNKRQQRPVHSRRREGNNERKGKAPER

SEQ ID NO: 994287 - protein, 147 aa, Homo sapiens
DAWAKKKGHPGREQKKHHHHHHQQMQQAPAPVPHAAGEPAGNNDGTEETQNNSIKRDKNKKKTNTNKDTTYKIEQNLQCESTLKPPSAITTSDQQANIEANIYKTYVQESETEYDTTKETDSEDRATDHLTNANIFIIDVERERERA

SEQ ID NO: 994288 - protein, 163 aa, Homo sapiens
MCAVKVFKAGSCLPLTFFPPDKLIEVATISVISHRIVLYHYACCDYNSIIVACLDHLIYIKTRTYYILNLLSSTLDKNERRPRNNGTNPARGRPKPPKQKALTDPKQHLLANQPRPTAPTHRTPRSTHTTTARPHTTLPRPYPKPPLNNSQDTPLARTNSSRL

SEQ ID NO: 994289 - protein, 312 aa, Homo sapiens
MKKETQSTELRNKPTVNFSPESDRIDEMEFEIKLLREACKASRLVSAKLTQINREGSPDTNRIHSLEEQVAQLQGECLGYQCRVEEAFTFLVDLNRYCQTKLKSSNTNCRTWFNMIQEVRKAVLTSFRGIGGTASLEEGPQHLTVLQLKRELKKCQCVLAADEVLFNQKELEVTRTDRTPSARLMAHGTPNGHAVSRQNGANTRDLDRNMTTLTKQPTLAAHMTEELPHLTATAPTAPNPRQWPIHRPESRPTRTPTPMAHKITHDTDSARPPTRQHHERQAHTNNQHRTQRQRTQHPQPQHAHHNTQQQTH

SEQ ID NO: 994290 - protein, 85 aa, Homo sapiens
RSWNLYGHNGTQKATRICRRLAVQQCVTIRVWSCAAHVVVRDTTGMSSQVNSFRALPTSRDTELHAGPAARKQRDPRQARADSMR

SEQ ID NO: 994291 - protein, 98 aa, Homo sapiens
VHELAICDWRSRLQLLGLSLASQWRQDEASGSLRCYDHLHSDQQLTRGQGVQLIIMRATIIDDHMLLSQLMISHQVRLISSALSQSSVSQLITCVIIV

SEQ ID NO: 994292 - protein, 95 aa, Homo sapiens
LSNTDVPVSRVVDDNITICETAEAGGMPLDSSIDIELVLHELNTSRTVALTRLRSSRISSTYSHSTSSTRLTRLIVNYLTRLDKLVLVARLVDTY

SEQ ID NO: 994293 - protein, 63 aa, Homo sapiens
WRDYEELGQPIARAVIASEDAGFVEHSGVEWDAIEKAWERNQRAEAVAERRNEQLERRQQQAL

SEQ ID NO: 994294 - protein, 209 aa, Homo sapiens
IYSRLHITIVSRARCCISTSRWCSRYVKVRYVQRLKSYVIQSSDRSNTASVSIYCKFLPVRKDKRNKATSQSAVRPVNDIISTKHYTHTHPRTGYVKMAEPGKSHKNLIKIKDKQNAPQEKITNNEGRRSITSNSPTAAPYSYQATTDGYVNKTPGPKNETPQIPQPQGTTAYNNERYKENTSTTYYLSTHPHLGEPHGDPPQKLLRAP

SEQ ID NO: 994295 - protein, 179 aa, Homo sapiens
MQSHAGTTITNIHTNKRANHSHSRTPQHHDATKQNERIYQTLDVLQKTHTQATTLTLITSTNHHIHYDTHLTRERTTPTLSRTPSPREDRTHILPAPHASPPRTHPEDDRNTETQATHGQLNIEYEPSYAGATRRTAKTVEETTLTRKHRENSATYNTPNNHDGTHSDITTKSTKAHRT

SEQ ID NO: 994296 - protein, 255 aa, Homo sapiens
MALWGGLGLSCREGMSRRAPGSRLSSGGTNYFAELGMTGNPELIVHQLTQVIKNILHPEIEVPLPLTDCNLKIQLLVTRQRHDDTRVHADIQNDEKGGYSVKEDLGKILMVGSRETRDEGKNVTSLSSTVFSMESCLNTKERRNQGEIEVYVMSLEDKIYLPRHHPGTEKQLEDGQAKPVTECNQTTEKKGPKQHGTTAAHLRLTNKTAKTTNKEAQEHRTRTTANTRINDHEKNKQIANPGQHTSAHRHYGNTT

SEQ ID NO: 994297 - protein, 168 aa, Homo sapiens
MQRFLQCPDASQLHDTWYVLSGHPSGPVESPHQMRRNVGVVELHNSHNGPSVSPTASDIAAHEDGTRDAWSAFVQRRYGTAVRCGAHNKELRAPCAQNLFAITDEGMDVPLGLWMRSGLPTSVSTTTLSAANCKPRPDVRHYTQVVWAKTERIGCGSHFCEKLQGVRR

SEQ ID NO: 994298 - protein, 121 aa, Homo sapiens
ILISQNQRYSRERESMNRLESLEESGGCSCVDNRLQPSQVALLFQAPVEDDHIPGISVVQGNVTVGYHSRGVAASGPCSEDPCTGTVMLENYSPPLSQVGYGIPKTRSDSQVGERRGASGY

SEQ ID NO: 994299 - protein, 311 aa, Homo sapiens
SPCDDKPVEKFCSTNIAIAILIKHTECFSNAKDGDGTITAKDVECKESIGMKKKIRRPAGTYTPTAKGRTAHTPRNTAQRSARTQHRHTQPPNTTTQTPPPGDRTPHTTNRAHKHHPPPHNTQTHTHNQDGAATANAHAPPRHPQHQPRDAHDERADTHPSDEPQGSPSRGARPNRQTRHPPETRSDETTQPRPATTDTARHDRTRARRHTGTPKTPDYRKDRGTNDRPPTDAEAAPTAAPTTKRHTRGQHDRDNNSNDGDANNGRDTPPGHTNPPPHPPPRAQTTQRRARAPDTKTAQKNEQNARTHAHD

SEQ ID NO: 994300 - protein, 145 aa, Homo sapiens
SPTMCSLMGRGFFRFLIKHLIDAVRNCLNLPCKVVNTISMFFRCFQIFFQKNSVKYFNKRKAMWNFRLACLNCSRHPHNPAILFWLSISHSIFSVFCPFDISLWLYCSQSRLLCGYTYAQNCFLIHSMSIFSKSICGGKLKLLWY

SEQ ID NO: 994301 - protein, 80 aa, Homo sapiens
LDYEKENEMMKSHVVDQAINNAINYLGEKTLNPYTTTDRRNREKTENHDKERHIIVQHNTDTQRKQEDTKIKQEKPSDVF

SEQ ID NO: 994302 - protein, 438 aa, Homo sapiens
PYGRDSSTRWKSIWTTGGSFRGLQGSRHTPPYPGPHPAGPPDHTACQQHHMFVAPPPKTQRASSLRGTTESTLKDSVRSPTALASGIRHWPLEDATSICRTTRRAAIPSHWLKSTRGPNQHGRCPLDAFEICCSGTTSTFDKQYNLEQCLHHIHSRLSFSILASHSSSAGSVAHNSLTALDGTAGTNKERINNTYASTPVQSHKAHILKILPGNTLSLIQEPTLPTIAFSFHTPRLAPFNQNHTTTEILRGIFMLAHARYYQTTGSTNVGNKKHNTHNQTNANKPANKARRKTNEKPKTKPHTPGQTTQRHIATHPSNQRRYRKQPTTIHTPTTPTTQTKHTTPHTKLQRETKKTEHTRARTSDRTEGRHTEKQTTGQADHPGITTPDQTPPEARTKTARTEGRHSTPKQPHRQMRKINEHGKINHQNEQHAHLPTDA

SEQ ID NO: 994303 - protein, 536 aa, Homo sapiens
MCSHDNTSRLHEATGESILCTSDIPKNSIGEHNKNAGTPTMPCDNILSKLLLTSTYLLVSSTRGSYTITDLLHEHGSCATYHMRGYQGGGPPIHHEYIRDRITHQYNTATDRITAAPYNTVIYICTKSTYMSDDTFTQNTREQNSTIYEESIPTDTSRFSTPSRHNQSQTDSITITYHSIIKRTQSRSPTEPLRKNNIHTQTAISLPRRNHSKRHKEHTTTINNYAATTSTNTGRNTRHWDTLSIKAEQDTDTTYSHSQRHNEKTATKQADTSTKYYIDSHKLNRHVKKSVIYTVGDRNKEQTKRIINNHRNGRPKKRDNTKSEDRKQYSTVVTQQEADKNYHQTTQREEMNTRENSSGQTRDTAQHHTETRETNENDRIKQQQEEKGEQQTRHTHRERNEKETNEQNKANGRQRENQRSRRTQTRQPETELGTDKRRRPQEGNKEDRRARQDTNGRTTEEEQRTRIERRTAKRTVNEQRTNSDGTSTTTQSAYRKHAAVKRRLRKGTDHGTKTHQDRERVNKENRREEKQKMKRT

SEQ ID NO: 994304 - protein, 402 aa, Homo sapiens
CFGPTAEAAQLESSKRFAKEFMDRHGIPTAQWKAFTKPEEACRLHFECRLPCLWYVKASGLAAGKGVIVAKSKRRGLHRLYKSIMHGAKPYGAAGRHQLSIDRTSLTAHSRVSLSVFHLDGKTVAPMPQNRTITRLLAGQMVALTTEGKWRALIVTATYTDFYMHLLNYNITSIHDPISTDTVRIGSCQPQAGYIAIITAIITSYCLRNTLLDTQSTHWTPNNASSTVHTFGPCIGLKSSNLPEGEYHPTSFLNKVDSSAELFDIQHASPSTTRHLESVPKSSMAELGIRTKRHTGTKHRSYLGPTRKKSDINTMCEQTKSPKGALSQHSNHRHAPVRRPHNPLQRRVNNAPTAPGTNDRTHMDGTDNTQKRSDNNTMERRQQTTRQHSSTTGDGQATTKNT

SEQ ID NO: 994305 - protein, 526 aa, Homo sapiens
LLSPRTPPSMEQRRVTDFFARRRPGTYRKIASGPKTGRMETRRPVSEHNKTDSTIREQVAATNSVEIPRTARGTQRRSIHKKKGRPKKHRQKTKKKTNHKQQTTKKKKQTNTKHNTQTNTQQTTKRRRNQNTRNQRRRRTMNEREEQTQQRTAKTRDKEKTEEETEQNKKNKTQAKEKPTRQERREKRRRRAQRRTHRAEENTKDRPKGPQTTESHTATARTQTQDTGKASGDRNATPRQRNDKTNQRKATATSETRDERRHKTTAEGHDDDETTEDNNRRKKPPQQPRSGERQARSSDKERRQHKNRNKRDTRTERAAKKREHNSTTHQQTKRDAKQDEKKKTKKKKKQHAPTHKDDDTRRGRHCTKTTDHHHSSHKQHMRGQATTRHHNKEQKDKNNAPKAATEKRNTERRTQTERDQRRHGEETEAEERKDRKQQGRHRTQHTQTKQTEPTQPHRSTTQRTEETGKEPETRDNRQHASQNTNNKKHTTRKRTENKAKTTRDRKNNKQRKKHTHNRQKKERERR

SEQ ID NO: 994306 - protein, 297 aa, Homo sapiens
MIELSYQQRSHVTHEESTSVCRALAQSRRQEENRARDRYIRGRQVQWPRFMSPGDKGLVNRQRERLGLHEESGQTVCHGDRVTPTIMSLAELTNTSGRSVTTRPLRTDEENILRAGLLDDVQEEQNDLRNNAASGVGSLNMGPFGKDRFTSDLQDTWQKAQENPQAIDNHPRAYQMWKGPATERQHGTPKAWRPQTGPEKARDGLTEPLDPHDEQRDNTLPRPGAQREAGTKPRYRHQTCLPTTNTRGLRTPAEHQKIDRTEANQEKKDNRRTNPQADYRRKEHQQRGGTKQRDENK

SEQ ID NO: 994307 - protein, 162 aa, Homo sapiens
MANGLQGERNRQVKAYLPTRTNNLGHPTNVPGQTAEQHTMAYQMNGHAYQRQTMMGAPPGHQNTTRHQGNHRKRRKRHTDNSDTEEKSTQKEDREQKTGDRKQDRITNNAAPSSKTQRRTRSRNTANEEPQENKRDAEREPREKTTKKTNTEAMTEDTTPDK

SEQ ID NO: 994308 - protein, 251 aa, Homo sapiens
NKIGTRSKRNSSRESCEGKVTFTYAFRHCPVPFGRSALACVEVVRFLSVRGVKHDLPPARALSVSNELKNTPADAGRQLKQDLAYLCAPNRHLAEHSPYYEAMTEVKDTEVLFCFEQFDELTLCTFVEFDKKKLISVETDIVVDHYKEEKVLRTGTQHASAYHEKETEELMAWMRNVLGSPCTKRRRLTLRLDTHPEHGHRAGDGGCRHFLRMQKYDKNQEELARSEDHAGDKARKRLIKKLNQLRQANLT

SEQ ID NO: 994309 - protein, 114 aa, Homo sapiens
RCLRITWRGHSRDSPCFLPCAGRVTSADLVQCPLTWLLAAPCSWDLRAQGPLTLHLGREHKALKSFLFFFYFFGNTVSPLFAQAVELQLGTIFGFTCNLPPPGFQAVLHTFRPP

SEQ ID NO: 994310 - protein, 109 aa, Homo sapiens
PVILTGWNFLILVVLFISRDPVLLGFPAGRECAYLHFPEVLVVRYPDSQISSSLPCCASLRLSFREECDAAIHLQSLCTSKQTNRDPNTPQQAYVRELAPMLAQPDEFR

SEQ ID NO: 994311 - protein, 171 aa, Homo sapiens
MFLCARWSTTREFFSVVYNHKTRGGPPQNEWAQPRALYIIHPPQGPRAVGRPAAVIFNHQRSAATRSRWGGGHNTPGVGLPCVGTSTHLLSGRRDRRGPPPHHHPRAGGGGGADTHTHAGRATPPTSLPRPARHIQTRRRLPAGAEHTHPTIWPRGGTNSGGQTPPRGHNH

SEQ ID NO: 994312 - protein, 120 aa, Homo sapiens
MGGVCAHRERGREPPLSLFLLERHRLCITSSVTNTPPLYCVGEVSLYRDGNPPARAQAGVGVFPSPRGGLLCKRSVLCAPRQYRGYLLSATGGRPPRSTGPRPLPLARHNTLLRPHPGQM

SEQ ID NO: 994313 - protein, 90 aa, Homo sapiens
LLSTATPTFSFVLVCQLQKNFQIRILSEGPEYNEYWGKQDRQETSRMHTARHYYRTHARYTDKSVETATTAESKLEREKKQRTQDTPDMT

SEQ ID NO: 994314 - protein, 189 aa, Homo sapiens
MATPSADFEALMNGVTSWDVPEDAVPCELLLIWRGFISCDGEVTWARSSFAASSYGRGRTGGRSPNDGLHWWNAHAHATFLLKQQMRGWLMRLPHVGSQLVYTQSPWHLLAKILEVLWSGCTRLSHEGEQTPLGVYCTWMPYNETMTRNQLVNVHEHGRGWLLSRRTKPGIGPTKGAGCKGSVTRTLRN

SEQ ID NO: 994315 - protein, 184 aa, Homo sapiens
MWNLQDLQRIECGALPFRNCWWAIQARNVEGLSCAQFGGSCASCGSQGRSPVSVDFSRGKDIRLGHVFRCLQPYRQPPIHVGQAAHSVGAVRPYWPVAPTAGGFISSIPWPRGCRVCNLCKQLCVSDSYNSHISEPLSVAVTLCVPWHIVQGAISGRPYMLEARCGDHAGGQFLGGPFAGEKKG

SEQ ID NO: 994316 - protein, 186 aa, Homo sapiens
MPSEGRCWETLKALRSSDKGRLCYYRDWLLRREAGCGDFMPIIPTLCEAEAGRVLEASSSWEPGLVSHTCNPSTLDVLEESSPATPNGTKGKDESQHTESMVLQSSRGIKVEGCVRMYELVHRMTRNRGPEAMAGGAGEEGASPLGRWHLTQLNAVDEWTEPESSIKEFPGLAGSTWTNSSREAWD

SEQ ID NO: 994317 - protein, 218 aa, Homo sapiens
MTGGTHCANIPVKAPTLKKPNIYFPDKGGNGEEGPREHTGNRALWTPKRHPNTVVSLKGQSTAKNKIVKGPPERPHKKVSHKGGVYNAWQKQTLNNPGATKQAALESATQTLARRSDDKNKPQRGDAHRKNPVKESMQEGERATTKTAGTAPTHPNNTHKTESRTGDRTKGEITRGTAADHNLASLASQHTTASKTETSKLTHATRQRRQNQLAGMTT

SEQ ID NO: 994318 - protein, 67 aa, Homo sapiens
ERLEDEPAGCFLNEEEGCCTMAVFDTPEEAFGVLRPVCVQLTKTQTVENVEHLPDTTYKTVDDTCPF

SEQ ID NO: 994319 - protein, 113 aa, Homo sapiens
MEKELGLVEELRTKPSQEHRQNSKKLYCKNLIKVIEASDVVLEVLDAMRSSLVAGCPQVEEAIVQSGEKKVVLILNKSDLVPKENGEVGKLCEERIGKEVFKKVKKSKDKGKI

SEQ ID NO: 994320 - protein, 218 aa, Homo sapiens
ELPDPEQLMIGKRMAAPKAVPWCHSQRKMRKPWKTNPSLRNSIQVDEEKYGGNYAEMKDRKKRKGSKNDILRADGEDTRRKGTTTLHEETDHQVTTYHACSRLEKTARQEHKHDAPHNKTPANRNGKTARRHPQKMPVNDGDNKHPDATTTASHNAQRQQTKDTAELPKMQPQSGDATTKHLDHAANKKTRNHKRQAEKTATEQKRKSKEKHTTRQKS

SEQ ID NO: 994321 - protein, 108 aa, Homo sapiens
RILKSGGLEGLLIADQYSGAQVRVLSAPSNFHYGQIKRTPCNLLRRIFLGGNGPMQLQRGDLSGFVVCCERRDSTVCRTMLANEELRGKYVREVDVRPEWCNGVTRSG

SEQ ID NO: 994322 - protein, 123 aa, Homo sapiens
MILALTVLTPAVHATKSVADSARRCTSRLAHTNRSSYHSAEVTAFAVIQAVSMRDMVIAPKALGMQQRRIEQSKAHFMKRCRTMLSRLMDQCRDVVRSVLIYPKGRLVDASECGLSGQGLPVG

SEQ ID NO: 994323 - protein, 45 aa, Homo sapiens
MIPNKSDVEQLVDDEKRARDERHCSTTATNALPTPTPPDTLMNTP

SEQ ID NO: 994324 - protein, 463 aa, Homo sapiens
DAWVFFRGRSFAVVAQAGVQWLNLHSLQPPPPGFRLFPCLSLPSSWDYRHVPPCKVGFVLFFFFYNFGDGVFARVAQAWSVGGETLGSRGVLSLRGIHTTSSASASVRIAWDLQRAVHTHRRGYIWVCVLCVCAAVYVVMWSAYLFYFFPNKKERGFHPRLTPERATHDSPRTTPAEHHPLQEAPHHKRSAAITRAREPTRGPRARGRRLTHETRLGRQPTQATASKKTQHQQRTKQRGKQPHKRTNHPAAHTHSHGRRATPREAIETHRRDYSDKWATPETLVETTNHSHAPLFYLACGRKQKTRNIRRNETNTTPRPPPYPPPPAPAQPTNAYSIINYPTLTYPTPHPPSPTHTIITHNTNSTTPPPSHHHHISRRQVRTADHDIDAKHAPPIIGYHPTEGGPISAWLRSDQRRTPAERSQHAAAREGEGAQRLLPSEPRRPSRPPRCSCAARQPPAAPPR

SEQ ID NO: 994325 - protein, 215 aa, Homo sapiens
MVGSSGGEHLFGTIGHSQTQYILSHLTLGLFSRHLVERRFGIRPTTGRTQVTPNGLKCKKSSVTLHNALRVTIALEDEAKIAVRTYLGAENRFVTRCVDAPGPRFSTCTRAGAFLGYILGTSFTHATEKALKGNCPQMVVGLVATRVEYENLPGNNCPMVYSKLFASCEDIQLCGSVSQQARAGSRHVANGGPGGGPTLSLERSLEDGKLLTLAN

SEQ ID NO: 994326 - protein, 366 aa, Homo sapiens
MSTWLRENVRVTSLLPALRLLAYSIHDHDQQIVTLSCRTGGLFLHPFSQAYIIMYGNSSTNHLAERVSFTYLESPNPHTIHIRILSAVHTSRLIVREACSRIRVPHCGPPRCQSGGSKFEQGISLISLEASNCKMAALRYRDKMCEQVETWLDPESGRKTSRPWTVWRTRSGCVRPPWRFDSGRKHLFIPPCDYYLFTGGSALSLVTLAFLARNRWVLTSPQWSRGVGGACDLFRPAGAGGAPPWGYWGGSLCPRETNPKLLESGHVCPVPAVRRSCHRDIETCNVALSKYRPKVEAMLLALHMESVGAPVRSPYAGLLRDESFAPSCPPCVVLGTPGLVSPKVTLGLGPKMGNLAVPIVPVHLPG

SEQ ID NO: 994327 - protein, 222 aa, Homo sapiens
TKWRMTAGACWGGPGVPCVALGLGNRGVLPAECFWQWHPGAWGLRPVDCGPGGRWPAELCWSAMADVIRSWMPCHHSEGLLESKDHEKITVPLERESISYSHAQLQELRRSIAFSLPVRAYSSSDRGIDRYMPSATSMNPLPGQAHPGSNGIIVSYTGHYNWPTVGSGVFKCSNGEWPTTIAWEPITPGQSLSISHPVTQDGYMARNNDSGKQTKFVTCHGD

SEQ ID NO: 994328 - protein, 310 aa, Homo sapiens
MAAKVCIGSLRVAEEAEHLAVMVISSRRGSRGVPPHGLPGLWGLTYSLQADQIATLKSKQDELHRKALGDSWRGRQLAGRPVTPEVILYVSLAELALVRQISSAMEQLQEALRGWQGCCATPSTLLALALRLPEKATSSHALVCVEHGITEQALRNFKLMLSKVKAGAGAERARRKALVSCMTSADAVGDPVPGSPSWEAKEDVEFGGGATVKKERWLAPELAEAMNGRPGPGGSTKRSREEDSREGKTLGVKKPRVGARAFVVAVSSSGAQKSRQRRETSTQRGGEEETGGKTIIAANERKEGPRARAG

SEQ ID NO: 994329 - protein, 474 aa, Homo sapiens
RPNPGVGPEARSLSHDSTPTGSLVIAGAEAGGCGAGVACGCGPGPAKVVMQWSEGLDVGPQKRLLVLCWDSEYCDCEPRALMPCHDTPLEPSTAGDPWHHEHTQIRDHAVSYTRGQTFLRATTQHNKGTAGEDVRERPPHQAIHSPQNTTHVTEERSDREHQQHYTNSQPIDKNQNNTMLTPKPPPIINTTRGQRLATSAHTMARLNQRITIPPDHATTRGPTRARATHSNEARGRAPPTNESSPQHTRSTIGHATKPPLRHNGRNEDTGQRTHRRHGEARRPHGKLDRTPDNPKAETPQGDGKPYSTAHIAKGDTQTLPRSSSTGHHNTPSRTSPESNPYKSTGRETNATKDRAYTILTTHYESTILYRSDSTISVWPTREAEVPKNTHSTRTGSNIHAELELRRAARQQQSSTQPLQSKRGATNTRAATNYETPATERCTNQTDEPIARNEASSKERNRGNDMLRRRTDRPE

SEQ ID NO: 994330 - protein, 346 aa, Homo sapiens
EVRGSVLLTKLPAHTVGDVKCDMEVSCPDGYTCCRLPRWLYLLPEERYSIKRGLGLATRLCAERTTYTAVPRGLRVTQQKGTCEQGPTNQVTRMEKDNQRHHTSDMNNPQAIEERCPRDDNVQTDMKHSSRIHAGHNHDLGNEEDDDTKTNQELSRQAPEHRAQRDPAGAKRDVRMSGNESDRRKAKIRARELDINESPGRTALTHQQTENTTRESQQHKTHTAGDTNEDPNTEKGRSARARENNEEERAQTREDEATKETKRQKQGEGQKEGERNNKETKRREKRARGEDDEQEKGSTEEEKKNQQEERNREKENTEQREKHDARNNGDSTTERRERTRTQNEQQ

SEQ ID NO: 994331 - protein, 36 aa, Homo sapiens
MLSGKKAASRGGWRLQRQQPGLEAGPGTVGGSENGS

SEQ ID NO: 994332 - protein, 138 aa, Homo sapiens
MGRVRTKTVKRASKALIERYYPKLTLDFETNKRLTSEIATIPSKRLRNKIAGYTTHLMKRIQKGPVRGISFKLQEEERERKDQYVPEVSALDLSHTKNQLEVDQQTADLVKSLGFDLPISVIAVSSQRGAERRFRKRN

SEQ ID NO: 994333 - protein, 157 aa, Homo sapiens
MAQDDTQAIKGSKATDTTTPQEQGRQNPQRTKRRRQPTCNKRRKGEQHEKKTENNGKNKQKGRTRKKETKEQTDHSTDKQHKQRQGPTRSTTRQGTRQRRRNEKHRTGRKRQEKQTRTNEPQKQEKQKRKRRKHRRQRKTKKETKTHKNQANNTQQT

SEQ ID NO: 994334 - protein, 273 aa, Homo sapiens
MSTQKVLRSQTWCPSRLPSEAQPCRHCGKVNELALRMTRPSRSSSQTFLGIQGLVIERHYLWRRMSDSGRGIQTDVDKRNGGAVPRAVLEAYDTRTIDLSGCVDGAVCRPVLIGKSPSEAFPGALSNDLFFYDLYADFQLTASAKAWPVVMKTHSMGTTESDTELKGSISIVLATYMAAIAGVAERREAGREDFSTSMQGSHCQVIRVVCPDPRGACMTLRQKNGPTRDDEIQVNGRDMWPPKLDCARERLEHAWYLCSKCVVQDEMIDVRRG

SEQ ID NO: 994335 - protein, 419 aa, Homo sapiens
IPFPGSSPSSLFPFFPPIFFLLPLRVRAIITGTGTHIRCASPRDPVYDPTILTILSAYPLTHVDCGAAEGAEHNMDPESRLAGSGKQPDLDGELGATTQGPQERHGLNSHIHKRKSTYLLMKKNPETYTHRKRKRGKIQGYTALATQDNTLHSGGHGNCTATQHNSTSHPLNTRKRGDNPTMSDNHNYKEWEDIHTRGDDNHYGNSERNEPQQMANKDTLRHETRNKAPTEHRHHPTTSPNKSRTNAPRKTNEHGLMTPQTTAGREYKGHSPEESTAKKHTRKPKGTGKHNHTTNIATTTTTHQHSNNKTKHTKKATHGNDTKPTQETTKQTDKMKSTQINESERSTEDARRESNSEKRARAKAPRTEKDKQESRQASETKRKTRDNGRDDEEDDKTEKQQRRSAQAREGKHSTNKRER

SEQ ID NO: 994336 - protein, 71 aa, Homo sapiens
EHVTAGKHRHAELGTSAALHIKPTRCPTAAARRPPVSHNALKLARLIWTYKRNVILMDHDGKEHRLHGLIA

SEQ ID NO: 994337 - protein, 355 aa, Homo sapiens
MPQGMKGDSAKSNILPLRSSNYWMIIRKCCQWWEQTMWAPKQMQQILLVSLRGKAVVLSGQGTPMMLQWPLRRAPGKQFQLWQKLAAVILRGTCEAFVFTKGGPSADDQGACCWPIRCQLLPDAGSHLPHVDVTVPGRETLVSGPEDLLFPGFKVSPTKHLQGAPLKVLSDVQLIKDWRQTWEPTEATLLNMLNISPLLPYGPGSSKQVSDNGKLYSLEVLDIHHRQLLGFYASWKGVTHSCASSARKHGQHQPLPYVTPIHQSTGENTTIRGHHMRDETETTPVPQCGRKAQERTWGSTPCHQEEPPERRHNNKEQGRQPTKDNQPTSRHNDNAGPTTQTRTLRHTPLKTSHTH

SEQ ID NO: 994338 - protein, 146 aa, Homo sapiens
TNSTTVEDSVVFLKDLEPEISITAYRPKGIEIILLQRYMHMYFITALFTIAKTWNQPKCSSVIDWKKRMWNINTMEYYAAIKRNEILSFLRDMDGVGSCYPQQTNAGTENQPPHVLTYKWELNNRTHGHREGNNTHWGQSGGGGSS

SEQ ID NO: 994339 - protein, 297 aa, Homo sapiens
MPRKTGRAGSPTTSLGSSNYWMIIRKCCYCGSRQCGVSNARCMHDPSCPFAGKAVVLMGKNTMMRKDIAEGTWKDNPCSGETVCAHIAGECGSLLFTKEDLTEIRDMVLAIKGASCCPCWCHGPSVNVTVPARTLVSGPRRSPFIQALGITTTISRAPVKVLSDVQLIKTGEKWEPGSTLLNMVKFPLFLWGGRQQVFDMGTIEPESADIPRKSASRLWRGSKVQCRRNGTTVVVPNIQRKQNRLREGYLPSEGRSGALTGAPCCTTLFCLAQRRARASQPTSANRVPLHSRRDYFI

SEQ ID NO: 994340 - protein, 405 aa, Homo sapiens
VHETLEDCMYISVGGATPWFWFKPAVTFASAVPGQGSGPNYNIHMLVVQHVSCVSLNFHVFSLKHNTHKSTSFHFHTSHNTHTTNKQHKHKQKNKQQHTQQKKKQNKQHKKKKSKNHRRRKQQTKERTARNTEHKKETQRRGSTKKKEKNTRENRREDRRHNQQQTKNTKKKEQKENTQTRPTDKEEKERDEKDKRRERRQPRSKKTKRGKRERDAETKPTNKQKEEKTTRREKQQAKTSADDKNEIERENSEATKKERRHERDQEQNTRTDDDEERARGQGRAREREGGQEEQAVTQPATHEGTRPKTEQAERQSTTDDTPEREKAGDEQRQSAQHGREPGRSEDGRGKDGQGEAGRGGGTKRREDNERPRPRGSRQGEEGQGGARNGSEGDRAGERPTKRGHR

SEQ ID NO: 994341 - protein, 137 aa, Homo sapiens
TNTHITMSGGKGGKAGSAEKASQSRSAKAGLTFPVGRVHRLLRKGNYAQRIGSGAPVYLTAVLEYLAAEILELAGNAARDNKKTRIIPRHLQFGHQKDEELNKLLGHVTIAQGGVLPNIHQNLLPKKSSKAKASQEL

SEQ ID NO: 994342 - protein, 76 aa, Homo sapiens
QRGCKSPVSVKPTPGVAEGPPSTRARRRMSGCQCRTTDTGRTRAHADVTAHTHTPHAQPPNTQAELQRQHPTNPAS

SEQ ID NO: 994343 - protein, 334 aa, Homo sapiens
MGSHTIEAGQGLSGYRICLGLALNEFYRRPHASKGLAEELAKRNRPSLSSPGVTIGVIRWALHDCVGQSMTRQGGSYAWGHLGACNGVRAPQIHTTFPMAVQQDAKVLGKVSPSPKVGHGSEATYIPVVRGNGLRVGNTVDIWGQGGRLEKALESLDKGQAFVVGASGFGGDPYSTLVFGLLAFPHRPFFVATLGPLFDTSSSAPRVAQWGQALPPFDPQDVGGDIPAPVTFKRGIIARAIRAQPPGKDSPNVVLPKGKGLSRRVGWDTQLKCSGRQHWATGLLEQERGAPAENHHSATRLRGPHTMLKKTTPGDTHVNAERDTKHERHTAGHR

SEQ ID NO: 994344 - protein, 322 aa, Homo sapiens
IIICPEVYAVFYKMPRRYFEGVWVCVMCVEEAEDPIESPVWRLDDTGTNNERTPPHRHTKAQEENTQHTIEKERTNAKRNYTLQEQANQTRNQNRSEQRSPDAHTSTATTNNNRRPRTTQHKQPRHHGKTETHTTTRHRKTNRTNKPQQNAPPRRTHPRHNHAPQTQHAPHPLGTTTHGSKTHKQQTHQRRNKGKHRNTKDTQTTEDPKPSQKAEDITQTTHRARTKTASEATAGARHTTQHTKQHAREHTQTEQPTNQHKEVNRRDYEDEVEAQGARRKKQDQQSTNEMNKEMRKQKHYDRDARKEELLSVEGAEGAKQRT

SEQ ID NO: 994345 - protein, 353 aa, Homo sapiens
SGGPAPGRDHWNPLETPIKDGMLYQRPAQSCGNKCWRKVWALLYAGGPSGGGQRVWRAGRSGMVAWEQRVRGRQGLAGEEELMGHPRWLTVCPCFLTDGRELAPGETGAFLLTYHAELKHIYWAAQHLFMALDGPQIVPGWASPDDRGGLLMIPRDDPVSHTMGPGPHWEENSNLASSCCTEVRAEFYRGGMHEELRGRDPLARLKGPVLLVLGPDAIQSDWTGLDRRPPKAGRTFLSRFGSCRACSPWRPDVAWHRCKGTLRHSGTPCATDCDGVAVGIARHRTRRRNRRPTLAQERGPIAYLEDQRLWNPGTGYLRKMKLDRDNNPQLGEYHGSWRAGTTGTRAHVSNTSF

SEQ ID NO: 994346 - protein, 152 aa, Homo sapiens
MVPLHSSLGNRARLCLKIFLNKETKNEGYRFNGHHVGKLSPRQINTSHLSVVIHTSLLNKGSHSQKLQMWVGTHWPLLGEKGTKKNTAELFLTRGKRGHVVIFSMGLESLNFRIGHYSVFWLPTEQSGLSCGKNRGGGFPKCDQNREGVPLY

SEQ ID NO: 994347 - protein, 227 aa, Homo sapiens
MNFSDVIQTPDGYYRREGVPTTFNSTVNSYLDAQYTQIWVIVDDYGAVMPFVDDAADVVCTKRVEEHPNEKLGGSSRWSNLHYTPFTPGSTSRQVPQLHPQEQHISHMLDSHEVIEIAAKSNLPLGWASPPRFYKQGLFSLSFSREAPYTGERPHKGRHPDHTPAAKREKHNHRRKHPHGPTPRGMRAAHQAYTPQPHGGRYTPPKERPPVVERRNQHSTESAGVRK

SEQ ID NO: 994348 - protein, 70 aa, Homo sapiens
GYALLITLLQKNGSLLQVLELRMDIPDYPSLLDDRYCFIIMEPIRTRDGASYHKLHTNRIRERPNKTKKQ

SEQ ID NO: 994349 - protein, 73 aa, Homo sapiens
MLTEGANDNLPDGATTEPPFQHERRVSVHRRHRQPVNAGRLHMSHQRTRRVSITNYSAQTNTYSTHRLMHRFQ

SEQ ID NO: 994350 - protein, 107 aa, Homo sapiens
MSLSMCIRGDVIPICHYNVHYWLLLYHTWMIPGTISTLLSRCRIPPRLSLKGKLTNHYSDLARLSRQVLIRFTSLLRRRWYRQLAPWNSTSPVLPLGAISPSSQVAM

SEQ ID NO: 994351 - protein, 372 aa, Homo sapiens
MSQEEKAAYLSDPRAPPCEYNRFGMHKHMTGKTMMYRQHYIANSITGLLNLSLTTVTSFSENDESKVPADLLKRAFVRMSTSPEAFLALRSHYRQTLSSDMHQPLDPRDWRQTSEQLSWWPWRLAADDRDRLWRMRSGSATQFLTAPELMPFRLTRQFINLMFPNERNGPYRTRIMVQQLRAFRSDPGLLTNHHGCVTPRSPPLLWPQFDQDNMLDHQRTGSRHYTATLTLLPRHHTGTPEPHTMPRHDESYKVPKSAHQTVDRPTPGPQNAPALKTWCAAQEPTIQTWAQQQSEDPKTATRTARGHAQSPKLRELSEHTQDTATGNNTDGPLQGGPMILPKRLQAPSNNTGTQHTRPPTTSPPTHNEHETD

SEQ ID NO: 994352 - protein, 119 aa, Homo sapiens
INWVTWLISVFHHRIRDQQLFPLPDLGPSIYDYAKSMALFMVGVNVCLIVCIICGPEYFHRDFSATAEENYSDQKKATIEQFDTASDEERAMGSLKMNTEVEEFDMDKASVQHRESARD

SEQ ID NO: 994353 - protein, 413 aa, Homo sapiens
MECWWLLCVCLAAPVRNVLFAACVTLCVHVPECVDPMPPCCVRMLLYVSWVHVCVLGPKLLVMFIVCCHGGLCVGRECDCASSEMCCEMRQCSPEPLTATHLHSHPHTTHKHPTYRARPTRPPTGTTTEPRQPSHTWSRDAAAPRAQPPQHDTRAPTFAPPPQATRPARRADTRQHGPKQHKKRPRKDVRGERDSHEPTTTHTPPARYEHQLLKATSTQGQANTTQQQGSKTNRQEAPDNAAPSRSGEQSASRPTRSPHATQRPTRAHAATPDSAHTSPQAEPSQQGRPPPEPPGHRDPHESLSETLPDAKGLEGGASKYAYIDLDEQYNGHARSTEPQKTQHPRAQGCASTARRHHTAVDEPARGGGSCKRTLPHPPTHIPNPSHPIPPPTHQLFGHSSTLPHSTTHSNYYQ

SEQ ID NO: 994354 - protein, 215 aa, Homo sapiens
MRNRGGEGARALPILFYKDDPEELVMRLAVNIWTWQVMEQLIAAYNLSKQLTVVPLTHECSLLLGKPKPCENMGRIFPKGHSQFFRQWHAFENTYESPSGVHLRQPTAVTVEGAIHTSRPCTLTPVSKKPLATRQRTAIMIRRRSRHTTDQREITRAHTTNSNKTTTTTDNKALRTTADQTEGKHKKVEILYDHERPRNRPQRWRYEHTTSHCRK

SEQ ID NO: 994355 - protein, 232 aa, Homo sapiens
MSSSRRPISHIRTLIGLKVKGVEKNLPEQIENRKKAEGGNPNFRQNRFQRNKSIFQKGQGGRGKIADLKSSGSWRLPRRRTKRVVANPGSSNWTYPGPKDQDGQGGGRDPKRTRKDGLGGWAHRGATGGKGSRHPQPAKGGSERAGYPAGETVGPGILAIHRSEDPIMRPHQRAWGANKEACRYSKAVKRSRAKLPNPKWGERAKHGVSGGKTASPGEGATTETAAKTEPRT

SEQ ID NO: 994356 - protein, 141 aa, Homo sapiens
MGGTPILSGPGPISFPKGKVSTSREKNPGYEHEKYFLFLMDWGSLENHWSQDGKMNQSGRLLSFFLEAMAKISVVGWRVREVTPVTKFIIALMGLGLVSGSTRIWMVYIYHSTIRTTSNIRSIPRCGQGLIHIKGLHQQIG

SEQ ID NO: 994357 - protein, 197 aa, Homo sapiens
MCGPGFHTGQIPYSIPLLPRGGTSGETPKSRRTQGHERAGDSPQHAENSHTQKGATPSTAEGQETPPLGLPLPKTPRGNPIPPKSARQTREDNHAVTTHQNTRKEPANPNTAHNSAARPKPLPSKNTPRQRHKHRTKPPVKKPPRPGGTTRQGGASPPGVTPDPEESATMRADTTKDPLELLNTHRGTRRTNAVKQN

SEQ ID NO: 994358 - protein, 229 aa, Homo sapiens
MREHPAEKPHTTHPGGAPCPQRGAARGKYTARGRYRAPNPQGRARGRKRDIIGENKFQKLSPTDEGRPTEGAQPPICGDPAWARVNSRPGGPQQVDTLSPNAYTTAATQHELPQKTRHTTKSRAAPDTTTNRVLSATDVTTQDYVRSGGEIKRGRVPNHRGGGQQPERGHNHKSLAPIQQRPLVVIENTRPRLRRETQHPDGETHPYGGAPPTHTTLHKKPTGARRGNN

SEQ ID NO: 994359 - protein, 37 aa, Homo sapiens
TSKTRHAPATNRPCADEHRGGPDEPHAVAHAAMSLAR

SEQ ID NO: 994360 - protein, 108 aa, Homo sapiens
LDCRYDYVTTRRNLPSSSGSPYAVVLLLVERDVYAYCHFPVSLDWPGMPHIEDVATPCLCMLRRTALRSEPAFSLEGTKVIGAFYYYKILKHGILVTRVVTRLGQGLR

SEQ ID NO: 994361 - protein, 331 aa, Homo sapiens
DTGSRVDKMTIENAEDPRRTPSSEVHLIIPRGGPSRGGPVGPRKLKLHRGAFRELIERPGASQDFQSQAERPLGTVPHGSVDHCFSIKGLKGTVSDRGPVLCRAPSSLGDSVEIPALKVVKTGEVHCMMFHMPITFSHAEETGLGIVRSPQFDPYSVLERGLVCAPESLRHWSDAGLISVAEMPYFRGPHVEPRPKFHITSGPCKQSWAGGCSSVLLQITLMQEPILGLFQSSLKNTVDQEQYLSQGFDHQGVTDTDEAERKPPGPEAMASGAVGLVGLTSQYMTPVGRGLAPAKIRHYTTCQSSRAGQGKADTRNCQRKVKSNSLTENTH

SEQ ID NO: 994362 - protein, 126 aa, Homo sapiens
MHIHRTQILRGPLSRTVRLLIKTSMSPELHQYSPSPNTRALLDTSHQRLTIPTQQRGTHGANTCAQREIDHGASPATTNSAHRTILEHPRTHARHRQQEHRQKVQPQDPNENELTEAIRNDNTTAQ

SEQ ID NO: 994363 - protein, 539 aa, Homo sapiens
TRREKVWLDHTEDDDKIHEESAENSKNHGTLSYKTSPVPPVKVDASAQQHKQLLATQGWLNIWPTAWHQHISTANWQAATGFTSAQQFMQAQIIFTTHTGPTCRSGITQQTPNPARPAHQSSTVHPHAQHKGHQKAMEHHPQFHRGTCCIPNLQCCKTLATLFISHACKHSQHIHKHAGGTQSVSPQKPPPQAQQYLSQSHLLCNSNITANQYTMPLKHPHPNGSTSPIWLSSHQPEHHANIPYNLTTLFPPREDSVLAEPHGHQTRHALDNTTLLQQTPQPPNLTHIDDTLQEQPTNDHKEQHTNNTLHPCHTHTHEPQRTTLQTRPPSDTLQPPLSPQTNPLERQHGANDPHLTSPRANRLHTQDAQRAKHREQPPIAHAPHEHRTQNTSKTTRSQHTTHSEANHDLQTAPQLDNIDRTEDIDPDHKKERPEATMKRTTNNTSKRRSETPLYMATGTHQDYKNNKKAKPRTTPSTTTNRNTRRTPTNPTTDNTTKQSNNANNRRTHVKRREEPTSRSTTERSMPGPHTHTHIRNNDR

SEQ ID NO: 994364 - protein, 73 aa, Homo sapiens
LDSHEEASEEIMEQGLVMEECGLGSCRRLKVLLAKGTFSETENSSRSRLCFVTDKDGLLMSARSGQTILKKKI

SEQ ID NO: 994365 - protein, 329 aa, Homo sapiens
VSSPHFQVGERALLLLEIMNDIMSLESSDNAVKILPIHVSFLYRSSKSHGTRQYMADIAERPGEHLQWRVNQKHYDDCTHTGSKQERLIREAKNEENGKKHGLKIENLAKANPQAQTQIRRRTVLLQRRKSDAGSGPPQQERLGSSAARPDELAPRTAASLRGAASGRASTRFLFRIAVRKYILAVSYQSVTSQKLSWNPFRRTITCVAAQCENEGGTKHKGGRFPRAPPAEPAGLTDGVSIWMGASAHAIGQVRDIRRTSRGKESTWHHSQGSEGSRTCTEGLEHPRSTTDAKRGQMRVRMKEQENRGRRGNQRKAGRPRRTKEKRPE

SEQ ID NO: 994366 - protein, 180 aa, Homo sapiens
SRAGGRCTSGGGGGKSSRPLTALWSRVPARPRTAAPLLALRLLARRLPAASACEPGRRLSPDPDGRADVPEEAARGGQGTGRTGRATTAELLSRPTNSTSGRSTAAQPQGQTSQGFTRGNPCHKCQEDGLADQARAEDDRPQQPQAPEARPHTRTDRPKWQTTRHRPRPVDLRPIGRLRT

SEQ ID NO: 994367 - protein, 166 aa, Homo sapiens
MVTTCWSQVLNVAWVQRHGDRSRVRIGPRQIGKHRCYEGLGQDSNHTTSSKERALATRIHAGYNHCGDMSRRILQQGAKGRQPEGGGELRYKNEEAETQLETYTKVVSPREKESKPKRRQTDAAQRKNANTGKVDTKLNQQLTDYKKRKPHKNTSSWHAPLVAPAL

SEQ ID NO: 994368 - protein, 243 aa, Homo sapiens
MVEAREWVLEGRLAITEATLLWKTGNWRLAYPIRSQPSLYPSTVLLRGLSGGGVVAGSRDFHGLCLRKTELTIDEGEGCPYRRSPKKEAVGAFHDADAWAFCICAINRRSRCPSADSGTHSLGRMVSRKLYAGEEVKNKKYFTEGTQLYVYVEIFLLGATEEQIYELFSKSGDIKKIIVGLDKNEEHRMWILFVGYYYAQMRKTHADHKWDASGDGSFGQTGTQALRKGRHTGRGELGAHVAL

SEQ ID NO: 994369 - protein, 127 aa, Homo sapiens
MPPHVGWGSYYIIVASTIRATYNTSTERHKRHHQQNSYDKNYVAEYIKTHHDVMQINSLYKSHAVTRRQQVIDERTTFLTTYKNIDEQAETYSVKHESRARQYEDGNGERGCDRGERRGEKSDGKKD

SEQ ID NO: 994370 - protein, 197 aa, Homo sapiens
MGKYLVVEDRRQDSEERRICMSCCVSGDGSDEGDRLCQREHMNVKRRGRKYEVEDGRGSKQDEMMANQGYVGWSEGGRLMGRVIAVLAVSEEVEGEFGAVHAQIVQMVCEAYSVSWRLKKCSSSTIQIDWDSATESRDRNKHDVTTIRSTNERKRVDEGNVHMRDKEQKTHYYRIQLTVSKSVICDRITIPIADTIT

SEQ ID NO: 994371 - protein, 135 aa, Homo sapiens
MSTARGSASPCSAGRRHRARGGEGTSAADVELQIVDDVVVAALACEHDSLPFLTMLRRHKGSEVALRQIVDDRRCSSRHEMTRFRRYCMLRELSLQDLQQPGRTEACDRYARLGAILVLTSVVQSFDRRRTVVRL

SEQ ID NO: 994372 - protein, 104 aa, Homo sapiens
LAYQSHLFTHHPKILPNISYLFPNLSSLHPNLSQVLTYSPTYSPTSPKYSPTSPTTATPPKVNGISHSPGYRHQAQATVLNKPRLSARMTVTRRTEGTWGAAAG

SEQ ID NO: 994373 - protein, 284 aa, Homo sapiens
MADSAERENRLLNSKKPSPYLIKMAMAPSTNLKELGNWQLRSLGQNPYSKLNCEDMIKLNVACVMVMATIDFPGILVDVVTVLYKTCNTIQTGEERTIPLEAIPEVFDNGMANLGYNHGASMNYVTVNDEELREEKRYAALNEGKNDMCTQRQQILMETDKSSYEEFVHDDELQNMKTQLFKRPIFAPSRKNQIEFFDLPLAKDKLDNHNQDQQLHRGGPRRCSCVRRASLVVRTSLVAGRGRPPARPYVAQAAALAHASAVTLLWFRLFPEHLTSVGGHFRPA

SEQ ID NO: 994374 - protein, 243 aa, Homo sapiens
KYLMGDLLREGSYGKVDKDVLYSETLFMRAVMILKKNKLLKRSPDGEAKVKEDHSDVRERVLRVHVMSSKLVDVVIHTKSKQINVYVVMDVLLCVACMNNAGTSVPEKRSPSCCQAHVELLSVSCLIGLEYLHEPGIVHKDIKPGNLLLTTGGTLKISDLGVAEALHPFAADDTCLDQPGSPAFQPPEIANGLDTFSGFKVDILVGWVTLYNITTGLYPFEGDNIYKLFENIGKGSYAIRATV

SEQ ID NO: 994375 - protein, 325 aa, Homo sapiens
MEALHAASRDKYRTTAATDGCFCCRYCMYLLPAGAVQGLGDRGEAPDSRSRSATYYAGGQVYPGEAVLFSRSPTTPMPLSKAKISKPAPYWEGTAVIDGRHLRHADTAQPDLIVGTIPMAPLSFSPHLTPPPTARCSHTLTHYLRPLWRPDPRTLDSTLPTSSTPYLGTMRQRNRPSRSHRPPGHNATTPPGTITYTPLATDHHERARRRPPHLTGAIGPTYTYTPRTLWTPDIHARSAKHAGTETAEGSVTPKGQAHPSQRHPPAHTLYTARAHTPLNTYIVHVGNPKNSGTHSTDNTPPTQPIPHYHVTKLWRDRNPIGSARH

SEQ ID NO: 994376 - protein, 85 aa, Homo sapiens
KFPRDMKAMSPEDQEYLEKRSVATCVDLKEEDHYQRARKEREKEDYLHPQAAAQTALALLEQSIPPRLPRQNSVASSPSSSSAVV

SEQ ID NO: 994377 - protein, 334 aa, Homo sapiens
GRVGRSGHPAPFGTQKARALEGDPPLVEEWRWPLRGRWPRARLSPAGIPAVALWFLCTLGLQGTPGRATAAPPWNCPAGADCLVTRFYTAGVAWLRAGDYPTPRISKRQLAYPGVPHRMTPGLGTAEQRLLAPPKNCQLGPLNGASNAQTRRGRDASRRLPTSSNWHLRRQNLRVRVQRPEGGLHHAYLTDGNVYRSYRHLLEPMGLWSGLGIPKGLGMAYDVEGTIPKEAPGAEGCGITQIGVPTVGAVPDVQGHKEKDPTRLKRGAALRKGLTGFTFNEVALNPPVERPRSINGAFTHEKNGSQHKRVRRVFPEINARLKSLGRATTSCEMS

SEQ ID NO: 994378 - protein, 129 aa, Homo sapiens
STCAVLSVLCCLCCAVLSVLCCAVCAVCAVLCCLCCAVYAVLCCLCCALLCCALLCCSVLSVLCCAVLYVQCCVVRAVCAVLCCAVCAVLCCAVLSVLSVLCCAVLSVLCCAVLSVAVSLTNLEHTNCR

SEQ ID NO: 994379 - protein, 109 aa, Homo sapiens
MREETAEEHGAHNIESSEEEKQKRTEKERAAPTEVHSPGETAKRTQHSQAEGAKTREAHEASATPENEAKSDTRQQTNRRRQEREQQSQHTHSPPARRTQVEEQEHTTK

SEQ ID NO: 994380 - protein, 32 aa, Homo sapiens
MLLLLNCAEIPNMVDFLTSLWGKRTTWRQKVD

SEQ ID NO: 994381 - protein, 129 aa, Homo sapiens
RQGSSGKREIAHTQEATGTPSRTFGTVEQQIRTTKGLVKIKCLPHTCLYSSLTNQLQVSSSPLSVPQRRSHRRRELQQSGSILAFILNPLWLVKQLNPKATPTYPRHCDSTPAVKGAQGSTIQGLCGHQ

SEQ ID NO: 994382 - protein, 107 aa, Homo sapiens
MVGRKKCMHHSYHSSLDSSRELLLALGSDGQTTMRLTQMMRMPDDRSHVKDGISKRNSGRLQPANSREKLQKVETMMQRPTERGQRMNKKSRVKRDNDDGTTHRHKN

SEQ ID NO: 994383 - protein, 38 aa, Homo sapiens
VDIDMTFRTIHLLLMKFWDEQQDTVCARHMRARDRSTS

SEQ ID NO: 994384 - protein, 313 aa, Homo sapiens
MANARDEEIVNATTKKTDKYRHGHEGKAVKEREKEEEARSKKERTEQREETEANETERPQQDEKENTIGQQSIPQTHDKSHLKKNPHQYCSHKTYGYTNNKQLTTLNLNTSHRKQTISYHNHACTTQLFNELTRNSTNTNTQREEMSGDRRAGGGGRETEEGEERRRESTRGAEGTKEEGRSCAWDGRMEKGAERKREGQTDRRRKTESWSEEQNEWESDGKETGRGGARGEAEREKERDSGRRDAMNRRERTSVRRQKGAEGGDGRRSERNEREREEKRKGVERERRRQGRRERHTDQSSSGDDRRQEADRT

SEQ ID NO: 994385 - protein, 81 aa, Homo sapiens
FSSLSSPSARLEAFRGWLVSIEVSIPRPSGWHMQCSSVCACVCVFMCALYACGWLPYPWCRASLVRAGPGGRRCTWVFAEE

SEQ ID NO: 994386 - protein, 158 aa, Homo sapiens
GIVGQHNTKFPQPSFWGHAKFLPYHAGTTFFIYTVEKLWIPVLARTPTPPLWNLWRCDNRVETQHRSHSVSPRGGISQVGASSRSPHLFSGTPRNILFSENISFLFSPLERAVCCGETPRQGDHREGQRESGEPKMRASATEHTAVFVLSHTQKGGAQ

SEQ ID NO: 994387 - protein, 351 aa, Homo sapiens
MPESLDQPNLWQTRGYQPHNCSCLQACRIHWRAQFPGWGDGGKTPGRGGGATRRREGVPNRGDNIIPRIPPEGSQGQLHTLWGGEKENTTCNHGANHTINGHKHNIEENRFSHPKGGKKEKITHMIVMGPIGRDHTAPSLDTEGHESSKIGRPTGGARTQWGGCPPQRNMLQPRRRAHPGGGKSDPQHRGRDPQWGAEDGETMREQTREDAPAGPMFGKPRWGVYVRGPILIWKTPPNTLGVAAMGPPHGTEKHLRGEKESFPQMAVLDSDTTTWATRLYPRLNDRWGLACLCQLYATLRNPSHLLATATEGRGGGPTPASLPQAVGYITAPPGGTVFPRELVEFPLLKVG

SEQ ID NO: 994388 - protein, 67 aa, Homo sapiens
VLIVTILIAMYLPNAYPELKIILGYIQLRKGPNVVGPYRATTTLRLIANKISFIKEPLKAATSTITL

SEQ ID NO: 994389 - protein, 182 aa, Homo sapiens
MGNMWKGKLEHGDAGNERVIRRGSRACVQGRHACDPSIWGRQGGRTGGHPGRWKTRRGNSEDPGLTQNYRKRVWGMPWKPKLHTGLRPKGPQLAKTVHTFTRTKTKDRPHKGEDPRVWENVHTNHKRPDTKKAPTRGGPPLREESKRRREDAQIRSTYKTTARANKRGRYTRRGPEQHNKAG

SEQ ID NO: 994390 - protein, 109 aa, Homo sapiens
MHSEWLLICLLSVVVLDPNMYLSVLADIISLHPGNWLGTRPIHFIATYYNGWNKTFTKVASPWLRDGNGRGWGFAPGVPKAPSGVARRETILSLSYIREVKILLRRQEC

SEQ ID NO: 994391 - protein, 115 aa, Homo sapiens
TLGLKQFSHQPPFYFFVQMGSCYVAQAGLKLLASSNPSALAPQSAGIVVLSCCASLPCFYISLSFILEFPQCFSPREREPWIGELQRAPLKGRTSWGLLSVCAPLCRGRYGVAPV

SEQ ID NO: 994392 - protein, 89 aa, Homo sapiens
STFQDLFAFDSYFIVLFLQQPGTEPHPIHTLKLSLTLKPYLYLYPYHYPYAKSNLKIKPKTNPYLYFYSYPYPRSYHYHNPNFNPYINT

SEQ ID NO: 994393 - protein, 86 aa, Homo sapiens
MSNVFLVETQAPFFPCQHLIYSSPGEMDKIRRGDETITSITCVSIGEQYKSQVFTNFPSDSNLIHLLKHLQWTVDILFVVVQIDLD

SEQ ID NO: 994394 - protein, 109 aa, Homo sapiens
MEIEHLAQLDMYRKGNDENIIIEHNIARTNPYTCLRYTELTYEEYTFRPKEKPKAKDPRNQTSYLRTAKRAHSVRYARQEVMVEDDCDMRSRRQDLSESCVDRLVVPTI

SEQ ID NO: 994395 - protein, 303 aa, Homo sapiens
PPPGMPPPGSFPPPVHLLEPSHWDTPAMPTLCSWGCRNGPHRRNHRARILVMDTHYTPIPTGWDAHLGTGHQMPERTTMAPHGKATHHKRLRPHRLMTGHSPTPKTQHQEKCPPAHGTQPTEGSDEHHLKTHNQNRETHQGANTTNQSPPKRKSRETTHTVDSTNTGQTQTQTQNASQKRRTHNETTHTNKKGENTDQRKRNRKKTNNHQKTSKTTAKKATDRADKTDSRGHAANGEKTTTKRTKNRPRATTARKTEPGARRKDNGTADTHQPRGRRRERKEEHESATGRRNEEPQKEEGERE

SEQ ID NO: 994396 - protein, 40 aa, Homo sapiens
STKNALYGSLLASGVPDKHTCMHTHIDTGITRAQMKLKDD

SEQ ID NO: 994397 - protein, 40 aa, Homo sapiens
FKLLTMYGDMLIKGGNANATVTKVLKDVYALKKPYGVLYK

SEQ ID NO: 994398 - protein, 37 aa, Homo sapiens
RRGEGGYCQGTMAMSVCFCVCVHVLSVLSVLCCAFCA

SEQ ID NO: 994399 - protein, 162 aa, Homo sapiens
AAAYYYYKFAAASTCVCAVLCYLCCAKLCCAVLSVLCSAVLSLLCCAVLCCAVLCCLCCLCCSVLSVLCCAVLCCVVCAVLSVLCCAVLSVLCCLCCAVFAVLCCLCCAVLSVLSVLCCAVLSVLCCAVCAVLCCAVCAVLCCLCCAVCAVYALLSVLCCLC

SEQ ID NO: 994400 - protein, 62 aa, Homo sapiens
MALKQITAPRGLSIPKDMWYSPPKSQHMNRLQGAHAFNPNTRETEAGRSLEFEASLIYRVRS

SEQ ID NO: 994401 - protein, 166 aa, Homo sapiens
RHLTPTPNLNLTPTPIPNLTLTPNLNLTPTHSHPNLNLTPNLNLTPTPILNLTPTPNLNLTPTPNLNLTPTPNLNLTPTPIFNLTPTPNLNLTPTPTPNLNLTPTPIHSHPNLNRTLTPNLNLTPTPNLNLTPTPTPNLNLTPTPIHSHSQPPTLNLNLTPTPVDA

SEQ ID NO: 994402 - protein, 31 aa, Homo sapiens
QASNDVRGHDVYKISGIFAYMAIKKTRFVDN

SEQ ID NO: 994403 - protein, 43 aa, Homo sapiens
KLLTMYGDMRGAFGKPQGTVARVHIGQVIMGFFLNKKAGKKKK

SEQ ID NO: 994404 - protein, 105 aa, Homo sapiens
VDDIKTRLASLRRAENLRKHRRNKEQTRTRFYKDPFKFLKSLFTKEKSGALKTTKKDLEEHLRTTNSDDLKRHEHLAIPSDIPPIEPPEHNIETSPSDMIRGESR

SEQ ID NO: 994405 - protein, 40 aa, Homo sapiens
NHKPSNTKVDKRVELKTPLGDTTHTCHCTPAWMTEPDSIS

SEQ ID NO: 994406 - protein, 67 aa, Homo sapiens
MLEETSSLVANPSPGRSAFQIINSLLILDSITASTQHLLELLVFKVLADRAQSSDFLLYYTSFSPCR

SEQ ID NO: 994407 - protein, 36 aa, Homo sapiens
RIQASNDVRGHGSGKNVGDCLEIDFEPDENKEWKAS

SEQ ID NO: 994408 - protein, 139 aa, Homo sapiens
RRENEGSKWEGKGLRRKQQREEQEEEQEQGQEEEQKQEEEQEQEEEQEEQEQEEEQEQEQEEEQEQEKKQEEEQEQEEEQEEEQEQGQEEEQEQEEEQEQEEEQEEQEEEQEQEQEEEQEEEEQEQEEEQEEEQTSRVD

SEQ ID NO: 994409 - protein, 162 aa, Homo sapiens
MPQKIRPWPYLLRPGSQQSHSSHTPPALRAFLVPSGPRPRFGPPVSYSLTPVRSVIGGNTHPGLACTHRSNGRRALTTEEFLPAAGKHTLTAQQRQGAIRAPHQGYGIARERTPSTVGSAERINPGKMWSHTARQARGKILALDKTTPANSEKPRVVTTTSA

SEQ ID NO: 994410 - protein, 165 aa, Homo sapiens
MAPLLLWPSAASSAAAGKTPPSRVPAGAVCPDGGASKLPGELAEPDWLRGCGAGLLAALGCVPGGTRRPAWTLRPRGHGPWGSLWIGRARWRVASRPGVSVSSFPHALGACGSSAPGSFEPRLLRVKLGARGAPSCHSGCNSLLVRYWARDSRGRNTTWGQTLHY

SEQ ID NO: 994411 - protein, 173 aa, Homo sapiens
MLGSARYRLIDNPSEGYLSNIISCMIALGMSVFVAHQPCRGTFLIAGSWAHCMFAAVEVRRPVDRPIPKARADAQLGLCLMSAGVTMGAKCYGIVCITVPQMWDLSSNQCDNSIAQHDAPVKTIHWLKAPNYSCVMTGSCDKTFNVTGILDRRDPHASVCNSLHSVTSADRDI

SEQ ID NO: 994412 - protein, 58 aa, Homo sapiens
STLVLVVGDKVVLVVGAEIVLVVVAEVVLVVVAEVVLVVEAEIVLVVGAEVLLGVGAE

SEQ ID NO: 994413 - protein, 260 aa, Homo sapiens
AGEGPGWSGSRFAHAGVSLSAGVPCVLSSFPRRVCWSLLFSSRPMRSTWSQTPCALTSAGRCSMVRHLGPWVASEPGVSCARMRNGLPYGPWEFNPSVSWNLECRQYSGARMSRLNESQPERRYPPDARIDGTKGYSIGRTILLPKHCLAPVGVSTEVPPLVQMFTLCSGPQDKGPRVIRGAPMAKKHPLIQSRRNITGKFQRNGKQHSRYSGDDHTFVKGALRTVGVVSHSHDNERDLWGRTRKGEDDEDGEVRPDMAL

SEQ ID NO: 994414 - protein, 298 aa, Homo sapiens
GSCNRCDRRSIRRSIRRHRRACKDSVGRRPREGRHKANGRMSPRRRRACLGAGGTWTCRAMEIQGREKSRADLVLVALLRPMPATVPAPPSAPAPSAQPTPRVSLCPWKEGSVRKPQGHRVQPVADMLKLRSLSELGPPMELKIRLITGETSGDKGDLYRLCRWNERRAAPWQDLTISHLWLLDVVRATQECQGEREVVGESYLSPAQSVKTKINIEEKLSRAKIQSLLNPGIYLESKGDCFLTMSLLQVCTRPRNRITVIRGLRDPCGQLWASSPQDPVEAVRTHRGSRNQVQARPF

SEQ ID NO: 994415 - protein, 184 aa, Homo sapiens
AADMLSDYALDQCLVPPAAPVPRWALVLGWCGTVPAGRVLCELVVLLWLGAWLAAHWAWETVVCSVYNMLTVEEGTPNRGALPKPASWYSCGPTVYDHAHLGHACSYVRFDIIQKDPNQGFLDAAIVMVMGITDVDASHHQKRHMRCNIYPRIAIDQTLNEGRPSTHGTWKDPERFYRNTKEVT

SEQ ID NO: 994416 - protein, 272 aa, Homo sapiens
PALVTRLCIVSAMMAIVHVLVLSQNTRSVNPERNTFVLDNINGCQDYCRSRSDTWFGDPKIQVMKYAFLDPNVGGKLVIDSNSMARLPLLLSSISRLQAIASRGLQSTASEQLGRAPEDWTEVGGWAPQSVELFFGYGATMRVVYADATVRVSTRDVTQPDGDQLAYRKKAILRMRSLSPGHPSNSRHIEVSPDRNIKVTSALRMPGTIYRTSVSFSTPKPIEVGESSLGVATFALDAVNAWYSSDGDRSDPTIDLLHTLCKKWTLDSLGGI

SEQ ID NO: 994417 - protein, 336 aa, Homo sapiens
DGPKWFIRYEFPKLYLYKRKLVELGEYGAFSKLPGESHQLVWWELVGPFQGQGSFGLQMSAHASPCAGGTGWVTPLGCQGYLLDTLNGEWVQWRITSKNFGMVGIFTNPVKNSRDSQKPQKGLSSLAPPGNGIWKGFRANLKLVLTPDGTGFAGNRTPWRTGRVSGPPGGTRILYITVTWSGPGKPSGRAEIRPGGARERPGGKSKRRWGGTGQHGGPSRRNGAWKSKSGYLFFHKVPWGCVTLVMAPHYWVNPRMRSFTKPRSATQLGDGAGGITKGAPTLKAIKPYKQGWSPRLGSPKNTGKPGWVARAHTPKPGLWRNLKDAKKDKACQSRNA

SEQ ID NO: 994418 - protein, 48 aa, Homo sapiens
MNEKHEAEKTVETSKERKRTGRNRTKTQSNTPNRRQRNDKQHNNTKPK

SEQ ID NO: 994419 - protein, 334 aa, Homo sapiens
MRGGAALFPRDSCCSWRRDGASRSAVPTNPCRWCASQWLYSWQLEQLAEQAGWNLPEAWCLVLTLDLLLGFCAAGWPGGLNRVWLRLHTWACLGAAAALLSLFKAGKESDAALSGTTFSSRALRNMEAHSVCERPLVLRGQLCLDPWAMEAPVLLARTYRRLPPDSRSGHKLCSLAPSPSLLRGRMYVMRRRNLASGKDSQLSPAAASTGSCGQPSLDSLPIPCARGWSFVLSRGIGPPGAGCGPTLCRSLGPVVRDLGGGHGLRRIRLACCHDRLHAIVLVRTPRALWQGLKSQWIAWSTLLPGCACRQNTGDESTGIAVNVLKSQCKAVIET

SEQ ID NO: 994420 - protein, 175 aa, Homo sapiens
RRGGHQGLGHCHSHHEGGGGVPHHLQTRMMPTVQQAKSIQRLPPNDHAWYFEVESCEILMGEDLTEEEDGGIIRRIQTSRVKAMLSLEVKGASLLVSVCSCETRDTTKEQCVFEPDVELRRLKIGAEGVEDTVGMLGLHECLGEWRQFQSAMGMHNWRKLITHFVGDRYQRTATT

SEQ ID NO: 994421 - protein, 277 aa, Homo sapiens
MTTLADWPWAGPFFTTLTEAGGVLETPLELDAERAGCSGRSGVAAVPSRKARRATGPSGSAHMVGPTLGCPRRRHWHPWPCDVFRRSPEFRLQDSTFRGDRHSVSLHPHLSFQVQPKPVLTCLVDLAKDLALSGKERRGSITPVTRGSPRAKQLWTSPALELGPQPWARDFSDFIIWHEISGLSRDNQVAGVVKVRTAKVCDNIFDMLHFKKGYVGTTQEEPHRKGSTWTQCSLALTTPKTRDKQENLNSFEQSQTTNESRTQQVRGEHRSPTRPPY

SEQ ID NO: 994422 - protein, 112 aa, Homo sapiens
MLLSHDVLQDMRPPGDRIITWYLYDQSGDDVDPRLERNDSIGRIHRARVPKKRQRGRDELPEGMGSTGSLGFLTHKRESILACLMIIEWLLGSPFAVNQHEDLELTMWVPYG

SEQ ID NO: 994423 - protein, 33 aa, Homo sapiens
STPEDSAVYYCQQFGSSPWTFGQGTRVEIKRTV

SEQ ID NO: 994424 - protein, 170 aa, Homo sapiens
TDVMRINGRDVVLCHTFATAYNSIPGSRRSVPMIMLDIASVLYWRRFTEHEGLLISSVGAPVPDEASSLDDPGQVSSCWLLLLRNDMQSSNEFPDDTLNFIKTHPLMDEAVPSIFNRPWLPENNGQIRLTQIAVDTAAGPYQNHTVVFLGSEKGNHLASLYGPNRNIVVC

SEQ ID NO: 994425 - protein, 130 aa, Homo sapiens
MNTNQGKGTPHRNAKKSTYPAMTVIIEHTCWGPSPLVPKSSHDTWHVPWLDVQRASQSPLCPLRDPVCPPAKCTDPMARRYKKWPAGKGPQEVARLGHRYTITWLWGLRCTNASRREAERTERTRGEPQA

SEQ ID NO: 994426 - protein, 222 aa, Homo sapiens
MDWRLFPSWVRTRTTKNHTDPFELESAEGLLTAHDLQGGAPDWSHIVGRPLCREDRILTTRERRGTSWGRKAICTWVEKVVNLYGNNTRTQALRHHAGQVTHRWEQTAEEPMSRETEDQITVSRTRYPGCDGRRFGATRRGTGIAMHKKGRPARGAHERHCRTGKSGHHYSEIQELHTRTKEERIHGDATGKSDSRILRQPKGGIRKYGAIGRNRHNIWNTK

SEQ ID NO: 994427 - protein, 304 aa, Homo sapiens
DFSGPLWLAVLMVGSWDAGSLTEGECQVERIRDVARHKKRTSLDAWGRCHVLCCDAVWCLLPKTAEQAKAVLRQDVMCLVAHVLVPVRWGADDVELLVFGYACKLVPVDDELGPGSGTGTAPHPLDAGTTRSSSTDMMDVVTCMTVSEYDADVLPQCNRALSGCLKQEARNRGAHLMTERESCGAIAVTEYAIEGTADKEQNETEVQRRTSKVEQPGRPRQRHGGNANKKGPDEGKNARTHRRKGRQHTKNSTTRARKRAHRTVREGSDKRTRQDKHETTTEPEPEQRVHEAQSATTPNGTRPR

SEQ ID NO: 994428 - protein, 88 aa, Homo sapiens
VDVNTHPKHMPGKQWLGVTLKEKEEERSTLFDSYGFPPQIFTFPHIYKPFLTKIGSKIYYSINKYKITFPLHVVNTVYSTYVKEPVVD

SEQ ID NO: 994429 - protein, 161 aa, Homo sapiens
GLYDLNHTEMGELIQYDIDGEDHSSIDMSLYCPELESVHVAPCEPVSQRVHAMERVERDQSRQSISMWDCKGCMWFIRGVWDFWWRTVDSQVILYHEYHLPGRSSTLQEEQASLRCRSMPVLDQVATQYFIRSGVMTRWLSCEDPDCLFSLPGILSHCLEK

SEQ ID NO: 994430 - protein, 205 aa, Homo sapiens
ERAQRQESELTRRSAMTSKGPEEEHASVTLFLPVPAYSARVQDPSLTMELLWLAFEETDTPSVGTGLSESRWWLAMAYVVTVVDRGLGTKPYTRPSIWSQSSHTECGACLQGTSESRPFEAFKDSEGYIYARGAQDMKCVSIQDLERCEEAEGGWVTGSPVSIHYDAISRLHEEVRGVNNGRWSLVRVTRARGSMLLRAGLLSLR

SEQ ID NO: 994431 - protein, 116 aa, Homo sapiens
ADICRTRFSWSECGLMRKGTVLLADNVICQCAPEFLAHVALGGRLGSEVEHTNQSFLWIQGRLVVTGLRGMSHLQRAQAWKAWALTSCPGLSHRGSHLRQASVTCKVADAVLLTCL

SEQ ID NO: 994432 - protein, 365 aa, Homo sapiens
GNMAGIELESCWLTRALVSAGEPCGHGECLSTSCRWMHAASRSQAEDVRVDGLLSLTMLPGDGVGPELDARRQGGVKGCDVPSGVPGAPPECGAEYGSEEKLEQVLSSHEGEQSGHHWNRFIPRWSIRAELASYDMRVKGTVGLYLGNSTYHVQGHYPLGYNELTGNKQIQNLGCIITEKTRPDTGGSTSLLLETMTQLPQARLMTTGSWQRKPHRQRTDTRRSTRRDRAHGQRAQGNAKRPPHDTGGRGTHGTTRLSTTPAARADKGTTWRTRGGAARGRRARQARGKARAGTRRAADHTQIQKNYGRGERDVHIEPNTSAVPIERGGSGQKARKTQRTDMNERRKAATTIHVRETVNRNGTSK

SEQ ID NO: 994433 - protein, 114 aa, Homo sapiens
MVITTIIHTRRNSLLPRGTQPVTGGHRNPRPCGKGAPSSGATGPYRYPGYPDPWCPSTPGTQISDHQIPGYPGSPGVIRGNKRIQKSHRGTTEDPQGSHRRHTGNILRSPEIPL

SEQ ID NO: 994434 - protein, 335 aa, Homo sapiens
SLCVLAGHVAPSRSTPGAELFPDTLGPRPLEGDSVSPPDPDGASDYLLHFAGSCAYPRAGQVPMVPGTSGGPGSHGWKDAFQWMIFPCLPRTPLWDAISMGHSGRADPAARQGRSTSSGIPVSRDLSRVEQLLLAQSPVTVSSHLPLWLAMLLTCDNSILPQLPDGHSIPGTVDSGKPGLARKKPQLSPGTSSTKLFEEELSIREPSEEGPVDFWFLIASSSDRVRGKTRPASAHVVNQEQETQESLPLEEAVIPIQQALPAQAVPSVHLPGNRRTCRVGTTRQRFLTSRKLAARGYKTSADNAGFVSMSWQSDPRKLAAGLNIGWCRTARLVDP

SEQ ID NO: 994435 - protein, 234 aa, Homo sapiens
ASTQETSESSRESKGKKSSSHSLSHKGKKLSSGKGVSSFTSASSSSSSSSSSSGGPFQPAVSSLQSSPDFSAFPKLEQPEEDKYSKPTGPRIQHPSIHAHSECHEHTPRDDRLKRQKGVFIWRGGPSVARNCNQTDSRLQDGPGKHIPLGTISLPTYTGSGAIGRHTTKRMPALSDNPVPADETPETGLKEKKHKASKRSRHGPGRPKGSRNKEGTGGPDDPSLPVTSWRDDEG

SEQ ID NO: 994436 - protein, 312 aa, Homo sapiens
AAAERRTAGRRLEAASSLEREKAVGRRRLLRSPLHGTEPTDRGGLSMRSTSFTSSSASSFSGAAGGGCVEARELKFAVRRAGSGRRQVRGPRIAGRPEATGTPAGRSQPDARRLGSAIGRTIPVLLASAAEGRETNEPGDPPGERARARPGDLDGRRGKGADLPQRRLIRNCRGTQRTLVPGLTRGLVLEKGMDPLRIWCHDTSQVARKNWSNKRPPLANGLNWNRDHWKTHHVHHGTMGRSRKVNIYETQPATSEPTVVRKLLISLLGAELNKPHIPEILKDLVGKTFGQGGISAKVKMAQDLSLPGREVA

SEQ ID NO: 994437 - protein, 324 aa, Homo sapiens
GLHGPVSFKSVYVCHEILCKLSLEGDHSTRLQVHMGLSKPIANFDAERDALNIESSHQDQRCGMRSPVVEHVDRTAGSAQRQDIAFAYQRRTRKELAVKHVKSALSGQLEHGDSGPIEDTCSDMTLLQLKSFLKGLGNRTRTSLIEIICSRRQAGAAGNLTESTTDTVQDCSGDGPLLYGHIWVTFRKTDWLPWQTGVEEPEDRLCHLMMNVIAPRHARDLYDAGSERRKGTAVPKVGISIIARAERAHLQKRTRQGSQRSHKGRRCTVDGKQPYRTTRLERKHLENRHTRNTGAQLRNKNKTRDEAERMHTAMKRKGEEIRTD

SEQ ID NO: 994438 - protein, 357 aa, Homo sapiens
MVAIRNRNGIPNAYRTTHSRLYTSYSKGPNVVGPYGLLQAFADAIKLFTQGAPVKTRHIVPVTLYITGPSLARHTIASSTMNPHIPSSQAPWINRQRQGLLLYCYATLCAYDVYSHSYDQGRASNLKPSALTRRTCRAVRPKQSHLKYSLGAVILAIKHGPNKWLLEASSNLITTARTPPEVTPAMHDPWHNMLDRPKYRQRHKRKPHTNIDRRGDPNIRLRTTTVEYSTKAPIPNLTYIARNTQNMHCIIKTPLQALTGSCLENQAYDRTVSSMKIYEQPSSKATTRRPKESTPLSSGVIEVEQQAIPPGKPDEGDDDNTRAPDDKTVRKQRKTISNSRAYADWLQNTEPRIRAIP

SEQ ID NO: 994439 - protein, 39 aa, Homo sapiens
PHFSPYSKFYSVYFSFFKFFNDFIFQVVKGIFLIFHDFF

SEQ ID NO: 994440 - protein, 203 aa, Homo sapiens
QKLLNQVGLPVSGRSLDHKLHELRVLRRCRLQRWEDYIGRRITELSRASAVKRVQRTSLVAESCTSNSRPDSRRAALSGSGLNGTSCVCVVGHWMLLQLRMRMRASAYFSQGARSYLLVCRTTPPCAHSESVRIGRRWNHSGSCSVCAFDWKQRGDVTAVATHDVWLTEPSDLHLSDRCEHGRDVSYSLCVDIVPETQRVHSV

SEQ ID NO: 994441 - protein, 116 aa, Homo sapiens
CDVTGSCVGTGPKQRGSERRTGAGTLGPVGTPAVCDRVTHTLVRCDQCIEGYLDLTCINESGICMVSRDRVSDSASCPIRELNEDCNFQKKFQRLISLTHASQGKQHDLDLNIPMR

SEQ ID NO: 994442 - protein, 385 aa, Homo sapiens
MMPRVGMDSSLRRKKKKKEKKRTGLVTPPVGCLTLVPQCDSPYRGKANSVSKLEPIGMARLEKSRPNWLVARPVLPAVENGSGGPGRLWSHTQGGGNTPVASCVPPRIHPTGVSAPTRRDPVPNRDQSKSGLRQWGTPLQQICARDTHYHNDTSPTGSPNNRTTVRRDLGETHKRGGNETHPDKQMCGAAPNSLRRDALRQNGDGWCAPHKSSSGRGTPPIRQTTATEESDREYTPPGKEIINLCDQTDKTTTQWGGTPLIEDNASPSMRGSTPAKEPARPRVANNPHKRPPPVRSFVAHTGRKNGSVDRHGGLTIVTQSPTKRGITTHEEDSPPSTNKWTPSASWGGHNTSRLNNADNHNVEGSAKHMCGFGATTVRHQTSSDK

SEQ ID NO: 994443 - protein, 199 aa, Homo sapiens
MAQQERHTPGGSRNGVASGRCWDWWAQKPGAPLLLLPLAHIGAWWLAIQVSRGTARPNGCAQGLVGIQEITGGLPVPDRFLALAHLGGGTRLGHRRTGKGSQLARGPELGLVRKIFMGTPGRPLRENLVSTKSLKSDRRVWGSGTKVRSGGSNLPGRSARPPGNWLTLDERDPRRSEGKALMQAVGPMGVLDEGTDDAG

SEQ ID NO: 994444 - protein, 216 aa, Homo sapiens
MNAAQVKPLGKSPQCVNPAVYACVLWCALWGNVRLAHVPPWEGGGLQTPSAQVGKWEEDSESSSEESSDSSDGQMLPTAVDPAQEKSLGNISSAKSISSPAKGTPSEVHGACEPVQVKAEKPMDNSESSDGVIGPVLDSEEAPAAMTAAQAKAALKIPQSKACQESNQYHCICQGRPLCDVGTPEPPEKPGNCDFSSRPHPQLLAWRAPSRTGRGI

SEQ ID NO: 994445 - protein, 31 aa, Homo sapiens
STRKRGHEFEKELGEGIWGIGRRRESDVIIF

SEQ ID NO: 994446 - protein, 450 aa, Homo sapiens
MWLVGAAPGAHKRGEWVTPRPRFPPNIPQWRSWGLKQGGVSRRNSVTHHNTVTTEACCVGPPRDPLPYNIAAPVGDNPKGRGSPRDKEGETGETEKAKSSIAGEPRERLPQWFVDHPGVFHNYFPNNEAGGGDHPTRRDRSDNPQSSNPTRRDRFAALSNNWGRAPMEGLLQTNHVGGAPPDVEESCVPTTECSTYGPDSGAPTPSEGETSHARAVESQDQRATHNHSLIHPKDGGRQYGRTDICGYGFPPNKSPLRTGASGGPPREQPHQVHHTLLRRDLNGRTQSSGEQTAPYGQSTHDDGAFSRRRNNNTLMLHNAGTQNVTRTAAHYWYVRDVCRDHVETNDTYLAPHQTDAANDPRGSTKQQKNTYALLTTYARTSEVNTPCGAPTGPHKRDRKKKIYTAEITTQVNTGGTNGQSRDGDVPTARGGRAIFREKPVSAGVPQSHYQ

SEQ ID NO: 994447 - protein, 139 aa, Homo sapiens
MSEGTSRWIRHWSCANRRSPEMNGLCARNEPYAPYCWMVIRKDLELKVDGEWFVSHLNHGPKAVFSLRSTKKYSSSGRTTYTVVTLHKLPEARDPYIRVYCGANVMQRNEMQKRAPLDVASMAAETLHGIPSELFDHLR

SEQ ID NO: 994448 - protein, 171 aa, Homo sapiens
MSDVGYEDGADFVHPSSKMFSSSIHAVFRTLLRGNGLRSDPRIQGVESAYTRHARSCTHANCRIDSELRLFRYLRGGYTVRFPIIHKHAHEGSIREPCVGQQRQAMALKADWEEPERTLALPGPYRSGGARRRTENGPPGWALMRVIYLRTGFRHGRGRPQHEVTRLEFDI

SEQ ID NO: 994449 - protein, 335 aa, Homo sapiens
EPPSSPDEPEFLAMDCPGNHDAQSISAPDCTRAMVAQKSTDRTVLTQQRHVLQLMPCKEACCERLLDSKTQAWECWCEVGTSYAYVHVQSLSIAKKRTSTGKTVKDPVDTLSDTWPESGPGLHHSSKAHSETQIICRPSHTKHVSSGEPAETPLLDDSRWLPPLAKMVLESTPGQLRETARLLTRSLSIRTSLAITHFTAGHVMNQKEPFQEITDRRAAFPVKHIGCASGLHSTRLQGDSTADMTCHSLANFSSGILPLSVAIQVLEPQADHYSIVGTLQAEGPEFQILERNGKKRLEKYLAHETTTVIIGPEAASLELNFRAGFLIETQRYRMR

SEQ ID NO: 994450 - protein, 50 aa, Homo sapiens
VDVKYMRHMDNYIRHMVNYIRHMNYIRHMVNYIRHMVNYMRHMVNYIKHM

SEQ ID NO: 994451 - protein, 296 aa, Homo sapiens
MSILKIRCQGDLGLLAGRSTRVEVDLVQPRKGLFESCCAQWCFTVVIYEALRGSGHNDKDSAIWGRVSSKADRRTSHIKSIDACRMGWPEAKPETLTEIAYDERLRPETRLDSSTGTGTHDRHSDIATVARCRKRHNSVCVGCSHVGPWGFGKNNLEFVAGFQRRIRGRDPRTPWVTSGPTKDPDRLDTPWESLGAHTLSLPQGFDIFLGANDSPAGRRNRRRTLGPRSSKHMGTRGMVPSHMGHRRDVGQKGPVGTQHAQRGNVVYPLGEIRGPHNVTGATRPRTRRNNSKGREH

SEQ ID NO: 994452 - protein, 510 aa, Homo sapiens
PISPHQVDRRGTADQTHEAQQKVDAYHLQLQNLMYAVCMPPTARSITNMFCAVSSPTAMQATLHPGRDLAGSLSEGMAPTSIYSKADKSPMGRPSTSTTTGNGHGTWRRLEKQAGTTQGWARRKGTRKKEGVNSKPNGTKGHSSRTGGPNLRHETNTTKRTIPIMQEQRTPITRGKHTTERASHTHRHTPQLDREETTPHEHDRMQHGDRDQHREAKRKLDNNNNKERTKRELTNNNDNRKNEEQQQRHHRNKTPRHSPKHNHPADNAKKDQRHLMEGDDTEEPTLGQAENRRKTQRARPKGATNNNANTDIQNNVGVRRNTMTGHTRAPQRRTERHLRHREHTTTGARHRTSTKREPRPAHHSRQSITHSHAQLPTQPQSTDSHTLPTSSCHPETESNEENDPTKQRTPEKPAETTRKKVKHTTTENISEDEGTTHDTKRTRHKTNNRQTKRTETPGHRTQRQGRQTTTDDCNTQEITQRRHSENAREHTIAQTREMQQHSSAACTTHN

SEQ ID NO: 994453 - protein, 204 aa, Homo sapiens
CCQPCAPHCLLPGARPVELGFAESAPGCGTAQRAVPQQGGLGGRALLVLRPGCLVAPGPVPASCACALISFLLQVYAPLPGRPDAFHRCIFLFCCREHSVLCRPAEYTGINYPGKTIYTHMSHLLRILPQKQENQCVSSLSLVLISAGYEAVIGPKTCSRLPQKHITARTAASDPRLGDWDISRLVHNQDHRGTIFNSTSTIFL

SEQ ID NO: 994454 - protein, 186 aa, Homo sapiens
MGQSPQGATKVWDGDRGVLGIDNDTSTRGPNPPEGETIQRIPPTREETPIERAEPTSAKQTRDINNPPSKHGKTTPTHKYEEQGDIQTKTPGRAKTGDTKPTKGNQESRGHKSDAKTETTSAPKNPTEEKPDNPTRYTATHHGRNLKPWAPPTNAPKGTAAAPDTTRDNSTDEHRYNRSNRSPSRE

SEQ ID NO: 994455 - protein, 119 aa, Homo sapiens
MVPCAACAGCHPGRAGRERHGLGRGPCGLAMLRLALDGPARGLALRAAALTPLQHRHHLRLRSDCQRPAGFPPGPAGCPAPGPATLDLASSSATPACVAHWAHTQVLPAGPAALDSPNG

SEQ ID NO: 994456 - protein, 108 aa, Homo sapiens
ILHRQSELMLTNQISKHRIIDLNHGFYSLIKCSRFGYYRFYFKILTHATASVLSSFSTIKHFNNIHTQTSMAGAPNITLFRFPSLLCALPNHLKCNTFNSNWYLNSLA

SEQ ID NO: 994457 - protein, 347 aa, Homo sapiens
GTLWGESGFLAGNSLAKCEHLEAKGWGRTPALAGALCVATGRRGFGRRRVPMVMGRCVWAVTPHVGFGLAQIEGAWLGLAVGWTLAEEASSGGQGVVGEYGWPAVLCYQCDLRAPKNCLVPALSSVAFGGPDAITLCSERSILVHDNRTWSTGPPSSEGERTRCPWDPRHAQIVALFGVSRSRLIGGNEGSAGDTFCPQVPSPALPNFLAAADDKLSGFQGDFLLAILVVEFLVAVASNGLACERFSIRKQAMDPAVVFSVQLGMSADCLGLDVALVALSLSPKHWRYWEAASGWSVLLHLNLLAGDLHHLVSLNGSGIGPFFAETPWASRLGVASGGCALACNQFH

SEQ ID NO: 994458 - protein, 222 aa, Homo sapiens
DSMSFSTRSSFSSNYRSLGLCPGAQLRCPAESASAGSVYAGAGGSGSRISVSRLTPCFRVRHGVRGPGPPGIAVGSWQDMGRASKNGEGDHAKSLEASGLASVPGTWSAREPARPDEAERLESRNPGRHIGGRQGRPESEDVEAMIVRTIILTEPDVARDLCCKNNWCDQTAPAIGVLDMYFEPEEATVIGHSGALELKDVKRHAEHEAASDDDHGLVEETD

SEQ ID NO: 994459 - protein, 150 aa, Homo sapiens
MMTKGKRTVDDRVDRRSGGSNERERKNKDGGGQHSRRKRGPPRAEDAARPEKETRSTKPKRRKRRRTNKKRTTERKRKKAERKDKNEKEKENKSKCKKEQNTNRYKKKKGAKKEKRERRSRNRKQETGTNNTRKTHNVTASVYHEEGGNE

SEQ ID NO: 994460 - protein, 242 aa, Homo sapiens
MAAIDIGTPSRGCCTVGCIFGERKSAKHPRSALAVVRCVSTVSDVGDCFWRIRSPGTVRNLGPCRSDALISDDVVGAVQEMCSGEVAFINSKMLSQGYRQGNSCKALCVLCVFDFASLATLLSTFCNGLGRLSAPSTKECEYPKWVETGLVVIEWGECTLPARKSAQVPTRSPRCDGSFNHWVVRCKVGTRWYLQFPTNGCMSQRTTQLVHTPSDSAVETSRAPTFPYSCHIGGPPFLTPKG

SEQ ID NO: 994461 - protein, 149 aa, Homo sapiens
MGCPRTHALREYGGLRTMSSDRTASNSLSERQALLRPTRARLGTMRMPEESGHHRPEGAQGRQAVEAGSPVTARRVAAVVTGDGLVAEKRPKSSREGSGGPQESSRGQTPLSGLIVGPPGCWSAQWGETGSWPAFNTTREVGRDTIPGL

SEQ ID NO: 994462 - protein, 163 aa, Homo sapiens
YELADGQVITSGNERFRVSVRRCSSLTFLGMDILRIHETSFNSIMTVCVCTSGKTLVQSQRTVCLYGAGTKQCITGNCSDRMQKEITRPVAQPPGRSNDQSATLTVAATYSRCRDRMAPSCAITGSIIPSQDVGFSNGAAVRTSTGPSIVHLSMLLNGTQAHA

SEQ ID NO: 994463 - protein, 109 aa, Homo sapiens
GAQPIGSPRDDASPPTEQIFLHCVLFGPMKWPMRSAAHWSMRTCESSPGDSDYEYWTLVLPGCHLLLVSCRHNQVHMLLLRQVRNLPGPQSGVLLQEHMSTKVVELCWN

SEQ ID NO: 994464 - protein, 361 aa, Homo sapiens
MLADLGLIGTIGEDDEVPVRRPESDLRGRGRWRGPLCWAYDKKLLREWNRMCCFHPCILVSHCMTGGVHVRWAGPCADVMSQLNECTHGHANYSYTDSTDLRTRFDKQTQAPTRVITGKPEALATVGITRHEEKARAAPRSSRPQRILRTHTFYMENCTEAHGLPQESDRPSQTVTYLTPAWLQRHSLDQTARILTRHPTLRSVKRTDRVMPCEPLPWMAWARIACHSSLSLPHRLLIDPPAQVTHFLCSHLSAPVPSYPLLEGPLDELRPSGLRIARTRPLPVPPGCVSSLRAPQPPCVSLLVFPTNLPDPAPTDPVPYRLAHRRLGCGSLGPAPHTHLPRPTVLPTPTPRLPGLCRCRS

SEQ ID NO: 994465 - protein, 160 aa, Homo sapiens
PGFRCAAWTVHVSCLAFVLDPWCYMDNDQPVRYSLQTRAMPMMMPFGQLLGGQTRRKTLRQWSQAPVDDLVKVWKLGVMTRLDLQLRVWRVHQAGEWCLWTSVTPCPLLHPVSLDAHIRSFGDFCAYPWTTDITSIDAGSVDAWTFGPFVFLISQYLATR

SEQ ID NO: 994466 - protein, 262 aa, Homo sapiens
MEPVERFRDCALSLAPLPLHAAGIFSLQLAQDLFSRLCPLAHSCPSWFRKRDAHSEPPTRVTTTRSSWLTSRSSVLNAAPLDDTNLTTPVTSGCPGLEPTEFFQSLGGDGSKGTVQIDDVPWHHTNCSPSSSSMELIAAAWILGASAGSYISALRGEQRCLRINPSPAMCTSVWMCKQTVKVLGKRHAGHRELHALYTTPDAHWKESLLPQLAPEALNGCCPTIDCCQVPGAMVPPSYYTQSLILWLGDHRRVRSTTTYVEL

SEQ ID NO: 994467 - protein, 103 aa, Homo sapiens
MVPRAYLTWHQQLERLSHRAGIKSQCSPHQGRLRGVPTKQQYDRRVAQASHLLKEGAPITLGYQYVRSPIRPSIPSLVTCYAVNVACNSISRGTYTTHLCFRK

SEQ ID NO: 994468 - protein, 246 aa, Homo sapiens
MQGLKGLTCNSKGRRPTYNPGLAGCYALTIGPHYRLYQTNLHLKTVVLHDRFNKEHLGASKRYETSGACHQSEPASTFVDRKWSQTVQKLARLKRERVVKPYTPQESIITAPKRVPPWDPTGGDQDGSTMANANTLHGRTRAKARNSDTSTQITPDVDDRGLNPRNAPPWATSNRIDKNATQGGTTQNLTSEGPRRRTPTGLRHINEPHTKHREHSNKDNRYTEPRGPTHEPSKDDNTATQKHPTT

SEQ ID NO: 994469 - protein, 41 aa, Homo sapiens
MVVGSGRSPVFLWVLQRVRGALTLSFCDGGTVSGFVVPCCV

SEQ ID NO: 994470 - protein, 171 aa, Homo sapiens
ERQHRRELEDEEGACASLTTITPGVCTRCFRVTLAIKECHSSSFLTTCDMDYYTSDCMSYTLVWSSRNGDDSYPRARLLSPAQFMSERRYPRYVWILSRCMKSIERNALQCDQKVSRDYGTSIESSQQRILKWFRVRRVQLVLVAVTPSQYGNDDSLKGAFAVIGAIRKCK

SEQ ID NO: 994471 - protein, 270 aa, Homo sapiens
PSRPVLCGPVPPPPASHELHAVNKASYGCRRRSRTVCQIDPRRRRARTGSRDSRPLHRPIPEGLKDGTILCTLMNKLQRAPSPRSPSMQNGTARKLSNSSRPWSATDDPVDCSRPRLFESGNMTQVQVSLLALAEKAKTKGLQSGVDMASSTRRSRSGISTCTMKAGQCVIGLHMGTNKCASQSGMMRTARGGIIYDPKNHICPHGPLDISLQMGTNKCASQVGMTAPGPGDIYDYKLGNDKCDNSSMSFQIGYTRAQTGAASFGWAGYM

SEQ ID NO: 994472 - protein, 223 aa, Homo sapiens
SSLSPTEVARLKFLRRKRRRELRYVRLPYLCCGCALRGQLPSPSARGLQEDLGQRWVTRGGRQTGSKQGYSVAVWIWGTKNYVDSTVYWPEGYCGNVFAMLSPCWVGVLYAVLLVWPRVFWKPLAVAVVLCAPVSVPPKRVPDKTQRYARTQRVEREILEEKFRDSEVAPVGNFWAPYMEAISTFPVGPPPVDKIYKGPFFLTHTLSKAKKQKNKKIKKERSD

SEQ ID NO: 994473 - protein, 266 aa, Homo sapiens
MGVLSESEKEALGGQALYPHVLVKNCAVEFNFGLESSSPTCSCPSPGVYRSSERRFPLVESYPGSPFGPKSMAECEILMMVGLLVLARPQWAINIMQSSERPSKKYNILGTNAIMDQMRVMGLRRQRNMLVRWDVLIQQVNQCLNRLIQIASRKKTQLYPEIRQMFMGQPRDEEMRPFEGFQLQSYRHWSHVDEDLKDRTIKRIDEEGQDVPGSAVLEDDSQLHVAKMLGDFLDEVLCIELQRDRKRTKLVKQHNEEMPEVWAPPE

SEQ ID NO: 994474 - protein, 275 aa, Homo sapiens
MCVVDPVLVYSWMLVIGCAVLIRTCSPKTLMESWLRDDKRKESKPIIFVYGQSKAVTGRLGVDQESEEGKRQNEALIRLDARFPEGTSLAGSDQENVRNMRAIPEHFLQIAGDDMEICADELKKVLNTVVNKHKDLKTHGFTLESCRKHDVRSWIADGSGKLNLQEFQAALVTTIKAWHEPFAKTMTQSSPASIRRYEMRICGQSAQDSTSKKRVYDIITMRYADKTHEHRQFDSFICCFVRLEGLVQSFFMHFDKDGDGIIQAQRSGSGCSSPC

SEQ ID NO: 994475 - protein, 488 aa, Homo sapiens
GQLCWCGGGSPGSSYRWPSAPATDMHRPSAPPSATGAALRGLRSRHTQRDKQRDDLTSHKVPGETRIARRRGRTEDQMNEPRRTADTQTNGNGQSGTTARTHKKHTREETTREGRQKADGRKREPRGREKQERRAREERRRESDEEEQEARGTERRERRGQAEDRTEEREGERQKRSDGREEREREKKRGGEEEEKERRQGEEEKSEREEKSKKRERERGRREEGGKERKETEKEKREKRKEEKREARGEGQRGRATEGEGRGREEGKEGEERNEREEEGKEEEERGGGKRAVERRERGQERKKKREEDRRERGGEGGEERREGTKERGEAEREKKKEKETGEREEERRRERTRRQEREATRKEREETKREEKERKRRRNKENAEERERGRNEREQKERQESGEEEEKKKMQEEERDDTRPEREKKRAGERRRREKSEKEKESRKLRTETNDGRKRRRGASEGEKGTTRDTRGRHGEDDRDGRAQSEE

SEQ ID NO: 994476 - protein, 314 aa, Homo sapiens
GIPARCMAAYKLVLILALAESDMDTCENLLQRAGTTPTSSPGVATQECERAAGRRVRDARLMSLDIVLPPQCRRRSRIREPLLGNRLARIAQLASTHVGLAKCVDGPLGALQVSRAPNRGIYTVSTTTEHDNLLAQRHGSQCRMCARLSDGRITNECTRADVRIGDPDTLLFSQRNIQVQDSPGYRRTLNSKHHAHPSLSSSLDRHHSLARDALARIVDMREDRFAAESQGRGNTVLLALAGTQWTHTAFTRGTLVNGSHERGTPLASSASHCEGGTTDRRWISTRLVIMKSGTEKTVNALIQVNAGINEGIEA

SEQ ID NO: 994477 - protein, 253 aa, Homo sapiens
MGRIGELCRRIRDTTHSGLTVGTGCLHGVGLRVLTCPGVGLRSCTGDELRVNLSFNTADNGDQQPYNRERAPTIGLGEHTTTRAENGGTQTLRHSAHTAETYHNTGRAENREVPDINTPHSTLRHAVKRCRDPSAHSTNQPRDTERATRRRTQVGTTGAYPPPTPPRASHTPIGEHHRNTPKADYTPTSAHDRKRAKKRTTAQTDPAPTNTTRTAGADNDEPGPPNRTQPPTAPRHHNTGPKPHAPTPRHNHA

SEQ ID NO: 994478 - protein, 86 aa, Homo sapiens
SDVELAVPDGSVDAELGGVESSGAVVVVVVGRRSEAGESLDKWMPTAGSRKPQIPRRVSAVLCSSWAYFFHEATVCSRLPLKAHNK

SEQ ID NO: 994479 - protein, 137 aa, Homo sapiens
MCRSLVSRKRSRVRLPGAWETMHHCKRYRPPRRSRSRSHGRLPTRGGTGSAVTAIHTGVKSGAHPWERTTMDLHVSSSSAIAGEGAYRNRKHAHSATNANQVIVAGLLEKAKSSKRSSGVWADDKEGHLGGRIGECS

SEQ ID NO: 994480 - protein, 97 aa, Homo sapiens
KKPVDELARGAGGSGALGGAGSDSSSPFTGFVAAQDWPVARADWLPVRRSGRTLCLADSVCLMLLTVGPSILVRWCGPCNIGECAPGLSRWAENLPV

SEQ ID NO: 994481 - protein, 140 aa, Homo sapiens
MNGPKGPSDGQGSNTKKWEPRKQADKGGRDKSIQRRGHTKFKEKRSTKTSTRNDEKRGQRGAGNTTNKLAHTIDHEGSNIIEHTKTQTRKTEHQTATEQHKQENKRERRTTAPSEKQNKRKGRTTRRQEATTPHEGTRKK

SEQ ID NO: 994482 - protein, 237 aa, Homo sapiens
MDRRSYRTLRLDTTHKRHDVPVWDATLLQPLLRQECLPLVALVASPSVDTCEWSDKCGLVAREPRLTSCMQSCRSDYVPLVVRCLATGTTGRCTRGAPHNASRFPQSRFGAPCPEALRRHRPHALRERLQTTEHIRGGPGTGTMASTQCKLEATRSLLSARGRPALPTRAAITLRGHIGTDLELLQFPGRNGLGDKLWQVALSPLGPLAVRISMWSTARPQRSRLNAGFSRKFQKED

SEQ ID NO: 994483 - protein, 339 aa, Homo sapiens
EFILMFYRDTAIERAPGPYTVGESLLTREGCESTVDQCETRQACENRLLDSRSPSFQATLVLLIVRRRGLAKIQMTDRTEMSFCDKARRHAVQGCDVNRVMTGGRRDDACKTYQDFNRWRKDYLRRGHPFWAIQVPCQRGVTSIARSELASKLVNALGDGFILPQWEHQSTRRTMLFNTSVEVLPFDKPQSDKEALHGGPTRHPPVPSEPRLATSSIGSFYKGVAEGEKVDPAFGPLEALRLSIQTDSPCVGDSERDLPEKGRLSWRASEEYPVAALKATFLGVSSLAVPRRARYGPPTGSAGSGLGRPGIAVARRPEELVLPADGRGEARGPNVLRPD

SEQ ID NO: 994484 - protein, 257 aa, Homo sapiens
MTLAIHASRGARLPQSILDAGWSQRLAANWEQCDQRHQSLPNYYSPSEDTNQLTLTRGMSEDGRAVMRYLLCRHYFAGPLHASTRELLHVGAMAMMQRGGKESEPIGLLRYIAFARARIESLHSMSRPRGDVVSRIVVVPVIDPPGSVQRSSPVLLRPRKAPSIQVQQTGRARLSEIGGKNTMRTGPIQLSLNLTSHDTLHWAPSTWEQMPVSAESGVTVGDSAHRFSGRRGDKFGRIPLKKSHSEFSSRFAYLRAA

SEQ ID NO: 994485 - protein, 102 aa, Homo sapiens
MPLRPCLQHPVWEREEWSPPSHDKHTSRRRDRWERDQENTVTKQEESKEVEKARNGLKERSLAHELVRVRENDNNRRVKGQIKAQRDRTKKRRRRKEEITKT

SEQ ID NO: 994486 - protein, 355 aa, Homo sapiens
MVLLLMVGLTGVFWEGNTEQTVSEIYVENHHSTEQVTGFGFPRPNSRPRRFYYGIAVGRIAIHSWGRSFAKPIKAQTFDCTLTPLATWTTGGSPTMGRGFNFNPGNFPNGPFPFSTVERTTQRHNRLSRALGVNTILVATFCLAQQRTDAFDKPTARTGVLWGGTLSPEQRAQLPFTPQHRGRNPLVWPYDSHPFLRFAPHRKLGSPRRALTGGGTQLGLRLYTVWHTTLTFETTMAALWNTTQNYSSDCRQRLIPRAEGGGQQHKQSVRDFQADCDKRTYPKRVCALAAVLQSDDVRSFSCGISRSTLCAESLVTYISGRHATDNIALIHETQLWCSGRFGLDAAEKSDPTQPQ

SEQ ID NO: 994487 - protein, 107 aa, Homo sapiens
MAAAGLWNQCPRWAGVAPVVRAAQRWPDHLFRPISAEDEEQEPTEIESLCMNCYCIWHDAASVVSKIPFFREIVVSSFSCEHCGWNETRSIQSVNAGLQDQGVAATL

SEQ ID NO: 994488 - protein, 332 aa, Homo sapiens
ALLVPCLYCLAPAVPPGPNGTCCMAPAGPSLTAVAPAACPLAGLWAMPCVTSGHALVWASYMTAAAWPLWSLLAHVPAGTMPPRALLTLRALPTGPPCFLPCDMCLPAPWWAFLCPCVMYCAMPLNGPCQGQGPCLPPVRSALLPHGMPQRVTSRMPHDAALAHVTAFTFLWPWDVLRQPEWQLLMGPGAALDQPNGWLLIGAHDACPAQPLAWLIMGPNNAREKPQTWLIPIPESPFNPGACRARPVWTLLGAVAAKLLVSPIDLVRARQPRSRPGLGNPAGPLRVLVDLICALGWPSGPICCALDLMLAGTPHMGFTPSSVIDLKAQGRR

SEQ ID NO: 994489 - protein, 240 aa, Homo sapiens
MLARALDKASNAAGTIPIHAETGGSVRIHPRQMSSVSQSNDEGSLRTLVIYFPREIEKACSQVRVHVGKCRMAHVTGDKADKKFRDSVVGAHLGIEGNSAQGTKLLSGDTIPVARHTQKGHFALVGKSRENRFMEFQNEDTIGNQEPSSRITSSAEEIENGNQNFGRVCSYGRAWGPEYKPGPFKRPRWGLSVFDTRPWIKSLRKGGTVISIANKFLARWVPRHSNQCLAGTFSLDPSKR

SEQ ID NO: 994490 - protein, 291 aa, Homo sapiens
GTTKPNLDLLEQQAAQLIQEALIFDKQADTNYTMEHIRVGWEQSVSPSLPDTIKEVENQILTARQPKGITSRRQMLGSSGRSLQPLRARIMAEALGPEECNGLPHSAWATMMGERPGGLRPMFNRNHEPGQTQISSGLVTVPSASIDFMVAGEATIRDERLTRSIAFLSRVISAGEQESSFTGGGGMRMRAGPADRGRVTGIVQDGSEYRGARLNRDPIPTQDPRALGDRSWALDRCSSRSYMLRRNPKQYKRGRATHRRENQLRQPTKTQTIHRQTEHKRILEPDTNVIG

SEQ ID NO: 994491 - protein, 298 aa, Homo sapiens
MHLRAAKATWHCHTASTQSQHTSRHAQAPNAAKTAPPDLVQTHKRTTVSRRGRKPAHTTNTGNWKAKKHSRTSSAKGSANAQYDPPSDNTARTTTHLRSHPPHCTYAGTHHSTLPPSHRQPTQRDPPQRTVGPHPSAPTPSKTVRKRKENREGHTPRTGKKNRPQNQPGRTRRPNQAATQTDHRKPNTNHSQGTRAPTQHTTQRSQLSGQPRPNEERTTTSTPQPTAPRRAPHALSTHRREITNTRQTTVRRTPQNKQDPHGRDHQTEHFNTRASPLDQHKQEIDDRQQKYTAADTQQ

SEQ ID NO: 994492 - protein, 239 aa, Homo sapiens
MEPSFESFLAPTYGPVWRHVLNGIPGLPPDNRYKLQVITQAQQQLQYGTRVNSMVLAWKATSLPYAARYVILTSTAEMFPVRNSVAEASNPFWRTCGPPRLAALVGMPVSAAKWLAGLGRDRNGGLRQPEYRTRTANSRNPLYGEAMPPTILAPLEQRRTLPLTARPPHMTSAPTASPAHTLHPRAQAQTGIANGRSTAHSPFGHQLAICRKPLSGKTTPRGTKEQPPMETQDATHPPK

SEQ ID NO: 994493 - protein, 473 aa, Homo sapiens
MHHQFAHTPGYSGWSSAFNRIVESASENILTLSTNILTTRDALVPAYITFATPYLKFLGSNEATTRLMPSNETRYSLKILTRRPHLLEWNERPLRALGRFEEFHNLSWHHHFQSRTDVQNSQSKGSRRCKSHNARLALNIETPTVRYINPDYAGVHKKDSETPISAQASALAHMEPHTLAHHIGYTSSPPKIHTDLSLAKSWSSDCRPVVRATARLCKKPANPHGGQQAGICPQNDSTQSHSPARADLCDDTFPTPTQEWHAPHNILSTTHTPSITRANQPPSTPRPNTIRGDARLPLSTRHKQTLQRTRRARSAAIRSDYRRAIDAQPLHHDIAHQQGRRPPRIASPTHTPPSTPRQDTSAPVRDSRQPRAEQERTNPAHATRPRLRAATASTITRAAASSPRSQRAPRTHLRALPEPSSHTPLTLDRPRRRAPREDSPLASELNSRLTVLDAARMTPTAGRRSRAPSVPPL

SEQ ID NO: 994494 - protein, 294 aa, Homo sapiens
TRGSAFNVITWRYLMAGNEVVATAGFSESIPARMQANVQGKPVRSWMQRVLHTNPSRSVTQGTRYGKGLLSQMVGGLTRRGWTPKHPGRSNRNWPGTRADTTLSTLGHTLVAINWYNGRYIVTCDRYSVLRSFVTRGLGEEYDLDFKSPDDRQIRYIVGLDLAWLTVYKVLHQWTTPGGVVSKDPDLTEGRLGDAWHEVHSSVARRSMVDGEELSLNKMSKGPERIAKAGERGRSWELVLAESEDHSDLVSGGPKISYEERAKQGPRASWLAGVKGGRHGPGGRRKKAFIGERV

SEQ ID NO: 994495 - protein, 52 aa, Homo sapiens
WFSKNNFAHTKQQFTKNRGAWTHHSENKGGAAGTQAPFPHYNKDDPYEFLNS

SEQ ID NO: 994496 - protein, 163 aa, Homo sapiens
MTGTKHHIALATLGKVLRSGASPGEEGALPEHGTPQWNHLGHKKHSGDKRQNTERQDVPLEHRYQGFTRDNTYNAHLRRKNIGEKPGAAKTMGVTRRGYRQNTGTFAQAPPHEIVARGQHTRGRHEPDKRATAENSGTEHTPRRRHRTRRPKERTTASVTHAQ

SEQ ID NO: 994497 - protein, 159 aa, Homo sapiens
AYGADMGKSKNQAETNRSENVPEMVSRKPDHKDTNLLRGVDPKVLREHALLARKPQPKGAKEDAGATMARAWSARGRGLSRASVKAPRRVKAPRIPKGVSRPEGPNRAWATLANPKAWGKRAQWPGYGQGGQGCSRANGQRAKGAGAKIQPTGQGCRPT

SEQ ID NO: 994498 - protein, 53 aa, Homo sapiens
MTDANTESSRHNAPGPSEATSSWQGQRAATEDNLTARRIALLNLHGHAKSGPN

SEQ ID NO: 994499 - protein, 72 aa, Homo sapiens
KVANIMLSYKCRNEDAQYSFIRESVAEKLCKLADGEKTTTEEWLCSLRRRYGGNSNFSNKKIPEVKQKSSSQ

SEQ ID NO: 994500 - protein, 132 aa, Homo sapiens
MKAGEKLALLVRVALRSNWRFWKGPRKRRHEHSRHNARYAVGQRKGHTHAKRYRREHIWVALKTLFRSVEVVYSLRYRTRAMDVEPPCGGVNGHGEVHPQGGREIRPTPVNHPRETNFCTRIGFSRTSRISV

SEQ ID NO: 994501 - protein, 330 aa, Homo sapiens
EISGSMTILFLLLAPSPSPSPSPSPSPSSSFEMESHSVAQTWSAEARSWLTASSASRVHAILLPQPPQQPGPQVPATMPSHFFLVFVSRDKGFTSVSQDGLDILTLDEWRPRMGSTRKQSGIDTWLSDPLKRQHREQPGNQGKRRAAQSADSRKTRRGTHTPRPTTEPHAKTYHHSSPKRLNKLTHCTHALDNKRVNTEGRTLSAASPASDNPPKGHKTAEPYCPQRETHAPLLPTPRTRTRNKTRRSSRQPLSRTDGQPDTPPSQARQAGPGGSPPRDAAPRLATPPRTADYTYQRVQQSPGHLHRPPCITLAPLLTYINKTARCSHAT

SEQ ID NO: 994502 - protein, 84 aa, Homo sapiens
SLRERTSAVGSLVDRNHRTSLPQLSFPNNVCYSHTKLHAGQAWHVQQGTAGSVHAAVDYQCFLMKNNQITNNQRIKAAVPSIKF

SEQ ID NO: 994503 - protein, 112 aa, Homo sapiens
DVSRVRSGILRVAETYCAQYSHHPIVNYIFDLPWMIKDYGSRQLDKVRKYRLHYPSYAIRQGTSRMGYNDDVGAVIISECSEGLSSHDGLIDSGFDVTRLRDKFRLSSNSSM

SEQ ID NO: 994504 - protein, 380 aa, Homo sapiens
MCQDQSSMSSGGGSGGWFMAIKTRVVDVWQLVAMDSSDLWRTEAWGGTWWLAVCACGVWWLATESSGWLMNPEVVEGGAWTAGRCDGRKVTVVASIHILVALGTKDHVMHSEQRSIQDNETPSYCARPGCAQCYNMRSVADYVRMQHWYYVNEQTKEHTGQCPMSISYGTPAQWKSWAKLDQGRGPHASSSPEIDHEAFSLKCTVNIGLGSDFCYHAISSAHESVIHKGHHTGAHVSTGRHSNHTPKSAARERMRHNSGPGSDKRPEADQHGKRTTKRRRDRQHPYLAHERRSSRQRQPDQAHALPNQQTAEGKKRPTNERTEPEHDHAHAKSDHRPSTRTATTEGNEHTNENDPNTQPTPLSRPQPPNETSHTAERATP

SEQ ID NO: 994505 - protein, 419 aa, Homo sapiens
AAKVCWSRSWSVLWWSLHLVSSASAITYGCTFGRGGSNPDTVIAACPASSCTQQHTVSTGMCHCNRWEASSLHVIMCNSTIRTQQHGFVHILSHCSTHYQTQGTQGGGNKYLAHITDYIESTVVSRAPVAVCTQGKPRRQTIWTPCRPFYSSTMHSKPGINTSYNHDVWHTGIVIYQYRPRPQGTVKTTLGMGVLDAETLILAVHTLERLEHKVAKEENVVHDVHQGNEKYSQGKQPKGHRYRVDNSSQFTRIGDSVGWTPTVKQTVPGTYSTLQVANPYLHTRTPPIRQQTHTISVIRAYHTKSAKPWGGNQRTRVERGHHKERHQEHTANDKQRTSEDHARTTGTDTGVDKTGEHQSDDTPPLHAGTTKRSRATKDKHEHATWGAKNDKKETQDSETDQLQVQTRSKTKHHNGTRQQ

SEQ ID NO: 994506 - protein, 151 aa, Homo sapiens
MTRSHTHNTRDFQRMPGPGAHRILPDPWVGTEKVNVQIEMAQWNNTLVFKFQHGVIAAVDSRASAGSYIIALGVNKVIGGLALNCLVTMSGCAADCQYWERLLAKECRLYYLRNGEPYFSVGSSKLLSNMMCQYRGMGLSMGSMICGWDKN

SEQ ID NO: 994507 - protein, 75 aa, Homo sapiens
RHVSLGSEKEKEWDAARVRCEITPSSSRDLRALGPGMADGARQLGSDAAAQAQAALSCDCVPAGLLPGYPVDASA

SEQ ID NO: 994508 - protein, 302 aa, Homo sapiens
MTKALAVSGCGMVLGRCIMILLIIVYLCQLQCCLRTSTCNTYLYSRPANRGPADCPTALGLDIVDMGQLTGADSDSRTTYSLGQVYSCAWLCKQKRHFPGNAETEQRGLRLADAVEGEPMRRHTDSVHRCESPWQQDQDTRDLERTRRDGATDAFAWPGGPFVGAHSRQRLTHIHPRANGKAGGPFRTEQVPLQHTEWPEPATRRIRMRNRTRATGGLHNIINAWDYTRIVPTKGAACPFDTCKPLGAKGDRIGTLEARSEDFVKTGVNTYCVAPIPNPRVAHATPALQHVGEHPRHGAHSF

SEQ ID NO: 994509 - protein, 243 aa, Homo sapiens
CISAWNDQEYEHTAEDPALLYRVETMPGLGWVLRRSLYKEELEPKWTTHGKALGLGHVDAVCLRLTPGPRVHLSLIVVPYPSYFGIVWPTNMNGYFHRGLLQEAQGSIDGSRVSSVRNCGLGREGKKLMKLEVHRAGSREAGGAGPQQEPIVKTSFLRTTQEGALANVAFIRMEEDDDVQQLEPGWQVPPISGIWMCVATIGDCGDCFGRRTTYWWWGSGFPLLSEEANLSHPIFLEPAQRTT

SEQ ID NO: 994510 - protein, 323 aa, Homo sapiens
GLTARGRLGHPDRCFQARSGPAPYSVAGLMDEALAGPCASQKIPCGRPSARRSRWGTGELSAAEDGGQRTFLGAWGLGTPSLRPVAAELEQTRYRFGGGPKAQVHSGPPGAKPGGSRVHSGQGEPPRRYSSEIARRYQGVGAEERHMRARENTEETKRTKSEPRTTTTQKGRKPTTTKEDREPETKERPTYTNKQQRTKQEGAKQTQSATQRTDRAPERTHKGARKHEKHETQQAATETRRKTRRRTPGRARRARPTGERGRRKRRARSTAAWERETSARTSTTNHTAQDTPANKQGVAKPRPNREGTAEPAEEKKHPARTQR

SEQ ID NO: 994511 - protein, 78 aa, Homo sapiens
AVTGGSYSGDAIGALTVWEVVSLLGKLLGYSSSRCNVVLYLLRSVLIVWPWKVRRTPAHSVAKSHKYSRKKWKSSSTV

SEQ ID NO: 994512 - protein, 685 aa, Homo sapiens
QNEKLNRYNYIEGTKMLAVYLYEVSQLKDEANAHLCEAVIQVEDALTSMKKRRLGSAQYICRNQRNRVYLCIGERDTRRTNAAPPPNDTAENRKQTQSDKKASQRNERQRVQSQQPKRHDANAHTPHKENNTKTQRKNPERQRDDQGTDGHKCQAPARHTAERGNTTSPQRPSDMNQRHHPAQTAAPQATPDTHWGPQTQTHNENTRPREPEERAHQPATGEEVEGPEQEGESTTDDTLESDETHKQERRADKRQRANTERNEESRGPTKETDESKQESPTEEQTSVDKRRGQPRRATTERTGDGERGRQRQTKNRRTRAAHATTTHGQSTAQNKTPTPQAEDQKQSGDDQTGRQARAAPHATRQPGPTRHPRADAPDTTPQRREPATTPERRRAQQRTAHATGRRRQENEPGEEETRTDQTRTSAKRRRDQAKRAATTHRAHSAGSRRSSQHERARRAAAPGQQQRAREANRRRDHTTTTRKRTTTETRRESSNQQTARRHTQTQMTSRPAEQQPSQLTAQEHDGRPVQSRAAEPKRSSSKQDGRRASARRSAALQKRQRPSQRASRYRASACGDATAATASQSTQLAAREIDDDDAHTTHATASDPVKPDTSQHAHPARSTRTPSSRSHHITDHATRTHTATTGTPDHDTQQTPTAQHEQRTRRRRPAPPPNARPPLPLRCAH

SEQ ID NO: 994513 - protein, 108 aa, Homo sapiens
RAPPGVGGKADDLSPAPSFCPPIVLPSGTTGQDLGASSVDACALGHETPPGCCAGGAWVGAPRLTSGPINKQQWSQRNNKQTQQEGDRGQRRLSSRGSVKSHKQPHRG

SEQ ID NO: 994514 - protein, 385 aa, Homo sapiens
MLFAGYKCPPPLGAQDHHPECRPRRTTDPQEAFTNRRITDLISETVPAGVSDFRTVPCFPFAFCRDCQISKRPPTDHDFLYSLQNFWHGKAPVQLVKISISTRRYLNPPGAIGITLTSIYQSSLAQILLNCAALAKQRRNYPALTEAGDEEEETARSPWLTETPPWRCQIHMGWQILPPKHVQPVVREEAVPGRGTTELPRNSIPHSTAQTYRPRDPTAGMQTLQPARPDRMHNSCEDKSPGPNGLSWRAQTPTQLSDHRRQATRNPRQDHGNNTVTAPEDTQLYPKNKRTLDRTATGQPTRQPTPAGPARHPPLHARQRNGEPQTLPPRDSARDTAEPDGNSTEAEIRGPGDNKRQRQQSPTRPTPASEKRDSTQKTENTSGHD

SEQ ID NO: 994515 - protein, 146 aa, Homo sapiens
MAESSASLHANGASIFFICLFLHIGRGLVYTDHISTQKPGNIGIILLLATSSNSLTIGYVLPEEPHIILSGPQIITKLTIRHPIHWGRANSLNLRRLLSRQSHPHTILIPFTSSLPFIIASLAALHLLFFAQKRRSNKPPRESSST

SEQ ID NO: 994516 - protein, 144 aa, Homo sapiens
MPESQRFPLVGACLNICLGWVHLWPDESRRQSVTKSEGLLYVCPSHTKRSGSLPLGMVGITASWNGWVKFTRVRIGIEIYQCVEPRGYRTRYKKRRGVGAGTERGRGTRAGKESAGTVQKQTDYAGSGKSIQNSGKHNQQQALL

SEQ ID NO: 994517 - protein, 222 aa, Homo sapiens
STHASVFLFIFTQTGKKLFLLIQLFEYNFHPMAILGLEEVWGNIPCLVNGWSSSSKSEIIPREGQKVSEEPNSRIITGEAVLSPLRRNRYKTRAEKDHNIARKATRGEAVDTYSGAPQRGKRGKENSETKIADRGRTGHSVEYIVTHSYHTRECLNSCHRGEPQKRKRGGEPQRATAQHVTGPRGAGGAHKAAALSKRGDRGYQHLWVSTHAAPLHRRDVTH

SEQ ID NO: 994518 - protein, 159 aa, Homo sapiens
GFDFYSHIYNHLEIFIFFERSLPLSPRLESSGTISAHCILHLLGSSDSPASASQVAGITGVCHHAQEIIVVLVETRFHHVGQAGLKLLTSGDPPTLASKSAGITGMSYCTRPNQAGVQWWDLGSLQAPPPRFTPFSCLSLPSSWDYRHPPSRPANFFVF

SEQ ID NO: 994519 - protein, 102 aa, Homo sapiens
MTLGHTMIYLHTSRRATRTPFDLAEGESELVSGFFNIEYAVRTPSPYSSEPAHNTNIIIINTLTTYNHSVSERTILTYIISPWNIYTKHILFTKDPYFVNHP

SEQ ID NO: 994520 - protein, 40 aa, Homo sapiens
MQYQHFLVDYATHQRARTPLTDTETELRYWSNLYTIVSAT

SEQ ID NO: 994521 - protein, 578 aa, Homo sapiens
DTWMMGSEITELPLKGAWKEGGAYGGRWLSLCWLPSDERLIFMEAQRTNVKLTKKRLMASNSEYQRDKRIQQQKDERRTEDNNQVLSTEQGVRDGIRRGALPRRRARTQPTEPPPTILAAAHQEARQTQRSERRLARKRKKEGKSERDNARRIKQERDGEGEHTHRRERGEPTSRSGQHSSSEHTTGLPARRGQRGRWGENSEDHTQRRGLQRTRTTRRAADTGAHTPRRREEIDYECVRANEQRPRDNSKPGENRRRTQLKKGAERQAGESRLQTRGGKSDRRTDNKRERRSRRAEEAHEAPPIGTRGGEKSSARSRGQRPHRGDGPSRGEKRGEDNNETGGRDQRTRRREENEKRERKEEKEEKRESRRRKTRRRDNDKTTEKRAERETRQRQRERRERGQQRREEREEGRRRARKRRQARREKEAASGAQPRGESSGEGWSRGGAAHDRGRDEEGGKARVEGKGEQDSDGAQGERAETKRTRRRGTRRATNGTRRRTDRARPEADEADTRDETERRSREETEEKRGRATGDQSERDATRAQGGKAERRRQGAQEKQRTRARRDTQRPRGREREQR

SEQ ID NO: 994522 - protein, 175 aa, Homo sapiens
MDSYKNKTKQKHNTTNRKKKKGGRPHKKPHRRGATTNQGYTSYMRHKKTTKKEHKERRAEQHADPQHTTQQDEPRETQRRQQAHTPRRTRPQHKQNVETSRNTHMVRTQTHTRTHEHTTAAQQAATQQQPADKEDKKRVKNNDSPTTNRQHNRTKQDREKTKIDTDKQPQPESRK

SEQ ID NO: 994523 - protein, 75 aa, Homo sapiens
KATRIGGLGSSAVSGGSAVGMITETIIETDKPKVAAAPARAFQAPSKALKLEPKEKEVDNFVDELKSEGEIHHVL

SEQ ID NO: 994524 - protein, 103 aa, Homo sapiens
MYVQLYLAYKLYMTQHISPHSDTIASRHIYTYNYPNNPPALKRPVYPETAKVHFPAVNLQTRNVDRFNSSRQFSVISCSLGHKIFEERYRNPATFHPGSGQCQ

SEQ ID NO: 994525 - protein, 171 aa, Homo sapiens
EASILAVATGVVVGEDEGGNQSGEEIVMVEPYRLEGVFICRGKEDATGHLQNAGPWGISLMEVEESLESLRNVKNDNNYDVTKSGTSFQLQMHRQQATLWVSVDRDPHRNRGAKVLYLRGVSRAPRSLHVSEIRRVRMSLVYASRVLPTDLAGDTSINLGTRKMDLKINSL

SEQ ID NO: 994526 - protein, 69 aa, Homo sapiens
MRRAHTPHRREDDNPAAGGGIKTQQEGERVKGVDHTKHNKQPGAKKNDAPPREEADRNNHRGGVGRKKT

SEQ ID NO: 994527 - protein, 267 aa, Homo sapiens
DPRVRNTKWSDDAGAAGGPGGPGGPGMGEPRCASAAGFGHVCILVVRGRWAWTAWARGPEGTQEHRRRQWTEDNRMWIARHQVGPHWIKDMKDQVPCDEMNLFFFSPVPLDGNHEDFTSIFFRYCEGPSSQTESKGIFDDDLMPKSHGEPMTPVSPGRSATRVLSRGILVRYTRELTNRHKRSVYSRVRVNVGLPKGKDWHKSGQFQVECGPFPFPWRFKMHSSQLQDSTPCWAAKVQGLIMGGRNQNEILGKGPPHQLVPAYGQSG

SEQ ID NO: 994528 - protein, 179 aa, Homo sapiens
GTRNGRGPPPPRPPASPQTSSQPHRVSPPELERWGHLDGHEGKRLSVTTQAEQTHDRDAEGGAQERGAGRRLHHRTYQMTSKPITSLASETKHITLDGPPQKTGGTRTANATLQSDQPPRRRRHKRATRRAITGIETPERTQGRQHTRRYTHTKRGKRPQGIRQQPMSGPPQPETRAHN

SEQ ID NO: 994529 - protein, 124 aa, Homo sapiens
MAQMTANSGRAADPISPEGRTQEQTPGHGEAGGATNQGAGPETERETHRGGGDPRATLDARRQAHAHVDTTLRRRQHPHGRGGTKMRPRHKQRQTLGAADKHRPEVTEHHSQDVAGKLLGHHTT

SEQ ID NO: 994530 - protein, 111 aa, Homo sapiens
MVGSTMQIHCTVLKSSDTTCINEDKKHELNCNVSNETNGMSCNYTVYKRSGGVHWIKKRLAGTTDCERLSGVKCQCNVREWALAFDVCGSLVYVGGLGFVTYKIERANQGY

SEQ ID NO: 994531 - protein, 272 aa, Homo sapiens
MKTPLSVRGYIHCGGTAETVCVSTPVWARSLSQETEALSLCGSHQRGLCVRRRTHNPPHGGKKWGCCGSTPNSLLQRKQQSPKEGRKPPKRGGGTIRLCGKKEALLSKTTHHRGGVLCAPSEKRHIYSNTKRGAQSLFTPRRQCLQRKYLRGAPPTLYPEDYILSSPRQKGGRQLQTPYIPSRSSLSTSHNTTRANTTTCGRTAPDGRRGNTPPHLTQGGGKERPGGRQKNMRAQRECGYPRRIELTPRSTWLETAQAGSPNGGGGTNTWAG

SEQ ID NO: 994532 - protein, 130 aa, Homo sapiens
RDLVEAVAHILGIRDLAAVNLDRITGRTMENWNRLMNVEVRQTLERELNLVLSVREVRQLTLRKLQEHVHQRRMRPASWHAPRTKEDGSGQTEESDEPAHPMMVNPEGPTLMRINSVQSSERPHVPGCNQ

SEQ ID NO: 994533 - protein, 35 aa, Homo sapiens
MGARRLEAREDIDRSNQGVHWLGRDVGNGIILNGN

SEQ ID NO: 994534 - protein, 322 aa, Homo sapiens
MLGFLTDGTTRTTNGLADHTQRNRRHARLNGHNATVASTNVGSDNNNSPSLATSKLPHDYELTDGATRELPKRSLDPTAHGEGITLRQLHTHFTSALTRDELWEVHAGAVPTLGPQRTRASASLHFLRSEATTQRRNNTHTSIHTLCYWLPPRKLFSTSLGNYPCCTRRPNLSVHTNSWKPVNLHASAGEDKNPLGQRIFPLLRAILRAARIACQTTHAHNTLSAHTPSIKCTRKLKGSNTTLAITQTVLFYLDTCARGNSTHPEANLTDDTFLLTAQVSLLNKHHLPRPCGNYQAERTLILSNFAEKGKAFSRKAGIERYT

SEQ ID NO: 994535 - protein, 131 aa, Homo sapiens
MLAQWLRPKRQCTLKLDYIQGEAETTYSRTQGCRHWIDRSFLVLEIDGRSGISGALRVYVAVGAITRIASSEEHQPVPREEQIVPRAIPVSRYQISWEEVVEQVAEFRIRGLSRVVQKPGLVTKGQFEASD

SEQ ID NO: 994536 - protein, 112 aa, Homo sapiens
MVRSSNGFRTWVLFSCDHSSAHCMKTGLSQCFNLTRAVSWSTPRSLLVPYDSPHQMTLAKSRFLCGQGWLADWWKVGWTKGGHVSSQHQFCTSSASVLVGVPVSPGPGWARA

SEQ ID NO: 994537 - protein, 138 aa, Homo sapiens
MCGTITNVFCAKRAKRVQSDRRLDNPPYIKHNVWGSASGEKNTEIAEGSAGTTCGKSSLSEILVGEEAQKTNIYPPGRDGTTGNCGAPGDEPTLLDRGLIPTRERHTRQHTRCRCQPAAGMLSSFLGRTTAVVDHTGA

SEQ ID NO: 994538 - protein, 211 aa, Homo sapiens
MKASCGTLREYKVVGLAESLRHPTEMRTRRPVYPHAKSFCRPYNSLFSRLGSRFWYFVLSRYKKDEMIVLQREDCHTCVVRLCEEVHARLRVNELSWIWLAAYESRSWDAQETCTGNTWDLITVVRMSAHVLAETVECRGSGPECHSIQHHEGAGASLAEIECRSAGLSEQIAMTPRSRFPRVHRPGYLAPISNEVTLRQQGEAKKPFCLA

SEQ ID NO: 994539 - protein, 174 aa, Homo sapiens
TRLHAVSYSKTQPMTPNRGPLRPSVMTFRAIAFDELSTSASINASFYTYVPVLNLNLHVSQYTKWSGADVARGKHYCSMDHTQHLPCVHTNGAFEISGDKSIVLVTISENCVFFRQWIRLSPCLPTREPLSRRIPSPKLVEVSPCAPSRIASIQPGLTYHHQKDPNVHVITQSR

SEQ ID NO: 994540 - protein, 295 aa, Homo sapiens
YTKEQRLLDPKATGQKNTHLCASPVPTTPFLSAPAPPNASPLLPHCPYGLGLLTSLHPSGLWPTRATALAPGQLHSTSHSFQASASTTWLLLPSLGTGTLQPHSLHGQLLWAPLPGAQPPFSTPSYPVCLAHPSPEHPSLPGNTLVHSGQLRCHTRQYHAASSSPCPLLQRLLRFPTAATLLSRFNNLSNAAQPGSGLPHMHSQLAASPQPERSSSPVGLATLALAQMCYRNPCPPCPPKLISARLNSATTDSEQGPRRPHLRPDLCLRPCARTLPSLSRSASWRLHLRAHSALT

SEQ ID NO: 994541 - protein, 100 aa, Homo sapiens
DRADGRVVEGNHTVYRISAPTPEEKEDWIKCIKAAISRDPFYEMLQHGKRRSPPQRDTEGAPGHGQPMRLWPFLLPPLRALWSQAEESRGLLCQFLPFRS

SEQ ID NO: 994542 - protein, 148 aa, Homo sapiens
WSHASIDHWCTLWRLGHGEATFMTSTVFHVPDVADMELLACCSPDYGHSLCPGGGHALDGSQSVLIDMKVSMQVDVCVLRCYVGLHHETAWSRQGLSDSPMCISDFDALCTDRCAAPVAFRDFSVLHESSKGDLSRCLAMNIAPNAAL

SEQ ID NO: 994543 - protein, 269 aa, Homo sapiens
VDPARELKVLINSLLELLTEVGVSGQGRDNALTLLIKMVPRKSPKDPNNSLTLWVIDQGLKKILEVGGSLQDAAGELTVTANSRMSASILLSKLFDDLKCDAERENFHRLCENYIRNWFEGHGLAGKLRAIQTVSCLLQGPCDAGNRALELSGVMESVIALCASEREEEQLVAVEALIHAAGKPSGLFITANGVSLLKDLYKGSERDSIRIRALVGLCKLGSRGGTDFRHEAVCLKGPPSNGKQCRKWVCNDPDVAGTPGRAREGLGYP

SEQ ID NO: 994544 - protein, 233 aa, Homo sapiens
MGCGTSDHSELDLRAPRYKLGPVRETPKLLRENTWAWSLKRPMPKLHSPNAVIPLPDEKLFPQQFNKLSHKKQDKVAHEEGRHWEYWRRTILKPKVGLVPRSPCHLGTPHESCNILAPRVRSRSRRRRLHDRKEPYTLLVWVTMGPTIGTPVWENPRKDAHFLRLGLPKASGDPAFRYMWVSKTQKLRSQQGGNFGPRNEKLYNWRGERLWAEKATPQGGTIGLRVVTRHSLY

SEQ ID NO: 994545 - protein, 242 aa, Homo sapiens
IKPTDSSMVVRICHLRLAESEALMLALMVFSMDKVCKENINDKNFSFWPWIDTILELIKKHLLCLWNDGCIMGFISKERERALLKDQQPGRSCLDSVRAPGKEAITFTWVERSQNGGEPDFHAVEPYTKKELSAVTFPDIIRNYKVMAAENIPENPLKYLYPNIDKDHAFGKYYSRPKEAPEPMELDDPKRTGYIKTELISVSEVHLLDFQTTDKLFPCLQRSLMKMFPDSGPEFDSMMSPD

SEQ ID NO: 994546 - protein, 358 aa, Homo sapiens
MTQQNFMLMKQRGVGGEVYSQPPHMLSPQGSHHGPPAPSENAHGVPTTFGRRSVIHWTDQMGYHRRTPCRHGQTCTFIGSSPARGMEPEGNDSKIRKHYNQRFVPHQLIWRLDLEIAGSGGERLEMREEELDDRERWHIKMESQNGARTDIEGKLARSGGYGGLPTTRRSDYGDAQSSTGHNPKGNLEHTITSQQYRNHAKRRPQNVRKHQSVNNDKRDAIKERTKKDKSPREHNPEHKKTPHPLTQRTNTELHEGERNAPRENWAEQTPRREARNDQQRGSKRKTSGHNTTTIHHDTETPTQHIDNDASEQADSNEREHHEAHIQSKAEHRKSPNSQSLTTHNVDKTHAHTTPQEHP

SEQ ID NO: 994547 - protein, 282 aa, Homo sapiens
ARAWSAVRGGQRRLPPHAAPSLTPVGGQSAVLALATLSQPTVRPAAMTAEEMKAAENGAQSAPLPLEGVDISPKQDEGVLKVIKREGTGTETPMIGDRVFVHYTGWLLDGTKFDSSLDRKDKFSFDLGKGEVIKAWDIAVATMKVGEVCHITCKPEYAYGAAGSPPKIPPNATLVFEVELFEFKGEDLTEEEDGGIIRRIRTRGEGYARPNDGAMVEVALGSYHKDRLFDQRELCFEVGGRGKSRSGLWGWEEAIGPGDRGDSIGVLKLVWLREVGTGGPNP

SEQ ID NO: 994548 - protein, 108 aa, Homo sapiens
SGAISICSSSYSWLLHRTYNRSRHSARCQGPRPERYIVSARVSLTMHVAQLGCHALRCPNICAHADAVAAGSSSIVYCFPEISDRSYSTLLTQKEAARYQNMGTVNLE

SEQ ID NO: 994549 - protein, 249 aa, Homo sapiens
KKKKRDDGIREHVNGLCTDRWRDSYSIDKKDKLRYLNSSRASTDEPPADTQAEHPSTDPRIHPGRLRSGVRSRRRAAVLLHWQLVTVTCIKFKTGSSAGRKKLKFVRRANIQNMGLVQPVEPIRRTDEMVIEGQWAKKSSVQVIRPTMRGRKTYIDGRRRQYGTQDLPMYQGVRPVEDASTIQTASTEWTRRIISSALPSQHTDGNHTKLDYSPRVDQRERRQQKGRIRPTTYAERKTERERGDSPMTI

SEQ ID NO: 994550 - protein, 146 aa, Homo sapiens
QLGPPPAYPCAPAFGDKFSLEEAYPRNSSIAALRLKAKEHIQAMESPGKPSRGAAELLRALCAPSPAWWPNFSLLALLQAASQPWAGHSRLLFERGQTEIQPRCQRDKLRVPLSTPLLAAPISISAYHREGPRILTWDVPDGRNGE

SEQ ID NO: 994551 - protein, 189 aa, Homo sapiens
PKFPTECFFLTLHAHHLSILPSCRRYIRRLRAIRELNRTVEDLKNNESQWKDSPLATRHREMLKRCKTQLKKLVRCKACADAGLLDESFLRRCLNFYGLLIQLLLRILDPAYPDITLPLNSDVPKVFAALPEFYVEDVAYPDITLPLNSDVPKVFAALPEFYVEDVAEFLFFIVQYSPQALYEPCTQDM

SEQ ID NO: 994552 - protein, 275 aa, Homo sapiens
RETWRGRTLAAGVAATTTQKDEGDSSVSRPVVEVFGKLKDLDCPFLEGLYITGVQDRQFRNCCGRPLRVPLGTILEWMCTRVWTPTLTGRGCSLTERWSQSRGEDAKKMSRKLGHEADDCVQLESDPEELLKGRVAWAQKQLQHYTGAVARYHSGGLTIGVLQLLDACEVEATCEDKLREKNEGLSGGALLLAPIVGVCFLNHEWNGGPVDMHPLLNKQSDDWQWGSVSAKSEERRRWGRCQAGAGECCRVGRRLERVLQSMSMGAVAQRIDRRQ

SEQ ID NO: 994553 - protein, 531 aa, Homo sapiens
ANVGEHGLEGFGNAYDEYTVEVSDDLSTIHRCRQRSASFITLACCILMQTSHLCQYAKVPRSWSLRNLYVKSKMTDSLSSGARIGLNLLCVKLLGGWKDKFTHLLDRVMDTHSIFRGLPWAQAALMDLHTRMPAITRKRTKLLNAASTIIPERNSYDHYHRQGDRLGSTLYDLTPQDHLVLAQRANRRGPLIATLTFPIVQDYYRQRVGARVKNSCEWPNATRMDLTRRRELCPKSKRSPNEDLSRRIKSVTLSVGLTIRGGALWQAQVRDNKKAQSGLSISEPNIECALQIKPLGLYLTEEGNGGVPYGYTGRVGWPPQHKLKILSKGKGTPPGGWIEHGNIHFPPHMDKPSINPRNTNLNFLTVDDPQEGKARLNTMIVETPFPTEGERLYIEQVFRRSRGSTKPTLMELLPGREGRPKHSNNRSVPLMVNIERVREARMTALRTSARAHFWKAGTPAYARVGDTSEERVPAPVNKTQCEEGSNILAEAKQAHTNPQQLTSHRAGGVTNTNHPEVALTRRVRKNNQNMG

SEQ ID NO: 994554 - protein, 348 aa, Homo sapiens
VERGKGREKVEGEGGDTTTTTITRMPDVKERAARKEPGAAESASRESRGGNTRESASSAQGHRSCRFNRRPSTAALTPGSAQGRGVKTAPRGPVGHGGLRTGPTSRCPQPSARAKLPSVTRGAPLPPSPGKGHLGGTPSSHRLGMTERVHDASKLDCQLARKEFIFKQPERQGQGHHAQRLLGASELAAVSRAPDFSCALELLKEIKKILLVLLVQGISRWKNEIEEASGPGSSFRQQADRGNLNVFLLSQYYPQLKGLCVDQKKNRPVTKTGNLSKPADGDDKGGDPRGCDQQNMGTWGIHNTKSPSPANEKLATKKGATTEATKTPRRYNPEGATRQKHKYAPDME

SEQ ID NO: 994555 - protein, 140 aa, Homo sapiens
MKRPQGSLVGPDYEQPPPNVMNARKGVFRITGSEGKPPFGLEAVDGKAFGLKHYNVGLSGDRGKNIGDFETFVGACRGCETASSTKINYVETRQFPLFGPPHLYAIFIYAHGTRNNNTHYREHTFYSARNTHITNIIQSG

SEQ ID NO: 994556 - protein, 171 aa, Homo sapiens
VAELLSQAYQTAMEQIRAGKLCLSSTVKQVVRRLNELYKASVVSCQGLSLRLQRFFLDKQRLLDGIHGVTAERLILSHAVQMVQSAALDEMFQHREGCVPRYHKALLLLEGLQHTLTDQADIENIAKCKLCIERRLSALLSGVYAYYLLPTCRVGSETWQTVLNTDQIRWC

SEQ ID NO: 994557 - protein, 171 aa, Homo sapiens
MAPSRNGMVLKPHFHKDWQRRVATWFNQPARKIRRRKARQSQGAPHQPQRPAYGSHPGPSMRLPHEFGTTKGAAPGRRGFKPLDGGLKGVGPGHFHKGKGGPGTIPGISCEIPREAGTQSTVVPCRPNVQPAARSTSPRLILFPRKPSDPKKGDSSAEELKLATKLTGPVM

SEQ ID NO: 994558 - protein, 70 aa, Homo sapiens
RRRRSRRVDAAEASMVSGGGAAFRGARGAVGPLVCDGRILESFVIYGGLIVGYGVSPVVFVDAWGWSAIT

SEQ ID NO: 994559 - protein, 119 aa, Homo sapiens
MQSVTVRRRVCQGRRIKPASVKPLKENIRAKKKLIDLESIPSKGSAKLGNPESLIAEPFSENATTVKVVYTVITRVTPVEGEQISFTLPRLQGPVDSVVCNNTRVKDAECKARVHRMHN

SEQ ID NO: 994560 - protein, 67 aa, Homo sapiens
PCLRTVTLTMRVGGFILDVSETKNPPIPDKYEMVPLGEERSCEGTVRRWPSTSQEERPNKKPTLLAP

SEQ ID NO: 994561 - protein, 151 aa, Homo sapiens
MRTKQRREKTRAEEYYHQKHNTEKKIIANTKQQLKKTYQQQTTYGRKNKQPPVETRGAAQVKRQVEATPTKTTAEVNKNSTPKEDNQIMKETTKQNYTTHRRKEEKARRKIYTTHTKEQTTNSQEESKYYHQEKTTTANPSGAQKQHTRGR

SEQ ID NO: 994562 - protein, 241 aa, Homo sapiens
MRISKWELELPEELRCDVSHCRRNGHWRACSTTAAARWCDACVSLRRQTRTARSRLQAAAEVLTLVSTHGPSPTRDRVDLRYEMTVVRFLHGKASARRVHVRTFQVHAVHSHEGWVRELYSAMVGLEAANTGGASLPSTRRGAHNSVGWGKESDEELDGKRKIVNLLLVLTWITIEETEAMSALVRITHVRNQINRANYARSVMGCDPESGATEVVRRGFGCKVTEPRGFKEEEERRTCTV

SEQ ID NO: 994563 - protein, 96 aa, Homo sapiens
ISLAGDMSCERTDEFDYADMEPSVNEVCIYSNVYISIGMSARRAIKLFNKLVLRIRKRYGLGNTKVAVTFYPVTSHGDANRDYMWVSHNRMEITTS

SEQ ID NO: 994564 - protein, 300 aa, Homo sapiens
MPFSKQSTSALKLRFPAEDEFPDRERSSTSHMDQGADPRACTRSCAPRARRASFTLDDVIQTGVDNPGHPYIMTDGHAMAGDEESYEAVQRISSKPIIEDQARRHTSPADEHKTELKPRATCRAATDHGTPTYVLSSRVRTGRSIRGILTSPPHCSRSKAAEPSDETTQRADSPEPHHGPGEPWTGQQNTKDASRRHDRPQEPASTTNKETHTSYETNTPRRIATCTTLRQREHYTQAQCTPTTHEKHGTKQTKDTYKTSTNERTTKQETHNEYSNDNKKPRRLPNDKQQRTPKDDDTTT

SEQ ID NO: 994565 - protein, 102 aa, Homo sapiens
ATCPPLTSESHSTEPHQRGTRGRLSAAASGPQGGPPGPCTLFLPTWLLAETCVTCCPSLTCHLSPYGDPLVASHVVVHICHLRSFFPPLGLSQVCFILKKYI

SEQ ID NO: 994566 - protein, 103 aa, Homo sapiens
MAEKQRDASVRVSPGQQSTDESEEEQSESRNSTAESMDRLSSGEVNYFRRMRPSSMESPLTSFVLRERASVSGERVFMLTVECLEGELSRSKIGVACERAVCK

SEQ ID NO: 994567 - protein, 120 aa, Homo sapiens
MQACFLKCLLIDGVRIYGAKLTPEDLVGEVLTRILGARGAKIPLLRTGGGTGVKDNNIGVNYQRTLIEMSAAASLILDNITPPGAECSKRRGGVTNTQEPRAHDSYAYIESRTTHNYCSI

SEQ ID NO: 994568 - protein, 112 aa, Homo sapiens
MMKIDLLVSCIMMLLVIHLSCSSSRVSLFGIVLPNSSLGYRTKADRYYVVAQVRIYVLINRSMYFAIRVRTASNVERSIFAPYSSSATCRYNSKLYSSQNSIVHIVDIRISA

SEQ ID NO: 994569 - protein, 204 aa, Homo sapiens
RVCGRVELRMSRRAVGSHGAQPEWHGYFERLLLFHKALLSGAVDIVVSYLRRGQVRFRDERIGPRQKPTGDPVIVVQYSRCLVSSITGPQSVQSSPHWFLSYPINVERGCRRAVFPFAALSLSEGKSIKAGYAVPGAPILPTFKPITDWSHLVGNPKFRPSRFIRVLCNVPERKGVRERTKRFPRTAVRFSLFALRWPRNRRFG

SEQ ID NO: 994570 - protein, 354 aa, Homo sapiens
SHVLSCMEKTEQCLLALLQKHLPGHPYVRRKRRKFPDRLADDEGDSDSESVGQSREETEEVKRQGPSEGAEEGEQEKPSRGVGEAGKLGGFKGEVTGASRNACHAKLGLLLQFPMGPFSSKGKLLGSIMLSLMSPAQKSSQQKWSPPESGRSLGMDSVSSARALLLSLLLLPHYSSCQAPWPQRGCCTPTVGKERHLATLGEVWTLLNLYLYTSPISLRPTCLFPLLPLRVTVSASAYRIPVPPDLGTGGARVIGPIRTPFEKSEDLTVEPTAYPVRPYRQTEISDSNKGGGYTSMNEKRLRKECGTTPHITKLCGNKEATVLKREYKSRYNRLVRKKEVQEKRIAARATSVVV

SEQ ID NO: 994571 - protein, 161 aa, Homo sapiens
LAATVRGLQLAGSGRHRLVQAVALRDVRACLTVLCTRGPLADYPRFVESVDEYQFVEAPGYLAIRDPQIPQEHEHYRYALVELAGSQETPPTKLTLLGTDSSSVMLQNAPVAINGLSAHGNRQMTVIRESVNGDIWALQKDVADFLSPLLGKTPVTPGQLR

SEQ ID NO: 994572 - protein, 314 aa, Homo sapiens
WLQRVTWDNAGKEREAVQLMAEAEKRVKASHSFLRGLFGGNTRIEEACEMYTRAANMFKMAKNWSAAGNALVKLPNSIMQLQSKHDSATSFVDAGNAYKKADPQEAINCLNAAIDIYTDMGRFTIAAKHHITIAEIYETELVDIEKAIAHYEQSADYYKGEESNSSANKCLLKVAAYAAQLEQYQKAIEIYEQVGANTMDNPVLKFQCQGLLSSRRALPLHSGMSLEAKACSGQIRRKCSGDFKDSGEVILENLLEAQRHEQVRFLKPEGVGPITGSGRPRCVVQISRGKEMTGGHLCAPYYGGNAYTPLCFPL

SEQ ID NO: 994573 - protein, 70 aa, Homo sapiens
YYYYYYYYYYYYYFERESLTLSPRLECGSTILADCDLCLLVQSNSHASASPVAGIAGERECYHTQLFFVF

SEQ ID NO: 994574 - protein, 77 aa, Homo sapiens
ASFVPHCNQCMRSYMDVPERLSSYEVILGLYTMTLRPLRILVHQGVLYASRLISLKHSTPKMPSLVWHICLSTLSVH

SEQ ID NO: 994575 - protein, 101 aa, Homo sapiens
MGECNPPGVRPTKCNRGPADNDGAEALNTVKCSPWNTGDAPQPAHKQHVVQSTKGAPGDTTRRPIQRPVAAHTTINDDTQRRCHTTADAPTPAAHAKHRTQ

SEQ ID NO: 994576 - protein, 614 aa, Homo sapiens
ALQAGGFGTIARPTRSVYPHPPKNTGSLKMAEPGYSHTNLKLYSQSVQYPPIYNNIPTGQPILLLIATHFYIATAPIPNCLPNRQTFLALLTTTYAHQATKTDEATPPYGLYSTTPYRLTATNKLFTHKAATIQTPDTTHTINHSYNNTTPRTTIASSTQYRPTFHNLPANAPPLNPTLHRYIPPTLRITNILPHAYQRYHHLNLSLETNDKSPYPNDNTKKPAYFTLRQYRTHRQTHTAARPAPLPTQPSDRPAQTTQGRHGPDNTCDKDTERQPKTDKHHSTDQSPAKPTPTPLKTNHTKNRDQTNQARNQPYSHNRTGARHTSAQPIQYTAHPTRKHTHTPPTSQQQAQHPAQDTHNAEHTTREGHTQVGADNPTLTATAPPAPPAHNTPKRRTPHTHRATRHPMPSTHSTRSTGSATPKRNEQVNARDAMTRPRRRKQATRSTAHPSAPHQPAPTRPRPSKAPAEQRQRDRGRLTHNHREHTQHTSTTAPPNATTPRHALGTQIREPARDSDVTTQERARRGCTGRQTPQQHDRARRPTTRESITQQKNTHLLTAHDDTTEHTPRKDTQTYSHHYHPLNAQQPTTHRQPDARAEQSRHGRNTRQAQNHTT

SEQ ID NO: 994577 - protein, 230 aa, Homo sapiens
TSSTHEVMGPKKKHLDYLIQATNETNVNIPQMADTLFERATNSSWVVVFKALVTTHHLMVHGNERFIQYLASRNTLFNLSNFLDKSGSHGYDMSTFIRRYSRYLNEKAFSYRQMAFDFARVKKGADGVMRTMVPEKLLKSMPILQGQIDALLEFDVHPNELTNGVINAAFMLLFKDLIKLFACYNDGVINLLEKFFEMKKGQCKDALEIYKRFLTRMTVSEFLKVAEQVV

SEQ ID NO: 994578 - protein, 156 aa, Homo sapiens
MPLAFYVGALAKGLVVRKGIPLELENGRSASTWALGPFRWSPIGQTVVQWVGPWTLPVLRKTLANIIRLTFKEGWVERRACRRGPLQGGASLGHYHLEATRVALPRTFQQRKPNSFHLSTLGAGIALKDHFGQSSISWYDNRIGRFTANQGGVGPS

SEQ ID NO: 994579 - protein, 133 aa, Homo sapiens
MIGPLHSRLADRARRPCSEKNKEETREPEGRGREKNKTQPSPRGNALAPPHGGGAPEALSKDETTQKQGAGPPRGQRTRSHIPPQTERQANQETQQQQGDHHAPHTRARYTEDLATAQRNQSPCTRTEPTHPT

SEQ ID NO: 994580 - protein, 158 aa, Homo sapiens
MAFMVKSMVGGQLKNLTGSLGGGEDKGDGDKSAAEAQGMSREEYEEYQKQLVEEKMERDAQFTQRKAERATLRSHFRDKYRLPKNETDESQIQLAGGDVELPRELAKMIEEDTEEEEDKASVLGQLASLPGLDLSSLKDKAQTTLGDLKQSAEKCHIM

SEQ ID NO: 994581 - protein, 74 aa, Homo sapiens
MRQEHLPPRHARGVRASRRPKTDNAETSPQHTREDRPERPPHTHIYMTAQPGNHHGKHNTRTEPQPKAVSQLCA

SEQ ID NO: 994582 - protein, 219 aa, Homo sapiens
TSCSTSLVTCHRNERQTTIELAKMFLNRINYWHLEAPSQRRLRSPNDDISGYKENYTRWLCYCNVPQFCDSLPRYETTKVFGRTLLRSVFTIMRRQLLEQARQEKDKLPLEKRTLILTHFPKFLSMLEEEVYSQNSPIWDQDFLSASSRTSPLGIQTVISPPVTGTALFSSNSTSHEQINGGRTSPGCRGSSGLEANPGEKRKMNNSHAPEEAKRSRVM

SEQ ID NO: 994583 - protein, 266 aa, Homo sapiens
YHAWLKTASFLRVSLATELGAGDDTVSEEPPACPAALSSLKLGDSCVNAATMNEVSVIKEGWLHKRGEYIKTWRPRYFLLKSDGSFIGYKERPEAPDQTLPPLNNFSVAECQLMKTEEATTNTFVIRCLQWTTVIERTFHVDSPDEREEWMRAIQMVANSLKQRGPGEDAMDYKCGSPSDSSTSEMMEVAVNKARAKVTMNDFDYLKLLGKGTFGKVILVREKATGVLCHEDPAQRSSIARMSRHTVQRAGLQYRPPLKPQVASDL

SEQ ID NO: 994584 - protein, 153 aa, Homo sapiens
MTPINKTAPAQEASSTERAACHVPHKPQGMGTKIPNTGMTEHRDTPTTHPKRTIAKTAGGIQTPERPTRRGKTLRAAADRGKPTLVPQGHSHQDGNERPHPKSAISTGGLSQGTIPRKDTRAQATKAMGPAGEYTGRPTKRGDGTTKRPQPRT

SEQ ID NO: 994585 - protein, 376 aa, Homo sapiens
MEKSSYQRCRHGDTVDSGRRSDHYWPSASYKMPGGIGHIEQPIAQHICSKEAAEMGKGSFKYAWVLDETEQLSVKRGITIDISLWKIGDQTSSYVTIIDSARSTGDVLSKNDDYRDISGCTVLSWIVASGVGRIVKLVISEEWAEHESMPSRGLQQLGVKQTEVVGVEQKGFTEPPYSQKRYEEMVREVSGYIKRIGEKHDDRSMVQILVAWGQHVGDKVAKNALGTRELHRQHGKEMQKPRGNKDEMSALHLAYKQQPAPLQNATVPDLTGMITTWRTRGKATRWTREEHVAPKDREGASMDNATGHTGNNNGRRTREATEQRTKGQREKRPGPPRARENKKTDTRPKKPQATANERIDRKDETEREDTTDTRQE

SEQ ID NO: 994586 - protein, 265 aa, Homo sapiens
KKRVFMGSAPPSCDFVDKGVLGVRRVRVGSPTPEVGCKSKVGCKHVQKKKQKKKKNKNQQQKQQTKKQNNKHKQQNTNKTNKQQNTQQQTSHTTTHTQQTTQTSQDKQEGENKTTDSEQARPQEGAEAVGTTHNSMRTHGQTHRSRRRTESRNKQNEKQNDAEKKYTITITADAHEHNKRRRARNRRDQTTDKTTRSVIPQTSREAARKTHKPTGESTTDATQKQQITTRPPTTTAPHQPSTHNEATRTTHTEGAQAHNTTKDRK

SEQ ID NO: 994587 - protein, 121 aa, Homo sapiens
MYFCQMLVVVKTINAAIGVIYVTGAAFSDPAFLRSKFYFGFIHLGASMAQNLREQELCVPVCVIFRGSSRLKFSSRTLSTMLTVQLTWIGKVLTMAIVGLCGIPLYPTGVCIGGSLSHVEF

SEQ ID NO: 994588 - protein, 241 aa, Homo sapiens
MGARALSLPVRVRCLSDDRGAVMIIFADLRDRIPYKGRLVGGIGLRSAGSGCSLEVQAYDYSEGATENAFYAPPVLVLCWLVREDVLGKAKYDDYRTCMREDTSKQYDDNWIDAEILRTFTGTFCDESRLSELIITEHDEDEASVESEGQDESRKVITNDGAYPEERDEYDHIGAAMMMNCSELGLGDEEGPDSCSIQLLKIRDKRVVLMSGVMTVRKQIEEQVMDLSTNFRWLIWWCPGV

SEQ ID NO: 994589 - protein, 106 aa, Homo sapiens
MELRIGDSDIGRKNTMYDVCVLVYTIPPGAVRNTSFLCRYASYTRVSAPMRFCVIELRIIIEKYDVSYRLFWYSGGHESGCDCDLSFLPRIQNHCACTNRIKMDEL

SEQ ID NO: 994590 - protein, 86 aa, Homo sapiens
VYFADDWLITQQPGDCYEEMQSGPVDVSMWSCGVTCVGVPAIADGALQVQDRPGWGFPPRALGAQRGPVPWWDDGWDLPVVPWSST

SEQ ID NO: 994591 - protein, 344 aa, Homo sapiens
AQDPERGPRAAGPVPDPSSMASWAEPSEPAALRLPGAPLLEGFEVLDGVDDAEEEDDLSGLPPLEDMGQPTVEEAEQPGALAREFLAATEPEPAPAPAPEEWLDILGNGLLRMKTLVPGPKGSSRPLKGQVVTVHLQMSLENGTRVQEEPELAFTLGDCDVIQALDLSVPLMDVGETAMVTADSKYCYGPQGSRSPYIPPSRPVPGSHPEDGRGWTLTWEMLKWARKRRWPGQTEAGSGGNAQYQGADLCAGRQFLFDLGHQGYSLQKPRGGLDLVERAEATRNGVTVEEALPGCSSNTPGGGPTELYELLSPINPRTSPCCPSWSNPRVLVRTQSRADNTEGR

SEQ ID NO: 994592 - protein, 262 aa, Homo sapiens
MIQRIPIAVERDCIDTDLRDLCTYVSVERPYREGPATHIVCVRISYSALHSNQPSYSEASVHIAALDTMRLPSVELLSNALVSCRPNTSQYGSEERHWKSIVKLRSRHRTGGCYFEANLMTCLASAIGWDHWKYIPLIGYHRQCRIPNYPRGSPKVAVRGRVEMSQAGMWGADSWCSERITPTVKDDSQCWNGLKSVALERILDSKHSKERIFRKHGLRNERGMRENTPRLVDPTGTELIHYGLGLVGIEGPEGNIPGLKTS

SEQ ID NO: 994593 - protein, 105 aa, Homo sapiens
DSELQDPSEMAEVEETLKRLQSQKGVQGIIVVNTEGIPIKSTMDNPTTTQYANLMHNFILKARSTVREIDPQNDLTFLRIRSKKNEIMVAPDKDYFLIVIQNPTE

SEQ ID NO: 994594 - protein, 267 aa, Homo sapiens
ADMATLTVVQPLTLDRDVARAIELLEKLQESGEVPVHKLQSLKKVLQSEFCTAIREVYQYMHETITVNGCPEFRARATAKATVAAFAASEGHSHPRVVELPKTDEGLGFNVMGGKEQNSPIYISRIIPGGVAERHGGLKRGDQLLSVNGVSVEGEHHEKAVELLKAAKDSVKLVVRYTPKVLEEMEARFEKLRTARRRQQQQLLIQQQQQQQQQQPEIKTTCHKALEGKASRSIIRQSQFGKPGLRNPSPKRGRNPRMNPVKVGTLG

SEQ ID NO: 994595 - protein, 176 aa, Homo sapiens
MASKTTTTVTPKRIAHSPSLQSLKKPVIPKEFGGKVPTVVRQRYLNLFIEECLKFCSSNQEAIEKALNEEKVAYDRSPSKNIYLNVAVNTLKKLRGLVPNTVPNLSKASGRRVVSHEVVLGGKFGSKTSFSIEPPSSPRVEELKALTHQCPAGLPVQRSGNVLVHSEPLRDGFPFP

SEQ ID NO: 994596 - protein, 94 aa, Homo sapiens
DAFEKEETFALSSTKTLEEAVNNIITFLGMQPCERSDKVPENKNSHSLYLAGVYRGGYDLLVRSRLALADGVTMQVTVRSKERTPVDVILASVG

SEQ ID NO: 994597 - protein, 258 aa, Homo sapiens
PRLSSLLRGSVPRDTRAPSRSSLFLKPFKAVFGFLLSSQILFSPVKMVDREQLVQKARLAEQAERYDDMAAAMKNVTELNEPLSNEERNLLSVAYKNVVGARRSSWRVISSIEQKTSADGNEKKIEMVRAYREKIEKELEAVCQDVLSLLDNYLIKNCSETQYESKVFYLKMKGDYYRYLAEVATGEKRATVVESSEKAYSEAHEISKEHMAANHPIRLRLALKYSVFYYEIQKSPGGKGATGQNRLKKPCESTSGGT

SEQ ID NO: 994598 - protein, 106 aa, Homo sapiens
MRVWVPVGVLTSLAYCFHQRRVALAEQRAPNGQRPVDRNLLELKMVQVVFRHGARSPLKPLPLEEQVEWNPKLLEIPPQTRFDYTVTNLAGGRNYILITTLNTEDT

SEQ ID NO: 994599 - protein, 373 aa, Homo sapiens
CFICNVGKSEAQRPGERAAGIRGQASLPGSWSPAEVRAIRNNDSPIQEEEGSPCCHLISAPLLLPCSRAFSLEKTFKATFVLRASRHQLEKVNLANDMKILQGRILAGKLQRTPSADVLKTSESQKLIIHPGYLIQAPRTQPTKELGRLCNFGPSTMKYSLWALLLAVLGTQLLGSLCSTVRSQRFRGRIQQERKNIRPNIILVLTDDQDVELGSLQVMNKREKIIGNRVGPPFNNGFVTTAHVLSNQAQSMVNWEDTCDIPKVYTKMGNALIPQWEQMNETSDTCGYTRNRGKERLARPPDGNKGSKNTGQEESRNKKKQVRPGEKRQHHHLTQAAPDKDNKEKHQTKRDPVDTPEHTQKDRDTRPTSHPHY

SEQ ID NO: 994600 - protein, 95 aa, Homo sapiens
VSNPYYWKHLNIMSLHVDTLVTKFLNLSSSYSMAVRIAALQCMHALTRLPTSVLLPYKSQVIRALAKPLDDKKRLVRKEAVSARGEWFLLGSPGS

SEQ ID NO: 994601 - protein, 83 aa, Homo sapiens
MSKWARTKLDPLRYLQISLKRIWGHGPRSPGRDWTLPQGYRVQPRAWKLTPWNYRADVNEHTCLGNEHRRHKGRKRVSQLNSA

SEQ ID NO: 994602 - protein, 164 aa, Homo sapiens
MSGLPPGPEKGPTRGPFSPPFAPSFFLCPWASNGYPYSSSSSSAAASSSSSSSSASQYPASQALPSYPHSFPPPTSMSVSNQPPKYTQPSLPSQAVWSQVHLLLLPMAASWPTTTPIQALSLLLGVNLQPTQQPLHITITSSSHSNNIIMETLGPLHPERILTL

SEQ ID NO: 994603 - protein, 283 aa, Homo sapiens
SFGYQLEALVSCILVLASNSTPKGGTGVLHPGAGLKLHTHLQLVTGFVVIRRMHACLAQRYCSQPVVQCVFPSYRHDSALLSWPPVVDELSTQAKTRCDALEVVGHEEFLNPPRHLGCPGDSSCEVRTTVLAIHLPVHELGLLGLDGHFGPEAWAQLVDDLCIEAATIVHVTHQHGERLCGTQLLRPHVCDPKVVVGLPNCAEGYCVGHLETVAQPFVDCKFDTFICTGNSSALRWDSRTSRVGQASESHLRGARPCEPESFHTQVDPGRGARGIDRGRGGGG

SEQ ID NO: 994604 - protein, 99 aa, Homo sapiens
ALDCELRLSQGRMVATYKILALQPVFPKDSADKAFTCVFICGSSRLEQFLLSQALSRVGSPDAGLSRSLVQGEQKLLEQQEVAGPSYPRNLPRTMPRWG

SEQ ID NO: 994605 - protein, 239 aa, Homo sapiens
QVYYVEMTVGSPPQTLNILVDTGSSNFAVGAAPHPFLHRYYQRQLSSTYRDLRKGVYVPYTQAKWEGELGTDLVSIPHGPNVTVRANIAAITESDKFFINGSNWEGILGLAYAEIARPDDSLEPFFDSLVKQTHIPNIFSLQLCGAGFPLNQTEALASVGGSMIIGGIDHSLYTGSLWYTPIRREWYYEVIIVRVEINGQDLKMDCKEYNYDKSIVDSGTTNFVAQEKYLKLAVKSISS

SEQ ID NO: 994606 - protein, 363 aa, Homo sapiens
PLASSVLRILPAPHLPARSSGCRSAGTTLLGAAADMSAVSQPQAAHAPLEKPASTAILCNTCGNVCKGEVLRVQNKYFHIRCFVCKACGCDLAEGGFFVRQGEHICTRDYQRLYGTRCFSCDRFIDREVVSALGKTYHPDCFVCAVCRLPFPPGDRVTFNGKECMCQKCSPATLLGNSAHVAQVLRSCGGCGLRNQEWPGPGGFGQALGTWDASSARLVGKLLHAEYISKDGLPLLRGDYQRQVGIRCTLYNVLQGPVQQAEERLQPYVRIRQGPKVHKGQEIPVRHPQWASRSFSGHGSRQSEHPDRKHCRSPPDGPRCENSELLRSSFTSTYRPQIYTSRYHKHHITNTGDTTTDSPLFVY

SEQ ID NO: 994607 - protein, 201 aa, Homo sapiens
ENEPVNVEELAFKLWQSPVLKIPQTSPQVLRIGGIFETVENEPVNVEELAFKFAVTSINRNRTLMPNTTLTYDIQRINLFDSFEASRRACDQLALGVAALFGPSHSSSVSAVQSICNALEVPHIQTRWKHPSVDNRDLFYINLYPDYAAISRAVLDLVLYYNWKTVTVVYEDSTGLIRLQELIKAPSRYKSKSKSAASLWQ

SEQ ID NO: 994608 - protein, 120 aa, Homo sapiens
MDDNITVLLAIINNGSSMCKAGFQVTMLIFPSIVGHPEALESDGGCGSDGLLHGDEAQSKRGIPTLKYPIEQGVVTTWDDMEKIWHHTFYNELRGAPEEHLCCSRGPPEPRQRERYPDHV

SEQ ID NO: 994609 - protein, 307 aa, Homo sapiens
MAVLAPLIALVYSVPRLSRWLARPYCLLSALLSIAFLLVRKLPPICNGLPTQREDGNPCDFDWREVEILMFLSAIVMMKNRRSITVEQHVGNIFMFSKVANAILFFRLDIRMGLLYLTLCIVFLMTCKPPLYMGPEYIKYFNDKTIDEELERDKRVTWIVEFFANWSNDCQSFAPIYADLSLKYNCSGLNFGKVDVGRYTDVSTRYKVSTSTLNRKSNLILFPGGEVIRRRDDRKASGLGLSEGRDRDHLMGFTDQKLKGGLQERGRPTAWDTAMTGWPPIELARLTLRLLAGRLRRQIDPKNKFPL

SEQ ID NO: 994610 - protein, 108 aa, Homo sapiens
MAHEPSSPSSLVYLRRTTVVYSITYTHVPGTKHITRTAQHLSNLPNLHCILTHGHICAPVCHKRLERETLNSTATSLAPQFPRGPNVTMPFIGGPLTATARAWDQLPQ

SEQ ID NO: 994611 - protein, 292 aa, Homo sapiens
SAEGGRDRRDGRIRSEEVHREDLKECGFESSFKDKSDCDFPKNLEPWERPHAAREKEKKDALEKERKEKGRADKYKEKSSERERSDKSTLDKCQKDKEFEKCFKEKKDGKEKHKDIHSKDRKASFDQLREKKEKVFSSIISEDFSERKDDRKGKEKSWYIADIFTDESEDEKDDCVAGSFKATEASDTQRVDGSQKRRKDENNPRTGTGSPLLTGSTQRSQETKSPRERRRARDFGTREGQKAPWPDLWKPKERRQGVGRVLIPCPSGHLWDITRGHLLRGPRGKQEWVRRF

SEQ ID NO: 994612 - protein, 34 aa, Homo sapiens
MSPGSGVKSEYMKRYREPRWDEYAPCYRELLRYR

SEQ ID NO: 994613 - protein, 97 aa, Homo sapiens
LVVIKQNGAVITNKGRKQIRERGLACFQNWVEAADVFQNFSGGPGQLLEVQGNYLQKGLSWFPSLLRNVIESHHAVTESINCSGKNYVCPLWVLELR

SEQ ID NO: 994614 - protein, 97 aa, Homo sapiens
MGSFIGRKPVNQTLLPSRGRLMTKGPRFGTPIWKPAQGLKATFNKPEFPDRGERHTRGHGSSKSATIDRNTHKRPPSRQKRSKRDLTHDTTCSTTGK

SEQ ID NO: 994615 - protein, 97 aa, Homo sapiens
CSYNLGMVGAVVVTLYKMGFRKPPASFRTHHIERCSNQTLQRDGLSTARSLLFTRDDFDERNLCTTDTREPTFVERTTRVAINLALQTVDNDCALAG

SEQ ID NO: 994616 - protein, 357 aa, Homo sapiens
RVQELRPESGEEAVTLVERMQKELGKLRQQVTNQGRGAEVLLEEPLPLETAGESPSFKLEPMETERSPGPRLQELLDPSPQRDSQAVKERALSAPWLSLFPPEGNVEDKDMTGTQLPESLEDMAMYISQEWDHQDPSKRALSRYMVQDSYENSGTLESSIPSQEVSSTHVEQGEKLWDSSVQTCKEGMNPRNPVPGVEQVLRTKKEMLSLFLLKVPILQYYCLARLRRGGCSWEVPEAPEDIGINRTKALCERFAQRTKYTHPHGEPQVLRRRVPPKKGQESMEHRVGRNLLKGQPNMCPQNRATQCLAHQAVEPSWCTHYVTKQGGTIPHIKETNYLGHRRNCYAEISTTTVTVIV

SEQ ID NO: 994617 - protein, 71 aa, Homo sapiens
MTHPASEEASAAARAKTQTTRGEHDAAWQGQKHQSTTEPAAGREMKTSSPAQEHGTTQNISPNSRGENTNN

SEQ ID NO: 994618 - protein, 123 aa, Homo sapiens
MGRYNDLCLLEGLEIAWPLGGKWAILNKVHASYSHNMPHLTVAPQLAMVHLFHPEREKPRGMGRDRLDGGVRGKAHPFGASPLKCLSRTGLPRPVEERRGPLDLVGIKHILAARQYRLISNKN

SEQ ID NO: 994619 - protein, 292 aa, Homo sapiens
MPHSYPALSAEQKKELSDMLYEIVTPGKGILAADESVGSMAKKAEPNGVENTEENRRLYRQVLFSADDRVKKCIGGVIFFHETLYQKDDNGVPFVRTIQDKGILVGIKVDKGVVPLAGTDGETTTQGLDGLLERCAQYKKDGADFAKWRCVLKISDRTPSALAILENANVLARYASICQQNGIVPIVEPEILPEEDHELNVASMYREGWWLQGLSDIMVLEGTWAANGEPGSGLSYPKMQGTEPRTWPTPGPRGERKRATRDRDAGTPGAGTRRKGGKSGQGGPRSRRHKRG

SEQ ID NO: 994620 - protein, 133 aa, Homo sapiens
ATPHLVPDKLSQRIYRDRYGKAIEISKPGAEVDIVHRQGKRTEMTVSNTEAIILSEETNSANTVFCSNVDLTYHRKNFAMEKTEHDVKEPPRITTTKRMAKRIEGERRHNHRDGKHRYLICSCKRYYDGVDSK

SEQ ID NO: 994621 - protein, 224 aa, Homo sapiens
MAFLTGPRLLDWASSPPHLQFNKFVLTGYRPASSGSGCLRSLFYLHNELGNIYTHGLALLGFLVLVPMTMPWSQLGKDGWLGGSHCVACLVPPCSLCAVSPLHVPPRRQSCVHPAPCLGYVWSLPCRHPWSLPIIHWTLAETVASPVPDGFTACQVSRESLMPSQCRRLGGTGPVFGLVGAGQVRRRRRSLGVMCPPRGAPAPLGAPRWRGPRGATRGGGPARS

SEQ ID NO: 994622 - protein, 300 aa, Homo sapiens
LHDDAWTKAETDHLFDLSRRFDLRFVVIHDRYDHQQFKKRSVEDLKERYYHICAKLANVRAVPGTDLKIPVFDAGHERRRKEQLERLYNRTPEQVAEEEYLLQELRKIEARKKEREKRSQDLQKLITAADTTAEQRRTERKAPKKKLPQKKEAEKPAVPETAGIKFPDFKSAGVTLRSQRMKLPSSVGQKKIKGAGTDAAGTWCGAEPTPQRSWCILFHECGSDLVLLYELKAGWANCEYELKMLGERDEAWSGQSAGGLREQWATPVWGHRVWFWVLWAPRTPCVGGPHTIREEERPPS

SEQ ID NO: 994623 - protein, 121 aa, Homo sapiens
MAELGSPEVRVETEARRRGHTSSGFLPISQLSLCFSTPSLLRAINNYTMNVRSSYSYIGGGQGWTLCCFIQKDKGEESILLQSFDNTYIFIKSREPAPSSHYPIITLYNPYTLMETLTIKL

SEQ ID NO: 994624 - protein, 190 aa, Homo sapiens
VCLEKPKYRCPTCRVPYCSVPCFQKHKEQCSSEARPVEKRRAGPPVRSEESKDDDSSVADFLNSDEEEDRVSLQNLKNLGESETLRSLLLNPHLRQLMISLDQGDNKAKLMRACMQEPLFVEFADCCLGIVEPSQKRDSKTGCVLCSSYLLLLQEVAVFKATIRSMHTWVFLYHMARCSNFMKRKLVALE

SEQ ID NO: 994625 - protein, 167 aa, Homo sapiens
EAPSLPAYSPDSHYQLFLPLLPGSVSAMVELELVAPSLSCWARASFDLFDFCYHLLKVQRQDGKAEIIKNVPLKKMADRIRKYQILEPNEVKTIMNKYMKSAGDQTVTTVEHVRMLYQPPIHQSLDNTMHKQKILQDPNLGGGAEKPGERKPQHRLTSGYTLDNECD

SEQ ID NO: 994626 - protein, 328 aa, Homo sapiens
AAGGGLSRSERKAAERVRRLREEQQRERLRQVSRILRKAAAERSAEEGRLLAESEDLVTELQGRSRRREGLKRRQEEVCDDPEELRRKVRELAGAVRSARHLVVYTGAGISTAASIPDYRGPNGVWTLLQKGRPVSAADLSEAEPTLTHMSITRLHEQKLVQHVVSQNCDGLHLRSGLARTAISELHGTMYIEVCTYLIPNREYVRVFDVTERTAFTDTLTGPDLPQVRDQLRDSIGALGETATLGSLGTGKAANELRRKQNKSVFRGPPEGLTKNPDLVSKTSKRLTTLFVELLGRTDMCALTREGVMWPKKRRTVTGSTFVDPGEN

SEQ ID NO: 994627 - protein, 321 aa, Homo sapiens
HWDKIAVSLPRSEKLRSLVLAGIPHGMRPQLWMRLSGALQKKKNSELSYREIIKNSSNDETIAAKQIEKDLLRTMPSNACFANVNSIGVPRLRRVLRALAWLYPEIGYCQATGMVAACLLLFLEEEDAFWMMCAIIEDLLPASYFSTTLLGVQTDQRVLRHLDVQYLPRLDKLLQEHDIELSLITLHWFLTGFASVVHIRLLLRIWDLFFYEGSWCCPDYAGMWALGEELEQAGKQVQLQNAGEILADGSQKRGGSPKRGGPKEGRETKGGTATFGPGPGGAPQHREKNTGKVTLEKQLRKKQNEGCTPQGQKNTRLSSRP

SEQ ID NO: 994628 - protein, 235 aa, Homo sapiens
EEEEEEDEEEEEEEEEEEEEEPQQRGQGEKSDHALTEDSGPYHWGASSRAVLPTSCSTSPAGSWLFPLHEKRACAVGPKSSAAEEPSETDKRLTPRRWSLDFLKVSSVFKDEATCEDGSAVMQLDALMQKAFNSSSLQVQQLPHQAVVTHGSAQRVKQTGTRAYAKPMYWNALMAELNATMVAGTDYLTQGPLHPHECMAYVTQRTKQSTGNTDSLRRDKICANRCTQALESKPH

SEQ ID NO: 994629 - protein, 120 aa, Homo sapiens
MVLADLGRKITSALRSLSNATIINEEVLNAMLKEVCTALLEADVNIKLVKQLRENVKSAIDLEEMASGLNKRKMIQHAVFKELVKLVDPGVKAWTPTKGKQNVIMLLDCKGVVKRQHVQS

SEQ ID NO: 994630 - protein, 155 aa, Homo sapiens
IYLTSAAPIIKELIHASCMYYYRVSTYCDRTRLMRVLHECSDLAPLYAIIRASQKRMHQRYPTYTNHRSRTSRRICCSSWKYALACLWSLFTCIESPGLIPTYRLVCMSHLCENNVKSYEAEYRMRSCNLYLQKNATLLVAPSPHLVLIVEYRLN

SEQ ID NO: 994631 - protein, 270 aa, Homo sapiens
AEEGGEEEEEEEEGDGEEEDGDDDEEAESATGKRAADADEDDAPANGNANEENGEQEADNDGRPNERRKKVRAERGRRTERPVTGDATRRTGRLNDVTDTLKSSYRGNAGRLKMTEDWRLSTTTEAEDQTRTDIDQQNKAKVKLKQNNRPTEDLLQPYTAITEHTTTLHQWVTITEVRDVTKHRHRHKRKIARHRQRLHTDRHTSKTTPKRHTREHKEEKGSKDNKNRKHSQRTKREKKPTKDTQENQEKHRQRHTTQKHNKQQSPKDPY

SEQ ID NO: 994632 - protein, 31 aa, Homo sapiens
MSSALKSSDVDKLENNTSENPSSEYPMELGG

SEQ ID NO: 994633 - protein, 165 aa, Homo sapiens
MNDTVTIRTRKYMTKRLSSEENKLVIDVLHPGKATVPKTEVRDKLARNVQDHTGMSSLYLDSELISVVARSTGFGMIYDIPGIMREKKRIEPGSIDCARHGLYEKIKDLKKATKGTQEQNEESQGDWKANVGAGMKVSWRWITAEGVKVLQVMLAVATVDFAQEH

SEQ ID NO: 994634 - protein, 103 aa, Homo sapiens
CLTLHRYQMQFKFIGTPFKFDPCQKQGFKTSEEKVECRRTSSIEEVIDQTTALDKERQVFRRRRNQDVRSRYKAQPAPPELNSESEDYSPSSSETVRSPNSPF

SEQ ID NO: 994635 - protein, 259 aa, Homo sapiens
MNRKRRKRKGEAEGRKRQGTAQDGTGPGGRKKRKERRRGEEREKEKRRAATETKKHRQRRTDNRNEERESRDGDRTRERRARGTKGSEEGGQRNGTKKERATRGGQRRRRDRERRRGERREAKREREREGRKGRGGERGREERGGEREEERKRGAGKENRKDRRKKRKGRKKRSRNKERKKEQEEAESRQTKKKKGTKHRRREGDERRRGESEPKADRQQKGEEEREGEGKRQKEREEEQGGRAAEDGWNGDAREERRD

SEQ ID NO: 994636 - protein, 396 aa, Homo sapiens
DWTGTEGYIGGSVENTWGEGRGGKARGSRGHPLSQSAPFPHRDGEEDRDRQTNREWRRKTKRSASGEGGKETPRWSTTFPLRSEFHRDKEMAVDRLHSAIRRNKKKEVSALILTLLEERVDRRKAHRTRPHLAVCEWRVCVVPHENSVSILIRGPEGISQGQLHSLIECYGRRGNNSIEGSGSNFHKLGAGGEFDGQGAIYPGSLFTARGHVKQRGQAEISGIYPFPWGSPGEPLEGMDIAERDLGKCRDIASLPDSPKSGSVRNDGLPGEVRQTSLVARRGAIFNATQGPQKGQGTGWTTQGHSEVPSLGDLGDTQAYRTTQRHRDLPTNGGPEATEAPRCWGPHIAAVWFAAPPSQGTQSNGKYRDGRPTQTRTHTGRGDATTKSENNSGRGIP

SEQ ID NO: 994637 - protein, 314 aa, Homo sapiens
PENPEGQTGGDGALRFLGREGTLCVSRAVYACVCSGERRIALKQRPKSQRLLLRNTRGRRRKRVGMLMGGGQTSCPALELLRREPEDAVCGRDSGLTDGRTAARDWKVKLITNLVQHLTGKVYCFLKGYEYNRKVSLTELDLNLSLISYRISEAESMLSDELESKPELLVQFVQNTSIPLGQGLVESEAKDNYLLIPPSSDRGLRMPATNVYQMKLPKSWLNSSQGGCPFFSWFEGASGVMWAQGGKRTGGPMCKKSPEVWDTEVPLPGENYAQEWPLSLGTKEKGGPPAHGGVRKKQRRALSRPPETGPVRPK

SEQ ID NO: 994638 - protein, 189 aa, Homo sapiens
MVPPTTESGQVAAERLGHTQASPVSVTLETEPHTETLVCLSSSQGCSRAALCQCKDCHMGRCLGYLEGQDKRQGPQGTAFGAPRTTGPKNRLLPLQTGSLPTDDKGSQKVGPSWKKGYEMADSQGALDALAGSQAGHGHRPTPEGTNSTARNKAQRRNTWRPGTRRCDTETVTPDGTEPRGEAEKAQRT

SEQ ID NO: 994639 - protein, 317 aa, Homo sapiens
PGFQPPEIANGLDTFSGFKVDIWSAGVTLYNITTGLYPFEGDNIYKLFENMGEETSPSLVTAAHHSLTYSEDVEYEPAKRFSIRQIRQHSWFRKKHPLAEALVPIPPSPDTKDRWRSMTVVPYLEDLHGRAEEEEEEDLFDIEDGIIYTQDFTVPGVEEAAEAGLSEDACDTCMWKSQGAGLPGEEPEEGFGAFSVAPCLLPTMSSIKLCPLCLQVDACRIPSCHYLKGSQPAFENMLGQGWASPQARGPARSGALSWGDASPESGFKVGAGDSGHGPGKEVKAGDGGTGGTRMGPRMKPGRPSKQGESEKPEGRRK

SEQ ID NO: 994640 - protein, 142 aa, Homo sapiens
MYARRGPGAPPRDKTLFQVPLCMARHLCSGTSVCMNTRGDDFRHLCCIRTLKGKKRRGEGTICDVFSTLVTYKQRAIRTNRQQRSHYHGRKTNTHTASSRTADRVEPWPLPCCSDLAENSTRSDPSERGPTPPFCLIAKELG

SEQ ID NO: 994641 - protein, 154 aa, Homo sapiens
MAAAEPDADPKAAIPVDLRRERRLVCVEYPGVVRNEAKMLQTLGGEESVSRIYTDPTKRLELYFRPKDPYCHPVCANRFSTSSLLLRIRKRTRRRRGVLGDEAHPQVTFNLEIIGIISTIYKFQGMSDFQYLAVHTEAGGRHVPCVTEWSWRQA

SEQ ID NO: 994642 - protein, 268 aa, Homo sapiens
EEISINSQGEYEEALKMANIKQGNQLQMQVHEGYHVVDEALPKNVVENQAAARTGKKPLAHYSSLVRVLGSDMKTTEEPAPEQCSSAPCDTDQPQDKPPDWFTSYLEMFREQVVKETVEKLEQRLQEKLVLQKPLLSSSPTEVSMPISEETLFLPENQFSWHIACSHCQKRIVGVRYQCAYAHPTTFVKIVKLDHTPMTLTMFVTAAETCVISSEAIFLTPSIPLPRLLCFGTKSGSKKQVDQNPGGSRKGRLRVRTTGKASPELKPV

SEQ ID NO: 994643 - protein, 123 aa, Homo sapiens
LGMEPSSPLGEWKIQHCLWKTSWYHGAISRTDAENLLRLCKEASYLVRNSETSKNDFSLSLKSSQGFMHMKLSRTKEHKYVLGQNSPPFSSVPEIVHHYASRKLPIKGAEHMSLLYPVAIRTL

SEQ ID NO: 994644 - protein, 49 aa, Homo sapiens
MNGEKTETNNYNNDRRTETRATQAKTKERRRERTVNTVMQPHLFAPLYE

SEQ ID NO: 994645 - protein, 121 aa, Homo sapiens
AHLLSGRNLIATGISEIKKVYTRCWEHLVENEKGLKENYQQMYVVNIPVLTVQIKSEETIRPLSQGTSWNTSMESPDSSQDNDINNSDLSEDEIANQRYGLLYQDIEADKDEVLTLECSLD

SEQ ID NO: 994646 - protein, 32 aa, Homo sapiens
MGQSTPEGHRKKAGHEKDSRMQQNLFGVVREN

SEQ ID NO: 994647 - protein, 68 aa, Homo sapiens
ETVREHGPEEESGRGQGCQRPRSSPAAPLEQKGKPGRETNPSESSGSFQNQEHRELQLDPDWGGLQVC

SEQ ID NO: 994648 - protein, 195 aa, Homo sapiens
RSEAAPCTPSPSSPGLLATALTSPVQDPKTCSGGSAVLCRDVKTAVDCGAVKHCQQMVWSKPTAKSLPCDICKTVVTEAGNLLKDNATQEEILHYLEKTCEWIHDSSLSASCKEVVDSYLPVILDMIKGEMSNPGEVCSALNLCQSLQEYLAEQNQKQLESNKIPEVDMARVVAPFMSNIPLLLYPQDHPRSSPN

SEQ ID NO: 994649 - protein, 232 aa, Homo sapiens
VLNLKRTMNSFCQSDAHKMTNSLRKLLHVGSSEACAITEEADDLKAAVANLMEINQNLQWVQWERTRYATSKCTASSLHSVDECNENGSAQKTLLDEGYSVMGDCTSEMVSKSCNSSCEMHMVSKTNPPKQVDDQSDGLLTSNSCTVSQRSTGACFLTDGVYSHEACAQKEGVYEGACLSDETHIPIRDCHTIHSVHSKENKCTDDLESTEELKLLTKVPKVLASGEFYVSQ

SEQ ID NO: 994650 - protein, 318 aa, Homo sapiens
RQTPLGQWTLRVSLRHPVSLKMNVRRVESISAQLEEASSTGDSVEDELEMATVRHRPEALELLEAQSKFTKKELQILYRGFKNECPSGVVNEETFKEIYSQFFPQGDSTTYAHFLFNAFDTDHNGAVSFEDFIKGLSILLRGTVQEKLNWAFNLYDINKDGYITKEEMLDIMKAIYDMMGKCTYPVLKEDAPRQHVETFFQKMDKIKMVSVTIDEFIESCQKMKTLLRSMQSLKCGLDWQASSTRGRWERLHPSWEPPWLLMLTSGAVCAGCLFRGPPPHRFVTGRPAQWLFSGAGVPPLRDRNPVSVPRVTSPTRGR

SEQ ID NO: 994651 - protein, 69 aa, Homo sapiens
NSISCLLTHAHSSIWAPQHTHARTQAGIMHACKQRKSKRFQASAVRKTETKPSSQDRKMACLKLCGVRK

SEQ ID NO: 994652 - protein, 306 aa, Homo sapiens
QTGLTPDAPLLDPCLPLDIKDEIQQNGQTLYLQGTGDFDLCRETLQPFMNKTNETQTSLNGVYQPPIHFQNSEFYGFSEFYYCTEDVLRMGGDYNAARFTQAAKDYCATKWSILRERFDRGLYASHADLHRLKYQCFKSAWMFEVFHKGFSFPVTYKNLKTALQVYDKEVQWTLGAILYRSRFLPLRDIRQEVFRAGHAQLAGRVFVYNHYLFFRLPGRPSVHPFSSCLGGAITEGPRTGLCGMEEGCLPRPGPLWTHLGCLKKLRKPLPRFGSPVVALLVKTCCPCAAPGPSGGRVSPYLWEGRV

SEQ ID NO: 994653 - protein, 339 aa, Homo sapiens
MCSTKQGIIQDTILCDGPLGQSSRVEADPLARQHTSPNWGRTFTTWWDEPWATAYITKVHIRLLRDTILRCTPGRKERTPPYRPWAIIAYWVGRSTISGQEQMPPGFWCTHNPDRAPINEGESRRRITINPQEAMPGNPTGNMSARTRNWTDEQTRSAESGQCARTNIKQEDRWRTKTRYQSKVARTTQNPQAHKTRADTTDEQEKQMRTKRRPGHTTYQDMPTRPRELRTTMQEKDDNNNDKHTMENNQHNKKKQTNKSQTQREPKQENKRRRRKSETITEREGSTNNTRHTNKTNQQKPSRKTNKTDVQTQRKDKKTRTVDKQEKRDTQRQNHNQDK

SEQ ID NO: 994654 - protein, 352 aa, Homo sapiens
GVPWNFTFNVKFYPADPAQLTEDITRYYLCLQLRQDIVAGRLPCSFATLALLGSYTNQSELGDYDPELHGMDYVSDFKLAPNQTKELEEKVMELHKSYRSMTPAQADLEFLENAKKLSMYGVDLHKAKDLEGVDIILGVCSSGLLVYKDKLRINRFPWPKVLKISYKRSSFFIKIRPGEQEHYESTIGFKLPSYRAARNYGRSVWSITRSSDSPLQTPSPKASFLPWDPKFRYRGGLKVRPGQARALIETGWCPLGAGRRQRGTRDSRGTLVEPQPRADTLANQVQAGFKDAARRPLTQTQQSVRGDKNREKDADAREEPTQARGSTHEENKTTTPTTDTIQSTRGQRRQYR

SEQ ID NO: 994655 - protein, 124 aa, Homo sapiens
STHASPTASRKGFMLLTRRSRYAHSTTPRLSPPTNRTIPAQSTVRLTQLSHTLPYHHLPPHPQQHHISDTPSSLLLHLTPIPPPPYPLTTHRYSTLQTILTYYHLEPPPLQPTSLLTLTLYHFL

SEQ ID NO: 994656 - protein, 216 aa, Homo sapiens
MLIYIAENGVKVQSDTKDEVKLGQSCTVILMSVPSYAVKTVITGGPSCYHGFCRAPDSAVSWYLYAIHGYFCEVMFTAAWEFVVNFNWKFPGVTSVWALFIYGTSILIVERMYLRLRGRCPLLVRCVIYTLWTYLWEFTTGFILRQFNACPWDYSQFDSVISWGLITLEYAVPGVCGGPPSMEQVNHREKPRLGFDQGPKPGELAANSLARAVRHD

SEQ ID NO: 994657 - protein, 161 aa, Homo sapiens
TTVLTMSTIITGVNASMPRVSYIKAVDIYLWVQLVFVFLSVLEYAAVNYLTTVQERKERKLREKISCTCGLPQPRGVMLDSSYSDGEVNDLGGYMPENGEKPDRMMVQLTLASERGSPQRKGQRGSYVSMRINTHAIDKYSRIIFPAAYILFNLIYWSIFS

SEQ ID NO: 994658 - protein, 153 aa, Homo sapiens
EAALDSSVCFSRSVSLPVSLHSPERGRTSTSSFRKMSAPAQPPAEGTEGAAPGGGPPGPPPNMTSNRRLQQTQAQVEEVVDIMRVNVDKVLERDQKLSELDDRADALQAGASQFESSAAKLKRKYWWKNCKMMIMLGAICAIIVVVIVIYFFT

SEQ ID NO: 994659 - protein, 114 aa, Homo sapiens
MEMALITTKVVVVTSDDDPWVQNPQLKQSCVDMINEVDARWERDHYDFSGSFLYHDGPEHMKDYSSEEEIREAFRVFDKDGNGYIYVPQSLRHVMTNLGEKLTDEEVDADDQGG

SEQ ID NO: 994660 - protein, 78 aa, Homo sapiens
STHASWLHLDQNPMAISHGFKVHNISAVWYDCQVKNGTCSIQQTLPQLLTTTTATSIRLFYIDLPDYLPDDPTRDFVY

SEQ ID NO: 994661 - protein, 329 aa, Homo sapiens
KALLGVHGTLFPWLQRSYCQKFAMSILRIHAREICDSRGNPTVEVDLYTAKGLFRAAVPSGASTGIYEALELRDNDKTRFMGKGVSQAVEHINKTIAPALVSKKVNVVEQEKIDKLMIEMDGTENKSKFGANAILGVSLAVCKAGAVEKGVPLYRHNADLAGNPEVILPVPAFNVINGGSHAGNKLAMQEFMILPVGASSFREDMRIGAEVYTNLKNVIQEKSGKDSTHVVMRVGIGLTFGEQEAWELVKKGGKAVTDRGLGGGGAKIKRLQVTDQVSGPGFTRHRGGTSRNTGKTSREGAANTVGGDTQRRGKSTEQQTTRQNAVPHT

SEQ ID NO: 994662 - protein, 234 aa, Homo sapiens
PFSARVTWLKGGERHSALPESSMEQQDQRHEGREAERLCLTLDNPGLSAYGSSIPRYGILTSGGRWLSNIRTAHDIMRDNGDKETYICVGPVNSMEEFPLDVAVVCKRVHVTIGRVDRIPPGSALWMKTYWGHERGAFAVHTNNSCAYQCRAGSLDGMHAGVADLDCDAYHGFRKTFWWEYVQVYRSNVVPMYLGELGPYKDLLGGIIVGGVLRLFITVGILVVQILGLRNLLG

SEQ ID NO: 994663 - protein, 368 aa, Homo sapiens
GRVGFRSMKQQYEQKITELRQKLVDLQKQVTELEAEREQKQRDFDRKLLLAKSKIEMEETDKEQLTAEAKELRQKVRYLQDQLSPLTRQREYQEKEIQRLNKALEEALSIQASPSSPPAAFGSPEGVGGHLRKQELVTQNELLKQQVKIFEEDFQRERSDRERMNEEKEELKKQVEKLQAQVTLTNAQLKTLKEEEKAKEALKQQKRKAKASGERYHMEPHPEHVCGAIPIATNHGSHGTHHAYRTGPTVNLTLAWEHTHHSDENPEMSLAETRGARGGIEKDHSGSAHHKEARHQHRSTQRKRKRTERRGATGERRARRREQHGQRGETQESKREATDGATSTATEKKMRAQNTTQGKKEKKDDENK

SEQ ID NO: 994664 - protein, 153 aa, Homo sapiens
QFSVPGMPRARKGNALRKGGQRRGGGARSSTQADSGSSEDEAASEARSTTSDCPSLLSATTEDCLGGEAVDEQSQQENLEEKLKGYVDCQNPESQVALLQEMDNLMDMLVNTQGRRMDDQRVTVNSLPGFQPIGPKVGDVQITCETPHSSLNL

SEQ ID NO: 994665 - protein, 370 aa, Homo sapiens
EPRSAERPQWDSVLHRTSSPGNTLSLLQAPCALPLDKCRQGIVCNGALETENKASEQPAGFDTLQKYPTPNGHCANWEAGRSKDSLSHQLSATSCSSAHLYSRNLHHKWLNSHSGRPSTTSSPDQPSRSHLDDDGMPVYTDTIQQRLRQIESGHQQEVETLKKQVQELKSRLESQYLTSSLRFNGDFGDEVTSIPDSESNLDQNCVSRCSTEIFSEASWEQVDKPGTQKMTRWVTGPPVLATGMPCDRGLRSASWKPLADWGEVFWPLLYPRVRSLPVLKPTDGEAWSIRRPPPKRAPLDRQWRKPCRSAKEDQNRVEGKDGATDTHTWSETQSWRDGTLNTEEHKPPPSIKRGARVTNSQDGNPDDSYH

SEQ ID NO: 994666 - protein, 122 aa, Homo sapiens
MSAGKTLSMLLSYTGKAHDTRSFQATHLVPQKHTFLGDDSVSCAVEPGTATKMAGCVPLPLAYHSLSEKPTLTIRIHGSNKKQDKRDNRHKETKRRGAEHANNHYSPLERGTHNKTEQKARR

SEQ ID NO: 994667 - protein, 208 aa, Homo sapiens
CPTYSGPILPIQQVPTIPNGHSSSPPMAFQDLPNTLDEIDALLTEERSRASCFTGLNPSVVEEYSKREVEIQQLTEELQGKKVELDEYRENISQVKERWLNPLKELVEKINEKFSNFFSSMQCAGEVDLHTENEEDYDKYGIRIRVKFRSSTQLHELTPHHQSGGERSVSTMLYLMALQELNRCPFRVVDEINQVWTQLMNGEYLKWL

SEQ ID NO: 994668 - protein, 247 aa, Homo sapiens
MANWKPKVVFFQNSKYSPPIGKGENNFPNMHFAPGGASLCAFEQVSALLQKHVPSVGGRQRVTEFLSRISRSTFSNRGGGHPRPVHFSNPANAFCLDNRGNTERSPIMEERRAPPDGVCIHGGDTPPYADSRRGPQIEQDSGVKLPGGTTATGGPPQRCSKSRANTTQRNKNTQPMFLSNPSGRCQPLVCGDHPQNDRSNTTSRVVFYYTAGSPLGATPKSEQLYVVTIDKERFIIGHNQQLSFVFG

SEQ ID NO: 994669 - protein, 101 aa, Homo sapiens
LLRIRYPLPYPSHRPLDQVCCAGPATQTFFPHTLPQGRARQASWFQRLGWNGITQVLSCQSFITHRPIIGYLRYARPIPESVRDVATFWRCPSVTGPNTHR

SEQ ID NO: 994670 - protein, 98 aa, Homo sapiens
MGQVGRQLAIIGDDINRRYDSEFQTMLQHLQPTAENAYEYFTKIATTFENATAGSLGPVVALLGFGYRLALHVYQHGLTGFLGQVTRFVVDFMLHHCI

SEQ ID NO: 994671 - protein, 326 aa, Homo sapiens
ISTTKNTGFEFLFFETGLSLLPRLECSGKIAAHCSLDLLGSSDPPASASQLAGTTGMCHYTQRIFKLFVESGSPYVAQAGLELLDSSHPSHLGLPKCWDYRREPPLPGLKASFCSDFTPECFYAFALLVHGIMFDETRVLAPAFQQAWGCGWAVTLALTASLLLPGSSDPVGLSLPSSWDSRHLPPRRANHHHHIYISYTSNMLSKRDGVQHVGPASAPDTPEHPGQNPLAVELRKEPGPQGGSDHRGAPNISSPSPQSAPSNTENTPRRPSTPVTPRAKTLGPGAIPADTATHRQRENSGTKRDPNHGTTKAHEPPHALYHITGH

SEQ ID NO: 994672 - protein, 68 aa, Homo sapiens
PCSRGAGDLLVPLDKEGKVPLPLAMACASAWGPKEELDFSFTCPLAPALFQPSAMAEQVLVCGHRERL

SEQ ID NO: 994673 - protein, 295 aa, Homo sapiens
MDELQDVQLTEIKPLLNDKNGTRNFQDFDCQEHDIETPHGMVHVTIRGLPKGNRPVILTYHDIGLNHKSCFNTFFNFEDMQEITQHFAVCHVDAPGQQEAAPSFPTGYQYPTMDELAEMLPPVLTHLSMKSIIGIGVGAGAYILSRFALNHPELVEGLVLINIDPCAKGWIDWAASKLSGFTTNMWTEFWSSIGQDELRPIGLIQTNERTCQDINEKTQTRDYRANRDRSVMANEKIGRQGSLRRGKHAKQGGDNRPKSRDGEARHGKDENGRRRTKHNTTKGDRKTSALEHIEG

SEQ ID NO: 994674 - protein, 369 aa, Homo sapiens
VEPLYEIGCVNLGRLPSHTPLDLHQRASGGHTSYPSKGLPFLAWTLFKITDSMRMRFVLQNAMRLRRVGTRETGGGYRPHSFDLLRPFLFLDPCDADSSGTFVQVARPWREPDQLFKARNNVFHYGYGFYCLCPLTPITEVCVYIYIVYYIIINIKEIIYLSWDGKTREGYIDIYIYIYIKEGDPCLHLTLDQKEKRDMKVLPMTSEGTPLLETTRKQVRKYTTLLELRDQERHRVHHGVTDKQNSGDVKKGSLTIKNPTTGPETHEGENKKNNMTMRQEEPRHNWKGERRERTRTGPPVLAEPERDGRDVGTKETQTAAKQTRGERSAGQDRQPPVRREPSDTQTKDRRARQGDERTAGEPLVVIENE

SEQ ID NO: 994675 - protein, 62 aa, Homo sapiens
MSERTSIEIRRSHLPCSPAGIPEATVESCLCLHLQHLPKSFDHFFCNENLLNVLGNYLVNKI

SEQ ID NO: 994676 - protein, 149 aa, Homo sapiens
ASGGVSVGGSGAGGQQPPPQQPRMARSPTKNLLKHKSLSLSMHSLNLIPANPAPQSQLSPNAKEFVYNGGGSPSLFFDGVEGPSTSTTAPFGSGGASTCNSSSFDVSQVFGGGANSLFLEKSPFVEGLSYNLNTMQYPNQPFQPVVLAN

SEQ ID NO: 994677 - protein, 107 aa, Homo sapiens
MSRLFHISYIYVSVSLVYYRGTMCIVVCSAGGLQQRSVSCTNNSVSDLTIWVHSYPGFCSLLILTVNPLFWIMHKCICNSKIYRFEYFCLIMVIVSPCVTCIGMRCK

SEQ ID NO: 994678 - protein, 495 aa, Homo sapiens
VGLNFNWESFKKKFHSSHKCGVSKGPEEVWVWGPKGEGQVEVWVPPATGVDRPKGVAREDTEAQEAVWASRNCSTLKRRAHLLFVPIGEGRQWCVSQGPRRATPLSSRGSSFSTACWALCLSPPLYMVFLPPPTLCGRPSPLCCPTCLPLCISLSVARMLSFSTAPLAGVLCAAGRPSIMWGASSREFSSLPLMVRRTTHSPPAAIELCLSTAGPHKVVLLLFRPGPIFLLLPPRQGGLLLGGGSEAVPHHTIVGGSVVRVTPGSLLRLFPHPPAHKQAPPFLPEAAILKRGGRRMLMGGPPWFVRPPPPDWLDGSYFSSLWRPAPTTPCEESGLPTQRAVLPGWLSHPTTPLCSVLPPSVCVEGTPFGGRAFFPRPDTISYKLVVVISRAAELFISLWAGLPYSTYEQGVVAIFSPRGITNPPPLVVAMLAAVALINFPPTTMAIRHHNTKSGPPSSPPFVGGTRQTFGCEQTNNVPPYVLRFAEDTNTAFPQD

SEQ ID NO: 994679 - protein, 306 aa, Homo sapiens
VAVGDVAVAVAVLGGMMDRAVAMAAWDLGVSYGWAQPPLLLGAFSAWCPYSDYCCLFTPAASSPHPSAPPDFLTCLLCLPRKPEQYGPLSLWDMTRLMNTLIVFRFLRIIPNIKPMAEVANTILGLIPNLRAFGGILVVAYYVFAMIGINLFRGVIVPPGNSSLVPDNNSAVCGSFEQLGYWPNNFDDFAAALITLWNVMVVNNWQVILEAYKALRRPWSMVYLCYGGGVLWLSGSTWFLGSSSGELFHRWDPQGLRSSCWDKRFRGLLFGIQKTRGGCWNKNPWLGRNKRPPGQQMAALWRSRQN

SEQ ID NO: 994680 - protein, 290 aa, Homo sapiens
GRHCAQHHHLRLLEQGSAGKQMAIWYSGWTPTLGQAPECCPGGCSVPPALKGPKAATAAAAAAAAAEATGGRAAKVGQLSDRALSGASLPNAPSSAPDYLGWAKSTGTIFTLGRLVKSGSLGSARGTQPTVEAGVAHMIEALGVLEPRGSPVPWQDGSLSDLSLTGEEMGPGGSLGAQGSDLSAQSMKPRRDKVGGVQNSGCQEEVGTPQKKGWVASIQQDWSNPTGETMIRNRHMSAVDETQRTEKTRKLVAERTERGQKTIREEGTKTKDKEQQGTPEKDKKRRKERK

SEQ ID NO: 994681 - protein, 136 aa, Homo sapiens
MGGTQMARRPTGVTHGEDCDDAMRRTAKKNIEQVDTHIRERREKRQRERNDSTKEERHNNSPRSATSNARRDNRNQRDEREEQKRKRTRTEEERDKRRKEQEPQQQKHARTTRDTKQQGQSEHIAYTCKTAMHTDG

SEQ ID NO: 994682 - protein, 211 aa, Homo sapiens
GILMISWLPVTIDAAGTSNGVRVTGYAIYADGQKIMEVASPTAGSVLVEVSQLQLLQACHEVTVRTMSPHGESSDSIPAPVCPSPGFCLPASQDVLSLTTTKPRGQNTPCFSLPRLGDTSFPLRHPVPHGTQDFSASLSIEMSKGPQEEPPVPCSQEEAGAAVRSISEEKRAIEPTLGQEGPEPVAPSLAKQEVECTSGDAGPVPCPPKES

SEQ ID NO: 994683 - protein, 151 aa, Homo sapiens
HVVRRVRVTEVVKKYSQLQYAANPITPLYGEGTREGKLCDDEAEEEKGEKEEVKMNDDEEIAKYRRCGFRMRRMISGMDKKDENVKKYRERNYIDSWKERKRRSRRIWIQKLLHDISLKRSMENVYRDASLIDWEEHLASQARCLWKVCWQ

SEQ ID NO: 994684 - protein, 362 aa, Homo sapiens
MVCLAGRARLVWHRGKIHLERQHRMHPLYEAESALESLVYVTLRGEGSVAKTLSLRVSNFEGSVPRMWRAVAQFLDIIRPLSEVARIALCHVRGGHLLTLAVVNSSVCPTVRRVIAGEQHRRENTQWAYKVYDEAQLTVYKSHNPRGTGLHSARGDTRPQKDPEWHGRIELTRICILREKVHTWKQSNSHPGLGATGARRDHTTPISEIGLFPSDQGPPLDGAVRPHKTTKGLHHRGGKSPIKKALCNALGFHKELIKGPRQTRARRRNMAHSSGTRGRGTTQCGNGNGKPRRSSPLTGRHRGEHVTVHDTATLRGWNNTMSHDGDTLVRDNETFTGAHKSVHTDNTPEGGMMNPRDPQERH

SEQ ID NO: 994685 - protein, 154 aa, Homo sapiens
MRSMAETGRQRDAARRRRAWCSRQADAAADERGEQQHQQHQQQHTAVKDDPSAGEGPRRRQAGSSLVDRYKGISHSAEEAVGSRQCSSKKERHARKRASREKDRGQGEVSRHGTRERGDRRATTMKRWGRTTPRSRDERRDRQGDGQPGTSNEG

SEQ ID NO: 994686 - protein, 97 aa, Homo sapiens
TVRWLLDSVRRTLLGPFLWTFNTWISSIDEELDQWYLQPASSTDDVVDDRVSVLVRELLAELISLSLIIGLNQSYVIYRDPRNYELSCLNRSLGTRE

SEQ ID NO: 994687 - protein, 346 aa, Homo sapiens
QARAEQAKAADQAAMADMEDLFGSEAESEAERKDSESESDSDSDQDNGASGSNASGSESDQDDRGDSGQPSNKELFGDDSEEEGASHHSGSDNHSERSDNRSEASERSDHEDNEPSDEDQHSGSEAHNDDDDEGHRSDEGSRHSEAEGSEKAQSDDEKWDGEDKSDQSDDEKLQNSDDEDREQGSDEDKLQNSDDDEEKMQNTDDEDRAQISDDEDKQLSEEEKGNSDEMSIQVASGNGEEKRNLDHRDQTARWSEERSTNGERRNSGECPQTSNKTSKGVRKGEKRNTKTRDEKQLQRQRHKSKQRSRNREHNNERALTKQQRHTRHKDAPQNKRASTSRSTKDK

SEQ ID NO: 994688 - protein, 563 aa, Homo sapiens
RQMSHLLIERSGPQPQFVMPRNMINCYKAWLMQLGDLRVPGGAPYCLGSVTPGYRTESVHNEVAYDCMDLTLEAETVQRIAQTFPAWNCENNVMRTLCPSSVSDTSKPRPMANRVSRDSSTVSHFTLSRGVAPVVPWIPCRARYRVRSCDLEEALITALEPARKRDRCDSVRDDSDPRRNRPKHERNRLRDTLPPVRTENPKRKRVPQPSQRLTSKRESLWQCHKHRHLRWWPGAGSCGGLRKNSLRCGDPIFPTSSCWYCTTALPRPKRRGGAPRTYNSGVTNERDTIFRNWNFELESVGHYWTKQVSTKRKRCREFGARAHIGFMDQRGAIRGGGAGRERGGAPEEILLKRGIFRSLSVSARPLCLERAPPAVRSAPTGGGGVPSGSLGLYAERGERAPPQLCFHCVAAVLRPHTRHLAAGVHSSLFFHRKICQVYFPSSLGATGEGAVRTQSGAGFTPLLHPVFSSSFIYAGGRTIGWGQFHSGGGPAWGDGARTACGGPSARAYERGSLERRNPLGPVFVVRFEDTPTGLPRRDTREVPALTGRDEERTLLSGISVWDP

SEQ ID NO: 994689 - protein, 159 aa, Homo sapiens
MSGGLASVHLRRTASRPQCVAVHPGICSSCISDWSLPASLPRAFGAWRASARDAPASPQPPAARRDSPRASKMVIQKEKKSCGQVVEEWKEFVWNPRTHQFMGRTGPAGPSSSSSTSSSMVSSRHVQPHHVGKCLQNRSLTYPQVTRIDWPHRLDDRPD

SEQ ID NO: 994690 - protein, 98 aa, Homo sapiens
RSVEETLRLVKAFQFVETHGEVCPANWTPESPTIKPSPTASKEYFEKVHQRPSYVCNYLKLFRPKKSPSWNPSNALKIIYRMAKPHYVCVYKYCSTGL

SEQ ID NO: 994691 - protein, 117 aa, Homo sapiens
MPNMLDVVGIIYRLEKCSRHRAVLPQPADEVYSHHSRRLLLSARQSCHSYFASFLIEHWCPGRVAQAWSRRSVAVRSYPSVPCRASHGRYGGVKKALASESSQSCETGVLSSGTSAH

SEQ ID NO: 994692 - protein, 158 aa, Homo sapiens
MGGFILGGGPFSLAHGYIYPIFCPKKAGSTHWSQAGENRLLQRRLVRTPPKQAHPYFLVKLSQAPAAAPRRIPVHTIREATYRTLPNFSHHQDRELTWLYHRGGYNKTESMVVAGNTILRVWKQLHERATTYFRQRRRPEQVDYKSDRRMCADDNTEY

SEQ ID NO: 994693 - protein, 143 aa, Homo sapiens
MEIPTIQRASPFPHTPTLLDHDIRNAPRCNIITDWEASLGPQCVWAKVDLHHFGTLLRSHHGITVSPFQHLRGLYWTLLPPREIKENLSVGNNNREPSFICTTPQLAFWTPRLHNFIKVTRGGPLELESGSFLTESSTGHPDV

SEQ ID NO: 994694 - protein, 141 aa, Homo sapiens
VLWCGEPLRFCEEVAFMRGTEPHADWWAVCTKGRAVTSLSGRFCALGSGYRKQGNRLQYTTLRTGKGQVWHSAKGKTHTHTHTHRQRDEFGSRESSKLKRKVEFRRNLPSLSVEVSLWRCMEKPGMKEHGYGQLVQAAWRG

SEQ ID NO: 994695 - protein, 72 aa, Homo sapiens
MGVRLDARVGLLTVDKPMGHLSLANGGSISTKDVIVLHWMLQCAIIQGLVGAPRIALSVRVSGSGCSYRARN

SEQ ID NO: 994696 - protein, 98 aa, Homo sapiens
MRPNGGTGNGKAVGAIGKEVSHPHAELPSDGWHHNIITDTDHTEPHRTNKTPTKSGASYIQATTIAKIQKEQDITNHAPEANRRYEQTGDATKPGRTV

SEQ ID NO: 994697 - protein, 99 aa, Homo sapiens
MHAQPPKGGTLEDTRPTLRTRGQANITHSDATLHKERTNQPSHEKGTYGQQTATHNAAPGDKQNATTNGTHHPRHRETEQQPPHRRVKIRNENQQTNST

SEQ ID NO: 994698 - protein, 273 aa, Homo sapiens
EPILGLLWTMPAVAETDIQDLKIWGRAGCCYGALQSFIRKASRCPMQVRTVLGREGTSNIKIISKIENHEGVLEALMIILEASDGIMAGSLVIYALRFLAEKVYLAQKHDDTDGATEHGKPVICATQMLESTDQDALTHSRLKAEMWPMQSWHGADSIMLTGETANGDKPLEAVRMQHLIAREAEAAIYHIANNKRNSAAWRPSPENPQKAPRGDARRRSYTVHAKGDITRQQQSLGQSGSPRGQKQQTSTKHSGDTKTTHRPDTCTTRYQEK

SEQ ID NO: 994699 - protein, 267 aa, Homo sapiens
HASDKHSVEVTNGMFSSQTMSHEDEVGVDMEYANNMYELVIKRFRQHELIPVHWYATGHDITEHSVLFHEYYTREAPNPFSYVWTQVSIEGAHEHRKPTVSDFKWESLERTMGVMFDDLLTVKYCVLRRVNAYGVDLINDDLLFPNRVIGLSSDLQLSRRGISRIQDALSNSVAEYAEDVLYWNVSQADRYWWAASVNEPGYTEVPNNSFPDDFDDQCSTSNINDRFDGDLPGRLTQSQIAHEKLVTVNGPRGKHVARDNPDPIEQW

SEQ ID NO: 994700 - protein, 386 aa, Homo sapiens
QVQPPLRMKATATISAKPQITNPKAEITRFVPTALRVRRENKGATAAPQRKSEDDSAVPLLPKQHPNLVLLFLSQYKLRMHVYEAFMTSSMEGLTVTAFDAQKQASVHNSGPMAKEALINTEMTRADFHSSGYTTNKQLQGIILKSSLCSELTAHKTGYIIQNRSVIEAAAATHPFPYIPPYHPVYFPILPVTLSTFADRGDLTLLIGQDSSDADGHWTYEMLGEQKTQHKSQYLANKGKKHTRQDIPPHNHMRPRHVAHSTMAHPRQSPKLPGSNMRDSHTRQPHTRNKHKTTTVHQSQPKAQKGGEQTTAPKAHTRQSPAQQKRSTKNSRANNKKNTQEAHNTPPHRHEQQAPPQKRTTKHAPATPRHQTHPQHSVTQRDNEET

SEQ ID NO: 994701 - protein, 169 aa, Homo sapiens
RRLLSSVVRHSTLSGEFFRTKLKYHDYLRKGTRFNKTRGPFHFRAPSRIFYKAIRGMVSHKTARGKAALERLKVFEGVPPPYDKKKRVVVPQALRVLRLKQGRKYTTLGDLSASVGWKYSDVVSKLEDKRRVRAAEYYAKKKAATKKVEAAKASQADSKVTKELAALGY

SEQ ID NO: 994702 - protein, 196 aa, Homo sapiens
MDQLPPPPGYYFFFYWVFLRKTDQTLLADRGPQGVRRMNTTGAITYDYTLCHSAHTTKAREKLTRHVNHNQMSAPSQSDNNGDPQGDNTPRKTRNPGPTPAETWQPEVTLNRDNCSSKTVATKTHFPAAHYATRHQNATFSPTHGHLTESTPAVPSDSSRPITVDLSPNRSIVTSPYATPPRPPRHIPEWHTRTRP

SEQ ID NO: 994703 - protein, 233 aa, Homo sapiens
DDWAIELIKVMSLHRERASQQRLGGEQSGVGRNRSVDSTKGREGTVDPCQVRAEALPVPRLHLLADAVPGSSYLLGASADEGPADGHPADGDYGIHGERGVTITLSGEVSTACTGAAFWSDRNGECGPGRLLSLDTEVDRHGAEYAHGNTALAYARLGLHAQECIDVLPAVRADPTSCFDAHGDPKLSRRNNNRNNSSGRVPTHHLRNSRARCSRLGRGSSPYSRSGSQQHVS

SEQ ID NO: 994704 - protein, 324 aa, Homo sapiens
EKKKQKEQEADNEVDEEEEEGGEASRQAGRRRCMVQDRGMADAQMQAQLQSSSRRKLSAAASMIARMTACRYHRQQNDLTEDDYDSKAKENVTLTEKTMAAVTYSPSTSRLRIYPVVTFEVEEARPAHRWASCHPPDDTTLSTTQPKPCRICNRESEHTHPTTSKAPDILPKHVTLTKANIRTNYHTLTTPYTSGYLTGNGSRHIIHDSRAGPNTAYREQFLCPTILTYTIVASDPIVIQELLTRENTNNPLVQEQSHTMDRHDHKRDSLIYLRPYRTQQHTDMLDCYASAVPSTSIIWHRHRQPAASQRATARHKGSYAIISP

SEQ ID NO: 994705 - protein, 34 aa, Homo sapiens
MSFTDSLHHSPPTTGPWCSVQCCPWLRLPVPGQH

SEQ ID NO: 994706 - protein, 35 aa, Homo sapiens
MPTHGNQSPYKLAEITATINNGLATDAHAGRLAAQ

SEQ ID NO: 994707 - protein, 95 aa, Homo sapiens
MGATQGRAPKRDRYLEKVNTDGSQAERRTTDTWWYLPGKDTAAHSWGNTLGKNQHIAKPHAQGGDTDMAHRHPTFHGEKPTPLDGQSKNLTGTNG

SEQ ID NO: 994708 - protein, 232 aa, Homo sapiens
MWWTKTAPAVVLYRRSWTGHPFLRPRGPYLERLSDSWWLPDGLIVTNAHVVADRRRVRSELLQRRHVCCRGHSMWIPWQHIANCLEDSDLSEPLHHAASGHAQPDSTRQRGSPVRRHGNVPFAPATNTMTHPGTRYALPQPSSPRDLGTPPNQCANTLQTCMQLLTLFAHTSCALYHPWVKPVGTAGRRRSDCGPHPYETVNPACNSPFAIPTCIDYSNVFALVAGHRPPPP

SEQ ID NO: 994709 - protein, 202 aa, Homo sapiens
MTIGATNFREEMSDAGENLNVVYNCYTQRRNIVRRSRDTVLAVGTTFQELSIAMAGGSDRLPLAWVTPSWAINGASAAATATPVGTQIDSLRAANGLQDKADKKHLQAYGVPLKVPSTTDIFPGCAVTQTRAQRTQRVTDRLCKHYAPLHLILLHIVSPYDYITTKYKITLQRTLRPRTSFGLDDTIVATLQAVIPNNVTSG

SEQ ID NO: 994710 - protein, 274 aa, Homo sapiens
HASVEKQEEEEEEELLPLLVFLFLFVRSISGRPYAREDAEEEEEERGSEREKRQDGRRNKTEGGTEEDDCSHETLGVPKHSKPGASGSRMNYLCVDPACECMTSPGCPHKNSQGTCTGTVTRGTLRDPYDQGWSEGSARRPTVDSRAARRLRGFAHVHVQPSTISEGELTKGAEPCEPSERQLRMNGLMRGPSKLGVRRLPCHVVLVRSNARSQTPHHNLTAEGERPESEPHDVREIHAWVFVIEPMTANGSGEPDFLSVRILGVNRTTGIVNV

SEQ ID NO: 994711 - protein, 344 aa, Homo sapiens
SVNGVDLRNASHEQAAIALKNAGQTVTIIAQYKPEEYSRFEAKIHDLREQLMNSSLGSGTASLRSNPKRGFYIRALFDYDKTKDCGFLSQALSFHFGDVLHVIDASDEEWWQARRVHSDSETDDIGFIPSKRRVERREWSRLKAKDWGSSSGSQGREDSVLSYETVTQMEVHYARPIIILGPTKDRANDDLLSEFPTSLDPVSSYDTSKREYEIDGAITTLSLPGENGDEAFRGHKVMEGGSTKGQLYGTSVQQSEKSNNTGTTDLEALASRWGEGQLTHSNIRPDGRRVKKQAKENRRPKATASIEVHKAAKTTRGANSQRHRNQGTHGKGHHDRRHPSSDTT

SEQ ID NO: 994712 - protein, 30 aa, Homo sapiens
MCKTNQLTEGEKEEDGRNRRKTQKHEVMES

SEQ ID NO: 994713 - protein, 109 aa, Homo sapiens
MREEASQWPLDLTYMTLSRASQVDNTAITHACVNRGTWVHGQSHQGVVSSERKPALRIDLCSRGTDGLKQNPKGTWRALLQGGNLHALGIPTGYSGGVDPGCGYVLGVG

SEQ ID NO: 994714 - protein, 417 aa, Homo sapiens
MSAPKNARTLVSAEWMHALVDNVVLYDPDCDPEGRICERRCHVVNPGASAVLGSVQARVEAMSAARDKGDLSLRCDDAGCSSATQHPTFEPAATRAPSDPGDLSNQLQTPWDARWLEERSSLPTEPLNSCWRPREIRWTAGGTYSSSSNQSSNRVMLCSNSVSHHRPPVDVESRRISRLTNYRREDIKGRVYYYQGRGRDLDLARSAGEPLQVARSTRHLLTHRHRFPPESSTMKRLDRRRHTAEHTWSDVEWPYVDRDLDRPEEIHKQDTSPRNGHKKGLELQGTGAHLTHREHRASTVPRGVTGKAEEDTRTTERTQREKRSNHHRNTQRGEKKTQNKTGGTQRKEGRTRLKQQAQGRKPEVIPSEEKPQRRQRQMRAQRGQSTTKKNGHQRPRARKADAQKTRKRSAKHHVFTL

SEQ ID NO: 994715 - protein, 149 aa, Homo sapiens
MASSDIQVKELEKRASGQAFELILSPRSKESVPDFPLSPPKKKDLSLEEIQKKLEAAEERRKSHEAEVLKQLAEKREHEKEVLQKAIEENNNFSKMAEEKLTHKMEANKENREAQMAAKLERLREKDKHVEEVRKNKESKDPADETEAD

SEQ ID NO: 994716 - protein, 145 aa, Homo sapiens
VLVSFLGTLAVLPGNIVSALLMDKIGRLQNACWFQCVVLCVLLLPVFGNSESAMIALLCLFGGVSIASWNALDVLTVELYPSDKKDYCLGFLNALCKLAAVLGISIFTSFVGITKAAPILFASAALALGSSLALKLPETRGQVLQ

SEQ ID NO: 994717 - protein, 214 aa, Homo sapiens
GHNLARQVHKGSMFRVDLSGHNLANPHPFAVVPSTATVVIVVCVSFLVFMIILGVFRIRAAHQRTMRDQDTGKENEMDWDDSALTITVNPMETYEDQHSSEEEEEEEEEEESEDGEEEEDITSAESESSEEEEGGPGDGQNATRQLEWDDSTLSYKPALSACSPDSLPAPRVHDVQNHFDQQVCRPFPHCSKSSRAWCVGPPAPPSPPSHWQFC

SEQ ID NO: 994718 - protein, 209 aa, Homo sapiens
MPFHLGPPRPSPGKSLVFHVAENQGGCALNQLCLLRELRRHIRVCGPPPFPTACLQGGGRGTPGGPTLFPPLQPPWFLLATLSPLLWEITGQQAWRRQYQVPRDGAPLRHSQPSDWRKICQVAGRIHNREPSRPRVLPRLAPQIKGGAAKKEALQRVILAPPWAPLVGWGHTKVWTGGSDRDWDKTNAGRLEIADLGNAQSERMLKPES

SEQ ID NO: 994719 - protein, 351 aa, Homo sapiens
MKFAVLCWPLWQALVAVLPCSNGYYPFPIAGFLKAPLSQERWAGGSVVLHCEAVGSPIPEIQWWFEGNAPNDSCSQLWDGARLDRVHIHAAYRQHAASSLSVDGLTAEDTGTYECRASSDPDRNHLTRPPRVKWVRAQASVVVLEREWPGHLFLFTSRATRPGSHFVEPDAALPYHSFETPLGTTGELNTHQCPCWVQVGLASSSGSSVRTPGLGLLCTSLTSVLVLSMTLVYLAPCLPVIAGRVGTVPRVRRVYERKIHTTGEPWGQGQPKKTGKKRERTKGRPPHETETEANRERGRKKGNKEGKTSKGGQENNERQNQKTSRDRQEEDKQASDDTGKQTNTQRATTSP

SEQ ID NO: 994720 - protein, 303 aa, Homo sapiens
MPREIITLQLGQCGNQIGFEFWKQLCAEHGISPEGIVEEFATEGTDRKDVFFYQADDEHYIPRAVLLDLEPRVIHSILNSSYAKLYNPENIYLSEHGGGAGNNWGRGFSQGEKIHEDIFDIIDREADGSDSLEGFVLCHSIAGGTGSGLGLLTLRATERTGSPETGARHTQGVPNQGRDELMVLVPAPRIAPQHKRGGANGDALWLRHTRPEQGQQERKIRNSTSLQNTTAGTADERTHPRGPEKKRDDEQANSNRDAHRGTPTHKRGDTTRRARRNDKKESTELRNQQNTAAQRGYSDNNGH

SEQ ID NO: 994721 - protein, 261 aa, Homo sapiens
EAAELKDPTDHYHAQPLEDNLFEWHFTVRGPPDSDFDGGVYHGRIVLPPEYPMKPPSIILLTANGRFEVGKKICLSISGHHPETWQPSWSIRTALLAIIGFMPTKGEGAIGSLDYTPEERRALAKKSQDFCCEGCGSAMKDVLLPLKSGSGSSQADQEAKELARQISFKYGAQNPSGAPLPETTQPAPKNTSMSPRQRRAQQQSQRRASTSPDVAPRSGTKSPQKEHGGSACVIIILSVGIGGLIIRGKLLGQEYIYDVEI

SEQ ID NO: 994722 - protein, 155 aa, Homo sapiens
MNKKDRRKRERKRQTTSKHREKTKRRHKTRDKNTRNTEARNKSSRKDNNKKEDENKRNKERRRRVEKKSNRQKKRKEEKEKKEQEKKKEQTTQHRTNTQRDSKRTRTEEKQSNKTLREDKNTDKRGQETTKTEEQQKKRDSKPETQAKTPQERQT

SEQ ID NO: 994723 - protein, 102 aa, Homo sapiens
MLPELQTLVHRGRLKHSWGVLWSPRRGPMAGLPPAGEKHSDKTNHTRGAPDGANIPRHRAGFTTAGVETNSGAGYLRRGLHHTGQPGSSPTVAPQSCSKMAK

SEQ ID NO: 994724 - protein, 332 aa, Homo sapiens
MAEYGTLLQDLTNNITLEDLEQLKSACKEDIPSEKSEEITTGSAWFSFLESHNKLDKDNLSYIEHIFEISRRPDLLTMVVDYRTRVLKISEEEELDTKLTRIPSAKKYKDIIRQPSEEEIIKLAPPPKKDLNKGEEEEEELDLHQTTPFPILNGRGYGQPPAPYPFTNLVLTLTMRVCVRVRTLWLSVCLAHQFLLLMRGSAAARGGLKFPRLLGAGGTAFLLWTENWAFSSFSPSSLFPHLLERTAWCAKRGARRHKSLAQTRGFLPDTTWGEHREKRRSNTHPGCGRSTTPADGGELQHRTRVKTHGVSRNKQYRRGTQPRMSEERQPLK

SEQ ID NO: 994725 - protein, 161 aa, Homo sapiens
MRTSCITLISDQRPSIDHVSYYRGLPRSMIVPVFPEASHNRRLTNTNIFRGSGNRKRGFVNVSCARHRSVVLHRPLASPYASFYSNKTDGRTESRVRISAVKIQFVPPIGYVNLSEYTRTYWRDLNHYNCLSDNFHPIIPRTRASLRTPMTVDKVGVVLPI

SEQ ID NO: 994726 - protein, 214 aa, Homo sapiens
QDAGILSITFTEDMGLLPCLLYQFYKFKEGIFQGSEATGTWTTHSFLLPKKIFIKNSFASLKNKHSSCFERTCIYVKVAFKEKITVLEMVALIQCVLPTAMELFDNYMQQDAHEFLNYLLNTIADILQEERKQEKQNGRLRNGDVDNEDNNSTPDPTWVHEIFQGTLTNETRCLTCETISSKDEDFLDLSVDVEQNTSITHCLRGFSKHRNSVQ

SEQ ID NO: 994727 - protein, 140 aa, Homo sapiens
STHYYLLPPSDLCLRPPQTQRPTSPPITATQGTATIPEGHGSAATEGLPRGRARGCSASSKVQMLQAMVHGVTTEECQAALQSHSWSVQRAAQYLKVEQLFGLGLRPRVECHKVLEMFDWNLEQAGCHLLGSCGPAHHKR

SEQ ID NO: 994728 - protein, 443 aa, Homo sapiens
VARYRPRDPIIAVTRESPDSSSGPPCTVDIFPCCCARTQIQEAMELSDDETIRGLKIDHEMIESTGTAGISSQNGSMMSTFVDRPGMAATWTPGYHTSTQCSSSIHVPVDRTTKRHTTHQKNTQETNKQSNTHKTQQIDNTSNIKDTTQTYTGHNENTQTHDNTERDINDKKTPESDRRPENRKTKRKTQDEQDEKREENKENTAPPPRERATPQHTNRNTERERNTTRAGKDANENGKKDTKTRIPRAPGNRKEGAEKGNEETRRDNDGGKNKGRTDANAQHHERARETETKETNTKKDSRKERDQRKRQQNTRAQTTQSGQKKKRAHNRQKHDNKPRRHKEKTESANGKQQQGKDTNINHMTTNDRKTKKRRRHETVTRTGADEHGGKGEESRAAAKEQNKEIQEQRGKREEKNARRDEREKRNKRDTSNAKHRRNRISSR

SEQ ID NO: 994729 - protein, 302 aa, Homo sapiens
GGRACVRSLRGGVLWRSSPCHYESTATRHFLGTLQKLPLQAGVRNFHTAPVRSLFLLRPVPILLATGGGYAGYRQYEKYRERKLEKLGLEIPPKLASHWEVSLYKSVPTRLLSRACGRLNQVELPYWLRRPVYSLYIWTFGVNMTEAAVEDLHHYRNLSEFFRRKLKPQARPYVACTVVTSPSDGKILTFGQVKNSEVEQVKGVTYFLGVLPWALEPSTEDCLPFQFSSSDSFQKPAGSPGKGMSVYPVFILLAPGTSLFPLPHDGPLTLGPSQFLCSGPGWPMVQSLWAGRVHATEQGSHR

SEQ ID NO: 994730 - protein, 307 aa, Homo sapiens
GPPTLRVAFLHGLHSAPRFLTAFAYGTTTSAVRLHVLGYRLLCRINFSLNVVENLALLVLTYVSSSEDFTIHENAFIVFIAASLGYMLLTCILWRLTKKHTDRKSYSWKQRLFVINFISFFSALAVYFRHNMYVRLECITIFAILEYTVVLTNMAFHMTAWWDFGNKELLITSQPEEEEILTPSVMLENKKPLWPSLSPRSLWAWREERKGMTGLTQNADSPHIHGDLKKDTIHWKVQKMSWRKVPLGAKQKRLGPRGVKPGAETRFRAPRGAPAPVPGATPGSPPGRRRQTGDGGDRNVSRAKTGT

SEQ ID NO: 994731 - protein, 273 aa, Homo sapiens
MAERGGDGGEGERFNPGELRMAQQQALRFRGPAPPPNAVMRGPPPLMRPPPPFGMMRGPPPPPRPPFGRPPFDPNMPPMPPPGGIPPPMGPPHLQRPPFMPPPMGAMPPPPGMMFPPGMPPGTAPGAPALPPTEEIWVENKTPDGKVYYYNARTRESAWTKPDGVKVIQQSELTPMLAAQAQVQAQAQAQAQAQAQARPGTSPGSGPGPGPSSGTSPGSGPGPRPRLKGQGQSQRQQKPRPKPRAQVQAKDNSTHQSSRGSHPNNSSPPRWSR

SEQ ID NO: 994732 - protein, 70 aa, Homo sapiens
RICRQNTGVVKHYPVKAKMVKGQDSYSPLVVIGHVDSGKSTTHWPSASHTMRWHRPNSNPLKTFADRQAS

SEQ ID NO: 994733 - protein, 69 aa, Homo sapiens
EAFTSEHWLVRIYKVKAPDNRETLGHKPRVTNIVPKQKYCQKKTTKRKRGYVKNKLVFKKGKKTSKKTV

SEQ ID NO: 994734 - protein, 252 aa, Homo sapiens
GSGCGAAGARAPRGGEAGPAAASMEEKYLPELMAEKDSLDPSFTHALRLVNREIEKFQKGEGKEEEKYIDVVINKNMKLGQKVLIPVKQFPKFNFVGKLLGPRGNSLKRLQEETLTKMSILGKGSMRDKAKEEELRKSGEAKYFHLNDDLHVLIEVFAPPAEAYARMGHALEEIKKFLIPDYNDEIRQAQLQELTYFEWRFRKCRCPSGSREIYFAYERCTTPAIPGKRRSPSQGLLRWGTPWEPDPEESFT

SEQ ID NO: 994735 - protein, 277 aa, Homo sapiens
MKTTQETTDRVNNKRHRGTEEELASRKMKATQQQTPTVNAGDSPQRKNMEPEQEQQKATHARHSSEDTITEEERAQSARTNHITKRTNMHAAKKCREHKKFTTKTGSTAGNDNETPTPNERDEEPTTQWTNNCHADNPPQQEPHTSIAEHTKTASTQHRARDSRTARKTEHQRTEEAHRKAGCTTMSRATNNTPARTDSQPDTEHADGPDDNRQTHAHQATDHHTRQKQSCYYPLYLEPTKRRREHHKDSANREASRRQRRTQNKDHERNTEATRRN

SEQ ID NO: 994736 - protein, 264 aa, Homo sapiens
QLLTTIARTINEVENQIRHPSTPRASAQEQMQEFRASFIHFDKDHGVGRWEPEEFKDLPQSVTGLTYVVERPCRVRPSFNRIMSLVDPNHSGLVTFQAIASTSCRGRPPTTDTADQVIASFKVLAGRTKNFIHSFEELLWESWPPDQAEYCIDRMAPYQGPDAVPGALDYKSFSKDYDMAERHVRPPENLTPKDPDRPPGRGHGKNPQSTNSLHICIYAKANTLRRPPRDVTGDGTGNGGWGNGSLTRLRIREDKNKEGTPRHR

SEQ ID NO: 994737 - protein, 194 aa, Homo sapiens
AAAGWPSSWSPQDRRSHPPMTEGPMNTPDHDTEPGGSYTGQRVASPTADHDTTATYSNATLQTSRDGSPLDGSQCTPRVALACPTTCPWTYLSTCEAVRLHLSHCITHRDVQHGYTHFRGELPEMGTPPLASTTITVFCSWDYKVTQNAETPDSSQDNIRTRLKEARMDQRWTRMTRTAHKERDAADGHASSAA

SEQ ID NO: 994738 - protein, 164 aa, Homo sapiens
MTSAWGILLFDDSCLDPFSSWHAHALAQQLEQFNMESPSTSLVLDPPAFSEGPGFLGSEGSMSGPQDPHVLNHQNLTHCSRHGSGPNIILTGDSSPGFSKEIAAALAGVPGFEVSASGLELGLGLEDELRMEPLGLEGLTMLSDPCALLPDPAVEDSFRSDRLQ

SEQ ID NO: 994739 - protein, 101 aa, Homo sapiens
MTSRQTDISNHDIKPKRQHEHHRTNITTTQRNYKDTNNTPKSTTKLRTATRGTLRTSTHRGNEQTKKRRNKNQQRERGSRRNPTTPDVSNEQGKGEQRKTQ

SEQ ID NO: 994740 - protein, 32 aa, Homo sapiens
TTRFQEDQVVHKQLAGISYQRGLDQVINKFLL

SEQ ID NO: 994741 - protein, 181 aa, Homo sapiens
IGLCLTPADFSPSPCKLCLRLASFVFRVGKMRHSKRTYCPDWDERDWDYGTWRSSSSHKRKKRSHSSAREQKRCRYDHSKTTDSYYLESRSINEKAYHSRRYVDEYRNDYMGYSQGIPMENLEADTRCIVASPLVGVEEAVTKVNTGVATTLRSTIHTGYECLLNVLKGFISHGEQETVCV

SEQ ID NO: 994742 - protein, 121 aa, Homo sapiens
EICVSDIILRLRVEIRASAVDERSSTRAVERGQFRTDNWQRVLSWDISQLHANHGCTKPTGLSRKPDRRYSNLCTAIAAMNAAGTQHDFVTTLPHVQDTHTVTKRTSPQDTKLPNLLTNDT

SEQ ID NO: 994743 - protein, 289 aa, Homo sapiens
FIDLNYMVYMYQYDSTHGKFHGTDKAENGKLDHQLEITSPSSRERDPIQNHDGADADAEYVVESNWTSYNTMADRLERLHYDTGGRHNSRDQLNLCTPIMPDAHTMITSMRMMNHHEHSMTTTALHSTHGDNCHYHATTTQKHAYKPTPLSPQGYIADEQSYGYFAEKGTPMHPTKTTNVPNSTDVTTRTEKVNMAGEIETTYSIWYTHYDIRTIKAEPRQSRRHHNHNSNTNINITTDETIISIVTDHGHPKREELTTAGPKKTITSTNTSLKTTGHIPGRKQETYKT

SEQ ID NO: 994744 - protein, 103 aa, Homo sapiens
MVSTPCINDHPNKNGSQRSSTEHDPHSHEDRKTTLTSGLNKRTKTDMKHICPWRPKHEDNCWLPSTARVIPLTRINKSACTRARHKDNHQCGGNTPQVSRPCT

SEQ ID NO: 994745 - protein, 186 aa, Homo sapiens
MPQSEEQPSWEAEPLSPIQASSVHLKSESSSLTKQQDGKLPGLASGLGSTWPISVRIAVERFVPVQVHQPEWSPESKLSWGGNSWVSGQRGVRLNILVFHGKAILPNCAGVNPLFHPFCAEEGKHGEADTGEKNSNTQNPVDTLIPQEDYHKYGAPLTRNTGGESQQDKTTKPESAHRKPSETKTY

SEQ ID NO: 994746 - protein, 66 aa, Homo sapiens
AQGSASFRRTNPQWSKTVAGSTLEMVIWGPEGKRRIDDYRIPSKARDRAAAKVSWKYTLEVGNPDT

SEQ ID NO: 994747 - protein, 293 aa, Homo sapiens
MAVCSRYIHPSEEELRALSGKLRPRVRKERWANGLHDEKPLSVPRDAHFQLQTCPLTAVDALVLRFFLEYQWFVDFAVYSVGVYLFTEAYYFVLGPVQETNIAVFWCLLTLAFSLKVFLMVTRLYFSTKEGGERSVCLSFAFLFLLLAMLVQVVREETLELGLEPGLASMTQHLEPILKKQDWDWTLPVIKLASALGWRCYVPVGAFLIFTGLRWPDHRSADLSGDDPVRCLTQFCSLWPVVWQAGRIRHGPGLVSVRRGRPRGWGVVRTPGFCGGTMVRHAGGGPLEGPRGR

SEQ ID NO: 994748 - protein, 111 aa, Homo sapiens
MLFYQARNEFPCGNLLIGEHTEQLEKQRWAERTEHGTHGESVDNPQNYTRKNSRNNEKVHHADKNKGNPGAQPTERHTGGEENTPSDHEDNQEHRQQQNKQTARHKTRKKR

SEQ ID NO: 994749 - protein, 142 aa, Homo sapiens
KNHACEMCGKAFRDVYHLNRHKLSHSDEKPYQCPVCQQRFKRKDRMSYHVRSHDGAVHKPYNCSHCGKSFSRCAGASLPTRPVGGRATRWPVFGWWGGGSRSWGQEPLPGGGKLLGTGGGTLEEVGLWAEGKQPLGRRGILV

SEQ ID NO: 994750 - protein, 211 aa, Homo sapiens
MTKDNNLLGRFELMRHPSGPPGRAPYEVTFDIDANGILNVTATDNSTGKANRRSPSSNWTRAGLSKEEIERMVQEGGIRYKRGRGEVHAQRVSANNALEILRLQAMNERLRIDEGSSGAHIIEACHKRSKCAVTSVKEVTLWLDANIRLCRMNGRWFEHKEEGSWYRYVCNPIISGLSRGAGGVPGAWGLRGSGLPGDRSGGHGPTIEEVD

SEQ ID NO: 994751 - protein, 330 aa, Homo sapiens
QRYGSHKDLYILMSHTSGSAAEAFAHTMQDLQRATVIGEPTAGGALSVGIYQVGNSPLYASMPTQMALSASTGEAWDLAGVEPDITVPMSEALSTAQDIVVLRAKVPTVLQTAGKLVADNYASPELGAKMAAKLSGLQSRYARVTSEGALAEMLGADLQILSGDPHLKTAHIPEDAKDRIPGIVPMQIPSPEVFEDLIKFSFHTNVLEDNIGYLRFDMFGALGAWLPVSSCWENTSWTKTVPLMALIIDIEVNLGAHSQISLWLILKRPPFVGRFTAQIGGIGHTQGELPKGPAGDRRKKQKGAATKVDTEKTPPGERGRSQHESRRALT

SEQ ID NO: 994752 - protein, 155 aa, Homo sapiens
MFGKSPHFLKSISFKEISPLVSHRGKFPRGGVSTTTSCFGGGAHELRRANWLFYNNKKQPQRKQERSSPLWAKKKNNPILHKEGCPHYKKAPNLGGGHKYWFAETKAFPSFSPAQKKQTAVIFVPPPLGVPQAVEANLSSSTEESLVGGAPTTFM

SEQ ID NO: 994753 - protein, 125 aa, Homo sapiens
MGNRKQAGLAGSLPSGQPPAHHSRWKGWTELSIDVREACTQQDFQKPPDPLGSLEGSGYLTLLSDPPTLGIPETQEPAVFTCPLPCLAPTLVFLLMYPAISFRTVWPGVGGGAPTVTCLQLGVTQ

SEQ ID NO: 994754 - protein, 313 aa, Homo sapiens
MCQCADTQRWDSHRKRRNKRTYNRTTGDRRCNAHTDYTDQNGSDQDSGTKIRVDTNRLGRKTHMDETAEHPLKKTRTGRAQQIRRGDNQQRGETGKNVKRARKQASKQNRTHAKNTAHTEGVTTTNNEQDKRHGRRKKKRGARQHGDETDNERTEHNNQQSRTPNRKHQQSTETTQPNNNQREQDRSKANQATQTARKPTTHKKTENRKKRAEEARHKGEAAEKKTRTTDRPEEGDTQNNKKTENENSEKKGEQKNERGERKQKRGAKKQRTERERRPDNHDQTKTKASEARKEETHEREDEAKDRERIKEQK

SEQ ID NO: 994755 - protein, 42 aa, Homo sapiens
MRRATNRKRGGGGANKSATRQRRRRKLNERDKPTRWQATTRD

SEQ ID NO: 994756 - protein, 378 aa, Homo sapiens
MSKSVIHGNKDAKLIKVERPEAGYLFSAQYTMMIQNRTHCNGCCSKDSSSTDSANYNTSPYPSGEKDLVYLRNLQRRFVGSQARELLHYYQCTGIIANAVTGCSELRIIASCIEGETVASVPWKEDRSCLVLNYSNCHHLNIRSFINWREYGSMLEGMKPWKTPDLLVRRKPEELIETHCTLSTSDGESMLLAVTQGPCKFKHLCQQSVKYDEELGKAARVSCDIEAAEGPNQCSADQHYQSKKHYSQELPAVPGASGEMARGNCGNTSNFCPKISIPKKRLKGQGEPQGGAGPKKRTFTKTGAQEQGLSNKGRMTRVKTGERGAEDSEENITVEKGSKKQKTPKRGKTIAKTDAQQQTRQRHEDEEQKTTAEKKRRY

SEQ ID NO: 994757 - protein, 141 aa, Homo sapiens
TNWTSKLTTFSHPCSKDARVPMLDIRPGLIAQAPGPRFPLLQPGIPPQRGIPPPSVLDAALHPPPRGPFPPGDLFSQPERPFLAPGRPSIDNVPNPDKRIPLGNDNIQQEGDRDYRFPPIETRRALPDLLRWMLGMWLGDV

SEQ ID NO: 994758 - protein, 174 aa, Homo sapiens
KQAFLLDVQNIRAIHQHLLPPVQQSLKFVRVRNTLRQSVWTLQQTSNKLPEKVKKILASLDSVQHFLTNNVSLIVIGETKKFGKTILGYFEHYLHWVFYAITEKMTSCKPMATAMDSAVNGILCGYVADPLNLFWFGIGKATVLLLPAVIIAIKLAKYYRRMDSEDVYDDPSRY

SEQ ID NO: 994759 - protein, 307 aa, Homo sapiens
MGAQYNTRLDKWNSAPHTSSTRRWIGTHDFRLGLDEAVFHNWRLLKERAHFVVEEELFPNETPWYNRMRQSTNFLSRNCGKVGPQVFETFISQTAGGTESCRHTGYGGTTVLFALKSGWAKAYEPIGNDTFNKRNRSPIRRLAQVGNGTPQIFDEQFTGRSQTINQHAHQISLVVEAPLQIADEEATELSSITHIYSPTQCVHMRHREDLNKPTTEGRGYPKHVPTSDDVGQHGGPIEDWRHTHDETDLMCDNIARGKHRPQDSNKWAGQLRHWGEQEEAQQQKQQGEHNRVLLAHKLSEPHRGETK

SEQ ID NO: 994760 - protein, 343 aa, Homo sapiens
MSPRRGQLPLLADEAALVVAGARNLPLPPPPPPRGGDLMGYDRRGRPGDRDDGMVGFSADETWRLLQVDTWSPSRNGMMGLLNHRVAPDMIIPMQRWSWSHMVILGGPIITTQVTIPKDLAGSIIGMNGGLAGLNEIRHESGASNQSLDEPLRRIRTIGSSYHYRNTGPDDRMHSICCITRVKQYADVERSSNCKICLLSYSVQQDSGKFFKTSEDLKEPCLFMGYLPCCRTPRFLRVIGVPRFEGCAPCLAVPHQLWFPFPYPRVGGGQAASYHGNLEPARDAYSGMGGKNPPCFVDRVAAVLVGGRPAISVRLRTAYVCKRRQIRGACGVPPHRLLSRCPL

SEQ ID NO: 994761 - protein, 206 aa, Homo sapiens
MHHNWKRDAKQYRSALNGFPLQLIIFTSSNSTDYPSTDRCRPLNPQPTLFISFLDKPSTLHDNTNDPPITMPYHYSKTQPMTPNRGPLIPPNDLRTTMGFQLPLHNAPHTRTSNQAQLTIVPMSGGDVYTRKATYPNGHHHGAIPVPKKAFDIRDTSYYYSVRSIVLRRDFAEAFEHSSLVPTPYWGGDVGRRWHYPAHIRYKFQS

SEQ ID NO: 994762 - protein, 209 aa, Homo sapiens
MGNIMEGKSVEELSSTECHQWYKKFMTECPSGQLTLYEFRQFFGLKNLSPSASQYVEQMFETFDFNKDGYIDFMEYVAALSLVLKGKVEQKLRWYFKLYDVDGNGCIDRDELLTIIRAIRTINPWSDSSMSAEEFTDTVFAKIDINGDGELSLEEFMEGVQKDQMLLDTLTRSLELDRHRAQTPERRTRGGRHRRLAAELGVEASPCGF

SEQ ID NO: 994763 - protein, 114 aa, Homo sapiens
LLVLIVPILIAMAFLLLTEIETILGYIQLRKGPNDCRARYEATTTPYPLTSIEHSCTNRAPNTPDTSTIILYIIAPILILTILLLQINPPRPIANRPDRSSTLAPLVFISTSSL

SEQ ID NO: 994764 - protein, 185 aa, Homo sapiens
SFLDGNPTFAHQYFGKKLSPENVAGACEDGWLADCGSLRELCQVEESAALFELVQDMQESVNMERVVFKILRRLCTILHADRCSLFMYRQRNGIAELATRLFSVQPDSLLEDCLVPPDSEIVFPLDIGIVGHVAQTKKMINVQDVAECPHFSSFADELTDYVTKNILSTPIMNGKRCRGCDHGSE

SEQ ID NO: 994765 - protein, 355 aa, Homo sapiens
ISALARRCFVPSHAFVSAPEILNIRCRFHVSSATRIHSCPQLTLNLARGPGAVAESAARKREHVASALKHAGQRNPVGVVGPVGAAVSCLAAWPVPIRAEGLVFRGLGANLELQTEEEFELLHPGKPLTHPTISGFDRGDSHSAPVQSGLKLCQIIGQAGNPEEGRESVSEIVSEAPGSAEPCSAGWTQPCLLSGSPSRKPFTSFHPQRMLAIFFLPGELWNDNSGGPEDPVLPEETERFGAGPFSAGSLNVWSPLDPGVCAVPPVPCARLGSRPGGPVKNFLWGDEPPYTRCVGATHSTQQRQCKEARPINVGRGRAIKAAPLTGERQLLRCTPNHAPRERQITPHVQPQQLSG

SEQ ID NO: 994766 - protein, 80 aa, Homo sapiens
QEQKQMLGERLFPRYPNKHSNLAGKITGMLLEIDNSELLHMLESPESLRSKVDEAVAVLQAHHAKKEAAQKVGTVAAATS

SEQ ID NO: 994767 - protein, 94 aa, Homo sapiens
PLLCSVALCFEVSFLYSMVLNLLGGKYLEAKYNGKKVFTLFCQMFIFIPSWSEQKLVMGINTTELWWEKKRKTVFPSLCWRTLERVARPLCSSA

SEQ ID NO: 994768 - protein, 140 aa, Homo sapiens
MRSVAFSLLHVQEAIMKPLDHKNLDLDVPYFADAVEVGVTVWPRAAEMKHISIVIVTVIVISKILLRGRFCYWNSCFIYVLNLKLCSLFDFELLSFFFFSTTENVAVYIWESLQKLLPVGALYKVKVFETDNNIVVYKEK

SEQ ID NO: 994769 - protein, 301 aa, Homo sapiens
EPFIETRQDGVSRRFIPPARMMSTESANSFTLIGEASDGGTMENLSRRLKVTGDLFDIMSGQTDVDHPLCEECTDTLLDQLDTQLNVTENECQNYKRCLEILEQMNEDDSEQLQRELKELALEEERLIQELEDVEKNRKVVAENLEKVQAEAERLDQEEAQYQREYSEFKRQQLELDDELKSVENQVRYAQIQLDKLKKTNVFNAIFHIWHSGQLAQSIISDWVRCRGFLLDVGCNPCCLGPEGAAVHALGNNGRSFQVRMSLWKIYWGLANNWSATDGGRAGTCRDLEGSKEDKTVPKEP

SEQ ID NO: 994770 - protein, 300 aa, Homo sapiens
MSRSSVSTWKRQLSSWPSSTTVLNWAFCNTPGGPASSSKSFSEGSFLTSKGENSEEDEDTEYFDAMEDSTSFITVVTEAKEDRKPESGPGTTTVDWTSADNCIRWCLIHAQEFMQIKRRVRIPDKPNYSLNLWSIMTNCIGRELSRIPCQVNFNAALYISQRLTEDLEYNNCWTKRVNLTGSVAAYVALEAGFRGTPNPTVDRLAKPLSLDRRPRLAYAELCRSLGAGCHTEWSAQLFFLMAYTPEKTATFVEQFHEKRSENTRTKEGNTDNYAQQTYTSKTGESTQTENHNHRDNVKDN

SEQ ID NO: 994771 - protein, 268 aa, Homo sapiens
WTFTWAAEHCQVTCKCNKKLEKRQLKQHAETECPLRLAVCQHCDLELSVVKLKEHEDYCGARTELCGSCGRNVLVKELKTHPEVCGRVEEEKRTEAAIPPEAYDEPWSQDRIWIASQLLRQIEALDPPMRLPGRPLQAFEADPFYSRTTSQRSMAAQFPVQNNLFEEQERQERNRSRQSPKDSAENNAHLDFMLALSLQNEGQATSMVEQGFWESVPEADPARAGPTSLGDITGAADEDSGCRVSSGKELFPRELVLDHSDKVDPFMP

SEQ ID NO: 994772 - protein, 103 aa, Homo sapiens
GCSNTKSSDSWDSENTFASHTCPETYEDYGYDDTYAEQSYEGYEGYYSQSQGESEYYDYGHGELQDSYEAYGQDDWNGTRPSLKAPPARPVKGAYREHPYGRY

SEQ ID NO: 994773 - protein, 275 aa, Homo sapiens
DTSPCSMEYLVSRKLCLSGSDSDYVISAITSSHKEHLSLLSPRMAFPPSPLAMEYVNDFDLMKFEIKREPSEGRSGVPTASLGSTPYSSVPPSPTFSEPGMVGGGEAPRPGLEELYWLATLQQQLGSDEVLGLSPDEAVELLQNQVLSLWKGLLATIQGARERQEPSMSSCPRDFLDAALVSMSVRELNRQLRGCGRDEALRLKQRRRRSRPGYAQLVAPAAATGRGLEGRRRSPGRPSGCPCGPRWTAWSEADSIAARVTVNSGAWSDEPTPLL

SEQ ID NO: 994774 - protein, 184 aa, Homo sapiens
PKGTFGFHVAHGSGRRDLRLYVQAMADLDTAKLYSGLLRVGDEILEVGGAKVAGLGLAHIKELLAHAESLSIRVLETKAGPPVTQKYRCSCCHSYRTPDPHTQQEGLETCHPEITCERKMQFTDQASVWAVAEAVLIGPLQEEAEYPCVRSVKITNLYRSRDRESWSPPSQKWSRSFVGGRELH

SEQ ID NO: 994775 - protein, 145 aa, Homo sapiens
PKLDTFLEHIRSHQEELVYSACLLCSWDLSSSPRYVAWRFTSSYFHEQPSMNELQLTRESDHAAVIGRCVSVGVRPWYSKLTESLMRATMVQEEALNNVTRCAYMAVVGRSRSCEKYLHFRGGHFGDNQCEGKGGTSLSVAHVVS

SEQ ID NO: 994776 - protein, 93 aa, Homo sapiens
TDLEMRSGLLGQMNNPSTSGVNGHLPGDALAAGRLPDVLAPQYPWQSNDMSVNMLPPNHSSDFLLEPPGHNKENEDDVEVMSTDSSSSSSDSD

SEQ ID NO: 994777 - protein, 311 aa, Homo sapiens
MANLTLLSLGENEKNIVETKCVHRQAVSIYFEAYLYNANNCTSTPWHLPPMHMSSSQRRPSTAIEEDDEDSPSECHTPEKVKKPKKVYCYVSPKQFSVKEFYLKIIPWRLYTFRVCPGTKFSYLGPDPVHKLLTLVVDDGIQPPVELSCKERNILADTFIRSLHKNIGGSETFQDKVNFFPERASAGYFRENSIPKSTLKVARPACSESLGQAPRTFPISDGPRTLTMFTDKEPAHFDKPLHGKQLDHTLHRCDAIPTYTYHLEFNGHTHDKLGSTHNSPQHTQKKYIKDTSTSMHHSHETPTKRTNNSRQ

SEQ ID NO: 994778 - protein, 115 aa, Homo sapiens
GHGRISCGGGINVDVNQHSEGGPGGKALGSDCGGSSSSSSGSGPSAPTSSSVLGSGLVAPVSPYKPGQTVFPLPPAGMTYPGSLAGAYAGYPPQFLPHGVALDPTKPGSLVGAQL

SEQ ID NO: 994779 - protein, 145 aa, Homo sapiens
MNEEMEKIAEYERNQREGVLEPNPVRNFLDDPRRRGGPLEESERDRREGSRRHGRNWGGSDFERVRSGLEQERQGRRAGLGSGGDMTMSMTGRERSEYLRWKQEREKIDQERLQRHRKPTGAVAAGVGCRERPMGMFKDGPGANQ

SEQ ID NO: 994780 - protein, 267 aa, Homo sapiens
MGEVTAEEVEKFLDSNIGFAKQYYNFHYRGKVISDLLGAKEAAVDFSNYHDVNSVEESEIIFDLLRDVQENLQAEKCTFNVMKKLCFLLRADRMSLFMYRTRNGIAELATRLFNVHKDAVLEDCLVMPDSEIVFPLDMGVVGHVAHSKKIANVPNTEEDEHCDFVDNLTEYQTKTSGFPHQWNGRRMLVSPEFIAGELNYNVNPPFPEEYKNPFPSPISLERGPKGFPRSPDLKSRPISGRHDVGDAEEHKGLKRRSQRTRPYPTVL

SEQ ID NO: 994781 - protein, 213 aa, Homo sapiens
EKKPESAENPGQKRAYLLLLSLRLNYLQILGELKTYGGKVFNATLMLQDRESYIALLVGAKYGISQIINSKLNIISTLAEFANISRVELTEESEKVSMVKVYLQDVNGSDLCVLESSSAKDLACLIAGYYRLFVDPANSVFHWSGNRRPTHRVSAEEGYESRACSDSEESSEVDCVLEPLSDRCLVKLSLCRPFAREELPPGDSPHLRQAEEV

SEQ ID NO: 994782 - protein, 202 aa, Homo sapiens
ENPSPSATMVNFTVDQIRAIMDKKANIRNMSVIAHVDHGKSTLTDSLVCKAGIIASARAGETRFTDTRKDEQERCITIKSTAISLFYELSENDLNFIKQSKDGSGFLINLIDSPGHVDFSSEVTAALRVTDGALVVVDCVSGVCVQTETVLRQAIAERIKPVLMMNKMDRALLELQLEPEELYQTFQRIVENVNVIISTYGE

SEQ ID NO: 994783 - protein, 166 aa, Homo sapiens
TCVPMCVHGATCLTTGPMSDFNLWRIWSSSACESPSASLCAGSPLDFSEMWPVIFRAVMVANVCGPSVITHTFNHQNLTHCSRTLAQGPNIHPHSGTPLTWFTTNGDLPRMPWNGRACAFERVSQLATWTPSGYGATTHSTLPALGRPLGTQEPRLQKLLDLNLLV

SEQ ID NO: 994784 - protein, 172 aa, Homo sapiens
MVRSALLRPEAGAGCARLSAREGPHRCEEVTVRELRASGPMGLHGDGGSPAAGAGPWRSGALRGSVAVFASVAAVFTLTLPRSLLGETRVKYSQAASSPRPAPGDLRSVSRPRVPRWTPVPVLIPNSSLSGSGSGLCVSRAAQPMKFKHCPLCPDRVTCITCRALTVSQTKK

SEQ ID NO: 994785 - protein, 215 aa, Homo sapiens
GGSRCRSEDVGGPRWVRNSGFPVGLPVGAVINGADNTGAKNRCISSPLKGTQGTAEQTSRCVGGGLTVVMATVKKGKPELRKRVHPAGGHSTSEELITVDKEWAVSHYTVGKHKLQELIGGTIRGETVTEALGPIYGGVANRQVVPALGGPPGMANPNVAGPGNVANGILPEEICGYKQTQQQQGARAPQKDTPPERGGHKAIRRYPRLYGDPTG

SEQ ID NO: 994786 - protein, 80 aa, Homo sapiens
IHVGDGIVKPTTHRSYSMMNVISGIKRIRSYGADRNSIGTVSITLNQSLGWIACHPLDPIHCSYKEMDLPVSSLMPPNDR

SEQ ID NO: 994787 - protein, 446 aa, Homo sapiens
GKSVPTDEHGCKTGPSHSLPGDMRLESDSHVWCGGSVDSSRVLSRLMQTYETWWQCLGMQLVSAQPTTWVGLARALGGAYCEKSTIRRSVRGSHSENHSTYALHVTTLGAVHTDYIKRRFDTEKNTRDWYRLLEDGQRGHYTQRDNVLREECGQGALKGSWAEVHVDVVDERDRFMAPHLNRKDEHAKGSIPAVQSGAQKRHVLAALAFNFFDRPSTVRGPPHPVTLGQQSRGLKTVQGRTWVVPESNSLGRSRECAVGQKGGLGAQDQRVYRLCEHTKRVLVCGATVDLGSMWTSRRGIQIRGENGTDKWEGGDTVVYNQKREGATITKTQDMLRMSAKSNRAMNRPGKETQSRKGVPCSPTGWDRAKLSDGQVKEVPGQREYKRHFPHGERTREATRKPDNQGLPNTNPGAMCSNVTQGEKMHNMKKNDTGGHTQHNEEQRDNE

SEQ ID NO: 994788 - protein, 467 aa, Homo sapiens
AAIAVMLGELAAQAQDQSCEYSLMAMATSVDRSFRGMLCQEPERPGDLDVERASKKRIRSLRLTEEQEDPYHEMTAAEEAGPDKQQSRDTELTRWSAPAYEGLPACCLMVSPCEDVNDMHHEAKPQTDRTCENPSINTVGILTDCQTATARLRGHGYDAHTSDKYSCKSISRRRDEQWYSTKLRYPGFSSSQAILLRNPYTQSQEPQRLNTRQRNMAHKYTTHGSEGQTDTEQYPLNKRHEKYKDPRGHKYERTINCHSNTHTDERSDTTDDQRPKQERQNEIATERTTKLERKEKDTQTRDRQSDEQKDTGPTQSTRLPAERQQEEQAEDEQKQEKRNPKNAKLTAGGKKVEYGAKEAKYQQTTYTTRDTQGIQQGDRWGSRQSEETVGSKDRRDNEGSERRGEGERNTRRERRTEAEDSKQARAEERGDKRGESEKESTTRSSTNNKQTTADETAGDGGPSKRTR

SEQ ID NO: 994789 - protein, 127 aa, Homo sapiens
QVINTCSLCKGSGEGLLCRPKQSQPGARSFHFSENLTSGCILFCPWHQACITLGDTLVWVTGTGTHSPATSLPFPEDVVAADLRKSFGTCGDILFFSLWRSVDRLRGKAAFNLSPALQPELHKMAAH

SEQ ID NO: 994790 - protein, 323 aa, Homo sapiens
GNRVLLNWLRRECRGGNHGVSDNHPTISGIQSRYDLTDSHNRYSLRMTGCATEYTTGDTLSEEIYNDNNSTRPLHTSDRRQRASGTYRERTRETTHKTRTREPTAAGPHKQGRERTETSDSQQPHHYDTHVRPTQTTCQKHVAQLHTTQQTPTHTQQRHTATLHKEQHKYSTTAHPKKHAPNKNTVTQENREQITAPKRRRGAPAHTETKGSTKLPALDGATKTGTMGQKRDESTTHQDMHTTHQRSDLRDKTQETPQQKMKHETQNAHKAPPRHTKRKKSTTKKQRRQRTQQRKTHHTNKDKQAAETTREGETRRKERHNTP

SEQ ID NO: 994791 - protein, 103 aa, Homo sapiens
MDTLWLVTHSFMRVESVLPMRCSGAILRCKVPTESGRGWSPIYIAAEAPVVSWDYQGSLSLSGTIWVLFPIYTGLVSTEGPLYCFFGFDLLGAEMARRVALAL

SEQ ID NO: 994792 - protein, 115 aa, Homo sapiens
MKKKIWWSYTLTIAKATERTNDCKSQEEGETDGNRKNKEKRRSGTENVTEEESERKVSAPTRRGEYTVDGKVVVTATYGLPDSNRRQARGDTKSKTRRTTDITHRAGDRGQAPRR

SEQ ID NO: 994793 - protein, 424 aa, Homo sapiens
FYIQLQADVFHSIVYAGYEKPEKSDTIRAFMANSHLRSVLITLARRVTGVLTCAEQADVMWRAMATCALNLVDNPSGSPRCDEEYSFKVPSYTHEGENTNPLSSWLPSTSSQASSQRLSAWLLLKLRRRHTLLNDLPDGSAPLRRTERGNQTESMARKPLTPPSLARLHSPYTSAAATTHYYSQPRWPLALQPHTPSAHSSHFSGSTAPYPTKAHHHASTHSTSNLLDCLPLRPVTTTSLALNSSLIPYGNPTHPPTTTPLHHSTAFSSLLHHPRLTLHHLLTLTLFIPNPHTYALPSQSMEHQTQHSHPIHSFTQHRLPPAHKLQRSHKHHTTPQPHMRPTYHTSLIPHPIPIIPPTSSLPTTSKSSLHKYTIISISPILPSSTVHQPPTILPQYLHNTPSSLPNYFFTYTLPYTSSTPSAQT

SEQ ID NO: 994794 - protein, 173 aa, Homo sapiens
MIRKPSPSGKPATLKICSWECGLGFDALVLANEHGLMIVRKRDRSPSKYCAFKRTKCSENKSTMLNFSELAGLSHHLLVMLLRTRRGYSGVGLLSPLQVPISQVFLPVNRLMRRHDSGMSGVMLWLNFDSFVLGKQGILYLSAGRGLVRLEYGKGGMQAVAQFLKGWFRKPWV

SEQ ID NO: 994795 - protein, 326 aa, Homo sapiens
RTRGFDYPPPATPHCTVFWLLVDLNRCRVVTDLISLIRQRFGFSSGALLGLYLEGGLLPPAESARLVRDNDSLRVKLEDQGLPENLIVSNGGDSSFPCRKAKKRAFKLMEDEETDQGYKSLKKHCKRQEDSGQNEKASDLETKLLPDETGRTKSKKKSKVTGSPAEEDEEETKKKSSKRKEKCEPKKQTRGSKSSKQQTPKEGASQNCSFPGPPQKASGKARREKQHGGKRSAQATCRKLRRPETDKKATDRPDARRHLSENGASSRGQNEPVTKNGSAKQRGPKQGVLKSERGRPKTLAIQHQKEKDQGSDKAQHRRDTHTTGEK

SEQ ID NO: 994796 - protein, 292 aa, Homo sapiens
MANRGTGAAGSSQTGDALGKALASIYSPDHTNNSFSSNPSTPVGSPPSLSAGTAVWSRNGGQASSSPNYEGPLHSLQSRIEDRLERLDDAIHVLRNHAVGPSTAVPGGHGDMHGIMGPSHNGAMGSLGSGYGTSLLSANRHSLMVGAHREDGVALRGSHSLLPNQVPVPQLPVQSATSPDLNPPQDPYRGMPPGLQGQSVSSGSSEIKSDDEGDENLARHQNLLRDQKLDDDQEGFQIQFTRHNDDEGPDPEQKGEREKNGDGPNGREPEGPKSRGVEVALGAPKGEPNKRI

SEQ ID NO: 994797 - protein, 293 aa, Homo sapiens
RTTLSSRFCLEADKQQKIARLLQLWEKNGYFDDSIIQQLQSPALGLGQYQATLINEYSSVVQPVQLAFQQQIQSLKTQHEEFVSSLAQQQQQQQQQQQQQPQPQPQPQIQLPQMEADVKATPPPQHHHQPQQLPPPSHQLPSQMTTSLPSRCLALQSTTPLQVSRILQLLARGPGPMSRSRKQAPWFDQPHPVAPWGQQQPLSNPISTQQGGPPPLPTLEQQATEACGVEAAEGTPGGNWAQQCRGTTRPEIHWITCLTGLVTYSNHAGVYQRIPLLFHAPHWGSHISQKLHA

SEQ ID NO: 994798 - protein, 148 aa, Homo sapiens
GLYCVAIRDFKQAAELFLDTVSTFTSYELMDYKTFVTYTVYVSMIALERPDLREKVIKGAEILEVLHSLPAVRQYLFSLYECRYSVFFQSLAIVEQEMKKDWLFAPHYRYYVREMRIHAYSQLLESYRSLTLGYMAEAFGVGVDFIDQ

SEQ ID NO: 994799 - protein, 119 aa, Homo sapiens
MTAPDSGSDGDTTHGLLLEAADGTGHGTVAHTAKPDGLPGSCGRPAVTWPALPVCEVAEPLLCSSLGLLRCTRELLPGTEEEHQPVPGRAELVLWQLPFPRQTCCLSPRQGPLSPPTFP

SEQ ID NO: 994800 - protein, 222 aa, Homo sapiens
MLTGKFKIQCHSSVSPLGHTPNPHGVALRRRYERVEWPHWVTEGWPAIRWAQVAPHGWVLMGPGTCVAQQRRIVSGHSQGFRAQFAHLWALRTDIVGGLSQLRCAPHVINTTSNVHHYGGSHPRTRCVTQVGRAFTENMNGISAIKTFTLCFAAHTCYPRYLSFRGTLVSTHKDGKSENFVFIYGPHDTPLVAPKKSILSTTTRGALAPGIHKGTRQTGADT

SEQ ID NO: 994801 - protein, 132 aa, Homo sapiens
MPGATPTFLFEKEGAPHQAGVALIKTNDRAAGGRVKKQAAVAERQHKSCLLVGALCGREREHTTILCGGGGTLFVSGNTPHHQQRILMTLRQEELNNKKNRGVFMWVVTHQTILIVAWSTRKSIVSAHRFDI

SEQ ID NO: 994802 - protein, 150 aa, Homo sapiens
MKPAGLHTPQEESVNRYAASDYTKQQHGAQHNGATSQGPPQQSIGTKNSEGTAKHSEAAHYDPKKDKCQDHNSMRRPRPRSLTGTGKTPVHRNKTRTANRPVEPHNENHQMLGHPEPHNSTKPNPTETENPTRAERKRTRNNKQPTTAER

SEQ ID NO: 994803 - protein, 175 aa, Homo sapiens
MASYPIRNDVRWAHSYEYHKDGVAITPTEQTNAGYVSHALCQESIIIALNVTSFSDESIMVTLSDEVVPVVHKGLHISNLPRPHDEAPRHEVAADPPQVVRGYESTHPNGDIQVNANHMGATGTNLPTGHGHQTHRQAREDTKKQKGASKNQQTSKHTRGEHSSKKATPYSRHAD

SEQ ID NO: 994804 - protein, 257 aa, Homo sapiens
MLAPVDILTGCGDPANKGYTWKTKVPGKKRTQVRYVEKRGSVTKRKTVQNNEATRQYGEQQVVYFFLFLPSRLPSLLTTHARSRRHKRRDTNIHKRTQKQTTRQPRGRGKARRKKEAQKKASETERKSARRREEARKEQEGQKTTNYRQEENRSKRDEREARPNETTEKERGTEDREKKEHKASKRRGEHSSERGRRQNGTESGRKGSREGRGKQQRGRGTRNAGEERREKRKRRGEEEEEGRDERGDVTENADGKD

SEQ ID NO: 994805 - protein, 124 aa, Homo sapiens
MAFEFSQCQKEANAQAVSIFQNEEQKGRSLKPRVKTSSNWSPTAQHHLGHLRSTSARPHTVLEREEHLCLAAPRPGKVTERLCPAAVQTSKCEVTALCVDVSAFPKLALSTLKFTFELNNKIEK

SEQ ID NO: 994806 - protein, 164 aa, Homo sapiens
MTPTGTRLTEGHKNGAPNGHRTRSDPVNGHGGHAYGANSEQRTSGANATTTTVLAESKKIKTEHHILRNKHREAAPGTDNCREIAAQLTHCPSPPSRCPAPSLVETETTKQKKQTKEKTRAKRKKQRRKQKEKEKKARRQTKTRTKKKTNRSKKKRKAEEHERN

SEQ ID NO: 994807 - protein, 33 aa, Homo sapiens
MTREGRRREKQTTESKEATQEKKRETRQGEQRD

SEQ ID NO: 994808 - protein, 198 aa, Homo sapiens
MQKRGARHNKHYADGETNKTDDHNAITRRERHQPETDITTKTQRDAHPTHKKPQARRTTTPHSSDTARERQPKTGEHTKTEGTRQTHTQPEQETKTTTHRSTANNTTKYGRRKRKTAEKQQKKQTPREETKKKTKKTKTAQNRKKGTERRENKKRRRERTNGQTRQKNRATQSKTERQREERNRKTKKTRDKQMRQQE

SEQ ID NO: 994809 - protein, 282 aa, Homo sapiens
YNIRRGIENYIMMIMDLQYNIMDFVQNMFKCCGGEDYRDWSKNQYHIAVPLDPWLWGALSPADFLGIHDKQVRTITIVVVDKTISQRERVTVVAAMVINVAEGSSNADDHLVFMDNYTIMEVGILLQQSCFPSCLWVLLDCLHVHHPGVGHHHGALCHLMGSWGQVSSPSCRRQARDAACATPIRAQPAMAAPTRTVWDSTSQSTSWGWTGLRALCPHSVLSQSQGCVCLCVGPRLCSPGSRAWAPLRGFPPRQSGSVPTWGRGQGLLLQGWARGGNRRLFS

SEQ ID NO: 994810 - protein, 272 aa, Homo sapiens
GVHLAEHAAVDRASQLSDVLRTAADTGSFSAVSTRQTSLPSAPMCRRPGSYPRIRTLRVLPGPETVSAKPAPVDSFVQSGCSIASTNPADRNPYGGARLQALLLPLLWNLSFVGASESTIQMSFCSQRDNQRTNYGKTISTKWGRVAGPKEVARKKARVTILATPPFPEEESVRPQELQNLSDDDRQQLWKEIRLQPDGHRALMKEEADEKRSDVPSKRQLNEQQAIMGSLSQTNTLELRSNRCHTLQYLNTGRRTVARIREAVKIINAEGV

SEQ ID NO: 994811 - protein, 134 aa, Homo sapiens
EAHFFSAIDVRCAGVAINPFLPNEIMLLTTISVRFGDRSEVLFIGLQLSLLRRCGETGFTTCTRQTVTPSRSSTDLDLHMQPIGTRLALTSISVLLSQPYRRLQVTSRIRNTCVPEQVRSSKRTYLTLESVTQG

SEQ ID NO: 994812 - protein, 253 aa, Homo sapiens
MHVKSSTSGGKKMQWDTHDIIAETQGMLCLREGACVVCSRAEDAQWNVAYTSITHYNFTRKCAENDEYLGGKTKVAWLVGSAPGVGKLGRPRGFLWHRSRGVGAREQNVGKSTSDDVGEYYSAKRGLDRKFSTKKIVEQQGTVGKCSRFPLYITTVAGGKQFITATDYTQRGRVPWFAHDNGPYVMRAIPYKINQQYTKKDEGRRSCCRKKLCPTQGGGVYQPCGRFIICQMVVKTDGTAEEENTSCDKVGGV

SEQ ID NO: 994813 - protein, 164 aa, Homo sapiens
YRRPTPFGIHAHRMGMVAVPERAITYSDSQRAPRHAFNALMAEHIHYGAGNMNAYERASGIADRGPGTVKERAPPERAGPLWPGYNNSQSMGPPGGQPGRLPSRPDIAAAEAQQAVFQPSPLTPQTLHAGYAALLQATDERDKTSTYRDCNPKHSGRQQAPPEG

SEQ ID NO: 994814 - protein, 50 aa, Homo sapiens
MATHSWQHTPEDNNNAGESKKARAKTVKQNRYLAAHKGKDSIYNNDEASN

SEQ ID NO: 994815 - protein, 302 aa, Homo sapiens
MPDAVGQAHPILHLHYSLSLQGSTIRTSTPGSMIHPLITPMGIKALLLGTHIYVMWIQAITLHQLHTTDEQNTMCSELNNAVHRCPRGPVRITFICPDQANVIWKVASEPSRKQKWDGPEACTIGADLLKHLYKSQTPRPQPHAIITLMYSKAQYTNPAHYNLRPTHKDRDTQRLAQTTPDTNARQRALKQRTSRSGSTHGEHEEETTRHQRNKHTQAQKQHKGTLNLTNRTHKEYEADTRTQKGTEKAKKDHLEYSTNDRDNETDARTTHSHNTTRTTTERSKNKNKKPRNSGTHQSESGT

SEQ ID NO: 994816 - protein, 280 aa, Homo sapiens
DEMIREAEIRWRWAWSIMKEFSTDDDCKVKAPRAAGDARSLDLSSSRARTSLFNTPLRTPGSSKDQLIDVESDKATGRDFVPKAAMMCSFSLLALRSLSGMPPHLFLLPSPRSYPSSFRGLMRFMNVESPPTGSPVGSLCPPPARMASPPSGFVYLLFRHLISGAVGGCTTPVPGTCWERTRGPPPGRRACPLPLHAALPVIPRADPRAVGAGVPKRGIQRTDRGVEEQWVDWIVAMRRPRDQAQKGTAVDNNHIPMAVVRNHGMGSEDMPGGDGIAPRN

SEQ ID NO: 994817 - protein, 145 aa, Homo sapiens
MPKTQSYTVPAAFCGIIVYHKKQSLVPYQVADCCSIRKSADCSSERLEVHEGQWANIVESSKLLGILSTFCCKNVNGNMKGSSMELINYFGQVMAIFARNIGSSLSMNMGCGTTLFVSSPIPVGAVVQYVSPLKRSFTSLVIWYS

SEQ ID NO: 994818 - protein, 288 aa, Homo sapiens
MSLLKLQASNVTNKNDPKSHQLSSLHRKALNDSVLVKEYSDVETIFSKYGACGRLYLCTRGYAFVHVLQVSAMPGQLCWDGEWAGAGRADRWISQLMDWMEPKSLIGPRGYREQHLPYTVDTVFDYDYLPGLSSTERSRSEGSGAVCRPCHMPRRSRVKRPGSESLGPACRTSVSVKLLCRSHSVSPPAQQDQVKERELRPSDGPGQDKSHIDALVARVGESGEEKAIQMAKQRWRCRKVEGYDGGKRGGVIGEAQNIEHPVTATDEATGARPGSRRKEPRESTRSRP

SEQ ID NO: 994819 - protein, 203 aa, Homo sapiens
LNNLRIGFSHAMRAEECKVVVRAWVRPLGGPAPEIVSCRRPLATSSTWSFSSSHSVIVAIGLKLAKCDGHIGNGGTGRILRATLSRELVNSWTEYWETTTGWLTVSPIGGLEHVVSMPTKRTKCKSQPVNVFFNVNDRNPECETCPNDNTLQKVYSVTHAWAHQIQLSYEHDAYTNYLHIENAYYTTGGCIAGYSTVVDGNIV

SEQ ID NO: 994820 - protein, 131 aa, Homo sapiens
MPVRIRIGVLLTSEVSGASLVGSPLACVITEQPRLCVLKLADRVSRDFITMDHFILSIRFRYSVPPGCLPVTLPSVTPIAGVPCASFRLRVAPVGGLGQLELELCCGPAPPCSCIAGPTSSVSRIEGLRVV

SEQ ID NO: 994821 - protein, 76 aa, Homo sapiens
SSRSRAAPFSMVLYREIKPQLYWARRIKFFWWKRVHLPKLDIKELLPRKTTSRIKRTSQSSLQEVVFPKIIGENAG

SEQ ID NO: 994822 - protein, 242 aa, Homo sapiens
MLFSSLIKTAAVAASLIGSVTALPAHQHNQHKRGVVVVTETEVVYVTAGAPQEVSGESTTVLWSLSFLTPQLPLLLSLPTHSRLQLLMLLLTPLLQLWPPPPPLKPLLLPPEMVLFQMMTLPASLRCQGYYLLSITSSGACKSLSEVKSDLAELSFYSLIEMSGVDCVPSVNVLRAKGLVKRFWGSPPGPMGRVPQGLRQPHGWAGYPVSRTTGPGSSVPGPSRKFGGQAVGRLPRVVPSTR

SEQ ID NO: 994823 - protein, 338 aa, Homo sapiens
ESSGTWSNEISFDFGPNGEFALPVQPGATSSPTLTNTSYRSLAPFNACLARNPNLERCSPTSLGTWGSWIAPRPTDDMFYVANDEVMEPEARAAGEGPNTLHQPVTPPVRVTETYEEYQVSTCETLVRLSSDLHGSLIDRPSRPAPESTRLKHPPKTIHDSTLYAWIGRTRVGQGDAWTSSVECCPMPRAPAGACPDLRDLDPLWRTLSVLVSPVCRCLFLVLASSRPCESSLLRLLCWPCLPIPHSHLTCELLPSRRSPPIVSVSAFPSDLGLTGVPPAAWLFLLQKADHNDARTYRQDPDRPKHRAPLASQRAKDTRLPPAGKSRLTHDNTHHPHP

SEQ ID NO: 994824 - protein, 391 aa, Homo sapiens
MESLRSPRMPSLLNDRVLRGQAEGGGDLCVALRMSYFQIVMQKDGPCRSMRRDRGPPWMTGGLRWNRELRRQEVFPTETMKLPGTGFLISQEPGETRDRLQAARGASIGMIQLDLVTMKSKTYPLHGRREERLCTLSTGRIFLYRDSDGSVPVQTGSLHPGVTRLKLGTLGREMTPDECGIEHFLSRMPGGGRSKRNRIDPQTRADLRTPSVPQSGEVQLPIRPPWMADGAAEVGAQSKGWNLTEAHNNISGLLTGHNTTKLHQRDHVRPTVDSVPARKQNGTQQEDQPGQGQENRHPQRTRKKREKRKQKEERDLENKENRRRQNRRQEGERKRERQKTEVNQQHKTATKRNKTGHKEKRERKKKTTRRRRTAVEEREIKKRAHKQHTRA

SEQ ID NO: 994825 - protein, 446 aa, Homo sapiens
KKKQKRQAELLEKLPAGDTKNWHAEKLNRKIIEENITSSCTVPNDQLMCEYCPEVKLKTTGLAGRRLTARKTDTGDKMRDTLDGTHGNDDTTTRPPDDTRHNTTRQKTRNDSHCTIQRNLSQKTIKKHHKRCRYRNLQPTDQPSLRPILLTDIGPQPPSNFGSPRHTPAHPTPHPPHLHLQNPTHLAPPTLPPATPHYSTSSDNQPPTIRTTKLPPQQHFYPEAPPLTWTTTHPIGSTLPPHTMRPRPPQTHVPRAGPQQDPTTKEPPQHRPLPTPSMHSTIDKHPTDSTTARAQPGGHHPSSTDPNRSALPATHAQRERPPRPHTPPPPHTHKTPNTEQQRPDHTPHQAPPSAQHTTPTHAPGGQPLSHWRAGGTQRRAAKPPTRHRRHQTPTRQAPQQQPRRRRANKGTRRAATTPTRHTRAPNHPSHPAAHRAPPTTRSQRTT

SEQ ID NO: 994826 - protein, 225 aa, Homo sapiens
KALQRRRRTPEPLSRTGSQEGTPWRAPPRCPCRARHPQDSLVATPGIDKLTEKSRCQRMAPCGSLEPEPQQSLEGLGSPAKGEPQARHGGEQRADVQPHQGPSWASEKPNARVGPLLGRFEAAACRTIMRLAAVCWFPQVEKICIDQRAWTDESEILRVPAAIGTLVGACCPCPNPILIRKYQANSGPLAMWFRTYMWGVIYLEEMSDPPVWYDTDVKLFEIQRV

SEQ ID NO: 994827 - protein, 176 aa, Homo sapiens
MAPLTSARSTNSPEPTPPPSIQQRAPAYVTQYASPYTYTTNSAPPPLQQPHPPIRPHKLHRPRHTHPRARQPPPPHRGGPRAPNHAPDTQLPPPSNRIIHAPRPPSQTNTPTPAHEHTPPPATTHTHRPPAPAAPRTTNTSSARTQRKSPHQLKKPTPTTTARAHATTRHPTHPQE

SEQ ID NO: 994828 - protein, 189 aa, Homo sapiens
HASRTRCVVCQKTVHFADQVQCQGSSFHKSCCLCMVCNMHSGQYHLWTCMVRRFTARSCYGQKYGPKMAMGYGQGAGMLSTDKGESLGIKSRGSRLATGSTSNPNASNICPEDWWLRTLPPMLPGSAMLRKKVHCVLVEILCHNGLLFDVPTCGKGLESNTLADKDGEIHCKGCYAKNFGPKGFGFGHR

SEQ ID NO: 994829 - protein, 185 aa, Homo sapiens
MTKKAKYKKRERRNHEERQRKKDKKERRRGQAEKTKKKSHKTGQKNRRQREKKARKENGKEKKNKKQAKEHKDKHNTEKEKKEHKQEPDRTTDRETSRTRTADEGPENEERPSQKRQTNKATDNTTRDDTGPRRNRHNEQQARRQNTRPTTAPKQTKTHGNKKERKKKRKKTKADDDNDTHNQRR

SEQ ID NO: 994830 - protein, 295 aa, Homo sapiens
MSCCHDMGEVILMVCYDSVSLLEKKEGGAFYSLELRMYVMLTVGNITGNSEVSSHGKDVSSLVLPTARPVTSHISPSKANGIYIIVQLWYRHHSLSEQDSINWIYCFCIDELFTSLDHTITRTKFYDHNGGYAYCNMKLAVSLVFQHFLYTSNMLGMSVGRDLLEIPIMGLRLRRFYNVLYTRLCPYRFEFQGPQSLTGIARTLLFAQFPSVVNWSLQEWPLLDWDSARVALKFITEVCLAHLLLRLQVRDSLDSLAIGDLTFFPPSGTRYFWPTLYHFRTVGWFPTSSSWRVQP

SEQ ID NO: 994831 - protein, 130 aa, Homo sapiens
LDSRSRAGAESGPQKSPEQPRPLDAGLSYQSTPRRGAAACRSRTRVTIYLTTMSSEAETQTDSGWTITDRETIAEEYVIRARAPDEHNSKRIKNTVKMEEQRIRDRARTKEKEKREAPAWRQKYQSEMSK

SEQ ID NO: 994832 - protein, 164 aa, Homo sapiens
MQEPVGNIWLSPNHQKTTSCGGPTAFKKRDAPWKHQYHFFRRNTTVREAPIVWPSKPPIVCSLLERTSRKLTATQKTRAATRTTNCAGVHTQLPKIVGLSERGGQNTSSHNTDGSPASKRVLYHNPGRATIPAHQRGAPSLTQQRSGAAPTPFMNTPLGRDNLD

SEQ ID NO: 994833 - protein, 314 aa, Homo sapiens
TKWKLLEEQNVVKSSRLPDIFEAQIAGYQWVSLRQCTVDGGRVEADLRTLPGCECRTSRISTGTTEIEARRHECAVRNRRSLWLLIPTDVDAVLHWNEAMRILGGQGSRTALEMYDDHTSSGTSLRRSSYQELARSQISDDICGACSWDDKFCSLDLETGDQFGYSVNGTRYRREIGPNCLPAASRRDMLVVRRTHMLLRTHLKPQAGMLVDELRNTRNENCRDEAGIQQGCTAVDRQHPRTRRSQGAEPPIGMARERGKLAAPRDGRAKQEEPETAREGAKQDMGQAEGRFPELMNAKLASALGCPSPRGEGR

SEQ ID NO: 994834 - protein, 243 aa, Homo sapiens
MTDSLQKPQVVLLNNNKHKQKHTKHTQKHNNKTTNNNTNTQRKQQTHPPTRPARTPTRTRQRKTTHEKKQDAERNGNKKTRGKAARPHTRDNAQHPSERTRDTAGRESRAGRNRAQGGRRGREASTRHERGARRRTQRRKRATRNQRTRAQRGQKRRRRQRAGPDNPEEHRLRWNGGKAGLAKSTDQKEPENRHTTKRTNRKTKRPKAREARRKDEKRKTTTRDATTGEATQESKRESEIEAG

SEQ ID NO: 994835 - protein, 368 aa, Homo sapiens
MAVLAGSSACGRHMAFAADGSSTRLCHAGNPQRLKPWRFSLAFMQQRCCNLYKDTFDIKHNSSTSSKAPNTDRTLTLPAASDGCMAAGTLHVPTSTKQELQARADRQALGSRHTDYTCARLRQHHPQHPHWRNSHTDNGLHAQEHPIQTCATASSDWRTAHAPIPHHQRNRSAKPSHPAHTTTAHRYHTNPTWTQDTGTTPEHKGNSHLAPADNYTLATPRAHNPTCAQAMNTYPSTHKASTMEQHRLAHHTSGPPPPSDHDQHHHNRRQDPTPTHRTATPKYETTQHSTKYNPDAHDPRRRHPTAHRAGPTHSTPPITTQRGPPEHRTTPETTPTNTHTRAHDTRPPPYKAIKHHTNNHEHKQTTKR

SEQ ID NO: 994836 - protein, 333 aa, Homo sapiens
TRGIHKLKPSPDPHWGASALLQPGWLSSILSLFPLVCHHYFWRAWEWLPALYPGPAVEVTMRTSPRLEEHALCRCSATSPCDSTVQIPAACRGRGAKRGIPEGLRGRRRNSGVDWTVAQEAASQGPTHRRGLTDGQPLTSHWTACTANHLIWLFWAFALGWRHCSYWPHLPAYGLCPSYLKLLSKLELTIPGANIPMADPYVTDCTPPTLRRPDLENCNVGALGPHRTMQRDHITTPLSHHMRPNKLKQQRTNPSRPSHTESRHGTHAPTNTTRAPAPSKHTAQERRAPEDGSTNKRMRPDRKTTPHPETGRAATIRARTHNDEPATRRTHPQ

SEQ ID NO: 994837 - protein, 157 aa, Homo sapiens
SRPGVACCARMECREMPWDPERVLQPGALPDRGQRKVSAQDGPGARVSSRLGNLPTSISIRPVADCASLVIQALDGEMRNARRAILYIGDFSESLDTPWNDDMNAISCGKEGRRMLTPTFSLVSIIPIQWTGRLHWKSKEKEFDRCWRIFPNDLPGV

SEQ ID NO: 994838 - protein, 113 aa, Homo sapiens
HPFAVSDDTTSSSPLNLYSLADGSAGKQDNKVAKQYLTKYKQALDLSLQICALNSPQTTLNQLQPHCSVRTYVQARSDVRLLTPTQSTDGHYAVIHRQAAHCALEDREPLRQL

SEQ ID NO: 994839 - protein, 114 aa, Homo sapiens
AAEDDEDDDVDTKKQKTDEDELDSNTRGKVKLRTKKGRRELFTLHFRRLQNLNVVTFEIAEARPALAGASATPVDDHALIQLDQNPKRMKKLAKVGGGEHKKPKVPKGPACIFL

SEQ ID NO: 994840 - protein, 199 aa, Homo sapiens
MSLSRTTEFPVDTTPLTVVNGQEHQALEHRSFYDPICKVSDGVLDPVDRGVREPGFSPGSDEARSGLQATRLVSVSKIAEDEGTRKREGDHEVAQQTEKIAWGLTHAFWRALWGQRTSEVYTNNAGAQLVKGPDRTFLPVRQMLRPWWEARRYGLTGVVAHWLMDAYMRAKSEAGSAGMCNDAGGQITDSLFLKTSPKE

SEQ ID NO: 994841 - protein, 267 aa, Homo sapiens
MEIMEVQKVMRNTSHGIKTIQSYISRSNELCLATYGSMCIDGLIFQVKVQKNSSCESNKMDFKRSTVLNLIVLSSLPGEANANSSCDNSLVYNEIMNPKNNTQNTPTVEHKHKQDKRTNPPNDTQTQHPTEGGAPTPKNTPPREESTRKVQARPRTHYLTEPARATLKTTDALNINQGSDREPITTHNTRCITGQPNLSSLHAHILRRTRHIPPSSAADRQYMYRRPHPHEHQTTRTTVKKPRPRAIICGHTPRSHITAHHNTMSPR

SEQ ID NO: 994842 - protein, 135 aa, Homo sapiens
MPRDPSGLDLFFRYPFQSPDPPDLSLNGAANKKHRLGPICESREDPLHLHRQKAGILTAAREGTANPFGGSGHQQLGEHKKQRCDFSGAETMKARWGPMGLGHSLLLIRIAFFGCFLCADCFSRCPYKKEQLKAG

SEQ ID NO: 994843 - protein, 109 aa, Homo sapiens
CVDISSCFGILMAAETLTELEAAIETVVSTFFTFAGREGRKGSLNINEFKELATQQLPHLLKDVGSLDEKMKTLDVNQDSELRFSEYWRLIGELAKEVRKEKALEIRKK

SEQ ID NO: 994844 - protein, 340 aa, Homo sapiens
MPHFPQWTWHAVLLWPLWFNHAWPCNDPADCKCPVQMPYGCCLHLPLLPLRLGPILAHLLLLAPTVFCVPQRSGAAACALLCFQAFGWKLMWFGLAFHNDMCVPWTIGAFLVALLSGGAGTNVHCDVPCRTKLLHAGFDMDVTWFQRSSVPTSLSEMPFWAPQENWGGTVSWLRMTPGQPWSNPKVFDPGHTGVNCPRSRANPVPHYSATRRQTAFEVHRPLMCTAQRGHSSHSCPFRRNAPSRVHSRPLFAQPAPGRPFRAISLGATTHQEWPNCAHGPGSESLLEYVSGPAPGQRRVSMAPFPLGSTFREFPVSAARSICLDVLPPVVVGTGGAPTLR

SEQ ID NO: 994845 - protein, 204 aa, Homo sapiens
PGRNWARFSVGNVRLSLRSWSAFVRIFRGRRYRRYRQHHLPSGRARTQRPGSRVREARARPLARVVAAPRKPPEPHTVFATEGGGGLREEAEEERGKMAAVELEWIPETLYNTAISAVVDNYIRSRRDIRSLPENIQFDVYYKLYQQGRLCQLGSEFCELEVFAKVLRALDKRHLLHHCFQALMDHGVKVASVLPYFFSRRCSY

SEQ ID NO: 994846 - protein, 250 aa, Homo sapiens
MTTIQCAKNNRRTGQWPREWPRRLIHRRVEIPIMQCFQETYALPSPHKSKGGGDDCSWRLRCGSSAMCESIGPPMRRNGLGASITIRGGRMAKWVNLALLCPSVLHGTRHVSGQTGDVNRMEKYCIQKSIKHRSINACPCAIKVDLGDPHVAKVIRGTTIENPRECDLGCDPLGHAINLPPRKTCGLGPPGKHVGREWAGGASSKNIIPCLYWGAGKGWWGKSSLELERGKSLGMALPESPTGEVVQVVD

SEQ ID NO: 994847 - protein, 147 aa, Homo sapiens
PRPHQYSIFEQASIVESLLRHLGLQNRRINLLSHDYGDIVAQELLYRYKQNRSGRLTIKSLCLSNGGIFPETHRPLLLQKLLKDGGVLSPILTRLMNFFVFSRGLTPVFGPDTRPTESELWDMWAVIRNIDGNLDMDSLLQDINQRK

SEQ ID NO: 994848 - protein, 158 aa, Homo sapiens
SFDDIAEGSRNSTVMSKSESPKEPEQLRKLFIGGLSFETTDESLRSHFEQWGTLTDCVVMRDPNTKRSRGFGFVTYATVEEVDAAMNARPHKVDGRVVEPKRAVSREDSQRPGAHLTVKKIFVGGIKEDTEEHHLRDYFEQYGKIEVIEIMTDRGSGK

SEQ ID NO: 994849 - protein, 53 aa, Homo sapiens
MNEPRKAHQKRTHHKPTKKNAKQQRGETQHKDTAQHNSGGGTSDTTDEPSNDP

SEQ ID NO: 994850 - protein, 119 aa, Homo sapiens
MQLNTNFFDTAEEENRIIYNNYSDIRTTRRIIIIYRLGKSPYGTYLVRQQDHGYIERQSKSSGTQGTRIDTKSNEHNNKRTNYTEKQNPSDRKSKNRTKTRKSDTTRPIYNKHKKAQTQ

SEQ ID NO: 994851 - protein, 132 aa, Homo sapiens
KTRRNQIWKPKGRLSWVVCVLLKFVSPQCVCATGLVDIFVSWVAPISWVARVWQAVASSRRAVGARRLLYTRQSLCACGVSHVRSQGAQCSEEPWARCAHVVRRTPRVCRKSVKVLWGHLRGPFEKREERHV

SEQ ID NO: 994852 - protein, 613 aa, Homo sapiens
QDNYSREVIRFSVLEKCCQCCMLNVHSAQGALGNHGIDRGGQHGQHTGTCQYWPASLPASPRWANTQQPCNSQVVTHSAGAIRAAHSSMRISSSIVCTHSINSSTSEHFSHSTCTKLHGIFSPNHSVQTDIGGAHAHYGPLRDIAYSHELTEIRIASYRESHTGSISSPKQSVSTHISGVQTRSTESTQHFPPTFPSTGGQYLNAPSSVPLTTDNFVQAKGISTKVQAYNKHTSQKDKIRTTFKQYPRKFQRSYKRPRRAHLTDGPIQTHHDGTHMPAKTNHYMRRKADPRHGTTGAEATPKRERTFHNGTDFTKDTGQRTQLGTAPPPTLEVAKNSTQPGSQSHNPFTPANVTQHNQHNFSGRIGRANLAARRRRHMGHDQEDKPALRTLDASSGAKGTLNTPPADGTPYGQYGNPPAVAAAQRHETWTQRERATRDTTRRKPSPDHSTKTTDEDVNTRQREHRLPWTSHSNSTKSNDKPTEKHDTTAASETNDQSIAHTKTGQQTPEQDHNHSTATSTREQTNNTRRPPQPPPPRPAAAPQAGRHNQDPHTHRHQHDHNDATSRQATNDNRNRSERQTETNTNTAQHDTSDPEEQSRHRANSSTSSHDAAP

SEQ ID NO: 994853 - protein, 200 aa, Homo sapiens
TAGMAFVGTVCSRSHAGGINVFGQITVETFASIVAHELGHILGMNHDDGRECFCGAKSCIMNSGASGSRNFSSCSAEDFEKLTLNKGGSCLLNIPKPDEAYSAPSCGNKLVDPGEECDCGTAKECEVDPCCEGSTCKLKSFAECAYGDCCKDCQFLPGGSMCRGKTSECDVPEYCNGSSQFCPPDVFIQNGYPCQNSKAY

SEQ ID NO: 994854 - protein, 281 aa, Homo sapiens
MQGPLMLGIIIQTQQHLVCNSPCGFAQPQPTPSDHSEVQTHMTSYTWSSAYEPGIKEKDQATHIDEPWVRLNTRTHRNGRHAHTNKPGHTPKPHANAPWQLHPNRSAGYTITQTATYARHQKPNRNPSYEWNIPDQAKFTNLGQKNYTSTPSQGEPRNVNTATPLKTHNDHRKTEEGIMPIPGARGARAAPAPPNTDRAYRKHLKNQHATSNGPLETLYTWDKNQWTPNTHEPGNYTTTLARPPQHTSTAPHNTLPRAAPTIAHKPRQDGNPLVRPLTAAH

SEQ ID NO: 994855 - protein, 95 aa, Homo sapiens
EETAEPQLEASCLEKCKDLLRATLTHWGPGDPLPGPTQGSVGQTIPKSKTLSSAHAAVSLVASWVLRSLAERPVSRAEVTRLLDWLKSHILPQPM

SEQ ID NO: 994856 - protein, 114 aa, Homo sapiens
CLSYSGGLNPGGRGCGESRSSHSSLGNKSETLSPGKKKFIGCITLKADFGKHVITLKVYLSQLRVVAHACNPNTWGGQGRWIMRSGVQDHLGQDGETLSVLKIQKLAMHGGRRV

SEQ ID NO: 994857 - protein, 135 aa, Homo sapiens
MGRRTKTEEKKDSTHRRAEEERQEDASMSEGDTRNQASTISTGRGARPHKKDDENNDTRQKRNKTEQNQSTRTRQATRRGHKRGETHEAATHNQSARNNQRSNTERTTKRRRQKAKKKEEKKETHAKQGKGRNKQ

SEQ ID NO: 994858 - protein, 202 aa, Homo sapiens
LAAAGAAVTVVLGARSPGKEPSHVMRGVLSRFLNVLRSGLAYGVHHTCMGQHAAEFPRRSIFVSYEKPLHWSQPNLDEEASKLVTFGIWTLLSSVIRCLCAIDIHNKTLYHIKALDASSLPWGICPLWDCLSMELQVPRLAVLAPLMVASFSIRGYAGRAPVSRSRTSIQTEEEKPEASMITFQDFLVGHLAIFIPSSASPS

SEQ ID NO: 994859 - protein, 432 aa, Homo sapiens
MPFSEVPPGVAKIHYIESLSAIRTQLCPTNDSADTGRASIVAVMHKRVSNFSPMSLGKTYPTCRAIGTNAQPGMWSRGLRLPWRLDTASHVALPVCATFCLIPVWVDSGLLASVLSTAPPSSAPLALAYPNSPGGTALSHLGGLLAIARARRPPVFALFILAAAQSHPSVGHRHIPAWRLGASTPACHAGSGHFVPPRPRSHRPGGVPTLRALSCGATLRVPVALADALRSPTRATSRVTPARRLVPLPPSLVRGALAPPPPAAHRHHPHRSAKLNISHTPTHLPSETPFSAPHQSLFDHTPPSTPALMLTSGPVIPHTDRGALSCATHEDSSVVALFTTPIYRYACSPEQLYPLPPSDNWLTSDAVLHYICHHNQSSIAPPPPLPRAHLRSPRAQRTTPSPRSAHSSKYSDPRAWLLAIPPVTHQHHTSPS

SEQ ID NO: 994860 - protein, 264 aa, Homo sapiens
MEREEGTREPGGSRESGRPQQYEDRSAAGAERTRREKKREEESGAEKARKEQQEKRQKDRRCRADTKETDRESGERETVDKKTTSREGRNDRDNNSSEERTEDEETPSHIHTTNPEERKTTTDDARKKGSRKQHRDGKGDEPERPRRRQRPKQEREREQDAGAARKRAEGTKKAARDEKENNQRTTPTRTEKTTTTQQSRTTATKTPRQQQNRHSHSSTRQPKHPRPNTTRPTARGDAPRQKAPRHTTPERQQTAENHTTHKHE

SEQ ID NO: 994861 - protein, 71 aa, Homo sapiens
LTGTQKRGVIEFVSYSDMKRALEKLDGTEVNGRKIRLVEDKPGSQAAPVLLQKPESLKASLSKQTFPEEQK

SEQ ID NO: 994862 - protein, 136 aa, Homo sapiens
PTSDKGRFYAFGRVFSGVVSTGLKVRIMGPNYTPGKKEDLYLKPIQRTILMMGRYVEPIEDVPCGNIVGLVGVDQFLVKTGTITTFEHAHNMRVMKFSVSPVVRVAVEAKNPADLPKLVEGLKRLAKSDPMVQVCH

SEQ ID NO: 994863 - protein, 128 aa, Homo sapiens
MAQKREERHPKQEELQKIVETGKRESGETQRLDKRTRTTTTNKKQGALKENARGAHIIRTQTNRRKRQPKKQRKTKTHASHLYRRKEHNTNANKCSAHIRRRPRAKHPRKPQAKAREQDQALPSHTTH

SEQ ID NO: 994864 - protein, 195 aa, Homo sapiens
NRIVILGLNTIPLFVQLLYSPIENIQRVAAGVLCELAQDNEAAEAIEAEGATAPLTELLHSRNEGVATYAAAVLFRMSEDKPQDYKKRLSVELTSSLFRTEPMAWNETADLGLDIGAQGEALGYRQDDPSYRSFHSGGYGQDALGMDPMMEHEMGGHHPGADYPVDGLPDLGHAQDLMDGLPPGDSNQLAWFDTE

SEQ ID NO: 994865 - protein, 273 aa, Homo sapiens
MECRVELTYIAIIEMRVASVHHMYADESTEGLSDRLHEPDGSPISHKIKQVDLAPDVNIMITGPIHVPRKVTRHLLLAVIMSYMVIGMTRWAVLEDVEGGRRRKGGRIVCVSEIRHVDGQGGSFRVFVCPLVVEMIADQLPWVRDYLRGALVHKAWFLCRAFLFECMAGKRVQPAKNLTKHKGGPKKAGATVGTKMAEGYILTQSHMSCARRKTVLSYEQCGEGHHTAHACSVLVLPFPCCLRFFLASHRLMRRNQPEQHGHTGTHKTKERPP

SEQ ID NO: 994866 - protein, 278 aa, Homo sapiens
MWKSGGRAPERDNFCVLASARSPASSCFVILCFFCLAQGGSRLLCGSGAVQQQGVPPCSARVGSLRPSRGQGELARGPELPKGTEGLTGHAWPTSDRGPKFLGYLIAIKSGGWHNCWRKAWFFEAAMTSVMQHPPGGPHKRGGEYRVMGPTETGRLPRGPLKKIQWGKGGPHCYGTKRDKKLDTKNSGKGNPGAKGSTRAGKKDAHIATDPVRNHVIPAKGPHMEGKNPMVARAKWGVNIEEESFLQTLSKIGKQANDKECLLPIRGIFPLLQVKERE

SEQ ID NO: 994867 - protein, 187 aa, Homo sapiens
WHRGLMEVERGLERAPYIQLLQGYSSVVQALLGTFFTWAMTSAGAALVFIFSSGQRRILDGSLGFAAGVMLAASYWSLLAPAVEMATSSGGFGAFAFFPVAVGFTLGAAFVYLADLLMPHLGATEDPQTALALNFDPALMKKSDPRDPTSLLFPESELSIRIDKRENGEVYQRKKVAATDLAEGVAP

SEQ ID NO: 994868 - protein, 122 aa, Homo sapiens
MSENTHQTQLRTTHNRRREQRNTNKRPPEHRRPGRTGASPAGTRARRGADGRAAEGTTGEGGRGRAGAPTSRTARRRRRRRPAPAGGEDSRTRTEKRGGTSEPGRGEGRAEAQQPGEPGGAT

SEQ ID NO: 994869 - protein, 172 aa, Homo sapiens
MGRKKKKQLKPWCWYCNRDFDDEKILIQHQKAKHFKCHICHKKLYTGPGLAIHCMQVHKETIDAVPNAIPGRTDIELEIYGMEGIPEKDMDERRRLLEQKTQESQKKKQQDDSDEYDDDESAASTSFQPQPVQPQQGYIPPMAQPGLPPVPGAPGMPPGIPLMPGVPPLMPG

SEQ ID NO: 994870 - protein, 102 aa, Homo sapiens
MTIYHGALLLLSYRNCYVCRFPMYIDWRLSTSNKKDILCDQCTVLIAKHSSSIEHNNVYCGIVHLNKKVEAVLTMLPLGWIGMWVVVEQIYQHLIEMTKKHS

SEQ ID NO: 994871 - protein, 481 aa, Homo sapiens
AWTEPWRSFPTPWRPDHSHALRHLFTAPSDCPKDPADAPAPRQPPTAPPHYSYSRRHDDTRSTSQVRQNYHQDSEADINRQINLDALRLHTYTLSMSYYFDQRRCGSCKNLSHNHFLHPIYLSAAGQPCMQHNCNASCKNRTQVGRISPFRHHQGKPSTLLMHLARGAADMHTWQCCHDHLSAHTTTSSHIHVPQLDTWRPKPGPTGNQTTSHDTTTGDAHPHADPRNALHQTPRCPGPHTANPPWPTVEHTHGSDDKAQRPAQTQGIQSGNDSTSATSHTPSSQHTRGNTQHRQKPDSAYNSPPDQPPIGAMERPAEVNHNGRANAHCCARIPQHNGGHTQGRTSNTHHTEQGHDGTRAHESPSQPLHGHTVVGPTASTHSLADTATRQNPRAGHEDSANTRHRDNAAQEGHARRSAAREPPVTTTTRANRTPPTLHATLALTPTPPTARPDRERKAHKPTDPRTPTRRTHQHRYRANCT

SEQ ID NO: 994872 - protein, 117 aa, Homo sapiens
NIYAVKTAVSVAQGGHSRTSSPTPPSSAGSGGSFNLSGSGDMFLGMPGLNGDSYPASQVESLRHSMGPGSYGDNIGGGQIYSPREIRANGGWQEAVTPSSVTSPTEGPGSVHSDTSN

SEQ ID NO: 994873 - protein, 77 aa, Homo sapiens
SYTLARDTTVKPGAKEDTKDSRTKLPQEPLQRLGVTKSSGAKHMNKLYMNPRQATNPGMIIHHLDECSHTSSFGESV

SEQ ID NO: 994874 - protein, 401 aa, Homo sapiens
MEATRMRMHLGATVLAHGAQLGASFLTGQDGSVSADEAARTAPISTVDLWFYFTLQNWDSGLMGCTIAMHGIPSRRGFHSTSPVMGTTFHMAYNVITATLLIAKLIERSPRTLANAPITYVEHHHLHSWVPASTMVGDSVNQPLLSSGYQHPPCLYDENPIIKNLQRRRTLIDSFELLYSYDEYLGHCHVVHPPSTLILLPCTISGWLTGIYKLRASELPGPAMLTGEHPVGPALTGTMVTEAQASSQSLHAIISHQFFAIAWALVPCTRKGAARPYIRGHEQGLSTYISSIGSAPCAWVTRLGRRDVVYARHTEAQTPTGYNTANDQPREHNTVKTETKKTTRHGQKQRKTDGADAKNEKGHGNKRETGSRETDVDQGSEPRRAAEQPDDTRNKTRREPY

SEQ ID NO: 994875 - protein, 147 aa, Homo sapiens
TGHYLQLLYIMKSELASTELQYWLLGMEKKMGSLTGSVKNLGCPQWGMNGYFLIERGRTCVAWCWPLPHPSGVSRGQPAAADWRRKARNGQLGLGGNSCPGGSSGRDPQGTTKYCHQTLCPAWKPTDNGGVPHELTRVYDRKDHQLM

SEQ ID NO: 994876 - protein, 129 aa, Homo sapiens
MACLPFFVYVDRVFYVCALEPSCREILVPDCITVIRCQQHWTKEIQNETTLKIKREQGHALQVHAAASCTLILKSPHSCPTRSSVRQAWSERQTSIQNGQTTRWAKNDCKPEKGKPRLTDGWIASLNVY

SEQ ID NO: 994877 - protein, 176 aa, Homo sapiens
VAEVEAGCGRRRQWRRLPWLGLCYGSLSALSDPGHDSQRAQRLSSWRVRVEESGGQPAAPWWLPLGRFLQRCPDSLGEGPVPCRDHVLPSRWLLPVLLIPKLPQNHRPDGFKTFTCSWASTCSASSWNGRLAQYCALVLPGRHLYPYICYSCMGETDKPVPLLRFPASRIGSMIPA

SEQ ID NO: 994878 - protein, 174 aa, Homo sapiens
EPRERLVGGQHRAATQNIVVLSAASVTCDITIYDCPMDVRRHYCTLLRVEPAMKLLIEALLVLRRLIITIAKGANSGRTNSWMVALAVAPMGQYPVKLHNRMSRRTMIPSMLFQQSSWLPVVPDVTGLPVLRSERSSKALGGDSNSRQMKRHSCGSDSKILDISNHRGKLTCEP

SEQ ID NO: 994879 - protein, 114 aa, Homo sapiens
MTRELRAVGAAVAKTEKQENKRQYTTQHEEATNNTTAQADKQRKENDKPAAPRDSDKQQQSPKRAAKEQECERAAQMKHARCARRPATKDERRSERGDQEADEGQDAGSGRTSG

SEQ ID NO: 994880 - protein, 107 aa, Homo sapiens
KHSLGLGHPRSLRGRHQPTRSDPTCHPDALTDGAQAFLGGIPRVLSQLNTGIVTCLHLGMLDDTQGIYQAHNRGSALASLTHQRMTPKRRERAGDRPRGGNGHGGNV

SEQ ID NO: 994881 - protein, 535 aa, Homo sapiens
TAQRETSEEIQQGDDKYKNKVKKRAKSKQSGSQAATAATSNSSQSNSSIPTTIHQQHAQQTAGISRSKAVNRHRAGGGTHIVQQHTHSTQAQSYAFRHKGTHSIQRKQGSQHSSHSSTVSTPVSAHPQAVTCQPCIHQLNTGHRAHTRHQHAATTSPGQFSSHIVHHQTTHRVTHHPVHHISPAHQAGTCKPATVKATSKARTASAHSKAHPNATSSICQPDKATGKYTPSGITSSTPEHITRAAQEAHGLHPQSPEAAAQETTNPRPTIPNDSQKDQRRKHKAGQEEFHGELPGSSNQAHSPNKPANTKRNPHLTGTTPRTEANRKAYQHQGTHPGTHTYRGQTVGTQPTRHLGPSLTPRSRRHPHQHQGLTTVHQGAGQPNHSGAGTARDLTRIPLSSTTNIKHHQGPVQEHTLALPQVPPHAVTPHQGEADQPHNNETPHVATSTHPPRNTQRPRTQDPVTSDKTAATHGAAKNHEHRKNKHRAEQRHQIATPALEDEQISRRTKTNHIRRDHSSSEPDIAGHTTSETPTGS

SEQ ID NO: 994882 - protein, 115 aa, Homo sapiens
MTLLHGSAPVLSMTTPNNIRQKGGRYHINARRQLHAGTHNFPHAHHTLRPTSRIDKSGTSQVSAELEGAQYENKEPTIQRSTQHGHGSHVTRHLTRGADIANPTEPCPATNAHNR

SEQ ID NO: 994883 - protein, 108 aa, Homo sapiens
GATVPEVIVCTALGGVRVFGFSLITNKVIMDYEQPGRRPTMTEVSTQLANKLHRNLEQLCLPFLWRGVPLPDKASLTCLGVVWHLPHKTQASCYLLLAPLLESCCLCP

SEQ ID NO: 994884 - protein, 344 aa, Homo sapiens
MDGTEGLVRGQKVLDSGCTNSKFLSVLRLQGRIMNVIGEPIDEQRSHQNQTILLPFMLTAPEFMEHDVLSHGTSLADWLSTVVDSASSPCQGLAKLGLSRLVLELGKTVLIMELNQQLSAKRPLAGLLMLFCWLSRARRTLCKATDFTTHETDLILSVLTHTSIHACHLLTVPAGYMAPTRLAPTWLPRCPGASLCTARWNLMRLPYLLRPPNHTLNDCYLLIHPASPLLPPSTQACLSTRPALPRRPQSHPCWGALPNPYPRPPRTRAHLLPRHTTHAHYHERRAKPRRPTHTTRPPTSPPPNPRPATTPGPTRPPPHSLPPPNSIHYLPSLLPPLNYPHIHP

SEQ ID NO: 994885 - protein, 136 aa, Homo sapiens
MKSLWLLNSKAIFSHTSSPKQLHPHPYHIRVPTSTPRYPKQDTLSSDPPSNQEGPLLGLLAKGHKQHLIRARHNDPAKLGLGPFQHQQDAVTTGENEAPGLHKPIRPKLTRWITRPDTNRARSGHREEIQGSTASE

SEQ ID NO: 994886 - protein, 483 aa, Homo sapiens
MRIEKCLISVRGPSILAHGMMFVRNDSKVFRFSKSKCHKNFHKKKRNPRNSLGGPKAFRTAAGTELTEAYIHSAHSDNTQQMQPYPNHPAQKLMATSTTHPMRMQEAARKQIENQHSAKSSNCTKLDIQDYGHDTPNTQQAYQETDSTALNHTRKDPKAHKTNPQSCTPSEPQPYNMPQSTTKARQHPQPRRHTKENKPGRHHGQRHTDTDEPIARAPQIANTQIGNTVYTHKNFHAKGTQHPQDDSPGSTHTSGLTGKDSTGHQHTVGTRTPTTTRERHTPTTPSGEHTQPHRGTPQQDNYPKLTTRRTRSSDNQYNNDKYNNKEGVTQTPRLYTKPLATQHNQSNGHIVRTRHRHTTPCTSLHHTSDITNTMGPTTDSTQPATRITPNTIRTAPTAQYTQQANTQRKIATDTTPGRHTTHSQENQAAQQNNIGPTKHSGSITQQHAHNSTHNRAQTNTTLGNTRTRHNQRPQEVDNKPDQQ

SEQ ID NO: 994887 - protein, 138 aa, Homo sapiens
EAAANTQQTLTFYELDLGLNHVVRKYSEPIRNMATSLLQFLEGQIFPSGVLICSENYITYKNFGDQPDIRCPIPRRRNDLDDPERGMIFVCSATHKTKSMFFFLAQTEQGDIFKITLETDEDMVTEIRLKYFDTVPVA

SEQ ID NO: 994888 - protein, 196 aa, Homo sapiens
RAPLFAAVVRPRRPLSGASPAAVPLRFSPKPRARACRSADHQPPVRPTASHPPWSARAVPRTAPAPGAPSEVVAGHRGPWSSAPCAHVPGLAVLEARSHREIRARSAPPMEGARVFGALGPIGPSSPGLTLGGLAVNEHRLSNKLLAWSGVLEWQEKRRPFSDSTAKLKRTLPCQAYVNQGENLETDQWPQKLIMQ

SEQ ID NO: 994889 - protein, 177 aa, Homo sapiens
TFAHRIFAECQGERVGRVPRLVPSSVTMLPPQLCWLPLLAALLPPVPAQKFSALTFLRVDQDKDRDCSLDCPSSPQKPLCASDGRTFLSRCEFQRAKCKDPQLEIAHRGNCKDVSRCVAERKYTQEQARKEFQQVFIPECNDDGTYSQVQCHSYTGYCWCVTPNGRPISGTAVAHKT

SEQ ID NO: 994890 - protein, 139 aa, Homo sapiens
AAMSAHLQWMVVRNCSSFLIKRNKQTYSTEPNNLKARNSFHATGYIHRKTVGVEPAVDGKGVVVVMKRRSGQRKPATSYVRTTINKNARATLSSIRHMIRKNKYRPDLRMAAIRRASAILRSQKPVVVKRKRTRPTKSS

SEQ ID NO: 994891 - protein, 151 aa, Homo sapiens
MSGHKCYSWELQDRFAQDKSVVNKMQQKYWETKQAFIKATGKKEDEHVVASDADLDAKLELFHSIQRTCLDLSKAIVLYQKRICFLSQEENELGKFLRSQGFQDKTRAGKMMQATGKALCFSSQQRLALRNPLCRFHQEVETFRHRAISDT

SEQ ID NO: 994892 - protein, 194 aa, Homo sapiens
SSFKQIPPAPPRPDFEASREKLQKLGEGNSSITREEFSKMKTELEAEYLAIFKKTVAMHEVFLQRLAAHPTLRRDHNFSVFLEYSQDLSVREKNRKEVLGGLLRSIVRSADEVLITGISGLKEVDDFFEHERTFLVEYHTRIRDTCQRADRVMHSHKCLADNYPISAALSSLGTQEVNQLKRSFLKLAELFERL

SEQ ID NO: 994893 - protein, 113 aa, Homo sapiens
MAGAPGCPIGVWLAGSLTTVICSLPLQIMRIKPHQSQHIGEMSFLQHSRCECRPKKDRTKPENHCEPCSERRKHLFVQDPQTCKCSCKNTDSRCKARQLELNERTCRCDKPRR

SEQ ID NO: 994894 - protein, 199 aa, Homo sapiens
MFISQMQKLRFRETDQAKQNSKEEARLKREPKPVFLCLCPSLPVPGGIAAESLTFTPLEDMIFLKWEEPQEPNGLITQYEISYQSIESSDPAVNVPGPRRTISKLRNETYHVFSNLHPGTTYLFSVRARTSKGFGQAALTEITTNISAPSFDYADMPSPLGESENTITVLLRPAQGRGAPISVYQVVVEEERPRRLRRE

SEQ ID NO: 994895 - protein, 136 aa, Homo sapiens
CFWQFADQMGYLYFSYEVQRILGMSHDRHIVATAHTPQGFLIDTSQDVRGQINFATQETGFYQLCLKNEQNRFSSIQVYLNFGVFYEGPEVDHKQSQRKQLNDTLDAIKDSTQRVENQVFHMWCFYNYARMRKVAD

SEQ ID NO: 994896 - protein, 108 aa, Homo sapiens
DSFFRLLPQCSVATLLHSIFFKVVYCCSWSVQVNQRASNPVDLRCHLWRQKEGQTWHSLPSSAVPLWEHGDMLFKVWCWSDNLMSGIGKIVHFCFLGQRGLKLMGFVA

SEQ ID NO: 994897 - protein, 123 aa, Homo sapiens
GLVRRPPQPMALRNDLGSNINVLKTLNLRFRCFLAKVHELESRNRLLEKQLQQALEEGKQGRRGLARRDQAVQTGFISPIRPLGLPLSSRPAAVCPPSARVLGSPSRSPAGPLASSAACHTSS

SEQ ID NO: 994898 - protein, 184 aa, Homo sapiens
MNKTIIVEFSTIFFLEVKLQELTDQKIADFAMDLYKAISLSHKNNIIFSPLGTTMLLGMVQLGAKGKAQQQILKTLRMRGTPAGEEFSVLKSLFSAISKKKQEFTFNLASALYLQEGFIVKETYLHSNKEFFQSATKLVDFLDAKTSAQAISTWVESKTDGKIKNMSEEEFGPLTRLVLVNAIY

SEQ ID NO: 994899 - protein, 193 aa, Homo sapiens
LQTKLKAEEPSGADDSPSGTKSSSSVRIKTFSEVLAEKKHRQQEMERQKSKKDTSCLTLTDDTEMKKTVSLPTVAVSKGQPEEPAGRARSMQEVHIKTLEEIKLEKALRVQQSSESSGNSRPQAEAAPGTKRLLRITKRAGVKEEKKCGLEDSGDPPQSSVTKMEANETSDETISDPTKLAVNRCDTVKEKHT

SEQ ID NO: 994900 - protein, 113 aa, Homo sapiens
SRTAALRGPGFDRLFKMPSQMEHAMETMMLTFHRFAGDKDHLTKEDLRVLMEREFPGFLENQKDPLAVDKIMKDLDRCRDGKVGFQSFLSLVAGLTIACNDYFVVNMKQKGKK

SEQ ID NO: 994901 - protein, 42 aa, Homo sapiens
KSPYYMLNKDKILHEVTKSCQACVQVNASKAKVGPGVRVRGQ

SEQ ID NO: 994902 - protein, 180 aa, Homo sapiens
VSKNKKRKKNYLSLIIVVCLNAGTCSRACGDQKTTFKSCFLHFLQMQVNSRPNLHLARKLLKFLWAQIEFCKNITDGEEKTCGGCEDPDAVYVKSTSSGGHEFIVKREHALTSGTIKAMWGGPGQFAKDETKEVNFRRVPHMCMCFTYKVPILTAPLSSTDILEFPTALELLIAANFLDC

SEQ ID NO: 994903 - protein, 183 aa, Homo sapiens
MPREDRATWKSNYFLKIIQLLDDYPKCFIVGADNVGSKQMQQIRMSLRGKAVVLMGKNTMMRKAIRGHLENNPALEKLLPHIRGNVGFVFTKEDLTEIRDMLLANKVPAAARAGAIAPCEVTVPAQNTGLGPEKTFFQALGITTKISRGTIEILSDVQLIKTGDKVGASEATLLNMLNIFPFS

SEQ ID NO: 994904 - protein, 68 aa, Homo sapiens
CPDQGCPQMGHYADKFANNTSVEPQKFFLNTGEAKNFARWRYRVSLTFSGRTVTGQVKVSLFGSNGNT

SEQ ID NO: 994905 - protein, 93 aa, Homo sapiens
MSSKTASTNSIAQARRTVQQLRLEASIERIKVSKASADLMSYCEEHARSDPLLMGIPTSENPFKDKKTCIILKWTRKRPLPLNANHSSNLKGF

SEQ ID NO: 994906 - protein, 142 aa, Homo sapiens
KFPNSEVLVKSIVDFVTSHGNIKAFISIHSYSQLLLYPYGYTSEPAPDKEELDQLAKSAVTALTSLHGTKFKYGSIIDTIYQASGSTIDWTYSQGIKYSFTFELRDTGLRGFLLPASQIIPTAEETWLALLTIMDHTVKHPY

SEQ ID NO: 994907 - protein, 192 aa, Homo sapiens
VISDAPTFASNSLPPPCPVSSGVPDPSTMWKRWLALSLVTIVLVHGEEEPRSKSKICANVFCGAGRECAVTEKGEPTCLCIEQCKPHKRPVCGSNGKTYLNHCELHRDACLTGSKIQVDYDGHCKEKKSASPSASPVVCYQANRDELRRRLIQWLEAEIIPDGWFSKGSNYSEILDKYFKSFDNGDSHLDSS

SEQ ID NO: 994908 - protein, 109 aa, Homo sapiens
RTGVVSVTHMVTVVTVFTEVRLLVEPHVLHTDTQVCTVRPTIGNSTVRAEVFGLIRVVRPTVLSITSRHRRTILTTIMRTTPVSTEVVVKVMVPFLLTVGSRRLELVRV

SEQ ID NO: 994909 - protein, 103 aa, Homo sapiens
YQGAIRYQNGYIAITHKREGAGGSKRRPIELGETGRRAVGTEDPRGGTGVSCLWSEVVSTQGVGDPRRTRYPPRRRTDVVSDPPSRVSPLPPRLTGTYGSGRP

SEQ ID NO: 994910 - protein, 72 aa, Homo sapiens
CIINKIEYVPTLYKGDDIYVQRTINNSKHPDHLRPVDLDAVSSSSLPLLSPPPPAGPTLLQTTTQHSNPPLT

SEQ ID NO: 994911 - protein, 105 aa, Homo sapiens
KGTVRSDNRSRANCMRRTRRKSKRKKGGVRKSRLRTSRAGILFQSRVPKSSPVNNYRNSNYLRRRSETGGLSFHYGSLSPPVTRRVATLPAVPLEEYSFEDSRSY

SEQ ID NO: 994912 - protein, 76 aa, Homo sapiens
VDYSDTESSTPSSPFPRSKEDFSARRTNTYSVRVSGRIDTLSKCSSFFYFYLRIYTGCRLSCENRRLPVTTRSTWH

SEQ ID NO: 994913 - protein, 154 aa, Homo sapiens
MFVGYRAATVARAAGVRVALAGYSGPYGSYAMDNYYHGYKPISTDNPRFIIDIEKRVTCYDEETIVVDIAEHAMSRPYSVADILKAQQIESKVASSTERSIAARDRLSRSFNAMYQGHDKCSHEFRTRTAVKERYNPGCTRGAILYDVITEDET

SEQ ID NO: 994914 - protein, 342 aa, Homo sapiens
TYFQIIWWSSEVGDRKKYFSRVQTMQSNTTFNLEEAQPYSKKASSTSPPAADTTSSNSSSRRPPPIPANGQRGLAANDEGFALIGPDSNLAANTQESTTFHPNEAVSLLSGNLPPDFTERKEHGGTSSSSHMATGQGDPVPLHEVIKGFGFIQLGTSRTSSGASPQAGAGQICHSVATAYWRVRFACHSAHPYSSNTFLTSCVPTELTGRTHLCVKATVETGRTHVRDWSRANAHQATATRDRAKRKPSCQGTPLHGMEEKSALPAHSNPCPEEMDDKDRAHEKKDSSEADPANPHSKRRDTTQTPTVRSSSHLPARTELTNHTLTHASTHNNTARHTHRAT

SEQ ID NO: 994915 - protein, 218 aa, Homo sapiens
AARDGACAVGRWVPVRRRANGGWRHSCDACSCGLTGVLRPQHALSLSAGLSLLVAFPCVVGTSWAPLAVIWLAMDACQRPLACIVGQLGEVSSPLAERRGCHLENGHEGLFPRHGRSLARHWSAWHRGRPACAVGAWDVLQTCCAAPRKRGNSGTGCQKGRNPSSSNTSIDHEHRKRTRQRRAETHLASGLRWALEALGNYFRRNTTCTFSTRTYFLP

SEQ ID NO: 994916 - protein, 310 aa, Homo sapiens
AAVFLRRIRQGRTAAMAPIREMCMVLKPHFHKDGYAARGLLWFNQPARKIRYDVSARHSQRQRQPSPRAPQSESAVRRQSCACPIVFGYSHRKRALHGRRDSSPVRMSHGLARHFTKQGGPATYRVISCVIRGRRSQGPRQIPAVPTVHAGCTEYLLLNSSLFSQEALVPPKQGRPVLTEERDNCATLQADLDRVMPVRERAIQKETSLESLTAGKQHTNSHTPSLALRMARANARLFGITGKRAKDRRMNTLLPCLPYMASLATWIRTPPPPPPGPLSRRATRALSRPCLLASPSPVHRVKFQSPKTRK

SEQ ID NO: 994917 - protein, 145 aa, Homo sapiens
MRWVRPASLGCWIPVDRWAFVVQALQSRAHACGWLTAPVGLHALASIASCNVLALAGNHQNALCWCVCDYCNAELLGPIPATNYSRALGHLMRSVLLDDHRGTPSYRPSDGPPCTAHGNCHPKCGIDYLDHTESLNQAITLLYNP

SEQ ID NO: 994918 - protein, 500 aa, Homo sapiens
MVVFSRAFFPGLKHSIAHEELRPYVALVYLQASTLPMLWLTCLLCDLPGEPRCQTQCKFVRHREVYEAAIISTTLTSPARDSYHSWPHAYKQTQGVSAVCIAHLLTRGDSYTPCAYMSVLFTTTCGWITYLGNNPRVALCRPYRTRTLDFTTLLDMRWNVLVHEHSAGRRLIMDTLPCPRVGGPVTAMRNTGGPGALGIPFDGPLPRSSPLPREGPRVMAGDSGFEVLAGSCTLPIQQRFASQEFVIPAINARGSAKSPGSVKGPLRRVTSIGGQQQDLGTSELEYESFARAVFPGGITDELPRRGKNGPSMDGHEPPRRGCRRGPCRLFSKGDITEASEDSSIKRGWLSDARQCLAARVNTLTRCLQDKITCGGSPNPHTYVAWRENDVPDEYTPQVALPRVTLYRTSPAPLGRTQRMVNWALWHSFVRTLQFAVNVASTRGTEAHPRAQQAHLSHFVSPIIVIPTASVQCQSKPVIVLIHSAHSGASDAILHKTSVSS

SEQ ID NO: 994919 - protein, 238 aa, Homo sapiens
ECKGHKMMELFMGKEVLHLCMKGMAIFVRQSSDPGYFEGMEVTDIYFRQECTLITCCVQKSSKERELIQVQTTIKNLEGWTGALKGSVCGTWTMKLEIPDDLNIGHELSKANATESVGHETQKSKLAAGAGHGKSQMQAADKSPNLTRRDASRRLRTVKPRRRWTRKERYNGGAWLILADAIEDGHVWTMRWLKNVLTYPCNYAWWMAPDSETGVGLSTLVRLKRSSKAATCTRRAQM

SEQ ID NO: 994920 - protein, 197 aa, Homo sapiens
MATVKAENGKRMIINGNSIHHLTRSEIPPKSSGAMLGAEYVRGVHQASFTNMEKAGAHEQGEEPKGYIISDPTTADRPHVRHGVMNHEKYDKQTHRSYRNDILKTNCISTTWTKDIHDTLGYRGKDSGTTDHEHHWRTRQNGDGHIRGNWDVNGQGISRTIIPDISLDAAKAVRQRYSHAAARDRSKRMAFDVPMTR

SEQ ID NO: 994921 - protein, 76 aa, Homo sapiens
DATEQQEDSGLSDRAPDESHKGKSVDLYYSETDNATNVRAVARDRSLVWSYIVMRPMKGQDDRWTTGHNVSSQELL

SEQ ID NO: 994922 - protein, 449 aa, Homo sapiens
PCGVRPKRAEHSMIYFFHHYELPAILQQVRIQEMLASGAATGPREPQETPDDMNNNSGRPGLQNTDSDWNSTTQAMGTTKSTMEAKRGSHRGPDGKLDSTKNTMNEEQQEKTTDETTKMTREDIETQWGDEENMGHSTEHSQGKTIKSQTSTDPYPEALTHGKHDNGHTTITCQTSKRHKNTGPRNSSSNHMPISAGPSRGQDKREPKGGKQKESTDRKREEQRNSIEQTNTKTKTIGERTTGKTTGRERQEKKNKGTQRRAHRKHRQAPEEDTNKTRKRNDGRQQTTKETRQRGQWHHPQTQQDRAERDRTKTRGKPAGKKNQQTEQPEQTHRKEKAQRRHEQRRRQTRSRERRTKRHTDKHTDNRRRRATTGKKGHRHDAEKSRSKSHNARLRPAAGGGDKMTNKRKAKAQERKARDERQGGRNGERRIAGSKRGRESTRKQTGRTE

SEQ ID NO: 994923 - protein, 109 aa, Homo sapiens
LHSLMLVFDKPETELWGQRDFWRKICQWLPSCLSPQHHVRAIYAQTHGNQDSESWGYLPRGVDERYSLCDFLLYFFFLRDILIIHLRASFCVPSCWKPLANALVVTSQF

SEQ ID NO: 994924 - protein, 182 aa, Homo sapiens
TLILINYIFLKEYGNFTFSPENTREEDFYVNETSTVKVPMMVQSGNISYFRDSAIPCQMVQMNYVGNGTTFIILPDQGQMDTVVAALNRDTIDRWGKLMIPRQMNLYIPKFSMSDTYDLQDVLADVGIKDLFTNQSDFADTTKDTPLTLTVLHKAMLQLDEGNVLPAATNGPPVHLPSESFT

SEQ ID NO: 994925 - protein, 49 aa, Homo sapiens
GPTSVPANSQNEVITQKVEESVLADETEKFTRYSEGKRVCTPCPSVESG

SEQ ID NO: 994926 - protein, 70 aa, Homo sapiens
CLVYLVPTGSSFRTTREVTPGLRQVLFRRTFLSGKKFLERRVVRTPQDASLDGNRKRTSEEPTIPGRTSN

SEQ ID NO: 994927 - protein, 112 aa, Homo sapiens
VLSLARRLWAAEGGAGSTRPVVSSGLLLHGVVSADHLCLECIYSSLPVKGNRGRSRMYRLTTALFNHPLPGLSRGSPDRACRQCGSPKAEDMGGHEHCQPCCELNQSALGCV

SEQ ID NO: 994928 - protein, 410 aa, Homo sapiens
MATSTGPLASPPSLHYSASSGKRPGGLDSGASRDDDLLLPYPRARARIPRDCTRVRAGNREHEKLASDSSRLPRPPADLAVQHLRSRNFREPAPVNRTTGDAGPVEAPFSATDPRVAEEATGMGPPGAGMQAGRRTERRPTGGHGTNRGGRERAQSWPVVRPRKNTAAQLYLPRPMGNVREHERGHCDEQPVGLAGQNRTADRAMTAKTFPRGRETLGHGKNRTDQRTRGGKSRAPGGKEGQTPFGLPNPGELNPEVYEGHKRRVRLGHATVGTKKPPKEMLETNGLALATFGEAPDGGRPCATSRTNEGDKTLHNRMQTDKQQPKETKHRTGWDDHARTQPRGIYHGASPLVKAQQAMGARRSALQSGPHGEHGDPTCGPRPQPREHKERHDTWTRPPMTWGQQSAPQR

SEQ ID NO: 994929 - protein, 395 aa, Homo sapiens
MISTAARQSDNWLLACANGLLLLVLTDAPPGPVFPSIVGAAPGNQELCMVRPWVQQGIPYVSAHCRAQQPSSRHPRPMQVTHIGATAIRRTTWERPLDDKLCAPQPYLHMSCSVASRRSNPRDCMTEGPPCNPKGPHPPTTDDPKTPVLRHLQHTQPMYSCLLQCLVLIPVTPLRRTHCASDDGTPGRTRGHPTTCDPIYDRAMPSHNDIPDVSDPAPGTGHPDWLRSMNSIPQQRRWPNQTLPIKVPRPGTSLRDIQGATVPTGPRGTTHQEKCHCRLSSSLLSKSLRTDRPAPVPPIAHVDERRHPEENKSTANNPGAMGPAATTRHATQHPTTTRTATTHQHASQQGEGAHAYPIATQEKTVDPTRQNVTIHNRHATHDQQKPTARPRTLTR

SEQ ID NO: 994930 - protein, 146 aa, Homo sapiens
HHRAAAQRTPVRTRPAAPGTVSPRPKPRSASDPLRRRLPPRPAPADLAHPTWPLGGDREPEAMSHEKSGCLGDKYPPPKPEDIPGGPRLHDAHTYDQDIPYHEGTITQQSPISENTTKHQQNRKHKTNTEVEQTKTQQTHTNTARQ

SEQ ID NO: 994931 - protein, 231 aa, Homo sapiens
QLNDSACHTNVNELECMAQSDLHSQHQQDVLRTRLKTTGIVSDTLHLQGPHTCQDVGIVGCVERDLEAVRSGLLLTFEGCDQPIDCATAVGSKAHYDLVLDAPTRRLNRDAMKHALNASSIVICRSEQVVHDEQRPISPSILYAYEEILVNDGRMDLQATDHLVTHHASPLDAITRVTNLQLIIGVQTSCIRKKVTYLKRPGIKAVKDDHREDVYQLVPFHRCEPTRDHAK

SEQ ID NO: 994932 - protein, 322 aa, Homo sapiens
MSRLSYKKLSRRSVQDLQPTFSERTNSNRSSPQRHTASKNGCARKMALTTDGVTICLVCRFNAAAVDPKKKIHTSLSNLVVKGPQYLIIQETRKNLGIPQKSLSCSEEFKEVMDLPTCGARNLKTTLKGQKPQVQGLWGAQNTGDQSPSRPQTRLEASRSRGCGDEEKALSKKYLKRFPGELKCPDGEPQVGPSYIEGKATCHRHRLDRASDVPRLEGARQKEPNMWRGDARDGVSHDEHPHRTKREGSEGKRELNHTRYGGPQKPWSTSEGLTAGEQLKARRRKWGRKETCRMLTTTDAKASPAKAQTSRHRTMPPDLPAA

SEQ ID NO: 994933 - protein, 149 aa, Homo sapiens
KQLDLRPLCLLELLKKGSLLPTIRQTERMRCEMAVASGPPITVQVSSWRKAGSFSYDTWMAEIRLNTQILLQISSCCIRCIHHIFPGLRSWSYRSSPNLSLPSLLLPFEPPVKALMPTPCMMICVPRLGIGHDALRLTRTSSVSGCLQY

SEQ ID NO: 994934 - protein, 464 aa, Homo sapiens
METGVLYVEIVQYGATLRDQVHITNAVIKDKERRDSDNRTQLMSQGNAIRSIRESTDLTHRETGASRERQKTIEDTITAETRLTQDHSPPHTRRAAKKQGAYTQHKDGRPQRTTVQPKDERQHNWHNTTYPRAARPDTFNRRDSNRWDHKDTEPNEHERQTQYKGAQTKTPKGERQHIWHNNGTHDLNEGQVALRHTAHDTYNTPERMKHANKPTVSNRQVQRRESQHDQCPMTIDNDNYRRKEENAQANMWKQQDTAHIEHNINTTAHTQSIKVTNRRQIRKTKEIDNTQEKEKTMKHIDKEKTTEHMEHMTGTDQRDMNIEKDNKARTRQAHREKTRTKTNSHQTQEHQTRQPLSPRRLTVSADNTQTTHKATTQVEPKADKKTMTPNHGHQRQEQERRCRTDNEKTHAANDRHRMNTSHAATVATGSNDDAHTGIGAIQKQSEGHTDNTLHIDVMHEHDPE

SEQ ID NO: 994935 - protein, 185 aa, Homo sapiens
MTSQRRTANAGSYRGHVASRPEQGPDPARGEFSRNGSFSMAAKHAPELAAMAASAPLGTLTHTPVEGNSPETNRATGKRPTPTWTRAHLDRAPADTHNKAKQHRSCPGQEPVHSRPTRRRSGETQQETRATHNTQDIIHATHKRLPSEPHKRTKQVRLTSPAPPPAPAPSPRRQHYVSEHLDTAS

SEQ ID NO: 994936 - protein, 334 aa, Homo sapiens
VRVAPRLLQPLGRNSKLPDLRTDCEKKNYLIFSAPIAYLECEATHKIENFNHDGKIVLHRSAGSVVATSRIGAKFWEVITDEHGIEPTGTYHGDRDLELDRTLCCTKKNPEVGNMFLVPSWMDLKPGTTGLWFRIRSLGPDLEMQTILSNRVKCWGRKQLGTKGHLDSRGRLSCVDSVLDVVREGCIQLRLTARAYQTDPSPLERGLAMLFNGTPSLLARSEKTGLDRIIIATVWRLQSTVSDPWAEYNAPLRPPGGRASVNETMRETGPYKSAPTEIAHNYGIDTASAEGYNVSVGNIGRMRKAPGQSGAHRHTAATVKRDHAGAGQHRQTPA

SEQ ID NO: 994937 - protein, 346 aa, Homo sapiens
PKLEADLEKKIQGGKAGYKKQDRRTAKDVVENGRMDVADQTLSLDGAAPWGRRLMVPQDSGENYIEPMAMWSLHHTMNLLKQHLEITGGARVRTRIPSESNGILHIGHAQGHRNYNFGYGQGRKEWLSVFLQFVMTTTPWEGGTAPRFFTDICDMVVLAYGYKSYKVTLCVYYFDQGNMRGAADAASAGVWLIVASSEERSFKGHNTPVFTWRDRSMEESRASYFEAMRKRKCPTCARTHYWITLVMYGRQKEPSLPLMSSIHEWPARGNGGYPLRLTHAVDASRASSSLCATSRRTAIHTRDRPSLARSGHRPTQRAGQSNTLQAGGTHHTGKGPHNLRTVTHHS

SEQ ID NO: 994938 - protein, 150 aa, Homo sapiens
MENITIAGRENHKGKTQGVKTIRTYENLRSTEKNGKQREVVSTKIPCRTKKRLKVAQHEQGVKNKLCNWKRQNRGDAAQPPTHTSGEQGETRRDTRERTRQPTPRRKAQNRNTTHTTQTHNHRDTRNKQTPANKTTRALTNHTKIKQQKA

SEQ ID NO: 994939 - protein, 309 aa, Homo sapiens
GQVMLAGVEKRRREEEGEYRREVEDPGYHSESDTAVFFRHLSGQKKGKVCLNPPFHPLHPLYLEPFSTIGRSARARGPEQENRQLGDEAVLPVRRRPGALGRQPVQHIYTNQHRIAVQHTGIRPSTKQTRSRNWGRKVELSLMSTYIATTNGEHGHRHHISQHCLAELIYQLKAQTHLGDPFWAASRHPHSAQDRIGKRQCTGTGESAGSREDNISSESRWMRCSMGSRHRGNTTGNARREFREAKCTGLRRNIRKGGNTYDKLSSRGSKITATQHCRGDEGSTHASHADIHGKRETRNTWRTRATHLH

SEQ ID NO: 994940 - protein, 68 aa, Homo sapiens
MSTRSAGSKKKAGSKHDANTQKAREDTRTEEKRGRRPTRRRSGAHTSEEQQTSVIAHIDQQNVRHTDE

SEQ ID NO: 994941 - protein, 142 aa, Homo sapiens
CWRWSEGGRDKAAWCSPSSLQLAVPPAGTGLRSLSGNGAVLVMPGDKDKEQELSEEVINMLQDELGRCSMERLGDEVIHPCIRPAAWSDICEWQIRIFYNFHDFSAQASQISRVHTMAKLKEIYENMAPGENKRFAADIISD

SEQ ID NO: 994942 - protein, 237 aa, Homo sapiens
ARRPASTEPRLCRSAAVHTRRQLTMDDDIAALVSRQRLRACARPGFAGRQMPPGPSSHSIVGRPSATRAVMVGMGQKDSYVGDEAQSKRGILTLKYPIEHGIVQTNWDDMEKIWQQSFYNELSVAPEEHPDAAARGPTCNPKAKREKMHQIMYETFKNPDMYVAIQDCAIPVRLWTVPWNRDGLQVTGHTTVPIYEGYDLPHAILRLDWLAGTDWYLMKILTSAIQIHTKAEREHSA

SEQ ID NO: 994943 - protein, 373 aa, Homo sapiens
MRKPRCGNPDVANYNFFPRQWPKWDKNQITSGLIGYTPASGPREQCDDAFVSMLFQGSVSDVTPLRFFSEFHVMDEADSHDLTFGARGSIGPMDTSFDGKDRTPGFMPSLAMARGVGGDSHFDDDELMDLGEKAKWSCVKYGNADGEYCKFPFLFEWQGVQRAALIPGAAMASSGAPYTTTLSKDGKYGFCPHEDLLHHGRQQLKDSPASFHSRFQGTFYDSCTTDGPHRMANAGDGTIEDNDTRHEVWPSALKNACHRKESNQNVPLVFPLPVLAATYSRLPTPDTSSKFGCTQGRYTQRTLEPRPVPRYCVTREPRFEQPGCHPERARGRTTEASPDRSTATASTVRTSAANNKSRPSQPRDNRIVASKPR

SEQ ID NO: 994944 - protein, 202 aa, Homo sapiens
GSLTIRRKPQDSEQEINRLSILALPPQCRLHPPAGSREEGPPHPPKRSFSSMSDITGSVTLKLLVPWASLRPRSSDQRVAFGKARKAIRGSGLWPGLPQMRSLAIRRVWPGAPQGAQSRTDKGPDGLSLLWGRGWSGAVVAQGAVCWPGSAMDGSEESTSGADAAGLERGVAWTCDVPTYGTLLLRIRGPSLPSLDGPPWAC

SEQ ID NO: 994945 - protein, 113 aa, Homo sapiens
MYQEKRDSRTSGARVKVVSDGIVIMRVIHRLMGESLETGDRVACVDIVRHMATKRNTSSRSMEMLEKIAWVANLIHLLAAGERGGLVDDMVNVTLNTLNVRVMIVANVVIPQV

SEQ ID NO: 994946 - protein, 232 aa, Homo sapiens
MSGTTRVLLAKGNDSMNFNPVTAELYVVSPLELIHRVREVVPIDVTDGGSHLPGAAFGKVTNLLMLKGKNQAFIEMNTEEAANTMVNYYTWVTPVLPRQAIYIQFSNHKGAEDRQLSQQARAQAALQAVNSVQSGNLALAASRGPWTQGWRWRAEPRAQDPSCENLFYPCDPGLCWHQIFSKFGTVLKIITSQEHQFQGPVQYVDPVSAQKQAARGGREIYKAVEWAYFPGT

SEQ ID NO: 994947 - protein, 318 aa, Homo sapiens
MRGQLEVKQVNSNIWERFRAEEDPLGLVAPLRGTDSPGLTVAGSEAAGNGRRCDHGGCGPGTGVAGWDLRYGGRRRAACGGVCLVGSERTAARLREVGYHFLIDFILDVKVDVQDFRQNLEDELEREALKQGVDLRSYSKQVELEHEGQMEQKSIRDYIQESENIASQQNRSQPVMLSLERMEQMWELFRVTLSFHQSEIGTLQETVRSHEHSTSKSPGQSGTLGELVMGPGGSPIVRVRGIRGGSADAPRTRSSSRGGRPAGAASSGAEARTRTRKGGPTVGRSEAQSSHADRETDIGPKGDSTTGQAEGAVGNREW

SEQ ID NO: 994948 - protein, 337 aa, Homo sapiens
ALRVVTVALGGGSGLVSPGGAVMAATELRGVVGPGPAGIACTWWRVAGSPCGGMEGGGVEMRGHGSGAGHGTVFAAVAVRPWCPGVPWCEWLVLVVPGPCAGWNWWLGRLWALGVRARSRGLALHTGPRYIKGYHPAMVRLLSNVTPDATYRSKAEIETYLRCGTIEGSPHGKHHRVRTPEQSFIISNGGAQTYHLKGKFQKLSGRRWVTACELGQGKAVKMLAESDDFQEMNESVFTKLTELSYEYPSDLSSTVEDLSTCDGLIAKLGTVLERPPGRWILNLLWQHEDSTVTEEPPLGYLGFTARRNLLFDTKWKRRSEPARKPPGETNEGPSAAT

SEQ ID NO: 994949 - protein, 45 aa, Homo sapiens
MTRPSERHYLRSADFDISRVQPINTGDTINDGNVDDMMNFSSTQR

SEQ ID NO: 994950 - protein, 142 aa, Homo sapiens
SPQRVPAADGALDPPPPFSILLPSVSPAGRDSRPCRCGRSACVVWDGPGTALLGPFLLPVASAAAGDAQPGPMPASSPGSLFRSTARLQSLSTGASLAGALVVLQAPGPQFLPSPTVAAADARAREHAGVPFWQLRMEQQAW

SEQ ID NO: 994951 - protein, 85 aa, Homo sapiens
DLCVTSRYLLVPSAAWEVGCGPCDMQLYPGCESGGSGGAGAPTRAISDARSLSSRVYSNEDDVCWDIAFSMYRAESQVSGAVHSP

SEQ ID NO: 994952 - protein, 55 aa, Homo sapiens
MWAALRSVGPGLAFIDLDQLVTAVYGGGPKATDCNSCKNTVRRKWNTVEPTERRQ

SEQ ID NO: 994953 - protein, 193 aa, Homo sapiens
AKDEDHRDVTFEEVQPKHTIPVAEGSRQGDQEAEPLSTVKVMKLQFKDSTLEVSVGIHYIWFHNGSHSLLRSNSVLSGDETHMNQLKEARTRTFTYKLLRWLCFCLADTNVRVSESMWRSSWHYTGRKRITEELKRFDDARLMLMGFKPLVLREETAISAEALPVQCSPEESLVIGSSTLFSALLINVSGEGR

SEQ ID NO: 994954 - protein, 50 aa, Homo sapiens
MSEHIEHRDNCVRLFAHHDSPLEVKPQNTSGYKRRYIELLLRYIGAQTNI

SEQ ID NO: 994955 - protein, 290 aa, Homo sapiens
MSLSALMIMSLRRLMTPTLIPGDYDMHTGDPKQDLLIERQYERAKPDQVIPGGDRNNFYPGIIQRKRGTQDCDVTEKVSELTRPSLSLTDDVDWTHRGAMRIRGASIEQRAGTKRDVDTDSFKEVSTLGPRAECQLLALGWGMHSCLSWNFIQKQLSDLQCTGICRKCQWGDLTYGGRVLGIRDYNYMQSRSDYKFFNAHGSLLTLELAKQGALGIVIRSSSSTQFQSFSQYRCKTGKKSEEEIDLASCQVRKIVECPKCPQCLHSLVDKFNDQRQVEVYTSGGDLRVWL

SEQ ID NO: 994956 - protein, 249 aa, Homo sapiens
LYKAPLSKSLSAGPQCPLPPARPPPASLPEALVYDLHAVKNELPELEVDMWKNNLSVIMKDTFLAVSSGVDLIIVGYLKEDMESGEKVCIAVVRGFRGCCQALFDYLLMEAMQYIFGITDRLVIMPSGFLAPVYALSCTNLTCCHTKSPEWRQILGPLSITKQDIDLYMGTAGLSSSGSYILDCSHKWTYVRSVLRQTKCSRCIRCSESPGGWQNSFLWTLEPIFSSAEATSEARIGMGATLDIQRRAE

SEQ ID NO: 994957 - protein, 270 aa, Homo sapiens
DYRHESLAQYRGPELDTRLLYPVVQYTHAGPSIVEGGPGVGGEMWRRSLEGAIDHVEYQDEEPRDSDQRCMKEYTRTSQELQTEAYCNGGLSMRRIKIFEEQGQSQEEMQYRNTCERFRREGILRTEMQRIAAEPPSRRQSSLQLPDVSIGEPHEAGSSSAAGPGLRTKLEEIDKRMKQPQAGAHADCAKIREQYLVWLTQKGAREKKINEWLGIDSETEDQVRNSMEDEGLISLNHRRNCGLLTLGYRSTGRRAEDMLSGKWDETFLIR

SEQ ID NO: 994958 - protein, 129 aa, Homo sapiens
VRVSVTAAGVLAGFLPRDGEKERARNDERMSLSDWHLAVKLADQALTPKSILRLRRDRTGRILAQGAIVLSFLKQLIAGRLQESVADPELIDLIYLCVWNAKTMTRHLTSMAFNLGPLSMFCESPGPES

SEQ ID NO: 994959 - protein, 50 aa, Homo sapiens
MAAEDREVGSYTYAQKKVAKGPCWRAYYTRGKLNFGCHVEKLDNLGRVDG

SEQ ID NO: 994960 - protein, 75 aa, Homo sapiens
PVLLSEAPLNPKLWQCSVPPFRRSRSLRTGPVSSATHGDRVASRPFRPATRPLQLRDISWYEVSVWHVSAVRTLS

SEQ ID NO: 994961 - protein, 206 aa, Homo sapiens
GPLLTTCSTPLLNSLPQALCAGLAGFMDDEWAGGELVESLKRFCASTRLAATPLVLFPEEEASNGRDRGSCCFSSCGILGVSKMWYLERLIHCKFRDAPGSLMTGVRCLLGLRTAVVTSVRPFRGGIKKGGFVLFIAQLGEANEESALRVHTVGGQGILGQNRDNGSLPGERSSSDGEGEKEYPGIAAPGMTSLLFDLDSPCVPLS

SEQ ID NO: 994962 - protein, 145 aa, Homo sapiens
MGRLFAISGTPNDAHAHRVYDSDFASTATARLYLFSVSTGGHARTTNADGNNGKYGVCGHEPSRPQHTAIPFHSLGACTHSFLNIRPVSLQARPVHKISVPSRDEAIMCTSEQKMRDLGDVTAFYESGGLTPQQRAQGHTPSMRR

SEQ ID NO: 994963 - protein, 375 aa, Homo sapiens
MTTFIDLNYNGYMYQYDSTHGKFHGHRTRLRNGKLCHHWKSQSPDDNQADAATHPKSRRERMRGRRRYDRWQIHVDDLHKTGENGSRDITTSQAGAAKKGVHSSTAGHHRIKPALDHRTQTVTLGDRCKHTAAQTIERSHARTNENNYKHRSEAPNLDQHTPTLGIRATPHGATRLQHPAQHNLNWENPAATKRTLQLATHNRHHPQAPKPTSAQNPKRTEAWHRTLETPPPGDEKPREEKTDLAPPARGSTTTNTHQTTHSNYQNLGTSHSPTGHCWRRKQDSTHHRKASKHTGERARTMSHMSALSTRDSHNRAHNDGSPKRGTSTKTQYRRSRNQHRPNTTDTTIIDEQTEEHPSDVEGAPHSHEQPRERTP

SEQ ID NO: 994964 - protein, 260 aa, Homo sapiens
MELANSARVAFAANAICTLERGPLYGVRTTNNILCSTKKICPWNADWFYRDEQEKFETIVNIHEIHPDTGTCFKSKKIACRYVNIGLIRELKDGNGKKQGGNTHLCKGKSGTLITYTARHGPGHGNTQTPNIGDAQQPTGGVFYPPELRTGQPRMGSYSGPTVGIITPVQRRTGPPPVNIVKNARPTNTRVRNIPCMQTSSTTRFEKHVDRSHHDSSFPVRKQTNFGVRDPIGDGTPKTGHSATVRTEQGNNRLYEGQPQ

SEQ ID NO: 994965 - protein, 142 aa, Homo sapiens
MLPASASETTTTEMLSPYYSASPYGLISHCSSGPESLDGYETVSRVRIHGPSSDPPSFEGMGIACNNRAVTEFNSIEWEVRGDCIRAISWVDTQMVTPQTGSIALATICHCIVGSAEAHLSNGQLGKRQIGAYACTFRNSTN

SEQ ID NO: 994966 - protein, 188 aa, Homo sapiens
MIKPFQKSPGSPDLPGKGNVATRGSKSLQRRSVALGLGQQPRLTTDGHVPIGTPPRTPVKGKRGYLTSKSKRSPRFKRPPCLERRLCHAQELFLSGTPRGSFEGGWEQTYAGKAWMALKKLRREERIREHTRSNRGQHELTTPHDRPPWGTHPGGNATAADKMGHYTWETAPETTKPEKRRRNKQIYG

SEQ ID NO: 994967 - protein, 448 aa, Homo sapiens
LGSSGSTAYPVRHIPIGLPGCNSIQVVVTGVCRSWSSSGSTAVRTVLSTLVGMMEALVPDPTDSPRAQQLSRTNSASPSQVNALRVAQRSHASASWDVGGANRHAVRHHARDNICCRSGLHQISRHHRHGTQLKYQTSSAIMNQSSRLLTTTAPDLVAPSQRPPQKQAHRSQSVTDARIPRTQRTIQDDLASQPIDSNDTDSRDHPGCHTTTKTIMDQHMEKEPGEYPPEAHSDNTTTQERQRKTPQKDAMKPKGTRSRETGPPREESIRPAREAKATRTPAAHQSTTHTPPRTNPGTSQTTGEQTHPRPNEDAPAPTHQPNYAADDRMHPQQRNRRSRRKEPNKQAGTLNHKREHKHGPPGNKRTTHSHRNKLPHNRADRPRPTRTTPARDDNQATLRDANRWTPTYNSVRTEQYKHNHDDTLKSKTQPRHASTNPYQHIQRTKGQQ

SEQ ID NO: 994968 - protein, 406 aa, Homo sapiens
GGILTFAPASLVKTQRTLPAVGFLPQNPLSGLSSALAEHCCCRCCCCYPVLGRWQAQAGPGALSLTNSSLLRTELQAFSPALDGLAPPSHLIRSTTDYLRLQKMALTEPAHGCLLLTGSFHCTNTGYYSPCYIPSNRVNDALFRDCLRTANSTSYTHAALTLCRTPCKQKGRTGSSRALPPDWPDRSPAERGSRSDRKIPYRRTANQGTGHARTHPTHPHSDTYTAGDHHRYSLRTAPTCARLPPHPPHTQASLEQAPQAHRPHTHPPPPRRHTAPACCHRPHHKPRNPATPHSAPTTPHRTHGTHTGPQHPTRTPTPLNAPPDCPHRHHTDSQRDKAGTPRHSTTTTITPPLPPARRDSLRPSTAEATTDHYTHEHLVRTATTDAAPHTNHPHQPIIPAPPRHTP

SEQ ID NO: 994969 - protein, 413 aa, Homo sapiens
MCLAGGPGCGCMSPSRVKTERLDGCWEPAGWLLAAGCHAAGGMWQFLWPVACCLSKGGGDPKLQFSMGPCECAGCAALARNSSLSRVRLIAPDVEAVLCVPLVTFLTHYAVATSHHWPAARTDRAGLFDVPRRNGHFVSIRDFQASSAGGWTVLISGLDRVGPPGEQTLKVAPPVPPGTSLPETLHRGDKGCFIQRDTLRRKTRGQLADSFHCFGGLGDQLEAWGKTEQVPWYKKVWHRAGAQRFQVEPRPDIRKLWIGSSSNRVRQSNRGQKLLQPNWVSRFQTRYSRDSVLEHGHWGHNELSVTDSLELGNKPLTDFEYPQKRYLRSLTGMMGTVAAGNARNGIREGTDSATRSMAPRHIYQGNRWTHEGEANNPPTLIDPIMQWPVPSRLNPRNNQARKGALLHRIVTRQ

SEQ ID NO: 994970 - protein, 97 aa, Homo sapiens
SYFRGKAGVLCVRVYRTVDHVTQESIRRRKMDTAIRQIACAGSSCEPPMRHTHELGTQTQRCTGLSDGLRAATDGEGDARMAFTGDTRGRTTSNHFK

SEQ ID NO: 994971 - protein, 226 aa, Homo sapiens
MLKPPHDHTPKEGHTRVPRGKNRDRQTTATTNNQTEHTTNQTSRYTSNNNTHRADKPTGRATPHTHEQHKNAAPPNSKRQNSAAGTTHPHTCHKNSSTNQATHADARGRPDDAATRSHTRTGTKTRRHTHTTRHTRTHSANEDHNRNRRATHYSSLRARQRPTPDAPPATNRENEQREREDNTAKKVERLHTSTLHTQTSHTVEIITPQPGRDTTHDLDLYRQIRT

SEQ ID NO: 994972 - protein, 205 aa, Homo sapiens
MEIAAVELDGANLAKCGDEVAVGGLACSTLDAWDLVVLPVETGNGPFKTKDILAYPLIIVLPVDHRSPFEDVRKFMPSAWTLAHVALVGCCSHESQGMLVSRQPAYFVQAGPRKRTSHQLNRVQGGNGIPVPSELERKGEDSEISMWQGHPPWWHQRGQRRSGLTGVVDCIAGDQGPNALGARVGLQVWPWLMSDLIDFERGHFD

SEQ ID NO: 994973 - protein, 436 aa, Homo sapiens
GKAYVVRSILDQRGYVASGLTLCLGRAVQRHLVDTVHFHSMAGPRLDGGCATVLRASSGAVAAAVQGRATIDPLDDDMVVHSLALLNHDVTCLRTAKGYYSLSSHDGTTLAQWLSAWLWERHPSARERPSLASVAALAAHAQARTELLAVRERRTALFDSGPPTYYLLFDSTGHTLHAACGLSSVGRAPAVLAVPQDAPATPSTANRRSSSQSQAGPLGPSAGPRSQHTPHTHRPLHCPGPPWDSRWATARLALSGPVAFPRPCGSDRAAVPALSSLTPVRWRLTHPDPEPRHSAPLPLARPHPNLAPRTSRSSCGSASITRRSSTTPDPIQRPDGLTTNTVTHRPPPPRPPSRTLPAITAPPPTRAPPRPPPQPHHTDTRAVCAHASDTYHDTHHPTNTTPHARPHRHSTPQQKSTNHATPPTTPAAHTTAPPPP

SEQ ID NO: 994974 - protein, 238 aa, Homo sapiens
MQNTLRPLQEVRVAEHSRTRAATAVAMWVELHSACALNDASRISARMTTRMRIRKSLDEVDIRIVQGRWYTMVRGYPQVTLDYGTMNCCPYESGTDGELDSMWQAVNTWAVGECWMEYDNGERGLESSPKGSNVKFETWNMVIKTPTDGARTQRRCRTALLGNGSSHQVYTTQILPKQKTQRHQGNGEPPQWRASAHYKMSWGQTAVGDTTDWRETPEESENSEKEDQNKEVTDRQYS

SEQ ID NO: 994975 - protein, 180 aa, Homo sapiens
MSSSDTIEFGASSIHVLGPSDSINMRFGIRQRTNQFDNEIVTKGRLADEWETGVRVEGSAHGSLRYRLENAERRDIVVSHPVDYLLCWIDVVEPAEILVWSCIIWMDLTGSIRRSYYARDNMHLEQRRSYMLSVSACCAELWLHWLDGWLEVLKDWIVSQEVAQNPEERCACHGLYIDVG

SEQ ID NO: 994976 - protein, 222 aa, Homo sapiens
MSKGTHSLDDTGNGKPPAAIGVAPRGTWIGTIVGDPGPHGGLTQRGKLARTRGRASPGCIPERHTGKRPSFTGTISVPHWHLKSSLYELIYGAIAKGPTPIRVYATWGGIDGDVSIVCPVGYSYYGRCLQRHTGVHEISQLIGQKMLGGKTIAATRHGSTPTGPAPDHAQASARRWNPVRARRRPCTNNRRTTPEAPRQTRPKRQHDQAEAPTDQHPQGDPG

SEQ ID NO: 994977 - protein, 349 aa, Homo sapiens
PRGRFGTMACKLERAQGHAGSHLRKVVLPVLDPVQEAPGAQAVVQQDRRLIAAQEVAHTHRQEWAWGLCPRLAHGRMGPKPETEGLLDLSLPGAEEEQEAIAGVLQRDARLRQLEDGAGQQAPGLSGRPWAAEDPDRGLGFQEARSQRHHNAQFGSDLVRASMRRKKSTRGDQAPGHDREAEAAVTETRKRGPELRAQRETEARQEQAQGDESFSILRRRSSASGDPGHRTSHKVMRRRAETRPGARAKGKAAPRTSRPDQDGPKRRQGTSPRAEPNTPEPHPRDKYNQLSQNRPETGRQELSHEKTRPNGTERKAPPDGHQHRHSDNHPKRRKHKRPHSERPRQTKEP

SEQ ID NO: 994978 - protein, 144 aa, Homo sapiens
MTEFYESIACGQLACPEWCEFFTLHMGAVELRSTDGRHFIAICRWTVWVLLYRTLPRTSTVDGFHDAQGLGCRYILDSIEGPPETDEGVISGPPGSKNSESMRDRSKGLLVASCLAKVQQAGGGDSYKRSHAVLNDEECVGPLG

SEQ ID NO: 994979 - protein, 427 aa, Homo sapiens
MGNNGAPITNWNLFQDTGDFSANGHIPIPAIMRLTIGHLANLGTTDRVPELTKGTLADEQRGERQLDARDRALPWQMPTLAPHIRVMYTRPTCGPIHLHMGVKRPACTLPKTAVVSTIQRAFVHPQKAYHRQEATRHLERHSRWTNDNSARVYATWQEGSSTGTGPTSGTHAKGRPYKCAPDSTQFTPVIRRKRVYAITKGRKRQCQTHIGERHSAIMGGPHDKVRGDTTHTRKHIRGYTVAKHQRGHMRDEHSSVREPNPWKRVGHSFTPIEQASIHSTDKRNQDGISKTQNGRPVPRDEPELAIFTQEEKGRGEWQNDAAAREHPHQKTPGGDSPTVDNRRDTGSDTPAQSGVRQTAPGYPHTAADQTAVDHVEQRQDSQEGGKQETAANTQEQDKAEATTKTARHRHTRQDERIRQVRGTAEKH

SEQ ID NO: 994980 - protein, 284 aa, Homo sapiens
LIDRTYRRAGGNIQTQQGHLLIRGRHRAPNANAASMLLQLLALCTSMECKLHARNIARRSHCSSKLSGSAQSAPNDGLRIMLRKCSRDLESGPLTWSLMELHHDRMLRRYSRMMTCFRSPVGECARLCQIDWELHLERNMGPHSVGRRAETLAVHICKMTMFRYLTFAYSGIRPAWCAHVKGDPTQIAVCGVTYHEGSDMTIGFLLPNLSDHLQCRPQRPCWRRAPSHDNSIPPTYRGKYKRTKQDLVPVNSAEKAMLCAILTFPELWRRARSMQGSPVVDIVT

SEQ ID NO: 994981 - protein, 341 aa, Homo sapiens
QRGIFLEICWLPIQQTNVNSLVTGNPYWEPVKHAAAAVYSLMTGQCEMFDLSVTWPGAVVLADYWMLQLLQKWARHVDGRDCHALGALTHMALAVQHPGSRLQCECQTRRSRGQHCESTVRYNHIWVLDLKAANDPVTVILRDLFHFSAKMMVAVTAEKASWEIAVSSVKKTIATIGLGLAARNVQLVTGWSKDKVPDHRVKLQELESLIANLGTGDEMVKIKTFGGYDSHGWERGKVHGASFVRDHECNKMLSRISLDRYMHSDYALTGKVTRDQEISRKNHRKTTGQAGRQGRSTCRTRRRTKEERIEENRTPRADDKDVNTGRDYETHQGPMWETGRR

SEQ ID NO: 994982 - protein, 165 aa, Homo sapiens
ERKGMVQAGTVHWTPRRGHACIQDPLIDAMKRRPQEECIGPQGSVQAASRVASQNHIGKFRGKRHASARDSCISSSTVLAFGHLRYSAPQVCEDDKKDRREHYGAHNNSSCKRIHDLGSSTSRYVVSRNSLDCANLVRAGKEEKQYIGELAAWERLDDDALAQHE

SEQ ID NO: 994983 - protein, 242 aa, Homo sapiens
TKRGDDRTLWWTESCEPLGCRSGFVVFARSTLALRLCRLASTYLIPLLNTGSTLDSLIYIWRTVVAPLSTQEGIGIQSTVSYVGDRLSIRRSRFGPRAVDVRLRQSRMGVPVPVLPTVSMHIPLDLSTGGHSPIAKKTRTWSPTREAGIVTLAILIWPQRSPTFSEKRLLFLPYLVFSILATALFTIRLGIPLVTIPMAFSLERQFRQPGFSKLPQRTAKLNLLLGLAMSLASFWRPAGSLA

SEQ ID NO: 994984 - protein, 177 aa, Homo sapiens
MRLACAARRISDSGEWLVCSALPVWPSCDPVSRPLVYPCDYVTERVPPLDLLPCANDAYATMRPIHGDHQYLMRCIEFAARRECKTGRHCCYPDYNSAAGGCILLVQTILSDDECSTSIASQEPHTRDDTMTRLVRHIMVTTCGQHVADESSHVRYSANVSSLAYTLSASHAAIVGI

SEQ ID NO: 994985 - protein, 137 aa, Homo sapiens
GAERWCISRDNWHNAACKTCVVQDEMPYHNELRECMMFVVLPMLPHTNDLCPLTCYPSHDPVLLCGMCTHSTHHLMHLAVFVTVGVTLSSLCVAPSSCIVTSCHTTNVNPSDIVCTTKLAIIDTLTAWVSDTNEPLG

SEQ ID NO: 994986 - protein, 149 aa, Homo sapiens
MIITGLQSGHKAPASLYDIYLRMTGRGPMDDANNNCRSFRQSLSGRGSGIYATSHILWWFLGHLTWHEMSQDCLHRHPKLEPRREDAHRSVRSLIVPGRREHWGPQESKTNITAWASHESHDIAIDEGGLGRACESETPNSCLQGLAVD

SEQ ID NO: 994987 - protein, 142 aa, Homo sapiens
EGGNRKVIMPELRQREIERERELREKIPGSCQGTGEMRVNTDYEETELIRTYESKVWGVLDLQMLRLDIYLSDRRREDELIEESKFLGGDSGEHTHLVKGLDFALLRKVRAEMCQYKREEEEELMEKPQRERQVKDEDPGRG

SEQ ID NO: 994988 - protein, 321 aa, Homo sapiens
AWIEGTLPTQRSTLDHVRPGNDTPSVTDADVVKRVGRLVVGKDDRKYNSKDQRTQSGQDLHTSGIKSHHPAVHQWDVVFGAIHDRRNVSSGLIAVWNRWSFIVRDADHIHNLDNFEALQSMHVLRIFVESASLNGEMNVPGETWESHNNIDERKGDTRVPHDRKFALRDQCFARTSEAPCNMPLGAFESDDDEDQGRADIYIKESADQGSQGLAKLMTPCTTRGKTLSKGSWAWELCHTGDWWPRTIEVILEPLGATSWCPLLEGICLLCEMPRSRHGVRRHDYLAGSTTGHDSEQYMPGMESGLTRGVLNTSLENIASNL

SEQ ID NO: 994989 - protein, 123 aa, Homo sapiens
ALWAAGGSGRASLRAWSLHETFTVRSGETFGSGLPHDAPRTPLATRRGVRSKLTVPEHGTVHPVADSLSKASMSRCDDVPATFSGAARLMRGSTVATEPGLEAGSVTLQKRCPCVSFHACRIS

SEQ ID NO: 994990 - protein, 88 aa, Homo sapiens
ARLFLHSEVSRGLRALALCISSVYSTRDMNAVLRAPPGFHSRHTGGARGMIPKMARILSLVVTELRARTESRWFCLFLSFGAAARRRR

SEQ ID NO: 994991 - protein, 603 aa, Homo sapiens
IYHSRRDKNIFELPDRSREVRCRQSASTWAFQRVDWRCSISQPSQRTLKTRCTVVRETSDDMMNEEKSSHMMELLAYPMRTRGNISASTELRAIASLRNTMAYSIGFSQYDESMETLVYDELGARWRFRLLDAGDASCVVLCNHGEINQSSDSRTLDDDDFKDTVSLAGAPRVWTGSLSRKRDVPVTRVVSTDSQTPENRARTGGVGTWTVMTDAPVECTSHRRNSWPSWVTGAGDSVGQDREQLKVVEHSSAVTVIDALCQRELGFTLVQMQTFLGPQIYLGRPYAYGTRGTYNAVNILYQLRHLADTHPEIEMEHFGPINPHIGERNPLGVSRRLWACLGKDRLVLWGNGESQMVPKERHRRLTVPSGNFVRGTHCGAGKLRRNFLLRNFSVSRRDIGFGGQTFVRTSAGVNPLFLKRPRIGQGIDVKNHCEVVIQHNKSEPLWWAHLGSAYCENFCATPWKIRAGKNGELGHTATSQCETKCTPQQIAVMREESHNTDKRRGGKQKRYSDTTPGAKQRDGHRKIRDQTREADEAYLVKQTTVWGEETERTIDRTLRKEATARKGAESNTVTTAPAVTSHQQRRCRTNDQHERVHTIENDD

SEQ ID NO: 994992 - protein, 295 aa, Homo sapiens
GTLNSGKAREWTPRAHRWLNTQQTETASDESAAEAFCESPRVCEAWRRGVLSNGGGGGRQGHGRLEQPVHNLPDSDGTVHRLSTDRGTAGDLDAPVDKTVNEGKQRGSVQSHAAQQGQQRRKIREKQRKRKKRNNKKLAQITRNEDTRQKTGAKTTENNTIAEKQKKKTAHNTAKNNSHRPKRRTENRHTSKRANITTPKNEKAQARNQIREPHKEDKEQPDNSNKKNMTNRNKGCKRDEFNPQQDHYHSRSNKATTKNTFHDTRHTDHTMDINQSRQPNQTHNETNKRAHPNYT

SEQ ID NO: 994993 - protein, 270 aa, Homo sapiens
MMTLVCKTSTYDACTQYGRHAYIVPVDDGSSQDSWDHAAIQDISSKDFSSPAQQVSSLLLPAQEPRPSTTSSAQTRRAVGVRKRPVQALDAHGAAGPRWERARSTPSTDHTDNLTTTHSHATQTHQRTKHLDGKNTTRTHCRSYAPHRPTQQHPGIRTRANPGPNPDLNTTQSSPTLTTQPNRDQPPKEADPWHHGRRTHPSPTTTTDSKLPPTAPSTRAQAHRNTRGTSETQHNAPPPSQPHNHTKPTHTNPSAANTTRPPPHRTNNNQ

SEQ ID NO: 994994 - protein, 194 aa, Homo sapiens
PGGNNTGWVRPGLVRCGDQSARGSCAWDRGWLCSGWGDRLGMHAVQCVTLSWLVSGAQMPLQSPLCPLRGRWTGRASVLQTLSVGRPGTACDGSGGCAQVRTRQCWHGDGDVGTWGCGWLPGAVYVAAAVTSRARRHRSRGRSVSGISMLAPRVLQSAGSRDSAGQSTLGRCSSDDNRRELPWEQSTRYLRAFH

SEQ ID NO: 994995 - protein, 41 aa, Homo sapiens
GNAERKECSEPEREQIAVVGSIGLGSPPSEAVKLQMIQVTA

SEQ ID NO: 994996 - protein, 313 aa, Homo sapiens
MSQWDVPGPGALMPELGERLSARPSPPCCTRRSQSHQRSAAMDAHADKTADGSPHAGRGTAQCLAPCSFGYNTGVINAPQKVIDGVLQPDMGPPLWGEHPAHHCSHTLWSLSVAIFSVGGMIGSFSVGLFVNRFGRRNSMLLLNLLAFVSAVLMGFSKLGKSFEMLILGRFIIGVYCGLTTGFVPMYVGERVPTALRGSHGNHAQHGIARRIIIARMSAGSKWATWTGGPDGDIISILARCSDVMPSAEESDLIITWKRVNRATVDKTWQYMRYLLAKDTAKKQTHRSRPTTTPSINTPLRNHQQDLPRKHNN

SEQ ID NO: 994997 - protein, 106 aa, Homo sapiens
MIDEGIAPEEGGVVPEGHVCHDPSQFNGSLPKRNKLSIGIYEWQRSLLIDESGTHFFLVNGRVKSFELSPTSSVQNMAGVTTWQCDMLKCSRLSSFSLCQFSSQAV

SEQ ID NO: 994998 - protein, 134 aa, Homo sapiens
MDGRAGYCSQLSCINEAIEQTYQQEPNNLKARNSFRYNGLILRKTCGRGHREAERQWVSLVVSYSGDSGPGVNACPRIRSGGGPRIKHRHARRHRLTHAIRQHESDKESRYTAPVPCRHGPALVQPRGTALNPS

SEQ ID NO: 994999 - protein, 320 aa, Homo sapiens
DFVSLALRDRRLEFRYDHGQGGQLVISEHGSQSHLVAMDQVSHCELKLAAQVCPDDVVLTVSHPCCCGGRPTGLRKNQILKPVTRGASIYQYEACSSTTFTQSLALCCMPMSICRFDCVAIARLCLSSASALQLAVTPESTVAAGHVWPVTVLLQCQPPCNLLGASGPPALPSHARASLAVPDGDGFAYCRRPVSPVCGLSSNGTCILTNAHGGPGLDRNVQPERRTVGLTIMRPIMDLRAGPTFTVRRSPSITALLNPASTPEEPRHLGKTPQPPYQKLDVPCAPLGRAPQQPGTLVSLLAQLPTRPHRDKDKLTNSAT

SEQ ID NO: 995000 - protein, 500 aa, Homo sapiens
GCQHAIQTEEDHGNFGAHVSRRATDQHRQASRIATPDGARIGAGWICSHPPVSNFRPEYHPGRIFVDKYGYEWQLSTVTRRKPTSFWRANCHIAWIKLCRTFGTSEPDIGVKCMLNNYMTGVCFPIIAWWLRIGPTSNSLWGNGEKTRQRQPCQSLKAHNSFRLELQLDGEELNELVLGGDLVSLDRTCKADHGTRQSVQFYRPGIRPFTLFHKQHTQSNIQQQTTQTSLREATTTTLSQAYARKNNGARVRRNHVGPPWGHPQKSGQFTPLTTPHENNYAGQASRRGEHTQHDGPDTPHAQKYSPAAAHPIITHTSSAEKYQTAGRLTTTWPQLERRHNYEDDTQQRTEGQLHNSTRTTHGHTPRAQNNPSTTPRREHPPTANTTDDRTPTRKTTEPRQPATAPPPVTHTQHTRTPHPTPTQNDANDNPPSHKQRKPQTPAKQHPSQPRPRDNTTEGRRAGRRQRHAKATHKALQHHTRTRPERHSNHHTDKQRAKTST

SEQ ID NO: 995001 - protein, 239 aa, Homo sapiens
GGGGMADTVLLKFLQTEMVAELWAQTRTQAGGTEDEPVGSWKGMGFRVGQALEQRLPRETLAFREELDCPQVLVATDLWVGVSCQTVRCDWLRTNSPGDRTVLQYNSFHPSSVPMALLACSILGGSDPKWPGRSTCGCLMLGSIYTQGFESVVAGSVGALPVCKLPGGDSETPKACLAPAASVTVAPGRHRLRRRWGGCICGVVLGIPGLGVTIVVRKWVSTRSGGCHDAGDMASQGAV

SEQ ID NO: 995002 - protein, 302 aa, Homo sapiens
MQRSKRDATPTRNASSDPTGAKHNHRNKTRAKRHTHNTPNTQPHAPRRERRNRKNPKQDQTQNDERTQHSKRRQQSDYGTADTTNEAHQAKPSTTQKQQGLPGRNTEKERNTPPTKETQQQDGRRRRQKDNTTEETQEEHADNKRKQGRTSRQQKEQGRTTHRDEPTEEGTNKHKQTENNKRDTQEEKEEQRLRSDRTQRIRSRQRSAGARPKRQSAHQHTGRPKQPQHKKSNRRKTRQHRAERRRHTADTEDERARRCKSKQTANTRKTEDNSKHKRGDAPDAGETKTKRQDKRTDKDKRE

SEQ ID NO: 995003 - protein, 232 aa, Homo sapiens
APNNFLCRHLHPHRCRRWSMSVRMGVLGLSYVVPSPRNPRVACVGTVLHRAWSILLLPGAGGRRPSGAYVKRRHRMDRPRRNVVMQVHSKYQDPYKQACVWHDYAKRTRKACGDMIVPIAGQPVHCLLSVLARTWTRLWTYATEASEHTNLCPIEGSEQSSSKRSFQGRTLTSKNDSSDPSFLQGKLDTVMSDKLAAYRWLSLVMFTELFGELEYLDVTGWLRGWVRHSRRD

SEQ ID NO: 995004 - protein, 120 aa, Homo sapiens
MVGSVVDHELGSCVDELRHHSPSSDSRTSRSSQGHQKLSARILKEALLCAVVLVKPHVYRACEETPPAPVGKNDCCTNCSRRQTPDPIRRVQKSPDETSPICLWPAITTRKSVQRPPTGA

SEQ ID NO: 995005 - protein, 103 aa, Homo sapiens
EEHPRREKLSPTQRPEAWRDKLVAGGSRMRARGRSLREDGWELWGSSSSSREDQRTRRERGCRAVQNGHGRAPVSGAGRRSRHRNPANLGSSAPVNPRVSGDM

SEQ ID NO: 995006 - protein, 137 aa, Homo sapiens
MVTSKNDQGGTPALATPCPIPYGTLAHSKHQKGDPRSTKPETRQGKCKKDDHETAQAQRRTNQTRQNNPANTHIATDPHPPHAYRPHRTPHAPSHQQQRGSPRHNNTKNHTRPHTQQHTYKTNHTTPPTTPAKTTPT

SEQ ID NO: 995007 - protein, 319 aa, Homo sapiens
DAPGRLGGGGCGDRPGPGPLKPERSACCPKAWDSGTMHRDRDFSDDTRVQARAGGYGAQRAPGGLRLSCRPAPSGPHGSSSWSVPGVQHGHGLWGAAWAAQGEELVDKNIEPLFIAASHARLEVVTVAVDTMYVGKKAGTCVFFPYLHQDWEVQYQQDTPVAPRFDVNAPDLYIPAMAFITYVLVAGLALGTQDRFSPDLLGLQASSALAWLTLEVLVILLRLYLVTVNNELTIIELVASWATNMSGMIGGVLMGLVFGTDGILVLGRLMRWQPWGHESGSWVKNLRSATEGVPSAGPKQLHYPDKAGEGHYAGRDTNR

SEQ ID NO: 995008 - protein, 114 aa, Homo sapiens
AERGGGDGQSKYPRRGRLVAWMRDRVKGMTCESDVYLDSRRLGVQDGYIVELEVRVYTNHRTSNIIILPPGYDYECSCGEDRGRACFRRIVICVYSSEGEYERFLEEVATMYDA

SEQ ID NO: 995009 - protein, 234 aa, Homo sapiens
DQATGSDYDNDSSLDVPEQRNFAPSARSYRYERAESRTVYLLGYQSVVRRIICDNSFPSDGDLHASRSQTAGRSLVQGGLGGPPGDIRRSSLMSVMSSTPRSQVLVIHYGNTFERRTSKGRTTIHHEHLQPETRLEPDVIEGSVKQMRLRTRALIPLVASHRVCQRELHRRIVLHLRNSSWKGRRRARSFPESAFQGLGGFHWARIRVGNGVSSSANPEAIQLHTFAKYTERAK

SEQ ID NO: 995010 - protein, 372 aa, Homo sapiens
MRRQCSRGNATGLRTRIRGAHTMGSLKDTGPVPWQLRGSSSSDIALCLTYEEAVSNRRTGPNRSTCEVKPDALKDKQCEVVLVTRPKMDDISRLIPDGDTRVRMNQDKKDRAAKPAHRTQSRNRDCMTEAPECTKSPSTQTARYATETRTVPPSEQNRHNNTSRHRSTNAKPKQCTQAQDKPNNAAHKTTQSKNKAEQAVNEEAKHYQNSKSNAHEHHSSKKPIGQDRNKTTDNQQKERSTRAWEDVAQRHEDKHDETTKQSGQKRNKRNNPDEDSEGTAEKDETSRGTRTEPLEEQPTQARQTRRQQCQYSTPATKHNSPTRIRSVSDSQENIRTKNQATHPTTNKRRHYHNGEEDRTKSNTHNRRKHRHT

SEQ ID NO: 995011 - protein, 347 aa, Homo sapiens
RVEEEQQRSAILAQCNAMLREQLDQAGSDNQALSEDIRKVTKDWTRCRKELEHREAVWRREEESFNAYFSNESQSACSLLWRQVVGFQCWLVSRGEDVHVSRDLACELGRGAWTQVRSRACPVRLGLGLSNSGATGLAIKSRRPEAALDETGPAAESQSGGDSLRDKVLREKDLWRRQQNAKRPGQGLTQCQSDQSWALAVERVLRSRIWRRITVKKDLTEKLGGPGNPCGYSEQVALVDTRTREAGHGRPLMDLGTGRSGRKSSERGPALSGSERDRECLKAALGGSRTRNQSNRRALTGEYGPRKVYTAVSYRKQVTRVNASLQHSDKESWTHTSDKRKDQNTQT

SEQ ID NO: 995012 - protein, 293 aa, Homo sapiens
MACACLLTRRRIHGRRVSGGVTGGDWHKRAQWPGWCNFLESELQGFTRHEWTKTRIATKAMWTLTLGPWDLLGRVATLEMMEALGHREERSYGWVAESHNRSEADCRGREDRGSLAMGSQRKLAKGQYELYEGTSNAYGGALLKRDALDSSCGGETQRSWRSELDRCNCLYSEEEFVDKIVPRGWGPCRRPYPCIGTNRRVVKRIGNAPVHCPMNGASWLGVGRTKRETCAGVHFAPPFRVHLVIDENSIPSSYGNRRLRYTGLGTTPFEELRQAEVLSDSGKEIGLGGLVTT

SEQ ID NO: 995013 - protein, 450 aa, Homo sapiens
MSDRSPSPVCGSSWRTVGTSRLLVFWPLWSSSSRTHCDGALAGHSSGPSQCWCLVQQTGLPGGPPSHGHAKQCCACCKERVIGDVSRRVRVTQRAHRRGVPSGRKTRVGRKVKRRSIHAVTGGRRSPRGTNVETSVTLRREGQEAFGFAKTTPLFTSTVSFYIALFLPERKAACRGRIRIEESRRERKAKGPDKRTGHAEQFGQAYDLYAGPWTNLGNWGCRTRVEESTRPRHAFPDPRHLSRDGQEPPCAAPLSILDAEASGTEGGTREDFGSVGNPQRERIECPKQIIGQALGTWDTGDPFSLGFEGESSAGLGGTPRGPVTQFAVGNSGELGTIVGYNAGAEKRMCGFSGSKWRCGNLSRARGKIRTIEEVPERNYRQAIHVFDPYGMARKKRLKRSGHGNPLVVYARAGPGAIGELEDPEKVHTQNWCRRRKEETVGMRMCNTPIS

SEQ ID NO: 995014 - protein, 48 aa, Homo sapiens
MRHQSLKGRKRYGQQGLENRIDVRNKRNVTPGVFTGVDTDGGGKEDNR

SEQ ID NO: 995015 - protein, 146 aa, Homo sapiens
MIPDDHRIEGSWRTICRCCRYNLLGEALEILGQLGDMGYSLRGSDQAFKTEQLASEPAWNQYIPGELGGTKKFLFSTGPTRIPNPGTERRKLPGSLAKKMDQIIEGNMKATFSYWSDPDRKQLLFSNVYALEDDPEMKVERYKRHL

SEQ ID NO: 995016 - protein, 400 aa, Homo sapiens
LHRDSRPCVHYYASVFSMPFPSPGRGTYGYGADAMHVMGRDEDRSRSLTTRGGSVTLEESIRSIYETAYLKENCAGLNVKKMRGKMMLGGRVFGEYVLMDEERRTQGFRTDRQEGVQCKDNRACIPTQAFIAHRYAGYLSDTTMSVSVTRDKDFIHVTCICRKIRDIARSGQGSDSSASKASDRSRYSPSESSRQWVLRPEELGIQRESRRHANAMALGPLAREDGTLMLHLQRLEYTLSVCAEEPEHSQLFTTLGRMAWSSTDWHPSAQNEAGHSILQNLCEPVGRRERGLKATWDQGAEHGGIKDAEKAAGWTTWRTRKVEAKRTTKGTQAEQSTKLERRQNTQSKTQRTARRKAQQCKNRKQLEHNTNNVRKSTTPKHHNRHNETKSTEDAPERRAT

SEQ ID NO: 995017 - protein, 204 aa, Homo sapiens
MGERIILAEITSNHSDWCTPALLYTGKPLMWRSRALGGGWEELLAYTQSCVKYAGFFGALSMDPPGKALSGLHRKSLAQKCITLEVRLWHVKSAGEVFCGDMRVRLSHIDHTSVWLRKTRDKNKDARGENKGGRQRGATPPKCETCGASRGRAYKTFLNQRVQGTTPVEYVEHAATSGFYHKEIIVRTTYISLKGSPAFSPIVV

SEQ ID NO: 995018 - protein, 483 aa, Homo sapiens
VDLVMVYTRVGGLRGMRLRRIGRASYFRSSEFPCDDREASGTGGPLVLVLSQGELEKVGQVQVPGRLRFGVSGASMSDAEHVGAFARLRSYLGAEEVGMSWRRQSRWHKRGLDAEDCAVKRTRRWEDPPAAKAPLSMSRRQRTISRGGASSRRIEITRERETAAEYVPTVCNKRVAHVLTWVAICLSGEHGHVDGLRSTRCSKMPLSYLYLTEPGQSLPCRLARQEASVTKLLADAGWWSEKLVDAVVPSLASFAPHCRRLARAKRGPVNLCSRDSLARWAQHSFAMAHSNRKATGWESARWGVHLSKKRAFVGTALGTPREENGRNQFTRGSPKGRSNGSKAEEGIESTWQRETGATPRPPQLGEGACLGTSAFPDQIPTGALGLGTPDALGGFQWQRFGLSETLDVNTNPPEFQRRGPCFRGHEFRRVGTTNPLLEPPGGTEPLRKRILVTSPTTTGGPPGVPRNDATENPTMCIEGQSPT

SEQ ID NO: 995019 - protein, 222 aa, Homo sapiens
RTRWLADEEAGGEPGPRALRATERSDLRRGRGVMVSITQLHASESCSLFRAPLLGCLAWLSDPSSTGLRALGPSKWGDRPVGGGPSAGPVQGLEWLLDTEANEPWGAAAAGCGHEAPRQGARPAMYSVCVLRRLGQALGVSRARTPSCGIAVSTSCRELESMLRSIRRLRSPLSIHGHPRVSGPLQAYLAFHLMVPWCVPWNRSEGSVSLRRHSPFAALLRG

SEQ ID NO: 995020 - protein, 151 aa, Homo sapiens
MYVTEFSTAPHATRDLLRSPCSMRDAVRETPVTYIGAEYDGPHKPTPGEGTEKGTRAQALPHIIRAWPGTPEDTTTRTMRRAAAEGESAQKEDEGAGYDIMAEHQNKREMAGRGASETARSAEKQQRGTARGQHRQGDKKGDGREHSRSNN

SEQ ID NO: 995021 - protein, 121 aa, Homo sapiens
MEIVVTDYSDQNLQELEKWLKKEPEAFDWSPVVTYVCDLEGNRVEGPEKEEKWRQGSRAGAEDVIVTSEARQLGAVHPYPLADLRAHEDCVSDATTDQNSPPTGGQLKETRKRSEGQEGAG

SEQ ID NO: 995022 - protein, 247 aa, Homo sapiens
GGEQQAEQRTEAAGDRPAGSMGRGYSLPVEGWKALEDAAGDCPEAGIPAPHCAQTMFILRSALRAGLHRSSLRMAWGRLRPNLPSPSGLRSARTTPCFPPGERLESGEGVGDVDGAEGMRRGMISTVNKPHPTRQDDERSCTAPQKTETGHHPTRGDRRLTGTARRNPGSTKRDDTDEERGDKDNTRWLTLGNQNPGSPRQTRTQFPPQHKGDNTSWPARRHQTTPRQSSHTHNNTKADTGTTQQGN

SEQ ID NO: 995023 - protein, 217 aa, Homo sapiens
MVRGCLRLSSPLRGGAGLRESSRVLNQIYPPRDVPIAGVVVACVADGLSPVNTVIPIQWTTLILLGFDVVERRPSDPVSERALRIETLGEWRADNKYNRLLGRVGRGVGEVAPQWRGALCRSISGIAGRWLGVQSRDDRQYGICQTGEQHAGTWIGAGSMGTLRVVHHHEVSSRPTLFSVEPVPSRVGRRVDLTVCFVGTDSRIFFGTPEEWLLSSL

SEQ ID NO: 995024 - protein, 103 aa, Homo sapiens
PEPTYLRVWVGLAAVEFVTYEVKHPSRSHYRFNVQTGSAMPWPVGIRYLTDHYDTESIDHAEDQLNLTSLQRRHTSHTRQPSTWRHVKHIHKPGHKHSTMPHE

SEQ ID NO: 995025 - protein, 320 aa, Homo sapiens
GLSRLLKGPGVASLCRGLDVEAKTRLTCATSPTCECGYQSAMWYHGKTTLTASHHEYSQLSGGGAKFKKYAGDLNNAPEEEARGIGINAGHVEYRELACHGTELARTMDWAGSCRLCEEYDQRHCTRVGRDASWCDMQTKDGPMAQTREHLINSGTIAIGCGAECVGVIVTLHVDRCLHGTASEWVEMAVNLVASWEALLIEGGGINGEGDPQLSAYALDSAGVLLLGLRTVNLSTSKGGVKKRIGMLGRLHSSGRPGTGCSISWACGWRVLRPMGGRGGEAPKASGEGRRAVGPGNQNSAGGKGAISPTAGTRETRAGT

SEQ ID NO: 995026 - protein, 341 aa, Homo sapiens
AQARLDVLGRAASSATQALTMQLALYGSEAVLDEMIRELVVPEQERLYCATNEVVEVEIAVLVNAVDEKELACENAETSVQAIGRCDWYKDGVQNGCAYRRSQLDKHMFVWLLQVLEHEIRPFCECDGMECAMLDMPVQLSESAMGNTYSTNRRLEASKSSPGSVSVSLRSSKYWVPPDAVEDSPKYDAVLMYQPGDERVDDVTRGYCVTDLYLVGSVGSRTCVNPKGRARQIFGGRPWGLGGGMPHNKKFDLRGDTLPKQDGGSTTTKGGHSATEHWLHARDKPTPSPNEDTADGDTIPKYKTRKDPPTSREPWMYTKRGASRKSDPKGKSCMAAGTLAT

SEQ ID NO: 995027 - protein, 189 aa, Homo sapiens
EQDLYHCHRHRGQPPAPHRRGGEEVLRPASGEEAQDCATEEDEPPAPELHQDAARELQSPAAWRPLKPNSRRRHTPRNSPTGEPGGGGGGQWRGTGLTLSQAACRDWMRHQKHDGVRVLLLGGQYRAPCYVKTLQTDTVLVGGEACQPHRARTRTDDRADMQTGVISFEHDPGLHPELESVLVNFFEKR

SEQ ID NO: 995028 - protein, 212 aa, Homo sapiens
SGSLLYTGGMGTAMYVALGRPHHPHQYLARVDCDVRLAIQVGSLGIFPLVYAMPRSASVPECRLSASNCQSNDQGHGVRAGGWYRHAGAVLMRAQVLLHVSEKEIAAFLPYLVFNILVHSCTISHGELPRVLPFPWACSLVETVSEARPFNESCPEDCEGSNLLLGLFYVLWHHSGDQRGSLAKDLRGQVAPPTTCLPFLEYIKVRVSEEGM

SEQ ID NO: 995029 - protein, 263 aa, Homo sapiens
SFFRKLGSEGLPPSSFSNYMRDCDTEACAYDSVCLLSVPSLSGCCLTPSGVSVYCPSCLSLHGTAITFRLVNPARDENALDRTLVFICRREYSTHWGGDIGGPTSYDDKSMYIAGVRIYEDFFTAASESSVRVHASVTCVASYAVTRHAYYAQMSVAHRHTKRGDLTMGVAPRCHLPLAIDEGSPRHCRRRGMASSIYWSMIVDTAATRTYNALDCISSQANIEGCLAGGHSNLRRSDTGSPPRVVIVTLDGAELTGVEVTRY

SEQ ID NO: 995030 - protein, 134 aa, Homo sapiens
GLCGMAALDCPWSLFTSLGLSEQKARDTLKNYVLLSAQLRRGRYSGSDGPLWFHLLTKLPGSLLYGLASRLRDTRRLSFLVSYKTSKKIHTEAPAKRCPGVCAESTPWYPIDTVDFERECGVGVMVTPEQIEDG

SEQ ID NO: 995031 - protein, 188 aa, Homo sapiens
KHQRLLWTLESLVTGRAVREVRDGDCPAGPGSCSTTMQIQASTQEEALAGWEPMGVIGLILPPDYSPSLDDVEDLPCPWLWAAAGGGPRCPAGLPRRPRPSLAQTGGGAGPLPGESLSVLELVLSSHGVAYPWPLARPGNPDGGRSCGAPGRKGVPLRRSLAGECAELGLGLGTESLCAAARDTVAGH

SEQ ID NO: 995032 - protein, 74 aa, Homo sapiens
REGKLARTKGNAEPAPAAQRSRVSHCTCNLVHGDARARLTCITDRVGNQLENSVADEDLGADDLIPCADVCQDC

SEQ ID NO: 995033 - protein, 505 aa, Homo sapiens
MAARGHPTDVVRALELAALVLMSNGHDSSRPHWDDKFTYRDGGQSCGFMVTRSYSSWVSWIECIRTWPLLTERTDDSERKKLQIRVRLSLGPINALAALNLSLGPYSPLDALVEGDPGYNGVAIARMYDKTDDDSCDLGDTTCQNDRACGPNLPVATQGLVVFEMGRNLHLIPRYGDIYLVGSLVAFVRSLESCKGLKFRIERHNQEGARTFGSYQALLHRALRQWALLAYPVGPQVRWIAPPVPKRALFWTLLRIHSKHWGGIRTRFGRAMGHISFIIRVARPDEVKANRQPKYEPPQEACVTEPEPRMQVPFSQLPFARILGPGGPNPRTGGGFPHWLIFRLVGAGALWGSRARSRGVRHNGFVARPDRLLHPGALSAALAPTTSDCGPGRGQFARSGPCLLGTTHVGWPNCGGLGPAENADKCMTRRLFGIYVPQGECVQLCKQQSTTERFPTHIDARRETLPLRMKQPTHHGCSVATKKNVCLTHDHHTNSRGESAKQDAD

SEQ ID NO: 995034 - protein, 182 aa, Homo sapiens
MLSMYIHAKKVFCLAYSLMPDSWGDGYPRWVLNAFYLYLSHECRAEAVVPEGRENDPRSNHRKPCLRTSFDGGPQLQGWGGNSTPKCQPLLSSQSTSILRGISGLCPTGNPFLVGYAFQCHRATHPMHLCPARQCWDGQQGQAQCLADRWVGREREKCRLSILLGGIPHKDPGILAGKTVPK

SEQ ID NO: 995035 - protein, 250 aa, Homo sapiens
MSVVTSAWFSCLLVRSRLAPSDSRSVFLGPDISPSEAHCYLDYYSAWNEKLYVLGWAHLTTMNTSHNMMHTRHLYALLVSSLTALICGVVIPVTLWLVTYPPHTRHRLPSCVSQEKSPCVLLTAPRVRACPGLLLPSTKGGRTGCDSFLVAPTWGRPRTPGTTMWGGVILALLERYRLACVRVRSTKDTRPGATSVAPCATPRWYRGGGSGALTTVPVTRCGSSKFPSHVVPIGVFADESLMEAHWRRQL

SEQ ID NO: 995036 - protein, 237 aa, Homo sapiens
MLSTPLFWRYREETPGRIVTHYQVLRYPNAWGEHTVCHPKKALRERQTFVALRKDKFAARRSQRYSGWGRTLVSQLFGIERRKLYNPLCNNSNAMGLKTSEPMSQARKSLGSLNGTPRVESAIEGCAPAHHDSCVEGRPLWYQFLGSICCPGTRNSFRLRKVKVPATACGERTTVALQMERSIVKRPFVVTVKFLPRHIRARSWSAVTDYALVAVHPKRARAWHCAIVNGGLTPING

SEQ ID NO: 995037 - protein, 347 aa, Homo sapiens
MGSSAYGTKYGEETMERSSGRGAPSRPIWSICGIPSRDESNDILVCGCLGTYEFDFYQLSGNQIGKGLGQMNHSDSRAMYQAYIELKRRGINSLHAGLRDNPMYLLFHRSGLDVRLWDLCEREHEPPWDDGLCSSLKTDYQTECEMVGCEGPHHGAILAMYLIVSRHEVPLPAELYGTGMPIADTLTDVIGVSHLMHRFRKSRDSLVHEELVKTDCHLAEVARGINIASEEFLIYESYFRRTYQHDWMSESWTDVIVNHRSEFNPPPGGGVSHHQCVPGTTRLRKAGRQGNRNDRVVAQCKCSVGLPRGNGDHREHKPLWGPTYDTALTGHPTFGLQETPANKKSQR

SEQ ID NO: 995038 - protein, 213 aa, Homo sapiens
LAFMSLLEEKLLPVLVHTFGIDTKKYVEVTREVVCRGYALSPRTSSCLAACQRQYMERLRAADLGSTGLRIEEGAGEGAVADRLWECLTLVSQWPGLFNKFFFGQCPCLLGRSSSSANLAPAVCKCKDKILCGEGMQVHLLVWSRELISCVLVVSHEFSCSSYIHPADWKLVPPTNARHHGRAQRRDGRSQYRGQEPGIHNLCWLRLGQHGWA

SEQ ID NO: 995039 - protein, 216 aa, Homo sapiens
MPGKMVVILGASNILWIMFALLKLLKIETTPESRYLAQIGDSVSLTCSTTGCESPFVSWRTQKHSPLNGKVTNEGTTSTLSNESCYVTGTNDSVPVQQQLCDIKEDWTNRNPGGRSTLFLRIQRFMESGPLRRWEADHSQAVQLPDVYPYDRLADRLTERRSSHEESRQSLPAMQNRKSLANPRTLDRYPFNTGSIEESWEKGPGRAEPHYTMDNM

SEQ ID NO: 995040 - protein, 298 aa, Homo sapiens
RGVAWTFFGKKKKIIFSKNPPGGGGGPPGGGPGGASPGQGFNWGGKALNSNIWPAFSRPPKAGRPANLEEGTRGKWCKLLVGDGACGIPGGLWGGPSRRLEVVPLERENEGERSTTLAVWALTKRGGGKGGAYFSRGVKEPHARKIVVNPSGHALRGRAISCECLCPRSDILHTQAPTILVGSLMNTGGDETSSHAGEARKTRWSGAQSRGGENTAGAPQAGGLTESGVVPLEIFLLGKDNPAVWDERNVLDRAEKDRPRESDVMRARGAGGTQPWVGGPYLKKGTAEGAPRGGHRVK

SEQ ID NO: 995041 - protein, 169 aa, Homo sapiens
MSGWGVNITGEPRASERTQRKNKKRSLKQVDDYRIFRKRYLIYLVDASKAMFESQSEDAVETLLTMSIQCMHKCVASVRSISSDRDLLAVVCYGHRERHRISVNGSKILTSYRSCDESTVRKRILELDRSFKGGSRDDKRLFPRHDGRTDLDYIDSSESDVGPVPRPLK

SEQ ID NO: 995042 - protein, 536 aa, Homo sapiens
MYRQLTNECSTSVTPSMESREEERQMRYVVEKSIDCGAHSVRFNIVADIKRVVNVPNCTRDCVVRRKRAHGQVCPAYSLVRAPLWGLAALETKYHTPFTKLGVPFPLGKFETRIRKENDPVAKLIQHAPHLQERGHVVAAPNCPSPPLCERVSRRRGLGVAPTSLSRSMEPIVRPFRGNHTDFQPVEPVLRTKSEKGSLVRIWRIEANPRRKAIGASMSWVDVVSRSGLGVWPVVPKAGPLPTHLMEGNPPVGMAHCWAWGAGRPPPGLLKSHPGVWRPTWRTNRNGLFRHHVWAYPPVGRMVGAGSTFERAFPCVLGAAVTHVVVALDPFLVPPCSVGGTLWSAPLEGVALGLLGVLANAIISGSTEEILPGIGPDGNRFPGSCISPNRQGFLGAALKKPGGVRQLSTGTKRPDTVPGTGNPPGEAGAPPDRGPVIHRVEGERRRKTHPEGVYSKEHASPRYEERQAAEVSPNTAWLTEEGGHPTHETMIDWIERQTTRGRDRVINDRWEAHRRESTDQRSERSALNETQTTSRT

SEQ ID NO: 995043 - protein, 225 aa, Homo sapiens
VPKGVLGWTRNWEQDTQQDADQGQMRPKGGGERVSEGPQSEAVRGVGHRLREVGLSSWDPSRGRVVGKGRGAPKGSRRRLHDRKWRETQGFREGPGSGNRGSTGYYGRDSPGPPGNTTERVEGRPRLSERELSGVPKGAGGKGSGGDPPVVAPPIKIQPRKSLGPRDPQTGGGIPQKLGGRPTTRNAYGRGQKTRGQYEGPKPTQGNRGVLRRNTPWGKQTDKGP

SEQ ID NO: 995044 - protein, 209 aa, Homo sapiens
ARCCPPRTRSPEPPPRKGMQETPGSVERRGRRAGAEDGMSQAPGAQPRPTRSRVTSRSGERRGRLSCLSSGPSNKRSAAGRSLAQEAADEICKRPLSQLGPGPGTGADPEAWPRPCRWGCCHCRCAGGTGWPCAEVDGVYYHTWSLKLRAPVGPGWMRTESGPSWRLRWPRPVRGAAGSDQGGGGEGQMVRYRLYMVRHRQPQAVPAHP

SEQ ID NO: 995045 - protein, 171 aa, Homo sapiens
GAIQSAGVRETLKRDRSLHSLRFSIKLICRFATALAPEKNGRRLLGDGMGTCAEQLLKKPALGDEILVSGGIVGPVCGLEVFSYECEQAGKSSIERRADVVMCQQRSLLAEPDSQWPQGGVVHVITKCSAASSQSDLRKEGMNLETLRLRSSNKHQRFPGASQRSVRLAPV

SEQ ID NO: 995046 - protein, 140 aa, Homo sapiens
MVKLIVDGRSAKANEYLMMGPLIPVKLVDVGPSVQQKTLVDIAKSQDAEVGDGTHSPVSLLAAELSEPSGEMPMWRKVYTPEIIIRGFSAADTQLAVNKIKEIAVTVKKADKVEQRKLLEKCAMTVLSLQADLPEKGFLC

SEQ ID NO: 995047 - protein, 179 aa, Homo sapiens
MAHTHPMVSRIIESGRAVSSCLFLLATVSRWWLCRLLPRSLRLSAASVRRGVPVSSSRLGLRGWTCLCDVAVRCLVVWPPVPSDPSTCTRLRERRVHVAEDMRRPRTGRSSPVILESQLDTQEAPTVEETIRLLCPCAPPKSSAAKLTQLSMPELTAGTLDWSRARKPVWKKRKKREGS

SEQ ID NO: 995048 - protein, 365 aa, Homo sapiens
MESRQDVPCGAGCVVQRRGVHFSTWRPRRSSFREPCSRAKGLRLPTVEQRPRGRVYLKLKEFGAASPVPEVLGPEARLKTLGRVQSMSGSPSTVPRSLPIRALCGSVPGVLEISELEARQPHFLGLFCRPQLVTLVNTFGRPLPQSIGKNAPWESHPEQNPHHTLKETLPVSRESLAPSLERPEHSGCENDGERPTKRVTRMWRSRRNSRERELRGAPERAYTTRGDTGTQPRDSLAYTGRDRQRSRNPEIEDIIRGPQHRGQGEPQGQPYQKGAITTEATVIAEENQRGTGTTEYCRNGSEHTPDKGRYENAGTTYEKGGLSDTHPPEADACRTSGQPEQQDISYRVRYEKQRSDDRTPQTSRH

SEQ ID NO: 995049 - protein, 101 aa, Homo sapiens
DRTRCVGSVRAGACEAAARGRHCPLGWTRRRLTHQTPHDCRRPSSLGTCRRRTWRSRDTPQSCRSKHRQESCEPLKKGIKRDARDYVRLRQPQLQDAHRPS

SEQ ID NO: 995050 - protein, 108 aa, Homo sapiens
GISCTTVILDSWLYPVRPFAWTQHLSSSLNVLFLPWTRRGCLGVYSEGSDDLVVQAGPSCIAEWSRGATRTNMLLVFEGRASAVDIMQAVGLAESHPSLHALVLSLPY

SEQ ID NO: 995051 - protein, 215 aa, Homo sapiens
MTPSAAGGPGALVALGWGTAGGFRGGFGSGIRGRGRGRGRSRGRGRVRLAVGEVRVIRSGCPITKIRAAWFNGQCKITVPGGDLIVFSTALVMESEIIDCLPGGRIISEDRRVFDRSYVPSVMTAKDTVAGPDATSVSKGICGVRESRELTTLCTAVRVRGVVRSCIQMECVGLPAQSRCEAHAISSSLKLPSYRSARSAEGVAWGRIQESEQRP

SEQ ID NO: 995052 - protein, 112 aa, Homo sapiens
MEALPLLDRDNSGPRASREGWFCCRYCVFLLSVGAVQELGDMRRGPWTRRRGVPTFYCWVDYKCTSRVYDGISRRTRVAAPRPSDTLKQSRKILQRQGSTGKEHAVIDVENL

SEQ ID NO: 995053 - protein, 207 aa, Homo sapiens
GCLILGSLAASLISFAPDPRNPVVAGRQSVCELLVPILRSSWGHRALRGARGIGDCEPGTSIFLLVRPALWPSPSTWCHSLMARPWSGPGWRWRHVVSPLWPGSRDCLWVLGGRSFLDRGAVIAQDMPRTLGFQHREEEESTRTSTGREEILDRFSCPSQGIQAVITGGSATPRFTVNREQPVLLLRFSPAPMDRVLRCRILLWLFD

SEQ ID NO: 995054 - protein, 469 aa, Homo sapiens
ALLYHGEYGRSLSSAGRWTDEQRYMIPRRSCDLCDGGRVCVSLRNRRYQGEGIVSSSKGATSRSKRRVGDYQSGHPSDAKHRIVEEQIENLVRDKSRWTNPLRADASLWLPRPDRFRSRSLWTLAWIDWDVHDVPLSSPFRAPTDAYHAPREQMLQVFSVGLKGEVVCSQSETLGDPKGAACNREDVLLGRPSGLCTISCSLAHWLWVERRIGEGRPRKAKWGSKCSQFETELNWGVGTRTMTHRDVEFWDVEAFHFGTFGETASGKRLILAEHLARRRRDLRRKASTSCGTSHKLEIRKVSKSVACFETERGSIEPKEIGLPALVSRARNRRETPPSKTINPKAFEEGPLQVKRVGIPKVKQADGFRVPTGGAKGKGLRLGTLNSAARKGRYGHQEGHGFNRQAGPRGPGGPPAGQAHPPDCDTKPGGAGAFGWWFNLPGGSQLGLLPSRPPSLVFRLHGLGNPGQED

SEQ ID NO: 995055 - protein, 109 aa, Homo sapiens
MAEPKVVLQDQKATVANERHIGQKAGLHIHADEEHQLLTNPVGILRGGAHTRFSNRAHFRFGFDHHQSRNRGCRNTSPKIGEDDRLCECHLFGAIKVAQWHGHILDPPL

SEQ ID NO: 995056 - protein, 68 aa, Homo sapiens
KAKKEAPAPPKAEAHKLKALYRPEKAVLKGVHSHNKEEDPSLSPRTVSRRTRYDDVRFRMTAAEVSSG

SEQ ID NO: 995057 - protein, 236 aa, Homo sapiens
MTPVERGGPGALVALGWGTVGGFRGGFDSGIRGRGRSRGSGVRVSPHCRPDDSSEGKGQRYKDVDARSSRLGRVCVKDMKIKSLEEIYLLLPVTLVNVKSRDSLDLIVPGGVISSRDEVLKIMPVHEARPVPVSSSQVQGHLLLSVDYNGHVGLVAVKCSNDGGQRHPVGPSSWTMLSIVPVLQMATGRNNDRKAADIVPCNGDRSMRLCAGYVVIPAPQRASWHQSPAPVPKKLS

SEQ ID NO: 995058 - protein, 122 aa, Homo sapiens
MRQRLASGAGIYLPCRSSEWIIQTALNQGVVESRLHPLGNWVSLQTTGSHAEFCSNYQGELTQDVLSLLLEALQDSRKEDVAPPRCWTARRVSWAPKARSPKLHRNALIVRVLLESMSLIPQ

SEQ ID NO: 995059 - protein, 608 aa, Homo sapiens
PNTYRLADCMRGCYPPVRPLCVRAWSAPGEWEESGGCVFRWTSVPSGGVPEAWVCCAGRTDGVARPGGVSCADSRRSAPEQQRIEAICELRADERHRYRGPALKRFERRNQRRRHYEGLHACGGESLRNSLYTLPLPLKYNKGENYYGINHNIDSVTCNIWGGTRNSLRQRANRTRFLSKRQYELGRRLAAAHGEGRHAQIRHRVAMAVETQEAVPPRGLVICVSDGVPERETDEHECDTASSVTCVVGFEPVCNTKTRRGSSRYQLSSLLQGAPVGNESSRVLKRPHFLEVHGYKPPAFGRANFKVGTLAVGVPLEEPHGGAVASTASPQRDRWVHLLLSRSGGRNQAAAFPLAQSGPLVRALGGVTLGAVHLGPVVAPARKRVVKPLKCKIRFHLQKETSSVSNTLQGRERPSVIPGGIGDQGKRWDLETLGVTIPSARPHRVAIGEAKMTIIPVERYRDPCGKFAQRPCERMSALSRERENSTTIIYLVVAQKEKPYGESMEPVVVPKRRVTPFVKEKFRVNPKLQERRGTSNPRHSSLPEKEKQHRSPGLLRRTQMTSPHTDRLRAEIRENKVEQKRQIARTPQRPTESRREREGIAEKPQKKV

SEQ ID NO: 995060 - protein, 280 aa, Homo sapiens
ALILRRHRRDVSKNFALGQDVIDLLVMLLHLYRTDDDLDQPVIIEHRLIEFKALSPDESIWPQHHGKRAAYLLIHSPWRSVRNLTAKAFAQAQVAILWRLPMMAAHKRPVASNIPFCSQRHSGLTVHFLGLLPPLLSRLDDAFRLGSVEDPGTHSWWSPQWINATPQAVPEVRTPTGWEPHVGIPGQVELSGQCPFKEHSPTPKKQSDWDWPKIPSARIPDQSPNEKHQQIQSDNKSRNSSTGLMVLECLPCMAAHRSGNARARDGRHWIRFAQRTHKKR

SEQ ID NO: 995061 - protein, 151 aa, Homo sapiens
MVALLTAAGLSALALALWPRPRTWRVPPRSPYQTGASSHSQSSRVAVTSEQGPQRVMHVQARLLAYNEEVTFTKHASQMATKGRICGKSTGHQSTELLSCDMKRSLGRRAVSACLYLLFIILLLEYALGSRIGFQIHHIRYVTRISNRRNS

SEQ ID NO: 995062 - protein, 67 aa, Homo sapiens
MQYSHRNHDCLEYSGQVSVSVRRGTYNGARPTWRTHIKKQARRPDALGWRGAYVRMWKPRRAKVYWG

SEQ ID NO: 995063 - protein, 396 aa, Homo sapiens
MGCGRVGSAGAGPAPRNMLVCERPLAGLLRSHADEPTLASPRIPRAVADRPAGPGSSSLKHMFVRLVAANEAHVVVITGVLGEATRRHGGLRSAPCSFWSSSPVIPKRDLERISLEAALTSSTVRECKKVDTLAYGVPILQSTGHLRQVKKIQGPDTTETVGRGDWYMSDSCGEKIVDGVRTCLTFASWRALGKRAIREWPVMGPESRSESDDRNGSMAGRVAREHGFAKMRPPQDLGSNSGASQCGVHATNSLKGHYKDDEELFWHSLGGKGIETVQSPKKDARIGRKQRPGEMLGSGKVEAQARKRESGAGPEGNPRLARARKELRHCKQGRSMTCRAKTGRTRVDLPTRDRGAKTRRTREQQMQCTARSHRAQSETGTNNGGKDSTVQTREKQ

SEQ ID NO: 995064 - protein, 338 aa, Homo sapiens
AALVVLDESPMSAALVGYSSRGSEDESEDGMRTRPGDGSSPSWPEPPSQAEIFSSLDSVLNMFARVTGGRGLKTDSQKRRGDGVVHLSLLRSDGNLGHPHVYVPTNEAHRRSSLDRAGSVLAAAYARETVCPPGWKGMKVVHRQRRVPELWVLGHPGGPSTFDAGVCKARMIVLPKIRSLLASRLKIVHQVHEENQGLVWALRSRSGHALDSWTWLQRWTESWRKSTQRLSARDPSLHLSRGWCVGWCRFRCEGRAADLRDSGWFDNAVGCGVTLSCPLRRESLSSLGGPGSLRPRAADGTGLWRLPGAPVTGAPPGIRPEVCRSVGRSSLGEYSPSL

SEQ ID NO: 995065 - protein, 192 aa, Homo sapiens
MATGKTALPCNKRLQQLMARAEPRLRTDVPGELLQKLRLGSQIFIEHVADVDTLLECVIKKVPVLLSRGMARLVVIDSVAAPFRCDLDSRAAGRRDRAICGPLGATLRELSSASRALAVLNSDRGMEEQGAHTGRRSLDETGYPRAWGITGATRSGRTREDRTRKNRGHRASRTRSDTANSPTGTERKAKQK

SEQ ID NO: 995066 - protein, 151 aa, Homo sapiens
WDEAGIKDRYGDKGAPAPGVSQVLSGVHYPPERKYQMCCGELPLRWLIGVIDRGDPSVSALIIRGTCVGYYRLIVGPEVRNQMFGYSFTYSYPQGVSGPGARRVSTLVCGIWISRRSGWSRDPYREGGSSHGGTERGDLERGNVVAYVLAV

SEQ ID NO: 995067 - protein, 152 aa, Homo sapiens
MYQSVRVINISGPKKSLCKSIKKDLLPSPQDVQCSPGFLLFVIVLSRVCSWCFLSLQSSGVHLVVCIRCEGLCLMMRITPNELMLLRMMTASFWRSRYWLGDRTRTCDINQCRGTGKGGAQSPLKIYGLLLNRLGSPGTPKGFLPPGIQAKP

SEQ ID NO: 995068 - protein, 85 aa, Homo sapiens
MVPHIRSVTHSGGGGPSDALVAGKPGASRADAEISRIRQDNSGGNTRYTSDPTGNCNMALHKHEVAQYGQKHLDGKPQCTMIKTG

SEQ ID NO: 995069 - protein, 316 aa, Homo sapiens
MEEEIAELVMDNGSGMCKAGCAGDDVLPETRSFLSIVRAPRKHQGVDGGHGPARDSYVGDAGPERTRGILSPEDTPLSYGHRPPTWDEMEKIGGYHTFVQLELRVAAEEHPECVLTEAPPEPQGRSKREDDSRSYVLTTVSNGTRSMYSVVIQDVAVPSTTSGSHAMDDCHGFWRKVSPTRWPIYEGYALPHAILRLELVAGLTEYSWKILTVRGAVSPPGVRREIVRDVKEAVVRGLVFEQEMATRSLCLERLPVPMPVLHGKDVRPGAALFGELAAEPSPEGGTELPPVWGPSRFERDPAKNHPGWAPPKTLIL

SEQ ID NO: 995070 - protein, 206 aa, Homo sapiens
GITQRVPAVGGALVAYSRSLRRFQLRASEPVSESAVDSPCCVGAGAAHVVVVGPGSASWCPFSFLLTSAAGWVIALSRRVVCPCLASYVPLPIVSSHTLPRSFSHLTSGLLLLCEVAPCYGCVTRRSAGPCRLVLAQSTASWCGGEDLPYRRHSERIATAVEPGTLTYETTSKTLHEVVEVTTRGDGMYGSHSRRLFTSRRTWDLP

SEQ ID NO: 995071 - protein, 272 aa, Homo sapiens
FPDGHCVSWMRLSIPVTISLTMDIGSIVVTHSASRSTGMWDGGTGAESGRMNGCGNCSSPEILQDSTDLSTVVDDSRRSYAVESMTLLQQDATSCVDDDFLGGAEFVPQDRCVQPGTDFIALDAEACERPGGSGQTNHVSQAQELKDNRVVAMEVEGRNLDKKDFLETSDPFLGVLPSRVMGNGLPGATDLRVINEPKLTSYDGKRLSCARFSICVVGNPKKHPFRCYCADYDSDRVTMTSHRVTFHTRLAQVAGKSGWPLHGFIPGSSVHR

SEQ ID NO: 995072 - protein, 154 aa, Homo sapiens
MRGPDPCARGMRPYDSYSHGSGSGKAMPISRPCDDPCLGIIDEEEAEGRSRRRRAGTTQRPGDPPVEREPRGQEDYGIQQGVPPVVVLSSAGALSAMLVSCVNSRRCGQGANALELFRSHVRPFWLGEISFTLMLTCAGNHARELVRSEELGGG

SEQ ID NO: 995073 - protein, 293 aa, Homo sapiens
MCDTSQRCGGGAQTLSLLCGERDSDAPVGYKGRGRQRRETHSGLLSISRVEGCVITQMVVLPQWGVNHQGGRSHLLREDPRGRVGGALRARGRFKEPLSHTKAPPIEERMGTPAEQMPPKGGLPPRGVGSSNPLGRGEDCGGATHICAQRSRHPPWGYLPSGGIYPERNSAPPAGVQHTPGLRVRAGQPPKHKDTSQGGANTGGPQLADQTAINPPLIGWARATQQTSGAPPKEGLPTRFAQKRAHHMAQLRVGDTPSPTDVGDRRSNTPTTQNFYYTPSSQTNTDVTHERYT

SEQ ID NO: 995074 - protein, 165 aa, Homo sapiens
MRQRAQHKRHNTRSHQGAETGSRSKRAKHTTDGGRRPHGSDSRTPPTATESDDTNNTNKKTRQERQPQQQRNRQTNNDTTRNTQLTTTTQQTPPGPHHTGPPHETTQYDRTQQNQTTRRHHTHHHNHTQTTKQNDIKPATTPATHTHARQPHQTTPPCRRNDART

SEQ ID NO: 995075 - protein, 148 aa, Homo sapiens
MNSLFLYGWEIEVCGRQEGCPTCTIVAREPGSTRMCRIAFNGHEGHAVSLSPEVYVKEQFAWRHFYWYLTNEGIQYLQMITVHRAPGDCAMPPYAVSVPDDLAGPSVLKVWRVSDLRESQEGKLTRDTYRTECCAHSGADKKVEGGAG

SEQ ID NO: 995076 - protein, 219 aa, Homo sapiens
MSAVCGRISRALSMKHLRWGLLPLEGTYRPRCQSSGLRDAKSLLYAVSYIYQRSRLVGGHFRVVARIVGDDLSAVSGHNPNIAGRRDEQLKHLIDLSRCPRDNQPENRLSGDLVSELDLYLAYESLSLRVAIACALTDPLHENLDQDFYNTKRLRGDKRFYADEIINVRAQIVASLSPHVKAFDKHSPSNCQLVGSIAVGKGVILRKLGLRISRTDVPH

SEQ ID NO: 995077 - protein, 179 aa, Homo sapiens
MCGAQRRPQLAEHWSSIVPLLLWGWASQRGVLTMAALQALKCVIFPRKSLDSRFRDGVRSVVPVCCLAMGTPLWLSNPFIARVKRVRACLGTVTLSLGKGRGALGDQHSLGAPPAVSPRVCVWSPPCVTEMAAGIYVGVSITTDPLVLEGSSPTRCARGRRCATCITYHIVVLLYRHST

SEQ ID NO: 995078 - protein, 362 aa, Homo sapiens
MVGVLAQAPRLELRAGLAFSRGIMTDRSTARVSILKVQPSGPDLGSRISCATSMPEWAGPYCTHSKSRNCRLAYCRSGSFAYMNIQTQDRTYNNTSGHIFISHAQIGKIQRVCMIVRTSKAAVRRERGTLETRMNNSIAKMAVRMRRNSVREDKYDVFTTCRYAFVDGEGLREVRRKYRAISPFRGWFQAPEGNQAPRGLTPRSNGPNSGHGQSSQGRHHTNGEGCKQMKHVLLQSFSPSAPDGGPFEWPSPVSQTVGHKFSTTRLGPGHSHGFTWPEEGPKEKWRRSDGNQRWLRKARFRHIMARTRDGPKEPGPRDDRYEEGEHGETTGARKGTETATTNQERAQKTAPIPASQVKHGTN

SEQ ID NO: 995079 - protein, 89 aa, Homo sapiens
MRTSRRWISGAPIRAYWKRCTWVARLGDMDLQTISRPARRTWGSSRLGTAKNLCLAGSRWVDALALVFEHRGPRLLVQPGVWLPSRSAW

SEQ ID NO: 995080 - protein, 138 aa, Homo sapiens
SNIAVPIGGCNGVSASLWCRAVSYWAVDSKCSCAEAVSDPTDWWTYVRVVPGRTSCIPSPITWALSDKIYCVCSTYDSPQSVGTELRLMEEMHVVRVTDRKTQQTISHLMPTLGRPQAVNVLICTLRPQVQGKSVQSA

SEQ ID NO: 995081 - protein, 171 aa, Homo sapiens
RDLAVRNCMLKMNMSVCVADFGLSKKIYNGDYYRQGRIAKMPVKWIAIESLADRVYTSKSDVWSFGVTMWEIATEGKLPYPGVENREIYDYLRQEIACSRAADCLDGLYALMSRCWELNPQERASFTELREDLENTLKALSSCTRSLTEILYVEHGMTGGRLLLNPLELQE

SEQ ID NO: 995082 - protein, 491 aa, Homo sapiens
QGADFPGCRTVDKLVAPCGSNERVLNLPGAAAGLACCARRTDTPGSERLAVEQAAVDYWLSLPLTFHSRKGHSDCPLNAYAKGSLGSTNGTHAHTHTHLLTPHNSHATHCSGGSRQGFCIEHSLGRPTLTWGLTGCASAGPALLAATPHHLSPATKHKGSLTSALQHNTALHSATGAAHPHPCGKALLTPAAYPPLHCLRTPTALHTQRPRPPPSAPLTRPRLTVGPKLASSPGAPGHARTLALNACSWQQHHAKGRTIPIVATRCAATCNAPLNWPPLKCHEGAWPNPTQPLPNSKSLTAKPPCRRLGGPQINPRANPQPRKGQPGRWGLAALASGSPFQTLALQRGRGHSTPGPFSHRVFGPAVVGSPQLFVPNELARATCVAPRITCGLVTPRAVPPRSRGFAHEPPLVFPLGALSAGALCAGAKRTERALRVGESLAARGGAWTEFWKTRRRLQNEAVRNQANPEATEAEVTNTPVLLVMRSRSSDR

SEQ ID NO: 995083 - protein, 55 aa, Homo sapiens
MPVENLVGRGTIDGLERQELKDNRVVTMEVEARNLDKKDFLGKSDPFLEFFRQGD

SEQ ID NO: 995084 - protein, 338 aa, Homo sapiens
ASFQLGHKGVLGEPSWITHCLCTSSLLSLTLTCTFMELDLEASAGCGCLRWQALGNLCNLMTLKSKSYNICASSSDEKTEKFVCVEKLNVLGSKGIQRGFPWYDRKSFRATKMEIGGVYEWTQIILERSRQSLFMYLEGEGVSIRDYMSVMHIESYHESVQVVHRIVSCATDGDISEWHNGECGTFHACVLLTKLCAVPWVWGLLLPEKNGVPSLICKVPLWASNETLEEEGPQTVGIVCLCVGSAQDISGYYLFLVKNSILRVCTMMCLLSTNGVPALHENAPGTTLMTGLGPRLAICEFRPPGGFPYIMDVLETRGSPPWFSGDGTAPLSWHAKRG

SEQ ID NO: 995085 - protein, 312 aa, Homo sapiens
MRDRKVSLTKIANERLGNGDKSWIERDFGKCAGHRTSSFFIFSVANMRNIQLKDHPDSALESISSECSLAENKVMMVVLGRIADLTELQYGAITDTQRVKQIGFESGDGGVSVSLAQIRDKRDRVESEWFTETRHDHGLQPELGMKQLSSVSLDPGPLEQFPHSMEPQLRQLGLPTGLKRGVVTLLSDYEVCKEGDVLNPEQARVLKLMGYEMAEFKVTIKYMWDSQSGRFQQMGDDLPESASESTERVSSEDDDSTGIGTEGLLGSSGSHWTITDGGRPLREPLYLAGAGPDWLDPVRTLGPAGVPGSRLE

SEQ ID NO: 995086 - protein, 250 aa, Homo sapiens
VSGDCGCTPPKVVRAPQVAPSSSTIRSVLTALVIVASLRPGRRVPWSSVESQVHVDSRARGFSIGPRTLLAMRLPRPSSGSRRRIAGSLLRCYASQFAPAVVESLGSNPGTSELVSYLGSELRCARPSSAEASLRCVPRRGSVRRPLGFRAVLRLRRSLSSECRGLRPRPIGLVCVPAGVAATGLRSGPECLGRMGWRLGWGLGDHPCVATMRRDHPPIDLRSIGEKNMGGSTIVTTLRDKGRSHHGAQN

SEQ ID NO: 995087 - protein, 261 aa, Homo sapiens
MLRLHVRGSSLVSSACGKKKRLDLAAHSDDPMRIERELPISASADPGMLIKDGLIDPASPDWTVHFPGLGCRERKISWSVVEGMHMGIEFSGKGYRSNARMAVLRLTWMMENEGFWGAKLASGEIAVEVVVIVNRQMYRRDGLPWKGGTGDMSSPEQTKKSRMLMVNTIRTPVGGGRLRQPALKLAGREPRHDGPTRDLRPKGRHCKAPLKSASRPRRRRSIKTLSQVEERRPRGLKTSPLGRVHTGLCDYIDAALHINKP

SEQ ID NO: 995088 - protein, 87 aa, Homo sapiens
MNPWLGLYETCGPVGPHVYDSRLPYWTRISLGLMSNLFGTFMVEIVRGEGKASIGAQEGLRTTRKGRPEAWFDFVVLGDLLRYGKGK

SEQ ID NO: 995089 - protein, 110 aa, Homo sapiens
ERERERERERERERERYGGAESSVADARAPFLWSVVCLSRSIERARGRGGVSTVACYVVGCAGGAGVYLSGGGAGRGRHTTHTIVEERDSMLRSRRNVAARMRKASKPVR

SEQ ID NO: 995090 - protein, 70 aa, Homo sapiens
AEFIKRTGTPWSMREAHAVRRKSEERRMRVIQQCEHKVLARRDGAILRLSTYARKSVHDERFFKVADQAE

SEQ ID NO: 995091 - protein, 75 aa, Homo sapiens
LLRTLCVGDERAPYELAATGEQRRANMLDPCPLEELTDLRATCYVRCAKCCSKTLMTRIMVCRISGMYCVLTRVS

SEQ ID NO: 995092 - protein, 169 aa, Homo sapiens
MRSKVSLYHPVPGRCATCPERAKHGEMYRTYLDTVKLLMRLHELLSSMNGSKRLLRGSELELQFTSFPCHIMVDFVLRELAWRAMLVMHMMISMVQRLLGGMPHMMRTVQIAAVSKTDSKSNKKYHENHMNDLEGEKIGTRFAVLMDIEQVSGLTIEGSATEICRVRKS

SEQ ID NO: 995093 - protein, 49 aa, Homo sapiens
MATISGNERIGAWLGASCRRITLSMAARTRHTANIRSTPRVGLLSARGP

SEQ ID NO: 995094 - protein, 320 aa, Homo sapiens
AGPLASLRPHPLTACGLVGKPEGLLARGCGLEFLNRCLAIRVSGRSPPGGPEPQDKGPDGLSLYGDRWSGAVVRRGAVWAWVRQDGTKRAKGGSCWFVAGGVPGRPRPTQRTLHHGIRASTVPSLMRLEGLPVLPVCPKACGNTGPGGEPFYIRAESSTRCLSRADPHALCGEYATEILRLVDSAYKRRQEWFCTRVDPSLCGTGPGHRANYQRAQQAPKVQRNAASSGNRGPAVNLKKRAWNRCGVRPAVGALQGSPVSVLSLVRRRDSTYSVGVLCACAVCVRRAVIDERRGNQAGTWGSTRPGAGPRGPRGGTQKTT

SEQ ID NO: 995095 - protein, 290 aa, Homo sapiens
MRTLGRPPTCVGRERYKRSPLCSDEGEGGGVGSYERLPTGKRGASPRPRSDNRHLTTARKQTVVAGQKKNEEVPKRGRKPGARGFPPAGSNQGHTANRGTTMKRGLEKSEKPRVVTDNVSHMCEENGAGDIDKQTERDGEFTTTDIEETERLHQHSAVKTPPQANHLTPTKVRREHQAWCNDAKAHTQQNIARQPPGDMSRRSGARPPMTNGQDDPCGHGQHHTVHARPGPQGGNTYQPGNIGTRIKWPTPRGDDQPPNRQQAPQPTGGPRHTVTPNPRYPGTGQRRPRL

SEQ ID NO: 995096 - protein, 228 aa, Homo sapiens
MAHFNSPPPEDAQWSWIMAHNPKPLNPMGGGGWRKTEEEEEEEEERGGVRTSLRLQRTLRQSKVAAHAQYRISVEQGMCGTREFTAPWRCSMSITDRMVEITRLRDPGEGAGRRTNSPELRGSWWRAPGTQLPRPTNMDGARGLDLVGTLSQLCQETLSSPGPSALRWKTRLKKPLSPEEGGLQGSLVSLGLKGQFQENDVKISGVEVHASMCGVQYQKVCNVQHSMR

SEQ ID NO: 995097 - protein, 122 aa, Homo sapiens
MLCLEHFGGLVGGCRSLGAYRSEVPPTTGIGLGIGSERRESYAPCVRQGDCGCAERLDGRRKGGISKVTAGGRESRIDEAYALERGTVALAYGAPGGIAGVRKVGNGEEFLVDEAEHRPRWT

SEQ ID NO: 995098 - protein, 558 aa, Homo sapiens
GDQAPAHPPGADMSHSLLMLHSPPKANHSQACLSWAAPLPQPMRVSGHPQLACYLLSLDAHTLHAHSTRSPPPDTSCALSRHHRSPTADSSCLLLGATRATLGLERAPLLPHTATHPLRNSHHSTHPLQDTAPIGTYCTHRTPDNTTPTALPIASPMTKTPPNTTPPSPLLHPNCKPHPTSNHHHSTPTRNQRPAHPLSHTTLYLPHPSLTQLPPSYQPTTARTTRPYSPFMRPLYHLAPSPPTRHDTPLHSPRLPPRNHLPFALGQHTTPTLTPNPAFPQTHSATPSPLARNPHPHNTGTHTNLNPPRTISTTHTPTPITHTPPTQPSLPAPTPQPAPTHHPTPTHTPPPPPPQPPTPHPHPTPPSPPHHHPHPPTHPNNHTTPPPPHHKHHHTPPHPTPTTPTPPPPPPPPPPPPTPTPTLTLSRHTNRPPTQHSPTPPNPPQTPTPPTTNTQPHKNPTPPTTSIISHNTTPSHAPTHTIYSHHSTSTHTPPINLYSNTHLTPLIPSTPALTLKHHTPQSNTYTSQRDTHQQLILNTTYSSLHIHKHNPPSTQRHH

SEQ ID NO: 995099 - protein, 103 aa, Homo sapiens
MSALRLPCLGLDSLGTRLPVPCVWLLAWGTWQCALVHPETFLVDILAEAMGASMLAIALWSCAPIDIAPTSVRGRQVRAGGSVGRSGRLKEGNPQEERDTDTI

SEQ ID NO: 995100 - protein, 149 aa, Homo sapiens
MRSAPVNPSLGIAHCAFRFPCFVHALILMSDTLSYSTCSIGILIVDRRQESRQGGTCAKSHGAIPHTRPSLFVRDTVWYSDRFRVGRPGLGGREIESLGALSRSVGRSSAGSLGRVNSRSRYAFSYTSTVVPLSLASLLQGRHCHDKVR

SEQ ID NO: 995101 - protein, 190 aa, Homo sapiens
GGEGSWQSSVSGSGAPVERPQREAVSPSLSPFWGLGKHAASKNYKSRQAGSRDVQALSFAPIVYVGLSGLTRGCCNCSKRRTVQEMSPGEGPEEQDRRRRTTESPILATFAWSRRCVNEHVGVHGSLRGPGFGNKGVTSSRRLLKDLEQKMMVTPNQIGCNAESPVALEEAKTSGAPGSPQTPLSVMTLV

SEQ ID NO: 995102 - protein, 227 aa, Homo sapiens
MLSLLVVDVGNPEEVRRDSKGYAGGTWCKSCLGSSPQEWQRLHQLTRRLLEKQLRPVYLIAWKYLQSEPHNQAEAPGPGVATLRTLPEDYTGTICSIAVVHRIPLAKLEPTWSNPLWQSDPTPGLQSGRYRQIGHRRYNGPRARIMTHSTATEANEPRGILRRLREPTKGPGTNPGGLRTHQSSVTAKENTTYGAQTDTRAQTQPAQNTQGDQRDTETRYHTPRRSA

SEQ ID NO: 995103 - protein, 210 aa, Homo sapiens
GLHLLTSVGLVIRDSGVCFVSDCAIRDIALMRRYAGECIVRLTWRQRVAAHDGASRPCSVQAPSMVRGDTHRLPVPRMWCDELLTDASKRTRVCEGPAVILIMRLLQTTGPLAFSRWDGNRGGGFGGEKKHLVSATGAGSGGFPGEHPSPEENTELKDAEVCTLKDFGRAWAAHEAVAGLRSSHRVEKSRPFQSQGEAKGNTRIGLRRKG

SEQ ID NO: 995104 - protein, 375 aa, Homo sapiens
MEEEIGVLVIDNGFRLCCKRVAFDWGLMLHTETVVSIRIDRASRQRSMGQFNGVRALGDRRTGSVHERGADRRCSQDVKALMSQVRIGTRMNTERTEYDVIGQSDTTRLGEATMGMERMLGQPTTLASDRSLGVGWARRVWEIRSMTGWEPEGPAPEPARQPEETDLDSGLTVVESLQTSPGTSVRVPIPGPVACALLYALLGPAPTGRFVHVTSLETGVTPTLVPHLTKGLRPSPQASPCVLDLGWAGDLYEYLIEDPPRARVQVHNQGRDGKSCANFRGNWATSPGILSPDGPRGYILFFCEKVSNVPRPGFTMDKTGPRYPNAGLHPYTGEDTCGPQEPSTTKRGDPKRCHSAPEPTYRFTGRETAHQKNLR

SEQ ID NO: 995105 - protein, 79 aa, Homo sapiens
DVEALCCVCCCPGTAAEVPIHSTEQKETEMTTDPQVQTEQDLASSEWREAEGHLRPAGVLPQVRRCPRVLRLRELYTAL

SEQ ID NO: 995106 - protein, 483 aa, Homo sapiens
MVWHEILSSLVSASDLARTEFFKAQPRVCTVELTKTAAVREPVRAHTVVKGGQRYHSCLVSLHSDDGIWGPDVRFSLVSYLHLIRDRDPMTLCALRLLNGESGDEKKLKQYWYKYSRIIHYSLRSCGAVSAPGRICTRRCKPQGTPIANSNGIGLALRVVARSVWNYGVVTDSSRGANRPVGACTHLIEAQRASLGVRNVVRVARGGLQPNGSPTRFDFKLASPFSPRENCKGVLPQGKTKWETPNLARNCGNDDSLFGGTFKVPDPGIQIALLPLVARVPIDMDILSNPSSIANTWVGGRPPIPKWYPEVDFAIAILCWEPNQLGTSGGGNRKGPRRFYVLPSIVGTCARGRSSIWAETILAAKELAGVSPFWVRNSTNLVWGCAVPFVHAGPRSTMERISHPRLFVAVVRFPITSCRGGPSATGNRELYTFFQWFPGAGTRSAWLGLLHKERGRSHARPHSSGIPSRVSASIEPPAFFHNL

SEQ ID NO: 995107 - protein, 468 aa, Homo sapiens
CRVWDILRDYGDRSLPIVRACVSVHTSWASHRRDPYDDTGQLILRIVPSGHARRYSPQWLVYLAGYPASVHLCLRADVALERNQQRSTTHRSGAVTLVPNGCNIPSALHDCTLLSVQHMHVMLFHILGAILSEAHGPCGTVCVTPNGACCYMMTFGGMCLTCSRCRRKRDSQVVPQSRGDDKVPHRARGSVYARAVLVRAKGTLRACDCGKSAYRLGTRLSVVTQASVLPECQPEGPMRAREALTPSIALTCGNNSLVRDVVSLQPVSADQTIKPCMLVRVSFASPVGLHENKFRLGLTRGRKCFWRLFPGFPWGAPGRNFPTVWFGRPCPHKAPVPEKGVLESAWTVLGPASNPSRGAPAGIIRSWGPGMFVPGRGGGLFWPTLVCARGARKRFGILGGTWTNGVAQGNIPWAYRRSRVTQQEVGCPTSDITRSGRTLGEKRSRESRAPVGALEHLLFHKAVHVIYR

SEQ ID NO: 995108 - protein, 51 aa, Homo sapiens
MVNFSHSGMAMDSGVEAQEGELKKESSGIERRKTELSSDRELVGVQEHPRL

SEQ ID NO: 995109 - protein, 166 aa, Homo sapiens
MEGIPPFQHKQTTFSPLCGPPVFHTLWGEFTIFHSRRERYEVGGNTNSGGLTYKKIIPFKITPGGRRCWHLNSPVLNVSRAPLYVCERATEVPGGPATIHRERSGGNTRKEPNYSVAITHAGVDKPTQFLYTLKQFTQANKTNFSPGGPFGCANCAPAYFVFPKGV

SEQ ID NO: 995110 - protein, 514 aa, Homo sapiens
MTFLVGGKYSVCQCILRRVDVSTVYSRDKECTRRSSKGDSDHVGAHDSDMGQEHVHLMKRRVIVVSYASKGLQAWSPGEGSTEAKLREPRRIALWRRRAIDNARSVQSRLKGAEERRASLVCKPKNVDVETLLLALQARVGRPDCRRTSTSYTGALLDFRNNFSLRQATQQREEAMEMSDQQASLGPYDTYMELLHENVADDTLGSTPGSVVAEIGEYGPTRHVLAADWRWYKRRRRANPEEKQNPGGLRQGTLGNAGLKRRCDPFASPKLPKPKPKENFPKAWESNVGTDSDRGKRPYLTLPPNGRRVPNRAGWHFKGGSKPENLRWLRWLQPGHTVHQGRNSGAPGYPKIRKGATHEENTYFPLMFEEPLLETPGDILRGGGKQQEKYRGYKAALCCESQGDRPWEGLSTKVLLVRPNRGQGGGPKRTPRNGGTPHGSGGHHTRAICERKEREGDERKTTLKPYSGPGGLSTQLGNKNTKKQRYPTASGKNDRHHKTRARHYEEKEEVLPNE

SEQ ID NO: 995111 - protein, 256 aa, Homo sapiens
MSISVSESRVTPAMSRVAGTRTDVNELCTRWTLQMCALAQLAGARRVAHRSVTLVDGLHLPRCQSDGCGRFTSGEFLALLRSVATAAEQESLKRSKVAQPGAWTRSRGPCQKGRTTAQTETVIAPGARTNRRTPRLKPCERCHTQRACVSDLASRLSGRKVEQVLQALRVRVGQGRTGVSVVMGIPIVLGEVHSYLTGHVVNSLISELSPQEKEDSVIVVLIAENDSKLHFGSERELSRACAPRRCILGSGGHLSL

SEQ ID NO: 995112 - protein, 108 aa, Homo sapiens
PAIRRHSGQAGTPSTVRDRPGPGPSPRLSAPSRAPQRALSVVPCPVSVRIVVMLRGHFRLARRLKILCVGVGLAMFRSQDGGCPLGKEENIIFSFSGKVNICSALISR

SEQ ID NO: 995113 - protein, 369 aa, Homo sapiens
MEEGGRDKGRRCRPSSLQRACPRLARTEKPSGKERRDAGDKDKEQELSEEDKHASRVNWRCSWNDYGETGYIPVSTLALEEIAEGVIRSSYERSMTSGAQAVSRFLRQHYGKAERKIYGEHGPLGENQAFSLLTSVSFPAMTMSGERECLKYRLVGSQEERDHGVMQYVMASGRRQWATGAGKRTEMTQDMSSVRHLHSFSPALTGTLVPLLHLARTMPEALRALRHLPYWINSTTWTLDGQPTSINSAYAKGQPRIYNKRCQKPAMKSSKNTQPVTEIDAPGIFIPETEQRRNPLHRHLSLVDTRMHARDQGEFGKRNIRAARQEQRARHESQIEYRHAQETDYTRDREENIEEKATDNNPSQTTRTT

SEQ ID NO: 995114 - protein, 220 aa, Homo sapiens
MNHAAVCMLDGPGCVRPMVATSSLGTARPEPGARHPGLPAMVNEPPSTCLTVGLEVGGLNVLCRTCPLAGAAVMGCSSVTSPPFSVWGCLVFHLWTPFYYSYISDQSSRTIQPVCDFYYRTDCDSSSHLTLTPFPCCQLSRLSKGWTVDRVLMVWTGRIVLAEELEAARVPCESRFGHVPVVNHFLVHQKVARIIFHFLRVRVMLHYRVRAAQMLDTVGS

SEQ ID NO: 995115 - protein, 208 aa, Homo sapiens
MAREDERDTREERLPEPSRRNDLEKSHSARTRIKKQQHPIRANNKAKTPRLTEKRKALGQSSGEKSKKRKKRKGEEKKSSHQAQQILNEDPKQKPLGVGSPAAARSKAESSDDSQRRSLPAEEGTQVGNNRRAGGGDAQEATKEPVERRETTPGRSAPLSNSWRAEIGGPQKGSSRRKAIGSQSHVTRARGAGTWVAGNTGGDHQATA

SEQ ID NO: 995116 - protein, 235 aa, Homo sapiens
CPGALFEFTWWLLRGLSSKDKYVKGLIEGKSDPYALVRLGTQTYCSRVIDEELEPTVGRMTYECRWYTRSQGYGRLEVEVYDKDPEYRRLHSGRMKLDVEEGVTRLSCSDDLGSLYKVGKGHTLHSEAEKWDVTFGQDAEKAGSRLLASGNWGVSVSTRSRRQRAIISCLPGSGPESLPMVTSELYPPQLKNGEQGTPTLWYNFKYRTETQESKAVYQYQTAQCGKEAYPGLRTK

SEQ ID NO: 995117 - protein, 209 aa, Homo sapiens
PLATEESSSSSEEEEVASSPEPPRSSPNGLGGNYGSKGLKVCGVLWVPGGWSLCACVTPGSLSRDEYVAHMKKEHGRSVKKFPFSLCERSLLLRPQPEAPCAELITEGYRELSLPLQVLLHEGKKRIFSSRLILEKDVQVRHGLAGWGTSATMARGDHLELWGSSARAQGQVGDADSLLTLAVRRPDRQKRSKSGRCGLDLDGMASAAT

SEQ ID NO: 995118 - protein, 96 aa, Homo sapiens
GRTVDEVPDAYSWSGARVCYLRDVGGPVVHPFRSLSQIGMLELGMLVTNDLLGRFLHRGTVEISADGEPDVRAVREPHMGTGVAAQHFKRIPTTNW

SEQ ID NO: 995119 - protein, 103 aa, Homo sapiens
MCRGQAAPSVFPARYRAHTEPKERAHQPGMMNAKKIKALLGDLKSQRENKEAEESVRNEGRRDDSPHPEEEHPQYNNTDTKQFNTNPRCHHNQLPAELQNKPT

SEQ ID NO: 995120 - protein, 155 aa, Homo sapiens
MHAFVQRLSSMRVQCRRSETDVLRGNTDVPYTGDRIASGAKVGRRSHNGSQPRRTCGKTQRRHPNTRGGAQGKTTQAGGKTQGTRGNEIIGHGYIAARGEEPRRADGTTRTTSRERNPAEEVATKSAVGPLCTPPPAEGDTGQRDPRSDDTQPLG

SEQ ID NO: 995121 - protein, 233 aa, Homo sapiens
MASIYSQPYELPPQSGDEYTGDRFLYANSVNVISEQDGHRPRPDLGSWCSFMQTAKPAAAVASTCGTLAEFLLKQDVVNAINLDGGGSCSFVLNGTLAQDEPSDQLHETTCGACSRHSVQRDCVCRNTSCPHASMTQHTGPLPVQRTSNRPEKSAQRGPDGRVSLRQRTALAGRPPETGTGQPGYQTHSLECTENKWKRNVALLMAMSRNDTDYSVDATDRYPTRHKHCPNKP

SEQ ID NO: 995122 - protein, 287 aa, Homo sapiens
MRLAILCRWKALNKPMISRLVGLAVQTIGGNRYANVCCLGRTSFGKLFHLLNFPCRDENSLEANESNAISGWLGRGLGASWGPIPFAKELQVGFSLPGTHTMHALDWDTEDWARLSHKSHFRGTRKVPLGHLWETNVKELGLGKTERKVTNRETYQEPWGQGGPTKVANAHIRRRRPSGRGLSVGKFPLTLRQDGGIRGGGSTTGGKEKTQEGYPARRGPTTWAPAKAQRAPRVKTAQGWRHTVRQGLPGGPTKGKEQAPFQEEAAMGQGHSGDIQPEVRPEGAARK

SEQ ID NO: 995123 - protein, 343 aa, Homo sapiens
ADLHDASDSSAMAAPSEEVLRLWRKSGHDGIVAGMLMSWAELTLVALIAARANRCQSRSPECESLLLHRYLHYYSTFVARVMPMLRSSNALSLLRLGAMHTMPSSTERCTVKSGDLFSMGAKHSTPSCVYAIQTYLSGSTTDGGCVSMRERSFTKQDMRQWVSRVRSISTCKHWTLRAHECEVAPPNAYVGQRMVGNLAPYALPILPPMIYLGVAELQMRTGNFGTIVRGTRTLRPQIRTFACQRGSQQYAPELRSDTKHTEFQGSLRSHSQTEFERRTYTLGGTAQRKWSQNYLPRAGTFQVCNEPPFALDIRGDPYYYRGLSFVDTSETDTRGGGDLNSTL

SEQ ID NO: 995124 - protein, 215 aa, Homo sapiens
MDIRRFILRLEKPDVDDYTNVSSLSEDACLGLLLKRDVACSIERINRHLDMLVTTRETCSSLNRPALKTNTKPGWLTRAVRYRSNSHALMTQGDKVAMYTEDRTRGASAEEDLSLLTVHPYSGALEKQRETHADSVTRADAGEAFLVPAESYASVGQQQQDVVPYEKALFPGNSKPDLVGRIDVCRARDEQVETVWCASGSYRKRGELCSRRQVA

SEQ ID NO: 995125 - protein, 590 aa, Homo sapiens
HAPGATLPPTPDIPLPATKPTTGAPSTVQLGALAYLARHRAGARERGSAVKTRRTAAGSHDRSRSGRNKHARRTTEPHAARGSTQNTEPDMTSTRAGIHWRPYHQKQPTNTPLTTTPTQDNPLKKAAAIVITAPAVYNEPQATTHGENTNRDWTHPNSIEAKTHPMTSPWASPTTQTTRHADKTPEEREAENTRRMPTGAEARHWPPSHEYRKNQQRPARQQNTTTQGKPPRYDRHTRPPPYAKEQNQQSPHKEPRGRPSRTNSPLAETQPLSGSGDAEMDSITRRHTQDGPHTRGNNFTRVSYMRPMAQDTCKPYDEQMKTMRAPTQAKYTTQQNTESVEEDPRTNPSEKRVGHTTNRRPQGATTREETNILGQSSTFRTEQRTTGATGDNNNTERMRNRSKGDQHKTTTTSTNNKRIKRRTTPGGTDKKPPLQRRTAISTRRSEGHTNQIYELGNKQRLGMKQKSNKRSRRQQTMKMTKMQSHAGDEVEKGKNEYSSMITDIMSGSAPNRDKRCNISQAPAECRHRRTHINQRTSASNRHKHAQAEAEEKTSKNDRKKREQKANTQEPDSHKYRETDDSIVHVQPVVN

SEQ ID NO: 995126 - protein, 297 aa, Homo sapiens
GNIQVEDIRIRAILSSYRTAHPSGLEGYVEVKEGPGPGMHDSVSKHWMGNDIRRVVCWHCCGLAAGVRRTSHEVPTQGDTEQCVAVDGTASEMRDWTHVSDGTCDAAQSGTYHLPGCEWLRTPQGCTPRDTRGNELISPGAEPGAYSGCVDRSLWCHGARVLQNHDREPQSKRISRNEDEYKRRQQDITPMRMAAHCSESRDDLVTIREDRGRGRMRKDWHTDTNMGNASCARATAHIDDTERHRTGDNTQTRSQRPQAGVGGTGPLRACNAETLSGQTRRTTGHGQEHRNAHTREP

SEQ ID NO: 995127 - protein, 571 aa, Homo sapiens
AKLRKFRSTVGRLNGRSGSRDERVLPEDQDFVDEDAEDIPGHKKLGAQRQDRRVGQALARYAGLSSLSLQYPSVEAPHNRMVFTVDQIGYGSERTVVPDVSCERERTRNSEQVMDFTRDCPYVVVRIPLACGEKSEIQEVIHRPGTINAHIEYQFSRFSRRRSAAKLLDRWIGINSRHAKGETERHTGHLHQVPEDVRNTCASNGKRLRQEDVEPRNSAYKSHYSATSHCHVAWYRELTGPLRACEGPNSKRIQREDNKCMRNRTKLFGETLGGSSYISFHRGTPIHTLGLFFQGNRKSPTHGTITEFPLRGSTRCNPVPPVTDCSGEVGSNLDSKAYDPPRPTNSTWPTGLALVYTRYTHTWGFGTLVTIKDQGTISHNAYILSKGQVARQARRSCEARRRIELTQTVTARSVQETYVNRRKAHLVDEIQKKQTKYIAEHNHDRYTPNTLGETQNHAATHHDISPTLGTQSGHHHHTHRHRVANEGVLTKESGAHAPAEHQRWRQGHPWLRHSKGRTWTELASSVRVYIVSGVYKRADRRPQYTPCERKSQTGHTRSNGYNKRHPHREPV

SEQ ID NO: 995128 - protein, 327 aa, Homo sapiens
MVEKVPDSTYEMIGGLGQTDQGDQRSDRSCLLSILSSSKHWALLSPRECCCMDLQALGSTTCWARAVGSSITGLYPLFRVILASRIALEHTFITGEGAHRMVWHGQLVSQLRYWRNHCLRSLSSFMAPKVALTSGSVASLDGRCSWQGVISEKIAKGSRCCELLEREARRRIRRPLEVEHRTVIMATNRIDILDLALFAQGALTRKIEFPPPNEEARLDILKIHSRKMNLTRGIQPEKNIAEVMPGASGALRVKGVCTEAGMYALRETGSPCHSRRDFEMGTLAKVMAEGRGDKTVLQETLGTELASFVVFSPNRALGGQWKCKKEK

SEQ ID NO: 995129 - protein, 141 aa, Homo sapiens
MSLNDSRCEWLYTAKKGRCRREAARTSLDRDKESYESRHDHSHRSGRARRLLSTPENSLKLFSREVVAPQDGNRSLDPTMPINRIDFRAMTQRGESCLMKEVSRKRRDPTHVLCSFGARCYKAEIYSDSDLRTGMSNDTLL

SEQ ID NO: 995130 - protein, 518 aa, Homo sapiens
ATEESDLVQQYGVRGYPTIKFPIEVEYSGVPPSELYMSGREAVSDGRDSWLKQDDTGPVRARHHCADGGRYACEQSCGSARPSVGWACSIGPSFDVDVGSSGTSWAPAGSFSRGARRRGADYVVHQYDTVLGQSSVSRIEMHRCAVPRIARRRPQRIRASCSRRFRRNRFWTWTTAPGKPRPLSESGQRAASTRHWALKTPLPLGTYITSKYDQTDQGFDLPSAQLPSGFQPQEGREHSGHPPHTGRSLLAARGCTQLHRETSNQLHLRPCVSVWPPTGKGWTGPGALTATAARNLCTPNRFQQEQAKAQECKPFSPVGPNKKFIIGFTFSTNIGTQGSNSPQTRDQNLQDQADFPSGRYTFMQRPLNMQQRRRRLDHGTGWPPLQFQPPGGGEQTPWKTKCSSKEPGNSGTNSLDGDRTNVILTTTGSYDNPSLSQGQETTKDHDATPHHGMWKPAAALVLGSDLREPKRGHQYYRRARVPAPTSHFWRHAAHYPDVTTLTTYHIDCADTHTSQATS

SEQ ID NO: 995131 - protein, 70 aa, Homo sapiens
TSTLKIIRFALVLYCCASDIDRKRDSGPDVMRVPHGLRANGVMRERRLGSCIHAECNSYLTNGKGTSYTA

SEQ ID NO: 995132 - protein, 378 aa, Homo sapiens
AGHPRRGAHAPGLRSPALAYGWLAPPVSRDLAFRVSAPVIFTAPREEKFGPGGGPKAHSESLPARGTAMPPPASPWVPVAHHDGSGCGEIPPIVLRKIFPLSPSPLAGDGEECMRGCSAEGGIPSRSEFPVEDVLRTRPQEAGISDSLTYWQASPPCIPHTSTAPIPSDGLTVVTEVIGATEIDHPEFDILTLPQCKAPGEPKTKDGNMKLRPGHPHSGMYTRLTGLAIAISQEHSRYLPATPTPWLATTRGSADSDAPGIPALVTGPNGNIRGSLVHYLSALPGACPDTRTPKHRQYPGSYGDTDPQDNTHVTKHNKAPRSDCRYQTSRHVKPEPHRAQQHLHNALETQCISHTRSPHNNADPKPNRHTPRARSVRS

SEQ ID NO: 995133 - protein, 271 aa, Homo sapiens
MRCGVRMSRRSSEEWQALSASDVEIILQSIEQRLLCVTITIASIGALDETAVALSQQRTTSVSTLDTLRHTLERSDSVIATWSQTLGFLKTRVAQSNYLVTSWDYESRPHDGYTEMTHQTTSGDHRWVGPLAQDAGWTDRAWMNSYQRHLTEIINTVLRPMYEHESCTAKTREIMKSTKACERYYADLAVANHYTPQVERGTVTYKKLGQDPHRDIRRDRAGITGPHVGAPPCRGPWSQQPEGTIEDQEAIPGIKGEHKQGDKQQKTAHEP

SEQ ID NO: 995134 - protein, 164 aa, Homo sapiens
GYLQAGQLPLRSGKSAAQRGLVMDLHSSWTLPRSPCRRSSPSLRRCRRCCGFEGRAPIEIGCGLCVLGWLRVSGATRRADLTVTASWHMDSFQVDADTAVTRGCYPRNRAAGWYLTGVWINLPWISTAFAVHQRALVMGAPLVSVADCGPYCGPSMWNKPLARV

SEQ ID NO: 995135 - protein, 476 aa, Homo sapiens
VLLLVCHDSEQSKAAMSSVLPLQMMVEDRAVCTSDIESRVGTSCPGWDKKDCGADPEGTPGEDSAAEVHRVPPHTSGPVLPISLPDNRERVDYPVRPRIAWAPTVCHVSDASVSCRSGRRRSEPAGPVLASEKIDEGDRQIRQTAAPVTDIRVVMCDRACMTRQPDGLYKARSHTKADTTRGARNDRGKDRAAKQAGAVPTHLRWATAPHLLEWQEIQFRRASTQTKIQSLGDYKPLACANGLAESNHLKESPQRDRERLVAHVSLLIRGALLWEPLNTGTTEHFEQLAAPGAYRTGIQGKKAETTVCYTHHEGMGQVRTSTLTACDTHVRTLQRDNCRDLLETDYIATETEMEMREPHDSRKMVAQRVDDTRVRPELQFETEYQKDYGTSTTDKRAQGMTREEPRSRGSETDVNRIAQQQERTIQDSSGERKQTNDERQEEEEEREDDMEEATRLRGRPGDSATPDRLDQRKAQA

SEQ ID NO: 995136 - protein, 202 aa, Homo sapiens
MYEEQCAHDRAPSSRMQREEMRREHATSNGSVASIHETGPQRSKAGALETHNLAEAVLRNIEGPKDSLQNEPEKEELLLRRGKTLLSWKLSTFEDAFVLAPGIGGHHFTADPTCLKCTSALCQECEGGDRYADTGFQSLKPLPRFQMLRQENHEQLVQVREVKATPRASRRLGDTRAPNIQPPGRKTLRFHLVRGKLSPEVD

SEQ ID NO: 995137 - protein, 451 aa, Homo sapiens
MVRCTVTLVATNIMHHIISQEGVPVGPCCVHVEQACVCIRFWRIMHVWDSRGLMPSRPKRALNSLNQHKWATLTSYTGQVIVGRQAQLDIAPHGHAHEPFTPGRRSRIYTPCGSLLIRERNESDIFFSAGRWSGPLLTYFLTGAHRKLPRFRHTPTFGALDLVGTVVLKGDLPNAVIWRRVQAMGKSMEYFRRGRIDRFYTTKGTNWESAQGDKPVQAKALKYTTRGVRIKAPAKGIYHLYGTTPETENATGPKKGLTEASQEGEAITAALRPSECIPGGNEHLNPKHPRRNASIEHQDPLGKVEPNPGLRLKGLLGTISPYADRVRMDKRTQALDQPSGSSTLHHMTTGAQSPKKALGRNWHGDKQPTNGSQRSLAHGHLTTHQKRGGRKRHPSHKHTAQRVIPTPNGRQQPGPANRRPTQRTSTRAHDRKSAHTERGRPQQNESRRRTN

SEQ ID NO: 995138 - protein, 505 aa, Homo sapiens
GFAARITGVVKTTPKSQNGKRYTDSYPGHWSLSRHTVGFAAKVHCITGPSGSSKVLVAVGQIDTIETHLRRQAADDWRNGRPFNVLHWDLWSNIVNMLKSLNRWVSASWTTRALLENFDGARAQVNSVVHLTFELGIVPPKDERAGSCIVEKRAIVLERRGYQFVTSMELVDLDPWELLLTWAGLLAVTLSEMAWYSSRSKLVQEPKKEAFAHIMALSSTWGVMHRGKHKVGQRWFGNQKTCGISPALEGPTPLTRTRGNPGLIAWDRVGFNRGTVQEQTSTTFKEHKFGALTNAPPETNQVIIASFPVDPKVFPGDSSPALGVTRNHMAIEHGREWWPKPSGPFGGFPRRALGKHKRSTTPVLRGSLAPQLAHVWDNPIGPWTFYRGYPLRHWHVSYIKPKTNARTVDEKAPVWTLASQYRGLFFTNTFAGANWVTGTQVYGPQYRKHRRWSTTNPRHKGREHHLCAQSKGISPEKSNTVPERAHTDSLVLKTSTGQQSRQSTT

SEQ ID NO: 995139 - protein, 581 aa, Homo sapiens
SDGLSADPEVLVCAQRAADASECRAPAPNTMRPLEAFLLHAALVALVQHAWPVAVVPDGPLDRGHSSNQRNMPVDGLTRRTRRDGRDLTDVTDRTRPRTDPLHRHTGHDTHWTALWVHYNLTCQTPSMRKLPDGPDQKRSTTNVHAMVKNVYTGRPTGADWHRLLHTTRHIGATRANYWIPTHCPHTIYLRTRIQHAFPPPHLPLTTGHKELRNWATPYTNGSEGGHGNQRPTGPHDALHAARYPNSHQLTGNSHLTEHREGDRTMAKQPKQTGRQTQENTTQRETTTVRSGPQVRTRNAHALRPRPPPNPLRTAPSPPSTHTIQGAQELIRTNEAHKTQHTADGRRHKYVPAHSPPPHGRNARTGPQHGPRTHSGRKHRRHPRRLAQSGPHHRTDSEQHRNVPPNIPPGHKTDEETSRANKEDKEQQNGTARHPAHPRHPDRTTPHTSHRQQEHTQPRPAPTRTRRETTDQEQREHANTRQRTAQHAPPPSTHSTTNHRANDRTPTPQTNQPPDHTTKQRHTQDQQEEERNNRRRPPAKRNEHRHKDNDTNAQKPPTARINSNHHPAPTPEHHHTRTTHP

SEQ ID NO: 995140 - protein, 82 aa, Homo sapiens
VVTVLGRPGTPRRTSFVGGGATVLGGSGCLREGWSPLSAPSATYERFSAKHVGFVQHRTHHGTKDGRCDVVAISAGRPRRHF

SEQ ID NO: 995141 - protein, 404 aa, Homo sapiens
MSWQRGGLCYTKRSLGLLCRYAPGHVRLTHAAPLRTNVPGQDARVLSPLLFPDQRLYFTITYDPSEQTRLTTATSQRLLPSTPLWSAQHAPGNNSSPGSLLHAYFPPSQISELSRDHLTPATHTRDTYTARDFTLKRQSTFARLQRHLYPSCAHFTAQRSPGRLTTLNLRESTATSTSTSLPRCCPTTQHRPSRPARRPRRTQQHHTRATGTRHLLTPRCGHRTPLSDARTPKARGAKAHCANDITPRRDTNHAPANGPTSNNQETTPPHHARLRETNPATQNTTTTTPLPHTTRAHHDSTDPRPRPRPPTPRTHPPDATTTPQNKHTTREHPYTATDPPQHATTPHAQTPPPKNPQRHPLNNDYGRTQPPTPHHTHDNDNNHPSPTEHDTARCDDPPTPNPPA

SEQ ID NO: 995142 - protein, 444 aa, Homo sapiens
AELYTGNSSAASKGMTRPSRRSQSLRPTKTESSLKLAARPSFCGLSLHSMRAWAALQGDDDKIYFFFSAALARQYECYGEHPLCPALPAICKGDEGGEQGRYSRRWNYLTSRHQLAVLTALTHGLTPYQRASRHSPLTLEHPEPQDLDVPPLTLWGLHHSQMAPTGTLQTGSADWCLSPTAGCAETSTRRHSYTEVKPEAAHSRGYTRRPQAGMPRSPGPGTQRNHPTGATSTKGRNHTSQPLQRRPQNPRMLKASRSKDTHIPAWQRGPGPEHPHKQLHCRPPAHSANTHSDQHNNQSARRPCTTRPIRAAHHTLGTLEEHSTCNPQEQKDPSVGPTGGGTNNNETRTGQKLTPAERPHAVTKNTPSEGTTTHAGATRATEEHQTGRAEQEAHSPVERIRTRRNNPPAPQGRKNTKNQKHKRGNRARRQGTNTERNRPDTRKE

SEQ ID NO: 995143 - protein, 74 aa, Homo sapiens
MCGPFAPRRERLGRDARGPHPLSCFWRLGCQREGHGPRPGIHVPTQTGWLVPTVPRTHFTPQARGGAGDKRCGC

SEQ ID NO: 995144 - protein, 341 aa, Homo sapiens
MVDRAYWPDEVVVGTRAGKNRENQYEGLASDTRSLNQSQSAVMSLHHAGWQWPVVGVADQVLTRKEFLVCMCTARVDAWTCMLPSLYALSSTRDSGTADEHVVLVTAGGTWCSMLVRHTKRHVALYVLSGTHEDARANINGVRYGAALNEPRGVVTCREVPMCTRSSNTALRRLRDSQTVVSLESTDARRGRGLADAKEHGFNGEGIAARCCTSGPQGDAVVWGPEYSRCCLMRCEKRGASKAGSACALGIQGEDGGNLLGTKGVQLGEHLLSLVAWVLKGGHTDRTGGSRPGALMGRPARGRLGRAWILPGSRYGERVPYHTGDSQQFGGAPEWPGQIWG

SEQ ID NO: 995145 - protein, 142 aa, Homo sapiens
TTLMLLSLRSDRGHGASVLREQLSSFGLTNESDGEEEEESHGDEDVEEEDDSRDLRDRAWMNVLRIRLTNGRTPCCLPVGGDSSCDTTELWPFRSSTVDKVSFDTKVVKDLLGGATQPELVREEHSPVKASWRHALRMCSVH

SEQ ID NO: 995146 - protein, 150 aa, Homo sapiens
MGKVKVGVKRIWVVMGAMVTEGLACKLLVKWILVAIKDRFIELNYMVYMFQYDSTHGQIAMGTVRRLTNGKLVHLEWIIHITNASRRRGSLHRIKWGDAGAEYVVESTGVFTTMEKAGAHLQGGARRVSISDASADAPMCVHGCGTMRNV

SEQ ID NO: 995147 - protein, 108 aa, Homo sapiens
MVWALNGREANDQGTDRRKPGWDLQAVVECFVDGHKEGTGSKPCRSVPIGTRVVFGSKAPRYLLGCVVGESVKLGAHRGLVVGPLSWQSKVTNINFVGRIVTGGWTWG

SEQ ID NO: 995148 - protein, 233 aa, Homo sapiens
MAVMAPDLLLLLSGALALTQTWMSALGNEVFFIRSGPPGAVSGLVEKHVRFDSERRETRGWRRGRRGEKQGGAGVWDTGKHQRQCEGPQQITERNEPEQTFARLLTDQSEALVSKQSKNQCMAETLRIETVRTYFRGGNREEERITDRAKRLHSTAAHEDTLRLIGDRERTIESSQNSTKGDTGGKGEPIDRGGSQTRLAMELSTWSGRGVRKYLENREEATLAEKRTPQRNL

SEQ ID NO: 995149 - protein, 274 aa, Homo sapiens
MWHFAPILSTQNTQTQTKTHSTTGTNEHMLPHGGLIRSYPYTPNPHHTFHIPPDHQRSRLANLGPPPYIRSPHYKRDPPSSKKRSDWAPTTHNDRYTTPSGKTANHRTHKPSNTGTLQPPTQTTKRAPTIGTYTSDPNYGANFAHQPPKTTNTQPLKHNHQNINANRVYHTHKLSHCVYSPPNETPYKEPPTLDKDHTQQHTTETPIKQPKPPNEKHHQVRAHQSEQRQTAHSEAGSSTHTTYNTHHRKPKGKRKRTPYTPAITPNKNTRGERI

SEQ ID NO: 995150 - protein, 243 aa, Homo sapiens
LQCHGALQEVLRRGKLGDERAESRVWGSSSVLWNAGKVPADTEVVRAPPSAYIDFGAVESRSQDSGVVAAELLNEVSNGGFYWRTISPGMIYDCGAMCVVVLVVTQMHEEACLLRRSQIELNYAQQSGHCSGVRDLEYRCMWEKEDELEGNVEKSVVEHDKGHRDKWRMEQGRLGYELCGPWVQAKTEYPIGPGSSTRSSEDGRSPGVSDAVVRSTRIIYGGSVIGANCKELAAADVDGSLWV

SEQ ID NO: 995151 - protein, 315 aa, Homo sapiens
MVLVPRRRVEQRLRSLPEGTFQNGIRNFSQVFNRSLQIARRVAKQSKGSKGPLDSPESYAWSSIAATKGHNPEVQFPAFPEAAKYEGSEESLQNTGQPLGRLEKLIANPKRKDRPGRRHEEGTKLPNKGAGHVKNPFASQTLSKEPQPYIPHTQQRNGVALRRPGRRGNDPARRPGGLELANNAEQTQRGPPTPNATGPTISLRQPEDLPNKPRPYEPRPGHMARKNPPHTSARKTDAPQQKATTRPDTCQCAKKSQEQRQQSTRGKMRKANTKPETITTTRPTAHPAKPDNTKPDRQDTAPKRERHGHNDLTGT

SEQ ID NO: 995152 - protein, 209 aa, Homo sapiens
MSTGLLVGCPGHECLVEQSLEPVPGSHAVHELTLPSEETLPQRMAAETDDAGGSWPRGTRETGSWAAIKGDAVNTRAAHPPDWFHWAPGRSTAGPASRRHAPAEAAGRLVGGDAAAGCLLVLLDDPCASFMGLRVWRGASTIAARSTAGLYSESSTAAYSLEPALAARFAQAVLCSAIWLDRRAFRPGVFRYGTQDEDSQEQAGVWGEK

SEQ ID NO: 995153 - protein, 120 aa, Homo sapiens
MPHVSAAQRIRPLLPHGLPRTSSNPGNRTMAAASKSARLRVMDAKVAWSCNNTPPDSQLEGEYHGTNAGTANNKSPPQGVSGDPSSLSTEGSRLGTEWPFGPGSIRAEAPGFWKNPMCIE

SEQ ID NO: 995154 - protein, 267 aa, Homo sapiens
GVSACHVCLVTSDRSFSCVCRWPLRYQEQLGTQALDGALRILRELHTGLYILPGLNRELQPRTQMCIQKLTVQAARVMTWVKSLEVDVGYAESSSVIQRHQRVKNFLKEGKLTRSQTSPHHRCVIVLAYVHEPGPIIYDRKQTCQRYIEIYVQTGQPEPDPGVIGGLLDVDCAERKGLKALNHGPCAADQEPRTCVSEAVAETYARTEPYGLHTTRTADSHAKRKAPKNPGKRTDERRPGARTHSAGDRTSNNEEGATNRTRKRHTG

SEQ ID NO: 995155 - protein, 240 aa, Homo sapiens
MNLWHMPGPGDKRSVDDGVAPRCPVHSTSDSENAGGGFLRIRTKGLANHPPSRVCRGGINIDCHSKGKYGGSVAVNSDTSTRVGFTTNGLELTGRSSRKQQRNIPKENHFFPYRNDPKRRGDEPRTFLGHLNGSRTKMGRTHRGKLRLEAFLKTLLEVPGGVFHHFPHAWHPDGAVYIAKSKGCPSQGTETGANLRGSNNNFGDPLQLQPREEGNMNIGDRHDPMTSTTPTNTAATLIYT

SEQ ID NO: 995156 - protein, 90 aa, Homo sapiens
KNLGIRVPAGNIPSVSSSVLDRRIKQSGIVRHAVGPPSNLTDHVDIHACLYNSSRHMALPDQGAATCEVRAASAMNLNRGKSPSDLDDTY

SEQ ID NO: 995157 - protein, 406 aa, Homo sapiens
MQRALVIVGQYCELSTDHDTSVCMSHFTNYVSISSQDAGYNVTHYGGSSIASWMFPLVLSSGLMTSIDSKIVRAIDNPLIHLIEYSHRAVPDRKLLRFLNKKLSTGANARKIAHCPVELRNYSPDLALTARIEEAFLIHLRRGSFHFLLNSIELILFPCPSCPIGNWEDSRYRVSDRPENKSPSNPISGRRHSVSDIENVGPFEMQILRYVPPTIDRRITQGVTFRETDKPPLFNNILKKSLRDRRHTGEGRHFSEKAPAQECAWGDSNRAKNRRMCGHPPMSAFLFSHRRRQKESEHDPPRERGTLPKSTAAATPGTENTEQTSAIADDNVLAPISCQQTASEFDRQQPRQKSISSCANTQRGEQIDTGGDPPNKTEGARTIQHLATKPQGGNLHHKIQPASTSK

SEQ ID NO: 995158 - protein, 414 aa, Homo sapiens
IHDSKSPGDIKPEDFSNGPRPRRLCAGWTTDRLLCFVTTVPTQTDHVTVRFYDGLTDELDWHGLWRTFSPTDCALHTTYANCVPDHPPYHNELNDLKRPDEQMILCNCKRQREDGDDDLTSKQIHLLTTLAGRQGQTVQAARRSDRPYATTIHPQNPYRKRLRSNTLSDETGILRRLLDTRGDITDENAELEKRPAQTPDTSDNQHPTHIHNPPSHINRTPPNTQTQRRTEKQHPTAPGLTPQEPHSRHSDSARPPTTRRTRPTPATRTTSHRAKPYRNTHAATPTTEKHHQNTQPTTHHNRNPQTPKDAHHSTEQTPTTTPRPTKTPRPPNQHLTTTEADQLSTAEPTEPTHTAATRSTENTTPTDPQTPPADSTTTRNRHTTTQHNTTQKRHDQPTANTAPATHTTRPPQQT

SEQ ID NO: 995159 - protein, 139 aa, Homo sapiens
MTYWKQIPHLAVDRRVSWGVWPHHPSIDQSISSRKYLQRFVDGKARTITGNDPDDPVTVDAGIGDGSPKPDASCRHDTEEAVHMVDHKRVRKFHGFKPKNISWGDAEGKKWTTHATETHVSTKFPCGVYHRRTRYRRLN

SEQ ID NO: 995160 - protein, 79 aa, Homo sapiens
MSTEVSMRMSTFKVLQLRTCSQQASEALGSPLAPINTTHLSDMRSLLDATDLSLGRLMRSFLTNATGVLSVTLYASMTG

SEQ ID NO: 995161 - protein, 241 aa, Homo sapiens
MSPTKEFRGNPHRVFDVHCPNSTPYPPWDILPNTKTEANALITQPPSRSTSIPHQTHIMTRVTPTLAHCVGPVGSCWHRDEDNVTTKHHYTILCNRTKRQSNTRTAARHDNGDMNNTDREPRTNARLTGHYQLDPLDSKHICQEHRQPTASKRQQGYTDYSGALHRTATNASHSDHTTRDSKRCTRHKHSHQHRWESSDDSKTHYIHKSMWATCHRKFNSPGPLTPAGLAPPSRATPSATH

SEQ ID NO: 995162 - protein, 569 aa, Homo sapiens
GTIVPYRDTFCLTRHAAEGPEDYIIDQCVPSQWTNTGEELYEDLRLRVRYLVARTVCLCRLTCEVFARPMRLNAETKDECKTGVNQSQTDVDCASQEADSDRSALLRPLSLQRDTSEDSPITSVDYIQSRVIGSLCKRPSQQVAEPPLNVTSRNSDFDMRIMYHTKRIDTKEGAYVTTDNSTRYLVARNLGAPLREWRTTLGDVRPMCHLIRDDSSAEYRDSEQCTVQVMPSGLVSAPAPRIGLAKHNPPAQPSQITSRHETAVVALTYTTSKHQLYDTAPANNKTTTTTRITPNTHEQAPHIPTQHQRPADASTPTLSGHTPLQAHSITTNQHPHGTKQHPPRYQLGASETNTPHAYDTRQDNRTNERLHHLTTKPEQHPQYTEKQANHNPEKLTPPNHKRTSDNATTQPAINANRHTTHANQQQQNTDRDQAKPTTDEHDRGRTHMSATTNTHPAETWRITKDERNIHNTHRGTTPHTKKTQEKQQTSNTSTAAHNNQTNRTHNHNLPHHTLSKSHSSPRRQPQTKTTVTQTTYTTKPITHRLHTDSDYTTTQHINHLQSSYNIVPL

SEQ ID NO: 995163 - protein, 132 aa, Homo sapiens
MGKTARILRTDEEEDDEMDKGKLKPNSSATGADLCQLTAGSQTLSDAVILDASSFCCVNVRGIEKGGNREHSGLGLGTSFATGLRSAHGVRSSHGGTAHPIILTRVEALSIESERWEESSVGVYVDGRAKVG

SEQ ID NO: 995164 - protein, 286 aa, Homo sapiens
GRCRVQSIIASVMQMVLICSIMEAELGELSINEMWIDLCINVGLCFAPFPGPWNARRSSGGGTQLHTKAMACMHGLGSAQVNSDALCAEATSVTSDDLSQSLRRLSSQNTVTGAMHLGAEQGRAMGIDGKPHLLSMLRTTNTCMTTWLGTSLQHPAWLLSLVRSCSVQATVRILYCTGNHGYSKVNRCTYSQGFCKGSVVHDTRARHWVGNCCPSRIIKQGSPGPNSLGMHAMGVLNVEHSPGRVLVNSEVTELRLRRGTYISPPMRRPKFHFFPSALREGFFAKS

SEQ ID NO: 995165 - protein, 149 aa, Homo sapiens
MSKFSESPKELEEVRKLFIGGLSFETTDDEPGGSHLLSNGEALTDCVCELMRSNSTKRSRGSWGLVSNATVEERGSGELSEMQGRARKDGHGERKFAGEKHKKINRTAWVLPSTIRMSSLTRCPLKLLHIQTIGGWLPRKDLNNMQLGD

SEQ ID NO: 995166 - protein, 256 aa, Homo sapiens
GIRTESARTRRRERARQELEALLNKTMLLRMTDGRTLVAASSALTVTADVILELGAGVPLSRRVSARGMHTRVIPSLPGSPVVLGLAMVPWTDTSISIRSVHEGESDRVSVISDHDGAYLSALRIKTFIDLIRDQEKIGPKTTLPEADLWPAVGGKRGSSDIGGRGSRCRGPPLGPKISCCVMPSGGVEDMLRRDATQVRGGGSLEFLEKTPGVPRGCEETMAGKKGPRRVTSVGPSEFAIVSATLLGSKSDHDCI

SEQ ID NO: 995167 - protein, 257 aa, Homo sapiens
MTPVQRGVPWLLLALGWGTSGGFRGGFVHWTIRGRGSSCRGTGPVTEDRGRLDGGKGRRNKDVCCPYTKLGPLGSMDDEASSPWHEIYLFSLPIKESEDIDFFLGASLKDAGSCRIHASAEGIIPMPGGSCTRVQGTLLLIVGRTTGPTSCLGCEAAPKEVVLRAISWVRIYAVPRLCIVPVRRGVLGGNKIWHRPTLVPCNGDQALLLGSVLGTASSLTPMGHLDIVFQHLCLKKAAHDVAWYLMTWYTSDPGLEC

SEQ ID NO: 995168 - protein, 171 aa, Homo sapiens
GAGGSTSGCAFTLDVCGTLRFLCLGDETPVGYKLPISCAILKDREWLEGKNTILDSSSGYPVGRALISSRSQWSSSELTLCRMEACVSNPYSDSTEATRRLLVTVSKTRYSCGQGCPHPSRRYVDQPSSNKLVSSSVAHWVNDHETVVVNQNHEEDVDRDKIDPEMGIGDT

SEQ ID NO: 995169 - protein, 217 aa, Homo sapiens
NASGSAPGREHRWLTAIGSRRQHALMRRAFHATSMNFIDIQKDRTIHIECPDMGKCKRSQAYADYIGFILSLKDGVKGKEADRSRYSIVSRWPIEKSRSLFSITAVTKVRLSETPPVDHASRFGSIGIQDLVCPKLMSESRNTCGGHSGPYPSGSLLCLTVAVYLKESVGNSTRIDYGSQGIEAAFAAFLCCLCKIGVLRVDDQIAIVFKVFNRYLE

SEQ ID NO: 995170 - protein, 253 aa, Homo sapiens
MSQTRLRSSDTDLVQRLIPCLMCGGRLIDILKDAGFLVLIWLTLAGCPHRGLPCCLWSLCSGLTLHAVTYWHACMVQYGERLAMGDLSGRILRSSQRAVARVHVVPSRAPWLSTDHEYSCMRERDEQLRAAAHNASCRASVRPVSGYISPGVDDYVSQLNSQVTYFCKPSAPLSGTESAFLFLTQEITALRAYELQVRGEGTGVLGSLSLPLSELLVADQLCLDRWFTAQQWSGAGATESSSYGILVSQHSGV

SEQ ID NO: 995171 - protein, 114 aa, Homo sapiens
MTESRQHIKEISDAHLIPTPNEGGTNLPQRKGKHVLTGLAKEATHSVTPLGTAQHWRDQRRGGGEHVRTGSEQQGQRSCECHQRTIPGDHGESKNEDRTSIKECEETSAAKGGT

SEQ ID NO: 995172 - protein, 146 aa, Homo sapiens
MVARLTNGGSPLLPDSIRVTCGVGTNYLKSILASPGRSKWSINRRCSMLGEQAGHGRSSMILPVGCRPTSGKPCAWEQRFTRSLKKCPSTRTLWRKMAAKWGGMKRVLGNKFRRLKKAGSAELLGKARPPDRGTAGLGPNYSGTYG

SEQ ID NO: 995173 - protein, 178 aa, Homo sapiens
AVPLRLLGLPADAAFLSSTGGVPTYLGCPAACILLALSGNGACPGLGPGPGWGPLRLLPAPIVTCLGACPPTRDEVAEQTGRDSLLSKNDNVAPHRTIARTPHWTGGRQTERARVDKGTTRDQAVKHCVKIYLLTTRQRLTHGTLNGVCPVHAHRLAEADYRLDASTLTYRPVPSFKA

SEQ ID NO: 995174 - protein, 276 aa, Homo sapiens
GIVKSRNSLKSSIDLLEDPYPMVRSTGILGVRKITSKYWEMMPPTILMGPPEEGDWGTGILTRAQLMFVVLSLSVCQEILDKQTEPPMCRADSFQLSDTVSTTDSGESEGSFVDMLVADHSCEGCYVRKICPTGAHSGSSGNTDFSTCVSAPGEPHLLILLLPVTSAGRRSGASAVSPPGADEPTPPARRFYQYAHEQHRLTKISKLIHVIAIASMPVSRGQLREPPRTRRQRRTGQPHAPARPPPRHHAPPPAPNPGPGPFGSRTTRHPTRPAQP

SEQ ID NO: 995175 - protein, 295 aa, Homo sapiens
IERGGGGDPHMIDQVTAHGLAQVGKLTLQEHARWRTIDPTVGTKDRFESLSQRNKGPCRGDVISHRAKATGEDHRRVGPVASLAPASQPNASGAPRPRFVADARRWGAPEIRKEVVHTRVPDTEILTVINSAHSGLPVRYFSGDTGRDQRQKSVSQINAKGGWVARWRARAEIKSRVTLLISLERRVRTCCDIRISLLLPQPGPGEKLTPGRHGLVIIEPPRNRWTIKRRIRGHLGIARAPRQVYHPIRPDLDRGLRYRSSKQPPVTRREKDTRKRDSSGNFGVQKGRMACRADL

SEQ ID NO: 995176 - protein, 132 aa, Homo sapiens
MQGAHRNTTCASLLALDTLTSIYSAPHFKATFDIREPTPNPSDSGTSLTQDNIEPNPPTLLSMSHSMTLTIYTHPQQLYTSHQYSKLHYTLLPRTNTTTNTTIQDNHNTYQPNTYRKHTTHTLHQTPLPSKI

SEQ ID NO: 995177 - protein, 61 aa, Homo sapiens
MVPGEEQQVVWLNCMSRTCNRSEDVTDETDRLRDYSDDDRYIHSLGHCYRRDIRRRRRQVA

SEQ ID NO: 995178 - protein, 396 aa, Homo sapiens
GWRGLAGRCCGPVDGVRSRSRSRLGWCACTVDPGNPCALPTILLLRNLERLYNECVILVLLVVTSPTPDHSPSHGEVTSTEEHENNPEYLRRAGTWHQTFARTFNTDWTQNDTTGVQLTSATALAFCEELGPHMTTRTHIYNERGRHPQALSGITRQIARLPTDPTEMYPNWSYPKTDSARQGMACLTNIEISGMVTSCEPDSHTESDFYYALLTTGPPPYYRPEPQGTTNHHNTLKKQYYKHHINPHTIIHTNTHTHPHTNIPQSPTKHTHPITSSPIKTPTHTTTPTHLPSTTGTPAHHHPASNNHSSNRRPPPHTGRHKPSARPTQYPTLKTNRTPHPGNPQERPRHNNHPVRRIADQSTAATRTNATTPLTRNQISSPLTNRDPTHQQQNRQ

SEQ ID NO: 995179 - protein, 324 aa, Homo sapiens
HKLLDEIESLTLRFSEEQENKRRMGDRLSHERHQFQRDKEDTQELIEDLRKQLEHLQLLKLEVREQRRGRSSSMGLQEYHSLQRGRAEAVEHVDGPQRLTCRDKRKLKEQNRGRLNGRDRLTLSIQGRQVSLFSRAFSESLAAEISSCLRDELMEAIQEARRRSTFRLQDYNRQDHRGHHGDQPSILEVKVEAGRSSLSWIRGLKHPGVVPGTTMRSQDPAGPTVDSAQSMREPREHERAAKTGCQGPRCERQGKARPVGVQGMRQGRSTEPARTAHSTDSETGIHTRGTHTIHGASTQTGKKPVTSTTRHKKNGEHDTTDGES

SEQ ID NO: 995180 - protein, 498 aa, Homo sapiens
GGGGGGGCSYRRGSGGSSVMEVDAADKSPSVNGPDGDEMGVLSDRSRIAHCSILKHLRRTGVRSDASQAGAAVVHGEYAGLRDIVAKTRQGPHNYLKCCSETSLLLHDCSPTSSVRNARTRIYQSGPDANILIYNPQGSDCKGVNDKWWYPTDDWEAFAGAWRNTQQRASHDMTPLVTVHGFTVNAQDAVRTQSKQAHRPFPEGLNPIVNQDEQHGSFPGTDDMAEVMVETAYQITSGTRANEVAGTRWSLDHRLLGPHERKRNTAIWELDTAEAREMNEQTRQSWGRRNTYPTKWCLTQALGFEPPATKATHSTRLACHTKTSRVQAIIPEKYGSTALLASRDEGSPISTSLKNPPHREKGPNAPPWVPTLAIPGATLNPPRTTASHDTDISTGSQAGNNTVSAGHTDRNPWAATTPEKLVTDPRPSLVDPRHTAPYQTQPADPASTHTRATTPKREATNSHHRTHATTTRTRHNRHNPALKREPSAQTNDTHHRPQ

SEQ ID NO: 995181 - protein, 318 aa, Homo sapiens
MNTETAQCTCQSITNGGDTSRQIGESVELDSHADRGHTPSGTHAHSPVPHTAPRGLHRGPVAPQEHTGKVAQHETKRSNGEAHGRQFSRVPYATTLNFGRETRGWRPFLALQRRRGKTLMDLNKAETEALLLHSKANSLGNIEPIHNRAHILLASVSNGGSLDIGMDIQTRGVLRRESSPLSAFEFPVYKRLRMDPLGGLAAQRHSLSQGNEFGMPLNWPYGRHSARLANGNELTSNISLGTLPVSGSAQHWQAASPLRPVNPKEVASNPFAFHRRGATECAWRSCQCSVLGHWSLTTRNTREILRPSKSRHEGTYIE

SEQ ID NO: 995182 - protein, 307 aa, Homo sapiens
MASIWHSRERFLVEPQEDIGLGQELRVLDRFYDTHIRFSMRPETGQLIIMETRKKDGTVAQAQLHVMNNNMSEEDEDFKGQPGICGLTNLGNTCFMNSACSASAMCHRLNRVLPQECTWRSSIPETTGHEGVTIAEGLMQDLVKAGVVWTPRSHCGHNVFKKPRWAILIPNFWVTNKHDTQGAGCHFLPGLGWIEDLIRVEGKKGGMWHASSGRKMREPELQNGWTNGRTVTQHHRTGGSNICESCPHSQDITTNHKRVWPHMGAKAHGEQHTVGKPQDKAITHKGSDSHNTPDRATQQRRGPKGNT

SEQ ID NO: 995183 - protein, 243 aa, Homo sapiens
MGAGDGIGTNRVAACTRHGTGPACVAEPRADETATVPMRPRGAQPMDRTVAKGKDQPRALGAHPGRGSYNGIPPKRVQPGRKREGGTQGHETRRRKNATIAQATHYTQRPAHRLTQLTEGGTPEAVNTGPSYGSAKGRTHSRPDMVTHNIDDLLLAITPDTGRLSGTPAHIQSAQDRGKQGNHQEQRNQHHITVARATPRDDKPRAPRPQYSRSTWAQTEERVVHPKQQSNTKRSSLVNSQTP

SEQ ID NO: 995184 - protein, 290 aa, Homo sapiens
MEQVSWSSRSTGGGELQLLTSSALGGFQLVFCGSQWVSYSPFAVGAGAGRGTYLLDLHHSGLMSEGPVSPGHSTWAWALENLRRPSSPSICNDRRGDPVTKAAGQDPTDVGPQVGRSGLPPGKSTSQHCLPREGTRLAGMAGGYRLKKSLSMWEWEVLRPMLAAKPASMALTEAVCNSREEATMMMEEPGGSEDPEVTGHPRQREEEKGSILWKDDPNVKGAEPESATGEPNPLPGGSCNEEHGPAKKGPCQGGRGTWDPGKRRHTPRASTGATLPGPKNRATYNGPAQG

SEQ ID NO: 995185 - protein, 74 aa, Homo sapiens
MDDDIARARRLTSGSGMCKAGLRWADDAPRGRLPLHRGALQAPSAVMVAAWVRKDSYVGDEVQSKRGILSREGT

SEQ ID NO: 995186 - protein, 518 aa, Homo sapiens
MMRTLCFRSMGSLGASHGKGRCSSGSTQVAAEDCQTWANVERFILGSSVCTRALGVGDSGMTRERVPRKHLLYLRHHEVIWHASQLSDDENLSETTMDEHADRHKVEHASNSKKLSWIVKSWKCFGEYSWTMNMDCIEFERTGWRDTAITEGGISRKGSRVYHSVGLGHAATGIHSRRHWLGHPEDYVAWRTPLDAEVRHLFVEDRANGACINEYPPGAWMRRHQLGPSLGSKRSAGFRTSHELFPRPARPAEHFDTEVSRESLGCRQAALGNPLTIACLSQLQGIERSSRWWLPPSCSRNYGDDCWPQAELQHLLLRCAKHARTSLTPRAGRDHPRGAHTARGRTTECAYGARWYCPIRGANPLDRGHGGRPASTPHRPVHSPETQAQTRHPWPHTKRGGTHPSDTTATGDKTPVGDPNELARTNAHPTAPQTRPGTKHQPRGPHTALATSNYDRSSHAHTTQNTHQHPNPPTTRPPRRTPPPAASTPPHNHQSSLDHPVPYPPPRCRSSDHEPHTT

SEQ ID NO: 995187 - protein, 465 aa, Homo sapiens
MIGVRGWVRTLGHVVHEARHTTSRFVTHSRQGSRLRRYLIVNAYTRARGAPIRTSYSTSVETWHIYGPRSRNGIEVLDLDARPERQLVGTPTTLCALGGRVQSILTFTPNCAIHYFVNIAINQGRGVCAPFDTQPGSGQWVPLGGPEPYASPRDGDGTSSGALPHAPNLSTNLSHSGQQFSRHLIASSSRRHPVHPLRHMLAIGHCGGFPPFPWRPLLRHLMGHRCGAPYRPPPCTAHRHSRGPPGRTKRGTCVRPHLEATERRYRHQGIPQLPSTAAPTLHSWFRVTSGSPNKDRANWHALTSTPTARARALCFDPNTCVRDNRHDTRTVGRVPLGPQELEHHRRAHKGPPVPHKGQQMWRTATLIGTHPRHRHTHNTGALRRHLSTARNELREPTKQRTSGRGSAHNTRSHTTRTAPAATHLLPRHNPRRDQHIPRADRHTRRRRDNHNAQQPHTTHAVTATA

SEQ ID NO: 995188 - protein, 487 aa, Homo sapiens
MRPCEVPGCPCHGEHLAHGRLVRCTIVDPCTWALNDSRSARYLTCTQYVGPGERTEPIQRRLLNASGLDIACPKRNRACRTAANGIGWPYATEIEKASLVLTRGVNLGIDHAYWAFNTRTWGAGAPVMDVAFSLGSAESLGVGTALSPLPGELGDHFGSVPEEDTQLLSRHFGVLILYLGFRRTEVRFSANTRQTVVAPVARGNEGTRGRRGGSLACLEGPKEALPGGNIGVRTTPLAVSRLASSKRVLEPDGTAALGKRNRCSKLAPVAVDSRVAQPTPSGDRAKSRLKPHGRETKGQIPDAPVYTSRRRHGAARQGGNTTLSPGKGAASPQKYRAPPEGPRVASWARAGTTPGPRTTRLTPRGSPARREVAPGARGPPAATHPHNWPHSQDPTPYTSYSAYRARAKTHAHQQDDTHHASHEEPDTDANTHQLTRAHTATPHSDVHGLTYRRNTTQPAAPKHHAGDSTESDATVIDRMTDSRHIDT

SEQ ID NO: 995189 - protein, 398 aa, Homo sapiens
MRRRGMTQAAGLGTIVHGAHWRRLRRPEGQPGAQQRNERGAEDGRSHTRLLGLELLGGDIRVISGHRMRSVRSGNGRNRLMSSPEGRFTGFQVTGKPPDGVGVRHEGAASGPTPMFLVGPLKCTTRTLAPDGLSANVGLVGAQLDTTPVICESHLMLAPVEKRLRTRTGPARSAAPKNRAGTVEQPGEHLRARGTPVTLNEPIRHGGYRHGEQGATDPSWLRRLRRGPLTDEADYGTHGRKNIDGVQAPNRGTPSARDPQGRINGHYIQVCRNPIGDPAKRGRGAQAAPEDIPLTTEHVPRALITRNRATGTRGAVTHNCEIASCRSTHRTSARSRARQRQDAQKNQHNVDTSEPKHYSETRIPEQNNTTTNIQRSELSAQQHSAKSTQPHQLDDASA

SEQ ID NO: 995190 - protein, 425 aa, Homo sapiens
RPGARPADCCHLHTPGKHAPSPTHRTATSTYHHALPARTTAPRAPPLRLRPSSSYHRTYPHTLPCTHPEPLAALTPWPRPPYPARLLTQPPLARLRRATPAPSSAPRPPAPRHALTSLSWAQGPLAQHPRRRSSSTPLAPPLAHALAHRPCTLLPQPSQRPADSPERTAPNTHPGAPKLTLSYPPPPRGLSQPGLAHGCHAAAPPNRDRTGPLPQHTAPTPNAASHAPKPRPTGTHNPPATPPPPHTQLQTPPLNQRPTRDGATPDHRTNQRRGHPPSIGPPRRGASLPTRHLSRHTIPASPPHPITHTPPPQPPPTHSPRKHPHRPTHAQQPATSEHPPAPTITHTPNIPHPLADRPTPPTALPAPPPTGQHQHLTHTRTTHTAPTPHPPPPTVTPPHTSPPTTTPPTPAHSSALLESPPHTTQ

SEQ ID NO: 995191 - protein, 207 aa, Homo sapiens
MRTTLGRSDVDSYSWYTIMCTCSLQGSNKKEAYLMPHKKLFDFDLGGDQFVQGASNVVSLGSLDSRLGFVLVRCGVVQFVEVSGNFGPQGKFGDRNTRKKQCRISRLVTSNVERWLEDERILLSGGLSTYTWDIATGIPTPLSEGHAKDELSDAETFALRTWIRSKASLSRILICNWPSEFTKPTRTEPGVTLLLWWPKCILGLWVH

SEQ ID NO: 995192 - protein, 154 aa, Homo sapiens
SAPHGWQQILEDVRGAPAEDPVFTILGPEDPPVPFRMMEDAEAPGRAVLPVKCRAYVGANTACMSSQAEQCAEAIGVSSCSEAATAPGAGGGPDEAGSYYRCKLSKACHHSGVTLSRVPDRSCGQRSEGGLHPGLSLGGPSAPDWHSGFPAPRG

SEQ ID NO: 995193 - protein, 399 aa, Homo sapiens
MLTLTSQDPTDVLLSVCPQVMSRVLSTREGGRRAVIRRSLQKQASSSVLMWDVVVNMVKACVTPQPLKSSSSCVGLGGYAASMDDRLEWVPDLILLTSLLAIEEELPYHGGPECDVMTGSRDYELRAIVIPHLTFGRDALACHDPTLIFASTCSPLTSFPEREGDPVVHVARHYRHRRMGHQVNGEQIGLRTLDPLKVPNLVWGTLNASNSKGRTIVSGISKMVARFCGHRYLGDLTSLAVAVNQLVWRKGIGYAPRLVLYGPSIKGIILHPSRRSIADTRGPDALSPCEGHRRMQCPCPAACRPSFGWHGAQRSVGSFPHHGGTHPLAYNVVTQGVPQLDKSHSGQLCGPRSVTHLVIILLYTVVAPTQLQWDCAGSRIRNRQYHDGQSADDFRCKCR

SEQ ID NO: 995194 - protein, 215 aa, Homo sapiens
GELSARAVNACGAAGVGAAGLTLCPLTPVPVLIPCEPPCCCPCTLTCAQPGRQRNTPYARLLCLCLMVQAEAGLLGDPCLGPETWGGLTMDQVTASSAMSSDCDCGDHIPPAPPSLEETDYRQLEKELQGQNVEAVDPRGRTLLHLAVSLGHSESARVLLRHKADVTKENRQGWTVLHEAVSTGDPEMVYTCSPTSRLPQHIHGPLREFLSCPQN

SEQ ID NO: 995195 - protein, 118 aa, Homo sapiens
RSSSERRASQGRRFTTYFPYSTRQAGASCTFNLCFPASLANPRHLTQRRRAPVSAGASLRPPSGSARVLGTQRAAAEQVRWLPDCAGQPIRLLIATTGTTGCDGSEETAQCLWGCACH

SEQ ID NO: 995196 - protein, 71 aa, Homo sapiens
RVRPRETQSLDLVRSDGLVHHPTSSSPWDDDIAVARTSITVLGDVHRRTSAGATNASPGAATIAPHIRGSD

SEQ ID NO: 995197 - protein, 130 aa, Homo sapiens
MYAIQNRPLFRPCADASKGDDRVFLLATEDYIHIGMSAEKRQEDRLLVSQGIADDYGSTQQKLVKAFKREFGCNGTVIELILEYGEVILGSEGGARREHMHSSSLEMGRVKEDQLKVHGSASACGSLKLT

SEQ ID NO: 995198 - protein, 220 aa, Homo sapiens
MGVPRMGRLWPRDMKYGSGWRVCAEQGVERGIRVDSSFLWRMLVALGLLLFFPQGHGRRERTGYGSLLLQNSPGTAFKSSLHSAGIKMPVTLVTTVDSCLQHAEGSRNPPGARPFPSPPCGQQIVRLLVETEGRTSLMTRYGGVCTEGNNTRGPQALSPGVHSGLTLNCGEGRAGGAQTLPHRERATRGKGCPQQRGGGLRAHPPARQTASTSGAAHKGG

SEQ ID NO: 995199 - protein, 138 aa, Homo sapiens
MERTVGKELALAPLQDWGEETDGLVRCTVSSLTVFWSSAGARLEGPGGSQAPSPIANTFLHYRTSKVRVLSGSAACESWLGGDEVCVVEEHPVQTGQTRRRYIAPGRSMGHRYRDLLYATDCLLGFLAATNATDPNSR

SEQ ID NO: 995200 - protein, 351 aa, Homo sapiens
GLIGPRATTQREPSWSSSVRDVVEGRSQKSLGLVLRRGLRRAGATCSGRVRNGVRRWAPCSSARMPGRCTPDRGMNSFSGHGASPRDGVMTSGWCEPSAIASLSVHQLVENTDETRTPLITEALYDICFRTLKLTSPSYGDLNQLVSDTMSGVTSCLRFPGQLNADLRKLAVNMVPFPRLHFFMPGFAPLDQPGQPAVPGAHGARAHPGDVRVQEHDGRCDRPRAYLTVAASSGAACPEEVDEQMLNVQNKNRSYFVEWIPKSGDGPVLKSGPGADDVGTHREQHGIRSGKAIPNSRARSGKAPAAGAGCARVTRQHRRRGTTAQNGHTAQQRSAHTPRTTATDKHESETE

SEQ ID NO: 995201 - protein, 290 aa, Homo sapiens
AAVDGGGRPGQGRPVQPQQSPVGGPPAVTVREAERYEERRDAGDKDKEQELSEEDKQLQDELEMLVERLGEKDIIAWYRAMRLVGTCRTASIRLLRSNLRMDVQVAQGLSEVSASTLWAKLKVKSSEEHGALGRISVWLLTSSPSWAMTMSGERECLKYRLVGSQAGIGIMGSEYVRASGREKWLRSGRSWMTDRIVQRRAICISPGRREICRLYTCATNAQHDGWRPGPCDMAPRWDIACGTGQLTAALALCGKGSAAPGFHTVEVNYCGFLTPLRNSLAICDSTTRTC

SEQ ID NO: 995202 - protein, 74 aa, Homo sapiens
GKGGGLGEKAQGRELVKVVSGDVRYGPESLSEFTQRVRMISEELGGLSRSQCRRLRGKCESLMKGRLIDKSVCV

SEQ ID NO: 995203 - protein, 94 aa, Homo sapiens
MRPKARTSEESLPITKNRAITIGEVQPWKKGAMPRCAGGTTGRDEKQWQRVASEAGERSSPCSGLCQDFPGCKSGGSCPRDPKWGLNFSTVGPK

SEQ ID NO: 995204 - protein, 132 aa, Homo sapiens
MPGCSLVRELGELEKWKCVKTPSSNKDLKFMCEKNQDLRSVNIQIREVFANRFTQMFADYEVLGAIPNPARIRNPGLPTGSKCKTLIKHLFCQISLSPPALPLKIPGDAQEVVVASFIDNKIMCHDDDDKDP

SEQ ID NO: 995205 - protein, 235 aa, Homo sapiens
AGVSDCIPAAATGLESDPERTLAMDSALRDPYNGRVAEAGRLPTKQNYAAVLPGPRASALAYGSLLHQSWVRLAIFYLGAAVASWYCCALEGRRLHRMTEIITRPGIACPRSCIDLVKLHISLGLVFSYSKNYSSPGVHLMLRAVHGISSCWESCALSQTHHALHEEVFTMPAFQIESISCSSHRVLGKNEEEIINYEFDTKDLVCLGLGSIVGVWYLLRKHWIANNLFGLGLLP

SEQ ID NO: 995206 - protein, 469 aa, Homo sapiens
PLLVQRALPGQVKRQGSDGADASDSAEPWTHQTAHPRHAKQLQGILLTKDTGLALLPAHSHGSVDSDQTEATPRCPEAALDRTPTLRPRMAYSRDPNVTTRPRKHDTPCPAAQTHSTRPPMTIPPCLPNPTPSRTTHHAHSPLQPPPLRTMSPSLLPFRPLGLRPPATTPSTTRPAPGPCTRTCPCLPPPATPPPARPPPTPAPPPAHASPRTPASRPQPPPTTPTSTPLHTATHPSPRTNPAPPTPTHTPSLPPLAPHYPTATTPTPLGPSHTAPANSPARPTPHSPPPAPHATPTYSRPLAPTPPTATAPIPRPPPRQHSPRPPPKPPPTTAPPTRTPRAPHHPTPRARATTPRPTHRPPPQSTTPPCTHSTDPPPPHPPSYHHAPPLSPNSTHLATPITPQTHATPHTHPPPHPPHPLSPHRPPTTQPHTSPPSPPTHPTHHPPHHHPPTPAPSPNPQITTHHPAP

SEQ ID NO: 995207 - protein, 101 aa, Homo sapiens
MSGTFRSAFKSQGLRRNTRDRKRKLAPLGNAGHSSAESKRLSRYQRGRPFTPPRNAWFYESGRGEVPGRAPLTDIGASAATLHEFRNPTLMASSKANNRGI

SEQ ID NO: 995208 - protein, 625 aa, Homo sapiens
MRLSVRTADVLSVPGHCGLGSLGMRPAEPRVRQADLNAAELGDCRHGRRSRARITCATELPALCESPLSRNPSRACDSTRAAAMGRRVPLSLQSARTPPHMCSQAPRPPYASSQTRAHRVTAWALSRARAHLATPRSVDRGRSRSPLAVCAPALLLPRERTIAATRQSPYDSRERLGNTAAYVATDRYSLARAAGPGACGDNVGRRACPPVPTAASSCACMLPGPRRPCTRFPSLAHRLAIASSPVLPRPESVARLPLPGILPPRDYLDPPPRLGPTLNPSSSPQSRTPTSLNSPVLPPPGPEVRPVDCPDPPLPTHPSPSSAWQREPRQSPCASRAWRAPCLRPAYPPHRPHSRRQNASHPKATPPTTATPKAAITHIETQRQPSTQLPTQYNAQATIPQRRPQQATCNTEDKPGSTYARKADSQNMHKHSTPQPDGAPSRTTAQAQPERPPLDSTLSTKGQKPSTPRYAQRTRNPHANPPLRTQPRRQLHTREGHHPPTPAHSTDDPNTPRPHKQHKQPHDSRHTAHHTSSNTHTNTHTTAHAAPPPPAPTRPTTRGPQPRPRAATQLNSTRHAHHTTAPKHPRQPPHPPHPTSHTNNTTNQPTTSHPHHHTTTAHQTQHYTT

SEQ ID NO: 995209 - protein, 278 aa, Homo sapiens
EGVVLGVLRGAPFSRPARGVGGRDRGREMCVRAAARRCGRRAQGAAGRLGIEDRLPGRPGAMCRQGSGARRLLSSFIVLSLLYGTVVAVSVRMARGRRYAKAGQRSMRQYDENRPGVDLCALGAVSKAGVYTSRAASACSPSIVVGTSHECSTRRALVPNPSRDGGTLGMRRRCRLVDGLAVDLTTHMTECSPPTASPLSEHLIDSATVGQSNQCHVGNGLRRGSQHAYAHVATPAHGQMRMGVHDHDPREYPAMKPQSMVVHVVGKLTMGDRQASAP

SEQ ID NO: 995210 - protein, 589 aa, Homo sapiens
GSVVCDSHTVSRYEGTRWLLYRTLVTDNCPYTYSATLDDIYADPALLLQLTTRKTTENVTLADGGLSQGKYEIHGSTLLMVHCTAQLALHAPTPQPPTPNSDSKPPNAHGPPPQPPPNTQITLRTGAANLIQATPGDLPNSLNTKNHPTPKPPANPNTPEIALHLNEHWRNPPLTTHPAPASALHAPSNDPNTSAPNPLTMLRNATAPTIAPPHQLAPHTPPNIPLLQHAHPPTYTSENPPRQHTAHAAQPQEEALGHTHSQPQGTHNPAAHGPIPSRRTTRKPHADAPPTTSTGTSTTHRTPNTPPPHPRRPKTGPHTTTHNTYRHNVPPTRTQHGHPPHAPAQSNPDPHPDNAQHTHQDTAQAWRNPKPSARHKTHLLDPQPHGNTRLATRPMHQHHNTTHTLPHPNESDHPPTVSQPSTATTRTRTKGHTTTDLRHPQQARPSSHHRRHDRQRPTQPTNPGTRKHRAHIETPATPRRLPRHDTTSNDHPDTNYTGKPTHTPEPPRHQKRPLTTHRHRTCGHPRPPASAPPTTRPPYGSKRRHKNRTTHSHRPQTNDTQHQTTPTRRAPTTQTTTHSPTATTPHAKP

SEQ ID NO: 995211 - protein, 223 aa, Homo sapiens
MRFMRGSDHGRGSTLGCLAVYSSSLPKWSEPKAWHKVHVLEKEANCGMRWSNQREGLPWRGDRAPVIGHQQTLVAGLPLLHSTRMLLSRASQLIQEPVTEKERGLKASSGLLAALRDRFIDKGSQAVLPIGPFPQKGSCAELTPLVVIKRRFISTQGTVQAVLSFEANYRRRGKWHPTVEPPSRQNFSSRIFPDERARTLSFHTAKVLHAVYVTLGPAKQRMW

SEQ ID NO: 995212 - protein, 423 aa, Homo sapiens
GKCRVLVAVTPRRYQLGRGEVEVKRELGEHVCCRANRKLEWCKNAAVIKLWTLESKQNHNSQAKHPSTSPTQQAGTTSTHQTTQTAHTPPIPCNTRANRATQTQHTDTRLDLYEPSTATRQPTHPRQHEAAVSNRTPNDRQHLNSGAPPLYHTRPNQLQRTQHAGNTQFMRTTTENTAPPTAPPIPHRAYTATPHTQPPRATPATHQPGPPAPRQPPAQQPTGPTPSPTASPQLMPPQPPTPPRHYPQQPRQHLTPTPRAPTEHSQRTNPTPRRYAPKHRRRSTYTTWTTSPQRTRPNHDPRPHPTTTPAQPNHPRPRHRPHTPQHSKPPPHPPAPTERPDNPTRPTCPPPRAPPHHLPTSPPPADRTTPTPPPARAPAPNQRGLGATTHRTPTTAPRGRRGRPPRTQHPPPPPHRPPPPPPR

SEQ ID NO: 995213 - protein, 160 aa, Homo sapiens
MSPYKAPPHKRGLPVCRKRQPCQCAQKSLLGTHTRGSNGVQTRPTCLRQYRGTRDRMSHPIQSGRTHTASNPTQQRHPTREREAATPSHTNKHTVEKRVHQHEQVDYYTPNCARDPAPPHNPAPVLKRHTNTKRNPNTPPRRTTNLAAIKKNNTTKTRTV

SEQ ID NO: 995214 - protein, 295 aa, Homo sapiens
MHQRIDTHALPLPRGLTHAHAPHMHRNQIAHYTPHTYGTTLLRRTHRTARHPIPPSSHTEPPYPTRDRRPIPLHCPRRRPPAPHPCPHTPQQPTPWPQPANTLNSQNPPRPHSAHTTHTARTRPPHTQHQATRSTPLDRTTGGESPEPTPTPPPPSLTTHRRQHTQRPQRHNGPGPDTEHHGTEQTPTRTTHTHTNPHHAKHTSANVNTPRNNTPAAHHNPHHNTEHAHPHADTENAQHTSAPPEDPTHRQPTRSHPSTHSPTPPPTPTQRRARTTSNTATTHARTPARRAHAET

SEQ ID NO: 995215 - protein, 188 aa, Homo sapiens
MVAISVRLCDVRMPKVFLSRAKDRAASALRPCPPELSSLDELPEGCGNGIPAGPRFKTYSVPGLQLQNSPGPVGPTHYFFGRGGEITHGRVHHWRTSHFHPGDLGSAYQGRLAHHPEYRVECFLALHLPFGFELGYPSALIDHLDTCHSRCHLYSKAAYICYTHKSRSRAADTVGLLAPTRSVYTCPP

SEQ ID NO: 995216 - protein, 453 aa, Homo sapiens
KWRMTPVQRGGPGGPGGPGMGNRGCASAAAFRHVALRGPGLAAVDGGRGRRDSGALAGPPTPTALRAWLPAPARSRPLAPPAPATPSRSPETRRTPPLLSSPCTTPRALPRTPSASPSLPCPAPSSLHAPLSDHTRNPTHCPPPTTATPPTELHDTQPTNPDASTRPTYTDSALTSPPPNTHPPPTPSPPPPLLPPMHHHTPAPNTPTHLPPHPHLPSPPPNHHITPQHTHTTPTPHPLAPTHNISSQQRTHTHHQEQHNENKHKTQNQAYHHTRPHHGAHGHEQSPQHTHTTAATLPPLPDTHSTTPPHTRTPPAPQTSPSPYSHTTPAFTHIHHPTPLTTLATATSHTPPTPSSNHYYATTPTPTHQNQHHSTPTDTTTRSPTTPQTHTHPQTPTYTNISKQHQTKPTPPSPPSRHNPPRPTTTHASNHTHKPTPPTPRTTTPNTTHYHPH

SEQ ID NO: 995217 - protein, 125 aa, Homo sapiens
MARRGTPPPFWSKGATNTGARRSQAAQWCAPLISRGRSSCRLKIWQPTKEPQRRGTSRASQAKTRPRGRTTSRLSAWNHGAGAQRASARDSSGMRRNPGGPRGHPDARGGTHKTDVRRRPPRQQR

SEQ ID NO: 995218 - protein, 62 aa, Homo sapiens
MDYMHGWHSYTTRNYKNTTEGIGPCTSPGAKKPITELKSTVAVEVTPNAQTKHHAPTTTKTN

SEQ ID NO: 995219 - protein, 265 aa, Homo sapiens
MGFVRGPRVCPSRAIHDRNAYVVKRAGRNCPGVQLYQRLEKAGRKECGPQEASVSYIAQTQFVRESLALGGDTKVTQCASKVPEPAASYSALDKTPHCSGGQRASKPLSSSGAVSSPRAEHLESRQLGGKVKFPWDPKSDSRTQPNEIKTEQSWGPKGALGEETGRAKWRIRPETRDTKRKRDKGKTPANWVDQQSGGGHKGAHCKTQTRTWEQSAHSDFAQTRGRPRPVVGALAHGKLTYEKPRTNYKKGVSITPEEYLSKHRV

SEQ ID NO: 995220 - protein, 340 aa, Homo sapiens
GVFCAPGPLSFRRCRGASWKPRRAAEWGAVAAGPGWAVGARSQRCTSEVARFIMEAGVSLGLRSIPQVVAACVAAIYHSTASLCRRITLFAYDPYLIATVFNCTWPLQRWESTHLRTRDIHQCVRLRYFNPKSVSPLEFGLPPSGNSGNSIVQCALLMLRVLRFQVSFQHPHKYLLHYLGLPPGTGWNRHSWQRTPVAVPAWALLRDSYHGALCLRFQAQRIAVPVLYLALPVSELRCRAGPRCTRGWQVFTAPSKPIIATLALPHTVSLGGVPRSGQLPRSQVRPGLPRAGWPHVSCVRAAHTSSLPQTAVYARHIVPARLARRPPACSFLSFSSLSPP

SEQ ID NO: 995221 - protein, 63 aa, Homo sapiens
GRGSRTKEQGLLAGVDPPPTLPGSLRKRALVYYATMTAKRLQAEAVRDPVRPSVNCEQSSTMS

SEQ ID NO: 995222 - protein, 408 aa, Homo sapiens
MPSSSIVPAHYPNDIPSTYTDRRSTDPIPFTTHNSTRATHTSDHTRNPSPQIHPELYRDATYHSSPTSLTTQLSHPTLILPYQPTTRTHSRKLTYAPASDPHPRTLTYLTPDSRHAPPRLPPPNTDTPTNPTQPHPPTAPTSRISKTSVTHHHIPPRLVRPTPQHSDHALPPPKHPATFNTPPNQTSNRTTPHAAFTHNRDPRATRLTHPHPGPNTTPPMHPSPPKRTPNTPHPRTTHSARQHTHPASTPSNLNTTPSPTHTTPPRTHTHTSGPPAQIPTPPSTTATHPPTVTTTPTTTDNANGHAHPNPPRATHTPTHHHTPPDGPHHTHTTQRATRSATPANRPRHPDQTHAPTARQHTHTPAQHHHPTRTPPRHPRPAPKHTPHETPPPHPTTTPTPTTHPRPTR

SEQ ID NO: 995223 - protein, 364 aa, Homo sapiens
GKTVRPSSVDVEGHTGELVPQFSPHGSVLLAGALSRAQVISLVTFFLVFHCGSQRLRAPSLQPLCVVGGRRSRPACRFLHQSQRLPQSSIETAATEEALCLGECRLKFQTMIAVGSSGLIKRRMIFQSPMDEQCMPRHGWDIQLRDALLVPGRWATSRGLIQSRGKGAEIPKTWKANFDCAMNSLPDIEEVKDQSRNKGSSAVRVYRMLPPLSKNQRKDRQSKSSRDATEQGKRKSCADSSPDTFSDGLSRSTLCLMTTAAYTSSRLHCRTWEVGAGLNPALVGNVPRPAALLPEWTIPSGKLVPEQHPRDPASTFPGAPQWASKLGGGYTELVTDERGKYLRALCEVLCHWDVTTKRGRGSTQ

SEQ ID NO: 995224 - protein, 131 aa, Homo sapiens
MGLKTISALGKVPHELYKHTAQEISQKHTAQHRTSQQVHTTARNRTSGPTKDIQINTPPAEKGNPQNDRHSNSTKKSDHLAHPQPPAHTQAPDAPNEHHNSQSITAQTHSTAERSDVHNADHAANQHAQRS

SEQ ID NO: 995225 - protein, 539 aa, Homo sapiens
IAAARVWRLDRGFEPGCPSVLLRQPGAPADLGYDLTPPWQQAARFIISGGQRPEFRRGLRGSSLDDVGIHPDPTVISGNPHLTELLMEPVKCQITQLPARTSTPDRTDHRCLERPLLSTHCTTDLQPRTVHPASPSYAACLSRAQGPGIFTSTLQPNLMRQHGSEPPANRCRDSCPPRPPWDTNHRAPLRCSTSPTLHPAQGPTACCPATASLPGATLTAPLAHDPHSPTRDTGTAWRLTWSPQTKLPRPRNASCGHHTMRATPTDNRHPRLTNPKTAPRHKGEKPAPNVIQQSHPKLPSPIPFPTLEPPNRRTEKLPAYHSDRRPAQPGPARRALTDPTSPKRADAPLKRSPHNPSTDSAPHPLPHTPLRDTNADRQNPTHVKRSEARAPSMSRGPYQPPPPPAPPTPSTRAPPTQVAPPPRPRTNHQPDPKRHKPFTHRPPTHSCYPRPNRPAANYGTICHRHEGPHATRATHGLNHGLCTRHTSSPYGSAITTTTTPSSSHDDPQENRNHHTPTRRPSPTGRRAPRHPTHKPQPVQ

SEQ ID NO: 995226 - protein, 418 aa, Homo sapiens
MSQDGGQMWDRCFNIRKRFDLQQLQSRTRCHRNVYWRTGRMKREQSQTRGLIEQSRELQEEHSRGIAASKASASCLQAALPQAAASHCTELNTASHRHTRAQTSLPRTCSYQPSIALARSPRIPLPASWHPRDQHHSSLKAATLPCTDYPPHQQQPTTPLAANLCDTTYQPTELSPARVPHTPSSVPDSHSHLTQTEHIPPTYCTQTPRPQPTKARTTPTKPPRPHTGHPPPAPHTLTPSPRTPTAAPPSLAPPPAPHSLHPTPPPPATRTTRRHSTGTRSPYPPPRPLRRQHPTQTNHTDPAHPTTTAPQHKPHAQRPAQPPDTSPLHRTLTRDKPEAKRMPKTHSAPPPGTPLTHNNSPNENTNPRPNGPGTKRRPQTYNTMRPDSNNSTATHPPPPEQPDHPLRNKTQTPEHPPP

SEQ ID NO: 995227 - protein, 137 aa, Homo sapiens
RRGFLASTVLGRKPGARSPSRPDRPLAQPILSTSFTRNSIGRHPKDRLGQLSSLAPGQLNTHWRPGSTSSVSARAARSTEFRVHASGKRCRPHEILPTQCTFEYGPTKSNRVARVTCWHASYDLATVLMLDRYCSMT

SEQ ID NO: 995228 - protein, 111 aa, Homo sapiens
MRGLGKHRTLKIVECNSTPPKGHNDHMLEMEDCLGFPGKPYPFCTLALGKHAYPRRETNLVEATQRCNRSMVTMCHYRLQKYEVLKDTANQTRLLKRIQIMIDKQTCSHRG

SEQ ID NO: 995229 - protein, 292 aa, Homo sapiens
MGILQSKRLVQDLQRSKGDIRSNRIVGRRCLWQAKLRRGGSTVVHELAVRRRLTLASTLTETAGTHSPMEQWEPDPTVQLSLGVQSSLWRHSSGRLLVDTMGEYVWYESPLGQGDTRSPSHLSLSGCGTRTWALAGHRLPPSRGSRSSCRSDIFHLVGMFHASVGTGSSADARSPSSPDSHLAPALELSSASVGTVDVDCLFHCWSLWSPLLPRLGLPSFQLSKKWKPGLRPCVSGPLTALPGPVPSCAETCSRTDFGEGLPGIAHGWFLLPLCLPGLGVALGHFLKCQGQC

SEQ ID NO: 995230 - protein, 179 aa, Homo sapiens
MSPPHEINTCQRAAAILTFDPHNPHVTLTRSRLTRLLSDGHLQHLACRTAQPSPITATGASARSDYISAPHTHSMQQTTSRPYSPHPPHTVSHTLTPSTTPCDPALMWIVTPLRRDDATTRHLYPWTHGRTTHPHLTSQPQRTTLLYPRHARLYPTQLSSHSPDTPPTKTSNIHPNTTI

SEQ ID NO: 995231 - protein, 190 aa, Homo sapiens
GPTGRWGAAPHEHQSRVQVLIASRMADQDPAGISPLSSDRVVASCATWGRVVTIVSFDELAPWDGGESVRLQIVMLASLSGRAMLSALRSHVRVGSLVAYYSILPFLSSEFSSWWNVSFRVIARVRVLASLVVPCGPRWCRGCDQLGISSTANAVFIGYRVGCLSSEALGEARGPPRDSLLVDASPPNKR

SEQ ID NO: 995232 - protein, 149 aa, Homo sapiens
MGALLVSDAEGTQTLKGNLWVCWEHWLTLTDSEYVDAHLTPTFGRPPLMQQTGLFYLSMVYPLQLLCTAAAANARMTLMRRQHDQQKRESLRIDIQHSHELLMTDSRNQITNQGQIFNPHEMAQYISIEQTFHTPSKNNPMTHIHLNRT

SEQ ID NO: 995233 - protein, 99 aa, Homo sapiens
MPAAVQCVLRKLLEEADGAPKREHSVSMKVDACDVVKPIVCRSCHGCALCIGDSGHRTGGLPLAVKRPENEDASRGNSEEATNREKSNRVLRTNIMPRQ

SEQ ID NO: 995234 - protein, 321 aa, Homo sapiens
MARLLPKSCGPMFSDNRRGQVSDYVTGALAQGAVAGLRVCVLTWWKAVGVNLYAQRCPADMQGMTQVQSRDQCCPVDTVTNSNWRLAIEAEQEARWWKSDEVDSLVTSALVQDCLREEIGSRLRDTAGKPNKSSTGRGYTVARIHSSSNPCAEWQEHPVPPVQSRQRIRTSHRGKSQLQQIRLKKHRHHDVQCNLGHSHHKHALRHDGAVQNKPQGRATARKKGEHSGRDTQILGQGTHNSLSDGRLRVGANHSDWSVNHRDERTIGAVSLRRRQLCTPWRIGIPHNYPGPEAQRREHWGGEDEPQNSATRTGIDDNPSTY

SEQ ID NO: 995235 - protein, 424 aa, Homo sapiens
MRHPKAVVDCGWLLCSERLLVHCAVRGVTMRQRIPGGTDSSDCQHRICRTLLSLGPQRTGHPSGVADPVTYAAFRTIMDQCPRAQSSGTNTAERFHTDRFVELKRTDRAAELGRALRRWTRGFSHVVLTVVQHPMRKMRVDAMSPGTTRTCAGSNAHESVHMLTKEVHSNDGEGMELWNDGTRFNAFGGWYVLEDAWLGSDGRVKTAPGARSKYLVYERVEKVGKGWQQDDPEAIMRGTAKRNHTHYTLQEKPDTSDSHRAEPNSQRPAHTQSHLEGDTQGSKGARVRPNSRAKEGPKQPGWRQREEHKGRTTTDIRGIRGNEQQSDPQAHEPLGDRSNNEEHTRGQTHGESHPTRTTQQKARRHHHHPRHNTKYSRKPAKSPATKKAARNKGPGTPGEHATRAPWETTKGPQQKTTQHATTPG

SEQ ID NO: 995236 - protein, 103 aa, Homo sapiens
MRVISVCKVWVGELSPMWCWVAQHYVQKGRYAGRGDTYLSGGSSRVIRSGQTGALIWHSRGETVVALLTPQDRESFLPEMRVLTSGGGGISGAQVSSPRALWL

SEQ ID NO: 995237 - protein, 555 aa, Homo sapiens
AILSVHCRDGNPSSVKSIDGYTEFLAGYARTCGSLAEKSEGGTPCWRDLVLRSDTLVHGIIGAQCISKKRHITFWSHGYRQGTTIERVHSEAKKEQRVNELSMVRERVIQNLRRDEYDEELDRRSVDLPATVHKARVAGTSDTYRSEISRDEMQAEEMDCILRVETIIKNIMGETERMQHDDCGDQGQEAAWQEVLGNARGTFARISKARIAWAHEFSLRQITRLWTRARHRTEIPRLTTHGVTHTLVNFWAQRGYEHNWQRAQRRRKVMETPKGFALTEDTCGGVPDKEIVSPLKTRKKVAHASCLHECEHHESSWAPRYSGIKEKTLNGSYTTMISRIETPARGSHAGRGDNTWEHGHKKRALHGRRERGVKQGKPYMGYVARHFTPLEGIMCCTAKRVAIQVKTHKVGFNHTWDPTRPCAPNSGAYNAGVNTTLIFLPPNVVLIITERGKTECVIPAKREKVPHIETTGNRRFTEDASNGRRYCLKTRRKRSLSQLAKKNQNIATQLRDQSLRYMNTHTIDHDDTTSHLYGAMIFDVTVLTCLSSQSVRDDQ

SEQ ID NO: 995238 - protein, 100 aa, Homo sapiens
DGGGYKSRTRRLPGLDDPSIPSSHGQQAERDFRLDVDQIMVASEYSIGSGPKEDRCKPGRRMESLSLTQRSNRNNSHRELYRLEWYQEDIAHSDGVLRAR

SEQ ID NO: 995239 - protein, 299 aa, Homo sapiens
ARPRASPGPPSQSLTDAGPRASPLLTIRGRAVISGEALGCCDAGFSLWPSYGVTWSLCNEAPEAWRMEHCGAARYPCGRAALDGNRYPPQGGGCAGGMPHGGWLGVQARGGGWGRAHGGGWGLSFMVVAGVEEVAHIVSGTSRVSQKARRSTWLVLQQLAAEVVRALAGLHAGKCHEQAHHTFLAGDYEDRYYRENMQRYPSKCDYRAMDEYSNQNNFVHDCVTSSQIKQHTGHHKQTKGRNFTADRRLALMERVAEQMCITQYEEGNFKGLFTTRRLQAFVTFFTYPTVWNPSSNSIH

SEQ ID NO: 995240 - protein, 247 aa, Homo sapiens
MGKVKVGVNGLVVWALVTRAAFNSGKVDTVAINDPFIELNYMVTCSNMITTHWIFHGTVKAENGKLVQHGNPITSSRSEITPQIKWGDAGLLRYVVESTGVFTTWRRLGLICRGEPEGSSSLAPLVTPPCSSMGVNHEKYDNSLKIISNASCTHKIEFSTPGKVIHDNFGIVEGLMTQSMPSHAPEDCGWPSGKLVVCWPRALQKIIPVSTGACKDVGKEIPELHGNITGMTDRVPLPTERGDRTGA

SEQ ID NO: 995241 - protein, 337 aa, Homo sapiens
MRPKLIDTKLSYVLHGSTTVLLRHRSHGSHAENTMFLSTLPWYHRIAEDSANGVARLHGAQVVVEDVFALGHAMATRRFSDENRQDALRRVSRIGLSDSGQTVYMTYKETCATGVTVHKGFSGSFTGLIEEKGIKCLRWQFLLTIFWAHCTWTRPPTASAVEGLQREFTRLIGRPIFAHHGNSARGPWETPIPFPTYEPLFDRATGEGTGGARENELNLYMCISTCEPGGHSMYPNQRPWLYHWHRLGTSNPVRAHLDSFGALTAILPVLGQAFGVRTPPCLCGVGLEVGSASGRWIPSVRGGVQVQLGPLSLAFSLVDAREPWLSSLWTQYLPDFD

SEQ ID NO: 995242 - protein, 188 aa, Homo sapiens
MVRASRGWLALTPSRQEWAMISLPGPGDQTCCGFCPGAGALGPLAGQLQMDLPANRLQAGGGRGSGASSVVHLATGEVSSSQPWEVPFVMWYFKQKEKEDQVLSLHQMGSQQANLEYPWSTPCPPWNLSLRLEGLQEKRLWALQLSVNVQDKQGKSMGPHDQNLESMYWFLQSSILPSPVLCPCGCKL

SEQ ID NO: 995243 - protein, 296 aa, Homo sapiens
VGADRSVRVSPSLRRWRVLSPLISVYSEQGESSWLKMSNSCVLRVFNVSYSSQHSREHFGSHQLAFRMTSMTTGPYDCQMKLPGQSVLMAGVLFDTGGQPVDLVSIPEFDCVGGTHRSGPGVLRDNMVSWRAEVFAPTKHLDTVWASYRRTQYQMTIRQSWMLACGSSNSVPELGVMFYRFIVLREGPWDFPLGKLKYNSVKATRRPTVSCLLLKKLKALDPEYQKSLFLSANEELGTGKMRKRRVSAQGPCIIYNEGYGIMQASETSVNNLLSVGKLTCEAVPGTVGVLLGEGFG

SEQ ID NO: 995244 - protein, 194 aa, Homo sapiens
AGSGIRGTGVVVPEKQESERRSGGRVLWLFRVFPQIRTFSRLFADDIVTKMWNSGFESYGEILIGVMPGRTRKSPGGFGSDLQLRSRRYWKIQEPEPSDIVPCIYISAAFCHFGVMNVFRIGNAEISQAHILVGIIRHAGEVLQTKMVQQKLDDADWTVTHGSFSHVGLSTDDEPAVKTLWFLQKHIVKMWQAT

SEQ ID NO: 995245 - protein, 156 aa, Homo sapiens
MWALLGRRTALCGCCALPAVWPADWSCSCVSSLLPSMPPALLLLSLLSRRRMPRVTSCDGAPAVSARDRAVRGPRCVTCNQACGPDIALTTGERPQRSARTPLMTALARDPDDTDPARNADDDWHSLASARTATSIAMAIETERVPTQRPTRLSSS

SEQ ID NO: 995246 - protein, 220 aa, Homo sapiens
MTHLHRNHGRPVVPQFGRSQGLPVVAQGRTDITLPNWGSVPRRNGGYHFWAIRNRIPHFYFHATDTCGRVLAESNPARHSGRGFFQRVSGSLGLLSIAQEKSNAYGKTHGAQFETGLYERPQELGQASARFGPAVQGYEWPPQESLREPRAKRTLAEPHRGPTEAQSGRPARDPAKEARTKITGPSPTGRAKASTVTPEQIGTSMDTVRKTPHHPNVQTA

SEQ ID NO: 995247 - protein, 111 aa, Homo sapiens
MIVAHPGRDFPSLPVIMGREANKSVGARVTRGTSPVMPMTGTRGSRKGRSHASFLGVISQRSRDPRSSSRALVGSRKLVPPGLGAHISPLVFRDTLHRYISQKGGALPHRE

SEQ ID NO: 995248 - protein, 320 aa, Homo sapiens
ATMKDTPSLASLIAGSVFFLLLPGPSAADEKKKGPTVTATVSMTYEIADDDVGRVIFGLFGKTVPKTVDEFKTALATGEKGCGYKKLANSDRVPHMDFTESRGDTSSGRRWPQEERASTVSALPDENFITEDTYAAWHVVSNGRRQQAKTPTASQFFITTVNTAWLDGKACGVGQSSRAAMEVVRKVVEHPTEDSRDKTPEGCDRSQDLRKIEGEEASCASPGVGTTGRPFPLEVTDLGRAMDPGQGVFMLTGPVLASGEADHPPSTFGIAFGLLYVETTTGLANNENGEPEKRHTHYKHTDKLCKLHRNSPSAKTCSLN

SEQ ID NO: 995249 - protein, 329 aa, Homo sapiens
VAEKFAIATKEGDLPQVERFFKIFPLLGCMRRDEESSRSTFASRWPAKAEENLLMAAGDMDMSDRMERASHRLQIRLTSSCLNGIARIVETHQPIVETYYGPGDIYNLIKYLQVECDRQVEKVVDKFIHCKGSTTSRLRHVHEQTDEKFYIAVNKMETKRIWMRHPEREVILMKRRHGELYLRFLEEEDELCFEVGDSMASEEVEEERQKCLDILLNEMPVSCTMQELIGYMFTKEESLHEVDCPISCVSGALWVRPVDSQLGMRRPCSKCWGDRRAQMKLLRLTPAPRRVLRIRKAGAHDTSDTAGKPDTTARIHVISERLTHEETQE

SEQ ID NO: 995250 - protein, 524 aa, Homo sapiens
DAAYTYFYKGTSSTGKFDMEAPCGVWARAYPKVQSLAGHSMRHGERATWKTKGPRMDPNVGPCRAVSTRPAGRCQESPEGPDLSDKRADRCAETAAMGDLPGARLTQRQRPSVVHAQRWLVVPSPCDRKSMCTREPAMQLSCPLCCVRSRNKSLHQRASMTPPFGALYTLTVLISGFHSTISARKSWHHRIDHVDHSRMNTSLRKVRTTFPEGSNLACYSDPRRRQMGINPDPYIQVLDELMTQGNSDAGHTYIEHNEMRDYLQQAVSILTPISHIRPHKLNKQRTHTLKTKSITVEENTPTITYRMTHPTNPQPHRTHDTRGYAKRGKQHKRRHKSAPQQANKPPAKNTRQQAYASTQQQKPQSDNHTRPTHTQSSQHNTEEQKQQQPPRTERKDNPCQSTMQTQEPTDTNNHQHQNTTTGTTHSKHSTQRSDNTHGTRKSIQTIGTDQNRLRSLQTGNTPHADRDTGHQRALTNERADIGRQYIKPPRETDKPMPTNERRPRRLTQKITQQHTSQTSTPHSW

SEQ ID NO: 995251 - protein, 265 aa, Homo sapiens
MRLRKHPGSCTDSMSWGASYLELLHSQMALQESPVEVIPLKQYCRTVDLSGSTLVGSHKACTDCTVIDKAQAFLSYLASIRRTNIYTLEHSKSITLGFRSPAALITWFRYDLVGLNYFLDWSPNLIRLTGSLTEQPQQAGTQQQTTHDRHTKHTQRSTYNTKRQTRRDITTNTNDDTDNKPSQGDNDQEEKERTKRTEIRRHREQKTTTPDAKHNKTTRTRTTHATTDKADHDEETNRTEIHTTKRTQQKPDERESVRETKEGET

SEQ ID NO: 995252 - protein, 440 aa, Homo sapiens
MGKDKTHINIAVLGHVDSWQVHHYWPSDLYNAAGIDPKTPLEDTFDDGGMLSTGKRDSFNVCLESRTKPDTADALNRGTHAWHISLMDHRRPAQYYADYHLSAPDDTSDLNHKSMQFTGTISGMTCDCTMIVSLHGCLDRKSERLCILHMTMAHEPRRGHDTIPGLPTNRPKAQHKNYTGTEQTHTTTLRTPTWKPTPYSTEHGEQSKEQRANGKRQRAEQHQEQTRGTTKPAQNKPDHTMPQTHRERATGEQPRPGQPKRAKQSHRAAHCHMRHDNADKRMRQSAQGEKPRRDWQEPPDTKPSNAAKNMAPSETNHHDRTSTPQGPTPTQGGTKERNQKDRHHNRGHTRTEPSRRPPGTPQPSTQRLTPGRRDTGQTQNNTGGARRPKPTTAPSPKQTAEDNKADKTQAKTEEEHPSQHDNATPPETARAYSHATTQKS

SEQ ID NO: 995253 - protein, 292 aa, Homo sapiens
MDHGSGMCQAGIAVDDAPRAAFPYRLDRATPVHLVHGRLAGAMVPKRSSIRVVAKRPQEQGVEILTREEYPNLSNVYSLLNWGTSIGTKNLVQAHSFYYKLLRGRLGVNTTNARLTLTASPLNAPIGPNRWRRMMKSRIIGFDDHLDALGPLLLLSQSTARRMSLLGLLVAPTGIVLDSWRRGHPLGWPVLPTGYSSRPPGALFCVVRPWAWLGDRVAGLPHEEFSLRRDTGCVSTGDREKSCAAINGESCANVCPWTSEQEMGTADLPLLWRKVTLAMAGIPIGMTVRVRG

SEQ ID NO: 995254 - protein, 237 aa, Homo sapiens
MPGSGEDDERGRGGGRIPSQRRVSIRGGSALGEPAGCGGGSGGSLASSSSFLTVQPLPRLLLKGEGGSQWARCGSRLRSALVLVGWGPPGPGAGRGRTGGGRRCGMEVCSSRERGLSLTVQPYSSAGNAGEFGLSPFYCLQNNELCGWPAGNITGTLGPVFKPPVQPGRTDHTDGQRDFRRTAGSDGKPLGGLFDFIQTFLLPADSRALVDEEKQASRATTQQQRKNNTGGANKVEK

SEQ ID NO: 995255 - protein, 107 aa, Homo sapiens
VLTDKARNRRCELMLAGGPPGARGEAGVRPHAACLCSMAGSVVLECAEGGESSSLVPTSHRRSPGWVSGCPGLGIARWESVAVWTVDLGSYVDSMGGSRRNWHRTTS

SEQ ID NO: 995256 - protein, 149 aa, Homo sapiens
MRNNPYEGSYSFVRSFQTIRYSAEDKTLEHVLIGAPRRGGVTHTKRRPQETAKHFGDVCDEMHTQTLYSDPVCCGSFWTCRKNPSTFGGDTTIVIAVVYVREVPIVTTIAARGPGVWEGCRQSWNAQVRNLNLSACGRKRKIGRLSTEG

SEQ ID NO: 995257 - protein, 213 aa, Homo sapiens
MSRVIGADESRVTEPTTMAPQQLLKGREAYKGHLQWELVVTWALAAATDVRNYHSDSPSYGLSLSPSTVFEQSVQCARLNGHRRLDFRATEELVIGRLSPASGARHAVPLCSGSQRKPECGSSSGMIAACAWDFQAEPRRLWLTEQMSFNALIRIDRVVKRVSVTLWRGCHPYHGLGPSYVTAARLASYSQSKQFLLDSGYFSDKNLVHFCAS

SEQ ID NO: 995258 - protein, 383 aa, Homo sapiens
MTRVTGGVSSVKRLARSLAWQHARLAPRLPSAWATSLGAGEDYRDPSTMNALLRSNGRAAAEEHAGHRAVDGRRRSRAWKGVVEQGPKLRPFYVRPCVVLISNLPCAADRAVGVLLIFRCEVASLNNPDEAAPSMDFLKQPGPRDLVFIIVVVNILHHGLTGSMKPLMDMAPQQYVTPRSLDASLPCKLSCRDPGVAIPVKVSTSLHMAVPRLSEPRLASSAHVPGSAFALTAGKQPPGGHVWSLSRCSQEAVPLDMWAGNNRPDGQTWDSEESLCQRRVSNPVRHTQHVRDGWILTGPRHRGQRTVADRTRGEVLPVPKEHGPAPRGAVTDALEAQPVTPTRGSSRKGQCTRARLTQGGCDERRTVCASYHRGGTRDAKNAR

SEQ ID NO: 995259 - protein, 408 aa, Homo sapiens
GPTCHGQYYQAEPILAIPKSSNKKSESGYDEETTGNGAAARRYRSHEIEDRDDSKERPTSFLPPEASQCQARQACNSRVERGLMKNNSGIGGTLRHLEDRTGPLSFRLLLYEDEDDFDGYPCCYVTPSRLRSSSSRWAEIGGSGYPFTIEGFCIAVVRSPCQLWGSREGPCTASSMKINEDISGEAGFRLQRPEPSSGPYPAGALDVLWTPSEAKSLDPMGMEALGTKFSNRRVERLEETRLEENDVMGALGFDVEMTGERVFHQRNVEVDWHGVDVKEKPEGELGTTRAKHVLNTRQQSGATEDLEGEIDEERGLETPRGETEKLADNSQRSDLETEGTLEQQQQETTRNLKVKQQKRKRQKGKKKTRPEEQKSKAQTKVSTHEREKCNKQQSKQLVPLSQIRLEKE

SEQ ID NO: 995260 - protein, 470 aa, Homo sapiens
GEWLVCSARRGPDCDPGPAPTGPRTWTNCSPSSSRTEPAQAIVDPICWRSLSSHQDRRGMRFQLQVRGALRGQHPRREEHRYHQDPHPASRSIGYTRTRDRAHHPMVTKDPTLTGLTPHEHSHRNGLPRHALLTDALTPLPGPDMTSTEPRNLANSTDVTHTRDPATQANSSTSPIHRPKPQSTSQAPYSTTQRCRTYDAELLLPAPAYPERDQTPGTPNSASDPSRPCPDMTHHINHHSFDTPAPPKTLAEAHEIKQTATTQPPSNPNLRERPTRKAIHKPSDEHSDSPHTQGTTRKRHTTTKTHTTARRTKLTQQPHHNNTTQHTKHKTTHQPPHHQHDKHSATTNTTRNPPQRPPQTTPHRTTQPPTQTHATPTHPTPTATTTTHHARPPHNEHISREPQDLMPKTRRPRPRQTTEATQPHDTHNPPTHTHNSAPPPPHPTHTHHTHKHKTRNRHHQRNAARPTTRQ

SEQ ID NO: 995261 - protein, 112 aa, Homo sapiens
MAMWKSNVGMEKQGRYIDIYLNSHSLCDETQENVLEVREDCDLEFEEQCEEVVELRIEWQAEIVKIVHESCQCERRNEREEGEGSEEISWKTMIYLCKCRAMKSNIRNNHIE

SEQ ID NO: 995262 - protein, 136 aa, Homo sapiens
NLRAQLVLSSQTTGSRHKRLCEGSANRASYILSELVSPEAPIQGHSSGDGLQVPVQWEDPGTDSPGTAPCIDRAAPFFERSSSKRCTACPAALMEPAVLPPKALRQPRDHGMRGPDGGSSGMSDELMSGGGNGPEG

SEQ ID NO: 995263 - protein, 359 aa, Homo sapiens
PEVAHSDEEGYRRPGWTPQRVSEITNAWFRAMLTTISWLLKVLTRVVGDMGPKREVHDVHFPQYRSRSQVLTRAHTHYLPFGTLAYLLGFTRSRLSPVGTPSPRFEYRTVVGIDKQGRSRIARLGSLLIAEEHRTQSRTQEGRSQGGIREVQRIEVHWSRFRIGNAAVPDDMGNSNSEGAGQVSRLRGADMNLVLQRSSIVTGLIEGSARGGLTRSHARHSRDGRSWSVVNEQSKAGYRDQPVGWEFPMNSSHGTIMTVSMHEGLGRPGPDAEDSTSPGLCGVRLKTPDVGDVSKNHPLTHDTGCWKLHLQETMGSDLHSAQEAQGSCASHGKLPKTRPHSNWRDQQPAHTTGTQPKKQ

SEQ ID NO: 995264 - protein, 44 aa, Homo sapiens
MKDPGENARENLDPGPSWDVLMLGPRYHMLELGPPKGDSGGGGH

SEQ ID NO: 995265 - protein, 148 aa, Homo sapiens
MAQKNGTVVQRLSSAFQVCRPPLEDTSPCLMHRPVMESHPDLERTPPTKPGPPEAASPQMFSSPRKLPMIVWLTVQVSRQVTANGLRSWLIKSRMPPQKAQMVSMISLRLIMPRMCPTRSPEAAFTCHICTPKGPHADYDFSQAATNW

SEQ ID NO: 995266 - protein, 112 aa, Homo sapiens
MPNRGYTTRLCIRSTHRGDKWCGDGRALSSRSGGRRDRCTLTLIERVKAMLGGMLGGRTLDWRLHVGPMVSVADTVRANGESATGGHAREPETNKKWQPWRRPTLAGWRNDK

SEQ ID NO: 995267 - protein, 281 aa, Homo sapiens
KITDVWHLRFKRRGTHTRCVDAISISSIVNMGQCGGASGCSTDAYLVVPERSTSSNICADIALHPLGSLVLIITNPSSWMLAIPKQDNSVYLQTDDETATTCACLYMSLFLRQTMQDSCDRGPDDCTFVMNGGRHVMPRIASGVQGAWCPRKSRIVPCDGYLMVHTYKAGMRANREVLAIDSYCCSSTWVQGAMVRYPVGGLSDEAPSHQGVPCRSRGTAFILVPTGERLGEIVLIWIQARQRNARRTTRTACARNHSPLDFHQSKMELASKQDSGVSVLP

SEQ ID NO: 995268 - protein, 245 aa, Homo sapiens
GRGLAALLGHWAGGVCLVVLVMIVVTENSSMREYQQPRRIIKVTRRIVCAGHSVEILKHGEGLGVMSQLCCRDHHNSIVRARVDELYLVEKGFTGSSVFRPLMSRPGATCSNESGAQESSEQVPAKMPAKCILSRIWESARSKSQSLITLGRPVGARSRGNCCWWSNLQGVPPAELTGLGLAETSIGRDKTLVMVEEETNVTGSLRLSSETTLWTTVVYGLRSHASYLRMSSPLGYVNGVPDKVS

SEQ ID NO: 995269 - protein, 264 aa, Homo sapiens
MEMHAFEGTDPSTPDNAGIMQGILRGAWDPWGIGHDSIGHACQRCLDCALREVAPILVHNELELMRMLFLEQALPQADVALVRYTRYEVSTAQEESAGLLNVVSGSGAPQSARQRGAPSGLILRPMCRQNSDCLLGGGKAGLMTQVSWDQTSDAGSSLPGKYAEERWEVVLSFMVGAPPKCTLSDRELGSGPQQGGSLKSMEPGEPAGFTSVGFQFLFVGHPGSDLELLVGSIWRKARTGGPGKIPFPSQEVSGKRIREERGHL

SEQ ID NO: 995270 - protein, 399 aa, Homo sapiens
GAGCGAQSQRARWCACCGTRRSGTGAGVNAHGSAAAWATLGQSGAVSSRANWAAPGALLERPVLVLSQLRSQYLRSQMCPADILNEARRAGRTPSLCPQHGTPETDDSHVDLPAALSLLPQLFPPTQLPAELLDDYPMRTGTTCLLSSLPLPGADRPLPLPTSLHPPTQCLMRGPIVHGACRPMSTPAPATTIAGDQRLHLRPSTCPTSVTLSPSSSSDNCTPRSGPIHFDTPCSSQRLENRTIRIPCHQPVTNSRYIRPPYSLSVYYKETGGALQTLTPRPGQRKSEQYSHDTTLAGTLRHLTARSRETRHARSHVTHSQAPHSAKHYHPRNRPLHSSPHRCRPHSTSQTATRTHTTTPTKNSHHPTPNNIPPNPTNSPPTPHNPHPHNPPHPHHTPS

SEQ ID NO: 995271 - protein, 119 aa, Homo sapiens
ANLSEVSGCVIASLREEMFVVSVGARWAAGVNSHIRIDGSRIWSWCDGVALEGPSDSEHPRMGPTGPSPERLSAIRGQVRPTGGKKYRSDETLATDEKYGMTTVMGYRLEESCRDLVGY

SEQ ID NO: 995272 - protein, 131 aa, Homo sapiens
SDDITSAEIGEQLRMEEGEQGDPQNCNPGSSMLDVDDIHASATDPVPHSTNGSTMYKVISCQIGVQNTITPTTIVDMLHWMMEDPEAIPRTSTSCPGSEAIFRITNDGTHDNRSIIMATERSRAHYCQPRG

SEQ ID NO: 995273 - protein, 504 aa, Homo sapiens
LGADGERGANMAVDSELGFVCKIYVNPAEYPFASNSRLAAEELHTLSLAEYGLRYIKTVQASGRGQTLAPGADDSVKARSGKLLCAFAVRTRSPPGVHGLRRVLEDRMCAGPVLGYRQYGGVACDLKGPEDCNAREFNISLVGTKESNKDAHCAVTQKERRVGDERTKGYYTTRLERILGATEDPQVRKPEQTSDGVTSRYARDQGPSQLKIPEVRYAENTVQRGMMSVKTTFSPGITHYPKEMGSPRTRLARQIYHLRMSSTWPDEVLRGKRYLTFAIPCDWLVHYARLLTHARAVFEDHWSPPGGWLSSTGIRTEENVGEDAKFWPPHENKVGGRNIGEYGGSGHFAGVGVWSVSDRRNNSTDDICVESVNFNTENLNLIRYPPLLRLRGSGNVRAQVTETLQEGKSRSRARKKRKHIAAAHSPARATLLRTQPTTSNNRSRTETNKGSTSANEHAKTHTSPKTPSGRHEHPSVGERKRNGRARQQIARDDTSAHQNDITKW

SEQ ID NO: 995274 - protein, 242 aa, Homo sapiens
MPVNESGLGVALLTLGWRQPTVETIRSTGDQDKEETIRGAREFGRDERAVAGGPSGSVMSSSESQARTEEAQWNGRVKRREESVLESEVNSEENSEITVRSVVLSSYMSSLHFITENSEKSRVSLYSPGGARAPEMNEGLFGTSLMAHDVQEVMNLVAPEPMKTKRGIYTEPDWISHNPRGELWNVRRSAALCQEGVWRNCHHDMQGVETQFEPIPRYVWSQSTYSVGLEKACIFEIEFALG

SEQ ID NO: 995275 - protein, 269 aa, Homo sapiens
CAWGVGFAQLHNLDEAVGSGGEEDGEPGGGGCVRRRRRQRARREQLDAHLPLLQHLLVLLGLPLRLPALPPGCMEACCRSAWRQTGGTSLLQPPASPVRRTQPPRPSWRLCGACRRRKVERPWLDCLWIVLALWCSSGGRGPPTCVHGPRHTYRKGGYVYFEPDPHSSVLVAVRCWLQSLSFRWLRGKDYTERPGLGAVAAGSPCRGPQGLGAGNVTGSGPGGHAVGSPPTPGQQRCVASPGGSRESVYPPDEMRKVVELKERHEGSAK

SEQ ID NO: 995276 - protein, 411 aa, Homo sapiens
ADYESKGIKAHFNLDEQWLLSSSTGAAALYFCDTWYTDSAERGTRTLTQTLATPLSSLLRARRLPPPAMPRQNWMPDYMSKAGNTAGATATQGDATRPTPWREHRLRTPPRHWTRPSAGPQPATEHCAYLKAPPSSPLAHHIQRGLTSLDTACTARPTAANHEPQRTNWAEHTPVAGHPRNTHPARFEHNRPRKGAPSPLARDRLADPKLPKEAHYRKRTVQAKPPDPGDTAEAEDLASIMRPTAPAGPPAPQPRHPAHRTQAPDAHPPTAPQPVPAHQQTPRTPPATTTTQRPTHATRPTTHRAISPLQRPHTTPNTPRPPPATPTRNYPQPDHQPEHQSHETPAAGPTHPSTRRERNTGRATPPRDKRHNTRPHTNTQPTAKHSPQPPAPRHTPLAQTHKHQNTHPGHP

SEQ ID NO: 995277 - protein, 258 aa, Homo sapiens
PGRAGACLLLCAVRVCRLCVSPSCLGLALACASLTCATLYPASLLPLLPTCLPRHDTLCSTTSPWGSATQPSTGIPRDRTKPNLREPGHSLAKSETNSTSYYHLARLANWAFSSYTSKSPPNEVPQTQTPFLHRYVHVQTAAWDQGHPRPNTTCQLKPKESDSASSQVLIPEVRLRSCKHNHEPKWFPRPWITGMSPKPILANRTIPKHFGHYQKANIKHLWLTQQRAVKGSHPQARLRSFPPAGPQSQDWHCLAPMR

SEQ ID NO: 995278 - protein, 182 aa, Homo sapiens
MGAFGLGGAETSCRAVGEEVYHGRHCQWESQLSPGVNHPKVGTGPRGVDPGNMANREDTLTSNQCKTETKQAQQGSKRGGESQRRAIPGRTSEQAPTPGIPSVITVIRYATRCQQGDKEGPMRLIKNFRPEHQSGKTATGDCYEDTNEGAMKCSSNMHSNSVRIATAARQVAQTTQPSSDHK

SEQ ID NO: 995279 - protein, 302 aa, Homo sapiens
DAAYTYFYKGTKYWKFDNELPAGWMPCATPMSIHAWTSCVLPVMHCVSQCPRTGPDCVTCAAHSTSHWRRDMNDPVGLGTDCHGCVLDTVVVWDLRGTWRATYLLCAQSGLQPTTVTRYLWPIDYDRLGTELAKNLLHVNAACGHGVTWLQDRLRWHLSLTSRMASACPSPLSLALYLPAYALTRRHPTHYRHARCAFALATAHAAHQPRIAVPYSLALTYTFTHHLGKTRRHLLPSAHRTKRLAANPVEDRELPHGKTATHSRVKHRAIDQSTPELAEVHHCIGTSVLRTANLKTIPPRRE

SEQ ID NO: 995280 - protein, 434 aa, Homo sapiens
AEHAPYWERLLGQRTSLQRDSMWLEAMEAHTADTLSSVPAALGTLGHPGRRPMTPFRGLFRGVLSRAMVGMRIPTGRDTRTAIDECGALLPDSRARPRKAQWAPQLRRLLLTPGAQGRETPVPVACSNDMRGKRVSPDLAPRRLGSLGQGDPLSDMSRWKNGHNTQEALTGQPQIGHSPLSERPHAQSNGRPRDRTALGNRTSSQGWQQGETPEGTINLGPGRDHRVPPERPCALHHERPHPWPGATRSKPRTRLRLAGSSIGAPQTLDTNARRMRQHPNKNPVEKHLLHQGVPRPLHTGATGPHMWPTPKERSVIIGTPSAPSTDEAPLDRNRRGLPNRQTGCTTGWPRGGPQREPAHPGEAAYPGMRPQPIWVVTNAPGYLRLNTALGESGPPTVPPFRCRQNGEAPRDDKGKLGSDSNMATLVRHHWLWHL

SEQ ID NO: 995281 - protein, 347 aa, Homo sapiens
MTGGWPVALEPHLMLPVSSRWGQLPSGSLAGLLAGGSWLAFLASSSSFLTVQPLPRLLLKGKVEAVGSGGSRLTARPAAAAPPAPASGGAEPGWRLAGRWPAAAPGQGVRVACHHFPGLGTPGELVISPSTASNTGGGGGVHIQGPGPVLNLPSAAAAPHRGPGLPEAAARSAAVPEDYSVFSPYPLPTLPGPLAAEEKQAQYVESSSSRCRTAINLAAGPEAMRRTSSDGPHVTAESRAFHSAESPAQQSASSPLFFSKGSRARGVTTRILAQNHGATPQACLTLTLTLLSRHSCHCIPRSPRRQPLSAAHLTPPPAPLPRHHTHRRPLAPPPSTLSLPHPCPPTF

SEQ ID NO: 995282 - protein, 357 aa, Homo sapiens
PVADSLPWSSVMYRGTAATRHGMAAPLAAPADSSRPGRYLRLTCFHHELPPGPCRADRTSPRQSGLNNTGNTGTRRQAAAGGRTDGRPRPGDHRRRLIGPGLALHSRPVEAHCPFGIEPHAPRNPASLAVPHRRRNPDGPSRANARTDHMRNPVPPRLGRRAALGPRATATADRGNEKPANNRPAPPDLHGKATEPNPPPPRPTSPSCAQPAPALQPPALPPRQRWQPFASAAPPPRTPRRTAPPPPLHLPRRPLDPCPPPLTVSAPLNPVVRFAPALRSPPRTPPRPPPPAPPPAPRNRTSPSVPTPLHPLRPHPCPRPRPWTHHWASPSTRNTPPPQLAPAHCPTATLLLLPSRH

SEQ ID NO: 995283 - protein, 165 aa, Homo sapiens
MRLYRHGLVRSHIAPTVVSRASRRERTGNGEQRVEKARGGEVRVTISRGLWVGMGTLGAVSMAKTMVVEVSPGAVICRASHDSADYLNSYRADALPDQAMSEQEGQVPGGSGAALRDMLAEQCGAVVVPAAAALVRSAFVRGRGPRVQAVARAAGTAVNHQQPSG

SEQ ID NO: 995284 - protein, 65 aa, Homo sapiens
MSSVCRTGIPAGQLTRSEEIAVTVKEGSIRVEQRKLWEEVCHERSELHGLISAARNAVALSEAWW

SEQ ID NO: 995285 - protein, 346 aa, Homo sapiens
KTPPHTKRGETTPKKSAPPPLSQKSARKYRGGGHNPTQREGGGERGKIWGGGENPTGGERNGARHKKGERNTGETRGGKQKGGAPKRRREKSGEERENTTKNRARRAGERRASKKHNHPQTRRRKRNPPRAKTTQEESTRREPTYTHTREGGETLRESRERHSARRRGRENNAREVSSTERGEETPPRRAHSSERRKNRAGVQGDEPRQRPPPTHDRRGGEQDEGASHTEREKQVGLTNREPHHQTNTTRLAADTKTKKQPRCEGEHHKTTEESIYTHPHMRREHSALRYNEKHSTTVSNMMDEGDPPERKKMRGATHYGGGRTQRPRPLALPREREQEENESKKS

SEQ ID NO: 995286 - protein, 343 aa, Homo sapiens
EGSCGCNGGGSTRTVRLPQTRSGHAGTDMSPPRLCWVWLMACGEPQRRERVVTAGGQTWWDCHLTRARAERNLSEQSGRRWGTAVLEQADGEPDLSASVLCAGPLVLRSNVAKPASSWVLEHALRDTWIRSQLMLDEGPVTPGNRGHLLADMLRSLAYWAGQEQLQAMMRRRLRVALHQLKAREQPHTIGTVSREPLWRALGRSSDSRKGLATCSLRAVNVQGLRTPLERLWTRSVMHDVPTWWARGVVEGAAAGIVTMQCGCGVCALGSKGPLRYVRVRMVGHQPVRQSSASKVALLWGRRAALATFASLPGLFRALAFFRAGTRGNCSSADGWEWQSLICG

SEQ ID NO: 995287 - protein, 245 aa, Homo sapiens
ERAMSQCHDRLGERQSVNAYNLPETLIRRQLSHATVQRMMVEICVEAVTTVYAQQIMIASLGLRSTTTVALKTLGHARCRPSVLRTEPFRRTPLSRQHHHQTRLRSRGDFVYLHVQGPFRSTVVSKLIATRKVLCSSAVHTDEGSYDYESKPPYIGRLSTDVYCGRQCVEYYPRGIHAQRQIILGSTERYHRTTTPSPVGLDFAMKTAHCTINVRTVVAHCLITKRIAPLQGLCSVGDNIARSIE

SEQ ID NO: 995288 - protein, 178 aa, Homo sapiens
TLRGLRGSRGAFGCGGCCREPAGVVRPDPAGAPRLTFEASEAGSRLLPFCRVDYFEDLQQGAHRMLVCVTSTCNSDRQSSTGVVHRSQQRSVASGVNSVLLSEPRSTDEPPRKRGEALVAVLVLSDASLLAVGGLQCRKRCQLRARGEPAWALRVQSLGAGLIGARVGTGVVWCGVAL

SEQ ID NO: 995289 - protein, 311 aa, Homo sapiens
DKAHLGRDRGSELYELRVSELLDYGPYTILDRGLRQAIYSRQLNVRRYQGTVDRNLAGANTPRPGMHRSLFSSILVVDYCYRRAWLTFPWTSTRGGRRSKRTDVHETGGFHESMRIKASAINGVVSAPYARARPSRTRKSSKGASDRVSSVLGKRMWGIRVLERESTVASCFSRPATSITEESGSLERECCHTYSHRAPERRQRAMRYSFAPTPGWGPLDSAGCCGHMRVVTPSIVPCSSPRRVSREPSSEGRNPFSRAWVRWTSWTLLVRPPNTRESWALSFGYYLARKKVGPRGFLVGGDLTRRGRTQC

SEQ ID NO: 995290 - protein, 152 aa, Homo sapiens
MCSMRGDLDSNRVTEVYMAVWYYRPCYGRSEGACTENSRLASTHTHLVCNVTTAAIGSYDCRCFRASAVSESNGRFPTQIDIVSTVLVVNAAWRKVSTLPLAPAATKRRKAMGGLIGLDEVKVHATELSIIERKGVSLFWVCYDWFVVTVKD

SEQ ID NO: 995291 - protein, 434 aa, Homo sapiens
MSVANRWRHRQRLGQLWATRRSDAEGLLGQAESRMTRKRLASSEIRLDRVTSNSIGGMRSRSRVTSRVARESSGDDLMNCKSTQLVGHNYWYPSACRYPGVGIFSKPWGVRKYVYVVVSRFKVVALLALKDSLEEARGTNVFVIFRVDVVWGRLGSTHCGPEIVHTGNSLSQGQSGQTLGLRIIGDPLDIAWVTEQRGGAAVASLSHLALLGRVAETDTLTCSYGDVGAYQGLLGHTGANCIPLIQPRIPEEQKYPLKAEIIDIAAIYAVVVRFNANNAVLDNPVGSGMPYTKLSRPIFQVPIQVGDEDNTGHGRHLIGHFGPTDGPFIMENTRVAGENQKRVDTEPKTYRGNIGPTVVVPATHERGVNNRESRYRGPAKRGPPETVHTTVAPLQRHNTMHGMTNYTRREREQKPQGKHTKFRAKEGGPKGPTH

SEQ ID NO: 995292 - protein, 98 aa, Homo sapiens
MLSYYERPHDVGRRALYLAHIVGAHVEGGLLARRKFSPWKVLAVGIGKQRALGGTVPVFARGFGKPKSRYGESAVIEPVDTRYGDTKECNFSREDLNS

SEQ ID NO: 995293 - protein, 92 aa, Homo sapiens
MWEGARDNPAVTIEVPRLIEESPIDTGTLTTDTTTHEAPDTTQTQSQTLPNTAYCKGPARRAQRKRLRPPYTDTQNSADLILAPHHRNPTLP

SEQ ID NO: 995294 - protein, 146 aa, Homo sapiens
MAPYGSWFRPTEEDSKMMGAPSGKTRSKRLRPLQGHATKKPGLLHSETECVTRRGIIGTYKKHIRQKRKENRSGTKQRVKPRKLCFSLALGEWRPMGASGSATSLGKAMAYPTRNRFVGHNSNLGDHWELVAEGVKLVETDNFPLS

SEQ ID NO: 995295 - protein, 157 aa, Homo sapiens
SFIIFKGIKTKHLKPQFREKPLVLAGLVSLFKLDLGLPSGLALKEQDSEDILMDRQFGPGGISTESLGGIRWIGELYTFTKRFNLWISGQIFFLAHGQLVTWRGVRGSIPATKSQWAWRGGEPGGCQSSEWSLQRSERGLGVRGRIGVSSPRAQSHT

SEQ ID NO: 995296 - protein, 270 aa, Homo sapiens
AAPKWRRLSCEHKVTKEAGPGAWNYRIELAPQRQCSRDDNWREIDLSENELTNRELCKGATDTQTSRSKYILILGCRVCPVRLRGPSEFTSSSEKGQKRCLGAERPHVGYWGTYCRLGEVRTHYFVWVLWVFPRVGQAAKPGSNEACKRYSGGMTNRWRAVPGNYHNVMREQGLTLDEGSVRSLWMLPRLVARAGAPNSRGGQRILAVTVQVQRAESWPEHTVTPRWRSHPASAGNPGRRFPQYLWRSLGSRTTDDTFLTADGTTVWGKE

SEQ ID NO: 995297 - protein, 298 aa, Homo sapiens
GSVVGLWALGGFDPFGPGTIHGWLLPSCRAGPMRTPREGYMFVVQKAPIPSVFRVVDSTLRQDSGLVMWWTIVGMPEHDFTEVKGHPMLVFQANSTSRGMDRSEATCWEGSFTRCWRIPDENIKTVADGWDLMLRVMDPCGPRELIRPINHGDVSSVLMHSIQRGRRSTTLRGGGGGLRLYLLSWDVVRNEADASEELASPSDDVERRRGEQSAEAGWQRILTAYLGSRAGTAAQCSWRRSAGAIEGQKKRMEALIGNGGGWKLGEGRFPACWWEKGNARAYQICSEQKKRTPKEKGA

SEQ ID NO: 995298 - protein, 309 aa, Homo sapiens
SSLHTPCALEQTRLALDSCLHRRLSRLRTRCRPSSVWWWEMGPWARAAFSSIYISNRLSPGVDTSPTHSCFDETYFRSQLMSRVVQQLGPCCNPWSAWCVTSCHGARERTYRRVFRVSILLIFSMTGTCLPSIVSFFLFVHDSTASLVSKIRAMMDSHKVRYHVPQHIQSSWVGTKLDLWDEKDTILMKLKEKNAGSQSLYTAEGVWRLCPMEIESVKTTCSAQLSPRGGLIIRVRRGIRCRAVSSALAELKRALSSSRGLLPALPLDGSDPPDPTLELMEPRLVCGPPVGFLRVRSLRLLWSPERRHG

SEQ ID NO: 995299 - protein, 164 aa, Homo sapiens
MRLNPDGKSIRNRYSTILDQSNVKKRVEEENKSLSPKVEEHPDHSLNEPFASCNIDLYVSIERTSASHDILYREDGMLSVEFIACQGSSLRGRRRSVAVTQMKLSPSIVDGLGTYSRSILSKHDYSGHWAMAAKKDSWQEPSRALLAMNEPVNTVVGTSIELDV

SEQ ID NO: 995300 - protein, 344 aa, Homo sapiens
GCCGRSENVLRWLREMSVPGTPAPVARMKVLKAELRQLQSWSEQAAAGKAREFTPRQRSGSSHPNGSSDVKYVGRKFRGGCSCSWAMGALKVHQSLQGTSQYRISNAGKTVAAMAIGKQSVGIRLWIDSPKSSSFRFCFGMSPGWGSPTDATGTEPGVPWGSVDPECCRPASVACSRLVHLAVRRVSQCSTPDCGATGLPRPCRVAAVGVGACPRQVAPSCPGVWSMAADFRDDGRCREREARLSTVFATIQRRTRGKGAQGSSEKNPTGWVGSKLHPRPHAYTTSALMHTGLSLVRENLPQRCCAAFIPEQPGPTESSVRRIPGRMTNPLPVPRISDSRLCPS

SEQ ID NO: 995301 - protein, 186 aa, Homo sapiens
MCAILSMCDSQDLVTLDSICSGIKVPGQNAFGSPTQDPRCQPTFHQGPFGHGQRPVRAEFEHQRSARVAGPGLGSSRASCKPGPMLVCSSVASKTRCGSDSAAGRLSASASHFSVLRDTSSGQDGRRRMVVQRVADSADCAPSPRAVAGIGEAAVQAAEGHHQAELVEAAHALEQGDKLVLVHVLR

SEQ ID NO: 995302 - protein, 216 aa, Homo sapiens
WRRLNTLQHYKVPVWSELWPSSPASPSMCSGKTRIMSLESGPRMLEDVDEGGIRSLAPGEAKVMSRSRPGLGVGSAFVGRGSVSASERSYSLSIYLTRPDCPVKGILQQRFVDDLFQVILSTSRPVPVRVKYFFDLSGLLSTAQKRHGQSSQTKDTSPHSRKDQEACHLRVLETQVVSNKTPQVVFRWYKPFLDNIECCAPCHCNMTFHGLPASLA

SEQ ID NO: 995303 - protein, 554 aa, Homo sapiens
MPAEIRLREPGCAWGSRKVRVLLPRACVSRPVDPLCERAERAFALTWAESSTEEGSGLSAALRVVLRRHVTLETRGSAREGGAVGIQWATLGIAERGFTPKIDGHGLAAYTAPLVGIPLWSGWDQHKRVIAEERVENAQFRSLSRVPITPFRVRQRHPMPRWVEYAAVRPPSRIVGIGPKRVWAPAMQFQGWWVLNGAEKGARGGSPGERNHAIPVEGESHKGIPKWGDRIEKKQIGKRAKEQKSLGNRRKRDGVNKEKRYPGGGAERAGPEEAHLEGTGNTGGIGPGPKVVRAPAICGKPKEGRPHTGTLCDRDQQIRPWAQSQHVLKATDKKGPSAIGGHAALLNPMFTRDTLKQTPNKGRETQLDPRHKQNNQGGVLDAEATKDASGMCASVETGKGTVCDETNVHPSFVQGTDDKHVLSFDTHHWHGGLVTHREREDQHCENSESDRIAHLTHRWNPRKVGAIKEGEDSVVWSMATQAGDSRGKAQIDETTLCEERKLPNRERRASGTRPKRWRVGHEENGEITNRRTSSEESGNAHDLYAASHVRGHHE

SEQ ID NO: 995304 - protein, 246 aa, Homo sapiens
ATAGHDRDAGVVCSNETEVAPTPWTSPGSLSEGPWPRSLTASWWLRICPSVVNVQGVGRAWASCGHYRSILDCPTMAGPGPVEGAVAWNVDHECGNAIDVCAHGHRTFSRYFYSRRIDIDPVVSQVLPQAGPLSYGARSSWQGYLRIASCCHPPPPGPLVPDAPGSCYAYVSGHMGDALLEKLCLQFLALELRGLDAGLRPGPVSPQTAPSAAAQERLAVPSELALLKAVDTGAGGSVLHEEVEGW

SEQ ID NO: 995305 - protein, 171 aa, Homo sapiens
MGDTHGSVTSASPALRPGREVLQRIGPWARECTRCTLRPREVSAPKPRKISKMRRLPGKRTKETLGGIQGPRDTESRLKQQTLRAPQKGPIPPKLSSGYTEPPPSTKGAAGTHSPRAYNTTTDDQSNPPLGKPTAKTGPPEIKGPKRTNGHPLPTAKAPAAREKHCFTWRG

SEQ ID NO: 995306 - protein, 514 aa, Homo sapiens
MLASDRACLTPLCGAMYRWCIRLSGLIERCYQKQREQITLSVQLMFNRNASCQVYYEDSVIRIQTVRSEPRYGRNLEAEPLEQIMSQPLDECGVIESFRHCVPFTNVTCFKIALEAKLREDMRVVNPIEYPPGRSPARHEHECTLSNGPCGRYLGPTLNIFKPRTRRVLNTAAAGYHQECSHENLDRSRQERHRRRDRNVKWIFWNRTLERQPIVTRDNGAVDKKPKLDSDMVDPTQKLGTSGYSTVPRLLSHGGAPGQLRSADFEQPWNADCRTRRNGLAPFGPYYQRGNRRGHNAFMRTSEVHTGLNVKHWGLRHELVDNVQQPRQANTVHMEQTLAGAPVDANWNTQAQNTTQTTMLDKVGPLNTTNMVIPRPLNCRLSTHYHGRANTRRRRQRTSATANTPRSNNLAASTTENKADIPYTDNEPTPYTSQTESSTSDISREQNQTTQQERRTIYNNENNTIERTKTHRRSQDKGGPQIVRRNEHKYRELNDTQTRNAVPKKQAYKDTKQH

SEQ ID NO: 995307 - protein, 109 aa, Homo sapiens
MVPVPRNATGQGARKVGNGETGTRLVQRWETSVDTFGGNPDWGTQNHFYDNWIGLEKKTQANEQSTNGRRHEFRDITTLRERQSTQRRNETQRDVEIYSRHLDEETGFP

SEQ ID NO: 995308 - protein, 293 aa, Homo sapiens
MEATGTWALLMALALLLLLTLAGCPGPGDLMAICPPGPRRTTAGKPPAVYGPGRCIHGLMREEGKSQAQNSATRTCCMTVIYLLYAGTMTGQKHGGYTLLLLSEIPSCPNMWVREELNRELGAGKDQAGLTVPASLTPTRDLHEAAGAAGRVVTMGNTPGPLMRSTTASDGYGTVAQGARRSCPHRLGSNAWMSPRSFKQPERVQTRTVYWMQMDGSRKHEAFLTFYLRASVSALGEGPGQKRSLLFFTHLQLLLESRARGKPELSHGIAFNFPSSRCSRHGLIHTRRKRMHG

SEQ ID NO: 995309 - protein, 252 aa, Homo sapiens
MLSAIVARSRLSLQHSHCGFHSTRKVCLIVWIISASGSFLQNVSLSQDTSCANAQVCVGVIELSDTPEGVRIVWVLLEDALYIHFELLDTWSSFEALNPGNHNPKVWMRSAVVEHIDRKRRKCIETGYCLSATKRRTIIGNLHQQLMSDLIWALETVIGWPIDRHLVQYRRFVSYKASMKGLGPDDDSLIEIICSRNKQELLRKLNRVSKENVNDLIWSKDIISDSLLVTSAADGLPLAQGSKSRRMVSSLI

SEQ ID NO: 995310 - protein, 130 aa, Homo sapiens
AIFVSSAQPQPHSLQHNMRQSVNGSEQLPRDSVSLLSSPASSCMLLTQVISEIIVAITDLSKDLDYMVDMVTIIIACPSILVQNIPLAIAIQVRTIRVKLSQIHMCKSIIYPIYPYGSRVCAHQNSVSRG

SEQ ID NO: 995311 - protein, 270 aa, Homo sapiens
GHYTEGAWAGVIRVLDVVRKEVKDCDWLHGFQAEPLAGGRLRAHCAWVTLLISKVREEYTLIGIMNSFSCCALTTKGVRRLVVWSHYYDCTRMSYLTLAGWRTRDEDAYWDPSIQRRLVRTSLASEGLKVWPTPTYGDLEAPGIGTMSGSQQSSLRVPGVSSTLTCSKARAVNSGALPGACTSSCPGFRPPHRPGQPASTGALTVPELTQQMFDAKNMMATATASRDVADGGTGVPGPMSMKEVDEQMLASMSKNSSISVEWIPTGEGGG

SEQ ID NO: 995312 - protein, 570 aa, Homo sapiens
MGKEKTHDQNIVVIGTREIRARCYHYWPSDRSNSAVGIDETEPVEKIREGGLLMMGKGVLRSMPGVVGVRIVERLGGEAVVVTYWISSLCRKSSETSESTSVDLSILIAPMDHHEGPLHSKITIEFTRGNNATRARTWSPLMPWNLSVLAWARFRVREFSETAIGGQSIFAHGDGGDQVPRRMAGPLGPHSTGDLNHHVHLCEFASERITTVTPWGYRGLVLELEDHYLRGILSPFVGDAASTQRLEKHGDPNGRGAKSLQLWTRGENSMGYENRGEQRSFREGEHIHRSFNKRGTTPTFRGAFNRETRAPEITTRHSVSAHQAVCRRMVPRNSLCTCGNNAVQNVEEFGPPKTHMSAMVEPVTSQIRDESIINQLCPHISRTISQTEGGNSGAQTHVCPRHTPLSKGPHSCCAQKTPRSVWHTTSNGLWLGEEAANDAEEWAHSTINTRAKEVGTTTEGRTVQSETRSGRDKWPRMCTPERKVAPNHTTKRGEGVAMRDDTSDYTQAGDANNLVTRTLREEVPTPNNDSLDERVMQGHTHVADIRERKEREEQAREGLRRHGRRNDWAP

SEQ ID NO: 995313 - protein, 214 aa, Homo sapiens
EKDVLKAGVNQCAAGELGLSYRGRLMSSVIAVPSCRASYETLMARGKPGTCGSAIQTTSVVSIGLDEKFRSEDLHGLAAWRLCASSIDRDNRRDRRNAVLWVKSSSPAPFRLASEVTHGCYDAICGETRSQEKAFVRPREPRLDPIQRGGSDPHLPTGQRAPTVICAQILQGCAKSMALENARREAEPVRRTRRSPPGMLPTFLLMNLLSLAGD

SEQ ID NO: 995314 - protein, 106 aa, Homo sapiens
MIIYRDLISHEEMFSEQSTRVREIADGLCLEVEEEDGHVATEGIHCMTRSLGGQCRPLRGPEGDRYSKGDSSSLVSSIVMNAFTMLGEQGFSKTGSATETVTTQED

SEQ ID NO: 995315 - protein, 125 aa, Homo sapiens
RCLCGALTSGVCGFATLHFVGHGPLGFLRPLEFWYPRRIGDCPVEALVHSARPLLTDKDRLRTGKARRDDIAAVQLWPRMNYTRHSDVLRRTSVSRHLSCTRVTVESLETSLCQLALGDKACVID

SEQ ID NO: 995316 - protein, 245 aa, Homo sapiens
GNGSKVSAPVTARAVAGGGSGWKIAVAFVTTLRSLTSPVMPSDGFRKQQEVSTTGSSDGAREGSQGEGAHPCVRDAGFVDEPGKFTFPSPHEETEICPEPQTLCPFPGACVRAATWCTCRGEKDAQGLGGPSCSGGNVTPTQSQHNCLASPILVTQVVSGGPWSWRALGFPHQTCSPGGEGQVRDSYPPSSPPLRLDLTFDLTLRGRTTCVIAGGLRVVSTSPHRRNPSVSGGHSKRWDKAAAGC

SEQ ID NO: 995317 - protein, 488 aa, Homo sapiens
MTSHSRSIAIYTVRLGVQYTTCPMDSKTLDLSRVGCHWLSCYSSAPNELVEARSRSVFPCWALSGQGVAFTTSQWHAHRHHTCVQHRKHLNRTHLGARTHGIIIATIWRYIVGLAIQSTPLSLSPSQWEATDYAMAAPWAPNGLTGAAVLPNSESCNILTQSLTTALSNGLARTHSHSQTCTPVGPFRSPQLKPGHFWRLSACLTSGSVCETPTEVGNPKASPWWAICKARGSQQAIPFVSSQDKLANHLGTRPIRANRIVTFQSLHLKGERPTMGAMQNRQVPPTRSGPPTCPRWGPLCVPFGTGRWVSKGTCLEISGSGRSPSCGHTQTFGFARSCLRHRVPLQFWANLQGILRGVPPGAGGHGSRTSSFKPNTVCLTTTGLGMANTTWDSAPAGPRKQLPGDTTHETLTEPTHPGSWYKKRQANTAYAHPPYLSQRRKERPPIATKNIAPAHSTKTTDRQGEHPKRPTPQHKKDSITTTGHDREK

SEQ ID NO: 995318 - protein, 377 aa, Homo sapiens
RVRAGARAGDGVVGRWRREAGTMALGACPMHVSRLAVPVEARTEKPSVQWMLGGDAVGQGQRTGAVCKRINSFKMNWRCIVERLGEKDTSLYQTSAGGIAEVQIRSSYNFHDFSVPKPLKFLRPHYGKLKEIYENMGPGENKRLAADIISVLGMNMSGERERLKYRLVGSQEELASWGHEYGQASGRRSGKGVAGAWMNAETVKETAHVQSDAGNRHYNTGRTNAEDEGLRSEELWQMEQVDMGGERNFDAEGYEKGTDEDITKEGNEMSDDERNRTERRVDRRAVKSTAHPTATGKGFRHKDRVKKKKRIQRRTEGRPMQESETDTGTRDRRPPERHEAKEGKGKDEEGETERDKRSKQQGTTKEDSKRGAHKNTT

SEQ ID NO: 995319 - protein, 202 aa, Homo sapiens
ETSTGELLIRCFNSFNDRHHGSGLLASWWIRTLDGQSLCRGWCGEGSWSMEDVGLTSFRPELGEAINFCDMTMTGGIRSESEWDIRGCCLLHSYVAMRSHPMNKRPHSRRVLCWDATRMNRRRGPIVEHFEEPIRNPSCRRCNSRRHRHGIRSAEDGGCGMGRNSDTGGVETHEGNVLQVAASLRYPWHRNRRRDASRSKPV

SEQ ID NO: 995320 - protein, 232 aa, Homo sapiens
WVGCPGPRETPARLVVMPRKIEEIKDFLLTARRKDAESVKIKKNRDNVKCEQFDAADTFTAWSSLTKEKAENLKQSRPAPVGRVNGTEMKPETSVSWYLYYIKILIDPTDEIRKRRAAQGLYSDVAWEAKRCKRAGGGPFLFHALPYGGPRGTMRGDTLMVKELENWGQHHSVIRHPVHARSRKSYNEEEKARVITEEEKNFKSFASLRMGPCNARSSAYGQKEPGKRRTGC

SEQ ID NO: 995321 - protein, 339 aa, Homo sapiens
PTLCAVAHTFQTVHDIADRRGIRVMPARLRGVGTGDEDCSANLSPVRMGGRAVWLERCRSGRGPEVLRSLTPGAAGAYVPFCLHVCIVSPSATGAGRVRPCYSDCHLRPTILSALLCHADAMWLGPCVPGAMHVIPGDFINYVYVHTDAHHSLIKSIFSSRRGACHWSTYPSLLRSGSLPFFLRAGSVGFVSWSQNMWLRTYCASNDVSSRRHGTSSIPLNVQIREGMARGRCMVARVYPGANCVLRAHFRFRYSQKFRTSVNRNTGKHESYGLRACRSMGERCLPEKITGGAMNRCVPNLGGPGLWDVCPPRDPVLPTMNLLMFGFANGTHAFEGKRR

SEQ ID NO: 995322 - protein, 79 aa, Homo sapiens
MRKNLGDQDGVEKRAHNGTGDGYRTISDKGKGGPDGAISNGTKRQRTEDNETKQGATGQRHVERLFALHKPARRGSREM

SEQ ID NO: 995323 - protein, 176 aa, Homo sapiens
HIVGPETPSLLPQSELETSNLDVNALHPQRCRSGASRIIVRVLTEDAMGLPKIRDGYRRGSMDEFLDLRMTVCHGRYLTGCVDRRSSNIIPGCCVDTDESGMLDSGLRRRTCDFVGVGLSIVTCGCNDMYSRKDGKNGPSCASSPYTNRKPHLVRISSKVSARRAISGMAHSDRIA

SEQ ID NO: 995324 - protein, 95 aa, Homo sapiens
MRDTVKCERRAVTHKEKHLSTRNEGHLGPPATAPAQTPRNGKTSLTVRPIGNNISPRSDESGDSRGNNTASTSKVTPKQGERQQTKQDITPQGDK

SEQ ID NO: 995325 - protein, 592 aa, Homo sapiens
AGSGVTVGRHGDPAGMCMVLKPLISNQRELVMQDAVVIVMDSNQDQELVKILRDSNGPAIDRMDVAQHQTSRRPAIGVPIAGPNRCSLCPTGYRVSTSRHRVGAARDPAGFPAASERSLPEAGARPISTEKDWVGSPEHTITGLVYRSGGIAEGERAETSKGFPASQVPMAYGAKRVVDACRFGTCDEYLGHSTKQRFDLPVHFPTARGKGPPFRGTRTQQGKRGGTEPKDFRRPLDAAIAFAHRLVAPPRRVRSSPVNTGILGGTAVSRRKPGHSLERTRRRTKASRKGSHHTLERDTGMKWTIFGEQRPALPAITVPFAGLVGSPLVGLPKQPPRGIRIGRQITGVRKTTEEAPQGGKGPEHSNTTGHWVWTHTGTTTHTLTQWPQFTFGGEEQFYGEHIHQCDSGQKNTEQTHDETRTNTSSERANLIEEQRALRRQMTTTQEGNKNHDGCTKAGQTQREGLLRSNTHEYDRWVHNSRGKNTTDEKPPIEGETRALRQDKDTTDKTAVQSRHSENNRERKARQGEQGPEIRDKDTADQQTEEHIDNERRKKTVKTDNTAREQIAKERCKRHKTDTEQTKQQTERRQLKK

SEQ ID NO: 995326 - protein, 439 aa, Homo sapiens
MSIYSCKQRISCELDHLLLHLAQQHWSVSYQDHCVHGSYATRSKWSLHGPLVHSKHSTHGHPLSIPRAYQAEALHDTTRTTICATMQTPDSDVRTAASETTRQKQITHNQTTAAHIRRTKRTKRSQTQNTTESPHHQAQYEEDNAKDDDRSKRHSPRPTGDYTRPTTDKENRAAQTEAGIPRANDRTKDERNRRHEHSDDNNRGTATPPNQKDTHTRHHTTHYKATHQDHNHETEDRANKQQQKTNNEEHTHNTTQERPHRLQVSHRNETDKSGRLTAEPARNRNTEHALHNRKAHDTARRMGPTHEEDQDRPTRDGHIREKTAPHTSTRGKSTHESRTAPQQEQQHNRKQATRHDAAAPPTGTGTRPGTAQANTERETANPPEKRTEERKGRKERRETKATWQEQDQAQATDRRRQGGRDTGGKDTNKTQVRSTDAEG

SEQ ID NO: 995327 - protein, 220 aa, Homo sapiens
MRLLAAHQHGSKAVPHPMGQRPLKTLHYNAKPKGKRPPPTQIQHSADNHNKARLKWSTQEEHNDIKQQAQQTHIHTTPAGQDTTSMVTTLENKTHAYVDRQQTETQISPNASATTKRHRKKRPRTASDRQTQGTSSKPTGETNRRLGAKRTNQHTRFDRAPSCTDGTARHATRSGTSSYRERDIRRAVDGGTVTTHVLLVAPRPVTTAVRPLHVPPHKTV

SEQ ID NO: 995328 - protein, 399 aa, Homo sapiens
VERGRVELEVSMPRVGSTELTYPQQQLRDDDDGRALDDQVDVGAAAAGVLYDWMSMRTQMIATWCQKQENGSHVLEPARLLPTAGVPMMASIRRCSAGCHVNQYAAQYIVQLNPTDVCCIHPMQDQGINGKQALAEPPARTICTIHHGAPLSGLSHTLQQPSTPASDSHHAYPQKESRRRALRTELDVSLFTTRGLAVSMCQIARSRTQGVQLSTVEQARFHSTRRRATAGNSAGCAQCELSRIAQKHSLHDDWAPKRYKAMDPRLANWHHTGAEQATGHTALRQHHRKHKARHTTPHKDPSARTIRELHIERHQNINPTEHAIPMYPTQTAPCTDHDTPYTSAHSTHSNPLVRPSPTTLPTIPPTLTTNSPPPQYLAPPPLPPHESTTPNSNHIHNYS

SEQ ID NO: 995329 - protein, 441 aa, Homo sapiens
GGWDPGTRILKTGGPSRLSSAAQYSGARGPSWLSGPPHLPFRTKTEPTPLNFSANFLPARSQLFAGDDGFMCVLAGATPLPYYCAAMTAAAGKIRPSRQPSARWSARRSRALRVKSGYITKPPQTEYRGVEPPRIRAIHDSNDTNTADLNATAKEHGQMERRHFWGALPCALTTTSLPTPAHLILGRATTPTPDTSGLDNSTTAGPQDAPQRPAEPSYYTQGTRKTAPYMNTGHNEQTPKNHPNPTRGIASHPGQLKPRTPKALPEGTGHKAGGNDCKPMELQNSTRHPQHRTCSYNQPLPRQTTDTAKTEAHTEQRGQERKRNTSRQTPRHDTTNEHHRTNGQDTQRPKPTAAKETRTRKTRKTATSTRESPVHGTTHRPHAPPQQQSEETKNETPKEHPEQQAHPTTKANDTKGRKNRTQTPDTNAHTKKRAQRQNKAT

SEQ ID NO: 995330 - protein, 229 aa, Homo sapiens
GNATGAAYLSTIRLRRCKVLCEKCKEHWLSPPEASPDPSRPRARRRLGSGRTGELRKPEEPDNGSPRLGATARRTARGRGREEGQGPGRARYRESPVNQDLLQHAPGHRDEGVVKIPVPPCTSLWSPSVPQQGPRRTKAAGTRGAGQRVREPGGLRRPRPQSPKLKLDTRLVPAGDAAATPKIRLKALPVWGTAKHETVLLRTILVSAPNEILAEDRGAMCRRTSVGDD

SEQ ID NO: 995331 - protein, 461 aa, Homo sapiens
GFLAAAWVMDRPCLPSRTDNHLDPLSCSPLCIQGVAAVSENISNWEEEMELTWTYPVAHYYLHTLSLSNDQIPSYSSTCCDIAQIHKTDIPCLPMHAMKQTSITASAARRHPGGTDTIEHFNGSLLLMHWMITYAAHLLPYPLHDHHNTTSKRRIRRISTANYTYKRHPTQLMRLTAKQPRRQKPHHTENDDIRRRNTNTHTAAQRTDTTLQLEPHKRSAIRGHTTNKRRTTPHTYGERTPTNATRNHPPHSTSHGDEHRNLTEHKNQIHTAAHHLAARRPLGKHTNTTTDRDTLAHKPGIRHQTTMQHHTQTTTSTTRTQHDTHGTHEEKRLGTQRQQEDHARIATCNKNSCTRKQTTTEENRDTHHRHKDDQTPENNSTRHRQHHHHIGDINPGPTVRTHKTTQTDANSNDKPEPPRQHTHISETRKPTTNNSNTEVTHHTYSNPNTLLNHYTLDHTIS

SEQ ID NO: 995332 - protein, 178 aa, Homo sapiens
MSARGSKGQKIGTGDSPGEAGPGVHPRSVPTTRGRISLHLHSAWPRAQTLADIRLCQVGVAHNVRAVPRGSVLCGARGVARNTKQESLYRARSFGELPCEISLQKKSALLNRFCGIRAVVSQGVFLNVIDHHSKTGAGLSCVSSAPLSQVSSGPMEDNEQRPNARVFPHKGISLTLRI

SEQ ID NO: 995333 - protein, 294 aa, Homo sapiens
MSSFPWPFLQCAQQETSVGSLQKASVGHTQSQTSEALSDTEGYLGGNHVGRSQPGRPPRDDSQKPPLVPEDDRTKKHNYKLYTYRLVKQIPPTRNIIKRPKDRLRKVTSIHPEILRHIMPQRERTNTHYHNTGAHNNRGPPTPHEPCTSEGKKAKQATGHVEPHGPQAAHNELNSRTTTTDTRGNKKQHTRRRDPIPISRGTFPKPSNRTPKGKENRAKAPKVTPPFDTDTAEITVPHTRRTTANKEEQHRSKNSRYIYRAPRNVPEAGRPKSTHTKQKRRGRRYAAPHVENHT

SEQ ID NO: 995334 - protein, 103 aa, Homo sapiens
GVGLRRGTDLGALPACAEFVRRLPHPNRGLCSRKHSSVQSPRGCRLVTVAAGRTMPKKTAAVHGSRSEARRSNAWLIGRFVARLRLPTLGAGDEDEELGISHP

SEQ ID NO: 995335 - protein, 329 aa, Homo sapiens
GDVSQKVLRSQHMGPARFLSSEIAAAAHYVKVNSFPKDDPSKPATSQTFLEIQWVPSEIISCGKSTGRRSKAEQASERGASAVYTLLEKTHRMRWIGRSVVAVTLEDSLDGLREDFVTVCAEAASLITEGLFSYVSWPDSLTKKGTWTGVPGVRMRAERGIGESAGRQRPISPGGPNSREPVKDETDGAHGQGMPGVCAGAAPDGTKSTGTGLKWRIQGDTGRAGGEKPGLLSREKALKQAGTSLNTRCEGQEMKRTDVKGQTKRRSANHGSPDGDHKTQPDEPARAGQVGRHRAGPAGSLVGPGAGERPDRGGHTKGNEGGHNAGKHK

SEQ ID NO: 995336 - protein, 86 aa, Homo sapiens
LHCTAIDLTRHSTWTGLWYVRRLAVWKLCCVSELLSVSCRSLEMLSLSGIKQLAESTNVQSSTDRAQWLISRWRPFKLRETDAVAL

SEQ ID NO: 995337 - protein, 200 aa, Homo sapiens
MTICITTEEDVGKGSKTYSEARGNDQFVNDQKERRKGKQYRTERPNRVALPTERGERRAHTIYKGHRTIERKVWDSAEALNQSHLRYTQQESSGEAHTALMEQETQDTSHPPGQVDTQQHYAPPRRSSDKMRDNGTRNTPKGSSRGKMRETRRGEETTRIDAEAVGKPAPEEAGQKTHSTVQATTGYDDSESKKQARLVT

SEQ ID NO: 995338 - protein, 367 aa, Homo sapiens
AKSRGLGARPSSFCPWPHTYAHHLFFCMVDIIYSLSFTRVLCGDHSKKKPGTDMCVGMRESRSTTQIILRVLARHRVATRTASSVPQCSQYLDETCTCFARETGKTYCKRDYIRLLRPLKCATCQVGFSSSRTCVDEELLGQQCTHNHVLSACLRDCSQPAACLRTDASRLAGKTRRYTHSRADTRKHHWIRERAASLEDHAPGTRTSYPRRTQELHSAPNAWEQDPAGQRIAAQEGCHKTEHGTRPDPALPGTDTRTEQTNCKDILRTRLTPAKTEDTARLAIDRRKWCYAKNRAYTQRDNTNLGYTNLSRCPRQEETHTSATQGTTGTTNKPTNGRQAALSKGTHPQATPSDRSACNLHTRIDTG

SEQ ID NO: 995339 - protein, 118 aa, Homo sapiens
MGLAPWRTATAGNTLTCAPLDCPRDRITHSALYIAMNESTSYRRTRRLMPRQYATLSTHTTTPSPTSEHLAPQAILHLRMAHTHACLLLYIISDTAHLTPSHIHAGCDTTAPSKHDCY

SEQ ID NO: 995340 - protein, 404 aa, Homo sapiens
MALELMLEDSCLPIQSLRRLSCGPPLHTTTSILLGNGLRSRPMTGPSGHVQTTLEAPGAPTLYGHPSQSLGALSHTNTNSAHINERLPKGLEYVLRSLTHTFNAVPLPPYQSRMIRTPGTLDPEPRQPGAHNPMDRKVAIPVCPGPTHITRPAVTLTPHPPAPAPTQECTLYSSLPQPLPYTPSPFSTEPQTYHNYTQTRIRLTLITSHTYSTLDSSTTITPYQKYTLHHNDNPSNHSSINHQQITNPHYQPPPHHAQRQNKDTPPANTQKTAKENHTQPTPRLNRAHTCPDQPTTRNKEGNNLSPTHSRLETHNNDIDTEKHIGGTRDTTDSRARETTNDTEHNDIGYETENRISKGKTNNGQSANNDGYSHRSSEAHRPEQNKQPSGTKKELTCIHRTLTLK

SEQ ID NO: 995341 - protein, 48 aa, Homo sapiens
ALLTACTPAAMEQRRVTDFFARRRPGPDRATGRDAEERKERNTRTEKK

SEQ ID NO: 995342 - protein, 122 aa, Homo sapiens
RFFCEGTAWYVCMCVCVVRVLCAEPWCPPTSAPLSFACGSQYGTLSELAVLHRHALWMGGRGLWSRLQGSPVTPTERRSPTRWPIHGSLMARTRVVGGTVLDGSTSASMLGSGPVAGSCVES

SEQ ID NO: 995343 - protein, 107 aa, Homo sapiens
MFVAPLSDVLDRLLPIRQVLRRGASTVSDGESVQGPSPSWHALIVAPESKTHKASDYSLGQTDREFLDCASPTSSSVVTNKGFVLHLKTMLGLLAMCSHFVEGFARS

SEQ ID NO: 995344 - protein, 69 aa, Homo sapiens
ATRERLGEAPCETDPGSSKCIVIITLLFGNGCIIIGTNVNVPQKRFFSILGEKLALQVVAAMVCKISLP

SEQ ID NO: 995345 - protein, 231 aa, Homo sapiens
MGDRPSTFRTRGDINIETGGLTTKQETTEQRTTGDNTRIPRVILNKSIGGSQTPTEKGGNHRQNARKGAQKTPVTERFKRPEATQERIRHRQSQTERDKTQRNRRSYPHRDNGRQGATCRAAAQNNELKPDSVSTVTLLSGEEHERGTTRPPQGSPKNRMPYKTDTTTLGEMRSPHQRNTETRQAPHTSATHTQDGGEHPSHSGSTQDTKYQNNSTPHRADRPTESDNNNT

SEQ ID NO: 995346 - protein, 318 aa, Homo sapiens
SLLPQTQKSRPQPLLPQTQESRPQLLLPQTQESRPQPLLPQTQESRPPGPRSSDPGVQAPASSVSHIPGGPDPRRPSVSHSAGDPDTRRSRNTENNNSPHQNDQRGPRDKTRDHTEAHTQRPDGGLKHSSRDTVKRQHTRNERNTSQTPGKKCRRGGKTGNAKDKKERKEEQEEQAEPERRHDAHPERGRSGQERAKTAKTRQQEPTEESKKVRQHTNNKQGKEKEKPGAEKERQDKSTARSTPRQQEQTGRKHQKNKNDDTNQTKKKGEPQEKESKKEDENGREHSGDGKMETQKQRKKPNPTNSTPPEDEPKGTGK

SEQ ID NO: 995347 - protein, 175 aa, Homo sapiens
GTSAGCVSCSVVHRPHGCRPWMLTPCWHLEATPSVAHAKLAMNPLLRRTSVMECASSEMPRHAHVVALSEDVRTDTLLVRRGPTEERQGMDQRSMDYQHSRLWTIVTRVQDPSNGAPRDRTMTSVVSIFEVMISGAIVGRIIGMRSRRQAKREIHTFSWSSSYYRHMYSENREIQ

SEQ ID NO: 995348 - protein, 172 aa, Homo sapiens
MVVSLQNLGGPERRCHPSRRGTGPVSDLTSRPGMYSPHGTQDPEATMERGRDDRRLQQSSPDGEVGQCGLVVSGMQLEKPNLGTGSVVVGRVLQTTNSPWEATGATGTTGLRTRAGTLDTWKDNKVVTPIQFPGYVLTAFVMGKLPCSVWLGGPLVALLNPCPHRILQPGRL

SEQ ID NO: 995349 - protein, 122 aa, Homo sapiens
MDTIDEKKREIGLSMEKKIQMQQMESGINVITLTVLREQRDELYAAELLNDSQMEELSKVVTQIQARSCKVRAGWTGSPGFGIQLLEPRSDCRPELTQDFPLVTAAVEKAIPMYKIVNKKRC

SEQ ID NO: 995350 - protein, 192 aa, Homo sapiens
MAVWDRGPAPGTGAEALALAAELQGEAECSICLELFREPVSVECGTAFCRACIGRCWELALVRGVLLGPAAWAPPSHCPVRSACEPWRPSQLRPTGSWRLVATLLRRFSPARVCPGESTGLRRTRAQGSGLARCGPAMAEPFKLYCMERTGNATICDGCAERSTGRHRGGKRLLAVGLRAVQEAKEALGVQG

SEQ ID NO: 995351 - protein, 325 aa, Homo sapiens
MGVVGARTLVVLLSGVFGLTLSWAGSPTPVRYIYTSVSRSGRCESRFIAVGYVDDTQFVRVDSDARYAAKRLEPWVRRGIEVTRVVPGVISVNRKQHREDVEWPRVNKNVFLSGIHVGKLCSRLIVSDSRRLSASVLNTHSRISCTWPCDYAGVWDWCRSPSEVLLWQEEPLLDVLHVIDIQRLTSTWNLALFVTPQEGSLGRSTGPQLIGTFLVTAGLRSVEIYGGGGLIWEGQVRGVVPLYCLDNRDRKDCAALGRPPRYACDRHACSLDHEVTLGCLGHELLPAEITLTLARVLEDLTTTRGSLGTCFGINLLMDGEYRCPV

SEQ ID NO: 995352 - protein, 330 aa, Homo sapiens
MNLMLGTVCLHVVPLCAMWPCAHAPDSFLGALPVMYIPMIPVCRLDVPAGLEATMALSRVPMSWCPMPQCSVPIACAHCRSALPCAGVALWLHTPAECQGPGCPCPALSVACRFRHAPFLALHLPGAMLLPPQTWALPATSVGRASEAGWAWFCICGPIQLAKRPICLSQMRDTLLATKSSFELICGRCHLLPGGPDLHIAATVAELCQWTASCPQAVKKLCLTQAEPGLGPVHVRHGTAPGPVRIVYAPIPLSPLCRYTGPGDTSHCESAPGAENTVEYCSRKSPNLEALPHSALGRHGPTVERPTEVGSLLHRSLDYVRSSPASLLSA

SEQ ID NO: 995353 - protein, 541 aa, Homo sapiens
MPTNAFTMHFMRRRDERRHEITQQNKDPENNHYRHHATHEDPTTHTEEPHTACYPQGRHPHMGGHDITIYGNTQRSKSPPYATSPQSYPNSPQNTRAQSSANTNTNTCRRHETPKPTRHKKRKRENTRGPLDNNRRITATKRRTNKTHHNINRREYLTQRTNSAVTNTHTTRYDHKSRYLTQTPPDQLTNIEHSNSTHRTNKKQLHKTDTPPIKHTTLTPTNTRATQYRAQTEDNKKETHTTHYVRHTKHPQTRQQQQATRERKTNHPTTINTTTTTPTDKQNRHKRNTTTQTQNKEQQHKTNAIQTRYNIITHQTTTDTTNIQQNPHHTLQHNNTDKTNKPHPSTHNQPQVTNTHTTTHPIHKHTRTPTHNNNTKYTTIPPQQTHNNNIHIIFTNNRNIINHHAKHPPNTTIYTFTHNPSRRPTQTYTSRQQTHPSQARPDAYAQNLHTPAPKAQNTTDAQQQNDRGRRRPTSKPAHDHTQQDATTPNTTTRTTKPDAKSRHHSLSATHRQTTETDPSQTAGTRPPRDTNTHEPLTAAHR

SEQ ID NO: 995354 - protein, 230 aa, Homo sapiens
MDTKYQCVKTEGWSLHACPGIGTYAPAEVPKSKALEATKWQLKLASAILILLIIYNNEEQVGLDIRSKYEMAVVEERRHILHFNAMVQEPIDQSWSDSTWYQVLHKSIHWHYVDLYLYSISPGVCPRQVRKVIPTDDNMENYYKKQTESTRCHPNEKARRAHTTKHAGNGTTTPKRRNQQTIHEQAKRALKYSTKRIATNRHRDKTHSSKIAIQQHNPKQIEQYDKHSKE

SEQ ID NO: 995355 - protein, 84 aa, Homo sapiens
ARAYASTLRVAAGEAERKRRDVRRRHAGDADARAAEPRSAPDAGRHARRALSARRAGRDVHVTVGLAGRRDLEVRSIERAGELR

SEQ ID NO: 995356 - protein, 78 aa, Homo sapiens
SLSAGKNGFPQGRSPASYVPPSSPASTARRQRGKEAKDKGGSRENFRRYSKLQYRVAVVVLKEYTQTIIKQNKEQRNT

SEQ ID NO: 995357 - protein, 426 aa, Homo sapiens
CCTTQLLCKTPGGWQPPLIHTVSLAQQPSKHSVPKTRYWHDGRQIVTPLTPLTPSITTSHQNALTHCTAPTAHAHTEPPSTRNQRNAWLHHMVPLSTRRLPHGTLLPLHKSNALTGTPSTPRATSKSQSSKQTVKRCNPSRQTCTTLAHVGKEPPASYRPLQRHLCASPSTARPYTEAPRETADLSPARTHRASQDSKKRTSATPSKTPENPNQRTGPSRAYERTNAGQPRPPMRHTTPNCALDNLGTRGKTQSERGPNANRLRHSTKNQSASTRQTADDSRTKQQLPTDCDPTGTRAPSQPPIDATHFTSRAQSSLTTRPSTPWPSAPTTGQHPHTDTPSHHEHSHPHGNILATRHRHQDHVNAPYTGLAHYTSPSPAPPTTTHSKTDHVSRFTTHPVERTIQSTCHAHTTSNTQNNKHVTHDHK

SEQ ID NO: 995358 - protein, 292 aa, Homo sapiens
MYFCAASARAPQTLPHPRASKHDQTQTLISTKTCTIPTYCATLTLNPILPVLLLLCHAQLLSPPLAHPCAASRQAPLIDLHSPPNDNTSLEHAHTRTPTSNPAQTPSRHCTRGGRPTCERTTTTRRMRNAPPTSTPTFTLPPVQRTPRIKAPNLRTPYTEPSTAAQTTCTTHTRPTRRADPMTTRQRTPLTPVTIPQHQYIPISQQHIHPVLQTPVTGAANTPKQGTNITMRHYDPHCSTPHTGHAPHRDHPPASNDERPQIQKGTNTQYADTRRTYEPHNDNIADVDKQET

SEQ ID NO: 995359 - protein, 303 aa, Homo sapiens
WLQRDYRPPPPPPTRAVPAARLPWRSRPQCAQASGLALLRFLAAGCQLTMPWRISWRKAWLAGRHTICAGLPCTPCRLRALLTSFMLPPTRRHAAARYARLLALDTVMGSALLNTLAALPIIHCTLACRPLRCAPAALAGLHCAVGLLAGLALLLNAPSNKLHSANTGHKALRQAMMPNTTDYSQRPAKQENQRTTADKPAPPHQNKHTNYNHQPYYTQYNNSNPLHPHIVTHPKTTHNPHTHNTTTNNNISQPIKNSATLQRHTHKATTQQKSSQKHTQPRNKQNYTHKRATHPEPKIATRA

SEQ ID NO: 995360 - protein, 241 aa, Homo sapiens
STLSRAKLKASSRTSGPPLRFAMVAMVEVQLETQYQYPRPLLIAFSACTTVLAAVHLFALLISTCILPNVEAVSNIHNLNSISEFPGIGSAIGPLYIELGWGFFTRGLAGFSIFSLVAECGVVLCVVIRCSSRVVCPAPVWTPTWPWESHGLAGRLVSTIIMVPVGLIFVVFTIHFYLSLVRHKTERHNREIEELHKLKVQLDGHERSCRSCEGPRAGLGAACARESARRDLSDADICKLR

SEQ ID NO: 995361 - protein, 372 aa, Homo sapiens
MSSSRLACERLHQLRICYWRRIARASTQLRTSRGIGNRPEMTSVPSRRNEMQGVSGHCETAGRLPQQRAYRAAHVRHDWQLHHCPAPPALRPRMTNRRNNTQAQRQRNTPGRPNTRNQNQTGQTREETTAGATLGAGTKRTEETMQTDTQNGTKQQQRRHPNPRHPTSKQTDTDRTKQDNSKHAKHKQNRPPAHHTRENPHGQPPQTRRPEQVSATTTPNERQQHSEQDDMKEGRDGTTEKEKQQRKRTEVNKTTPDNYDKRHRATTTQHRHATKSTRKPKHHMINPRRNTTSTAQLSDNILQYHSRKIKQRSSNTKRQTYEYVLSDMKSTRYRQQRRKSRQLTTIVNAQRSQHADHNNKSTQSRLNYPYPC

SEQ ID NO: 995362 - protein, 354 aa, Homo sapiens
ERSRDEQAAGTATDSLYPIAVLIDELRNEDVQLRLNSINGKLSTIAWPLRLKGPEVSFCLSLQIPSMMNYDVLLALAEHAGNLHYPWMCGVPEYVHMRCCHRWSRWPQWRRQVVRDKEVESLMGPYSNMMTLGPSELEKAATFSRPGIDESDWLGERLAINHDQRAFLSHDETHYPDMINHKQCTKLSEKEETIRQRPYTKHLCFTNDHRPWMQERVNTIHDKGSDGQVAGDWKSPKVDIHPNGYYTTWSYKEKTHVRMTAEEQHDNRTIETTKGSEAQNRKIDRRNNNQGRRTGETDRENTEETQKASTQDRIRREDDTTEELHTRENIQRRTNRQLQPPHSTIKAYNPNSKK

SEQ ID NO: 995363 - protein, 515 aa, Homo sapiens
MSLLDNQDITQDTSDSHFSTECVEDMDMHTHYSMDDGKEQTQSVASTCTATHHLRTWSAQHTQGHTASQSSNSSWRLSRTARPRTRPLGETYNQHVRRRHHDWWPRAHASPTNTTHHQLIQAGCDTGDKHEPHTTQRLIEWTQGTSRTPHHSHPNTRSPPRHRDRHTTAHSEHTITPATHHTPLHHTPRHQPPPRDSPRPRHTPDPRAADDPHDSLAPGEQHSRNNAPNNSPARAAQAARARRKTTNAATHHEHQTTTPQERAHTTPQHTHHRRRTGTRGTRNETTQSRRHQNGKTEPTNTGRQKTDHRTHAQEPQGYTEPEKDKNTHTTNTSKPDPQDRNNNETPRTPHDDTTTLSTLTRHTQRADDREHTKTPHNTNPAGTATHAGESGAPTAHNDEPPPPDARQRRQAPRARRAPAAARHLSGRRTGDSPERRERGPAQPETAERPMNQTHGEARTPPRRRDGQKQTSRENGPHRRPNTARERHRADEHDTEPTDPATTDDTDETRPTRERE

SEQ ID NO: 995364 - protein, 140 aa, Homo sapiens
MMYSGTDIHRQQRNATNWMFQKLTTSEWRNGYTPGVREQTNKMRGQQLRERGMGTKKWRGKRGGADKKGKREQGGQQAKTAGTNEGTKEQAGSTKRRETRRRNREQARNKREEETKTERNRRRSSKGEDGDKKKKEKDSA

SEQ ID NO: 995365 - protein, 179 aa, Homo sapiens
GPAEVMRVREPELEMACYEGVTPPGSRICPEDCLVLYNVQRAGSDVMEWEAMCDQFPSLGKTNAHMGLARSVVRRIGTNLPLTPFARASFEILTQASVDLVFERCAPSHLTWRDICWIAADEEETYARVRSDTAPPEAHLETRPLIVMQAQCLCSQAAWVRGEVLALKKPALQRLSRTT

SEQ ID NO: 995366 - protein, 283 aa, Homo sapiens
MDPSKPVHLIAFLGLHWLDMTQIVQEVRAGRGLDLVTHDRAVVCEAVILLVDTRDPVVVVVALCGYVGAPLEGLRTFQSVLADAHHALTREKAVISPPWPMSEKKAFYAMYCDHVAVMYRWPAAAGERTFKPGIDIKIIVAQLIRCHFARLGARVPACVCSCDQQSSGPRRALADSMLNAVHMRARQHSCDLRSPAQSAWRQCSAAWFSPVSRGRDAHDPRPSGLRHGQRLPHGVTSRFGPPRHLSPHDPPCLARGLSLGAGSRSAPLLVARPRTRLPPPALP

SEQ ID NO: 995367 - protein, 307 aa, Homo sapiens
NSLHSSPSGSGPCDELRLTFPVRDGVVLEPFRLQHNLAVSNHVFQLRDSVYKTLIMRPDLELQFKCYHHEDRQMNTNWPASVQVSVNATPSTFEAWGEQEPLHKTLYLLGMCGRPGRKNIHINVRTGVWVTHLIVLHVGARATSVRSVLQGPPQKALLPVSTCFTKDKAELQQGTIPGTPGPTEEDGVEQTVSGVPEVPITFRGSKLPARGHDWSAHTGLLTWSRYPADSNGAGDLEGSGVAQNQLLGGPGGGPNNAGDSLIYFGKFACEGRHIRTRVVYYKAWIPTDTKEDASGNNKSANDAPSLM

SEQ ID NO: 995368 - protein, 326 aa, Homo sapiens
IAAFIQRLSGSSNIFEPGADGALGFFGALLSLLCQNFSMVDVVMLLHGHFQPLQRLQPQLRSFFHQHYLGGQEPTNPSYPSGWDNHHNLCTQRGVKKEYVRGEFLLGCMVQPGVVIIRTNLEFLQEQFNSIAAHVLHCTDSGFGARLLELCNQGLFECLALNLHCLGGHADGACCCYQWRIRRMSRGVNPSLVSWMTTMMGLGFKVGLEHMPCRPDAIVQNTYAGLGSPQHYREEQCKAREAEELPDASGRRVPGRETAGESHVERHPAREGPRRTSGVHLTNLGDARRPYNEGAEGTALCDQVRKQKRAIYGGKGTPKGTSNTAT

SEQ ID NO: 995369 - protein, 313 aa, Homo sapiens
VGSVVQCRDCAEGSSDQRRCVLCMWGGLHAAMCVGAVRHVLLCVPEADGVLCMQVYLVSCWLTVRACGPGGLVKCLVAVGVCPVWFALVCLLCVRVARLADRWFARDVALVPGLKCENVLPVRSAQCPCLPGCQLFDLDMIGFHLLEGAPSLRVNETGRAGQRCAAKSPQEEGPCRGPEFGREQRTGDGRIRRQHVATEWSLPNGNVNLSSPWNCTPFGLSFPKIFGEIEDPTLAFRTPGQAQIHKCQQTSHSFCLASGKSLADGERGCGRGWRPETGQHIPWDEKTSAPSNGECAYGRMKHHIIYTAGEQPF

SEQ ID NO: 995370 - protein, 392 aa, Homo sapiens
GERELVSSYYIFIYLGAVTVFTFILESRVPRWRGGMNTSLWAPCGELLRGGSPITLCCVPLTRDSTPPKRKGSKRIGGRYLPSPFETPWCPHLCSRENRPSVGHTTPFVKKRYEKDRREDVRGLRLTRGLLWPPHNTIQRPPRGKCPAAPSKSPGELKGRPTQRPAVTRNNNIRGRVEKTLEVKQEGTTRANKNGKGAPHPSPTAEVANVPTVEEERETGEHPPTQPPNGGGPKRRQEHPQKPPHKREPQQALRRHNEGITEESSHHTSAPPQREQENNAEHKESNKKDKADTDINRYGPRTRESSTQRKEPRTKKTATQNKAKRHTAKRNKQQDPKHQAAQMKRPTNTGTPKPMNTTNTHPKKTQKPTQPKLHKHQRDRGNRPRTDHDTER

SEQ ID NO: 995371 - protein, 166 aa, Homo sapiens
WGTKFLNWKDGSKSKTLSGCLGTTYKKGKGNPKMLALPVVTREVTPGLGGNKPEANASYITGLPGCAGHKRYSAKPDSGRSHLANVGHVVTQYLEIGFHLLHPGKGVSMNVTTNGGLILGQVGQLVALSQSVTGSTFFPNLVMATLHGISSPLLPVNQQSGFLRYP

SEQ ID NO: 995372 - protein, 80 aa, Homo sapiens
MHHDSPGTGSRLTCAVMALAEKPVHGGAQGKSPEKALARRQGANQEKADSQGGQNRLQRARIQKGALSSVAHPLHTLKRK

SEQ ID NO: 995373 - protein, 100 aa, Homo sapiens
DGTTRVEGVNVDEEQVSTCAVLGRIIMKQFDGVICNGHMGVKWRWRSRSGGSLTNAIFPLAQHTRRSIPHPIRCIDGTFTRERGWWAHVKLRAAFSVLLP

SEQ ID NO: 995374 - protein, 420 aa, Homo sapiens
MRAHQSGRGGDTSPRREEKRRSRDEDQTQHICNFTQHDEEIEGEEKHQHIRDEEEKTNGGARAHRSTTRRQTTTRRDGEEECHVNAIVTNTRARGREVSKTSRRGRNAQLHAGVEDVAQPETTQQTTNTNTKGTSTKTTEEKGTPHCLLIPETEGRGRVGRAPNKPHTYGAADKKPPPQTGPHTQTTAAGGARTDSRMTETITQMGGTSRRHNNKRRRGRRDSKHPPYEDESHTRRTQNKDSGEGPIKKYYLRGGSINIVCRAPTTQRKVVSHARYQEEGAGPTKRTAAGPTRKRQRRQSDAGNQRTATRIRSHEGDTQRGVGAKKRARGGRSIQKPTQSGGNNTSVTQTTRMKTTPLLRERRRKSTDRPRREKTEEAQRSTPTKKRARYCTSMTQQRQRKQDENTRAERKAAQQTRDSR

SEQ ID NO: 995375 - protein, 181 aa, Homo sapiens
MELVGSCRGESTRRIPGLYARSPSAGLVVERVKGGRSLLSSARNYPSRDLLTVRLSASNIVAAADDHVCKSAENYDHESTQLFNAMNLFMGAVNKMDQTVMVPRRCMGDVPLAEPGLDNDVGVEVGGSGWLLEERTPPVPDSGSANGSFFGPSRDHVQPLTVLLKSIRNDIRVGGVLHQAP

SEQ ID NO: 995376 - protein, 241 aa, Homo sapiens
MVEPDVGQRLARLVATGSNGPITENMPSAHGEHGHWTDGMMVYDCIEEKYRPASEENGVRYTNTEWNRRIDSPRWDKKAEFTMSSFSSEDNSKRYDAILLPLLRTTNKSTRTRRGAKLAKMTGERSGDFQVGVSLSARVAGPSSNCSAKGPNFARYTNAMHERATENVRARQMTQVSDPSREYRVYVPQDGGSPIRRNHAPRGIAPREEGVCMKAVVKEHVRQMLNNYESKLLNFDQGQKK

SEQ ID NO: 995377 - protein, 250 aa, Homo sapiens
GLDWMPSTDHPDLPAAQNIPSSAEWPGSASATYDVCECVQGAWSHCARRTHDNGLDVAVNHVGEFLASGLGAWLQASCHAAPVPLSDKFDCYNVSLGEKAAMCGYGICEYSTDEVYKGYFHVKGLRARDLGSLRCGPDGPTMPFSVQLGHLEMMRARQAAGLIAPLSSAETAVSTDALERSLHLEKLLRTRHGRGRTQYTTEAMRPPQGQGADTWVPTGNTDLPKPEQKHESETPRDNIIHAQGKRAQST

SEQ ID NO: 995378 - protein, 113 aa, Homo sapiens
MPGRRSPPTVPGALGCLAAGRLLGPGPLCGLVQPWGRVWSPSARAKAPQQVGGAARVIVPSKVKRAQNKPAALISYDVASNSSRSGCWNEKGKALIPCKKIILNIFPLYKRWT

SEQ ID NO: 995379 - protein, 121 aa, Homo sapiens
MFQLMDTEQTHAKRVSADVRCCPVNWASKNGMRLADMTAYNELVCTSVTYTWQCIESECDHRDDEVEESLGFVATAQDVCPRLTHMASCKAISCEPRDLGTFITLRAMTDSNHHCTEKMGN

SEQ ID NO: 995380 - protein, 140 aa, Homo sapiens
MAFLMLTERKISRHIYHYAQDHNVCRHPTGLLHNLRLTPLKHLHRKSPIKPRHIYTSALIHHTTPPFRLITHTLIHNYGHHPHPHNNTKPPHGSINPSQTSAPITLIPHILTTQTHTINTLVPELSLPKYTTYLHITQRI

SEQ ID NO: 995381 - protein, 414 aa, Homo sapiens
MATPTTHYNPHRGTWRANAFLPAPRLAATPLLATLKTLLNAQLLTTPSQRNYLAPAARPAACKLSAVPAHLRQPTSEPCLARLSPSLRNPFTYTSTHGHAPFPRDATRPSPLLALPEPPTGPAHTKPLFTGRRHSSTALTPYPYPTCRLLLHTTHFIPSAAYCWTTLATPPFQQTKRARLTFSCALSEPAALRTALRLRGKVTLPAIAAWATHFFPRCEPTPHCGHALTLPLAPSWLTFSYPPRNPWPVATLPPPHRQPAPSASPVTQRAQPDTQTRHSTLSTRDRITFGTLRSPGSTDSYQPMAYISSPLSNSARQPAAPRTRRGTRAAPPRRPSLRPPPPYLPQRDTHPPAPGTTQPTGLCDLHHDTHSPTDTAPPAPPAPCAQTDRPKDANEPANGLPRHQSTPAHSTTPR

SEQ ID NO: 995382 - protein, 113 aa, Homo sapiens
MPSDMPSPPMQGCVNECACDDDDTMLCKCDAELMNDAVCQCTLCVPKNGMCVALDECDVRSANGLLLVDECMLHVMLPVLPVLGSDATVFKCLMHSLCKALVMDTGEAVHEML

SEQ ID NO: 995383 - protein, 336 aa, Homo sapiens
AERAVHGMGYVNGKKVSVMKLPEKRATFFSSRSTVLGHTRMRKISNHGSLRVAKVAYPLGLCVGVSIYVRLHQVAPGHRHQAFFRHHQGRPGGPDGVQQAQQPLGDSIADGHEVFYGIMSQQEALAPEYNVYQYHPAPQRNSHVNPRKPSQGTERQVFSALMLLMLNRERSGNPGNLLGCCYNRDIPYAFWEGRHLWSSEATDGARLLLEDTRPRRMRNVKHRHLKLRTNPEGMAALPPTSGNRRRAFADHHDAARQLTYHRRETWPADLADDHTLSSSADAPSEIHPRHGARHNAHKMLKHRGNDRTASEPTGTLPGPTTAQYGDAHSSPADTQR

SEQ ID NO: 995384 - protein, 681 aa, Homo sapiens
VCVELESGPHDDALMQPHLPEPVPSYHHTPGMDAAAAAAGPRSPVTCKPVMLLRPETHASHARQKHTATETENRKFLQQEQKTQKAREHIKERPDLSHPRRTDVNGHPDHSRTSTNSRATRPPMHQDEIYQHDTAQSQQYRKEITTSTSPNNNTYNRRHTDTRRQPATLTGTDQTTQREQNTMTPPHTADTSGATDSITPTHETWTQLPKGDTESEGAPRARHPHNTRPVTAQRAPQAPNDTTHHEAETDARRRAHTTGKPTEPQKTERRRAQNRDPNRSNHSRNTTQGHAPRSQQRPEPTEQTRRKTHGNRTKLTTADEQRSDKTTATTHRHDDRATATARRDGPDTRREQTPRTSTPERRRQSEARYHETRTTRDTRTNTHTRRTRTPDESSDSRRKLKQQRHHTSTPHHEYTDNTAARNDRATLRQPRRRQRERKPERPTRGDGQRRHQRTPRPPNAQQAQRRQTPRRPPRAEAIRAMSRTHMTLATTEMQRIRMRHLTTALQMETREAADAGQDETKSRTSNDGSRDREQRRDRGDRRQRPQTKAEQDKTRQQTHEQQDTDDEQHADRRKRDKQTRRRMRSTRRAEPMTHNDSSHDHESTGRDETKRERQNDREEKTERNEDRAAGEHRRPRTRHDRKADDSDKRKRSDVATTPAHHSNTSTRMTQRAAWTRRNHYA

SEQ ID NO: 995385 - protein, 208 aa, Homo sapiens
AAAAALSAIAASAAAPPRGTRAGGGAGRERDRRGRRAGAELPALAPAPGGPGPCPAACRPTEPCVECLAAVGPPQQQVQDGHQKVWAALEVALRELHMLYIIDAIFKSYPDSSQSRFCIVLQIFLQALWCICIQYVFVILSANDHIFKFLQAVQLSLSVRLQTSDVGELLCFFAQLSSMVPTTRQGFGIELLPRKRSLAVDGTYRIYR

SEQ ID NO: 995386 - protein, 443 aa, Homo sapiens
VLTREHRASPLPDPPPCPHPPASSPCDDDIALRSVVDNVLLCMCKAWLLLVLTMPPVARLPLHTWVQHPVHQWAVIVCGIGDHSKDFLMLALTDGPKSTRAWPSYDPCNVPQSARTGNRYTQTGEPTTGSNNRGHQQPYRNTCSRAACWDIHAGRQRHECIARPRRTTTLDTPKRAKPSAAHAEHPKKYTSTPDGHLVKLARARHNSYTANAITPQRGHGCLSSTLVSRPITGHRLNPNLGPLPLEWRTFPEVDNQWVATNHKTTLGMAPPNYINALNVTDVTSGRTFPAHTEIESRNDTPLDRHTWGEHIGGTSAHHERTPPSRNASGQHEYPHTQAGARPGKLAPDRNAPVQWPASVCVLSIPRDPFDQQPKDTPTTTDGEPRSSSDPAGGINKHKVPSGIEPRAGSVTTPHSLLETAAGQAEDNKQSHSRDLESTAIPEA

SEQ ID NO: 995387 - protein, 73 aa, Homo sapiens
SSHKNGSPRCCPGCSPIPGVKKSSGLCLPKRGDYSWKTPLVLCTGGGSFTGRNIRQVSARPGFKNLRKAGSGM

SEQ ID NO: 995388 - protein, 330 aa, Homo sapiens
AGIRYHDLLYTGVYVAVRGRCAALRMGGGRSWAWARERYGWVVTGCEHAGMDGAQRAKRLLSDTGQGPPDVPECTGDLDTVYQVASNQVTCVGASARNRYGPRMRARDTKLRDGLVRCVGRVVDIWTERLDCSLLSGKLQSLRSFPTIQPDSGLETPALYLIGRERYGGHGSHAWNPRKGETRGVVTLEPSGRADEAWQSEAAAIMNSARYAWMYFIRAVDLGLGVSRRLDGFTKSSVGMGLRNVAVTALRPINGAYVDWGRISTPRVSRERPISSRKVGIPWGLSTVEAYRWKAVTQFKSGPERGTQTLHGRLSAVIIPCIRGQFVLRL

SEQ ID NO: 995389 - protein, 109 aa, Homo sapiens
MSCPIDDISPCDSSAESLSCERDCAVHTVLCDLHVDVHPSFWPSSLNASPMTKCPFSHVLVALLMPITTAAHSDSSAHLHFLITRLHTYQTTNVRIRYVDNTVETTNTS

SEQ ID NO: 995390 - protein, 248 aa, Homo sapiens
APRRRRPHWILQLLIPSFAHAPLKNCVLPAGKLHGAALTEAKGARSQPRDALLYSAAVLLHDPWPSQLMAELLHMLLVCVQLRIQPLVLLCAVAARTCLCSTCTWSDALMPVTVRLVNLHPHLRWSCLFCDGACCCVCALLVTSLCDLGLRRNALIRLEFGCGCTSRLACLILIRRWTFVRDYPTDAEALHSWTRWPCTAHLASLSDPHHGKRHRTCGRLEGDPYPLLDPLGIFHYGRNPRDTPGYRV

SEQ ID NO: 995391 - protein, 313 aa, Homo sapiens
GARAGAQAVARASTKVEAVPGGPGREPEGLRQAGGQEAEELLQEGLKPVLEECDNWLGLGRQSMRDVLPVANYGSDGPLVASSPPLMACYGPCEDMCGWLGPMGLALYPDYRVSGPPHFALSRGPALSTLLPRLDPRMYHIEYPTMWVRAVCAPSILLHSGASVLVESSLVDALVCAHWGPPSLIRWSPHSFLLFPLSARDLASLGAWPWFFFGVHARGGGASCLQSGFPSSHWELPARLFPGADGPRPGNGRLSGPQLVLPSFPVCPLRSAASRLIFVVDAIVFVGPRGLLCGWLPRRLPVLRIVVPCAFPG

SEQ ID NO: 995392 - protein, 196 aa, Homo sapiens
MLYARMDTTGLNYEVPLRRTIDHDLPRLRSHPDPRNSPSRLLFPHTRTATQTEHKGPHSLAPTTEHDGSARDAHGAPPLRPQPKHPTQSTQTHSHTPKQGHHHTGYNNPPEPRQPHHPPQAPRQPQRNRAQPKHLPCNPPRKAHHRPHKHQEPMAPTPNRHRTHRPNETCHAASPRTPTSKANKHPRRHTTQHAPT

SEQ ID NO: 995393 - protein, 344 aa, Homo sapiens
GHTGLRRLARGPYVSRAGGWSERTPGGWREDGETEECRDRSCRSPAVLTSPCSAWDKVPRTVTRRTRMQSLLNPRWLTAAGLTSLTSRPYGARAHSLAAALVHSAPRLAPVPALQPHAHSCSRAFTACHCCLQASSPHRRPMLPQLCHLGTRHLLSWDATLGSMAPNGQPPIYHSEQKPPALLDTDHNADCARHASAAAAISLYYQRKLRVALPTLPNNARRDSPPAHPGPGREFQPNLYQPTASPNLDPSNLPSVTPLTPTFKWADQVTTQPVQRDRNTPNARTGGITPAHSRHPEPPVNGAPRTRLRNRRPEPHPPTDTQPRPLQGLLTARAPVQLNDRQFR

SEQ ID NO: 995394 - protein, 166 aa, Homo sapiens
MVEVLRFVHRVIQELLVDYYVKIQDTNVSSEDKKFHETLEQEAVVTELMRLLGPSQEREIPPLLGLEKAELLEVMPSQRICVDEGSVQQRSRGAGSKEKCFTLVCTMIPIQMLTVKPWKAERCGKLAEVLVGEQKQCRMPRAEKEQMLCWEESAVTRGVLGAHLRE

SEQ ID NO: 995395 - protein, 324 aa, Homo sapiens
DESDRYIASTVAGMDVQEMEPVMQEEIFGPILSIVIVVSLDEVIEFINRREMRLALLAFCKEQAGGLRRVLTHDTVEAGSPFCVDNCRAFDVAMEPGRGCLVGRSGCQWDGPATMALFSFDSFSHHRACLLRCPGEETLTALALKPCGICARRLRGGWLRVAQWEVPNGLLVAAAASDASLPTGAQARQSTMIVPVRLRSWCETGGLGSLGPEEAATDGQGFRGTPLSMGLSPPLLGLSSHVREAPPSALASMKAEVDAWGNSGVIVPPWPDNGQRIPEKGEKRPFGGPRSGAGAEGRIGRARNWSATALVHAFREKIAPGGGT

SEQ ID NO: 995396 - protein, 101 aa, Homo sapiens
DPHGGWEPVHVVRDNNWQWSARTLTLVSAVQRGSESRDASHAPAANIPVYRCTIQHDTSAEPFVPTTVSCAAKDPTTFEGLERVEFCDGLRRCQDVAYAIT

SEQ ID NO: 995397 - protein, 383 aa, Homo sapiens
QTFDAHRGPGDLWQPSKVATTSVITIVNVHRALLHLLCPFIVRCSPYVACACVWLVGVAVAGCGWRGRLGGGTFPRTCHWDADISDIRVQAQAPSRRRQSHQEETVLQGEEWAPVGPELHAGPQTHSRPATCSPTGCVCVVGIGILHPWESGHIMERPSGSSAYSDWGLPEDTAPGVRALWSGLAWGWIPLLLYSKLRHLYLQRTPRRCGETINALTGFCRPPAQEHGWIVARKASDPFQIGHDEQCTVNPGMTTSTGHEMNLAPSDDTSRKQYKMRTRDVKRHMGSPKARRSERSSKLEERDQRGRAHEDHRMEERSGHKRREVPQETQGTPRKASTQTADNPRTKEDQPQEMRPRRHRGTGRREGQHYRRKQTSDRTHTQA

SEQ ID NO: 995398 - protein, 169 aa, Homo sapiens
WLGSTGKMKTILSNQTVDFPKKVDFTLKGRTVYREEAPEEPWRRDFNHFNVKLSLLGKKKKRLRGGQQGGVTERNGLTGSDYWKSCTEHDQGVLHWGFRYKMRSVYAHFPINVVIQEKGSLVEIRNFWGEKYIRRVRDETRCGWSVSQAQKDELILEGNDIELVSNPGV

SEQ ID NO: 995399 - protein, 306 aa, Homo sapiens
SGAGGLSIAFHRQCKESPPDFRDTVTQEHDAVLSCLVQVKLAWRDGEDIILQGAIHDIAQFYVGMSCTPGGPEDSARNQDLPQPESVCGKFQRPQCTLPVGECSWARGGMLLVILAAESKVAAEELAVCRTGLTGCYTESSIDFLDSSEYLMGPLHRTTLSLHRMILLQKWTLTETTTWTARHFLASPESVDVGGESRPTARHISGRAKRQSTRANEPPCGHNMPETRTKRHHQVDRHMPHGGREPKRRPTRSPQQPGAARDQRKSRELRSLTLTTADLWNSHHLLSDRTPAAASAASTGTTKGTG

SEQ ID NO: 995400 - protein, 110 aa, Homo sapiens
GTPAADVCFSVMCGRQKGPIEKPWRGAPNYTPSGISQSEANGATASKRRRGSIRPPWRHSPGVLSTVPWDAVDKLVADRRNEVVQKNEERIGNGSLWGSLLKDVIIGTQV

SEQ ID NO: 995401 - protein, 121 aa, Homo sapiens
MTRSLIEELESIVQAFVIRDQAHARPENGSKDMVESFESFTLKEGVMIFKCLSVALRMGPCPTLRLFRHYGQEEGKGSLESRIVEQGTNNAAPGDLDILTTENIPGPFRVAEHQGSRLGLL

SEQ ID NO: 995402 - protein, 478 aa, Homo sapiens
VSESGVFPSFLSQAAVATGNVCASKETAVIVTQHSYCAGGPGLVVPGMPAGCQPLPCVNVATFFVRTVTDTVTAICDLCRADYGSDGAMCQGQQERTWQRRHAGAQKHNTGTKHRHSAQGTPPWDAAQQLGTRAEHNLGQNQKRSHRRAIFKPRTEHTHRRNAIGHYHTYTAGPPTHVPVSPYATRSIMTISQLAKGPPGAPGDGTNPNQTCGSHRLQHTMVEYSSGSRRAIARTPPSHSLLTFQAHTAQHASVTCASLRPRISRLGHPKRSTAETQNSLWTPITHPIQIDITSGNSRRIQPLSPAFSKRDSCSRPHSNTTAPRQAATLNRKGTRTPAENSLPPIADNHYQYCTHTEDNNPFISYAMHYWTKAPGNYHKVRTPTQNDSHTVVYHSDLHESDPTPQSARRHTMPPSSVSTHHLQKMRGALSEMCSCVTHANTTDRHETISTQENKCQYTARHTVDAHSTQNRHRTPMLD

SEQ ID NO: 995403 - protein, 179 aa, Homo sapiens
ASVLTSIASGYQRAAGLNSGGWHSAGEHAEQVCEARVSPRRSSRLKIRRRMRELLGQALENEQMEQAMLNGEDYRPSGKEVKASQPARKSTGTGSTEVAPRFIDGPYPIGRSVIGDWRCRIGRWHLRGFIPVVAETWGGNTTIGKDLRGSVGGRSDPVRSVLPIHCDAYAHHNIRRSKR

SEQ ID NO: 995404 - protein, 156 aa, Homo sapiens
GRSRSLDKEDVDACDEVSRMALLGPVACFRRAPNDLPMVVVDWTVALGVLDSGLRRPSWKLDLTGDLESFKKQVFCADEEGVEYRIYISFRVSREIVSGDELHPVIRTGKASRLTRSDYMVGELQHLSPASQTDEKTDHLSWEWNLTINDTDWKVL

SEQ ID NO: 995405 - protein, 146 aa, Homo sapiens
RWCAEDSRFLPGFHSFVPCTVAPSLRCQPAKTVCPVAGVMQRARPALGRWLTLMFAVRGPRWAGLVLSSWGALVSRGAADSPCGRRVQWSTCAPLTRGVVLLRIGTLSRGWVVCLSAALERGPPWGSTPSRCGSGYGGERCRIEGS

SEQ ID NO: 995406 - protein, 228 aa, Homo sapiens
GPFFSPHVGSFPATFSRKMPTFKADRGVGGQEKHALLADQILAGNAVRAGVRDNAVGVAGSWISVRKSMWGPGMSRQDVCSRRTADTRRNSKAESVGLGTSPRRRRERTTAAWVQEVPQEWITMTRTEEWPILGEGCHNDEQGDNLLLEGGMWTRVRMRRATMQMFMKKNPFRAIVHPGMRLIMWTFLNEKDRRDVETGSVRRCTACLLPPLTPGSDMFGGSAGMSTC

SEQ ID NO: 995407 - protein, 270 aa, Homo sapiens
VPRPEQQRERRCEAITCLIPVGNLARANFSRLSRQEVARTSRRLGGARRGRAPPRAASSLLPPAARAPGLSPARAHSLRPPPSSGPLRAAQGAGVPRNSDPSHLDLPQCPRAAGADRRSRAALLRLPVSPAIPGRGCGVDSDPGSSSPAREPDRAGGARTAAEPPPWLKPELRRKPGQTQGKGDKAAKLARKPDKQPEDNDEEGTPGDGAANKTARIETLRDTDRRYRPPHTRQKEATKRQPQHPTTNHNQKPPNQAHNLTPPGTTSATS

SEQ ID NO: 995408 - protein, 506 aa, Homo sapiens
MSGVTCRRVLVSEQSRRTTFAPSGSSWGLDVVQSGAQRNPWSRFAVTEHQRNARRPWAATLSRIHRAVREGFNSDLCAKRLGEEIIGGGVCTSEGRRMWTRCPWVRTDGMLFSQGGRTIRGLQVNSQLTIRYSWVFLLIYTSVYCKTRIRVKYPQVRYKLGRGKLSRFWGRGRAAVHEPASFGALAQNSLQLWRGCGIPKFDKTMLASNPSELAMARKRKKANRSVSAGKDRKLWLRGPRIVTFRRGSEKLTRWFFGFTASIGGTKGSLLPAMNFKGTIRNGTSKWWRFTMGGGADAGSVPPHGELGIWPRDMRKRVVVPPNAPNSELIMEIRSRVDFMPGIGYLKVDKGYNALHLLARRLGASDGAYIPMLQLLSRHWHICRASAFGWVNRYVPLVVAAQPKVRHAGSDCLLRLCIAGKSSAKKGVSIQKRGLQSAAELQCAPVASTSKGLLGPKKRGRRTRGGPQRTLTEGEEGGPPRGRTQAWARRPPNVIRQKEEGGSRHPR

SEQ ID NO: 995409 - protein, 81 aa, Homo sapiens
MTEEAHPPSMIETRVVCDATTKHNNGRVMTPQQRVVCLHVLHQQRRGGPPPAGRKILDTPLVQPTSSSPTEMKTGEHDKQN

SEQ ID NO: 995410 - protein, 262 aa, Homo sapiens
MCKVLGIPFLHLKVNGIAQQFEMHVSGPYILSTCDKCTVGSSESTRVGFTHQHKVQWSFSLNALTLCGCYTHKWASYILSETGRTNLAPGVETETRNETPHSPAGNLDATTCACVKNQQDHTRKSRKRAHKAQSTHDMSGAPKNQCYNTPTITKACNRRTPPKRGKPQTGAHKKTTPTRGSQQGGDTSTITPPREDTTERAHTNLPRPPSNKTPSTAPHKPRGTAGQHMGATTPPAVQRETRRQSIFNDNTAPLDQNPATRT

SEQ ID NO: 995411 - protein, 220 aa, Homo sapiens
EEFSPAYHEPGDPQPYGAVVRLYLKLRPPWTDLSMLGDGRGRTGPSGRPTCLSTAGWLRTLTCLTGAHLCICRWSAEQTQRSLASRLVPWSRVTSRRSPHAPQGAFSDALDEGTTVSRWSFVLVGDYMTNVAGLESSPPPVGMIAMRPRCRNKDVQLPGIRHARDSWGPALPGKWRIETSSNIASLRREALIARVGDQGDAWGDRFRKTIQSLGNEGKLE

SEQ ID NO: 995412 - protein, 109 aa, Homo sapiens
MDSYRRDRNVFQVVMNDGRQMMKAHVDVEGLIRLVTLHTILIHDVGIDCERTAKQLKIPEMTIVSASVERIQVQHKSPGENHWSGKSIGSPEEVARPKWNFGSGTVGAN

SEQ ID NO: 995413 - protein, 102 aa, Homo sapiens
SQKHLPFLECHCKKACEDKGLMQDPVWGTGAEEWRKVGCKVGITGSRGKPPGLWGRMGREIGKDRMSLWRYSGHGQEPPGLNRWASLDSYTLGAWDRPTLGD

SEQ ID NO: 995414 - protein, 102 aa, Homo sapiens
MMFTSHKTSHVASMKLLFDRIFEAMPPPFQSTMEFQNQSQPLIFSKKRLPSGIVTMSSRVLCRDDAWSCTEPETKFLPLCDWLEQPPVNATSLGQDFLGFGL

SEQ ID NO: 995415 - protein, 271 aa, Homo sapiens
TDSLPSFSGPTPEHQRALSCPQDPIPPTQAEPIRREEVRGRGEEGEPDRGNPAQRPEQVEIDGKSGRDTATKKGTNTQDRQRTQQENTETHEETREATHTIEEQHARERERKRETHNPEENERHTRRREHKNKKNREEDERQQKQRRTRSNNRSTTQGTNERRRAKQRHGHRGRRRAHTGTKVTPKERRRKGRGDAQRTNGTEHRDGKEQEELKKTSTTTLSKQKHKAKDDNRRDRRVDTHTEPRRSQKQDPAKAHDEDHDAERDRRRQAA

SEQ ID NO: 995416 - protein, 220 aa, Homo sapiens
EKLCSGQRWIDFLKCALHAGPGEHASSRGVREPHSSVVCSICFPHLDGADDAMRSSQHQSRVLAMAVMPGQWLPWCKMSGQLYWQDCHRCHVGVLCHAHGVLIFYGDQPEIVSQSMVRRNCPSCDSRVLLTVPHWSVCIMRMELAKCAHVLCSLGWKDPRYNPWHQSPGACTPRCAHTGTALRKWALESAVHRRGELGTIQGNTLNSCTASRELSLDAPY

SEQ ID NO: 995417 - protein, 290 aa, Homo sapiens
MAGTALKRADWASTNRLTLKSVRKELVAGPIELKRTFLEWEALIMGPRRHLRLSGGVLPAILRFPTLITRLSPPKMRLYLVMMLSVPTIYPDGRVCISILHAPGDEPMGYEELAAVAVESCAECGEDPAVRCVEHAGESPTARIVELRWMRPYMWSDEREQCYKDCQADRPEVSGTVRPGLAQARSSSREQLSHSPPGHLVTVMLCARYQTRQTCKKPWASCSDRQPFLIQTRPSLLEMDVPSSVRNYSASLHGKFKQEFLHKGVPRLDYSELVQKLPSPRREPSQFTVP

SEQ ID NO: 995418 - protein, 201 aa, Homo sapiens
MGRSPPPAASPTPSEDEEPEDEEEEERQRLRKVKRRRWRRGEESAGRFLSRGCLPGARVGPWTCSCLCDLRLLDRAASPRARQRLRSSSGLLLPPVVTEMSRGVTVLPVLHRHYSGFQPYVRPIAFSRGALHAPSERKPVLHSHAKVHGSLRGPPSGNGRMALGSPQSFPCRQGLDTVPWAPVTNRPGREYRCSQGFRQAR

SEQ ID NO: 995419 - protein, 233 aa, Homo sapiens
ASIPAQATNEHFSRVLLVLCGRLIWSPSGPFCFPLGGAGVAPSSPRPGVPVCTARGRQISPFRGRPHVSRSRVGAACVLTCGCFLAPVFPEHVPYGARKRAARGEEILTLVRGANVIAPAGGAPSLRFLPHPPDEGDEKGVPKEVYSGPAKLSRGLARRVLEKGLRAPRDVRAPRERRCLSQAWGVSPSPLPVGAGASESGENPKRENQKEAKRTLACPPRGGKPPFSQPFIL

SEQ ID NO: 995420 - protein, 244 aa, Homo sapiens
MDSKSPGGLNFFFSTSGPAASWALLARMPKSRACGTGHTETSEGLEILLFLSDDSSFLLLIDVPEGHDRSGQLGGQFQFFSKTVSLLGGRGLLRGKRMSWERTPSAVCTWRLQGLRWTLSRLLGSTENAEWSGPPLWVNAGHPELLQAEAAAGAHLRGVPNRGAAHDWAGVGPDAVATGTMLGAWVCRAYRTGGSIRAGWLEPRGHAPLPVLCESGGFKNHAIPGGRHGCLGPWGSLRQERERR

SEQ ID NO: 995421 - protein, 265 aa, Homo sapiens
GEAVSKNEWNAYYEEVVYVLEEIEYMIQKLPEWAADEPVEKTPQISAGAELYIHSESTGRGPRACGTVEIVSPFNRHRSQAPWMVRRVACEGKRELCPLGALRVAEVRTMAEHLLGVTIHSPLVNLGTGDSWFPMVNPNGAVVPVKNRGETVFQRQQVSTYIRVTLVQSRGVGSKHHHERLLTESNLEPLINAGAWEGKKSLTYVDENCDLGRGLPDSIAWGKFMNSGQTCVAQTTSSVSPRIQNQIVEKLKKSLKEFYGEDAKK

SEQ ID NO: 995422 - protein, 260 aa, Homo sapiens
GPGHPVGAEERSSLLSFAALTALRRTLPARTRHVNSTTPYSQKGKKFRNPYNENREPEEYDEGINHTGKEKNIQQHDRSKKKQQRTARHEQKKTKEERTKAETTQQKKDQKKENNNTQTRRDRKSDKAAQQHDTETEPTNKQKKKKEDHRQNTTKNRQGRPKAPTSKHNTHNKAAKQRKDKHHETTTHQDNRQTQQDRERKDNKNHLNNKNTKHAQRKKTEQGQRKKEKTNQNKKQKARNTTNHSKDTTKQQQHNTKRTK

SEQ ID NO: 995423 - protein, 362 aa, Homo sapiens
RERERELVSRFFLIFFGKAILWKNWEGSLPYYFIIVKILKWNVAKKTPGLQTDSGSVWARRLGGAQGWPPPQGVREGRGATANKVKRRKGQGATGERLIMRGEASRWEQSTKNCDTQRGTGERGYPVVHNRLKTPPKSALRTNRSIPQTKHSMETHSRHPYVSQRGINPVDPIHHIPRGSTSQGAQAPPGVTVLERHGALKSEERSKTCNSPGQTPPEKARRAWHKTINPKDRGYRTSRSAHTAIKTLEEPKGHQKENRPGIQPETNDDTGTRGERSVARGHHERQTGVQPTLGGQQRNPRAGGPTDKCATRYAAPIKVGKKAAITNVYPKVRITTMCITRKELERANNRERKKPRGSRKHT

SEQ ID NO: 995424 - protein, 138 aa, Homo sapiens
MSEAGEAEHRAGSTSLAAGSGRRRPSADPAGPRRPESPRGQLVRHQAAGPERPTTTIAGNPGEGRGPRSHGHQGRRLFSPRRRAAEDAREKSSRATKYVGQLSTWFNGHEMRYGIYNIENDTRRRCISNIRLASRRIT

SEQ ID NO: 995425 - protein, 116 aa, Homo sapiens
MGAGGEEYTTTRRPCDDQEHDGSSLEKQDVRPNTQGGVHTNEDGKCCVRTPKGIARTLRQGSGPSQQTPLRAQTSAVHKHRGLPPTRRGGGTTTPPRRKKTYTRAEELRADTKLDS

SEQ ID NO: 995426 - protein, 318 aa, Homo sapiens
AGFSYAFPEAVRVFFKELIQELGIGYSDTGWISSILLAMLYGTGPLCSVCVNRFGRSQGLFMLVGGLFASLGMVAASFCRSIIQVYLYHCGSVTGLGLAAQVSQLRRSSMLNRLLQQRGAPWRKRGWRQQVHLSSLCAPEPVWGRLTVRNRYGVDGVGFLILGRSCCCNLLRVCRTHEAPGGQLAQAGSGPSRPSRRLLDLSVFRDRGFVLYAVGDSVMVLGLFVPPVIVVSYAKDLGVPEAKGRFLLTILGFIDHLRAAGAGFVGGAWDGAAYSVTFSVLHVFNGPADLAGLRGAIRGLVTSASLWISTAWWGPESK

SEQ ID NO: 995427 - protein, 104 aa, Homo sapiens
MPGICLTVARFSLVEGASSGYTDVSSSDWAAEIKSLMFVSLSEGELRDTGPVREKGRGKGFQSAHCRGNTPVRCPMGPYLERLSEFACQLRHWDLAVEAYLASP

SEQ ID NO: 995428 - protein, 265 aa, Homo sapiens
PSLASQVPWTQDPTWSRDAGSPPWGLVLAHPAGMPTVFQTPHLRGAPGLVLLLSLLHPRPRPAPQAALYSAWREGWENLQRHYPHLSHCGAGGCMLYATNKKKRLFFQTKKKKTKKTPGFFSCFWGENPFFRFPTYNGVGDSGEKPRTIGGNKPPAKMIPSGRRHICGHGGHSRGTGSKTSMCSTKAAGFLVCDPPHSTEVRDYLPKGPTDEYTVLRPPPVGLNNTAQRPPVVWINHGFSRQGHLCHTVDMAAHHGRHGNRGWNN

SEQ ID NO: 995429 - protein, 121 aa, Homo sapiens
AGGVTLYFMVRKKDGSGNRVDTVQASAFHFRAGFRAILGPQGLPGAQPVASRGRQARLTGLEALFKSLGESCVRSTSNVTCATSVQFVQGSGLTRGNTVVHFLSTANSVIGSGEKPPGREL

SEQ ID NO: 995430 - protein, 108 aa, Homo sapiens
MMGGDLWLADYMKTSGNDKFAVFYGESRLGRDMKQFHEINLEIEDLEQVSVLKVFPKVQKESDLPGRTFKNGGLAQELGKGGHWKGARELEIHDKRLLAEERQSGGEG

SEQ ID NO: 995431 - protein, 100 aa, Homo sapiens
AFRGAVAMKVESVQFYRVQDLARTREALRQDRREELTSNLNAKCESGLSFTKRKSSLQIRLDCPLQKERHKNRDSRKTIHQRRTRRCSRIPEGHDWCISC

SEQ ID NO: 995432 - protein, 100 aa, Homo sapiens
KVCLNSQLPSTDSPVIVRRSLGKRFISLDNQGCSVWILQRNELSSESTVKLAIYRAMHAHTRYPVICIPVSTQRTELVLTHRSPGSDGTLWRGAVLGVRD

SEQ ID NO: 995433 - protein, 235 aa, Homo sapiens
RVWDLSDIDKDGHLDRDEFAVAMHLVYRALEKEPGPSLPVSSPPEKRVCPGPSRLLQPPQRSSSAVPRRSELKEGAVPKKLKLKSKVNWVVPWRQMRFDEISRRLTGLDGYVSGQEVKEIFMHSGLSQNLLSTHMGPGRYEANGEVKQRPIRVAMYFIQKKVSKGIDLLKSSRRTWSRFGERHARPDIQALSAPGELHGVKELDDIINEIAQYKERTITGKSIREKEEDPTENRR

SEQ ID NO: 995434 - protein, 372 aa, Homo sapiens
LPGTSGPSRGRDSHTLQSVPREFALILWHPYARHYYFCMMTEDRSEAQWCAERVLAKDVRVRARADKWESPEALHTVRRARAYHRMPSPHVTEPVQGAVLAPGRCCVGTTVTDSVRQLVGDGGAGALSLKALASDRVVKGETRKDAERRPAGISESPDRRVNHKWVVSDDKAKVRSLRRRRVACAKGCRLGVARTGAFARGPVHSDTWTYWILTLILPLLQRKATRLDAGPKESMRIPFHSPSRYWDTKSSCGGWESQWYPTSALIIPTIAHVLENEGPLEVGPPSTSHGLSNFDGDRELARLIPRGGYNGKPLETLGNGSLPNDRGRPIGTHRPCARTLTMGKRTGWSRGCESNKPPRSRNARGCDESTER

SEQ ID NO: 995435 - protein, 91 aa, Homo sapiens
GGPAWTRRAHWFRSPLRSSSPGLQSGPPEALCVCVHARAWCAQVRGFARCAWRGGNLTRKRAPTLCKECARSDLDRPVWRSGGVVFQFSMV

SEQ ID NO: 995436 - protein, 114 aa, Homo sapiens
MELRQRVVNRSVCKNESMTYESMVKRRARAWDAHDCIAGRGRRLSVMLYLLVYRAISQDLPQSAMNAAEYHRQSGGCISLRLTGTGDIRVSCTTSGDGLYEGLEWLSNQLRNQK

SEQ ID NO: 995437 - protein, 262 aa, Homo sapiens
MARAPECSGEQFLNLRGCHRAIDFESLIEENHLLYLEEPLDSSLHKDVPCGDYPVNEEHVQIPLVCETRCFSVPSVRYHLKDVQATSRYLLRAWYGVKHNSGKGVEDKGVYRGKRRSGVPSWKMLVVEREMKMKVPVKKLALPERIDGQDWHQQVVQVGSLGSESLGEFRYWCPFDCMVQLGSETLVREENLANPDSRVRTPEILASGLPMQGAVTDGREHGAHTVIAPAHDSLETPSIPQTSFPRDDEPPQQRAPSNNRLI

SEQ ID NO: 995438 - protein, 110 aa, Homo sapiens
GWSEPPEVKTGGTGEAYAWLPRASTTCAQMSALDLLDGSSDGFVDSAWISTRAVAGAPPSNLLPRLDARCLSSSRVVSFRARSLERLAIPWRGCLTRWWDLVIDKMRMEG

SEQ ID NO: 995439 - protein, 306 aa, Homo sapiens
MRQFITPSCVGSQCFLCGSCHRVRDSVQNLLVSLRCQFAAAICGPFPPFSAPPVAWRHPAVPHSCEPRLKWLGLTAVSLTSPIPLWPLEPTPGPPEVQVPAACGSQSRVKPVLIVGSKLLCAVASLTGHLTHCGDFQLPGFFDEGCQSSARNSCVVHVFHSYLPGILRQRLLLRPLPIGSTSSGVTGCALNCHGYVGAPSFPGRYPSRLWTFPWFPNISAPSPLSAPPVSPFAGRLRAVQIRLAGAPGLSDISAVPCDGAPAGCLPAGPPLFLPASSPVLAPGASACDLAPPAAYLCSGACPPTAH

SEQ ID NO: 995440 - protein, 284 aa, Homo sapiens
MYKAITTHKGGHTNKRGRRVWPRAQWATHKPLTDTALTAFKYCLTSHTIFAAIPNKDHLERRMSYHKQATPENPPHTVTPATQTRARTAPDSRHTTTPDRTRRHDRPTRTTHTYTPPNTRTNTTTNTKRPAQHTTLKHALTRAHPTPSTPPSDQKHAHETDVAEVARPQQEAQQQHTRAQGPVRLTNRASRVFSNKQQRRDKVAQKCSPMTPRGQRAQDQNPKSPTADIRPRPRWLYAPYTRKRHATGSREIRASAAPAPTTTQWRSPSDGQTRIIALAGKRRD

SEQ ID NO: 995441 - protein, 407 aa, Homo sapiens
GQMPCDGRGLGSAGHPVWCPGAMACAACLKVTELLLMELLRLLACDTRMAVNGLELAERLQCGVGWPEEPDDVARSSTPTTNRGLTRAHHSDGDAMDNITRQNQFYDTQVTQHNETRVRLRDGDHWHTWQQQQAYRPEMTDSRLKHRSTHQHSSRLTASQLKPDRQQFQSRKEALSRKTGARGYFEHPRGYSEGPLLLSLLLTTALTTDFDEYPRLLSTTYNLAPPLQGGPENRQQVATPRHHLSVLSITCWSTGALCASYSGSRNVGRVNASRMTTPLYGHIFGDIAIASSLTGAPAPPHGWTAIRVRPLAHLEGPQLRKRRLLQHCAYWEAPLYKRRPQVVRVDPAPRTEPGDNSCDQLIVSAYNYRVSQTRNSQHARRALSEQRDVRRGRSRRHRLHRHRHQQE

SEQ ID NO: 995442 - protein, 303 aa, Homo sapiens
LELSSRGLMKVSRSPARIPVTSDDIISVLMYAVDWVYTLPWNGNAPLEELVLESVIFGTLGAHIAPDDVTDEMDDSYGHCIHERAVRGCASTKRDTNECPWDDHGMDIDTNDWRVDLHVQVVIQANFLSDWTRNSPVEHPGEPWSASEADCPLAPHSYEPTLQRTVHPLGTRSSDDNFNSLEAPPSLTTYSPFSHFRAPKGGLVVQRPYDSPRDFADTSHALLESSTFGKHHKSAVISAGRLKNWRKPTVTIVDTHTLYGMAFAPLVRKLLGRKRLGSRCNMGRHSASIGTPLHSRTASNLNT

SEQ ID NO: 995443 - protein, 213 aa, Homo sapiens
MRPQRSCAITPVLESRGNESAQEDRKGRENAPVGTQEANGTEYTGRDKDPRCWKGAEETTTGQRKANSGEHQSMKKKGKQEVKGELRGKPNTNRQAEDNKRPDQTAKNGAKTSSGRGLHVGIDRGDDDLHALLSVGTAEQTGKSERLSRGGLVRVSRAIWMYLRYDCELITSARVVTDRSGLECAAACCFHGGLRVPWMLQSTMIEVGDSEYE

SEQ ID NO: 995444 - protein, 293 aa, Homo sapiens
MAVGRPPRACGCGASEAGTSLVPATAEPAARDPAREIVDGGRPAKRQLAGSDSDLDSDDEFVPYNMSGDRELKSSKAPAYVRDCVEALTTSEDKSGWEAALRALEGLVYRSPTVTREVSSGAGQGASASGGRRLCGREYQAGHATPRGHCVGRQRAQNPGTGGRLTWTHKSNPTENSSATHGHPWMADHEMPQEQVRQGVEQEGNPNTGPQVQTAVCLQENAITQERPGKEEKRKRKKTDDAQRRPHRQRTTTNSGENTDTNDKKQKKTTAQQDRETKNNSKKRHDTGAHGKH

SEQ ID NO: 995445 - protein, 262 aa, Homo sapiens
AETLVSLRVHTVDDIQQIAIAALAQCMGPSRELVCRSCLKLTLSSELEAMMRILQDQRPTVVGYRDSATARSEKAILNITGDLIHLASSDVRATDKTAQSWEPELTICGWWRPGYNLTSALTPILTRSRVLKEEPLTAGGPLPVLMERQSPYPGSLTGTRSPGPMSANLLRVAGGSGQSPSRVTDHRAYTLRSFPRGPETEWGDKRLNLSRQFRWSELECVPVGLWYTVPCASTYCEEDLGVADRRGQGPLEGALHGQGRLA

SEQ ID NO: 995446 - protein, 438 aa, Homo sapiens
LTSSMGGGKNKRLTKGGKKGSQERKLVDPLSKDKIGDDVISACYVQSIRNIGNDARSPGPRGIQRLLLMVLKVSGCVLRSRGLDKTLHEIDEVAVLGREFKSRLLERWLQGYNELRMELNFASCYGIFTPWTTHGVSSGQQNGQTNDGELTWMSRLTEWVYVGSRPVSCDRGLDLNKAASQNQYTAMNRLEWLSQREEGPTNIAEEDDGQSGCREVQTNIDVEKKVVNYNLSSRAGMWTRRSKEACQCYYMPTPDDVFSLEPVPGCCKEKPKVWNWGKLMELAWLDGQEFSEQPLGDQTGRKLNEQGWQFERTKSRSRVQRDQNYKSGEIKTTNHARRQQRNNQRKDPGATINDGRNTTRYRKGRAETHSRRPHCGASGEHSTGHLTCSQHRTRDDTQHKKGATRASQKTANTNQPTSATATPPDAPPQPPSNSRSDT

SEQ ID NO: 995447 - protein, 426 aa, Homo sapiens
FFFFQVEILNSGGRKGVSMLRCGKGPAQLPPAPQVHVPRPQLSLPRLLSCALPFRGIHRVLRVHTLRQGQPGLNTRAAESPACGQCHNGRLRGGVKQQDHSPGPRRGRGATSGSKGQDWENHILGRPGAQTHKVCALKRGGRKEDGETAKSQPQKERGQETHEPHDTNDSKNQYRAYNNRSINMNRRNAQTQKHQSMTIRARHERATKAPRGNTKRMDTEQHCITKEENTGGKKETHQKGEKEEQIITREGGTGPKGRKNNTRTHRRKRGTEMKAPKAVYVENPKNTGTGPVSKEEHTNNETRRTNNTNKGARGEKTNKEIKRQNYRNKDPRRTTAEHKHRTTNKNTDKPQEIEKNKDKKEPMHEKERLIAKHKRKTTSRPQKVEDKTQERKKAQNKRETTQKSTPRGERTKDKKQTEKKHKNSHQ

SEQ ID NO: 995448 - protein, 77 aa, Homo sapiens
MTKRENKGAPQEDANKQERNPEKNARTNRTEQHRARRAEGDTHRNKTGETTTTTRKRKKTKNKNSTKQTYNRTHTTQ

SEQ ID NO: 995449 - protein, 570 aa, Homo sapiens
MMTIASSRHLVKTILQGMEERGSECSTCSEDDTVSGLSSPFCSKLHTSLGQDAMIAVSENQCRRQRRRRRREEAREEGRAVLLFEHIDDSTELINWEIGPSHEVIRYDAGYAIVVRRSLEIDHCLDEWSPVRYWNLKQERKLRVAKEANDYTFKSGKSPVDWSAKGCTLAQCGSQICAPRYQYQTEKTCREIEGKQIINRACRGGKHWNITVISFPCCERVCGSNPALGLGIRYMRGTIDWGYPLSANWFRRAPIVWPQQQPQELYIIPCAKDTKRFPTAALVGSSIWDWAIWRIQMEHWRGGFSIRGKGLSRFLAGRQPNCGGLRVNVSAWNAVAKALAQQAQANKVCAKGDSRLCDTLTYTYLLKGDMQHSVVTRGSHCDSFRTTGHGPYGATTLANSFVLYICTCGANATTEQDVGHRHQSTESKIHTLRTGGIPQSHDKRACQTAQNTTRYKHIKAHTKIKTEEMRKTPVEESRTEEQGKNSDSTLQEEALENEHSKETNHREQRDVTTKEIRKTEHSNQSGAPHERHTSGDRVSVTPAKDTKERHNRNETTVDAHKRRRTEEHQE

SEQ ID NO: 995450 - protein, 226 aa, Homo sapiens
GYGDGYDDWETDEDEEIVWAMKREEEEEEGGGSSGHSCVVGVARDSVKRKGDLSLRGRGWRVGAAPLLLRHLGQGTSRRRLMFSQALTVPESGASPLDYEGGAVTFTKRRVTGTHLHLHWQRSPGAWYPSCGSRGQEHCLLLIDPETAENLTPVAKPQMLHFCCNARTLNWGDGMPGLKHLETGDPYRLVAMLRIVVALKSHSVLLLSLIGLMSALFAARVMIPEG

SEQ ID NO: 995451 - protein, 230 aa, Homo sapiens
MPARQDASSRCWPAGGLTALLLLLLGLAGWRALGRPGPGGGWRVLRTGPPRQTVRGRDRTRSASTLYTADMFTHGIQSCRARSSCSSRPGVDTARRLSRLGMTWETNTNSMEDAKVYVAKVDCHGHIRRVLRPQGVRGYPTLELFKARPRSCEVPGPRDVPDTGKLDAADNWNEEPVTPEPDVEAAQCPRSSKHRACIEALQAEAHFEPAPVAQTAAPRLSKVTFRFQWM

SEQ ID NO: 995452 - protein, 85 aa, Homo sapiens
PRVLASLGLGFQRAHGDDQKYMADPSTVSLEATSAESACCYRCGSAPCTSVVWLGRTIVTRLIRRKIAMDVFSALLLYCGKASYR

SEQ ID NO: 995453 - protein, 627 aa, Homo sapiens
MGAVATARVLTRRVLRSQPVVKSREADQSLVDVSLVEQPWAVNKILGHGHSARVERCTEHLNTLVESLCVPRLCHACCMLSHNAQYPSEYTPRSKRMSSIAEYKYQDVHSPWARVSTVNQTRSVHFIPRVTSRAHKTVDYEHRPRNLRAKTQEKTRQGTYTVLRLQGAARWGTKRRLSLVGLDKAGGTSGSPGGGTPNRKRPPWGSTLLPCRCRKAHRVVEKRKTPGFLNTQKAVVAGVGGEGHYQQPKYKGPGEKNIGGLGMRHFGGPFIWENPELEDRSPPICRRRGGVGEYRALFRFIVPHLWLLFGVVCVLIQEELAEVVNLPLLKSVGDILIFLEGGAHYRGKSRRLSRVTGFPYEVSIRERAIIASTVVRPEEEVAALVFQWNQMDAWSKSLWWAKSNFPSMGGGTVSLGFREMPPEEVVAIGLSKSKRGIPDVCPEQLNGMKVGVETRTGDLPRAPGVTTKCRAGLGLVPLCHGGALQLKVVLGGAIQNRLRTKRFLEMDIGQREVHKVSLSAQALYKGPRTKMMSFTPVGLRRRSHWVTIMRYYSFVAPYRCHLAFHHLPERTTVSKTDSPGGANTNKRGGQTNTTTSVTTERATWSSNTRVMQQPAIDTTRTEETNES

SEQ ID NO: 995454 - protein, 64 aa, Homo sapiens
MPMAAIGRDRDLTTSAAVPKSDAVLETGRLQAQSAERAQSRRPVTQDGTREPIEHSAHTPRAPR

SEQ ID NO: 995455 - protein, 211 aa, Homo sapiens
MADRCFTRVAGRCGRIRASAVYEAGRVEDWDFKYACISRRLSQFSPMIELFGLAGNVWTDTVLLNVQKSIQTQEDRIIIKTTMPEAVSEGPRSTHLRDDKSQDTVPRRLARFALRTPYSLPTLQQMSTYRKTTCLKRSGEGAEFQPSDGMSHSRETPVPKTSGLRHPPSQNSRAPYLQQDEVSTTEINSRRRTGGETEHSQETRPGCPDTY

SEQ ID NO: 995456 - protein, 93 aa, Homo sapiens
VLLGVSDGTGCADAMVLVLVFLCHDSCWCPPCVLGQMQLEKAKVPGPIFHYDYHTLRIERLVYSCAVRLLGWRESSLIPKIRKGANVSVALLK

SEQ ID NO: 995457 - protein, 294 aa, Homo sapiens
MNPLFTYPWAFWGIRSTGREGGSRNMSPVTKPAEHGVLNYMHDVNHKGSYHTDASLHIRLKTYSGRNCTGIPVSYSSGESFPFNLENGQFCKPTGRYSSRQDPLSIDSPFIDDYCRVKRSRGTISRPAIATSPPSAYGVHSDSIFNPGNVTESNCAKANEDNVHFERDTADATPYLSLRIVIERHTALYIRGHTRRRPTSVKLEFGRYNYTLGDDCQTTTAHKDIDRQRTVLTSRHSMPITWGPQDTAVSEPRRRENQNTHECCPTAVTQRPRDELIAVDDKQLLLESSRQYVV

SEQ ID NO: 995458 - protein, 282 aa, Homo sapiens
PLQSAPPSPLPGPGPLLQYLILPFFREMKCGWGLAPRLREPSPAAPPDYMDTRSLSQLIFSFDSPETPSHDIPAGNHFLGTVVGAGATAEPPLYRPWLTWTPEWSRAAAQAFSLLTLEAASQNQSSGEAAASFLRSPLHSPSLLGRQLHLSPAPRRHQQLGSGPERWPEGSSVVTVSKRKDTSVDENYDVGLQNSLGTCDTCWRVCTWAWHSSRLENLKLSRELGVKTPDEGGLWMLPMYWPEAVCALRRNPASRANVLGRYHYESSPNRRPFGIQGAEGCP

SEQ ID NO: 995459 - protein, 398 aa, Homo sapiens
MGPTDGGDERHGHSTKRAPAGRVRHANHKGTYCTQPPTEQTTGRTRTTNAKPHTNPQHAHPRPPTPARPQHPPRPVYTPGKPPNTNSHKRATQLANTTPQHRTNPARHTQEQTSTTTNGRQHDSSTPRHRYTPPAPHATPPHHPHARTRQDAAPPLSHPPPHQRNPQPTTPTSHPTQGKRDKSTERPEQRKRTTHPPTPPRPQQTTQQQSTRHNEQTDDERSTHLARTEAAPRPEGPHAPPAADAPRLRYTGPATPTCNTQEHARRLDGIQRIGGTRHDKTYQAGTHDREGARTKREESTQTATSRCIARDTAFSDPSPSRPPSIREYREHCKSDDSVDGSRDDRTATDTNSKPAAQTGTDYLATVAASRRTRQDAKSSMAKRTRSADQTANNRQSER

SEQ ID NO: 995460 - protein, 364 aa, Homo sapiens
GACPGLLTPPQLVGQFCPVSGDGSCLASWGLTDPPCVVRLCPVHVPHFPAVLQKLVVDNCSLMCRACANVSLAVAWALAGLTGPGVRACPRAWGGRRDGLAGSAHGPPVCEQLAVCRWDPVTRGVLNGHLKCMYVALLTHLPQHRCTPQCPVDAHTALTFTLNWWHGEVSAWWKSTLVHKTLPAQTCPRTGNALLSAVTERNSRQTGRAFLKHHHVGTLTEKGTSNLEDHHRGTRREYGRHAMVSNTGSAENPSADLMWEPGSFVAGFLQYERTQPEEPSNTQMTGAYQVIVPPMGHWPWAKAESGFPGTDIDERKCHQRAPDCANLRFCSECNRKQAERTLEHYQSWTHTHPRVNLRKHNTRD

SEQ ID NO: 995461 - protein, 157 aa, Homo sapiens
MNSRSSGNPLLRKGPILRFGPIILQAPLYERSSLVKSGRGPLMQARQPTRQAFRLHPAAVPVKFARSCQPKLDSYICLDTSEFLLPCLGSTYCTPGGTFQLQFSFPRSNLVRPQRHGATASHTPDISTFPLRHCSNGPQTNQHTKETLSDNRPQHQP

SEQ ID NO: 995462 - protein, 30 aa, Homo sapiens
MKGETVTSNTYDSSLTYNASSITQTERNKN

SEQ ID NO: 995463 - protein, 90 aa, Homo sapiens
EETAHWKPPPWNDVDPPKDTTCEEHYPELWAPTPSSAWCPATSDGIEWGDGAGSVILTSGIHAPEAHEKLIEYKDLSSGPSITLDRNRHM

SEQ ID NO: 995464 - protein, 307 aa, Homo sapiens
PLNVDHFSCTPLMWACALGHLEAADAHFSDWNRQDTDAFPTSLGRSAICHVSITSQGVTVTTIARVPCAGNYEQTGSHSGWSPPVCPSSHTHIHPRPQHNMDRDADVITRPSELVEMAPFSVTSAYSRCHQNGSPTQLHLCQHSEMTMEDMDPGQLSSGVPEAPLLLMDYEATNSKGPPSPPFLPSHQTSDDGAAPEDADRPQAVDVIPEDMISLAKQIIERTPERITTRGLVGLPEAGASLPDRTGAVRLSETMPGRHLTWTIGDTFPRHKPIQRPAFEPRRLVVIQDPPGQQPLHPPLARGTDSA

SEQ ID NO: 995465 - protein, 111 aa, Homo sapiens
MRTNTSNKRIDVHTESKESTDRSNKSRHSRSHATMRNKRELCDTEQRRSSNRHGRAQTTQRSSSPDARRAHSSASGRGLAADLTATGQRSRRPETRHKHNSTHTERTPQRK

SEQ ID NO: 995466 - protein, 454 aa, Homo sapiens
GRFCTSVRRCPLIRDFHLAFSGCIAGTWLVQAGRGADLLWQSFHGAPLQQECRSFANISSEQPAATASDTAGLMLAYAHNHSTSTPRRPHDVDTGRWAWTSRRRASAKQDTRGWTTHMQAANATQGNSEVHIKHPHIHPTTAQGKQQAPSQGQANSPSTDKPDVHHYCPMEQGNTDQASIASRTQQTQKRFSPRTLEARHQVTPKTHERDMTDTRGPTGAFGIHHGNTRGDGTEDRAVSEPWRARRDFTLTADEQDTLVNTTKHDYGRPTLSGLGQGQHVVQAHAWHGTHNGTPGKTGIKDECDTSTEAALEDRQTVQMVNGRQNASRTTRAEGGNTNGKSEDTPTIWAQGEDDKPHSTSSHQQRPQQELGHIYSTQRHREEKRRGQKEKSERRTTRTKSDTGQQARDNDKKTERRSRQGRQKKRTARRGRSSKSEAPPSPGKASNVKRQRRAN

SEQ ID NO: 995467 - protein, 488 aa, Homo sapiens
GRSRVFRPDSQASGMWVGHEPSRQHRSVHLCKTQASAQGGSCNNWSGPSKLPPCCTAVHQQVAEPAGMPAVPSRLVSRAGIQAQIYCTQAPGAKAGLPSSSLKGHVLHKSTYVNPGARISVQSKQSQARRVHLETRKLASFPYIQANKQSCTKKHKTTQGIEEYPRGNFQAKWQAKRGLKVRQQKRPQVVIHVKVPKRTRGQTTLQKHFGVREVQGNTAKDSHGTAGLSTDGGTGHQGGPAIMATIRAPRRGQLKRPRANAGGQRQMNAMGHATHDRSDTRDWRKTATPTTNVGWPKADISTAPNGEPTQSVTTGQTDTHHANHRANGTSDNTTTSDQTLSRTLGANTTAPGRAAGDKTETSHSPDQHREATITTEPPRPAGNPGTTQHQHTATQDDAPNDRNQDRTEEATNDTIQQVEHRKHSTDTEHAHTENTAQGSEHTTPPKTATDNLTSRPWDTERVTPTQKDSQTQRRPQPAERMKPTRHRA

SEQ ID NO: 995468 - protein, 175 aa, Homo sapiens
QHYEIPPCHGGPPERHGGTPVMAGGGLRLRQEAERRPGAAPPPRGGRDWGEHNQRLEEHQARAWQGAMDAGAASREQPGVQGGERGLSGPSVPGAHGKPRWSGWAECGFAQGGHSQGQRGARWRTGVVAELPARTGAAESLTQNPHPRPAYPPLHPARLLRSHSLLSIRVGRRHC

SEQ ID NO: 995469 - protein, 350 aa, Homo sapiens
IDLLSKHNNLNAYQRRRMVVHTLWFHHFGRLRWADHKVNAVREQPGQHDEYPVSTKELQNNYVVPCARCLVVSLECMRERRRSHRETRLTDAKHGVTVCGEHQYCQQMTPRILVEHSSGVPPPCIEWQHEVIKQDQDYELSMLEESGSTGDHRPARGVGKVEPSTNSLDSPPTMAQFRGPDFSERKEGQSIAWRAKLKLCLFEGGTRRPASKKIPDFRPRQGMLLKHKFVTRYIKKTPSQGGSSTVYALACQRVLARSQRLRTLTIDGRVRRGAGPSGYAYIDVVTPKLQGEGAIRSLRAQRGQVSDRPRIETREQKGNGAEELVGPASRGGGVTNIRHTNFKNVKNPGS

SEQ ID NO: 995470 - protein, 106 aa, Homo sapiens
LYLCRARHGFGQLNALTTSVMTILPPVEKLKTVLTEGERLPHQLPVIIRVRRLSPSGDMYLVLFLPNARQAELASPVTLPRGLGKRPLVNFVIILPLETSSLCLDC

SEQ ID NO: 995471 - protein, 439 aa, Homo sapiens
VLVWVLVFEMDLLAQLISRRGVCRWHDILWSPCNLLCPPGVSSVILFTKQERAPSLTLEPLGTWTGLREKGQGLKRSFSFCGHPWEGCLPIGLSLKIMHHSSGAPAWPWAWIYKSFKQWLGAMSTHIPLYYYWNLFTQMSLRPLWKRFSGAPSEGETRFGIHMSQQEAALGLSNLSLRSLFFPPQSWIFPEKLLYYSEIFWAQKLSTLSGAHIYYPPLSYGDISSAITRFDTNLGRRVSRETYPWVFHTNAVVPFTPLFSTPRMRGLKKSFPTGYVVLWVLRQRFGRHHYNLKTRSLRTCGHRHPLFSSRRPTPLVGPHQQGGLYTRASPPVSPLWASALWCTRSVQPLSCCRGAPTPYKGRCRYGGPLGYYHPLLTRERLLCCDPLSPVCAAAHTHKGGSDPHDKLVGRTITSCSLQRGGDLPELISQTVLTETLRST

SEQ ID NO: 995472 - protein, 294 aa, Homo sapiens
VFNLFFKQTRPNRSYIFFLGHTHGAATAARGLGGAGPRTQRPQKVTQPSMAPRIFFSRIQGLQRDAWWSKTIGLETWSWYFPSLKHPSGLVQENQFWGILGTWAVEIILRINWVRSTTVSHLNILYRMDCFSRAPIYGEKCTNGTEHIPLKHPHYEIAIYFYTGPKQPSVRSGPVRWRQKELNIFPAPVPHQMCTRCVSRLVISRHKIYAPGRQPSLLQGEHLHLKRHEPLGVLARDTTNGEAGENEYNYNDRPPGREISARLSHATETFIRQPTSGAAHPTRFETPGVWGQHR

SEQ ID NO: 995473 - protein, 154 aa, Homo sapiens
MIQIANSMHRKTTQQPSEPITQREPGQRTAPQQRARGRTTRHTNETQHENNTEALPEQLQKRERKHEHDTPNNRQRKTTTKQDRTGNAKATGGHTDTRQRTQHTNTQPPPQQTPQMAQRTQEITKHQRDTPSSEHHHSKKTPTTEHKHHTVKHR

SEQ ID NO: 995474 - protein, 290 aa, Homo sapiens
LIHYYCAFRTLVNVGGYIPHLYSHLLSEGDEVSAREDGTEYKHKDYDENTSITLTREKASLQDVMIATTSVSDEECYLVEYSPILHVCQWQQCDMRACHSECTLRLRLTDVLCSDSLHPQSKMILGFVSLWIIIALGVSTVSTVQCAVGGAFHTNVVLPRVETSRTAERTSFVPGRYHHAHTTFMEGHMVSKDRRQSLGLVEHSKYETHNKWNHNKKEYHFGRNRTLVLIEHSTELELLITKVLAGTQVTVSLHQRINTMSEEIYPFNHKSHFGLKNLPSRARTKEGLSL

SEQ ID NO: 995475 - protein, 606 aa, Homo sapiens
AHLPGGSLPSPIRIPPPPVPIYPLCPYTKTIPSFAIIPHTTRLDMIHASTLSTQSYTIKKKNKKKNRKTSEQREEQQQKRDADDPQTEQQETEATSEDETGEEREGERANRKNKDRHPTHTQKKKKRKNDKAEERKSHTGRRPDAEKDEARTRDTSRPTSKQRRRKRQREPTQGGRQTESREQNEPSEPTAEDGGESGRGGRGEERHPAAREQEERRRQRRRVQHTQRTDGRREERGGARRNRRPRSAGEEERRRQKKKRCDEPGRAREEGEALQTASADRREGEDREGKRRARSERDRRRERGREHGSRRRGERGGQQEQRKGEGERRRGQKGEGRERDAQREQRASAAEAARARGASGGERRAARRSGRRRREGRRGRGERAAQGQAGEKQERGEGGAAREARAGRSAGRKAAEPPKRERKAARRARESAKGSAGAPEGGAARHSDAAHSAKRPGRDPKASPAATREHDRSRPTRHSEDDARRRREQTDQPSTRAHGEAEPQSPTRHSTPSGGPLPQTTRRQRRKRPRPDLPSRPRKHDRGALDETRPAHAEAEDRKHGSRLRASEPTPAQHRPHAQSRSEPAHPDAQTQENAEKTREQTQRKR

SEQ ID NO: 995476 - protein, 193 aa, Homo sapiens
AEKDRYSIADLRCHDWSCVASGLGSPHVRNILASCSYDRRCHYLERGKRHLWRRAMETVQETRAPQLNSGVLGALPGLQDMILCRVVSSDGAISLSDLHRGRPMGSKEDQQLLITIGVQCRSAVSPCMLYLESLSRPPIVVQKPNLHHSRFAITVAVTTSSMLCEGGGGTAVEGGAEAEKRTVTGVRDVVWGP

SEQ ID NO: 995477 - protein, 443 aa, Homo sapiens
MPPRGNESGGPAGASLFDVTCRHDATLVWPALALSACPGPDEKRCHNSCTSLTAMRAARDCPAGHPPGNLCACCSPPSYFGWSSDKAGTADAGVPDVGGYLGLDTVSLNGARPFRRWAALNPFPGGLVTKRRDGGNPRVALVALWNTFAGQTEGKQVFRFPPTTGHLERTVVGRKAGLVYATFWPPSVGRAHHYHDGVTKKQAILYHKRPGYNPPGVKRTVPKRALTKSLCEDRAGPEVPGGPWEPGKAIPAGWFRRTHQARAGFGPPFVGGPGFLARSGPSLFPHAAFRPLFPPGLERPMGGLYPGWLSDSANALALGDTQPGVFPFGRRHTWRTRVGRRLWFWVVAGRPPGTVPWPTWCRYQPPWGKASPRAPERNSVVPPFPRAKPCLEVVPRVHPCCGAPRYSGSPTAEARASHSRAATGPPQQGVVQRSRTAPHCVLL

SEQ ID NO: 995478 - protein, 185 aa, Homo sapiens
SRRPGKMADIQTDRAYQKQPTIFQNKKRALLGKTGKEKLPGYYKNIRSWASMNTQGGYGGPLTCDKKVPLHVVSVLHPRADSSRGVVNQDEDAEDQWSLRRDYLHIHSEDYNRFEKRHKNFVWYNLSSLFSGTVQIGDIVHRGQKCRPLSQDSALQGGSGSPRSAGTKKQSQKVLRLGYRPVPPQ

SEQ ID NO: 995479 - protein, 150 aa, Homo sapiens
ENCTRLFVSLQTVDIPRKHCLAFTSCEGVSASSLSVKGLAPDANAWRRRRTSISSHSDTKLLDAYHLRRDATEIECRAYRVMTTCGLGELKRGEKDTMGILDIRALNFSIRCHWISDAEQFGVRKWARLIDPRRTFPRFIEKSRRRSVVA

SEQ ID NO: 995480 - protein, 325 aa, Homo sapiens
QCRPLYIDTDSDVLDKASSLMRRRTRQLAIQGTLRASSGLPTVAPSSDPGSEPLCQLPTCARRDVDNVPEGESDDASKRPPEVTRFLLALGHFKKLRCRLNDKLLLGCHQAAHRTGAGLSGNPSGPGSSLRTAFGQEFSTFLRSLVWRWQARLRARRTEPKFVSNLKGISMSSSTLLLAAGLPRTLMPYLESQVDCTVQGSQRQHQSAHHYVTPRGRRQKSVDNACGNGDGPELLEKPVQHKDVHYLGLDETRRLKVREPWMALQTQTAPTSGSATAKQGPQPDGAAGPPAQNKKDKSAREQPRAVPATTAPRRVHNNRHKAREN

SEQ ID NO: 995481 - protein, 180 aa, Homo sapiens
MRHMECPGRGTRGGCQEQHDQAWYDEDDQGGHPGPAQWRCGLTLPLVGPKSHGDDAPKYNPLSLDEACLKASMSWSRIEGRGPAGTTGSGNSPSSEPTVVVAGAGVCEFTRVRNRIAQENGLEAGLDNKCTRFPRNDSIDGRLSIGESPILDRNEELLKNKRQKVEVMLNTRRITKGRHR

SEQ ID NO: 995482 - protein, 382 aa, Homo sapiens
MAGPCRRTMLLGPSTRWRPFACRGSGELDRPRCHAHVVKELRLMDGRAAPRGRSNGTYGLAGKYRCVCTLRYTFSGAYVFRTKVGDSEKSSKNDSDGWIAAWLMTHLVDENECRIGGYVGGTCCAREVKTMGQTGCQECMAQGRDLRLADNSHVMQWKKRGQLVENVGEYKSTLRNVGFVPEDTGKDNMRQGLEGIGQKQKLPLVGHSWRLPSTVKRREQVTLAEMFHELEARLWVATSPTDWAGRGNSGHVGPRTVTRASNPWSWWAEYQGVDKPREAIVDEEQTALPGDRWGHEFTGGDLVEGTPGERPAGNTNDSWAFTRTHAGGWDRLNTSAGELPKGKQQGDTAMVGVNRGGRVGARKIREKEWGPSYRNQGAGPSE

SEQ ID NO: 995483 - protein, 129 aa, Homo sapiens
MPTNRRVTRQVKKSAAHKKQQQKEERRTTQRTTEQRGGPTHIRTTNTRERHRPNKDAKKTTDTSRERPDDTTAATSKLKTRGQSESNTKQREQPNSEEARQNTEQTGRAKEQSKREAEEDWRRTRTSAP

SEQ ID NO: 995484 - protein, 104 aa, Homo sapiens
AVVGWHYLQGDCEARLLVPLECQVDPAVQQLKKQEKEEMKAVNENGLPNGEGDALEQRNLACWRHRWSFLEGQDSAIFDLGHLYEEYQGRLRRNCAKLSQERGQ

SEQ ID NO: 995485 - protein, 266 aa, Homo sapiens
EHTKWRMTPVRTRRARGPCVGLVMGNRGGFREKCRQWHSGPGSLAVDGAMAEAGSSGSACRGYEWSAQSPKLCRLVKDMKIKSRGGDLSSFSLPIKESEIIDCFLWCPRLKDEVLNDYAMCRRQSLCRAGAPRFKACCLHIGDYNVRTVESVVLQCSRGRLAAGSCGAIILVKLSIVPVRRGYWGNKIGQAPTVPCKVTGRCGSVLVRLILNQGHWDRLPSPVPKKVLMMAGIDECYTSDRGACHPGKFARHRLMAILRLSYLTRL

SEQ ID NO: 995486 - protein, 516 aa, Homo sapiens
MAPSRNGMVLNAPLPQWTVHAVLLWPLWFNHACALKILQTVMALCNANGCCLHLPLLPLLSWSQSCAHLCCLPRRVRVATLNVVAAACACLCFQPLDATLMGVARALHHTNGCALRPLAHLPVRIPMRRAAHTNAPPVHSPPRHVATTVATPRFDSAVTRPPRTYIPSFPPMRQRPFAAPPNAHREHQPLVPCTRNPAQTVCPNPQGVNPAQPCALPFAPRSPGQPATFTPQPTTWPRPTRRSGKPPLPHVGSSQHAQGNPQTSPHTTPLFPPSGSFPAHWPRRLAHNGPSAPFPSPPPPFTAPPPHTHAHPPQLAHTPRPTHTQRAPASPTSRSHPRHTSPRPPFTLPLTTLFAHTSPPHPHPPSTSPLPLHAAPLHNSHPPPTPQQRPHHSHTTGARLAPSPRTSHLTPPPLLLPHPRPPPSPPHPPHTTPPPSQHTSRHTPAFTVTHPPTPTQQHPHSSPHSTPPPPPHPPPPHPLPPPPSPPSPPPPPPPTTSTPPTIHPTPTSTHTSHHTQ

SEQ ID NO: 995487 - protein, 565 aa, Homo sapiens
AWLRCSVLDASDLAPKDRNGTSDPFCPECCYNGAWTLCETSICDMNVMLPTAGMMTVLNFDACSEVWPWMCCLCCWTCLGDLVTIVMPETDFLGANMCVDLIVHADLRGLVASTVMLMCACVLRACMTPETHVPNPALCCAIAPKCATPSVASLSPSLCAVAAVPCRRTARTRLHMHTSQASLTAMAPTLSHRHPFALLAPPDRGSNCLLEPTCHSGARKDGHGLAFPPLSISHVKDQDTNGQPRNVWSVHPADSACAPTGKHPVAFHTALPSLLVSATGSASGAQTADLSLFVHPIGLLITQWPSGNSPGRYRAPHKSAINPQPSTSPFILSSPTTPTPLLSLSRLSPPSVISLLCHIHLHHPDSFHKRQSCHSPCTISAHIHHSLSHTSRLCSPSFPSPHILTSPPPTSRTSITSTTTPPTRFPPPSHPPQTTTLIPHLSVHLLIRFSLHSPLLLLSLTLTPLDHLTRYSHLTHTHTSLAYMLHDPLTTLSPFTLSTHTPHTLTRHFTLSHHHSPLHPPPHSIHHTPLRPPDHRSLSSLLHPPPLHSSPPYSLLTLYPPPLPP

SEQ ID NO: 995488 - protein, 261 aa, Homo sapiens
MRVCEEIAIIRQQKAPARSIAGYVTHLMNANSEEALLKEGNLRSRLHGGRRRDKEQTNYCSMTVSRSWNQGKLHGTVESLYHLRHNCLNSLVRDLRDQLMLQHAFKGSTLSPYEQWGNANVSNKPPPRARNPCLVAHSHCPAQLALTNVTCPNLQTHGRNQTHTNPEQNPRRQSPQRELPLDTHTGLRLPDTQNTTPRSPATHTGVNPSGGPPTHPGDSHPEEDPPKNTNLELRTPAPTSLPQHHTSHHTLNSSAPHIFPH

SEQ ID NO: 995489 - protein, 349 aa, Homo sapiens
PRCRSLPRERSAWSASDLGLFLSLFRPHFLRLLFIMSMHLIIIDLLHTIDMQLLRRENVTRGKVDGEEAQLGPRMSRCRLLAIHHSPRSGSLSYALTDDSKPSDYFYRTQPLAMSDVVRTRWQGRLYTPMTLHSPSVRINGTWCADHSPGRRLHPFSVLPSTATTGLLCLLFTQLCGNHASSACQTAGLMQLPCMHPLPFTHMPRTGGTQHRLPANNPGATPGSHPLRTSNFPHGLRRATPQGRYTRKPSNSTRLRCPQAHSPRAQDITRTLPNHAQQTGNPKTETHGSVYQQEAVARHTLHNELVTPGAKALTQHTTDRNHPRHHHTKPCAAPPKEMELPLLASGHTC

SEQ ID NO: 995490 - protein, 296 aa, Homo sapiens
MSGPSVGSGGPVRLRGAECGLDLCELALKMPGSKPGAKVMDFPTISRSPSGPPAMGLGVGPGDILVAFGRDLIAMTRQLGPYARRAPEAQVGMELDRCQAFMELGCSKFEGSAQADLGCARSPQVGAPCPSTTFARQAGVAIGGLLEGDWLSAARGSVSCRRRGLGMTLRGPLATVRRNASPFSRRGSVNEPLEPVPRLVASPLMDPNEDSWTPRGMGWRRAPADAGRAARELKQVPRNLAGDGVSESTLNKPPAGAQSPETWLLPGPPRGCLVPVTLKTLDGLNFWARTLRFTTL

SEQ ID NO: 995491 - protein, 113 aa, Homo sapiens
GSLEIDVSKTWHLEEGHRKKKEEQDHQPSAASGAAEGENVVWLVCAIVFLHRVQVTLVVHVTDRCSGKEDRSASVISVGIEGRTAEREDEILTILAMLVLVPVIVCPSRCNGD

SEQ ID NO: 995492 - protein, 300 aa, Homo sapiens
MEPTKQKTKGAARFPGGPVAWGGQDPGLQHPPSGSAGGPREGVGRLWDQEAHGGGQYSLQHKECYGRPTPSSQGPPGKGSAGVMRKSKKPCATCRRTQRGAMVLAPRCPLVWSSFARALEGGRPGRVSWGAFVSGHTTGLGGPSFPGKGGAGDPAREHRRLLCGGPLGGRLLGDTALAGAGQRHQFVWFRKATESTGSNLGLGWEREKSTLRDKGWGGPASRPWMGWSDRPGLGAKKINKGLGRPRAVHIRKWPPLVGTGRRRGSRCVIGTSKEEESRHTGRGGPNRTTCGPSLDCHNAY

SEQ ID NO: 995493 - protein, 335 aa, Homo sapiens
ERVRWRTKEKLDYSLPHDSTRSPIGHHIYDARMEWMSSRWIKATELTLESPVNETYDTGEQPVRRTGTGSVEVRPSAGAISWIRNVSKVSWTHVGRELVELQYRACDVAEEQANRPGIHVTDYSVGMNSTANAPEKACRQHMVTWTRRCHTIAVILHSKPVPSLPATMEHIHSVAWTGTESRKTGREQRLSDNAGSCGKEHREPAEREGEHRAWKTYQHCHPGESRTCARTTSGPGSLTEGDFIRFRFFQPLRLERIFFRSGNIEHRRKLFNTSVEVLAFENLSQTRRPEERRTATSGTPEPEGTPIGPLKGVERQGDQLAWKQDLEQEPGGNED

SEQ ID NO: 995494 - protein, 373 aa, Homo sapiens
PGTMSPRAPQPQPPPAPHCMQIAAYWMDAGRWGGGMGRASPDRGTPVEDVVIEEVTTSTRSLIPGAVQMAGFLCATTTHGTFEDGKKFDSSYDRNTLVAIVVGVGRLITGMDRGLMGMCVNETADAYIVPPPTGHMGDIEHWPGLIPPDATLYFDVDFMLDVWNKEDTVQVEHIAADPTPVDPDMVQGPGEHKNSVAATNAQPDWHGHLHSEHQRTDKGRALYLKTYVEHLYWADSRGMEPGDDGTLCTWRETERLLIFKYWDIWRLKGNGTGESRHNRAQDERIRRSSIDDGEQHEERDTAKAQSRPPGVSEQRAPGKKGKHKKRVYDAQIDKERRARQQWAAKRDEGKDQHERKPPSEQSSSPTLTVEQTA

SEQ ID NO: 995495 - protein, 107 aa, Homo sapiens
MSLIERQPKANNSSICLLQLLLGRLILSSYKPPEDFESPLQQFARGIYGSTFYVATGFHGLHVMDGLNLPHYLLHPQLIFHFYIQTSGLASKPRLILAFVDVVDYIC

SEQ ID NO: 995496 - protein, 239 aa, Homo sapiens
MRELRVGLEESELWLRFKELTNEMIVTKNGRRMFPVLKVNVSGLDPNAMYSFLLDFVAADKHRWKYVNGEWVPGGKPEPQAPSSVYIQPDSPNFGAHWMKAPVSFSKVKHHNKLNGGGQIMLNSLHKYEPRIHIVRVGDPQRMITRHWIPWDQFIAVTGYQNEEITALNIKYNPFAKAYLDAREEVIQEMMENRSSQELGLPRGVDHRNKTRDHCNPRQRGVPSAASKWTRQPRSKAHN

SEQ ID NO: 995497 - protein, 138 aa, Homo sapiens
VLRIFFSVASRADIAEDTYGGTCESVRDGPTEEYLGQELALPGLAHGTRVSVNLLGNPWIYVAINDPFIDLNSRWFDYVPNMDSYPMGRLPMCDQLKGIENRRKPGRSQCVESQSTESFRGADDPLANIERWRRCLGA

SEQ ID NO: 995498 - protein, 128 aa, Homo sapiens
GHICQSLESAKAGTRFPGHSGGVQDPRELGSAVQKRYLTDCLMSICPQSLQTVYDLVDRNCQSAAREFLLLTPSLRLRTLHAEMREDGVATRLQEFVEESASCRQLSIGSQEPAMRCENRVLLLRAGS

SEQ ID NO: 995499 - protein, 288 aa, Homo sapiens
MRTILSNQTVDIPCKMSRITLQGTHSFIVKGPREMPCGRDFKYHIISVELSLLGKKKHSTGPGRLNGGGNSRKWYWLPFRDYDVSPLSQNHWIQRVVDTGASRLTHVLRSCRYAPLSLYQTVVSSRARNGCSSALITFREELSMRVENIVILPAQGCGIGRPESVEPLVTGYFYKGPMKYDEILNSPFEKVTIMEQYRSWVGSRLSRAALWDCAWQSHKNLLRASPSGISTRRSWARWVTLSGLLREEPDLVSMPGVGSSEDLESPPGFDFARNEFAHGWTTLKKLTV

SEQ ID NO: 995500 - protein, 108 aa, Homo sapiens
MTPEQLLHHREPRENLATIYQFNLVLHRAVPELVARAINRIFYYEPSASPNDRKSPRGCIDSTLRHSLFYSNTNSEAQPVLRRSLVRECRVERSNIKTTACVSGGLAM

SEQ ID NO: 995501 - protein, 125 aa, Homo sapiens
MVCELFRTAVSRVAERAWAVGDELESVPPLGMEVDCPTSGNLAWVRAPVFRDCSYTPTCGSGVGRHQSGSVGSPLTSLPSFLSMVGLPLGNRTRGPWPKVVDIGSMEAIKRELEKLLSKFYWLIR

SEQ ID NO: 995502 - protein, 451 aa, Homo sapiens
DSSVVCADAIDLGIAGCGVYPGEPSRAPHTILVTQALLAVRYNSSQVDSSYVRGASYRYDRTLGHNELGYSERRIRASVATEGPSAEARGKMLQGERTLHLGAREVEDWYFLSRNQPYRFQPRTDPGGVGSVESLAARLRWVARSFVVTSVSRTTRERRCESRSSRGSASPSWRQALYHKAQGPCFLLYRLVRRTRGMRVRSRRLNAGDSNETIVLHLYPELSHSTGQQAINESATLVGTMDERHTPISRRPILSLVMKEPQNASAAKRELCGSLKQPCGKAKHMVGWLIATRRGYFSVVGALLLRHPKSGIVERLRGGGTSVWASSVGGFGNAVHPTETVALGGHLCPFVRGLWHFINGGHFQERMSPRTVFLGEGSAIRQIYEPPEDQPRLIGLFAKLGAWFYATPSPPVNTGTLRIHGSTRKTQQNQAHRGEDTAFLCEIVGPRYGWE

SEQ ID NO: 995503 - protein, 70 aa, Homo sapiens
MWSLFSKLFFSTQKNRAYWWGDKYKGEGECFRPILSHAISGQRDEIEQHDDVKEGESSNRGKEASRKIRG

SEQ ID NO: 995504 - protein, 229 aa, Homo sapiens
MLCKHVPKYDLAIRSIPQNVGPGYTLGSDAWLPHMTISTKLGRGEHTNVCTCQLDSASIKSNGRAYRMKNYVRRIAITKMGIKRLTRVTVRLPEAGKLLTAFTKPSFARWPGGFTRPETTVWPGRHSTICLERENQRKGMVPNLQSYWDSPVPATCVEMQNVRCSSAVNRDVNNRVYWFVFGPPSLKGTQTYGSGAIFGPDSKTSQQGHVLPSACTVFRLTEFCVIMVA

SEQ ID NO: 995505 - protein, 184 aa, Homo sapiens
MQDMRRVLTERGTTLMSDERKRLFSLKINLKEQTGRRMMIRDNAIVEHSNTTEPIDTDVPVQGPSSCSLLTTILDAPCVPSVDGTHGTRRWYYDNSRGGPHCYDACCADYTLRASVLAVIGTLEAGTVTLVADHESSMERIPQIESEGYSLSCNPGARRLANRFAEIPRNNPVDYRPPLDFQKG

SEQ ID NO: 995506 - protein, 181 aa, Homo sapiens
GGASFSKPSRAILVGGARDALAGGMTEQMTLRGNRQGRRTAGINPESRTYPAVFPDIESSPTCSRISSQSITGGKLTRDESQTYGKYPLACLCEGHFPTYVKVTVVYSSEWTTFAPPQVVPGSGSRCCRRGSLTDVAATERGGFVGHTKDVLSVAFSSDEPARLSLDLEIKRSSYGIPWVC

SEQ ID NO: 995507 - protein, 255 aa, Homo sapiens
AHWLMNRSHDSNTKDTTSAVSDDGNREQVCPIASSDTSYGPVERQGEEQQPAAAAGPGEPSRPKIVKPQEEPEWHMHHVLSWESQNARSLSECCRPVSRYGRHKWRGLEIKTRGSVRVRGTIGIISTFHVFELNGVPFCKQVGSAGKPSETTLFEASSSVKWVGKDADAGLAKQGLETGAQEGCQGPSLAPKDVACVGDSPLKRHNGNSKNACGKTPTWVIGTLCELLGKGPRMGPRNGGPLFETVSGHGSAWGK

SEQ ID NO: 995508 - protein, 109 aa, Homo sapiens
MELGILPQSTAGHDRMTPTASRVSDIAESIRETKSQQNRVTLLHQVLEEAEKSHPELLQLPRELEQTSQAAGIKLEIIRSEASKLKKRLETERKVSGSVGRGPGAVQRS

SEQ ID NO: 995509 - protein, 454 aa, Homo sapiens
GGRALALGYRLASRMESGQSTDVQAGGMAPVIARAAGGPFRRPGSTPWSRASESVLVEAGPVAQHGVMQTSPSMQMGRQSGMRAAWASQWWPSVVTLVTAESSYLILGGGNIQCRLQGLLSLVGSAFNERSDIVTWERPRHIDRATDGTYAITVGGYDGRPDRLASRLVGFARTRTRELGVDSRRGCARESQFMRLGGRNTHDKTITGRWVPKPQFHEVREGWERVKGQVCLEVPYPESRTSKRLGSILHVEPKWDTRLSMATVMGQLQRKTDGLGRVALLWRKQEFHTVSLDKQLSGPGGNTPHKIWGGKRQPKGGLTGVVPLWRANRTDKGPHRFRSRTGIALGGYCDTKMERPRPFLRPLGELGRPRGPIMRQGGGGKATGANHTRGPNEGPIMNGSPGPQGPFGKGASPNTWHRTHWMGHPLLVKPQRLPENNTGPATDTGRRNNTGAWV

SEQ ID NO: 995510 - protein, 295 aa, Homo sapiens
CYKPSDQSVVALSPPGACPDKRIGVGVIDGQIYAVGGFARCIHHNSVERYEPERDEWDLVWPNADTKDRGGRGCPQSSALCRGGLDGINTALYSDLTMLATHERNAVANDHKQSDTPSEAGTGGYEWSHVPGRVWSVTNQYTDTWSEVSRMTSGRRWGGRGVTLWSPVRKSMIETRQKLYPVEGILVSWAMIQSKWGSIIVWYKNRGKTEYDEDWENNSHLSVRREARMSSVLELAISRKKCRRRESCGPQRSPRGVSKECLAGRGGGTRRVPGRRAALWPGKAGPFTMQGRPGH

SEQ ID NO: 995511 - protein, 164 aa, Homo sapiens
MALGPLPREDENLMLHLQRLETTLSVCAQEPDHGQLFTHLGRMALRVQPKLASNVARELSSATPFCRPFCDRFGHGARRSWRPRCHTALHTPARPAQRSPHGQLWGYEAASYPRHPNARLCRPAPHFRASPHAVLPTPSSLPQQVPRFPFPLHSLSLSPPPSPP

SEQ ID NO: 995512 - protein, 111 aa, Homo sapiens
QISDAAKSSASVKSTVITKKRAGPIDDMEKLLEAVEERYTHGTKKVHNVKILVRQHVLVMKVPIAFKEQLHRIIQWLKDLCNKELIALERKKRGKRVEAVDRSYTLEEMDV

SEQ ID NO: 995513 - protein, 396 aa, Homo sapiens
PESQDSTTKTSVGIKECENNEVNIPPRKGVPSIQSVEAGEQGDIATPHRNGDDTLHESPTLHWQSWPHEVDKSELKDFISKLWKRGGVAALTVVGNYPILVEECSDDAEPVQKVLSNRPNHVQEVTVRLICRTMNASTRAARDRRCDEIITFGDLVGPRRWAALVELRGPSPWRLVLQKARFAVGRGARATGRESPWISVHPYETWVPDRMVNCPTVLRHLESMSPGPVVTVDRVRINLTRNVGNGVGASHLALLPFPELYPFTLPIRLDDHLAINDFQIAHHTRDSGNGISPGGILIGTRNLPTKEGFCYHSTKGGSLTMQNSYLYPEGKRANKTSLWTYYRPTQVLLAVNNPWRKRRQRQYTYYYYLCNTSRGCATYRLHLTDYLTATVSSKTI

SEQ ID NO: 995514 - protein, 178 aa, Homo sapiens
MPRLLGFCTREPLTSVLLPCLSIIRDGPPCATLDLLSSSVVEVLSPEEISAFLGLHGLSLHLRGPCLSVTPRTYCFPEALRQHLVVADGRWALRYTFSLGSTGACGVVRRYPLDLNGMLPAMGFGVPLPGLKGGCPAAPKLSPEDSNCDGPRPLGPARAAVFGPGRPPDVAPPPFLRL

SEQ ID NO: 995515 - protein, 138 aa, Homo sapiens
MSGFPPKRGSTTLCGGAPCVGARPLWRLVCLCVGPPADIGGRVKKYPSGHRVGSPSLNHYQSAHKALISKTRRHYTLQHLTQQENRLFYHEDIVGFLGRDPPGGGAAHKGSLTFPKPPIRNNPVGWSHLLWVEAKAHA

SEQ ID NO: 995516 - protein, 122 aa, Homo sapiens
MGGTHPTQNSKRGDPNTSITPTSDTPQQRAQATTEGSTKQRVEDKSIKQKKTPCQVVNQPTPTGHTVRLNPQRHRAPPAQRQRRHKSGRPNKITHHWTCKRSRQRIGNKSPAHHDQTTDEKP

SEQ ID NO: 995517 - protein, 199 aa, Homo sapiens
MGGRRRQVQGACWGPRVSPIPVPAGSCTVKVLSPGGRYWRLLSFQQLGRKYLGGGKGLSGPGALLVFAPAHLPVVRGERAGWSKGLTPGIGVREALCSRVPSVKFTASPATCRVGEFALGTLSRNKLLFPLDHVFPGSLRRMSFFGVPLLHIFLGYPGSQAASRPATHSGWVPTPSERAGSGVPWRLWVGRAPLSRLPT

SEQ ID NO: 995518 - protein, 286 aa, Homo sapiens
MTCAPHARVPQRPVLDSLVALAGGQHDSMAKTVPGPSHSAISCTSVTHQMDMVTCLQRLGPMSDQQDWQRVVQTTMTWVNTTKQWQDATTYVKTTQSDEGAQGTSNTRVGTCEHTTWAHSSHCIPQLAVTLWLNNETTEPRTLHESQAFHLDLVRHKSLSKATPLPHPLSNLRAFTVSEGRSAVNQPSADGDIGGPSHWHHEFVRHTLDSTHIFWDHMSNSTIGEDGKPNTRTRYTHGAPSAIWNDYAVAIIQERKAFRKRTLSGAGTISSNTGDGMDYTKKKTLP

SEQ ID NO: 995519 - protein, 223 aa, Homo sapiens
MAVAHSPDESLAEAVGVFVERGVERLSEMRAESWPSSATSRIASAERLDSPDEFNYTILIFGLMCMRTAHLSAHLLSIEVVALRCDRVERGRTSRRWIDASAVPFAHAELGLYQLSLQQTTNHGTSRLALLTMRTPSGLRVSTELSPGALQSSAGGLCVRAVSPSERAGFWDRHPPVDCGRLLIQRVISRHVTTHVISEMRLLSSLRARQMSKLIAWASVTVR

SEQ ID NO: 995520 - protein, 404 aa, Homo sapiens
MGQRQVWRGAVGEAETAAQEKEAQAHPVCARVFVKNTCGVLVSKCARVVVWVPPPREKCKHNTRSATDTGEPPLRPPPKRMLGSPEKNVADQRTGGSVGPEAVLVDTPEGIRHTRGRVVQHVGAHGTCGGSPTRTSEQTQGGGIPYQKTLLKCIRGRGPQQTPHCWAGNHSESIITTGFAGATHAGGCGTHRMWGGDNLTPEGGSPSMFTHKLPFYRGPHGSPTRRRRLSIEARDDKYTGKALRAGVTKALVWAVMFAPPSGEQQHHQHAGGRTPRQWVLRTKIRGSRVLCDDPPAQPTRGGPGAQRNNERGPRGSARDTLVGGPQWGGTRTPRTRGPRALHEPHGGERRRPRRKDKRRSFSQNEQEERASHNTRRERTEHETKDAAERSSDTASGEPPSEAER

SEQ ID NO: 995521 - protein, 220 aa, Homo sapiens
MVRSASPAKLINGGIAGLTPVSPACLPSILGKTRLQNQQNGRACTRDMSDCLIKTVRVRGLLRHVPRELLLNLTLVHPARRPLQSWAANDFLRHQLSKDGPEADPALKEMLAGCGCWHLPSDRDHRHGDAERSSCHDAGRNRRPEEDPWLARDSSSPQEGCQNISGGLKLALGPRTHNWTETCCEHRELLVSKGTRGKLLGCPNYRMNTAFDTYNRAPGR

SEQ ID NO: 995522 - protein, 557 aa, Homo sapiens
RDWSAKLGRGRKIPRQTPMCLGIAGNPFAPEAPQVIYIGVATYISHLPPLAENHADLLNSHESLMRQPYPRVRGQRASSNGAKGRAPLMGVTRDSAGLLARPANEALVHFIERDGYSKTQQLYYSARNLVMDAQGTANRTSRARARRYSTPRHKDQGAYETSGLGNKGDPPHWTEPRNNHRNDPSTRPLKNAYFAPRDHGAPSSPVGAPFRPNTSCDCANARACPNHPAHPRIGGTRTATAPYWLRPYNPITRGPPWREPAPGQDPRGRNFGPPPSFHEEHNTPTLLRGPHWLTLATNPYKHTYAAPPAILNLGKVTTELNAHKNGKRRQMDLPGPLDLPWPCFHTVLALIDHRAGPPRRRRRHPYRPHPPPRPPPSLASRPPSPPLPFAPLRGSSSAAPSTHPSPHNRPHTPHTPVPHPTTTTDPHHSLHTPPHSPPPRHLPPHPSSTPLLSHPPPYHQHHTTPTTCHPPTTPLTSPTTTHPHLQPPTTTPSNPLPSSHTRPSSTHHTIPTPTTHHSLPHTPPLPPILSSSSSRPSSPRSSSLHSSSPTLTHTHPP

SEQ ID NO: 995523 - protein, 311 aa, Homo sapiens
AGWPQTPGLKAILSFPSRTRWFTPVIPEFWEAEACKSQGQEFETSLDNMSAECLRLQARAATPDWFWWRRGFAVLAGPVSSPLTAGVICQPRPPEVPGLQTESRSLSAQMVPRLECSGVISAHYNLHLPAACLGLPKCRDCSLCPAPPRLGSEERLCLAVHRLGCEEPLCWLPVWKVRSVSARRIPSRKCGAPRRQRPPGGEGRSAGALLGSEEPSAGTPSGSEERSRPGSPPGPERNGGGQPRRQPHPREKREQHHADTDKNIGDTPHQKPDHQHETAPPTINAPLTHRHTHTPTAHRHRSTSPPHTADT

SEQ ID NO: 995524 - protein, 196 aa, Homo sapiens
EAGSTRRESCSMRRVCGSGSGTGREGTRRWIFNAWRLSVLTEPGVAVVPLAVTRTKCPMVDFILLLGPTKSLRPLDALDRSTVMRQVRIIDMVSRRRGMRDITRLLRSTRHRHDLEALLRKQQELGKLSTADGKAFADPEVTPETDILSQLCTGMKLSAVTDYGMTMQREQPQCRTSGHSQSSSKLDSDGDVNAVR

SEQ ID NO: 995525 - protein, 114 aa, Homo sapiens
AELTLGGVRAQSTWIRRLLRMESESESGAAADTPPTEEYPKFFHGDEEIIEVVERCIPGSSTSPRMTMAPLRWTDVDVLQEQEERMRACEEWRVLLKSPMKGSGRAAMDRTQTE

SEQ ID NO: 995526 - protein, 421 aa, Homo sapiens
CVLQCGRAGTGWVVLVLLVRGACWWLVLCAVPMVDMLLWCVPDVIALLCGCVCFLAARSLCDLLLPVASHMPDGWALAAHVCCSCCSAALVCSSSVAEQLEDELLALQEARAKCIDRDCPTSGVAYKGQTTLDEALHSDERSISYRQQASTFSAAGQALNAMTHRFQFYTSIAWRTTERCTAGNMIETCKFGVEDETSNAFDSKRQVHHETNWYRAGIRALDGRPSRRRSAALRPIGRNLDRRNCFAGQTPRKQRATSQHSGSGPTGAPAPTPPRSPQEQQRLTRRGITPSAHRDPMRPRAARREQHSTHMEHTNRTDSADAGPRTREHRHPGRENHTHAEAEAAHSLRPGNEATTPGGQNERHNTNADSHTDQNYVPTRPTDARHHTPHTTKTTDPHSSRRPQTAKRQTPRPSYTRDHEA

SEQ ID NO: 995527 - protein, 139 aa, Homo sapiens
ALDDLEYSTSAGYRMQVVRAAGDPASLEGRVETACRHMMVQLALCRLLVNPSPFQTSAVSRSSGSRHQFPVWSQMHAATNLCARIGSLISSLLAGLALVHGASCTSRASGWGPRARQDGRLGDDRFVRAPPFLRSRRHV

SEQ ID NO: 995528 - protein, 325 aa, Homo sapiens
MACEYGAEGMQQRTEGALCLVAAWVSVITPYLPVGVGRACGEMDTPPLSDSRVGNPMNTLVTDRAVWQDAFSRGVFCKPGLTVSCCKGANKGVNDVNGLNLRLAEFKRDLEVGLQGSHVTLGPVPDIGGSEAPGTSEQGPEICVIHDDDFLTREMSFYRQGEAVVLCEFLHPSPSAQSPYEASRVIDSGANGKSDLQMRRIRQKLQSKQAGMDEVCKRLSNAEALRTYGQKVQRRFCRRGSMRKPVLMRGIREYQKGPLISGFLRENRTLEAKKEDKAAIGGPVNTGKPSGGGAKAPDPRQGTPAIGGRGQVPQRRNTSRETLVT

SEQ ID NO: 995529 - protein, 256 aa, Homo sapiens
MATCSSEKFYRCPRSNDRQQLPTAGLVVQQIAMRAVLRCLVSTLHDLEDKGVASERSIFRDFVFLEAEVYNQGFIRKQCVDHYNEVKSVTICINLPPPLADYIDVPVPEVQKADSARKEIHMNEDHSGYLQDIGNWLLRKPFFSADAVNTVPRFPKILPGETHDSQNGGKAHVTPESPNRGHSNRGATAVVNTGKQSRETTGGDNQEQESARDHEPQHNTATTNTQQNTVTTEKTAKTTLGLKSTAQMSYERTKTR

SEQ ID NO: 995530 - protein, 72 aa, Homo sapiens
ERYQIQSYDDCHKGNLLEREAKHHDLALERITPRYCDKCRLCYDQDYTYCKLLNPTALKQEEEEEKEQQLTV

SEQ ID NO: 995531 - protein, 460 aa, Homo sapiens
GYKIIYYRIAYNLLVTRALINNSNTSKEVLGSVGSRVRASTSGDKVELLRKLQEACIQRKLQKPVFTIFFKQSSGESSIVTSSEHRLGPVNPPEERWWEGPHIHSKPWYQEGHPEDTEASLLMSGWQYIPTGGNTAKMNPARVREQGERRTQSGLQNLISAEQSAERRSVSQTRGPRGDPPENCKPAATLTIQTRGVFPPTHYNTGALRGTTRGRPPDQSKAHITSRREFHNPNTQEPPSPAISTTLGQNKTELLVNTVAQDKALTIYPPCLQTENVCRRVSNTSPEAKGRAPPEGPPWRDPTQGKKQSITHGGLLDTHPALAPGDVLTTFQTANNRRGQKPGLTTTSTKSPQNRQQVEDDSTTRADEPSENPHSTNLKGKTTPEETGPLTPTTGNHHPPAKPHPHRPRTTTTGDKTHPLHRPTTQRQHSSKTSNNMLTNHPRQTPERDQKRHTETHNSH

SEQ ID NO: 995532 - protein, 185 aa, Homo sapiens
APCPVPRIACRLGPGLWMLGFAESAPAWRLRSEQFPSNGGAVAVPGMAWAAGRVLPGGPSALALLSLCWSALLSFLLQVYAPLPGRPDAFHLLHLPLLLPASILCLCRAAKYFQESTTQEKRFLLYEPPSENPPPETGESVCLQLKSGAHLCRVCGCLGPKTCSRMPQSILLQQGASDPRLEIGT

SEQ ID NO: 995533 - protein, 141 aa, Homo sapiens
MKQTRRQRQQPTSSDTPNIRWSEGPYTRAERYTRLDCGSNHIEEPHPQGGDHPHLECGTTTPPIHKTERQKQRAELQEQRRRPHKRRTTPTVSECANAHTEVDMIEERGADKHKSWKERHHRRYRHQRKRRLATNKQQHSH

SEQ ID NO: 995534 - protein, 293 aa, Homo sapiens
GRAARSIRKLPVMQMGRQFPGQVPNVVLASLKPTANRGSGYIPVTRGESSSRSRSLADREVANAKLPLLEDAPGPTACGSVTRGKDPISALRTFYYNADRKYDNCLTPALSPPLSYDPVRFWDIASQSGSGGQTFREWAPPLEFPCPNPQKPDKYDYLSYEVVTASMVERVCAEIHFGLLISLILAIGYDSGLCGLGPQAIITGSLYAHEGGRWKKLEVRQNAVPEALKVERSTEKTMRTRTRLPWCTNLSKRLDQQRAPDQISWPGGVAHACNSHDLTKAGGVIRQGNRGTP

SEQ ID NO: 995535 - protein, 314 aa, Homo sapiens
SLNPDAKQRPGRAKHGCLASWIPSRASAGGASTLGTSGLQRRATDFKCAPHPFPWLTPGGKAAQAGAGLCGDCGLAEASRMRETCADSRSDTIAHAQNKIRACGERLSLGRQQWPKPVQSKRGIMAVRPTHCGSPSACTTFCTQAVSLNQDRAGPSWGAHRPVDRGPTGRDGQSHPMRVDPRCQASRRTEWQNQHEDLGETAAGRQVQCRSYTFLTSIGPSITVHLKFSAQTRIDGSNLERNINAMGAPGAGKPPGTKTQFERATRKPWGLAHNRAERPNQDAHGPWGPGDTRGNNARGTERIPGEKKRSNKVE

SEQ ID NO: 995536 - protein, 262 aa, Homo sapiens
GGCSGTTRTRGHGPGLPPAPREVIPRGAEGPSTTCCVGCRERWRGGALHSLAGEGPGCRPGRPRERPSGCVAPHGVRGVCRVWSRSPGPVPQPGDPVQSPSPALLAFSGCAWWHLLPSLASCGPRVHSAADTGGDLRGGLQFPPSPSRPQLRAGPADASGLGKTLSPPGVRPWKCFKPPSDLPCEQRGQSAAGRTPHTSVRVTLTRLIQAEQSPGPLALIEPSVGSAGPLLLTKRRAEYRSQWSPMKQNCIQQFGRHRRRIS

SEQ ID NO: 995537 - protein, 138 aa, Homo sapiens
MDGETMWTRDGPQAYRHICLVPHEIKCPGTYKCLFVWTCPQDEADIAAPRHGMLCERTNACRVTRTFEWSIPAKDWALAQKARRVLCLLPGGWLPSPQGVVPHQGSDTILAVGKMGAQLSMLLEGSGAEVNRLRSLCG

SEQ ID NO: 995538 - protein, 151 aa, Homo sapiens
MEPGPTARRLRPRAIREGWFRRLQLWPGRPVAECACPPPGSRYQDILVLPGDKTYGNVLVLDGVIQCTERDEILNTSEMIANRGVSARSSPNPAKSVLNHRGPENGRVSCADGGEGDPSVESRYSCEIEQGCHSKISGKFPVHGMAIGITL

SEQ ID NO: 995539 - protein, 151 aa, Homo sapiens
MDVSEIGECLWRGSELAWEATGIQAADGPRSPKVTKDPCGGGRRDDLPFERHFAVQIDGRCAWHKATLPPGGLYVSRKILRKPQQIIECIRFRTLDDLILSQVYCANPLRQASIHKAKAKELLGTKLELIGARRDGIVTSPTMGREGRLEY

SEQ ID NO: 995540 - protein, 118 aa, Homo sapiens
MCFGEVGSGGTRIQGWFIFHTFTSPLKTEKKWLSGVTPITFQAGSLRSEGLKNLRKAVEKAFCWSPGTFPAELTGPGSRGNSGAGLDWEACRCYFLATGRCVQKRGDPHFYGGSTPGG

SEQ ID NO: 995541 - protein, 227 aa, Homo sapiens
MGLGKGGRGKLGLNILNGVDEESGKEYGGGNYGGAGLARSAQEAKTFDLAEVFLNCQKKHQVFPEARSTGGFRQQNLCANKGLVRAPARGSMGYSAVWAGFGKLDRWSGVVTYGQTRGKPQGGGAARTGSYKRHRLVAQVYNRKRGLSNLGKCTQNSNGNGAAPTGEKRRHAHVTGAPRRGARDTKCLGDHGETPWEPQGAVWAQRRDEQDGPLQYGPLHQRAPPWG

SEQ ID NO: 995542 - protein, 105 aa, Homo sapiens
MDWGALWKGPWTICLGTDSGARMVNLWDISPRFFPLPQRDTLFAPRAGERRPIGGGEHESEMWPHVDLVVWPSGGFGSANLVGLRVKGALGDSRNIKYSPPKNLL

SEQ ID NO: 995543 - protein, 282 aa, Homo sapiens
HLGFFNLKKNSFLQGRQINLKVKRNLVAGSPESSVPQNLELRKGPPGASCGKVGAPRGSRGCGGKEPPAHTRFTWMGVSVVPTATCHVLSPRDLFDFNTLGGPTIYGTDTGAKRGGYIRLGLLIPTREIVFILVHPSSSHFPWERFRRSGETVRGVDVPPGAPCLQDDARSMRLATGGGGWVAQGRLLEMHFCGVHHRSEFPPAHPLCGLVEDRSQRVTTTHSWPYSSKKRIAPQLAKTLGSRVPYLALQIVCCPETFTSEKPKARGKPPVNASPIPSLTPP

SEQ ID NO: 995544 - protein, 115 aa, Homo sapiens
MNELLPVMGYPGVAFVDFMSVLPGIVACGMASTGGHAVLGAVRSPLGMRRVCLWIGYGRCMPESGAGVPRGGTFWSLVWRGAEGQEPPRGLRVCGGVWGPSRMACTSPPLSFRGV

SEQ ID NO: 995545 - protein, 155 aa, Homo sapiens
MSWGANGGGGLVFTAPEAPAFGRVLAARRLPVTMVAPPAVCAPGPRGAPRIGPASPQIAACHAAGSRGPGQISLQASRHSCPRIAATHGQVCPGWRIPKFERRHSDMTLYVHKRPLLSDRAFQEMKNNFATVFDRLGCAKELREHAGLRLGRGDN

SEQ ID NO: 995546 - protein, 100 aa, Homo sapiens
MAWVYPCIVLFRWDPMISWSGRERLLLELWAGKELIVRVALAFLCLVLNCRGAVSGQPLVLSCAHGGGWFGGSLMFGLPPGQLLGALVPGTAFRKGPCGR

SEQ ID NO: 995547 - protein, 80 aa, Homo sapiens
VCEVVAVSRKPTFSRPDASEGPKSEFPGQPKSKPCVLRAQHCPEQILANTCDQIRVPLDATMPKIRSVCCVTRSDVDARA

SEQ ID NO: 995548 - protein, 251 aa, Homo sapiens
DPVPFEPPDKIAVLDEEVADAVDVCLEQGLMYCRMRFLVTEESHEIFMIILALLFRMVLQVHYMLTHIAIVATRSIGKDRGILTRDRSCIPRQDSVEDPLCGMRPKEALGRRNLFQELTRAVSSRVYLMHRGKPPCLIIVTKRSTTGNASPKLLSRGALGWLRVACPVASERRYYAVAHCDGVAAIVPGQSLIVLCAGVRPLAKALLDDLGILCVGHCFGVPLFVFGMLSRYQSLLLRKREYKEPKGATER

SEQ ID NO: 995549 - protein, 398 aa, Homo sapiens
MCVRRPRSSISYTNFTEYIYICGSQAGGRTQKSPAQYLSPLNFPVCVYPLSLLGDNISGGPLVAAVVYPPLLGGFIPLYVSPTVVCPFGALYSRGGGAHRARGLIYPRAEHFQRGPAGEYLRPRVHPARSCAGDLEPPSAPTSFVGIAKTYPPPEEHPARSLKPGREKILCAPIVGAAHLSTCWRGSLHLVRGGRLYKTAKKSPLHTYLYLGPQQRAGTGGTPPLYTGGRKTPHFSHLEKGPLCIGPNNLTHDGECRGAPPPPKRTLMAPPQLRYQTAPACWYHHTHHHAGRGGPRVAARPPVGAPHNKRSGSQAIGSRPADRTAGAARTPANYQPPRRAPHCTNTPSRNARMERRRHHTHQRAVSSYPNPSKLALNHAHRSTSQLAGRHSPPPQHHS

SEQ ID NO: 995550 - protein, 84 aa, Homo sapiens
GDPATLNLFLSNMERMLHDKVHGVRVIGSSTLDTLPPGPQRPRMPINRFGLHCCGSGGATVIIREAGGIVIDTFWVDPVDLMAC

SEQ ID NO: 995551 - protein, 233 aa, Homo sapiens
MAAPRGPGTTPQPSPQGHPLRKDHRQTHTVAQTVQHLPPIHAAHRAHPSPREPHPTHPPAAPHTRPTPRPHTTPRPPAHTSPRARQQTTHAAPTHRPHTPRAHHPQPPSTPPPQHLRPLSLPPSPPPLTTPTRPPPTHPPLLIPTHPHPPRRPNPLPPPPHGVQAPRHPPRTPPAWLTTAANPPRSATHPPTGRPHSQPHAHPTHPPTHAPPHRTPITPGPAPRTRGSNTSIH

SEQ ID NO: 995552 - protein, 291 aa, Homo sapiens
VLSKITHASIPIPVSSSSKSAQIKRDKTSSTAAMQLIKRLSLVGIIPTGNSSDYAFSNNTKVITKTILTPGIGQFPCRMPPQVHRDCKPHVQYECRQYTSVLRSTPSPINAKTHLSCRKAPVDTKIDYEKWLVSISEALAIAKDPDLGIRYPDYALSPRYQSIRVKLEPNMCSPGTLRGHRLKLKGPGGASYPSRGACSVIDKPRSTHHSCSAIYRIFRKTPVWRLPSKRKVPTVKTFRFRVLAHEVARKWVQFYPRKKYEYAFEIIGSKWIYPQPGIDAFFNRGLKLYTA

SEQ ID NO: 995553 - protein, 333 aa, Homo sapiens
MKHWPIYGVWMMLAVPNGSKLEYKGETKSFYPDGRCPSTGSAHNDARQHCQHSLTMAKTSSPMPCGHRCPAFTSHTDLSSVQATHNDCLDTYSDWLLNCYHLRHSLTLTAKTCMPRYSGLYRALRTNTHGFAHAPTRGHTAAYQIPLATPAATTTEANISPDLLASPPPIPPSIGKRHWPNSLCTRAPKRLLNKRHCASNTTTHHSGASGRNKANPRQPHPPSHTVAYTPPPPSNSCALTQTLLTTPAHTSTSQSTHVNHFPHTPLQTHQHDRLVIHIKRDPPAYHTRHSCTGDHRSRQYTTHVTTPTHIPPPPNNNSPQRHHRHTSPQAKSS

SEQ ID NO: 995554 - protein, 349 aa, Homo sapiens
GSNMETFDVAELDHELPPNGAPRPCEHATHAAVPMWLGSALCRGQWTLRLDLQATMAMALPTDLTTWLWMPKPMCDRHDDLLGPTGAPTLHLTMTSTSQIAYTSLSLPHIWLSLPLHTPDPSIDYSDHQPSGPYYGHVGPGLWTSTRAFSYMGHHRTRPLYTAISDTHRPLTGPYNTHRPHTTGEDSSMKYYRTPDPRCPYTSVAVLANQAHRHLPPTYIPPYNTHCILLPPHHPLTTTYLTHTTNTHIPHTLPKPTITPPHYHPSPIYSHPRSPTPPPPPPFIHSPSLTTLLPPPLTPNITPLTPTLLLPDPPSYTFYTLLPPLIPSLHFHPPSPLHPSSPPSYHLPP

SEQ ID NO: 995555 - protein, 105 aa, Homo sapiens
MKYWQHGELAKNGDMNVVGCLWARNVVRGQSMRKPTGLKMRCWLDGQDFSCSGSHYLSSNLGTTQAPGHIPAMPYYYLVERHNSTVLPVDFTLERGPPVHVKPCQ

SEQ ID NO: 995556 - protein, 298 aa, Homo sapiens
RCWLLVLNLEPYQTWDWRTTQNDAYRIRQILRRRNEEEEELVDPLINSERALRAVGEMCTGPGAAKLCDERVSSRSHTVRGCTEESLDFLSCEVSIAWATNSLDNLYTITCVELNSPQIFIIWAVRIFPYGVWMYHLFFLSSVSCKIHMNLMGLGEAGSFYVISQVIPSRLKKFYDLPMEEGHVASGDYVLCSGAGSNRLGPPVASCKDTPLVGEPRAGARKECESRAWVTCFRPLREEARKSALDTGEADNLERGRVLGVVDRILGLNSCHPCFRRKCGSVREVWRKRGWLSRRFGR

SEQ ID NO: 995557 - protein, 167 aa, Homo sapiens
WVLKKSETCEAKQSKAGAVGGCGVWGPGGPGSVPTLSSPLCACKSGVCCVGGHSSCGNVASVESLWDAKRGEEGLWGGVSPKRARGVVWVAAPSWRGPLSQCGPEGEFPVDQGTPVWGYCAPVRIVGRGPCEGETPQEHKGERETCGCVWREGISQGGHCGSGRPGV

SEQ ID NO: 995558 - protein, 231 aa, Homo sapiens
MAMGVACRVSVHFNEWSVRGSLVDRYVRCGTLEKTLSSREGRRVQCLRCQNIVPMESGGLDSRLCGLSHVSPYLGVADAMVGSVIYDRTSDGSVGNVCRGRSILCWHGYPHMVRSLALGRGPCVERFSICCLLLMEFDQPYLYKKRIVELPETACMAIGYPITSYVRPWTRERESGGWAPRTLSEEFGTRKEKKETNKTPGLERGQRDKKITILCYTEYDQTNYFNKEYRS

SEQ ID NO: 995559 - protein, 125 aa, Homo sapiens
GLKGSLRTEDKRLQGVCPEEGWDGVFSLTVPFSEGSFIGPSFKAITVGACSRQVQELEKTRRQGRRDRTRAVGAVIRRLVGSYGETSSTVADAVGGYGGSRCRLVPLGPSQRDRIEGGLVPSGRT

SEQ ID NO: 995560 - protein, 511 aa, Homo sapiens
LYVANSEDLPRFCSEALLWSSTAMYPVGFDISIQPMQTWHHVIGPAALCSRAHLQRMSSHLISMPTVILGSSFIRNGHDYTDDHYRHMPDTTAAPYTPDDHVFADRNYSSHTTDTSTRSQHVEDKIMNRASGRPHACNVISTGNTRQRSAIARRSKKARRTEHSDTVTNRRAQPTTHCLAAPHHRPSPDGCQLTPSRPHSASPPADKERDTHLPPEPRTHTYKLPNPNYDSPMAKNKLPHRDKNACKQHMTHSPPCTTNDETPSHTERTTTKHTTPLEHAPTTTPTQHHNQRRPPRQTNTHTQHNTTHTERAEHTPTHVSASEEPTRRKHTRRHRGTTQQGKQPQPTHRTQARQPHGTDLTYPSTQVTPTRLRSLRPRKPTHHMYNNHTARPIVERTNDKRRATASDSRTGHKQQRTLRSKPSTTPTGISTTTRDLRDRDKPTKQNQADKPKEANSPNEAQQDKQTKRQDDTDEHKRTRRDNLRTTLSDYHEENVRQNQQQQMTQYRERRN

SEQ ID NO: 995561 - protein, 300 aa, Homo sapiens
EPGSLCQVVRNLQRAAVTGAAEPAACPAPGPATLDPDSLWLSPRAPVPALGLALTAEDERLERGKEEPAISSASLAKPGPSKVSVWTLRVLRSCRGPGQATRTDTLLGHVDLPRFPHANHLAMERPCGHCHLPRAVQPRVTRTGAPPQRTLRPRGSPGPTGVRKPGKATLRTAAPHRVPGAKFTPKRAAGMTAHRHTYWQRRRRARPPAPQPTQRRTRTTTLTAPNAPQTAPNSEHQLTARRRPRPPATSTGVGKDQKPRKEATTQHPGATRHTTSRKARGTEPPRPPKRRTRTHRPRTS

SEQ ID NO: 995562 - protein, 247 aa, Homo sapiens
RSDESPDGRCLVSKKGAVKRHAWLVFRGSMKHAVEDEVYHGRPRPDGLALVVRQYAGGPVSSQGTGRRLREPSSPNHKKPGRPEREGRRRDSARRAEQHAHAHPWTVGAHDFPHTQGSQGTVHHTMKARHAEMIQAKSSRPSTDSGLVPTIRKRIPCGIATQIGLANGQHKDLTVARFVMGGRQIPYVGKERNYMTKARTGNHQGTYWNAYVDSPCAQYAGDTKCTKEQPYPTGQRTTQNAEHVATE

SEQ ID NO: 995563 - protein, 272 aa, Homo sapiens
PARVRDPGSRKNVDAYKKNRDGPFMRTPFKGRGGHGGPKKGCPHGSKHPGAGQDKDMWPNSYSGRMRRDMDFFSQVSPEGLTCEKENQVGLGRELFLSGILLTQWRGLSHVISPRDIYTLHILGPAEKLVALATTPKRRVRRVPRKSGAEGPRGPKRGFWEGGGGGPLGREISPQERGGKPLRNKKRYLNREGGWAGGPPRVCAQTREKGPEGCGGAVGFQEKPEFSQWLKRGGGDYRGPVGKLCASQGTPSTCYKILGEKGNHFFRAIWDI

SEQ ID NO: 995564 - protein, 110 aa, Homo sapiens
MPTFMGKQKEMEQGRELRNCSHRSGSSRTELVLSNPGKSFKRALVTSVTCLREVKRPEVHGIRQLWNLLLIGTRMEPTYDTYLKRNPSSNYRFTEKRLVLCGLGRHDFVH

SEQ ID NO: 995565 - protein, 428 aa, Homo sapiens
APALVARVVRAVRVAADPHVVAFSLLALFGPPGLSLWPVWPAFLPEIAEWSMSGGAIWPACLRVLCSDACCLVMLKSCWSDSLFNTVGIWASDDFCTTILLIHSTCHYLINGSPSDHTDVSAWKLDLVNCATRIDLVTTFVSTHTRGNTTVFVSHCRTLAPKRPQSARNFPQHRRSIWHALCASTTFKATWHGVHAARQTAILPVSLHTFVLARILPLIRISLHPSLSFTRLCSGVASHPFSPRLVAILHCLNTTHILALRLALHNNLGSITVILGRTPHTHIHQRSSAQRSLDPSSLAPLGPRHSSSKTTRPQACHSHAARSHWFSSAMESTSPAIPALRALWAVVSVRRLTPVARDSSTRNAPCAALTAPVAAYRPFARPAMQLRLSATLIAGPHGISCAHVYPERAAAPITAEAFHQQGEQGGSA

SEQ ID NO: 995566 - protein, 249 aa, Homo sapiens
MPPTHTTSKHTQTIHTLPNPNHSTLLTPYSTLYPPHPYPPFTLLLDLPPTLSKLTFCTTQSITTPTPIPPIPLYPTPLTHTHHTTIYPTTTSSLLQHYLYTLCSLPLHLSPHLLLSLPTYATTSNFVTILQTPHTPSPTQTYHKHLPYPSSSSPLPTTPPNHTPPPPPPSRPSSPPTPPHPYPHLPPLTLHHPNLHHTTHTHHTTPPHSPTHPTPPTTITHPTLPYTPLTTTYTIHPISSSHSFLTPIT

SEQ ID NO: 995567 - protein, 428 aa, Homo sapiens
PRLADTQLMLGVGLICDHLSTVAKGHKWRSFCWAVVLSFHDSHITGTLLLRKLLPLHDDNNTLSSPSLLLLAHVPEPTLAFLPTHQPTCTLYPRLLPPLSLNNTLHPHFFPYSRSPDPAPTRTILNPTERHAMPCPFHPKRTYLLLRRSSAIFGLTPKALERLPRLRAPNSSEAIHRAQTTSMSTSPWWLSKQSQFYLRTAPPPKQPSPRKVNYPCNGKSHPHEDLVLSPLQTIRTGRAQPSQGSVQTESWTLSHGKHIHVPIWAPRLHPFQPQHEAVQLVCATKVLAHPTTSRCTHPSLPPFHTKPRTTTLGICPPRTTEGGPISPIEAPLSSNVPNETQTDNPLGSNSPSHDYICRNNAGTNTASGTKLTHLNEKQTSAPPPYSNYDRHITASKTHIAYTSLAVAATVDHIRRRPPHTRTLPYASA

SEQ ID NO: 995568 - protein, 152 aa, Homo sapiens
KLSKLHGFSFFQEWPSVLWFFLRKLRCFTLASLNERVRVGGCAACVRVWQDFSSGGWCFSTPLTSHPHLSSLISHTKNILKHLLCATTLLYTFTGVFSKKMWREIFSRVEGSLRGCYSYPPGVVSHEILQALWVSFQSFSSQDPFVVCAHIV

SEQ ID NO: 995569 - protein, 346 aa, Homo sapiens
QTGGDGPEEVVLLDSLRWTPGRAWPWGSAGLRLCVLSCCDLCEVLTMCWSDAVTYLEVDAEAPVGSGVSPCLAMIPLCESCSPLCIGCPDVRRRRIGPASQHRGPGELGKVKKEQQDVLRRTMTSSPMCIREGRQTGDSVDTNWTLVTLPDDAINGRQQKQAERQAAHERLHGVGLSAARRKLADQYPNLHNDLKLSKTLGKLWKDADTKVTRAPSSKRLSGPYAAQRKTPDYQYRPRRAETQGRQQWKMRSAPGVEARQVDRRHPGHYTRTPWTPDHEKGPMEMGPQRPHAKPRPETDETRDEAQRHEHSDKTIGRSDHKAEKETRTRQRQREKEETEGQRDPDT

SEQ ID NO: 995570 - protein, 263 aa, Homo sapiens
DAGPVVSGRERGRSAVICPWYLRPPQRMDPLRSGNATMCARGPEPEYLCTMPQDSSPRDEPSKAVLLTWSSRSTGQVAKTWTVPLRAGTGKPGEVATSQRASSFVSTWSRRVQWCYEELARMLMWGWNCVVFAHRHVGHGQIEGDEDCVAVFDITDVVPSTGIVVRHAIADTSDATIRTYALAVYCRSILEHEFSLARAAIRQFLNGPGIESRESNLAGSWYYHVVHLSCYDHILNLREQIFLGPLREKNDDQFVEIDKVGSF

SEQ ID NO: 995571 - protein, 383 aa, Homo sapiens
MPILAAQHTMQVYGTIGDFFPESLSQKDCGLCDVQSQTCSGIKCIQSTIMHDDHQNTIFGWMTAQITHHGDLGMSAVPMMTGGWIEQDDCMRADWKEDEEIDYREGVDCKDDMRGAWPRNKDEQINMRKKKAGHNMTHTNTSNKIEIDPYKKYKDRYSTTLQKHRSTSDHAKRRCDQKSLTHRAQEMGPMRQPHRDRAHNRRHDQHTHRDIGEHAKQKQARRQPQNRSHGPWHNDKRRPMRNKPHKTPRNTQGGTTHDTTKNKPKQTDTKPRNAAEERDNMERHHKQDTTHTTSQATNRGQKEHLGNTRQQGRAERTQTKTTRKQTNGPHRPATQQQQSTKTQRNNPTQTDRRTHVANKTRKKPKSTTKERENKDNNMGGPTT

SEQ ID NO: 995572 - protein, 120 aa, Homo sapiens
MQRMDPILRCERRSVVSIPEQQFSLQLESEARLGQHDSAARAHVIIVINVGQTRSEYQSAMECLAVTWTDMERGRTVRMPKHLHALLRVDTWRRERMSGQSKLNGTQERGGTLKTLNLVT

SEQ ID NO: 995573 - protein, 141 aa, Homo sapiens
ARGASRQSSDSSYLLESSELTPAGLRCPRLPARKQCPADRRGNGDRDVPQAEVGRGGGRRPRHRPEEAGEGAIGGGQERARLPEATKDLGVTARVAQHSRNGRQSAPKETRGNENHRTRQENKKNRNDNEKDHKIRKRVNQ

SEQ ID NO: 995574 - protein, 366 aa, Homo sapiens
YNGPFGSEAMGGAGPPAPALGRGSQSAEEAWKSTRIPGDGASALRGSWRGSPPTARGATDHDRPPMTSTARDAHGPGAVTEETQADEEAGGVDHSSELSSLLRVILSQVFDEVTVKMNLIASADYIHLELSEETCSSEHHTLTKLHMYGLSTHYTASDVFLDADTSGACSNGRLKHDLTEGEDTWRPPVNHENVRIWIKYGEEEGITNHSIHTKGNKNRAMMKNMVKREAILNGGRTKGLMKYNSRTMIDHRNKQEPYRQAYKRESETNRHVKPGPQPKGPGKGDPKRQHETMDTSKTHTTQEEQDTTTDETERNTQMWGEIHNRCSEIQCKGARRLVALADLGTMNTVSSADIHVDVNGLKTNGQ

SEQ ID NO: 995575 - protein, 362 aa, Homo sapiens
APHVPLAVPRLLRWYQPGWRSVNVDRGSRVYGLACQCCCPDAQLRLGLYTLFECVRLAGHDLAGQLDYSNDRVQSNVLTMRLSWPREIRQRFTLGYSLACHETLHRKRSGMNCLLLMLRGKRVVDHAGSQWDTKCDTLCKRRVVSRDYSKRADAVDCGQITLSEAHYYAPLSYDFLNEHRAFGTTAIEVSEAHALIERAFDSIGAPTSGTVTTAARDERDIGSYDGLSKARSWRFNRWNIAARILSSDREDLPTQKVWGHIVAQTYSRDISHLAHWTTHPTIGKGSAHRREEPKAERKRRTLSLKWLAQSATYQHVGAATQTTYTGEPNVTETVLFNIAREFHYHNGGLDTTNRTFASTLTM

SEQ ID NO: 995576 - protein, 306 aa, Homo sapiens
MRHQIGPRCGADNSMRPWYMNKLSGGGVAAWTRCGRWASLGATGCVTRRIGMLVLISPRGAGCIPMDNSHGEPGISVRWFGTLVLCGGPPGHMRALDLQHTRTQSHTGRSSVLVCEGLCTECLRGVGQRQGRKSACQPARWQGILIPGAYGSKIPRKTACLVKLRRMLLLQLIVPLIDTLNQSVDCMNCQGQSHGCTTKCNSNLHLPSRRDDTVTEDREMSLSVTNRHCVQVHRACTILECPEGVWPGMSPTPLGQASQLALKQTFRNQPKWGHLMTGWMAGRQLGETERKPPSNDQQSTAHDMLV

SEQ ID NO: 995577 - protein, 481 aa, Homo sapiens
NFQLPYFMGHKGGRMQTITTGPPDQRVLQALEHLVQHESSHFYQYRQLGRDGVGQIFHQRKGNIRRSYLRLGALEAMSLLLGHKCPLYGIENKAGLRSLPVVAKVAGGRGQHISPYNIRTRHTRGKRRFHRGSGTIPLCETNIWGTETDAKFVPPLYNTGASDLIRERATTTLQQQDFKYYKPISLDHTNTQDTVCQTSKHTSYISCHKLREEQTGENTERDERQDKHNVGANKHHEVFTKEYRTQVKQRKKPTRYSQGKQRRIPQEIFKKTNQGEEKKNPPQKRENTKQRHTTMHAKSPDTNKGQRTRQKAKDNHKCGRRKTKKSMQADDPPHTDTGNRLQQVRRREYERTSREYNKRDTQTTGPTEMSKTHQRHKKRLKQAHEEERKRQTEHTHAINEDNKHTQQNEDTRQKGPRDTKGHNNNRSGDPPDKRKGFQHKRAKRNTIRAQELPATSTENQAPCDGKTTWPRQRRNRSTNQR

SEQ ID NO: 995578 - protein, 342 aa, Homo sapiens
MAGQVPGLLQTSAMSLPRVLRLSLALASLGLHAWDRGSGPTDASVWRHMINACSVPRDQDRRTPLDPDPKVTLGHHGPESITFISGSAEPALECPTCCLLWRAWVWEWCRAAFCFRRCRDCLQSLLEPVCGDAALSCLLRTPMRGLLKPTGPRSTMECAPSAMIVQPARSGGCACGSSQSLGNEVTVTTDSSGSKWQSLCIPLPERPRISLQGTWKWRTSMLEKGRHLSRIPPMPSRQHIVVPERTRYCSQDRHRMATQKEGAKPRFWPWQGCERMYTVTGGLGQRHPHGEGATNGVADRLKEIWTKLHAEPRKSTFAVAGEVIHTVVLQDDRRESCNVQQR

SEQ ID NO: 995579 - protein, 76 aa, Homo sapiens
QGPANMGRVRTKNREEGGPELIIAEVLHAPGAMSVSRRSKRVCEEIAIIPMLDSLRQTRIAGYVTHLYEANSDQAQ

SEQ ID NO: 995580 - protein, 112 aa, Homo sapiens
MDGSRMTDREPREVVELKGYDKTANWRAFEKPGRDCVRSGMGGKRLASYDDMRHQTSATEKDAKGTYRKRESVGKIQALVALARQGLAWEHNRRTCQSIGQGLPGDQKQTEQ

SEQ ID NO: 995581 - protein, 628 aa, Homo sapiens
HAPTVNVSVVITVQLDSASTGCSRYTIGRLGDPPIPHCIHNRVVAKVIWAERGDHARCTIVHFRTISPRVRWWPSHRETAIGPASEIGYSKPLQHASKYFGRCLCALSITEQRRKAQCDARMPRATPPIGIACYERWRNSRRLRHWSLQQVVDRLIYSKGGRSVVETSNRFQHSMTFGRTTELHFAMLTKWGVGGVIILGGTGHARGNFYVDKFFTPLTLDALEFELEGTTVLSRTKLLYGRRVRGSDSPAERHLELFRHAVRLCGITTHFALSNQKNRIRRWGIAVPLPPFIPVDLIMVAFGNTVWRRLNIGHTRTTHAVRIPFMGFPGGKTQIVRIHLEREEGSVWHLRGTEHTMGPDWGGFHTLRVCEPGKKGITQDRRDVLRNAYGPQFPNSRGLHIATLEVPKGCPNRRPKKQVPLTRGQTQDNKWVRQHTNLYSRISKNRFGLGAIKLYSRQERNSSYRGRRPSPDVIDHISRNEEAMFDLKHPRGITQRDNTRRTRKQKVFEHHSRLMITPCYNHGSREEIIRTDEIIGELRSLKTDVDTTDDEHLKKEATITYWLEKRIWNDETTHTICVRTPYEKEDKLLCIGSTTPLNVNRVTPAEGERKQYEETGCIINQETVADAD

SEQ ID NO: 995582 - protein, 59 aa, Homo sapiens
MESLIALGLPSLSTLRTTPIEFPDMQSHAKDLEESPLPSPLLKLELTPLNSHLPKAIGF

SEQ ID NO: 995583 - protein, 88 aa, Homo sapiens
EMESVLLCAQAVELQVALTRWLTCNLLTFPGFKQFFRASAFPKYSVGHTGTLPPTPGIIFLWSIFIDKARGFPPIVVAECPTLVEKLM

SEQ ID NO: 995584 - protein, 206 aa, Homo sapiens
APLLGSRLTTAKRLARTPVSPASWDDQAPRNGGPLVRSAQRSSVWEDQSTLMVSSVNDVLVIGVYGYEGTGDACCIHYMYLLTWKDIGERRGRLTEPRDDDTVLDAMKELLVAELLGLPRMDSVNRLKSVRQIGLHREQPYVEQLDKIGKKPVAELAGCYFPYGTESPLRGIRPKTQLPCCLTFLARTEIAPAMAFTKQESSSGIG

SEQ ID NO: 995585 - protein, 60 aa, Homo sapiens
APLVFVPCQLPAMAELDRFGAPAGAPGVSRAWCDTAVASGTGRPKIPGHDEPFIGALDTE

SEQ ID NO: 995586 - protein, 208 aa, Homo sapiens
AGERRCVTPESPEQPHLPPACAKITITPLWSEPACCRKPVPQVTITCNHEHAMAWDPSMPDQTETHTTNSTHLKHLDDAQYQTNQTSPETTYRTHTEAAKEGTAEAETHCIPETIQTNQAKKNQEKGQRDRTTTNDGGHHKSPESTTGLPSANTNPNPPSAHPHAGYRGSHRRTNSGRTTTNHSTPEQQRTKHKEQSKPTHPQSPPSN

SEQ ID NO: 995587 - protein, 131 aa, Homo sapiens
NLVDSNLQKKRASKWSQLCKQNMHDEVKGEGPPSGKKTAGPTGEESLNQLLPRRDGVVALQRTPLQDPVRKTMKEQARTTPEKTDGWLAVPAKHLRAPRKKRARGRSSLLKSEDGDLRSRMEVNSEDSMRE

SEQ ID NO: 995588 - protein, 78 aa, Homo sapiens
MGHNHRRPRCTKTGGRCRMAPRGNQDSRLHPRGGHREEHKEHTTQGRTQQTYYTLRDSGQQPSRHERKPPKRAPQGTG

SEQ ID NO: 995589 - protein, 151 aa, Homo sapiens
MSRHPWTLTEAKTPGRGPPPLKQEKEGAAKTHLSETQYHAGGPKGVNQMHPRNTRGCSHRTDIPCTNHRDTQQHKEAPPTCGMRKSTQRSCKDPRHRQRSKEHNPPETHDKEYPHERGAQQGHKHRGQNHTPQHQQREEPTIDKHSNTYRS

SEQ ID NO: 995590 - protein, 158 aa, Homo sapiens
MKLLTANPKEFAKTQPDETVPILQDGSALKSGARNSGDTSQSTIRQGQASKQRDRQKSNSSPQTAARRLHTLNSKTGAKRGMTKRDRKRETTGRAGKKQKRRQETGEREDKHTRRAQKTTRERPPTKTQKNNEERKAKERQRHTKEHEASTQQTARKE

SEQ ID NO: 995591 - protein, 33 aa, Homo sapiens
MVNAPRRQKGAHKTEHVGYPKKCPIVQNEQSFD

SEQ ID NO: 995592 - protein, 175 aa, Homo sapiens
MREARVGAARDSRRPAVGTQSGPSGREGGHKILAKGGSKPNKAQRRKTKSPTWREPSGPRRVVSGGTSGRPRLGRGTRGPSWPRHEGKVRAGGTPSTAGTQQKSGQQRPDGPRRKQPRTRKWIREEPESEDGDQHSSDNLREGKTGKQRDRTRRRGAKIGPQKSTEQLRQGGAAH

SEQ ID NO: 995593 - protein, 349 aa, Homo sapiens
MSTWGTDSKAAGQAPSQDWEAHLSGTAYSASQSRSIAIRAALLLGNDLCLRALEGTWKACGGLDNICFHLRALEEPVEGERQGQSGELLATLGTCRVAVFLDDNRKSHHQALGSTTCALWDDGDRGQQTGGLLAGHMWGCDVHCPLSPRMAARRCQAPVMPLSSCGTCGDSMCRQTFIGHESDINAVAFFPKGYAFTTALTTPRAALRLRADQELLMYSLDNIIWWHQLCCLSRSGRVLVAGYEDFKWDIWGCHEATVAEISGHENRVSCLGVSRRWDGWCPRVPGSLPQNRRERCHPPRCRDERGVAWPQEDRGGRGTTPLREDEAAPTECRARERERDTERQTQPQN

SEQ ID NO: 995594 - protein, 199 aa, Homo sapiens
MPAGSSSAWNHGMQPGWPTCSKWTSNDGGQSRCIAFMTSSVLSRGRVGSSRAPGPGGPRQDVRKPRTIAIDVSSAYWLPDRQVLPTRVAGSSRGLGRDAAQGGVMAEEGYTMGEEIIDLVLDRIRKMAVTSCDLVFRASWFAHSLGGGTRFWVRLALVMERLLSDVMAGNCKLTFSIYRSPGYHRLVGEPVTASMLSKQ

SEQ ID NO: 995595 - protein, 290 aa, Homo sapiens
MGRVRGKFVKKAARVIIRSTICDLGKDFHEGTSAAVRSAIAVIRTGTKAPAEEIAGSCHAICMNEFRERTSERYLASELHERGSRATERPSYASVDAVEAWSQGRLMEMWICDEEGKCWKLADFVQLCPGFRLTQHQSWDEISGRLRGPGRKLVSLYVAEVTASINSGDHRNESPKQHEGAVQGGAEAGLVVPSLKPSLGTELDRVMDEPVMGLVEATRKGVRRREGEAEVTAGPAAGNPRALGLAEWDVSSRDGGEGGNETQEGTEGAKDESGERREIKRGGTNQKKGK

SEQ ID NO: 995596 - protein, 377 aa, Homo sapiens
QQDVTRSAKRARACGPRDIAACIGGWQGLGLRGCRSHEALRPSGLGAVMQGPSVGLVEIRLVLPSPAHASMGLGYGMTGSSIQGDVKGAMEAETKTQSDGRAGAVKEVRLVRDVDGMVHGKGADGCSSRDGRAGMAREPLSSPVAQGRASLVRRPDAGTREPSAVTVAEMTQATVFQAWEWTVRHQAGRQAKDARVRVERDKAGHDMDPDVTSEDMRRRVLAFLNTLGWWGCGQKRVCSFTSSTESATLWLPSGIQNHKMNSNGATRSSLGFESGPNPLAWNAYAALYKPWTTDSGNRVRNVNVDEPPDSIRPKIIDPFWKKKRERHQPANTESKLIEKTVVGEDTHDNIVFTEKLLQESSLRTADHIQTGKSNNNQ

SEQ ID NO: 995597 - protein, 493 aa, Homo sapiens
MGWVVVWFFWKRVFSRAFPQAWSVQVAQFFAFPCSPPPSVSFKRFLRAISPPQSNSRGNVTRAARQQPRPTDIIQVGTSYSIETAGVLHSVLCTRGRGLSTKSRVDFSRGESPPRPLQTSPQSVGVGKYTTPGEHAAGAPWGHKTCGGVLHNNQRVIHARPGSARGSYTNCNIRVPSAQVTPQVALSVRALLIQSVDKPCACIPLTREHFVEKTDKTTPRVGEGPAEGPVKKMGSMGGMCAHRNNVIPTVRAILRPPVVSAPRTKQHPPKNDSQVAHASWRRRVWTPRTTIRSQRDPPVGNKTIWRYTNTQRPLPNNSRGGTHITRGDNPLCGTPNPKSDLRHKEGQKRHTAVNIDKGAPHWRPQEIIQRATTGTYTTSETIAPPPSKKRAPQPYYKSFLLKTEGGEQHKPETTHARQPTTEDRNEARHSTQLERTDHNPSGEHEGQHNFCSRDVPPHTEAGSTTTIRLVTPTTPKDTMRETTPNNKRHVRAQ

SEQ ID NO: 995598 - protein, 70 aa, Homo sapiens
PNLFIISVKEVSDCYGTLPLVLRHVDHLVLQVGLVEEFAGDRGERHVESPVEGKGEVGRASAKRPTAQGP

SEQ ID NO: 995599 - protein, 491 aa, Homo sapiens
WFFQNPGNFVLHLVQTRVLHNPQCGRTPKTKKEVGDTGRGRRGARCVRGEHGRGRNGRQRGETGTISPAGHTITTEAQRGWREARVWRNRGEVCAREEARVWAAVKKPAGRSPPRAPRDPRERAAERHICEALVGPPDTQRIIVECGDTKSAVWVWAPPAVSQQERERERNNRGSPEKSVSAKGEKGENKVWGGAEYTRHGHSHSGSLEGPRPPDTHTVPGPSQHPPGAINPMGEEPPNNLHQRVSHQSNPTGGQLYNSLFSPGRKRTEGIKPLEHTSEPLTRDGPPVPAHTRQKNPTRGKSDRENPSRHSTAKGTHKRIKRPPKGKNPEKEEAQEPHTHGPTTRRQDRRNTQQDPPPHNSSTHTRPHTEKGGQFTHPPRKKTAEHSMYPPQSKSPGEQHRENSHGDKTDTENSSREKPPSEATQKPHTQNKTTRRHQNNKQQSIDKTPTKRPHRRKTTTPPPKKKRLAKHTTATQCRRHTTPHQTTSSPT

SEQ ID NO: 995600 - protein, 389 aa, Homo sapiens
MKQRLTNPWPRGLYCVVQISTGGPQPQCRCVSPGAGVWGARTSPSWSSVLGRKILYLCETLCDEGPWVYVVERSRNLWNCETVGLCSLWALGLDSLGAWGLVAFGARATDACGAPCVGKITGAHESHRFSQELVGGWRTWIGARLRLERLVRRCDNPFGGDLCGGVIDLSCVGALLRKGRLVKYASRGPCVATFYVGLVGICGWGPCDDSLSFKGPPLFVGGGASPLGAKRRPMLFSLSKGETLGGGSQHSPFIRERISGNIILGREIEGGHSRCGISQFFSVGGPIFSGRENHGGIRKKRGESGGRTPLGRALLGRPQGSLVGKPQIKKPGGGIPAKRGRPPYSLRRKSNPIGGGPSTHERKLTHGKSEAGEREKQNTGSRKNKTRRE

SEQ ID NO: 995601 - protein, 296 aa, Homo sapiens
MCGACGKKCPGVCCCPDKLVALLYPNPREKTMWDEIPPWGPWGPNKNKWGCFSRGAHYVRLHNGQIYCGGNIKGFIQNTCGISLSKEFFLLQRGETFTILLFKKGQPFFWRRCGELSSPIVDEKRGCSSNKRGGPPYDGGETSSHVGGAYLHNRRKSSCRHIKDHLPVVIYNKSELPDRGCHCCDANRCRGNRITTHPLCKRGATTTRRKYKPSATKSVGTGRNQSVTHTVRSEQSDPEKRNATNTCNTTGRHKQEARTRNNKRVAPHNKLAPPSPQRERPKQRFDKQNCAYQPTR

SEQ ID NO: 995602 - protein, 407 aa, Homo sapiens
MGVDWGQQPWSIFGLTINYFYLFIFSVFSSPAHIGARGESPLIGGEVASLGTRSQYRFSIVFSLRAVSGTKKEAFQACVKGCEVSPLYLHSMPVYSELFSLFLEPNLSELVTSLEDTYSVCLHSGGRLFSPQHRVSITHRGSYNILCGETIFTRGTPAESTPSCSPPQNSSTGRGGDTKNNPRVGELPPPRGALGAWYQYSLLHQLRSLYYPISADKIFSKKLHNKRAARSSVGLGRNQKLAATATYEHIKRAAIFSPPLLRRFPPPVGKRHQHFFPKRDKRTFHGCYLTRGPMAKTYSQCVRTLAISRGVLKKKHPSFQKPSLWFLGGGDAFNHFCVDLSPPPKGFSPPYEKGAETRSGCAPYTKNYDTARGRYTIVRRDNFVINDVNTFWGEPPTCCLPCEQHFV

SEQ ID NO: 995603 - protein, 121 aa, Homo sapiens
MRPELWELDVYVQKSLGAAVIDMVCCLARSTDSNGAFAGGAESGSYRNVESSRALAVGIARLAFGNFRRDPQNVLHPREVEGKHEIAMHCLGLMFLGSSWEDVGDRKRADMRPGPGCLSWR

SEQ ID NO: 995604 - protein, 320 aa, Homo sapiens
EKHPEYAEQNIRKSTTKKRRHPRQAPGLSMQQQQGTDLNGHMRRMVRCTEQVALGAIAITRSSQDLSQVPPGTGQDTQQTEVAPLNEEKTGGLARTGRTNGNGGCRHTSGQEEARRRRAYADPMTARTKDRAQTTRSEEDLTPRTIEVRNTVTGGWNQGSSRATACTPQGKTHGNSHSTPQQRRNQSTTAEHHRTPRTHTAHRGHSTAHEAHSTKLRSKTAKVRTNRHKHRTRTHAARSQQDHHKANKKPKTKKEKNKDNRREKQPTGTTGSMKTKKNRRKETKETTIRKQHKESTPYHHGNLTSDNIDRNKEQTRHKKQ

SEQ ID NO: 995605 - protein, 60 aa, Homo sapiens
MGHREWPHKSTRTQGGRGTGAAQRAQDNTTPGEGSRRCIRMNTTTGGLHRGNPPGETHEN

SEQ ID NO: 995606 - protein, 103 aa, Homo sapiens
MEGRLRSLISGCSVHAGSWTLGSHNGAGESADRLWPTRQELLQRMTGQVVSVQAVKGKPGGSLDQLPSRIASPCAMDSPIMARLEHRVSRLTNLRMQRERANM

SEQ ID NO: 995607 - protein, 76 aa, Homo sapiens
MYPCDAQAGTSTRTCSIESEEVIDKECNTSGSSLSNGREATYGVRGAMHPHDILGSLLACEATGRLGILRHWTIGR

SEQ ID NO: 995608 - protein, 258 aa, Homo sapiens
MHNDGEYRGPPDDPWYTTCEEPKLLMPEGREARRIADGNEDRVRDTPTNRDKPPHRHQNALNQGADCHRDRSDTAHHRGDHSARIGQRRDKATRSKHQEGAHSRAWRKRYHALTPLIALVATTTPRERSNARKRHTQWPKGYTQPAAEALDDRTNIEPAGTTTTAGKRGQKPSGKGPPHTPRRDIEQSKHQQMAQHGTRNGTQHPEKDYGDNTETRQNHAVTLYKRYEGYVRNSMETGRTTRHTERNQERDKRAHPSE

SEQ ID NO: 995609 - protein, 91 aa, Homo sapiens
MPGQCQGRPRTGRNSGGGSEWVTEDQGHPRRGAFKARTEPTRPGETQANRSVSGEKRPTTGGHTRGGTSGQQVPGRPPGETQHRHKRKPET

SEQ ID NO: 995610 - protein, 231 aa, Homo sapiens
GLCPKFYKRVLKSNIQTPKYSCQGKPCNAVGTGWGMAGGSWSSHPSGSGNGGGGAVSHLRGPTMLTWSGRGFYEGQSNQWVVPGQNRIFTLMPSNTLSEQTLWRTDSVNVVVNQGLRCGSSGHPQTFMGLSPLSSEFPRDHNLDSLGPQLSMMNRAHHKQALRNEALLGVCNSKDSAWGNGTQTLYGATFSDIKLYSALVKSQPLLNYRKSVPESGGLFTKNILRIWGARK

SEQ ID NO: 995611 - protein, 381 aa, Homo sapiens
TTSEPHLHQPQPASLPGVGDVFTPRCGVPSRLVAEEEGGPLLKFIAQLLEPSSTMSLAPKKPPTGPYATKYMEPLNEKFDPSGLCPLVRCGGSNGGSNVGLDRWVSDPQGGDHGQGSAACDNTPRFPGGCTARNGSNASKGVMTGKALAYPFQHSASLDLEGGPHKHVTDGHPSTVDRADCQVLHDLSTPATQTKPMRHGQLHQKAVTSPSAAPEGTKEAAPTKYCCTTKACGTLLSEGGSVDGRSQRNTSQCTEENQSRDATNMHHTGRHEQSTEDRGLATGSNTEPQAHRETTGCPSGPQAHVKKAEEGRQRVQEGGQGGGDRRRERRRERTQGLPRRERTGETRREPTTTERENREDRKTRRGENTRGTEAPRERSRG

SEQ ID NO: 995612 - protein, 354 aa, Homo sapiens
MGPKNFIGRVRKKPGGRGTLLLSHSLSTPKRHPSQRDTKKPTKPGGHQRDLGEAKKLVEEDSYAWNPLEKPRAWTEQRAHTTASHTDAENMRECSQRSTRKGKHSRETSSSAPPQNYKPIAKKIVRPPQQQRRIKSHNKQREKISQRALGEYNSGAHTSERGTTTKNSAAPTYAKKKAGHTTKRVDTTIHTKEAADDEASYETKRTPNQARRKEQPVGTAEFTKNYSSTKKKTPLLAKEEGEYRQPPTAHEKIHEGNKHSIATDTPLRRDLQPTLCERQKNTWKDTTQDRESGGTKQGTATSSTHRRGQHNNKKIPNTQAHQQGIAAGEHHTPKKGTNSQNDTRHLDNNETVDI

SEQ ID NO: 995613 - protein, 289 aa, Homo sapiens
GKRQPGAAARKNPGEVSGFRTPGGRLVKSSLEGFLNSHCFAKKKEGDKPRDTHPPQARNQWPAPKALAQPGRKTEERCPRGAPSHWVGRNPGPGASRRSYLDGPINTTREDPQGGRREYAQKGIHKSFHGINVHTYTPKRTAGVKCKPRRKHKAVHQDQRTEVFYKEPRHQRTHKNPQNGNYNAGKPAALKRGGTAPLKRRKLPGEERHAMNRQGEAEAQHTQDTPGNSVEERQHCRSTTKSSSNWLPTDTVRTESPLLHRTLQIRGMRMARRGTTVSQEDPTMAKGNG

SEQ ID NO: 995614 - protein, 339 aa, Homo sapiens
MPQSSRDKKHGGFIPKPQRVTESPPMTRTPSAVCHFTMGSGPPDEASEIDRRCASDISIHCSVFPGQVIHPWWPAAATKLDLGSTGAASQKLLLQLSKAKLNIGKGGSTQFVWTRLEETDQALTEPEAEHLLTDRPSLHLRGKQHTLHRMQLNQTRRGAGNHTQTTATEPGLDPGIEWTRLDTVDRACTLEGITELGGDANSAGNDQMELKHLHCMRNHAEQEEGHDGRSQAKICYGGKAIPTKALTAAQSTGSEVTIQYKDNLITSTNGTGTHRQDEVPLTRDQTGQEAQRQNKRTTEKQRKAQGQREKMDEKDKVKRKQNKKNKKTKTKLHKRTERN

SEQ ID NO: 995615 - protein, 324 aa, Homo sapiens
AQIENIEQEFRIGLKLMLLLEVISGERLAQPKRGKMRVHKISNVNKALDFIASKGVNLVSIVSRNIVDGNVKMTLGGSGPSSCAQAIQDISDGRDFSHGRADPVLSEKDSPYKTCQTIQNFHIRWPDGLGFCCYDPTTPGTSCIDYGDARGRNDPTPPTSDYRHQARAQKKFLDKPPTCWIADRPTRRKCPNDLKTSIHELHVSQPIPSHQLDAHERGKQQPLDICTGGRQHGTRQHTDRIREAAVNGARSPTNRARNRGNTQNAMTTEERKRTDQDRREAAKKARQWKREDKERDHKGTTDKRETGEKKDERTEKRPTKRPQG

SEQ ID NO: 995616 - protein, 359 aa, Homo sapiens
MWGYDSYACPAGEYVLSDQWLLLQYPVTWERQVWAKSTTHGHPVTTPNSQGSQTHHKQHGMYSIQINTYDLQESKVRLTLTIVQTQYGISEDQITQAGQLQAYTWNSSMHNSRTYLQEELTIRRVLHTYHESRIHDLLVFHGPTGHSLKSLDSAHEDAGPAQETNIPNIATEDRHNGPVNYQSPTPHSTQTLDRPTDASKTQTRPPPTARLDGPTHTGHRETTTPPKRTTRPDKHTPKTDTTHTHADADPRATHCPQHGTAHDHHAKPCTTRKSKAKIAGTTADTQSAKHHKRAQSRALNKQKQHNRNRGTEHTKQNYETQVAHTTQERSNENASHKATGRHAKTTRRGEQRTQEHDIP

SEQ ID NO: 995617 - protein, 440 aa, Homo sapiens
DPPLCGRQRWRRGWGHMRKSIRAAGDAAAAADASAAEEDSADRDTASRPRPQRSHRHRPRSQTARSMFSQGEERIKTRQEERKKKRQRKENIKNKQNKQYQNDRYHKTGEINNTTTKYNKNTDIKKHNNNKDTINNQTAETRQDAETKERDTQQEKRARTRQKTQTQTKAGGKQRQKENTRRRSGTSKRPKREPEAGRRAKRGKEQRRAWRAKRSPPTPAKKQKESKTNEPEQTKQEGEDDKKTATRTHTRRTPTEEQTQHERKADRQQTQRHRKERATANKQQRPAHPQTQRAHRDRHRETPQARDDKSAADKTDIRTRNRANHRQTTKNNKRRKTKANKSRQNKKQQNEEKRKEQTEKNNHTKTTTKRTQRPKTKKTRTTGKKRKETRPTRRRRTHNTRHIASHKQKEKPRRAKTQKKKTEKSTNEKREEKDIQETKQ

SEQ ID NO: 995618 - protein, 487 aa, Homo sapiens
LSETSPTPQREAALCAHPSGRHGAGAESAPKSPTNNTQHTYDQAQNTLRGPSDGRRRRGIGPRTSREPTDPGTKQKAPHGSLRTWRPRNQSCDGLIYGTAEGTTVQTSGPSQPGDTLTRATTWQTQEDTRPAIGDDSPPWTKLGSKVASNTPTLNKHTKPHGHQRETQIEAATIGRPPDTITTAQGPTGRAIQHMADIHTNTQTPHKRKRNPRGITQDNTHTPQAAAGNPPTNQRDNEQRRHNKRRQTGDQNRTAAKHRRPRDSTQPQTKRHKKKRTRNKTNEKPNQQTRENNDKTDPDRGEPPRPKTRQPNTGERQTPKQQQRHQENRTRTKTRPRRKASRKEGKRKTQRNAPQRGAKHKHTPNTNEGSDTEGGPTRQETREKRRTPRRKAKRATKEKKPKNDTRREARKQDKQSETKRKSRHKMETERRDTTGGTQERQENKRGRPQREKNKTCEERREEKQQKENERSEEEKTKERRDKGTEKE

SEQ ID NO: 995619 - protein, 208 aa, Homo sapiens
MGTLEKGAKTWGPYREHLGRARRKRERTDTEDPKPGIENNTERTNLGDKKEIREQVTYTHTQGRADIYIKDNPDSRTKEDKREQTIKRRRQVKPPDKKKHNGHQTGLTQETKGYACTPARHPGNHTPGEDKRFQQECDQKGNKIDGHHERARQRHLLTRRQKRRRKINRAQEQENDNKPGQLIQAPEETGAQHQRGDNRGGEKSSKEH

SEQ ID NO: 995620 - protein, 433 aa, Homo sapiens
PQPGPGAASVVAVSGSAVRANGTRERSLLLSAAVSCSPTADCPAPPPRVWSPQRIQLNLELRRPTVFDAGGAISCLSAVQGQQRVFLEGRSTVHERTSRNQDYTWLNYSGSQAIYERMNQDLTDGTLETDDYLAQPRKLCLLAHGEDTRSRSASRPIDTAKLSLQARNSSSTQPRAITKESRTPLINKVINQPEEECTKTTYQTTRAHRHCAPHNHRGHAGRCIRARTGYNYVFRRMREGIGHCSYYGRRKHARWTHSDQIVGHGRRAAYRQYHANPYATRHAPTGRPQLHTTRQAQYTEHNTGTGDRPARTTPAKTREHTRTNNRHRPHHTQTTSTNRTPGQPASQHENKPQHGAARTTRATRRNTHNTQAAERQTGGRNASRPEARTQNSTEHRRRAAKHGGPDRTPTRHTRAKPMTKDATPRQGSHTATR

SEQ ID NO: 995621 - protein, 349 aa, Homo sapiens
MRFESRGRSLCGPMLNDAINAILAHQAAGGSDPIDQLQAVPVINVGGTQSVLRMTLQVRSSSRLLRVALVADGRQDASPSMMVLVRLRPRASIRMQSRPGQSVGGWTGQGGSILWDNNAVLPGEVLGRDRRHRCARTGSHALLIIGGFEAYLGLLELSAAREKHEEFLCPHGHGSALLCATNVPGSDCSIGADHALNSILETATHQAVLQRNKRRVSIIRDMGGYCGYLANHWGRSGRKMVRIPFDEPSTSGILAPHVADPVRGYTAGGPIPKGLCPRRNLPGHNRQRVYNSVLTQAPAYAHPEQLSKRGGTSRDTGTSPQGQQEAREKLIGSRTGGSLQIRRCSQESQ

SEQ ID NO: 995622 - protein, 180 aa, Homo sapiens
MANEMRTPAQATAPGNYRRYYTTRDMDLRHTDTRTRTSTGRTSTPPITIGTDSLATHLHTHYQHPSHIGQETHTAHHARLTPNNHNNRRTHTQNSRTTHHAHKARTTKTGTTTQKEPDNKRQHTQQTPTKTSTATEAKTRIHRHTHSRQRRYNTETHTNSNRENTYIHERRRAKKRRNNE

SEQ ID NO: 995623 - protein, 198 aa, Homo sapiens
AALPCSPQWFGRGDPLRRRVPELGTAQPVSPEARRPRPAPQSVEPAAPLVAAESPPLGFARMVRPAVPPVTSSQRTRRSTPIRESPRKTITTDHYWMRSQYMIRTHETRQTPPYGTEDLTATNSEEPDRTPYQMKKVIEYLKSNESQLDPPNKHQGYNIGESGPLSRHNGITLTSLLSSSDGAQPSVKRITQQKPLTH

SEQ ID NO: 995624 - protein, 318 aa, Homo sapiens
MSENLDNEGPKPMDELLARRCSSALSCPIRLQVPPADPGQPWTEVEKAGRCGARYTRPAASAPRLYQLPSADDLFTSEIFKLELPNVASTTPTVQRIVRALTWAGWVWQTHKTKHLSGPSTLAPYCRHFPRRIAAEGQRALRQYCMVHLLERADHSSVSLAWSKRRNPWHQEGRRTTRKACRSEANKVIPNGPNVCAPLLLDSGPMPDPLYRQSHRRANQVLAQLAPRTPAGQPAAAGPAGRTRRQTDNTGRIALKRPKRTPEEPLTQSHRTIDVHRQLGAPQDDNTQTAHKEPTDTALKDSTAHATKRTTTHTNTRN

SEQ ID NO: 995625 - protein, 548 aa, Homo sapiens
AVANGLFRALNGGGVDMQHHCGAHSRRVDAAAPKPAGRNNHSQETALWPPRGPRVQGPNEDTARRVPAGPRPRLGSQGVYTTIAVGHIEVEDGGDTPQILRGVYPQVCATGRPTRGGHMWGHHKSWHASGHSTRSVHTKAISTQDYVCSSTSHGASCVECVAPRVYEASGHSEMWTPTLLPQKRGANHTCGDLKSEPRFSTTKHSTIQHRTTAQGNRNEATHREKSPGRTDTATPPSQDGGGNTRRGEATFTKEGDKTAQETINTAHPTHRPHTSGGTRRRTEPARVTEQEKPGAVAKKRATQPRQSHKHRIAAHYSEKDDHADSKRRQSPTSLEERHAYGQHSSNYQETDRTWAAARLDPTWHDPERKTPKHKTNLSEQTTVRRITQQQRTTKQENVYDETHTNYPRREVNTRHTPVGAKKTATCTEQQSRPGTHQNNRVEDRRRAGHQTSDHRGEDTHHTNDRRSRSTKMSNGRRTRDQPNTQPTPANHANERDIITTRGRSQAFPQQQNNRTRPRGPMRPRRDHTKNGDQATKQNEPRHYRLHIT

SEQ ID NO: 995626 - protein, 253 aa, Homo sapiens
WVLVGLVVYFSFFFLGFLKNQETRVRAKTKDKGRGGGRCGACGHQGRRPGSAQPQTPSVGDKTRGSLVWGAILPGDTRAHERSLWDDKQGEKGALAVGVTTSPVKEEEEESHPLKSDERPPQQTMWAPKEKHSHRAANRAHKVRGPLSAKAELARESAHQKESAPLEETTKETTTPHRGARSDKREKTPHGDHIRAKEKHTGARNDTLRENKPPSVEHPPHNVSTKHNGTHHPTYKPNISTKPEKSETRPERA

SEQ ID NO: 995627 - protein, 330 aa, Homo sapiens
SSAPSTSAALSCPGPSPAAAAHLEGGSKGRGAEGEPDRRTQTEAGEWVVVTPAATTDTTRAAGLPPTPTRKQPREGNAGATTRTQERHEQQQAERQQHQSGTHPHWRRTTGHQHDTARHNHTTATSDTREHAKQATGSDHAAGNTGDRSEREEETPRQPPHTAGRDTSDREPWGAAPRHADQNKRLSYRRRATRREATGANASPNRARHAQQTHGLAPRCTTQSIQTHTDHRKAENDETQNRKRSKTKHKRSKTKLNKQIRASNKTHREEDRTGDAPRDTDHHRHGEACTAQNTRQTKRQNSRTATSGRHDKTDTAAAACTANAANTTER

SEQ ID NO: 995628 - protein, 184 aa, Homo sapiens
MEMATRAQKKRQKQKHQDNNRQTQKSKQTSSNKQVATRDKCTPVAHKHNNTPTHKREEAQQEKRPQRREKKTKEEEKKPKERKKRHRTRKDTRKRTTHNNNAKKENQNEDGEAARKREEEEARNGTSNNEDATQHNNKADTTPHEANTTREKTSRKRRRKTKKDQTATHENRNHDTKKSKKHAA

SEQ ID NO: 995629 - protein, 497 aa, Homo sapiens
LVCETKKVFIRAPTMCQALNKQVFIRAPTMCQALTQTKYLLQRLTMCQALFIEPPPRRKNDKNQDRGSKHQHLRERQTGAVGSKTRIKGQLEQALQVHRRASRPYRPTLLTSLLHRTIPYLLLSRRDAPSHGKNMAEYSRQTRTRQTPIDRLHHGTSGEKPSQITDHQMHQTEHREITTEGERTGPHGTGAGTTTRSTESNLAYRTDLDSHRTTTDLPEDKRLEAHKRPTMRPGSHIAQYSEGHPPQKDEGTRPADTGPWTSGNKSRSGRRYPQRYTTKTKAKSKTTSATNDTRYNDLEDPDRTPTKTKEPNSRTDRNKNHDDPTTESTIRNPCARQEQPRGTHEPDLPSGQSQQPGTPAPTRPPRKQTRNTSTDNTDRGVKTEHTQQNSDTHTSRPRPPTASHTTQRQQDKSQTNRTRRCNTTRVRNNVHHTSRAKNKQKRQEKRSTTQQNDTTQNSVANNETEKKPTQTAQEQTENTTKQQTHATCPRDPNTPTT

SEQ ID NO: 995630 - protein, 655 aa, Homo sapiens
MEMCTTDSFMSCGTGRPLTAEQELVLDNSSARTEGNTRRPSQMNSRTQPGNFSNATTQPLRALTVNSAQTLRKALHTTHSNAKPLTLTPHYTTQLLHRQALRKRYFAPANSLLTDTHTPPLIQHFHTLAPPDTHSHTHPSSRTHLADPPWHTDQAVYTHTKPRPYSHARSQQQRSLCKTSRAESASTPYTPLYSPERLTAASEHAHVAWILQTDAAPTRRPNTLPTNLRRSARPTPNFEPPARETDPTPGTAAPTLEPSRRNTHQDTRALPPLHKRATLRRNSELRTADRRPPTCDTHDNRIHATKHTPPRSHTTTHHPQRALHSPHTHTAKRNTHPPAHPHHRTHIPHQHANNTGHGTHLTTTGTPTATRPPTHQHTHNKPDHTAPRPTPNPPTRTPTTHAHTPLRQPEQPRSPEPHQHSTHTYQTPQTHAHSHTHAPPGTTHVTPAHSTHHTTQAKKEANQHATRNPHAHTPTPTSSTDQADQPDNPSTPTTTPNTTDTTHPSTTAEERHESAGGTKNQQANTHPDASDQADQQQRQAPHTSTETTSKQTDGEHDSDPPRMPTKTPVRAISDHNAHTTTPPTITQHRYLVPRPHDRNRSTEQTPTPGYSRRREAAQRQRPQSQGTTARNRLSTTHEHTAKPHRTHPRRTHSAA

SEQ ID NO: 995631 - protein, 264 aa, Homo sapiens
MREGKQRDPQQKRQGETPNPPRGTEQKSPREESNAQNQGEQHKTYKRHNRDTQPLTKNNHKAKSQDKQNKKTRHPDKKQNKTKNPPTRDHNREQDKTENTATNNTRNTPKQEMNKTPSDGTITPRETPANTGHQPHQHRRETEHPRGATKRTTGHQPPRGQRRAKGRPRHTGPLQTASPQTTKQTGRNTQEESQKTITTKSAKRQTEKLYSRRRAEKNKRKQEAAQRKYEKQSQNAHTKGHKETGEGPMHKRTEHTGRPAPSMP

SEQ ID NO: 995632 - protein, 419 aa, Homo sapiens
MVPAPHIGPRTMSSISWTDKDPGGGEGEGRDLKRGWHSSTRRPGPDGGRPSPSPPGPSRRHTGDTGAPGRWSAAGRHGAQHRRAEHTTRAGRIRTRRSRRAAPPRILAQNRRGATAVATKTAATSVQTGEAGSERAHRNLELPGAPRVSTPKEEVPRGGGIARGEDLKRQIWQGDRSSGEKGKPRYRSSEKAARGAHDAGGNTPRETLRHLKQGEETDPKGGTPPVSKGHKHEPHATREERVDDTQGSPRKHPRTTLRHTKKVQETHRNTTEITQPPQEGGIRGPEKPHRRRSRKHDKGAREDTLRRAKHQLETPGSPSERTITKTTTDEDRQHNVGGPGQRPIRKAWDIQRSKRCSDTETRSTETPEEQTSTEYTTNVQNTPRGNTEQQEETDDAHNEKRATHDEAHTSRGSATQGKE

SEQ ID NO: 995633 - protein, 450 aa, Homo sapiens
GSKGASILVGLVRTRRGVGVRGGGEGELQREQHQEGSIGPSHRPSSGRGPVALNGGSVCAALNAPWKCGSQKCWVPREPPEMVSRKRGRPIFSPTGDHPSGTVPPRRKQGHLTQRDRCGQGVGTKYETRAVHHSLTSRVADSTTSAFPTGHTTLRGGPNAHRTGPSRPPRRRRAISGAAQRGLTLSNIAAARNTHPPLVHRSELTHPPRDQRPVAPHTTQQRRRGINHPTLGALHHSRGTPPREPPPHTGPPWRGPPPPTNPKRSPGPAQRTPLEACTTTNKEVAPNTRAQHFGRAHYHPPPRPHPPPHTIDTESSPRAKPNPNTAATLSHESTTQHPPTTHPNRDPLPTQGRNPPDTAHNRETSDNTPPPSEDHQPGATAATQPPHQHRPPKRTQQHEKVSGAPFENAPRRHSGNPTIHHADEPPPALPTSSHAPSHQPTPAAHTRGHL

SEQ ID NO: 995634 - protein, 329 aa, Homo sapiens
GYYGSLTQAGTVSLGLDAEGQEVFVALQRGAAHGGAQRARVRWLGHLVAERWSEVMTAAPRGCWKLGAAYGATVSLHRWKALSGPGLLFDIPEFIAVNQRRARGVSSSPGSRAQQLEQIRRGHPRLPVKRGAGPKSYVLWTGEHRTLLAVESEISMGLMDHMAEKLGAYTLETRVREVSALQLFAGGHDTPWMGLWLPQVGSPQNTLVPGALEPRVTAPGFLLGGDDFNVRARTRVHDRASGLPHGSGRTEAMSIGEYTTTGTPALGKNLLDHNAGPLKEGPTTTAGWRNMFAEHPKPNKHGKSCTPGGHSLARRVVKTPERTSRIRGH

SEQ ID NO: 995635 - protein, 416 aa, Homo sapiens
VCSWAFYFKIGEQKTEKKKKSREAPGGLGLEEREEDPENRGPRVVILGPAQTRDVLGGDLRHPGEQRGVLGGTKIAWVSGPIRVSRGDVCAETQHWGGAQEDHKTPPVWASLYYARISARSLRGESVTLGRGRGRRCALALCDTDRWLTRVYSGERILGERTTRSGPVLYTQRGEKTNCTTCGGGTPGKFHPKQRGNFFPLSKTSSYLWEKARERGIQLSKGPPIFTQRLGESRWENDVTTGEHIGEPSETSRRIANLGRQKNTMEPKSREVCHGEFPQKEFITRDTRRATTLPFTTGGAAPQPPKNWELHTTRERIHAGRSNHNHTPARETFTTPHKRSLCRRQSQIAITPSATQTYRGVMEHHTHIPRGDKGEITNPKQVARRGGKEHNQREYPEDTPQPFYGEGTHDRTNKTS

SEQ ID NO: 995636 - protein, 256 aa, Homo sapiens
GERTSLEYIFLIFGGLQQNFITKTREAGTLGPQTVNLPITTLKDNSDDREANEGAGGPVRDLVVRSGNHLKGSPGSRRGINTPGRNTGTCAGTVRDQQVADTQRRKHAEGVLREIRREPSLISNTNGFNSRSGPTPSASESNTVAPVGGTDPYGAPRRSLRYEGHDPPDPSHGWVAQWIASIRESKAIFHPVPFQGNPHRVIDSINTIYLATLARTSPLLGVERQGLAPLRALAGLLTRFAVCYLAPDTSCLSLDN

SEQ ID NO: 995637 - protein, 522 aa, Homo sapiens
SKWSLTLSYSGLGCGRGVWIWVFIGEPLVFLGVQGEIPPGLKASQMYAGVLQGSVATKAQANFCVFFKDEEDGGFHHILGQGLGSSNSPVTCVVDSHPPLSTVERARGPGKITLRGYREFRENHISVAQPIVCEKSPISSNLKIYPKYVAAGAMRWRRWRLCNIPQKKKHNNTKHSPRGGYLSMWRGGARRDNRAGVYGDKVGAHMWGTQNRVVSLVRAHRFFLLCVHPNRGAQRNLSRARGYLPPNNIREGRRARKIIKSLREKINRPRRVEPHRAHFNDCRLVSVRDEDNTTPTNEQNNSTKAATGYNKQRPQRHNTQHEQNEQEGHNKHKHTQPKTHTKTKQQTKHETNNDRKRQTTTAQHTLQKPEYNYSHTTHTTTTHQKQHNNHEYSNQTYNSPIKTTKKQKQKKRRTSEADAYQRQRVTIKDALDNEEQRSCGSGGSERNRVQARYQYTWKKRREQQSGEERRDKAEKPELKTQEEVDEDGAGGESDRKQHDGSIWMRREHTDKDGREQGVKKGS

SEQ ID NO: 995638 - protein, 208 aa, Homo sapiens
MSKAASPQKGDLVSSTSAFPINKRVQNRGFTISRGGGITSPVSLYKGARRLPGVLCSPKTINVFCRPMVGVDHKYPLCVVDDGSTTHMYISAGISPLLPHCCGHPHICFTTVCAPATKEKLLLNRYCGQKVETRLAYLVVAPPSERVTEGVQHRTLDIGKKGARLRRRHKPRGTPWEEPVVRAPDKCAPGATGSASRGRDTETVAWRS

SEQ ID NO: 995639 - protein, 347 aa, Homo sapiens
VLVQNFIKGVFEKSNIPKPPEIYSCAKENPVKCVVGDVAVGHVDRAASWLSHPFVSVRSGGWVGRNPHSCGGLSTQCASRVVHAQGASYSGQLYYQLGLPGAESDSFTLVVPRNNRGVCEPQQRVGPQKSVLTAIDSYNQVVSDVVEIQSRAIQQISRGNLRPSVVLRKFFPRKTNETSRKAFAVPPNFSPCGLKPEDNNHMARGPLRTTEHASYGRGLVNAQRGLLGLGGQWRTKEDSHHVAHHSFFPALSKGFLNTVPLLGKRAKHFFSWDLNRTSIKFPGNPGGTFLPPEDNHSSRWQRRGGATESNENYRGPRDTGVVTLRQPSNFPERIKRTFFKPRGSPKV

SEQ ID NO: 995640 - protein, 125 aa, Homo sapiens
MGRLVCSGTVAGAVILGGVTRLTRVCASRWKMGFNKGDEASYKPGGMGSRIRQIYQQVSKKFINLELMIWHCTEFTFIVVHGVLNTECGVRLVGLVYILLLTTLGEMGWLRPWHEQDVCLPLWLV

SEQ ID NO: 995641 - protein, 228 aa, Homo sapiens
AAEKQVPGGGGGRLAVCWWAVAVAVVVAAVDVVPEGKTNKENERLLAERIEGITTEFGDSLQFGRFFMIELRMSSAAKHGLLAWRFVRGYRGYVFPYDKDVFERTSLTSRWVTDHKIQREEEVTEELLTDNRYLVLVLMDAEGAWSYAMQLKQWTAKLNPENGFILLSRLRKAVKHAEEWNACVRATRVDGKTRLEAQAYTAYLSGLLRFETSRMESCIEVQTSAKYL

SEQ ID NO: 995642 - protein, 193 aa, Homo sapiens
MTVQTDRPTEKDEGRTKEASRTHQGATTTNNNTTRHSHIHKIPHEKEEERTRRTRQDERITTKQGKNNTNTTRRKRGELKHKHDETHTKSTQQDRTRDGEEKRTQYDARTTIRAQRRATQRTTRKTNELTNKTPTTKSSTEEIADKEQHKREDDNHSRKKRRINNKRTQEEKTFSRTHHKVVEITEREERMKG

SEQ ID NO: 995643 - protein, 456 aa, Homo sapiens
MAGGVHHALPMDHPKQETLQTRGTLHPLFQAQAMPRLIHWYTSYNDVIPFLPARVQKTFPSTYHMHLAHTQAGGALNPLLRTGIDDSPLRQIITRKRRGPSHWTGPKAHARTQLDRTKLTADIPRGHNQFNLTPSTDAYTLVGPKGPRHTIENTELTSPLTISSRTQLQRRLSEPDATGDTKARASQPAASLVSTHNDYWAFDCIITGTTAHGTPHRLLTAVAHTARPRGRRDRHNCTRLGRHTQSRRDNNNMNKADRPALTSNTQGMTRKRRHTTKRKQGATLDTHHMHRRNAHTPRTRPQENETEHHNTTKATGAKYAHTQAHTKSGRHTGHYTVAAHNTAKQPGRIRYDKSPTEDPTEPTIRAAPTAHDAQPPPRTTPTTKGGTNRHTQLRKQNKARNEIDHTNPIVRSAPGSTQHSTKQLTKLLAQRPSKRQATGNTWHTARGRPTTEADST

SEQ ID NO: 995644 - protein, 223 aa, Homo sapiens
MSIHPVTKGLYSVLHHTQQIPYILALRPGHIQPYRKGKHNHKITTDNTEGGTHQPHTPATHTAPSALTANIHPHELASTLLAQTSFSLRPTRQDQKQQTWRYTNHTHTRYHTENIDTTATNNLKPPGNTIQIQQQTQRTHTAPLTRTSPGPTGAEHHHPGTRAPHNNHDTDEHTGRTLHAEHHHAPLEIQQRYMTRKHHNHTTPTNQPTTHRPMTPPKNRAPT

SEQ ID NO: 995645 - protein, 199 aa, Homo sapiens
MSRQSSWQRLPLLPHSNHPQPLAPHRSDYYHSTYSAPHLQPLPTAPPRANPDLPHTRRTTPRLEHTRTRLTRTQRYPRPARPATPPSHPTHTPPTPRTHNHPRPPTKLNPQPPPPPPPHPPGNPIPTKQTRHPTPATPPATPPPSPPPPPPTPQPTPPTLKHTATQHPAADTPTPPTLAPTPPLPPHHAQHPPRPAPTT

SEQ ID NO: 995646 - protein, 365 aa, Homo sapiens
MRCRWLVMSVAAREQAAAARKWYRVDQFGRRIRIEDGVDELNGGCAWSRKPKMCSFLAVVGTSEVVYKRYARPANLLLRPSRVKTMSSSDWSCSTDNVELCSTEYCGQMLCELDVIFNFEKAYFILAMSPGWGGDVQDTSTFPILPLKVGEARRQEDVNQMRGCYKAVIVRCAMGELMFHQMSLRSLITVNIQTCQVTRETVSGGFLSALSITSSKLTPKAARVSLLPGKGGRLEPHYTPWAALGPYPVHGRNNIVISHQPGNFDGRQAGRTSTTYGTRGLARAHKPALRTKTSRARTAPRTVRKRPHSTRETLESTTNPDTPAGQEHTHNRQPNKYTATGINRTTPRTQRTATTRPTPPPYHNC

SEQ ID NO: 995647 - protein, 434 aa, Homo sapiens
GIQDTAIYSSLGLPLHLLENKQEQRTTSNSTAPPPLLHSWTAVMSLTTSSYLTLFYPCVWSDSCTDPAPATSPEQMLQPARKILETSSRKTHCSNEVPLSLFLCSLARRQGSNPQPTIPNAGPSLLNKTPHTPLRNLPRKELPHLTPDTPTLLLAALACRLTHNPTPAPGTTAALEHSLVLQHPTCSPPPPHRAEHQNTPHPYPTTSPRRRSHQGSQSGTNTQPSPNATAPCPHHARTPNAAPSHDTTPHLTTRYLPYTQPPPPLRLAQTNPPPNTTHPQRTRTARCTHAPTTTPPRQATNPPDTTQHQHPDPPPQPHSPHNNAHTNPNHTPTPHPPATRRTAPTTAPPKGPSIPHPATTRPPTRQKDPHQTTRPHRTPTPARTADTDKPPHRTNAPHPTATHTGRRPAPHAPPTQPCRTHARLGSTRPPAPTP

SEQ ID NO: 995648 - protein, 322 aa, Homo sapiens
KPLFCQEFLGNRFQQFRLLPMGSQKGGLFGVEQVGALFDPKGTYSTIEFLFTIMSGSISPIHTFQEKLISGSKDGLNCWLNTHINPLAKRILALKLVWCQTTFGQQRWCGNIGQHSSSLAIGTHWGGQSPFGTRTPSPLRVVQKYTLSKRSAIILWPRETPHVSKRAKNQYYGGRLPSFPLGCYDNGRTYLGQMAERLRALAQMVKRGNQHFAGIQQRAVKHNHSVEEACPTHCVAYWAHVLVPRWFSPVSEFLYTLRTLGTKDSLVKVRCSIADDMGAPVVWESDNKLTADTSSRNAAELWCAPDELFPKKKAAIRTNVSL

SEQ ID NO: 995649 - protein, 206 aa, Homo sapiens
MESVWDKSAQFSRVVSIFVIYSLYTIYQVCDKGVRQLAALYVTRRHTKIQQGPHTKSATWCYTRGQNEAASTTNTAQLKTTHNKHNMRTREPCEPSGQHNPHGKVHTTRTKRSRQKSAQHLNPAPRTQTWGRQNTQEGEPTTSINSNTRSGHQQNNSEGSTTASPHTGCTTRNKRKVRPHTLHNTGGETIHTNIAQHPSNTQHPPG

SEQ ID NO: 995650 - protein, 68 aa, Homo sapiens
MPYANKRTTVSTTTTARQTSYRVTTERTTDNGYRRTQPNRADHRPIHTKEKTDTAHDNTLTPQTHANK

SEQ ID NO: 995651 - protein, 243 aa, Homo sapiens
MGFGATLAVGLSHLLCLSGQSLLIILLHLLLLLPFNDCAADHVRFVTTQQIQPLMVHCPVILSAPSVPDQATLDQSYQVLTSTNAAVSAGIAMHAPKPMQIPNTALRQLQAHGPNRPYARRTWVDGRTPQPLPPSSHDILTNPALHWIAPKGRALLTQFPLGLLWACQRWETVGGGVAVRLVGATGSRDTLTDPIVACWCRVPGTTGFHSTSPIVDAVDDGPGHETYWGGIPRRVTALATPVG

SEQ ID NO: 995652 - protein, 204 aa, Homo sapiens
MGSQARCHESMLAILRAHCELGTQSSRCARIYEEWQASFPGRRICAGHIFVFQRPAMAESALRGTEAVAGQAASPYLATSFRLAPLRGGHVNANNQSLYTLTNKIGDPHNRSLQALAILMTLPQCTPLSPCVWQQIAVWGRSPTPNEAHEIPGKRLPGTPPWHRATQPRNLRYALPLGTLPTRHPRNSTRSNDTPGGTGLQQTQ

SEQ ID NO: 995653 - protein, 80 aa, Homo sapiens
MPLSYITPHRRTIYHGGSKKGHQQKKGGAPNKGRISEKQFLKVPFGTEAQGKVINGPTHFKNWGKHTDSYLAITKNYKRM

SEQ ID NO: 995654 - protein, 485 aa, Homo sapiens
ERTSLEFFCWFFFLANPTAEENRCYYLAMWFNPTGVSSTLPLDGNALWAAFSFVSRVVQTGVLKDAPRNNFPVPREPRGRRTEVLGSHRGVSVLLSRDNLSPRVLVCVSGVGDFHNAHITWPCGVARSPLSMWEKKFVNNREHTFISYKAIYGAPVASLVLHVATMCVAPKPTKVWVSPPPSLHPSCPPVPHRNRGSVPLRPCVPTRPVFAACLAAPHRLATRRGASAPYLRVADPPMLAPAALCAGLPTDNCRAHNTRTPTTPHPSSPQAAPGASWRRAPHPPQQKRFREPCGGTTNSHKPHPHDLAFPLSCSSPSSGSNDTRRCSRPPQLYRTLATALLPSRTLLCGGPPYAPVRGFPPFGGIPRGMYPFAAPLPPSAHQPADLAHTSTFHTNFISTSPHPYPLSPTTPDPPTQSNNNTTRDTSFKRHHAQPTGSHHNAPSAPNPSPHPPPLCVPPALNFRAAPTRDHQHISHPRSRIYTPPR

SEQ ID NO: 995655 - protein, 332 aa, Homo sapiens
EEEEDEEGLGPPGPASLGTTALFLPYKAQPCPMAFLRCCGSQGCLGGQERAGAWPCPSREGGATLGPAAAAVLYHGDWTYEEQFKQLYELDGDPKRKEFLDDLFSFMQKLRDSLEAASPSWANQVLDLFMLYVLVTEKGGLVEVINKKLWLEITKGLKLPTSITSAAFTLWTQYMKYLYPYECEKRGLSNPNELQAAIDSNRREGPAPELWWLLFAYSPGGAHGMLSSAKLPCLPGPGRSTKRVHHAALDQKEETQHPIKVLALAVSLAGHLLLGSPGAIVQAACGQQCGLQAVAWTTARTLSWKLSRKKAVAEHTLEHITQIGGPSPNRQH

SEQ ID NO: 995656 - protein, 171 aa, Homo sapiens
PKKQTCIFLNLKNIYGRTPKRNLGDIGYPHIGGFFWAMSENAPPLSLVRSMATSALHASPIFLYGGVLRKRPYWVLGGVHRELYHAAGVVWRKKFAWHVAPSLLRRNINGLAIMGEQPPSRGLCAGNAARVSENQISETHSLSKQWINIPLTITMRLLPLFIIVSLTISLQ

SEQ ID NO: 995657 - protein, 194 aa, Homo sapiens
GETFSFFFLGGLVFVQNFIKGSLEKQLFQNLQKLPAVPRNTRVYAGGDVAWGMWQAASVAFPPFRVRECGVVGRYLILVGFHKCLTCGSGRGLSIGPIFTRWGLPGPACDSFTCKCPENPCVVKQPGVCRNSSCLKAIQIVNTQGLFRRGGSHFRGPFQKTFSGFYSPLISPRRFFPKKPTNLLQPFWAPQFFH

SEQ ID NO: 995658 - protein, 564 aa, Homo sapiens
SEAWVEQAPVPPPTSLRRVRDSLVAVRVAPRYAMSGRAQQQVPRREGVRLAQSPARQQAGWPQINRELLLCTSTVTVMHRRTFQTTAHQPSKEQVHGVRTCNNARRSIAPACSFNSRHAWRKLACTPSTQPGSMTASMHLQQVHQRRAVQPQQSINPHPAALTAATHESPEPSNNRDRAWPLPRYRSHRNVSTAHHRPNAATKTRDTEKRPRNGEHTTLHDGMHRQADQLDSHTEATDANENTTRRPIKRTHTSPNTTLHTRKQQPPPPTYHIRQTDHRQETHHSTRTNRPQESKTTHNNTHLTTTTTAPKTDNDKTQADQEQIDRTTTHTRHTHATSTHARPTPTHATPTHTQERAHQDSTKPNNTRHTQLNVITRTPTATSSQQHESDNHTRRKTPHATARQHNLTMLANISQRTRTAKRARTVLNRATWTCHPISTTNSYTTYVDTQKHQTNKSKLHNGNKLHTYTNNEKDMTLTYYNIPQTTINKTTLIHAQTNYKQSHTEQQHHRPNQNNINNSHAHSTTNLHQYTEHQQTYRPEHTADERNYKQRSDPTLTSTTHTSR

SEQ ID NO: 995659 - protein, 122 aa, Homo sapiens
GFPDLGLRLTVFGGCTPCHHVFRSCDRRCACVGGFDRASARGLPSVPPRQDLHFVCRRREKLGTHVELGRWGLYLSVLSCEPFLPVPGGRESVFTTWEEPYEGGPEVERGSVLAPFNSVVDL

SEQ ID NO: 995660 - protein, 253 aa, Homo sapiens
HRNSARVPSASRRLPVSMEEEIAALVMTMAPACANARFEWGADAPPSRVSFPIRSGRPRDTRRHGGHGPEGLHTWATEAQSKRGILTLKYPIEHGIVSNWDDMEKIWITPSTTELRVALEELSQMLLTEEPPEPQGQQREDDSGLCLRPSKPGNVRGSSRPVLSLYASGRTTGIVMDSGDWGHPSTVPIYEGLLPSPTPSCVWTWLAGTDLNLMKILTERRVQFTTTCEREIVRDIKEESCATSPGLRAGDGN

SEQ ID NO: 995661 - protein, 245 aa, Homo sapiens
AENVDITAEGTRMVICEWAPRREAAGRGTSESAVNAEEPQASVVWEETEKTQQAPGCDKMRLGVHSTRNLAYSRELLLIGRVVAWSTRVNGVVNHVARVTGLIKDLMCLAWYSTQRVPTDRFGLSNADGKWGASFLLVWNIVRGKMDTNCEFGTKIVNEYADEGRFSGQLHDNAKELDWVSRWAKFSAFEMIPKRNVIELVTLPVLAEGDESWDPYGRRSLDMCQRECATERGSFALCEGDNGPN

SEQ ID NO: 995662 - protein, 329 aa, Homo sapiens
GEARSRCGGWCDPGPEGIRRRLISSGLHHPDRGISSGLHHPDRGISSGLHHPDRGISSGLHHPDRGISSGLHHPDRGPGAHRDSQRKWRRLRRVAARTRAGLELGWDPELGSSRSGPAHLLVPWRLLSPGAPGPTRNDGARCEPPLMAAPAGSLSRKKRLELDDNLDTERPVQKRARSGPSPEGPPAVALSPPMLQIVQLLWHCSRLGPMSPGAEGGRVGYQAWTALKGTGVYLCKVYPVQGSLTRLEAYWRGGPDKHVGRPIEVWWDQSSKAYHRPWGIGSLWERPIPEQRWRAREPLTAKTVRLEHTMFTQSGHRLQRRRGRNTKEE

SEQ ID NO: 995663 - protein, 173 aa, Homo sapiens
ESEHRELAGSPSASEGADVGLSTGCSRALSRPLQSRMPRGRGARCAATRASPSAVMAGDGVAAVADATRMGAVRKNTTGRRPRECMCESFDQQQGRHGSDCELIADGHSLDCVAEILPLHFEICAEDQHSRISGTGILAIFDKLHMPNTDVHRIIAQGTAAVSEDFPRIRSSF

SEQ ID NO: 995664 - protein, 395 aa, Homo sapiens
HRFPPVFWGGLVSGKNPKRGGRGALFPSWKIGCSPPLKSEKGVGAGRPCGVWGARFPPSLSFWRGSPFLFFSSQQKFPNKTPTKNTKQTNKSKYQPLPQGGPLAHKLLSPHSPQRLGHRGLAEEGAGGGHSPLRKKPPHRGPTRGKRSGQGPQKRGGRCPTIFHIKIHTYNNTRAGGERKRATLRASETRGAPFLFSQNRRGKKWRARGRKCGGAQIPPKRRPPQREGRSKTNRGGRATKKHPPLSAPTRSIMPQTRGGQHNIRRGMGSHTKSPPQRRERKPPSKPTANTATAPKTRTASQSTPPTFPQKHCQPGDQREIGTRRNTQTRGEHSTHVCGKPQIISVPPPAKTNDGRANNTRITTSHLAHTVPRAPSWYKREKPPHPISGKIESRRT

SEQ ID NO: 995665 - protein, 315 aa, Homo sapiens
MWARGPLGEWATPASRGGAPSDGTSPWRKDPKFLTSLPLENTHLFERVSVLTENSSVAPHLENSQSEGRPSWWERATRVVSRELWRACHTQHRDRGRPRESGALVLAPTKTPTLPKEQRRDETSYTGGQWPLRGPHCVGRKTPGAQGPLGGGSEGTNRERGRTQWVLRHCAPELLHPRGPTARGGLRASRRQEGKNPQETPVKNVGPQQERTERPPTQGKASPRRHHQHGGTGVANTGQKKEPTLPTGCPPRQLNGANKPRERSQLLYPQRLWRGGAEGKKTQGAGDNRIIDMAPMAPQVVPETRVFSRHRETTS

SEQ ID NO: 995666 - protein, 112 aa, Homo sapiens
MGVRKELTVVVRDWWPMECMLLPGDKLVWPVCVCAGFQWARCMRRGALKVNSRRGHVDPTGSSGSSEETGTTLVHPCGNLREPKLGKQGGTQAYNEKETSLLGFSFGVCVVC

SEQ ID NO: 995667 - protein, 248 aa, Homo sapiens
MSVRQVDRLVRIPACGSTLYIRHDRAVPSNNWNWFLVGANKPRMGGHMAMCTNFCTLLNPNILYPMRGPFNLKFAQGAKVLKKDANALFRLSIPGSSPEEWHTGALCAIPHLRLELLRSPKDFFHSSKEEDPSNCESVCNSNFTFRYGHWGHICSSYGARRNFRDGCGPIYPPNLFPKGVMGFHNDVWPLTTLSFLWEIPRIPFGISLPTVGTTFRQFSSSELVPTPRPTQCSKRATDKGITKVITPV

SEQ ID NO: 995668 - protein, 168 aa, Homo sapiens
ESGDDVQKWHLAKGKEEEGRTGHQRSDRRWLKERMELWCLHNIFASFNDTFVHTVTDLAGKESICRVTGGMKVKETDDESSTICVHMWACPRMWPRGARELGYAPTYTSNSGPQEEIGARPAEPGDPVGPSEALARSGYEESGRTEEVHPHAPLTVLAGRGVAVVAVW

SEQ ID NO: 995669 - protein, 72 aa, Homo sapiens
LNVLPQRRVDEEEKEAVAAINEVVTREYYRSTIQQDASMEVGFKKRAPRALIDEIRNIWPTEVRWELQHVRI

SEQ ID NO: 995670 - protein, 97 aa, Homo sapiens
YDFSAVQELSERCESLSDFTLHEAYCLRVLVLCPECDWSPVPRETMEEHCMLEHLGGQLSARSAHLSECHMLLRNLEDARVMLSWSSNVVLHVGEPD

SEQ ID NO: 995671 - protein, 328 aa, Homo sapiens
FFGWSPSALLVPTQFLASLPHLRRSPQPPPSAMAPRKGSSRVAKTNSLRRRKLASFLKDFDREVEIRIKQIESDRQNLLKEVDNLYNIEILRLPKALREMNWLDYFALGGNKQALEEAATADLDITEINKLTAEAIQTPLKSAKTRKVIQVDRNDSGRGTQTDDHCTSRIFKPASTSDRCPPSQEENSVHHKAHAPPDDRVRRGLPLFTPGVGPIGGCHGQRNSRPDTQVGPQGLKTLAWYSGSRRADYSISGNGSLCCSKSSSSCAMAGENLRIGQIEGSCPVQAGHSRHGALGWPWTMRGWAGESPLGRTLWAGRCALGPASPSLR

SEQ ID NO: 995672 - protein, 114 aa, Homo sapiens
GLSGLRCLDVRGSLCPSSVVLRRAGAARCRRARAAREAGARGSCGGGAGRGVVVLTRSRMEKLREESAARVVLTSLTRLTTRRPRVYFLKGGYETFYSEYPECCVDVKPFHKRR

SEQ ID NO: 995673 - protein, 312 aa, Homo sapiens
MDAQRRQRPYVVTFCGVNGVGKSTNLAKISFWLLENGFSVLIAACDTFRARGRGAYCVHTPGVLVPYTLQKKAWWPTNGAVRPVTKGVWQGMLLALPCKPSAFCTSPMALTVVLGETRQADARTNAPLMTVPGPNSLLSIHSDVGADVGEAFKYAMKPWTSGPVQQSLGDISMAQTPRLIDGIVLTRFDTIDDKYNVRLEGGWGLQDLKLTAAGKPGSIDYLVREVDLNSWALWKTATYPKSGTHSMRNIQQANHMGDRRTLYCPKQVWATRAYSSTQWSQPRRNSQGTLNKGEAHQPREKPHRQQATHPHL

SEQ ID NO: 995674 - protein, 49 aa, Homo sapiens
VNHSFSSSYDVLCASSCRIFISYARDSYLSDETCSVGGYAYRSPGVRGH

SEQ ID NO: 995675 - protein, 119 aa, Homo sapiens
MLLALSSYTRLQPAENRIEDEPACVGGMNAYGYHGYQGPITDDRYDEIRRHWGGNVLGPRDLWLVVANALRKAHMAEKKLATNTGLNVHVLSFLYIKIIETKLGKTFSPVNMNNTKEKT

SEQ ID NO: 995676 - protein, 225 aa, Homo sapiens
MAPRRVGMVLEPHFHRDWQRLRGHVGSTQCGPVRVRQTVRPGQSHRSRRIRPWATGRCSTAVQSCVCPTVRVITLKSAALGAAGSALEELRVAGIHKKVARDHRQFLWIRGGGNKSTESLQANVQRLKEYRSKLILFPRKPSVPKKGDSSAEELIDWPPSLTGPVMPVRNVYKKEKARVITEEEKNFKAFGSLRMRANARLFGIRAKRAKEAAEQDVDQEKIKSL

SEQ ID NO: 995677 - protein, 555 aa, Homo sapiens
TAGMAGVATAAAGRVDTADSIRPDGDIHHRRHAPRSGTETPRSCGTEGSRNAGRTYSPISVTLSRPPLGRREHRPHGLPMSHQDCQRHTTQNGLSIGKGIINRSSAHGSLDRTRVGNTPREDTGYGRSQSRTIFPVPLNTYYICNPKDLYTPGTDDAEHPNGHARQYQEEPHTQKIITLTIQDPMRPLGRHKTLTQTEGRQQNLFDRLHPIWLQVSPRLPDTQNDHYNPRKQQPGANLTHQPTHPDLTLISPEPHPTHHYHLDYPHIHWDSPSQHTRSMAYYLNQHNKQISQTPIARPYHLKPHNTTNNTATKQITTDTAPHPPRQNTSRDRPSDATQPNGHTHLQTTHTEDNNNMWQPNSAQQAQPRHDHPATQQPYHTVGNTPPTDGGTNNTLSYHRNNTTKKHTQHKDSDNLTNILSHANITTPKVENINTTHHTHNYKVHPHPRATTIDYSTSRAAARDRHRPPSTSNGQHTRHHTERTDRPRSTSTRTPRHGPALKEQDKKQTPTRQNHEDPKAEAPSCPQLRTRQSIITAHDWTSTHDLRERGSTSARR

SEQ ID NO: 995678 - protein, 117 aa, Homo sapiens
EEKLSPETYLVDTASPRPNGNIWHVPLQHRQTCVRLSLHVNSCQSNACGMQQAWQLASHNPLSVQSCAHSIISCSNLQHNTSQASSTASPDPTITSHRVRAQSLGKHHRSSPSVNSD

SEQ ID NO: 995679 - protein, 458 aa, Homo sapiens
KYTILKGSMLYLYQPLICIKRIGTFIQCEFHATSRHSKQCAHGTHQHASKHAAFRQSNCNSTTGHSIDSMSTTRHASTTQKHPKQAHYLQYIGSNYIFTAMLALASSCNMRFQSNTHEHHHIIAQPHCNSHPSQQVAKLSSQHCRSAQGPHAAPTVTSAIFPPNSNTHMPIIFITAHHCTHSMPLAHNHISQQYRNAHMNENTTAKPDKHRTYSLANTHLHTHSHSTYETPQAHTSNLEAHSNTQETGTATANKGNIYGRHTHIQQRHNTRNTLGCTDNQTETKNNLNLQQHQHGHTDTREKQQTNNGSDTRDEPKTQATPHNNPRTSHTHTHTSPPARHQSGQTPNKPTLTHQPVTSIRERPPYHIGQHEHYHTWTRPAMQHRNTPGHNLDTRQCAIDDHKPNIHIAPICTATSLDNSTPHADHTMQENRARPATPEIKHSPQRNSTSRKSYNSNYQ

SEQ ID NO: 995680 - protein, 234 aa, Homo sapiens
GTRDLRTGFPYRHDISHTHLSNLNSSLHVPPAIALLSPWLSAMLTMQKQIKHMMAFIAQEANEKASTATQMPTGSKQEFQHSSKGRIRANPQRTQSISWHTYIAASTRSKQDLTPGQHTTKYKEEIPTSSTENPTRTHTHADRLHDSNGRMDRYSNKNPSPPTRQAKPKARTTTHKARNNTRTKQHHENTHKLTANGRRDTWKHTNDNKGNTTEPRTDPQTQKRYGKAQNQTQH

SEQ ID NO: 995681 - protein, 418 aa, Homo sapiens
AHTHVFYLTQSFRFGVEIAYVGATILACFKQSPGNTSTLVGGNHLELAIRGDAKGQVALSVPDQQPNVFAMRPYGVTERGIPIQELHYDLGGTLNHSLDHGNRHHMILRESIFISGQERKQQEGKAKNLRSITKTTKYIYSKTEVAPKEHGLEHGISNESGYMTEPRHAPKGNQAGIEKTQRTQTAGPNQTLTNQELPRARGAKATPPNMPNTATLREPKHTRYKSDGDNCSQQNSTTTNPKGTRTKRQHEEQRAPRGKPHKEHQKIRAATEIPTEKEKDINTNGGMNRPVTCRDSKKHETNNSATHKKQKPSKHPQNARAGEMTAATKKRPRNDQYKQRKATNEGRQRAQKAAKGKATGREEDNDRAGGNRRTPPHATPDGAAGRESRTERRSRQKRVESGARHAPSKTQSAKSRRT

SEQ ID NO: 995682 - protein, 424 aa, Homo sapiens
APSLLGWQHQGAQTHPPGEQPQTMIPGHHTGPGPCWREAAPPREPRAYSQAMSLDGGGWPGMATGAQGAELVIHPEKPGHPKRTPHRTFLLGMVSSTLVVKPLTFCRGFCRGLTTRDLGCQSPFDVTLHSTWGYNIETPHILLTGTEPKRTWETMGQAHGNRHEQPKDTNNPHPEQSHSGIEAITIGGKHKISSSMRYIDKTHNGRVDHCAQEDKLEMRSKTPLGNIRYKSMHRHTMKSNRSQNHNRAHYETPGLSIPSQADTISPTGFDVPMNQNTKCSKRTRETGEHARTQQRQPRWESPHSTRKRNKAVGDRGPTIPKAKKKTKDVAKHHSVKHGQLRGTAPALVGAQKEHTKDSATGTSDNAREGEHTDKPKYTIATINDQQTGQGPNHIPHRESTTANKNQTDRHHDATARRAEQNSEQ

SEQ ID NO: 995683 - protein, 448 aa, Homo sapiens
MGKAKTHINIVVIRTRRFERKIHTLLAILIYNTADGIDNNDTIEKFETGRLLDWRNGLLQDMPGLLDKPDQLSDERRSSPISIITIDRHNIRNTEQVTYVDSSIACHQAPPASTFIQNNHAYTEGPSPGLDLCQYLDLVSIDWDVRDELSKTRIISHKHEETDHAGDMTLYWGLTQRLGVLKTNTTGWSGSSNHRTGHSQMAGQPITGQDHEHTAGTLADHDSPQTHHHQIQRNKTEANTTPRKNKKTRKDRPKTPGQNTGRKHKGRAAPKQSTQKHGQTKGTGTETKQKKEYDKKKKETKTTSNERDKKQATHKRAQKRNKKRRRTHKNTGNTAKDRHNKKEKQHRDKNQKDNRNKRDDQHRERKENTSRRGTHTRRKRSRTSTKAQRTHRRNRDIRRKRLKKVDTGGGTGHHKRAANRVNPPTARTVRAAERQTDEEKHSKRKIKR

SEQ ID NO: 995684 - protein, 54 aa, Homo sapiens
MACLSAREDKNPPNEAVLKEKVTAGKRGKKLNMPERARVQPNAQVRPRGAPRGW

SEQ ID NO: 995685 - protein, 102 aa, Homo sapiens
MWMPGLHVGGGHGCESSALVVATLAVASVELRERGPDDADAHCRSRWVEDGVCCGRIVCLRTEVCCLEDINYTRYLGKTKSQEKPLHAILQKSSIMFLESVG

SEQ ID NO: 995686 - protein, 176 aa, Homo sapiens
MGAARYAGKLMRRTAKDTTRRIAHNADARKHIWTAPPCLTNDPDGLITNTKNKPDGSEGRITQQEAPARRIGQSHHPSQHVAHRFSGGDTRRKTEPTEAGTTRPRKRPQRHYYNTLDTATATCTAMTDHTHHPEQTQLKPHNAARGQTKRSTKTTRERAAKQPKGEIEGEHKNSNT

SEQ ID NO: 995687 - protein, 66 aa, Homo sapiens
EKILRETAVTRPGLSGEQAPVLLSGRRSGGPLRPSESRSVAQAWSAAGVISASRAMRLPCHDVSSP

SEQ ID NO: 995688 - protein, 141 aa, Homo sapiens
MSGVASSTTESILVTRLAVEQCWHSHVGLKPRFHRAKGLPGIPCIDDVFTRQSHFRWHGRPSQGYKYPGREQIRHTHEKRAMKERGVASPVWLGKEKDMDLHGAESGDRTLSVEKEPRLSRVDVERSFNRPRSYPTSELCT

SEQ ID NO: 995689 - protein, 308 aa, Homo sapiens
MSAGPADTLMPSSAARGPERPEQPVVPDPRIRLPLAGSDGRAGERVRGPGRGDVSGEGGCEDLDEAARTEDYMIRECAGARGIGKCRGQMDHSEDWSEHAGGPVGDGKLGAGMDWTVPGPVQHYPKPTDQTNASDRWLETFRIQTYVKAAMDQRGRPRKVIELVKKSGTKQLDTDLPRHLTGRLGDSSAVNGWHKQLNPEVKKSCWTEEEDRIICEAHKVLGKRWAEIAKMLPRRTDNAAKNQWNFYHEKGTVDTGGLLDAKSKNWQAPKGLVVGPPRQRAASKVARPRKGQERPDKLASSHYQKGEK

SEQ ID NO: 995690 - protein, 108 aa, Homo sapiens
LISTMAVGKELGAFTEMACKKWDAKKKVVDPIVLKKDRYDVKATCYVRNYKKYWKDGIVLPKDAKEPKTVATLEWSLTVSSSLFDMVQVLPASLQQCIESCIYEQFNA

SEQ ID NO: 995691 - protein, 279 aa, Homo sapiens
VRLVGTVLGGCCAGRQCPHERAAAQSGGALGALNGRASAGETGVICAPPSGLYRDRAGVQLSTGKIWCRLDRELPTRVTNRRASTLRVMITPLDECIQKEHAAQRTLAWRCRACVTSTDEKTVTAISAGGPRNSKHGTMALGTIAGAQVLSLAMDGRTSGEVKSAIAIRAAASVCTSNTGNDGFTNGWNRTWAEPVEKGPSDNMKRSNAYLTGKTATNSDAAYRTRSPLGDQVRDSLCAHYLVKVWHQIKEASMRRVIQKHGLTVRIAHEQDPKQYILD

SEQ ID NO: 995692 - protein, 135 aa, Homo sapiens
MALVGPLRVAQAVLGMQCYGGVSRKWGNRPKDDLTTEQFPNIRDLCSQTLGTSQKPTFNGPSTRNRGITGGDKFRRKVWESYLGKVYTTQGFMENVRVTKLSEKLRTRASGTREGQYHLHESGSIWEWQGARERG

SEQ ID NO: 995693 - protein, 119 aa, Homo sapiens
MGLLQYLLSLHRSPSQATDVLAYRAVQPHTPRCCSFRGSSLNRRLRRGQARADGGAAEPLSGEPRLRRRKNPPDATGCASARTPSRLTGPSLACPCRGGSGGSGSLFHSRRCATRFGLS

SEQ ID NO: 995694 - protein, 103 aa, Homo sapiens
MCTEMWRMHLCYLGRTCSGGKHEWCSRRVWIVNWICVHSGGYVSLWSLYVENESIEMHLWLHQRHTTHSDMYPCGHYWLACDANASVRKSRVQGEFFIQAPEN

SEQ ID NO: 995695 - protein, 197 aa, Homo sapiens
MALARLCMERPLAVNQRGFIGLGGRADLAGSSVQGKSRVMADAVVRAGHGVSRERSQDVGRDALAWNRTSPWCLSKGVPSLRSSSKVCRCVDITRGLPRRVCITIALTRGAVKKGDTIKAQTLARRAWLGGAGGLHASGQRVVGLGQSPNRTEAVETRGTRDRLVGEHALRKTCVARNHWWVIGQPQGAVGGHVRMG

SEQ ID NO: 995696 - protein, 466 aa, Homo sapiens
AWRLTGTLQQVDDFWSTALQAWSVAVKTTRIWPQFPVSYQWVTPESEKVQHSAYRHGLRQDNVDCWSTRTHATRMLRPSASLDGAQGLAGPGRKEEAVRRSIGRRAPMVSYRDSSARDGTSLVYIVVPHGHDRKTSLAGIPHRTCSSHHRCTIGAPLRWDRNRSQSDPSWVGRLAEFPFTCVIRPCAANTSGSYLTNRGKTSWWAEGHVRCNVAGPMVYTHGAVIPEELFGRNRSYLVTALDSEMGGRGASNKRQQKHARKPLTSLDGPCGVDPADKSSPVGCLSVPPGEPKVTLLAKGRLGRGTSRKAIVRDVTGKRRALVGNLGSRLTVCATSGTGNLVNLLGKACAIGHHPFPREGVALASKNFDDETSPNYSLERYPLCGTQYVGTLKESPGELGSLWEKNGNHSPSFVGPFQYTGAHDLGGDPPYNQTVCLGVYQNSGLGPKASYMHKQERGAQMRGVYIY

SEQ ID NO: 995697 - protein, 95 aa, Homo sapiens
LKRQRRRTSRGCEATGAAGSRGGSGGSRRGRRQTPWVTARERSLLASWQPGRDSMPSSPGRHRSDAGIYRRTFYKRILECARVRDIRDSGICRLG

SEQ ID NO: 995698 - protein, 196 aa, Homo sapiens
GVMRVLCWQVCLGLSPCIGNILASCSYDPETSLSVREDITAPWDEETNEHAGDMTPLDRDSGCACGPPSELTVHDTWSCVEHRDGAHLSMLTLTTRGKANGEVTDMIQRTLAPIRPCHIACHASEPPAWCVTLAHRPRLGPRRVGGRKHLNYDQKERCSIDGRACDETLIQTLVDSAERGKGAGQRGKRDGIARKR

SEQ ID NO: 995699 - protein, 335 aa, Homo sapiens
VDRNPADGQSGSGREGRDTGWLQVLRQGCSEVVALIDLEVATSFLAVLLRSEGPSGDLWKSVPRPDRTSPPLRFPCVLLARHFSERTGSHFQPLRPQVTCCHGLTHIRPDAPELTDFSMLKRLASRPASSICWSSFLETKDFHFIEADLHEPLWHRIANVSILHTPHTKVEQRYYTGGQNKPALRSNEPLLPSWSDHRITDYAIHWPDLVNLLTHFGLAAPSPPYHTAASFSPSHRFYCSVQTGALADTPASMHPLRPTTTMSPRSCSTSNSVHHGIAVHATPQIRHDVLSPTDRNTLECRRPHLGQSIAPPPPHSALTTCEASTPRAHNLRHPA

SEQ ID NO: 995700 - protein, 211 aa, Homo sapiens
MATLGDQGAREFPWAREIGCSNQMAVGGPQGAETPPHKGGHTRELEKTVETRASGIGQGSMRIPAGRTQLERLLGSFGILNQTKFGAHLNQSALGALGLLPGVVSTQTLGGGNGEQWPPGLGPKWGQRGGPQNPGIVAGHPLWLQGNGSNGEDKTRANAPDERDERLSGAKGARQSARTKLPERWGDSKTPAEVLKDTHQTDERRVDHKRE

SEQ ID NO: 995701 - protein, 433 aa, Homo sapiens
FPPDFPAVVVDDDHEGNSCTCRPGSAVTKSGPSFREVISDEHGIDASTEGPTTEVHDDAASVERIKRVTITLRLNVRPMYVSPVADARGSRMPERLIGIRCLSRGAVRGDESSRARTNFGVRAREVRRLGTKVRAKGGTIHSKGSVRMSVTSECLGLFVDEHGTGVARMAWLTLAHRHVRCCRARIRDHSPLSGERAWSMERCWVRLAGKGAWPSHFYPEEGVLQRGPYAPPPGPHNCAFPTFMGNALVTLVLRWAHFGPRKFNRFQSSKRKFAVRKHWHPWTRIDPGPSSIPSLNQGHGSRVRKKLPMTDRERNPEGVGQIAVRLDLEQVLASLEGNFILEAMPEELPLNNGSGQLYPSPTSYIRGGRHWKTLTHVPLGLLGLVPSGSYVQRLHLGRRCAVRGAFPRDGVPGDVGTAVVCPQLSVSPFSVRG

SEQ ID NO: 995702 - protein, 388 aa, Homo sapiens
CALAHSNAMTQCGLPYGLRAVLGTQQVTFGMCCLVLQSLAPRGGPLANPPGLLFSPSGSPLALAHPQSRTLLAEVNQPGAVCSLNGRTLPNAIRLRIVELAHLGIRPCDISRQLRVSHGLRCSTHSWRATTQTGIHTARGHPGRQQAPTSTTPTAGQATSEDYTSQADPGPSLACGDPAERHAGTTAYCDKLQCDIRAEHHSGQHPDAPKTRQPGEGTDQYRGKDSSQPGAAYRCPQATSTQNPHDDQDQANGPTDSNEKEHEHPTRLRGNGENTTSNPALMALGPLGHHKQAIRTLLGAYPGLPRIANLTGHTTHTTEQGHSGAGEKPNRTQRNPPQEVLTNLNHRGSNNHSKTHPKSTLTANTTEQPPDHKGHTTHDNNEHHKRKK

SEQ ID NO: 995703 - protein, 266 aa, Homo sapiens
GFLSRPKFFISFKNFDFPPGPLLPPVAVFVLRPAQSLVISSLLSASWGRGGIPFPCGKEETFTVVVVALCGNKNKMCWRKRPECGNTVCVRQCGMIFLPVCEPPRLKEIRGGALSPVCGGDLPPQFSSPVGVGPLSGSPYASGCPRGARQLVKRTIEEKSVGAQALLYNLHLRERGDYIPPLERGGDSGGKREKWGRGTYSERLPQDERGDTPCVVRPQKEKSLSHNLCGRHNIVVTVGGPPYEGVINTQMCLQEKTGHPVVGVSQ

SEQ ID NO: 995704 - protein, 180 aa, Homo sapiens
MGFHHVAQAGLELLTSSDLPAAASESAGMIGVALLPASLDFEGTARLVRERWGKPEGAAVPMVPPPRRQSTGYSNTKPSQVRGDQAAAPLMDDGLISAVGWQALGSGVKQGKPGRRDEVAWSGRHVGEQMKGTVGQIPWWVQLATYTAEPAAERQESKQHTPDGTGRPHAEDTADLEGKT

SEQ ID NO: 995705 - protein, 304 aa, Homo sapiens
EENWTAMCDGLQQIQLLLRLAVAGSDRLCVWLTDERATMHDGAAMAWTASGCQIRKLAMMLGENVHCCGRLKAGSLWMKHWYKHVGRHTVQGGDQDSSTYPGCINNATLFQDEINCAPQGGDWLEGERLCDCSQQAALDLSMDPTEYGSRDTGQTPHSTCNGHETLTNIQNSSTLTQLPPAALIRHTCICLNSQQLAFKTYTPQYGITYYGPRYLSDTSYPDAVISRALDTAANRKSVLCLPKAQINNRPSISPYAFRTDHHPSPVILLTCPSTIPTCGQSDTSHFQINRGHKPEATWAQSHQT

SEQ ID NO: 995706 - protein, 207 aa, Homo sapiens
CGLLEGIVESVIGMSRVLSHLPSLFLHNSLGLSPLGSRVLWELKATLEEDASALPLSESLRHLQMCQTNRSECMCVCVCVHTVCMSAHNLVPGIVHPRGQGQAWCAEGDGPAWRLMNASPFLGSALPILSLSIVPGDSPSQILKRALCGLSLLSGFREAREECPGSGTEIMEDGTPDYSLQPWVVSESLIWLLWNICERALIHYAKL

SEQ ID NO: 995707 - protein, 79 aa, Homo sapiens
AKGAYAVINDVDLHAGTLLFHQQIGEFQAHFVLVENVGLEIDMVFCIGDGGHHGLDGGRAIEEQRGLVAGNEWTAGGGF

SEQ ID NO: 995708 - protein, 269 aa, Homo sapiens
GVGSQAGGAARAGRKRILGTGRRAGRLAERSGGIPPKASRGAAVEGRGGGYPLVAVEERRRPGGHWAGPLRLQPCLVALRAACQCCYNELAPGQGAALRTRFQRTLSAGASGSRTVSEVRPASRGGCFSSHLTRSRPQGPPSLQGVALSRAGLQRPITVRSPQHLPAGCGGSMMRQKYAQDAGGGREHEPRPAEGQDSEATAMQQAGNAAGNEAAAASNQGGRMEQPAQSHHPLASRWPRLPSCKANLALVPEAGLRNRRALETGVGPG

SEQ ID NO: 995709 - protein, 101 aa, Homo sapiens
LVHALPGTPKGWWQPRCHLACYADTAVIMGSMGSHNTEDVLSYYEKLSMSDGPLNESDLGMNGGVVLSETMEGCVAVLRCQGRGYETQPSVATIGVGMQGA

SEQ ID NO: 995710 - protein, 199 aa, Homo sapiens
MNRIGLQCPFLGYTAGVSLGLPSNRSGHFALEAFRGNCGKLNPYVRNTERGFELGPLGVSEESITLGGANYCGHPSVKNRRSWVDYLDVGKPTFNPSYGTYYGPWISHPGASTVSLWKQQLEDLWQPIESLTRPYRSARRIFVIHPSGLSCWGVVKWGDIVRHRASLDAQEVSLQPGYRVSHTVRRNNRAPFGRNSPLG

SEQ ID NO: 995711 - protein, 88 aa, Homo sapiens
MTSALMYVILCLRTASIPLYRQREERGNPASAPVDLKSLLNEWVGNSIELDKALARGMLLTPCCTSARPHFDSIVNARLLTAISGRGG

SEQ ID NO: 995712 - protein, 360 aa, Homo sapiens
MHVVWTRYWIVGEALALEAPRRHGTGLAVPQRMDDTPTATIRPDKAPTHKRTDEAHNVRTRHSMEGRHTGDINPRRFTGVGKQKKVNTKRKDDGPEDSGYAAQTKYRGRRNHQMSRISPQQETQRCVTRLDNTKTSRGKPQYRDVNTPGECHGFNADRRPSVNTPGEENRERSNHIHKEMSTNGGTGYATTILGVARKAAIPAPIARSKHTKSDRDVEHREQKPWGDTHKQRAKRCSPRRESIQNQGGNNSRRKSRQVVQTKRGKVENTDAGTETQGKTPTATLRGKTNDQKVKDDQSKGSSNRAHPEAETIRAEYNYTSGSRETVAPTHRKEAYDGGTHTEEEDTNQEPQDTNPRTQKG

SEQ ID NO: 995713 - protein, 258 aa, Homo sapiens
IVQQLGGPTEVRVEVNKKFRLSVWHENLAVVQVSGYLLVPLEQKFSQWLTFSSDCSCWYAGELCYWRSRRVDGLLYSLSIKQNRSCSDLEHCSLDTCVGERDLFRPTTGVRYGRAFGRLAFPVHTVPLEYDNVGRDGVVHMQSIGQGLIADETDYDGLGALKSTELLAAELHVVSCCIFPPIGGPRRIAKTLNASGTWAYSIGARKIRSPTIERESFRRRKVGTRRATMASGNATVVTPRNFIPCQGIRGGQREGIGP

SEQ ID NO: 995714 - protein, 627 aa, Homo sapiens
FTTRRVSECSVHAPKYLEYSEDTYLTVVPETRTSHVTIQDIFSKVDWKQLSDNAYQIDLSIKSLPWGDESNIWHVAIRQELSMPGALHCFLTTTHKDRPHIHDARDYVIIPTYSKSPQVHEECALVIVPSDAALAAVIDFLCNSSDDQFANTTTTVVTIIMDKCTQCDARVRTPFTAKTRIGQQAGGNSKNHVGSYEFQLMKARFGLAVLITNGAPQYEYFYNQALLPTHNGSLSLRGAPNFVLLYEPIWRLSPEPGRLSSHPNFYPQERSKGHLWEIVAAISSELSGRTGGLNPNRSPYPQGWATPTFSDTSVTTHSRTSGTAQQQADTAANFRHPYLITLPFQTRTYSRRQLNNILEAEDNETRAAAHRDYPLWPGHWKVPTSTPRRIPRRRINHITTTQPSGQHDGKENTNTVLNDSIIRYDHSADQQAYTTDTATHNKRYEHAQHIDADHNKLKRDPYNHATALRLHEPNHKYVHPGATHRNTRGDDTHTHSRRGTLSPPNYKQRVPPDDNAPHRQHHTRSHASVRQRRAQSTMTHDQHPTHMHRHMTPRHTKGTAHHLPPPPHTCPLSPITRGYLHHPLLTREQNITLPLSQTQPPPNLKNNPPPHTQHSTSHHTITTLTKS

SEQ ID NO: 995715 - protein, 473 aa, Homo sapiens
MGVSLCGPAGMWQGVGSRAHHNLWPPRFNADSPTFSLPRAGDYRAIVANTAQANSCGYFEEIKDGGFHRVGAKAVAHVEPFCRPSTCDSTHPSQAPTNTVPWLNMCTVRASPVPTCWRSWRSPASTPLLSPLNTHLCDHSLNLRTPRLPRARSHIPPSLWRDANKQRARATQSATHPRRTPPRRPLTPPSHPHGDPPTPHPTPTRPHPTTHPPTAPHTAPTHHPDPATTTRRQSEHRNPGHNTANSTPSHTPTTHHTNQAHNNNTHPHTTRDRTTTPSETATTTGTPPKTPTPHDPPRGKTHHRRHPPAAPNPTTHTPPEQHTHPPTPPNTHQHKHTRPPYPPPTPLAHNLPAPTTTPPHQHRHHSHPPRGPPRAPPPTPHANPPPRYTQPRPPAPSHPSTQPTPPTGGPTNPPAPPPRPPDPHPPPPPPTHRPPPPPRHTPPPTQHHHPPPRQPPTPHPPLPPPREHAPRHQ

SEQ ID NO: 995716 - protein, 303 aa, Homo sapiens
MRIDPPTAPPYHRPRTRRPLPPCAPPTLLLLPSQPDTPPGCAPSCSPSPATPCASRTPTTPPADPTRHLCSPLHAPLPRPPPPLYHPPPNPPLLPALTPPGRTRLTKPSAPPTPRPTLPPTTAARPAPPRAPPLSLALFCALAAPPRAPPHRAHPPPPSASHPSAPCPRRPPLPRPSHPAPLPPAAARAPATHAPSLRQLARPPSLPPPFPPPPLPPPPAPPPLALRPSPRTPPPPPPPAPPPPPPPPASAPPAGPPPPSPRPPPLPPPPPPPPPPPRPRPPPPPRPPNPPPPPLLPPPPPPP

SEQ ID NO: 995717 - protein, 465 aa, Homo sapiens
MWAGVSSIIRLLHARKVKLTVASTIDFSITADMGTAEGSSADDRTTALTRTRTDSARRPQGPPSEKQHDVTLQALDVQKPRDLPRGYHTDAETVPMGLGTHPHNLTPSGTPNHGQTHGPHPNKPPTPHSTDGDHTTAHAAPRLDPPTRTRPPHRPRITPPAIDAPNTGPSPHQPVTRPPPKEHGPPETPAHHAHPEHHTPPSPAPPTPGAPHHPRWRPTTSNTQRADLQTCAPSPTCPQHPAPPTRPPTPATPAHPNIPTHTPPNNHHPPQPPRRPPTAPPSRPTSPHPPPRPQHLRKHTRAPPPKQQKTPHTSHTPNPHPDKHTPHTTPHKHHPPEHTTQPPTTHQPTPPPHHPHTTRQPKTNTPNAQTTTPSHHGPRATTTQHTTPHPPTPPAPGPTHRERTQQHRPHQQHPQHYHHKQHPAPHDLPSQPATNRRAQTTTDRHNNNTTQRHRDDQPKTPQTIP

SEQ ID NO: 995718 - protein, 110 aa, Homo sapiens
EDRGQPGSVKDPKMVGETCLKTIDWVALQRSYPRTKGIVVPWKSWNETSLQVGCLPENPPAIDWAYYKANVGKGWLGWMTLRRSLIALKVSRAEDNILAQVEMPEDNTKM

SEQ ID NO: 995719 - protein, 131 aa, Homo sapiens
MWIFSDVESLHHCEKKTNPFKTYFSERHLCVAMCTEEKCVVLCFSKRVSSGWNMRLRTSFTTREDTKCFSTRLSRVLKSPNQGCYWIQNAFERIHKCAIFFVVDHPYLYFIKPRFKSFVGRGKPYFHSSLF

SEQ ID NO: 995720 - protein, 141 aa, Homo sapiens
PPQTRASESRRNEQTIRRKYELVGIGRGISPLSSASRRVSASHGREIARCHDMARHVQAVAGDEAPEPVSSIVGRQTQASGGMGEGLYVGDEARASVAPDPEVPQFEHWFRSPNWDDMEKIWHHTFYNELRVARRSTSGGD

SEQ ID NO: 995721 - protein, 38 aa, Homo sapiens
MRTSVLTISLRMPTRVKVMVSESSDCELSELGRLESTT

SEQ ID NO: 995722 - protein, 470 aa, Homo sapiens
MDSTIEGERLRAAGGTEENKNKKTDDRGKRSTGTHETHTKTEKRHHNHTRAETRQTHDTHKRDTRHTRERRRQRQQQAKTTQQRTAMPGTQERTPDEPDTKREDAKKQNEKKQHKHDNETNQTTHHTQQKQKEKTERGNTRTQRNTTPRSNRQSPKDSHTPRAETDNTAAEPRRPTDTINNTGEQKRDKPATEEDSRHTTSHNQSTTQHQTTTHKPGTHEEKPPRKRALTQATPTQTESTNANHQTAKTSRHAHDTRQRRGKSNNSEPPSMKRTRDGGSAASSAWTRARSTNSREKTGNQKTRATQPQRHQKEETAHEQSAQRENDRAEMTDRGARRRHAVRGEHPHKQPTHHRESDNDKTRASIAQAQQSHPEDDRTTRQQTQQPRATRSNTQHQQQKQNDEQKNTNNEPKEERIHTASNEDSTNAQQDRNTQQTENDKRSRPQRRSNTRDHTRNSNTHERQNSQTNRQ

SEQ ID NO: 995723 - protein, 157 aa, Homo sapiens
MQIFVKKPVAVRASSLECRETQLITIWINVKVQGSEDKEGISSRTQQSRLIFAGKELEEGHSTSFHDVQTSPEGMVDPAPGPVVLRGGMSVVFGGKILKQEVDPVTAWTVEAQMNNQSKNCEWPKIPGVTRRHPVPEPAGRAHLCAGKQVEDGRTSF

SEQ ID NO: 995724 - protein, 136 aa, Homo sapiens
MVGRLRTSAVTKRRQEGRPREKRGSIATVLERDREFVLVSREDVSTLLVLTTSRAALFAHRERVGTTGSHGNHESGVREWLSRGSGVVFERSRSLLELCHELNERFDQFQHKVTKREYSMTECFRRGLKTQVRVRR

SEQ ID NO: 995725 - protein, 70 aa, Homo sapiens
LQFSSALAWWPAAGHRCFQSAEGEAGVDMRPGTQRPAARKPRARPPAPPSPPLPISAPCRRLTVDQRGVS

SEQ ID NO: 995726 - protein, 142 aa, Homo sapiens
MGDTYTRFHKSGRDRTPLWTMEGKRSRPTRVEEEGPKEALFATNRPEGKDSRTQEQRPRKQLKPTRGRILRTTHHNIGEQEMCSTPKNNDAAEGPSSFTRGGGIILTKHSTGERATIWREETGGSNSLYEDAHFVRCQQLGR

SEQ ID NO: 995727 - protein, 232 aa, Homo sapiens
VRTEAQVPALQPPEPGLEGAMGHRTLVLPWVLLTLCVTAGTPEVWVQVRMEATELSSFTIRCGFLGSGSISLVTVSWGGPDGAGGTTLAVLHPERGAQISPRGPKIGGPPCPRPGPGWETQSQPFSLILEGSGASSPCANTTFCCKFASFPGCSSRPLCHYQHQLPPSYFGHSSPPWGAVLVGVTPHHAAHRPQALPLGSNQSLHVAALSLLRMDSTLRQGRGLLTLVPASL

SEQ ID NO: 995728 - protein, 369 aa, Homo sapiens
MHESKYLSPDRVASREHYARMDESQQGTDYSQARPSYACGVRKIVLVTNLAETSITINDIVHVVDGGLLLRDRTYDTRQTYMVSCLRVPVAWRINAATCSIPRAAGPGGACCPSPGLWPITHIWYPPYEDPGHEEEKKWHPPLSESSADAGIHVAGHRLVLCTGNDLVSRVRNRQETNSLTICLRESPEGTVSGGCRESNPMCSSEKGAMDDSNRKISHTTNVRDWVLGFVLTRKAAIGWKYLFAISRKGHEKFRSGVLPLGATSERPLGIRFYPHEENFEPPPLWPRVLKGLGPHFVGLFQPRLSIYHRGAGKATPSAGRNSVCALPGDVRPNPIFGTSGYPRGALGPPMSCASRGTHWFHVGAKRPV

SEQ ID NO: 995729 - protein, 295 aa, Homo sapiens
KSPRKGLFFFFTNFRSGGSLWSSLWPLCAQKPRAVGPGPKAEKNNKRFVKFFLFLQGSNPRSSFPLFIYKEFSRRGHMITAAPRTQRWVWPSFTDFFTEQQGVSLLLWGATRVSAWRKREDIELWEARYTSSERRVVEKVWAPRERESPRENSVSTRLLSGESSTQIYGPTSGPGAPHPLLCEKNMRARTTSRTLFPSQRAIDTPDGSPRSGRHPLLRGCPPENTGGARTNHTTTWAPEYVAHTPKNTWTTHTRENKNRGAATPFEAHEPRSDPKPRRRERTPNTRATQGVLQTP

SEQ ID NO: 995730 - protein, 318 aa, Homo sapiens
GLHVKNTNGERAKLNLCCSDVWCLLACPEMLRWSLQMCCSCDYNCMCIIVEANSDCDLVLRCDMSVCSDCVLALNCARWNYCAVECAGDQDQGIHDNCSTETSTSVVYRRHGEDREQRDKAEEKDKKEATTRNHPGETQQKPEHQPEMKPRRTAHNTIQMAHEQGKKRRKGTTDRDEKRNVTPRKRHAGDIGEHAAPLTDKTNKEREKTGARNTGTHRKPQRNRRKGTSRTQETKRTTQQRNTRNNARRKESRNNRRETDAKIRKTKNERTETTRGTKEQRGGQQRTEEERRQRQKKTEGRERKTKENKARKRRNEDR

SEQ ID NO: 995731 - protein, 148 aa, Homo sapiens
CTSVPGSCPVLHAGVSDRTREAPDGRSDSDTDGADASPLLFGWATPDNVYLVAGYHMSVIFFTCEPEAVCGSVVQNLRIDHMEESLRFDSDVGAEYPGGDRGVGLAQRPSYWNRQNGPPCEQIPPARLETVLRELTYGRCGDAFPVKR

SEQ ID NO: 995732 - protein, 334 aa, Homo sapiens
ALSPPKRGRTGSGERWQHERTTRLVARKQVKKFLQEFYQDDEARGKSSRFKVWVTELCSSVALIEGTTVASCDAGSVDGGSRGMTPELVDVNLGECQGGYAKLLADAVQELLPRVQGRGKWKIKMSWTVDSGASGLMMEQQESGTRGMVRRPLEAVSCLNSCADFELYMQGPSRNKARVIREVAGKTHVGEVVTVRGIVTRVSEVKAEMVVAVNTCEQCGAENYQPIQSPHVHASDHGAQPGVQTNVRRAVNLQTRGSGFIKFPGMKMKNYGISAWGKYPCSTHGLDKERTQDCSLKQRSVTEYTGQPEQGQKGTGDPNARSTGEKYGRKHWGT

SEQ ID NO: 995733 - protein, 609 aa, Homo sapiens
RVLMTGAMGVQVVDPGTYYTRVWTSGTVHHDVLERPCIAHTEVSNSLADSERTVSYKRDHIRTLTTVAALCVLQYRAPTCYEPSDGSSWNLTRIWSTIVIRASIRGGNTTIGAHGSMPQVASKCSEPCVAMGALNEWVLTIPRRGHFERITCAGQASDESNPSEIAPRSPSTPVRNTPRHPHTVDKPGGLRMPQRTPPGERGLTHPRTDGASPPGGLGSNLRPTKKLAPTEDLPAPTSSQRPADRANCPHTTQPGHITYGAPPKYDAKKRRRSAGWEPHSNSAPPVTNGANPSFRHTCPPPAHTPPTDTASNTHLDTLGHPLRRNTERPPSRTPKHRGDHTDPLRTRAAPHPARSAPPTATLPQRLPPPPHATTPPGHSTAHPHTTAATQPLRPPTTAAPLPHDIITTNPLTQPPPTNADDQRQPAPDRSTTTQRPTPPPPHPAPHHTAAHNSAPAPPARPSLAQLPHPRATHHHTAPPRLTPPAPRPTRSALPAHHHPQRSRPPPSSLSSMFTSLPSDPRPPNALTRRPPPTRHRRTPYPSTPPPATQHTSTRLTDDRHRDTTTTATPPPTDDHAAPTAPTTDNPRYAHSSHSTNRQPALHHRPDCPP

SEQ ID NO: 995734 - protein, 168 aa, Homo sapiens
MVEDARTCADSMRSSYCVQQVTYKPNVGEPRGNGLPRSGNSGTALVQGELLMLRVLRIPGLLPAIHTSTCSTTVVSPAELAESHSWQRTPVAVTAWALLRDSYHGGAVPRVQASTSPWGALPGPAGSTELSARESSEKPWCKVVNDDLSKPSLIYGLSSFRFSMDKNS

SEQ ID NO: 995735 - protein, 65 aa, Homo sapiens
MRDATAQCAVSETSETPREAWHISSYTRDHRWAQHDIADYRSTRIQKKGQAWEEKTLTDNDVEAT

SEQ ID NO: 995736 - protein, 43 aa, Homo sapiens
MPRRLPNFRQPMGRRAHLSLGRRVAEGGSASQTRVVKNIWQDG

SEQ ID NO: 995737 - protein, 240 aa, Homo sapiens
GECCCYERDNKKQPQETILPSKVGLPPEAATAQGCKEETAAPSLEVLTPEARSAHGHEGAAWEGTMARAHPWVGLCVLGTLVGLSDTPGPKSCPESHYWAQGKAVLPDVGEPGTFLVKDCDQIERLTQCDPWHTGGLHSLLTTTPGPICESCRTVTLVFSYEIVTIIGIAELCLSEWLAVPGTKEVPRVVILFQTLRLNRIGVVSGPMSHDPSSDPFTYNFSDEAWRARHKWEHARLVVN

SEQ ID NO: 995738 - protein, 475 aa, Homo sapiens
MDNGSGMWLTRGFRVADDDSPRAVGFACIVRSAPGRRRAVVVGSGPAEDSVTVGTDRMDPSTTNAVRDSHGPPAPVTPRVGMQCDTSLHHRTPCDLSIGRTMTLGPIQAAPCQRSDGVLPWAPWNGTSTHVVWRDTLRVRPACQSSPYGPNEEGLNDLSIRNYCFVRTRFNPPPWAMGNRCAYPWAVAMYPYITALIGGSQPTLRHFVNGNLLRSTGGQPQQQGAHLTRRGLVASFAPQTRNSFVGPGDLGTGSGNLTPDVRFIDSIPSTWKTTGLPGFHPHNGAEPGTIRAAEPSTGQESLGDLRTGAWELCGRHGKHWATTVRDIPSLPYVPGRKKLNASLARKGHRSRHPMGARAADPGRHATGAGTQRRYHPPGRPWERCGGEPQNETQFEHFNACEVVRGDTPEENRVRHTRELTAAHHSAYEMAESNERTHTLDLTRENTTRPTRKSMSERTTAHDPRRLNRDRRPLVS

SEQ ID NO: 995739 - protein, 145 aa, Homo sapiens
MSRREERTERITERDAHALPAGRRGSDVRSVRQDSATDSRSERRGVPWRNETLGPASAYSLQRFALNHRDSAIEGKDTERRSQSSSLCWLHFARLVTRPIQRLLYEFQDNGRSGTGKGWVIVPISKLLVSLYRIESIARGISELV

SEQ ID NO: 995740 - protein, 470 aa, Homo sapiens
RHAGRGDERLTDCDPGSPRQVLTLTHHSLAGHTKSVRLPRQRSGGIGFLSPLERYEVPFDLHRLRSIGADNGTAGDSAQHCTGTDSSLSADTIQLIPRTLEPASSDTHSPTTAPIAMATHSRAHVGPTALGILPWRAAAGKRRLNEGHRKAWGGHPGALANADGSLHTPLQAWLHPGKGPPANSYSKFSQMELSLGGKAQGRAAQRKPFKPTKEVPGYGDPPPPPACKTNISQELLPPLAPTRGAGSGRKNPERAPREGQARTPALDPNLQPDGCLPGTHQAKPQPGTGRGPKAGTRPIPNLAAKLGLARIENPLAYATQLQLYPATPQRLPRPVSDPTRIDFKPAAQHNSTLGSGPPAGTTTPHIPPQPPRRATGKPPRDSHPLPGHSPHNEAGEPPQETHPTMAAHLRAPRRHPNAPLGAGDAHRHPQEPDILDREDTTAQIQTVAWDHTKGPAQRTNTRRDARDRST

SEQ ID NO: 995741 - protein, 316 aa, Homo sapiens
MRRRKLAARVLRAGRAKAKAGKAKKAVWNRCPLGTKKEEDPDVTQRFLADEDTADSGDSPNILVKSASQEKHSLTTYAIIKFVRLTTESGMQEVSDRRSKHTGCLMVDVEEPSKHQIKTGCGRSLYDIDVAKVNTLIRPDGEKNGTMFDWLLITDALWMLANENVGSIYTEIQLANSEYIYIYLSQPYMTDMDPRNRKKNRERLSRGEYNKVGEELAAWATNGRSRAHTRGVDPQGRKAGPTVPNRTSRDRMMDTAGDTPAIKDRRKTELARWARQSPLAKNSSGVRGPGPHPTTGEGHMSASRNHPLTNTNGSTG

SEQ ID NO: 995742 - protein, 427 aa, Homo sapiens
MLIAGLYASARQARSLNQSVSICHQLSGCIQDRSGRHRTRAMGGTVEVTFVTVCEPLKVRGATWIVRCTWQRWRVTRALRCGCVVPCAKLERSGTVVERTRIIGDPQPGFLLANQQAMPPVGPSRAVQAMRWLAVTRIRSKKRSTLAQRCEMPQATSNKDLKGRVSVVISEERVWTCTRVAMRDVWKPLLGPSAWERVLTPIVGGCGPSWGALVPMGPSWRTTERVSCPTNWLGSGRTPHGWHSRGLLAPTGLRVPLAGAGEPLGVLGPGGPRKRKINPTNGKEFLLNFVGTKGFKPDVIRQAIGFRDTREKFPFRRKHSYMEANDSVSSPLSARVHVCSPVRMGAPGRQVPRDLRPREKECQRSLAQSGAKEFCPTGDYNRNSRGTREEGGHERHQTPAADGAPAGHPPKKHFNTPQRRDADSPQN

SEQ ID NO: 995743 - protein, 508 aa, Homo sapiens
WRGVLFMGNLKYGPKRIFLQSRALGAANTEKSEAFVGFRAQGRRRTRYRRNKEPLQRVKVPLQPSLYSALWPQLSSSGFPPLLTRPCPWESGSYLHRAKIRAWNSLEGISFQGLPSFPQICDLLVKDLSDNLWNVAVTDKRKRCDIFPGCHGETTGSNCGVLPLKNRFPLHEPRGVAKVKYSVEGEQRHIALRRDTHSDSRGAGRNSRAEVKQGPPRGPNKTWSTREAPKAYSVCTHMWGYRTHERGYTPHNSDRRCRYYNIFPEINCPKGINPWPLNRTFAGRQKERDYRQTNQKTAQQPQTTRPKTQKTRRRQREQHHNHTHIGDTNTHIKARPHTTTQRNTYHRTTIQRQHATTHHPHQTPHQHISNNTKPLTLHTHTTPTTTISTHTHRCEDSGTREKNNAHRTKETTQREQGNEQEKDRDAHKETPHETTTRTDRHQKRHSRKTTTTRHTKDSKQTRTNNEDTDRATKTTRPPNEIERKNQTSKLGTKRKTSSDAEDTRKQNR

SEQ ID NO: 995744 - protein, 253 aa, Homo sapiens
MKISPNRQKTSTLLIAKAREAAEMRAQVERNTGSERKGKRMHRETSQNPAQEKPGRARPGDHTPPRWHPPSDTGTPHGRTALQTRPWNAADQTRPPAPANPTSSNTPTTTSTHPTKRKTAQPKLEHTRNPARHNPKDVQRHTHRHPHANTTHTRDTSTRLKRATDQTTTHKTQDTSKGRDTTPRDQQREKAEDEGSPTRRQEDRHGQHTEAKDRYKTEDAIQERDNKSRQNIARSPQRADKHEDTTMRESNHN

SEQ ID NO: 995745 - protein, 294 aa, Homo sapiens
LRVTPTSAEPLMGGVPDSRLEVERERELPLQHHTAVITPLQVHGSELKLLEKIPENAEATVVLVWLRGVASPVPPWSCVRLREAVELDAVLEVPVPVRFLFLLRGPEYVPDMELRNEIGALRLHPPVSDRVDSYEASATVVMTKLGGPAEAGRSKAFLDCERGACRLQQVLGRGAACASVAHFQSPDARDARGAGRWYLQGLGWSPNLPAIGRSCGWKTAAGGPLNDGFALRRTGRPLGGLIRDVRMPYPRYTWSDFREALGLSAGRVILLGFRPAVLGALCGRPRFGGGRGGR

SEQ ID NO: 995746 - protein, 39 aa, Homo sapiens
MPAALTIDQEDISTLPTLTNVDVLRNRWIRYTEIFIFLR

SEQ ID NO: 995747 - protein, 349 aa, Homo sapiens
LEQMSNMFQSSGVQTASSRSNKPKSDGNEDSEGKEQRWEMVMDKKHFKLWRRPMYRHPALGSSEFLECYNRCDTSAVLQVFSWTQSIEEIMGCPWIIKLEVELRGMWISGSHGLLQLGYTQCSLSRCTHLGLCAATEVIDVAIQEKRPDEVVGGLGGCASSGSVGTKFTENGRKHMILSMSPRGMASPKSDPDRTEEVYDSSSPSMTVDSCTKSGAGLVDDSVRMIPSELPSKAWTPTHEGDNSAPRTRKIWHTTPVASEHRDGDQRGSALGRRRGEERGHGGQPDERTRPETTQAGQTACDTSCEGHTDGARAYQQWGAVGRHHTHAGANNPRQRGSGKTEKNHKEWK

SEQ ID NO: 995748 - protein, 209 aa, Homo sapiens
MHNLTESVKPIAEYSPVRGIRAMLLNMDGTVVSPISLDIATTPSASECSIRESIIPQRRHLNPWNLWLITSRSGSPWTKVTFGAVVISDVLEDNVKYSFCEGDTYAWDKAFPSGCSAVSGALRLSLWLELPSLESIRFDFMEKRHHMAGISGFRRVLLTLAVTHDKSDQSLANAQQTSLGRKPGDVCNGPSLYRNPKQAWILQIIDTGF

SEQ ID NO: 995749 - protein, 85 aa, Homo sapiens
AAVAWEAGKPLSIEGDRGGTRPKAHEVRIKIIADCGLATPYAYTAVVELILRVVFHVILGHEWCMELWKRVGEGMLLMLTVRVST

SEQ ID NO: 995750 - protein, 320 aa, Homo sapiens
RESSVGLYNGGESVHHTSECVHRDPPGAHTPAWSVHHQQCPGKEYQLIPDRLPRRRVTESFLKVSHFLMDRARVLKRRHDLHAARPTRHLLPARWLYNRVPWTMQPHLRCPLPGHWLTGLVAPTKVSRAVRPPVCNIIEESAVSSQIVDSLGDMNLLLRHPSWGLLQCVLYISGVVQGVPWCNCQAVQELWGLPPRPGPLLCLERSSCKHVSLYQSQLATRSWIQDHRGSQRHKDFAARLSVVSPLFCTDRGERHVSKFRSQPNTVDNFGLPGPLQPGTDSGFARGPGNASAPGTCFHLGTVLGGPTAGESTLSTGGSPC

SEQ ID NO: 995751 - protein, 74 aa, Homo sapiens
PCTAYPENWRAFTGLIAAQYSGTQVRVFSATLASSIIGAKATAPLNCSENLPDQRRECRPDYVMGDDGFMCCLE

SEQ ID NO: 995752 - protein, 80 aa, Homo sapiens
MALFNGFLNEVGIGVSQHSGKNSRDRPSHIRIHNLLYPAQSLRTWGRGWEPNLTAFLELGLAENLGCAPPWDGMKLAKIS

SEQ ID NO: 995753 - protein, 71 aa, Homo sapiens
VRRTSIVKQIHSAASRRIPFGDYSTRYQGLPGTSNIDLRNTAMGIWHQVARQDGWTSMTASTRGSRGIAVR

SEQ ID NO: 995754 - protein, 67 aa, Homo sapiens
PQGRYRFYCHLFQLHRTATVGKGKRQEAARSRFMSVKARMQDKTGSCGIIRKSNIINDMNGAMEHER

SEQ ID NO: 995755 - protein, 279 aa, Homo sapiens
ARAAAGELLLTGPGLEERVPGGLGGHCCLPRLFTLPLLHYLEVSRLRGACCAPGAWPGCRACLQLHSLVLLAQRAGALACCPDGSGPGCLPFGCSTLSGNAAGELLPAGPMAWAPREPAGFLQLQSLNLSGNLAARAASRLAGRCAPACRDSDSPGNCLDSFPARALSPRRAALLSELAVLTTASENSDPNRPTGSLKTLDLIEQPVSEILQSLWNAPSSREIQFPWGNKLRDKRLRKMVRAADQIIVEYCALEDVWREAGAGEGRKGESGKEGNEQRK

SEQ ID NO: 995756 - protein, 350 aa, Homo sapiens
EPARPLHSLSAPVLRAVLPFRHVRPCTAMTGTGHLHSPKTSLGGGIAGGISKTAGAPIERVKAACCRIQSSPDKSDSAVRTKHVSQGSRWSVHLILQSHKDAGDCACPFVDGRNACGQRCSLAYITTSHRPFKLLTIQGYVARADSFLARAWNEELRRKIRGRIRLTGIPWTSRAVAGPVDERPLVRSVYPSLGVSARIPRWRARRWRKVMAHEREFLRALGRLALVNESPRSRTASGALVPGLQVVSVQGIIINGPATFGVYDTGKGPCSPNPKETRTIGEEAGMDRAKPGERAVRPVRWLFLNPVSTTGSRTGALMIPAARQKKVNLHVHRAPDIAGATNFQNKARQA

SEQ ID NO: 995757 - protein, 71 aa, Homo sapiens
LSRPPRIQQPRAGVRLACRAYRTHRVSPIARQLRAPRFRIPFAARKRNRIVCHVIHNLHSFEPFCMSASNG

SEQ ID NO: 995758 - protein, 117 aa, Homo sapiens
PTSCLYPPCPFLSAHLTRPAGPTSTLNPGREEDPAASRCSGLLCASWMGTLSPLLLSGRYIDDVEPVLGLWSLRSRLSRAHGADAAIPNLPLKPLVPGDGAPKACQWRLCHTDAWQH

SEQ ID NO: 995759 - protein, 331 aa, Homo sapiens
GWKTKGCQAHGNCRAACCQVTLREWLCFFRVWEDGWSEPGVWRSETVSREKSQVLTLQPFLTPPPHSERGVGTLCACWERRGSIISPRARARGHSFPFRARSLSQFPFTDVVYTEAECWDGQRHTGKRGIPLGASWGKESVDASLEDRQGAVEWVAVMWSPGESHFKLDPEWPGAPFTFRGPVFLGQACVALPTLRHEYRRVKRFMQSRPKPALSPDTLGGPILGAWAPKQSLLSRKANSRVRSPKSPFQSKPLRDFLIGGKYALKLQPCEAEQVPFKTALRQLLGPRKSGKTPWHPRTKGLSVWVPTGKRNTGKRDAWEIGSSQVDDTLH

SEQ ID NO: 995760 - protein, 91 aa, Homo sapiens
MNWCLRVFLCPVVKVTELVHVIGIGKELAHNKRLMEGSLFEVQKEIFRGEIRFFLWVGFPTTVIPSWWLDNVLIHHFPCLARSCMRGSFLK

SEQ ID NO: 995761 - protein, 140 aa, Homo sapiens
MLAPRSVVVTLSRALRVVAAPTCLHLSICALYSGAASCGIQACFPASFASVPTAHEQPPLMNYNTTPLYSPELTIKYHHCTRQLFQAPPILRNTLNSEPTSSPPKNRHTHLPVVHDHLRVSLSLVHNNQTIRLRYHLPQP

SEQ ID NO: 995762 - protein, 311 aa, Homo sapiens
INLNQELEKLLLAARCNGGIENPADVSVISSRNTGQRAVLKVAADHVEPLPIAGRVSPGTLQLTQIHAVLSGEPTVFLWLLTPGTDQQALTEASYVNLSTIATVKARDSPLRYVGTLPSHATIQGSSLSGLDVVDAGLRDRFCSTAVRHDIPCEHHIGEVMPDLYFYRDPERDRNGQSTAGAEKGNDQRMRIPRLNGMIPPPDSLYLVSCGLQTASAWCTRALCAYVSSSLLCELERSAASWDWSVSPNAHGAAWGGARLLCDCVRAKAVGCCAMVWALSVFTWKGRVVDGGEGEGLGFGAVSEAALGMTA

SEQ ID NO: 995763 - protein, 296 aa, Homo sapiens
GPLLQHMPKLFLTDCEDKSILDVGQWNELDALLEELERSTLQDSDEYSNPARSSPGLSSFQKGSVTLIETSEILSSSGETQVPWPASARVILTNIQELNVYSEEPKSPTVNHHASLLKRQQLLSCDELMAHLIVRCMAKVAVRADAGNDSTYQYNAGSPKASLDSSAWRVWRQELQDLGVATVPKGHCASCQKPIAGKVIHGSRAIMDPVAFRLYSCAKKKIWLPVPSLSGVALVYWRKSTTNFFLPAGLLRLALLGKGCRHGPDWPQSTSSAPLGEGWGPGSSNGRALAKVSPLP

SEQ ID NO: 995764 - protein, 60 aa, Homo sapiens
GSRGAAGAAGGGVRGAQDPNVGVPGARVANSCPPQQHGIVLLNPLSRSCPTARRGPSRVE

SEQ ID NO: 995765 - protein, 390 aa, Homo sapiens
GEARVSRCEQRLRVGAFRALQSGPGGECRDGAPAEWTGRLQGAELDRLLQPSPAGSMTTSWWTAVRTGLVCAGCWHMASPSWGFAHTTHIYDVDPMTDALTTNDVEPAICANGATILARVYYQRCIRVDHDNSDGWWPVNDSVTLRGLCRRTDDRVTITDMCASPGPSVHVPTQPPSIHARLHLALTTVTDAPTLMDSIHGSTLARRAHARGPSLNIRIPWQRDHTMPRILQRTILHGPRIILTPKRPIHRDIDAANVAHSSGPRATMTLRGTYGRHHGTVTHTQNTQETIRGHPHPGIAPEDTNALGPRTHGATLETLRAPRGTDVCTGGRRPSPDAHHKEGTGRGVAGAARNKWDRQEGDTETRRPRQNPPRPSKAAEDDTAGTTTHE

SEQ ID NO: 995766 - protein, 71 aa, Homo sapiens
VKPLADLRPSLPSRLRTGGLRVVWIRYPPVKCPGSGLRSFIGMNDKRYSSSLKDRLSIMNDSPRIRWSAYK

SEQ ID NO: 995767 - protein, 90 aa, Homo sapiens
GGALAPRLSHDRPWGALAPSGYRVRAWAGSHQKGADYTGLPETRQRALHHPHYLARHKHLCECRCHVRIFCWPNENKQFELSNIANNYKS

SEQ ID NO: 995768 - protein, 129 aa, Homo sapiens
MHAKSLARPCSEAVAGESVRAGNPSAIGRRNVSIGDRMSQLHDPSLHRKRTESPMKAPRRIRREHSSRYEAPTSPRHTSSLMLLIVSWSASLCPAAAELRSEGAMEVSAAQLEHRRDGFERRASESKHT

SEQ ID NO: 995769 - protein, 78 aa, Homo sapiens
VHPIPSPPLPRFLAPALGVDVPGLPWARVLCLDAVMLLPCAPDGACICAQCIDSSNQQNGCEVHLSETPACMCVAKLC

SEQ ID NO: 995770 - protein, 147 aa, Homo sapiens
FPVDVVPGLPGPSQSSASASLMADGGAPGDLACRTAVVVRVRGARVGDGRGVSQEPMSDSGLYWRDLISSRHEGICVECRLSLSKEEEAGNELDACTGDVETLVRGAEYTWPELREFMEVRICNDGCRTRGFDVGGRGPVIEGDTDP

SEQ ID NO: 995771 - protein, 130 aa, Homo sapiens
MATGVLGLETGADVVSVFSETGHVVSREFRLLMNRTAMRARQKDFENSVNQVILLKKDPEKEVKHKELYALYKQVQLKDLVTCPNPGVFDLINKANGGMEMPLRRLPKEAATAELMWIWCPEYESFIGIL

SEQ ID NO: 995772 - protein, 207 aa, Homo sapiens
SGQAGAAPRRWQRVPDLPSTALTTSRSSLSCRYQAPPSISVHRSANLACAFSSELLASLLDRPAARLAVGPGFVEVVDGRSSVQRPSYLLILDSGNEPLLVAIIPTSLCSGFLEQTAHGTQQTLRSEEITRENIDMGRRRHDRTRVASADGCGPHFTNNSVPRLRFMGGEDCRVSGAQRLRNDEVDRSSRQSQARIGLRTGMALRQG

SEQ ID NO: 995773 - protein, 291 aa, Homo sapiens
ERSGLGPHGIGASRLRRGRSQHHRQPLCLARLTYAHVKAAKPTQTSPQGQVLTKAPSQDRPPCMLEDGADGHMYRYAVDTHQWKSHGATHVKGGTLTPSVEGSDKPKQDNNMGTLHEAVLATYKVGIRKTTLKHIDHNSMRHTEYMHNGRCAQGMAHISTSENTSHGVTKHKREHRIVEHKTTFHLALHMSPYEIPTEKSNAIRLLADHIRDHNTRVLGRTKVPTTAQPRAHTNEELESRHEYTEAKRTPSMNMGHTRGHGGVNSTPGPGRQRHTWHPSQWTTTQGTPHDT

SEQ ID NO: 995774 - protein, 444 aa, Homo sapiens
RSQSSGSSCACVGLPVSGTKSMLLELHAAAAAPTLTSGRSLRREDSPAGAPWPSLKPKDPGSRPAYRARYKPSAAYSQCHATYHDADGYPGDGYLDTNIHTTDILLQIQALTPSYRGRGLSWLWLLGRDGAAGKRILERRSYFLTGDINDIPGRIRVEGLMNPHWHHKYPTWNYSHEKPYRTNDMKPNIHQEHRCNRAYYEQKKKQSHHRKSPRNKRQTKKFGRNTEKHNHKEKPQEGTISNENMEQEEMGRLEARAVDTIPKQEREQRVTRTKRAQKEEKTTGKNNNKSEHTPQKGKTQRNAGQNTGKGKRDTTARNAKTTGIEEGKNRRRHMTREGWTEKNNHRRARQQRKQSEKERTDDEGRERGPRQDEDQHAGQDDAADSGEAKSRQKNRRKPGHNKEHEAGRREKRDKRKAAGHPMPATRQRPSRKRARSRRGTRERR

SEQ ID NO: 995775 - protein, 381 aa, Homo sapiens
GVEESVRDRVREGIQETYDDTEDVRIREPTDLCTKARAIAPLSWDYRDDLQPSRGLLRCTVQGTGDKDVMISGELDIPVARGGRVVEQDASSSYSKRGCRPGKVFSCTRNVYIQQPRGRISGSVSARALRGLLSQPMADGGADGKLEYYTDIDARAASSWSSWSSYGGGQEPQDWCMRRSETCWWRRMMCNVRCPSALCTVLSRHEEPREPTDRSSSKVIKTSGGNRAGGCGDRRRRSTTLKEPGQPGDEGVGTGTTMKAERCTWQDEGNESNNPRNEHQSGNTGPEKAHKNRDVNTETTKGARARAQDREEDSQTGNGNEKRENHKSREYHNERRKSETRKKGDAQKTKQRRKHRKRLSQEKKKEKNSRKQTVDPPTGVS

SEQ ID NO: 995776 - protein, 330 aa, Homo sapiens
HYPRHKALTHCSCHLQHILCHSWKGAWPLTFVQMGGNADDTDPPCVPCHGSSIVNWLVFAVPRGMGSSQAHSWRLDDRAIESGRGARGRVSHIGRPTQTYTGKCWALVATHRHHKRKASLTGVCAQGPVLLHLYSPFLHHENIPFFTYKAEEDVLGTARNQHHLNDRRAEGARCVSNPSHNLQQNLRVVVRRQCSVFCAPRWARVNKNPLASGTIHRWRCRVTAISLFNMTSRDKTLPHGHAGVFTQTEIIGYGQYNQKSMYANGPCEHHYIRAPPGDAQQSNHARPPRTYSAFHRIHVYTRAEETQSTRYPRYQRKQQHSPPPPPLQRH

SEQ ID NO: 995777 - protein, 293 aa, Homo sapiens
TKWRMTPCAAVGGPGGPCVALGLGNLLVCFLLDVFLCMLCDPVWPGGLLACVTVCACVCLMARVSLCGSAMCRWHNGSVIAAVHRKFGACIWIKWTVKAINVPMLSEESIILYSPCTDITDNRGESVDLSYPCGAPSFIERDYGLMLDKTFIAQDGKKGRHPQIDLRGQPKDAAEPEEGLRQWDQFNGIIGLKLQREANFKPKVGCAKGYEGIHWGGWVPQSGIGHFARHAGQGGLGEPEPLGHQIYPGMEVGPPKLHSFRFVSPKKGRFPFPQGFPAFNTRGLALATEARHN

SEQ ID NO: 995778 - protein, 309 aa, Homo sapiens
MAVSLGPGPVALQRRGDLLSWPVAVRLVQGRPMRGGPVDLGGELSCCVAPDEATGMDLRRQPFAGPAGLLLVWDGACLLRAGAALCEPADGGKGPPWCSGTAPGVWRAGEKLERDPGRRLCAISCRLPPDSDSGGADMVPATPSGPDVRRLPLPNELEAGDAPGADSGVPREPGPVTDRRGEVPPGGVTGRLKPTCAASRGGTRARRVTSNRPPEACIPWSYLPRRGKGLLNVQKKRAGEGMANIHGLRQTDNRQKDERDNHTKQERDRETEKREYKTEETGERRENRREETEANREKDTKGSKNKTDT

SEQ ID NO: 995779 - protein, 313 aa, Homo sapiens
SHNERGPFLGAPGPGARGGGCPSGKNPLFWPFFCGPRVVGGAPLFFVGLAHTERLREIIPAAEILPCPQCVISADQAAGEKEEVPIIWPPSARAQHRGAEGRHSSSWKWLETTGQKLTSHPSQLGVRAKKYTKPCGETTGRNLPPLDLEKLRDYRNFPSKRLLHVASPHPQEEVFMAPRKGSFTKKIGIVCAYHNHKPPPTTPSTIHSCSHNLPGHTTLCGTGCRSVPTQKSTPRAPKNMSGPPENDRPPEQDAQHTELRGETAEKGALKGETPIPAGAHYQSFAGEHTGRARHPLSGGKTTGPDPGTHKTWG

SEQ ID NO: 995780 - protein, 308 aa, Homo sapiens
MDRVSVRRKDERRKEKREEYSRSERRGEKATRSRTQLKQLMNLIRMEILVQRLEKSAESIHVRTRCWCLDERVTLEKRLLYPCPGTTYGSCQEVALEGTSTNRGRWHGWRSHPMFDGTTTGALIDGLGRLGLSCFTGTWSKDAGLESRASEHGFSRGSRKIQLVGRPIYEVPQEQALKGMNRMREGPFSGARRSARSPFAADVGQEKPVYEPGDKTLRGVPGLSITRVDYEDIIDELPVAFKVNRTGGDPVTLASALSEILSLLNDEEMNRWVSLKKTLSVRSEQEELGQAGVSQKAKLLEHAAFSVL

SEQ ID NO: 995781 - protein, 258 aa, Homo sapiens
PSDGVLFADTCQLLDAPQVHPVSSPPPTRHLLVSPGLRIRHGKLKKYIIRIPPVPLYPCAGTRTVNVSRVRQVGPRDLHPSRTMRGVLYCPPCALVSRFAPRLATVAVVNPVSRDAHGLWCCMMSQGQVRAYDHRCNLVDPGLAQVPLPPVIPGGVVLEKDINIPWQVVLSNHLPPSKGAVLIFRANRLRDKVFGPAACSRVSRRDLGRTSPGRRSSGVVVRSYGVTHLQARSPVLSALGTRSSVVTRDFCAACALGD

SEQ ID NO: 995782 - protein, 156 aa, Homo sapiens
MTHLDRTGKRASKGTFSNVVIHHTKDHELDEFERHSNWGKDPWMGSNPNKNKVKPGLRRQQPMGKVGPQNQQELWTMDYRRNDRPDVCEDKAKIIKREEMTRGKSQDMTTQAELPGHKLGENRTQGKGSMEASKSSTRISKGGPEIPIDEVPAGGK

SEQ ID NO: 995783 - protein, 380 aa, Homo sapiens
LGNVLGRPDQRGPWGGGRRAAAACWLVEECGWWLVELAMRILVRSHQLPSARLAAQYKTGAPAPHAHITPTLSANESAGGPAVPGDIFAQLAGDDMEVSATELMNILNKGFDTDSLDLTTDWFGIDTCRSHWWPVLDSTPQDTAGALQDFKLLVEQQSKGGRPYTNSSTLTDQGPFAVVNSSVPLRQPGFHLNEAISYNLIIRLLLRLTVGTMDLDNLHQLVGPAARHAPLPPDLLTKLAWTNSRFPSRNLLQAGSCSLTGVQNQPITACNEEYPALSTIPGAPSQQHLLRGRVNSRLDPDLIPALDITGKSTSAAPGVSLNTVQGPQHELKTHSLPYAQLRPPANRANTAPQPGRAAVSRMRQPSFFPLTSDEYTTPSA

SEQ ID NO: 995784 - protein, 412 aa, Homo sapiens
MAGHVGGVALRGAVRFVTQKELSDLSCGSMVAGQKPNFMSECTEQQFAMAELGASHTVTLSDGTTAYVQHSMSKESTLLATGRCSSYEDGTTAYIHQVRYRQEALSFEDGQPVQTGQMAAMAYIHRDTQRLAMTPGNLASRPNWQMAPLDYIHHPVASAIGGAPSWATDRGGLGGHGQERGCCGAPEADAEVARQRNASKGADNEQARKPGNGQHTDKRVGSTDAISDVSGINWDSRGRVHTRPSVSSRFNVCLLNDAIHHGGTRQQTECDLIPHQCATRPPGPTGRRPWSALASHNESKSTDRAQRNSATTGKPDEGDDETDRNAHGNDTHTAPQDTASNTRHHQPSDPPQLHNTRHHGAIRSQKEARETDGGGHTRIHRRKKTDAWAVLAAQADTQNTDTRTRPERPHAG

SEQ ID NO: 995785 - protein, 549 aa, Homo sapiens
MGGWSRRERQGEVAERSSDGSPLSVVCPVELRPMCARGEQRAGDKNYWAPGDITTPLRRKRVQGSDSPAGNTIATEGDYTDAVDQCVTRERNSSAKKKRSQEGVNNGTHNYTYTREQLESDRTPPGRENHPIRPERGPENTKARGGNPPQKERHQQGPATKRGQRTIATRQRAIMKALGKQQREYQHPTRNEQSAIYGTTIIQRNHRTGTYHPSSIATRHEQHRTQKHEEYPRRKNHITLKQNHTTYKTHTSRQKPHRSETKHKPIRKREHKQTIQNIKQEPRRTQQNDEVTSKQPKGRESNNIERHTKRTNRTTNANTNKRTIQHPEPQQPQHKDNSPATHTTRQTNTHENTTDYHRGHTQDINTAKYTEASRTTRDKAEQTQHTPQGPEKTQQNQQHRQARHNKNKKINTGEQRSRNTTQDNYTGTHTDHTQQSGRETTQQQDTAHQARSADHNEREQHNQTPRSNSEHRQRKWRPKKRRQTTGQHTEEHTQLNAGHKTRAKNQQTSTRDNAPPEHENATTGQAHRTIAANARDHKYHRAQHTSTYT

SEQ ID NO: 995786 - protein, 474 aa, Homo sapiens
MQYTIYTFRSKGEYSGDIEVTTRAIYSDFAVRQEKYTYETAPPWEHKDVEKAGKGAPYGTKGKKQMKPHINGKRTQEIAGETTLFNPPDVTVMRKPHSKVRHMAHRATKEGGIYQNNAHTRKLTVQAGKTNTGARQEDWGTTFSENMGYSTFAHDNHNGGHQAVWTHTKRAEAGIVVDDSTPHQQRKTPLNIASKHGLHPKGEEYSETKHGTTRQRRSTANMDTTNSDKESTHYTSMHSGHQQQLGRTSIGHQITHRMKPRETEETPWGKDRTHRPENKTPSRTAQTNTRQKPQSWHTGQPQNAAHQHNTRNTPTRPQTRGVTTRTPSSTTRMRLRTQTTETQTHQEKRKQTIPQENTQSAQDTNSPENSTTHRPQHNTCEPRQRRAGKDNHAEQQRRQVNARDQTRKPKDDEKKGETHGENDRKQGSYQRREATQEEQTQRRRKRSGNKQQTGDKTERHTQETERETTRHNKT

SEQ ID NO: 995787 - protein, 227 aa, Homo sapiens
MASKGPSASASPENSSAGGPSVCSSTGAGAERRAGQDLSSATSAWTQHKDADHQPVWPPLLLADVYISGWRPDLTDRCVLLAKLAISRDKVITTIYGRGSTGATGPQRERTHPSILKDRGQRQENRGGSPTALELRRRDAKTTKDDVGATERQLIPLQGNNYRAKTYQNKHMNKKQDTHNQNEPTQTTPDIERTKDTTNPRRNRDSGAPHWPTNPTPRRPTDGNKAK

SEQ ID NO: 995788 - protein, 561 aa, Homo sapiens
RHFFVTPLRHESQRGVKKRMRRLKRNNDETMSADGPMYNPLRLICTVDVPHGRTTHMDTARPHGDCLVHTLMGPVNCYLVVDDLISNWNRDTSLDPSDSTESHILRTPHIDVIREECPMYESYWPMEPDDHTWTYLLDDINTDRARRVNTPIINYNSHIISGHDTSSLHTHISRQTHNKANARTHRGQTKGQNDTPQTGQRKRQQAEETKPKETEKKTKHKGEHNHRQQKNPEETKTSTKRREKYKKQHYTQKETETKNKETQNKEKERRKNKEQSTQRRDAEKDSSKQRVSETNTKTLRENNHAQNPDSKENTTQKQPRPNKKETNKQTKTSKQDRQTRPETTEQGKDAKKERENRHERSEGAKRQGRRQDNRRPVAGEQRTGRRRRERETENEHPEQRDEEERETEEMRRRAEVKREGSREEEQEEAERRDREAERHRKKTVEQAQEEARRSKARRRREKKDEPAERKQGVEKERDKAREDGRARESRQGYEEKKENKQTEERRKEEEDAKDAEDDGNAHEGGRETEESRTQERRKTTETNTSRSQHREREGRSSEGTD

SEQ ID NO: 995789 - protein, 160 aa, Homo sapiens
PFRVLKGELELARNDMIIVSRTCIMNRQGEDLEYVSKTEDGLAGRDARRKGMYTDPAQRMKGARKRATHDRWRYGLMQRKETPGHGMRLVTPAESEAMLSAYLDSMNGIDDAGGPAEVTRGSPLGLRHAHHTQQRPALSPEYTGCDTNLTGRHAATARIA

SEQ ID NO: 995790 - protein, 199 aa, Homo sapiens
RQQPFRQFLCWAYVKMAASVLNTVLRRLPMLSLFLRFSQSSGSPHRLFAPKLPLREDSLFLSFPFLLISDEPWKYLESEEYQERYGSRPVWADYRRNHKGGVPPQRTRKTCIRRGHKVAWESHDPICQRSHGCIVDFRNRDSSLRATLVCRPQRVSSSMLHTRGSLCEGSTTRLTQCHPVKPGIMVSSFTTSPRLNHGT

SEQ ID NO: 995791 - protein, 94 aa, Homo sapiens
MTAETENDAEKKDESEEKKTEEKQAEQKPRRREPKQSESREQRRDEGSNHSGIGARENKEKGEAKSKQHARRSDDAKKDQHEDRARRQRTADTR

SEQ ID NO: 995792 - protein, 69 aa, Homo sapiens
RVLIRNLILPPNLNRLANNAPDSDTDCRVREPVTVSKESGLIVYIQAEVVRATIARNTKETHASEKVTN

SEQ ID NO: 995793 - protein, 372 aa, Homo sapiens
GLLPPVGSLLVPWAAGHGRGLRCGWLGCAAWRTMVPWGEAATSPAEETVVWSPEVEVCLFHAMLGHKPVGVNRHFHMICIRDNVHATNTRGAHGPIQRLTLALNHLTHQCTDTARPPALSLDHSSIPESTRGTPSLPATRLISGRSARQAPRSTALPRRTTHTRRDPRTRPTRHPPTSAPPATPFTTSITHTHATTPPHHPLHPHHHHTTHPHTPTTPHTHDPTNTRNTATPNPNAPPPRTHTTTHTPTPQTTHTPPRRRHTHRQATTRNKPAHEPRTNNANAHPRAPPQPTHPPPPHTTPATPTDSVHPRAGNHPPDATHTPTTPPPTPNQPTPAPHPHTPPPPHPPTNRTPTPPHPPHLPTHRLPPPHPQ

SEQ ID NO: 995794 - protein, 80 aa, Homo sapiens
TKSCDRNPIADGAGFAIKEEERCGGRLETGYGMHGSSSKATGVCRSIRTADSVHYCIRPENDHTSMLTHDCGSMSDAELA

SEQ ID NO: 995795 - protein, 467 aa, Homo sapiens
GAAAPPSLADLPWRLGLAMWRREWDPSDAPASPGLRQCARSVPPSPWRRRRLLRGAPRTGEALVAWIPMPRTMGHTCGAASLQSASRTPHTRVRRPRLAACEPAPPARRADHGRRAPPSPAKHTHTRAGRSSSHYPPQHAPQPPLTETSLDQPLPDQPDSSKHHVPPPTLLHITNPWHLPQAHTADNALNSRDCPHTDNPIPQATSTPTEAGMRTHPTPPPCTGTPTPPRTQQLTHARVRTNPVQPPPLLVAFWHPGYSPPLAITPPCEQATVFLTGRRSPGHRQHAPILCALYDVGWQEAPRVKADSDHVAHPLMPLCPVHTDNLAATPQGPIAVSPRAKPHPTATGQHERRSPSLTRPRGTRPTHDKATPLLPTIGHSHTYHDVPHHPTHDLHHSPPTPKEYLPHTPAPQSPYNHRTLPLTPPLVPTVKQPTKPTNHPPPHTPTTQHLNPNSSITPTPPTLPPPT

SEQ ID NO: 995796 - protein, 58 aa, Homo sapiens
MGWGAWERAERRSEEKRLSSQLGPFTLGLHGIELQYNFGLKWKAGIYRRIETNRDKNA

SEQ ID NO: 995797 - protein, 77 aa, Homo sapiens
MRLWNRVHTEQSVPLVRYHDGPAAQHGFGPTAIPHELERDLPSPGKPTGDTEVAHSILGDCLEHHFFHEQHTSSHKE

SEQ ID NO: 995798 - protein, 377 aa, Homo sapiens
ENLPDIAVMDIRVMDDAAIDNGKRCMIRVEDDDADNLQESLSAELDAASRGGPRTSFRSSFRNMQPHTDHSTHHYTQHTLTTTIRPTPTTTGHTARDNTQNPTNNEQHTRTVTDRATQATVSTPVTRHDTVTRSTQPTTPSHHGTTPHAQRGPTNNTTPSPQEHSKDPNITEQAGTQNTTNEVRQQHNKYKRHTQTPNTHHDEPHSTDHTKATNKPPDTRHAARPTRARTRQDKPQHTGTTKQRHNTGTTHPRSHAATPSNDQSSQPPKDTEPAQTPNTTTAQNPHTPHTQHATQTTHTNTTGNRPTDRSRERDRHTTPQRASEQTNENEARRERNTTSPRDRRKRKTHTEQEQGGASNDNRSQEGIGTKKEHKEEK

SEQ ID NO: 995799 - protein, 193 aa, Homo sapiens
VTGEGRLCAVRVQSSGPAVMESHLSPALVCGYPLCPSCERICPKSVAGFGHWLMMMQGGPWRGKGTAQAAEGYWGVATYTPARSSLLGHCAQPCRALPQVERRSAPLWDESMKRMYVHHLISAFSASSHQCLLCVRSGDVERPGTASVGMGCGSMRMAGVEHGLPLARDGLSAVIRLSQGSPMFHHEEVQFCL

SEQ ID NO: 995800 - protein, 290 aa, Homo sapiens
PSPGGQMSGRSPTRGALQVAVNGKARKEAVLDCWLRNFLKFSGNSESLSLSSAVAECTGTALLQAGVQLNFRGYLQEHGTIKPESRYFMTRNSSTTSAYSRVGGQVRFLASGIQLVTQGATSTEHVACSPGETVGSRRQAYGGAVRVKVGVEDLMVGGIWSTWCDRDLSLAETASVVYVPIPQVGVEQLACVHVERTILRIRELAIHLQRNINENFGPNTEMHLVPILCHSIQEELEKGTPEPGALNAVGERHNSVLMSCSVPIWGLSPGTRGIGALPGETQACGVGWGQ

SEQ ID NO: 995801 - protein, 62 aa, Homo sapiens
MHDKRARGVLGSIEGEHTRSGGRTCLGDFVRTTVIRRRDKRKGTAPFHMTCRTRKEDHQKKR

SEQ ID NO: 995802 - protein, 186 aa, Homo sapiens
ILVSPWAAPRPLLPVCKNKPYPKSRFCRGVPDAKIRILDWRRKKAKVDEFPLCGHSGVRLNMTQLVLLKPWRLTEFVPSNYMVQSCGKDGFHIRVRFQPRSTVIRINKMFPVLRLTGSKEACKVPLEKPQGDCGQGSHWQVIMCIRTKTAVTRSTVIEALRRASSSFWRQKIQISENGGASPHVQC

SEQ ID NO: 995803 - protein, 319 aa, Homo sapiens
MAFKTQEVHTFMYLGVATSYRGEGCVGSIAAHKALGRIGSAAGPHHVFTAPSPPGENNKDLKRDVSPCTEPKIPQIGGAGGVCMTLAWGGLLQMISGPRGCWGVFPRYEASGAPLGALELPVRDSGVTPQDVCWARGGLSIVSHETWWGRPPVGRGGPFLVLWGEAHPLNSKDTWWRKRSGPQRGTFDYPTAGKYFSHREKTDIVRRPPSGIVNQPGRGETITTSFGAVVRRTTNSRAVNKGEKLFAKEGGQNYMRRPQKQGFMKNNQRDKPALIAVLLYTHKETGHSVKSNLFLGGHHSMNVVVFDTTYALFFVPTEL

SEQ ID NO: 995804 - protein, 63 aa, Homo sapiens
RAQSLRLCRFDDPSTPGRQVTSGMMISPGSSSTEGSGLVARAGFVGLTMLLPGSGFHLHSWGA

SEQ ID NO: 995805 - protein, 129 aa, Homo sapiens
SLSSANQGVVVRLELAVMLGLVRIFDTVPTLARDLLLAFTEGSPGGEATLVSHRVTGVVVAQISCASIPMGDVALHQVYGDAPSSIPIDPLAVLSNDGDLGVRRMDVSRHLFGAEKQPSWVRATKVGYG

SEQ ID NO: 995806 - protein, 97 aa, Homo sapiens
MVLSSHPSSSEVREALDLMPCRHVPQWKEQFPSGTCTRRWSRPRAVLEKQTQVYSKLSTGGGYPVGLMSDLELTSESPWGKFSGVVRDWLTAENTRG

SEQ ID NO: 995807 - protein, 367 aa, Homo sapiens
GLDAADVGEWRGRKMMRGRGVPGAWWGSPCAVLPTAPKKCLARVPSCGARWVAGRGCRRPRWCPVTLQLAWSVRPSPSAAVPWWARLELPPVGHFLNRRCALSSVVHRTCCSYLASRVRAYSSRGAGLLLLHGARWTVRACCTPLVGYGGLTAPASCLCPHTARRKGLATLCRRPVIAVPAVHSPSSSGPVPGLVGASTARVGLALLLSLLGRSSVIFQVMAGPPAQILPLQASFRGDSEPKDQWSKVELHRDSTVLRYTRMVGQESTGVRAPPGFLVHAEKGSGSKELEAQPRRAFKAATVDKGLRAALGEVPPVVPRKTCIRSHRKKVATEPAVRTWVYTPLWEPQGKVAPETRICGGRHGATHT

SEQ ID NO: 995808 - protein, 68 aa, Homo sapiens
GKMADDKDSLPESLRTWHFSRSQLEQPCSGDVRKHEVEQVEVGHGMASTVVPPRCSQWDSWLVYVGGP

SEQ ID NO: 995809 - protein, 284 aa, Homo sapiens
GRVEKFDLVPAAHQPLWRLLHGGDAYVILNDSAAVTERNSADMTSTTGLGNECTPEMRAGRRVQSLYAVSGWYDVTMNWSGSCSTGVGPRAFESGLPFPRLTSRSGPEDDKKGGVCIKDSTHVDTLDEVGGAETLFQVIRAAVLVRCHPYGTVLVLRKKPSKQVADLLLIPGLWANNDPTRLDVGFRTGNRYENDWKGHHRCPQGQSGTVGAVVARGPDVHVSEEGSESRGRMLLVLVPQAGSAAGSVDIRKEDAATGAGKLYKVSMVAGTMSVSLVVMRNLPR

SEQ ID NO: 995810 - protein, 101 aa, Homo sapiens
VDYLLTANKRLVQTQLVVPLGRVGPYNAEVKGGNPAWEAEEERRRKRRDGTAETEWSEKDGTTCAAEGKDHLHIIETHEDCGRLDCKQFTAPKTSDYALCY

SEQ ID NO: 995811 - protein, 434 aa, Homo sapiens
CEELTVFMGLKPGVRGSGGPRCYLVNFLLQRSSRPVSGSLMSWFLLPGKGIYGYISIPLSPPGWAGHWPGNYHRHNLLETPGRPQDRANLILWWSLQDGKRPWRGTQRTTHTRLYYLGSARGPGGIRRTTRLCERRGSQKGVPGALRPGIYGEGARTYTYGNGFPGQEKEVAGWGGGPLENGALWGALRGRQGVGRVYPHRRFERRNEKGPTCEHDRQLGMNLGKQNMRHTENMAYDAPSNNREVIKETTKQHYSRRHPTRETTDGSKKPHNAGPAQGRGHQGKEWALKKTKQKSNPGTPVRHHRAQNHTLRGTRSIRADDRKEQQHRVRKEYSRARQTENEEILRQRIQEETHIYMHKHKTEADKERRPTQTGKRRETDRRRKRNRDQEHNHEPKGSDEHTGGGPAKKTKRGMEKGDGPRRDNPRRRERETRE

SEQ ID NO: 995812 - protein, 174 aa, Homo sapiens
MCVTASFLLLKHSVAILTREKRFLTSHGYLNTRYYSAWIQGSMRIVRSGRRLQRETALEGSTDTRNWVVHSKSEGGSQYGGYSPSHTRYAGPWVHFTPIGIGASSWCGRRRTLLLVDRLPPLKEAIPFLGRNTSAGMHSTRTPRPRQLSHRNWRANRNEGDGDAYKLSPVTQRN

SEQ ID NO: 995813 - protein, 363 aa, Homo sapiens
LEEFVLQSGAVWDDSPEDLTAAYGSILEAIKPMGLFPCDSTTEDLRIRFSDLEIGRWSVRTKHIRKIADPGPPVSSIRVLESRWPTRARLDSHGLCLDLGSLTLRDGLKDSRRRRASREKNTQARHHWRGLPVRTDPHEGQAPPSHRNPGTQEARQTWASENGETEAEGKPDDPMQEDRAPRTQIWTTAYGARLLKNGAGSHRTHLTEPRLSEDNRLQREPAKGTTKKGCQEKFKIPQGPRSTSCSRTKAADIPRGGSLKNPQKVTHEEDHAKLDNHLPRAAKGTRGPVKVDRITTRPDTEANEAVKHWDIILGLRRGMKEGTRGYQNMNHTSVQHVGNTIKEQKRRVENNTTYGTTKDAIYQ

SEQ ID NO: 995814 - protein, 276 aa, Homo sapiens
CCAPGSLDGKKGWAVPVPVPIWNPNVCAADPSQVEMSAGRSVPGGCPMTTRHLLHWMTGSERHTGFHLHVLRSGKLGQYIRLVEPWLAVPRQAGHAGEGTGLVEVNGENVEQENHQQVVRPPPRPPLNAVHACWRSNTEHGREQLQTSSASRIREELSETPRKRTGQADSRRPSTDPRGANGGLATDHTEPIADGPHNAAHTNHSAKLPDHGTRTHDTKGPTRRDSIGALQAGTHRDKHHQGHGTRAKPEAKMGAKNTPQHRLAYRGVRAPHGITN

SEQ ID NO: 995815 - protein, 155 aa, Homo sapiens
MQLQFLKLEKQEQKGKWPVHKFHFQPQDINSPRTRKNQEEKPQIHLTDIDLNVDVFRESSYYVGRCSHSADETPRSEGYVAQDTKCKQSDPRQLQPKRIRQVLRFRQMDPTANTQTGKEKGTRHKSTREEQTREKEARHPMAEKGQREKGEAHDR

SEQ ID NO: 995816 - protein, 271 aa, Homo sapiens
MIDENIRPTFKELANEFTRMARDPPRYLVIKRESGPGIAPGPEPHGLTNQEAQQDSQQLAASTLRPRPQPWHSQRRHNLAKPPHLGSARQPTSMEHYNRPRGSQSLIQVHHLEYMPMNHRVIYGELYARRSADSLETQMNGAPPIQSHLHTNATGMPGIRVIRGAMYTGSAAELQEQQCPCVEAGSQEPEPTDNAEISAIHIPSATVWMTPDNPNLPKPGIRGQEDVKRNIVNGHESTSLEGYIPFLRRDRHPLSIDGVSVLVLSNEERGS

SEQ ID NO: 995817 - protein, 250 aa, Homo sapiens
MHDIQQCVVPRTVARYSPCGQVRAHIVPSGPGGSTHNCTSAGRMVDSRDWATSLRWIHRTTKMERLHWSSALAFHHAIYTTRADDDPTTRYTDHTCTGYPDLEVSTPKHKTLGTVPVTQIPAMGKRAPKRGSRDQRHLEHTGPKIEEPRTPKSPTMGINTYRTAEARPSPRRAQEPHLGNTFTFPEEDSSEEGKRAKLKQPFAVPRDITSSRWSPKSLGQVRAWSKDPTTGPMCEYTQRKTGGVLHKVEK

SEQ ID NO: 995818 - protein, 416 aa, Homo sapiens
MERPQENRKDDTESTHVWYNSRREEQHKNESQITYPRPRGYTARGLNERENGAHTKSSTQSDSRREDTTSRNPRHRETHDGETQSTTKKNTERRDNTIQTYTTQEVDDDRKKARAEDTMQKRRRRNGDHKEWTKQSYNTEDDEHNKSGGEQHTPKREIAGRSEAHTQNEKREAVVTNKKQKNKPVGAGACDGQPNTGGGHTSDKCPHPQRKKKEQTTKNHTDTERYQSDTNTPYHNPTHDRTDNNHTNHTQHKKKHKSTADKKDEQQHQKKPDNRTRRQEGSKTGNQNTKQTTERTTTTTEHKRAGQHIQVRDTATTTTRERGAARQNHAPTREEELDGVSITQPRGGGEKQTTHIRDRQEDRPHTINETEQETKQRDERKSKRYEGEDKRTHRKEENHRPEDTTSRSTDTNRKTK

SEQ ID NO: 995819 - protein, 206 aa, Homo sapiens
GDKHHLDCEGQDPVFCSEQADDAEERAERLQASKLKGERRAREQAEAEVASLNREIQLVDRRAGPTLRRRLGHRPCKSWKKLKKLLMRVQRGSEGSYEIPSLEEMKKRWNSREIQGRKQRYRQQSPERRQTQERIERQGGQSGRTCGEESNTETGTQLQSTTPRKERKPQAEHARRSTIPRQREATQGMKPDMKNVHETQKARKSA

SEQ ID NO: 995820 - protein, 143 aa, Homo sapiens
MFARCLLPDAWCSTEDMRFGVTLLGELHWDAGATVTRHSVKTRSALSSGQHWKVATGHHGGEIAGNKGTERCPQPVRLTITARSQGPAEHAGNPDGPLRETATHRAWSAEGKIRRKKQGGHGIVARGLTAKPTTGEEPKGPLG

SEQ ID NO: 995821 - protein, 43 aa, Homo sapiens
MRWREELCSLLTIWHRELPPAFRELEPTVNSPGRLLVNIPKQD

SEQ ID NO: 995822 - protein, 163 aa, Homo sapiens
AEVGCRAQVGWEREDGELLSEEPKRQKSEGGGAVKLLRYSRENQMTNILAEDKRARNCVMNLVKKFKSRSIMLVAHTHRIAIKRWRQWMSSTRPRQMQTTFFGCIGIDKFGEILKETKLLEGHVDAHYYETEDEQPDRNLCCGCITGWTDRSLIAISRLLPNC

SEQ ID NO: 995823 - protein, 485 aa, Homo sapiens
GAFPCRTEPQGPPSARHCAPSPRTLALRLLAHPPTFHTRHLATPRALAPHCCASTHAPAPAHSTPAQHRYTRPANAQRRRPHFAFRRPPPPRGSPLPAPIAAACPPTALSATQHPTLLAPAPAPLRLSSPCPRDASTGLAPRALSTTPTRLAPPDPLRAILLAAQSRRARAATPKPPNRHASPLPTGPNRLATPAPCHAEATPSLPQPFTSLPFPPTANGPSRPPPKQTGHDQASLPLHTNLENLGPTPSLDPAPRAHLTRLPRHRSLLNPHGPTHASEAHPPRKRNEHTRKLSQQAPSRPELLPLIAPPGCPTRPRASSRAPTRPKTQKPNGQPRHTPPALLDPRTPIHSPLPGGNCRTPPPHPPPPPPPPPPPTPPTPPPPPLPPRPHTHPPPPRPPPHPPPPPPPPPTTPATPARPPPPRPLSPPHEAVPPPPPPTHHPPPHPNPPPPTPTPTTPPHNPPTPPTRPPTTPPSPTATTPPPTT

SEQ ID NO: 995824 - protein, 147 aa, Homo sapiens
MDRIYSMFRERNVNLPCSFEHPSSVIDLLVRPNERSIQDVSLSTTEECPSPTRSALRLISLRRYRRLRMREYRVRQSVGDLARAEVGLGPRPLASHQDPFVSCVVARPGPRDIRMSGPSIDSSVCLSNKPLVKARLVGQDEFAWNRE

SEQ ID NO: 995825 - protein, 84 aa, Homo sapiens
FNSYILSLRLTYYAYVIVRAVTVAAYVRTVLAAYRPPCSTDARMLRGQAPSLTISERSYVSTCTEAHLLRSPSHAWRLRIREFL

SEQ ID NO: 995826 - protein, 71 aa, Homo sapiens
LTSTIGGRQEQGAVYEEGGIEHGSQEESGVISIFLQKDWYDVNSVLLMFKYKTILDMGLLVTRDPGNQNWI

SEQ ID NO: 995827 - protein, 166 aa, Homo sapiens
MCERWPAVLGCIICRSHSHVQLPLNFRVERPRSQSSPLREVLKLVSSLAERPGHCEWHVFPGGLQGRTSRACLDRASMESMLGAVILVSWTMVRLEWVLRAQEADAWGHLTALHLRQFPCCSTVGVQVLIPDLQLRSKYTESPSLDAMNETLSSYCVIVSGDCDLW

SEQ ID NO: 995828 - protein, 245 aa, Homo sapiens
MTVGHDWSDIVTVRIPPLKSTLAHSPDPRPSIRYFSRPDLPSHLHSDREQGELIAQIGDAWVAKVVVFDASPKGILQCCLRYLHLAHAMATRISDIGYLSAKAPWHLSTIRLSYHGARLLAVGEPFNFAQTNCCPKSNTWMPSVKSVVAVQLRGRVSPNIRTLEFARAEMSSMSPNLAPLMECKEFLNAAQTKSPIFSTVLPVCPSEAVTNPRAFYVSPSENYLFRSVPLVPGQIVPRKGDASGN

SEQ ID NO: 995829 - protein, 131 aa, Homo sapiens
TGRGCRFRGQRPGAIKCPGNDPGPPARAPAPVARRAIARKPLRPDSLIIYRQKCEFVRGSGADGPRASLVKKLFQGRVKDKAPVPRTGDEGKAGNPETVPTTPGRAVDPGKPGEPKAQAAVREASSVRPGP

SEQ ID NO: 995830 - protein, 388 aa, Homo sapiens
KKPTQILIPTLDSGFIVMKHMTDARWHTYLELTHGRTATRSFDEQLLELFEFGGPEVLKLRSDIAVPIPKDHQVLIKVHACGVNPVETYIRIWYLYRKPLLPYTPGLRCGWGDRSCRTINAICLQDKVTETKLAARSLRGIMQSMLYAARTHCNKLAEKLDILHTELDNRHTIYILHNEASDTTVPDVKAGASDRDKGRSAQTHGNTTMTQQHTHTGTTRLKATQDSSTPDENGTQQRPDRPTTRTQERRKTRSKRKTIEYTKQRQEGEERKQSERNGKGTAKRKHTTRGTGRQQAKEEDQENGRAAAKRPGRKKEKETARHRKRAQQGRQQHKRTEERNRNRDERQEKRDTRKKSGNTPTKEMRGKETDGEQKTAAEGRNEKEREEE

SEQ ID NO: 995831 - protein, 42 aa, Homo sapiens
MRIGVVNLKPQEKDVAKNLQRLTRIAKEHKKEETKEAKKKRQ

SEQ ID NO: 995832 - protein, 407 aa, Homo sapiens
QNEIKNLCFYLTHGGQLGKSQSHGFPGGSGGGVSWGALYSLSQSRRHWRNFIALNCAAHVRTRGVPEKTTHVGGGSTKTTTIDYTLLIECVTEETPYSCRETPLDRQARFDKKRDSSFDDLERYLSHKSTEGERDSLQSAYAKAGYKARVIVSPREEEELANEGALAVTQHTGVAKQRQTREETLTPWGKNTLVEGTHHQSAPGRKCGGHTQDEKERGAKLSTAVGEEQLEKKHLHYKQRNPQEGTTPGEQTNRKSRREGKNIAQPTTEHNRNETDNNNTHHDEEKKTNNNPHREEPPTPTERTTPPLQARRDQQQNDEQAQHGGTHPNDDESNTTSRAETHHTEPHPPNVRDKLEKQTEEHTQEEPTHKQNQRRETHPLKGRHTRSHTNLEKRNAEKNNSHNTTRG

SEQ ID NO: 995833 - protein, 332 aa, Homo sapiens
GGALYGRMTPRPTVWLPGPDIRRRPPYSISGPATIRMSGKVQGYSWLPGERPARVHASRSHVEGAGAPRLRRSRHLASRELRISRGESSGGLAQGRSRWVRQCSLGGTNGPATGRASTLRLGSADLSRTPPTRKVQHPHAGTRGPSERTTSKTFCALARPWQDYFRIINPTPTKGKVLLQTEIATGHKTAGVIEPDTDGEIYHLCSFETLIIFELDTIVRDPKGHRCQIPIKPKNRAARKLRCKQATWNLKQSKLERGKTTAFGEDSPRGSRDAFCDARIKQEPGGTTGPHLNPKSGRLTISHWDDANHSKTEKGKRFPQLVGNKKRRSTQK

SEQ ID NO: 995834 - protein, 138 aa, Homo sapiens
MSDINHAGSDLIFELEDRPPFHQALVGAITHLLAIFVPMVTPALIVGAALQLSAETTAYLVSMAMIASGIGTWLQVNRYGIVGSGLLSIQSVNFSFVTVMIALGSSMKSDGFHEELIMSSLLGVSFVGAFLVVGSSFI

SEQ ID NO: 995835 - protein, 32 aa, Homo sapiens
MPQRHPHLTKDDVNKNIPDTKTNTHNTTHRPH

SEQ ID NO: 995836 - protein, 207 aa, Homo sapiens
MSKTSWAFRTYNGGIHCSRTLGDNRGISRRLGHYFTKTTFDLNRPTRKGHIVNSYVNPNSNQLWCQGVLDPHCSETMLTVLPRLARRKPGCEAASHPVPKNWLRPTQTTEQRPRADHEQWHTKKGQTLERKRPRTQSTPASLQRLSTTHGGGHWSAEPDMRGDRPALKHNLTIDEQTRAITRLTRTPATLRHEPSHSLTRHKHYTNR

SEQ ID NO: 995837 - protein, 175 aa, Homo sapiens
MADMCEGYSCVLRFGRTAQSTLRVHLREFSSGYQAWPLYSLCVYCLSRSSVFGDSCSTMRAYYSIDLWPQGPWILTDATWIVHLYTWRGPLYSSEVLKAQFRAPVFPDLFHNTCILGEYPTHGPLATEKSSVMMSCEYEMRLEEYTRAVVNISTRLEPLVGLAITPKGSVWNASA

SEQ ID NO: 995838 - protein, 303 aa, Homo sapiens
AAPARRWPDGGEPDRCLSGLLRPAVGAASSPWLRHQPGASVWWCPGVPLVCMAHPVSAAWADWPHHPCHWDGVRGEGREEPTADEQGLPTSVAGRPGGHCGGSLLACQRNSEKGSRKKLLDIILLILERKPQLHYYQGYHDIVVTLSAGGRREAGNIPGRNLIYPPPPGITSDPTMANTKHICAYLMPIIDQVTPELHDFMQSAAVLDHLRPYSWVINLVTGHVLSEYQHVERINDYILDLATPCVLRAISTSAGAVRVGGRTSGARRRRSTVEHCGRCRNGGTSASRPNLGWSQGIPIRRSI

SEQ ID NO: 995839 - protein, 134 aa, Homo sapiens
MVETQTITVRDRRLKGMNTEGINPPIMEDNWANLGSWMKNSEDELKSQCTEAAGPGGQGTQGPRDAPGTPAVEHNEDRQDERICDRERISDELAEIERATQVEDVQKEEPAQRYTTTLEERFTQNQETVRRGYG

SEQ ID NO: 995840 - protein, 106 aa, Homo sapiens
MTRPRTHKTTKTAPQPQTPPKHPPGTPARARTPRAGTRPKPPRHHRAENNPADPNPGDRGEAAQGGTRKTRCGRHKPTAPRTSDKQNATDATAHKHTNTHGEQTRR

SEQ ID NO: 995841 - protein, 76 aa, Homo sapiens
SQNTACCENYPLRAKRGTGKALISTLSSIGQHRCEQVHPGTGHSESIESAVASSKMNPFAHDIVKHRRGLTEYCGR

SEQ ID NO: 995842 - protein, 433 aa, Homo sapiens
ALPTSLLRGNETGEWGSCCGANSSPLHRERSLRHICDLSSSWRQADLAAGERAPEEAQLEVRFYALSLSFRGLELPERTGNQRSSRIRQSHIPLRAQPHKFIQGTALRLLCLGWYSPWCPRSSTAQVVTVKDRIRSLQCITASRTTEESERSRLGTSSCLLKYAQCGKKWSARSTFPCNLPASHHVTNLANEWHLERLTAKVQRGDPTYTRHRRTPWRLGRTASAAMLNDPGYVLVYDDAIRGCEDVSNGENKRTQGQKMKAQKDRRNETCRRREERKAREAGQNKDTGPKPLDPCEPPASHPQPSQGETHNAKRARNKNTPWEHSTNVRWTQPDPNQPHINPGSTPKATQRMTIHHAPKSSRRTEPTSAQVEADKHTTQPKVEPAGNNTHTHTRQTQTDDATNTAQERHNKQENKNNKDNKHQEKATREDTP

SEQ ID NO: 995843 - protein, 120 aa, Homo sapiens
MGSTGKITRGYVSGSQDINGSYKPRSQSEQAVLNFPGDRLHGEWALYLCVTVPEGENVRLQGQYRDIDDVSVIGVVTTPLIVEISEPIEVMSQQYLRLVGDVIIAPSEGGALKSSVNEAL

SEQ ID NO: 995844 - protein, 185 aa, Homo sapiens
MRENTREGEKKEEVTRTLMWGERGTQRDLGPREAYNHHPHTHPTRETQESHRGRGDTKDTRAPHKQIWGYPPHATGQPPRWGPTMTHKKKRKDRGSNTRRERHKRREQEKTIRGDQQESTDTKERDHPPQSRGEHQGATIHEERKKQQERERETRRTRRRKKHTASHDHPEPQERGKTKEGETAR

SEQ ID NO: 995845 - protein, 154 aa, Homo sapiens
MLALAAVPMVGLLSVPGSVPVASPRPRLQQGLLDDPSSSSSSGNPLVYLDVDANGKPLRRVVLELKADVVPKTAENYRALCTGDEGLTATKGSTFHRVIPSFMCQAGDFTKHNGTRREVPYYGSRFPDEKLYTEAREGQVSCPWLIAGPKNKGH

SEQ ID NO: 995846 - protein, 207 aa, Homo sapiens
PSLAEMIQKGEQLFLEPELVIPARDSTRCLHGPHYSLGSFLITHGRTMLLTDASFKVKSQRRQLLEGQDCKYTTDVWARGPLRLSPDASLSVITAGANDSSQVPSPSSVRRARLDHSFLSWLGFSSMDTNGSYTAKDLDEMGQDSVRKTDEYLEKALEYLRQIFRAQRSAASGSSHSPWAPGQDENGKERIPDCIVGEDGLILTPLG

SEQ ID NO: 995847 - protein, 94 aa, Homo sapiens
FILYYHREDMEEDQEHTYRVVRFEVIPQSIRLEDLKADEKSSCALPEGANSSPQINGHPNEGESSHVLRATLSTGRKVISRSGPLAWDTYLTHE

SEQ ID NO: 995848 - protein, 363 aa, Homo sapiens
ASSHQEYESIEAWAAVHVGELKPGGEQAHEPVCECHRLRPLSSHCLTLYRWRPRRSDYDPTAKLASDGYRKQNALHRAWQVPLPRRPWDDVLGGWCGNSCNWATVCHDDTSWRRSPWVPNVIQSLARPWVPEDLWTYAEVTPVGQGWNWQIHVGSQASCTFRQRSWLPSEKTASCVYVHQVIGLAKNLGVSVKVGYGPYLACPNDRVKGLEPPKKHGPLGVVTLQPRGAGAAPGLVLRGLMAMSERTTHTKKEEELLRHGTCNAAHEDLVGGTAGPGGDPQKALAEVTRQGDTGTAARRANPKGPGHTGEVAPAETAGNQRQVGKAPPTRHRGLATSRGAPGRAQTEEAGNTETGGAHTRTQA

SEQ ID NO: 995849 - protein, 192 aa, Homo sapiens
QVHVCSCRQPPVLAVDYRGMKECRALLVYADFLDGRGYTGVGPAGLELTGSLVIWPAMEASPRVLGLAGDAGPLRHLRALMCILTLTCFVDSFQRSCTLPLRFRPDRKALYPYFPSCACLESLCEFLNGDLAFSCMSISGETEVNHSMLDLVLSDITGTLEGDQGSLFCISLGKECGLISACESLAVPYRKD

SEQ ID NO: 995850 - protein, 539 aa, Homo sapiens
MTSIIDAYNIDRRMNYTRQNDETHRDDQVTQGDNTNNPCEAPGVCTETDAIKDNETTLTRLNNTQTREEQTTQRQKKRAANKQNQRNQMDKANTETQPSTEQPNNEEIETEYTQLRPHKHTTTNNKRQPNNYRTPKQQKEKDTKRKNIDKEDRRQTRKRQQQIERNITHRSTGTEQDSRRPQPAAKANHTEETQHTKHTERKHNTIEHNNIVDAYTNSATNEGSQSNAQTAPPQTTRKRSSATDRPQTDKRDKDTTMRSRQTYTTTATDQQKEEPHNTSEANTYEGDNTTRSTGNTTRTKQKTNTPRTTQQTTNKQQQRPKQRQTRQEDKIQRTHNTLTGKRKDKRTEETRKNQNEQTEPQHDNRDQNKQHHEREGDTMNRAPVSNATEQHERSRNHQNAERPETQTSLQAEGNNRTRRREPTRTRHATRDRLARSRRTQRTRQRGERNTHRRNASGGEQNKPKRTTKQRTRRREKDDEERTDEQREEDNDTGRQTHSRRRGEKTTSSTGRANEERRRRRRTAKHPIDTPVQRHSDSER

SEQ ID NO: 995851 - protein, 268 aa, Homo sapiens
MYYTIFSVAWYRRHQCKWSPIARTCNAAVSSQMVAWYVPLARLHQSRGRLTRPARSTNRAGDMSARADTQRCERAGTTNNTRLQHNYTTPPPRETATYYRREMNEVATTNVRAKTHDRRAQPYRRTSWRRTLKPGRDGAYPPPARPNNYTHTARADNHHSTDPGTTPRQTRAPQHHATLRHDHDSASTAPHHSQQAGPHAHTHTNTRATDKGRTNTPYRAGSNHQRVSTRTASTPTDAARQGPTHAAEHSRRTSHQPDNAARPTAPPP

SEQ ID NO: 995852 - protein, 295 aa, Homo sapiens
MIIADHTSWEIMITSSHHEIQIYECHLAMHIENDDYHATDAMLTTEPYPCRTHSVGRRNPTYKPTDNRVSIRGTLETHITGEQIKYSTDCTTLVLSTYYYELTRLTHFPTRLNTYFADYATHTLEHELASRTPHDPWPNVPQTRASLTKDELRGDRRSHTLSLDLKPQYRTGHKRDKNKDEDDRGTRAMSRRSRKPADWGPQRATRGMADRKRKKATDTQTKATPHRGHGPQERSNDIGAHERHTNHTDRHGHWRNNGRLEAISNNPNPGETRTSIEHHHGQAKHRHDRKHTLTM

SEQ ID NO: 995853 - protein, 180 aa, Homo sapiens
PHICARVPLGDFSRAHFIIPNTSRATVSPDLAWSRAMVLSDADVRKLMQHVMAFIEQEAIEKAEENRMRRQIERVQSERKGRVVEEPDRLEDEWNVMMRTEKRKVVELRNENSECPSVTECKRRVKGPQEQEMSFIDRPTKLRQSRDSAKVVQDEQAGTKVLLDGAGFSRGSGSVVERPK

SEQ ID NO: 995854 - protein, 122 aa, Homo sapiens
MHCSVDLPGPGGRRCLLMTNVGCNNGSVSSVFVLSPSPSAFLFVHHAGVLATALRCGESVCWWRAGDSLVYQRVRLHQFCLLCITIARVPGPSITRPQTLCRMPSASGSGLDFFLSPVLAIP

SEQ ID NO: 995855 - protein, 528 aa, Homo sapiens
IACPRPELVAGPPATSEIAMLYFSFVFGAGSEPLQRCGQLVRMAIRCSAQQRSPDSDWGSKQWLDRPGEPVGQMILRCGSLHAEGEGQDRCRWPGAHCLRATSASRSCSLECPGGSMYWQQPRYYERGYPGQKDHYGSEQQQSGRHRNMRLHCAKTARSHEDKDMMDTLEYLKQKREDQTVPDTLTTGDNTKTKPGSRHTNRTITCKPHPTKPGNPMRRHDTTMEPRKESRTNQTKNNRDTTHGSWTGQKKRESTQEHTYDKPNDSNETKMNRLNNKPTSPPDKQGETAAMGRQAKHDMGHTRNRGATNVSTGSTNENPVHVRRWTAQEAAAKDDSEATWTPLRPQHSDENKESRQETGRKGETTSYVHKQKMRRPEHSNVDDRDTRRTHENKSTTTDRKSKRQTRTTDEEKVRGAYSAEAPAHRATANRQTRDKKISHKQEAQQTKIPRTIGRTEKEESNKKNEHKHTHKNTRTQLQKRTTSEARTKKSREDKKREIQTQQEKTEKKTREENRQNTEDTRRREKAAT

SEQ ID NO: 995856 - protein, 149 aa, Homo sapiens
MTGAVGEHSLEKSPRRPFASGREGPNKVCKNLSFWGAHGGTKEPVKLNLRVEIITEILGRDSDLHQECRITTQGSTPRHQRSNGWKASNTTELHGRPTATQNREQEIEQTESIQHYREQQSHPANKEKEERIVRLSSSCSARTCGWGGG

SEQ ID NO: 995857 - protein, 340 aa, Homo sapiens
LACSLAHAFLPSLGLPSHAVGDVALANRQGGGGRGHLSWPPLNLWRQRVVAAAVPSSGSGVGGGRDCWHRARGGCRDGRLALAVGAPLLLGAGAIYLWRRQQRRREARGRGDARRTERRQQERKNPEGRAKSGPGQQDTLKVPVLTVDTDTLLIETKADKNKGTYISLKQEIMTKLFRCYTEVLSIVPTEKNVTYLHGLKTPEQHALGTRCTQLERTGAQTGAERDELNRNYGERLTLEPGQRPKEKADQTRGQGAADDNGREIDEGYKPHQAGDKAAKTSRTETKDTKERQRPMKTHGRAKRITQSRERNSQGDGGNREAKSREQRRRNRQEEAGRTRQ

SEQ ID NO: 995858 - protein, 96 aa, Homo sapiens
GASNTGVVKTTPKSQDMGKENDSYQHCRHWTGVFEGTCIIDWAICIYKWRWHLRNKNALRIDLRRRLLEMGEGLRVKVMPGFVGNNTEQLEAMNDG

SEQ ID NO: 995859 - protein, 155 aa, Homo sapiens
MAEHDSKLKRAVGAVAGEELALDIVGKGRKPTDISGLAQTIEEEEEYMLQWGLLELYGEDRWCSDEISWRDRIVMMLCWPSWDVLGLYCRSGGNRREAPAVNSIEKYNPRDQQVGGASACSPGSSVGCGGLEAAQISRRILPEAGRCLQQALTTT

SEQ ID NO: 995860 - protein, 474 aa, Homo sapiens
VAGICSPSYWERCGMENGVNPGGGACSDPRSRHCTPAWRDRARLRLTTNTRKRNEQENKTLSHVPMNQCKRTNTDKLALHTGPHCNRANAATQHHEHEHIILWLGQQQDIGTHSCLRGTQRSSRHSTASENRNVGISPEPLHLRNLDQTRRGTGAQPGGETLQQPSASNDETADAPRPGSHPRRNATPLCSNATRPPKSKLVTTHPRATTTCQNQQRTTHTQAPPPSWTAPGQKPKGPKPYKRQKRATSTKIATSNRARTPTDRAATRHPHQTRADAHAGRKTRQYRQTLQCRATAHHNDKSKPTARETTYNEPPTQPTQTNTTPRKVDTEQTRTDTPGHRQHHTLKEISARQPDEFKPRTSLSTPTITHIREPARKRRPDEQSEKAAKQAGGRRVESNQAVKLTLATNEQPHSALMQLIQAAKQEQLERVEPPKPRRDRENSKTRAGREIQMAADKHVDENSRDKDTARADTT

SEQ ID NO: 995861 - protein, 236 aa, Homo sapiens
GIDDQDEQNSVTHTDPGCHCRWGSLCVVDIPGYIRASVIASDPSAGSVWRRVPSTTYGPGLVIRTVSSEDVWEMRNHLNRNSTQFDELVGVSGQQRRFCPSDYLVQCSPPRDPWYGCVRERYTVLCIAHVHTVLKHNRGSTSASARVMILNVGVYSRYAEIRSDAENGITVPESPCANCSLDLLTFRSELRGSTWRAVGRSRRHESMAECHEPQPGIVPSLAEVVRVKSHGSTPWV

SEQ ID NO: 995862 - protein, 369 aa, Homo sapiens
PTGRGYCGDHEEQLWLLWRSPGLPRQPYLGLLLEELRRVVAALPEGEDVGFSVGREKKLALMLSGLIEEKSKLLEKLSLVQEESMNGYEVESSLKDASFEKEATEAQEFGGRTSNGKLCKAEQVQILNVEDEILCLEKELKEEKSKHSEQDELMADISTKGYSRLEDESIIPQITSSCSQNDLQDLSHDLTERLDDSTNKMLLNDTFSSSGKAETALQKLSMDRTVSGLNKTRQRSPLDELQRYHGTNSVLICSRKAHQDSGWTLVHVTGGAATLWNTITEGITDSKRHGTSGQVDRPRITPRMPRERASAEQVIPAATRETHNESVHQYANERKENNTGELRQTNDEHNNEEIKVTTRTIHSTVPNSV

SEQ ID NO: 995863 - protein, 97 aa, Homo sapiens
TPWSDWPTALGKDFVTLLGAGWRRGRAPEVPTPRGITLKELTVENTCTEPDWDPGRDAGDLGSPWLIEWAVWGSFFYIYSLYYYSVILEDSLASVTP

SEQ ID NO: 995864 - protein, 201 aa, Homo sapiens
EVLVSELGAVQCAMGPLEAPEGTLVAWCQCAWLLVCLPACRCLRLWVLGLFMATMPPQRAGCLGMLLDVMFSRTQYRAKDGSGTGGSKVERIEKRCLGAVLAETTVSAMIPKQRNGDYLVGTYTPRHSRDLAGITDELLREKKPSTRQKHTRNKEVKTKYGKKHKITTGQPDIGPQVDKPDTEYDHDHKKNPVTQGEQHQH

SEQ ID NO: 995865 - protein, 459 aa, Homo sapiens
AASTAKMKTFLSQLRTCVDILQKMCSTFTSEGTPSYLGEGPQRNPGGGTFNSHSSVELSSPFFGKRKQKREALRVCAPQVGWGYTRTEATRGFTGAGHLILFSLCVPQEHCCTPRAGSFYPLWGLLSGLPSRSGELLGALCSQLFPSFQSVCVFYSPSERHSGRSLSVAVRKSAGESNSLRGGRVENHNNNHIPREKGGVLRRVLTRTPPRRFACAVVSLPDATILSKEGPPTKEEVVVHSSKLPPVGKHAPQHVGTPFLGNSFVAFSPTTTFLHTAAAAHYESHISPDGHKSVPPLHNTPTVCSPPTTPNGGATIFPAGDNQLSSSSGGQWGAQHSIEMVFLPSAQTTHRRRQTSVWSLPTPHGRPVSTMNTIKRRPLLNKKRYYPRKGWLIPQTRSIQSILLPEDRCTPPFKGTPPSRLAHDILSPQLCRLAPQLKDDTPLFLTLWRDHTKHPSIHI

SEQ ID NO: 995866 - protein, 507 aa, Homo sapiens
MADYLIRCGARSTVPDDVTHMHQHVLFELARGSALYATIDYSSFSLRIRSDFSLPGPHGCAPHVGYHDLVYPNATESPSLMTAPWHCPYLRHLATHSVHHARGIGHLDPIGPTCVRLSRARLFWPIHFPAHNLGIHPLKSYPMDPNLPTVSLRLARPKTHTLIPTAHRALFSNAKLNATNVPLEFPLSYAATNKRNSLPVSAGGTSVFYLWNVGPQPWGTPLLPHFRGVVSIWPVGSIPFQHFSNPREPKRMEGTPREIPEAHEEAPGPFLSVPVLAHAFKSFSYPPFPKGVGGKTHKLSPYSHSMSLLIPKYHTDQGTDPLGNNPYVENTRLGCLRDPSLVEHSGTVERFKTLSETIKLLHTCAQKQRVKPPSRASIVQRLNTATPPPVCLAAAPQFFHSATCSAINASDHDRSPATRLVTHRGLPLVPDRARRRVVPPALSTSPVWPTHKLLVCGPPLSRLRALPLSLVESFGPLFTSVITAHLSAHCGVCHHPPPVLARVSPAV

SEQ ID NO: 995867 - protein, 69 aa, Homo sapiens
SVLCGLHQTVGDWHQTLEVLVDGPTSVWPHSDFMPHDSASLLGNSSLKFPRLFANSSDRKRTETNSLAL

SEQ ID NO: 995868 - protein, 129 aa, Homo sapiens
MKFKYPSLPRTAVKTVNVISDAPSHVLQEDHVDLPLSKELREKYNVRSMPIRNDERGPSITGHYIRSVTIGNGSPGCPDIDILSVYSRRGCMRVAQAKRHRLSTWAFTQARWLSPRANHLDIGSDNNNS

SEQ ID NO: 995869 - protein, 146 aa, Homo sapiens
MCTLPSYIGFLQTDRRGIDSLLMVLTYRVTTNDVPSINQWEMLGGPHLEWLTISDVVTSCGLGYVHLKLQIVNKSRFNREERPLSCLLETWTHAITVGHSRKTRSCRIGPRCNVLTEQVATITSDLTETVGYIYWYICDLNWCWNQ

SEQ ID NO: 995870 - protein, 139 aa, Homo sapiens
MALTCALTLDSIRLTPAPSALHCTQHSQSNTSAKRPRTSIPLQITHSTAARNSYVHEPSSKRTHNSKPQHLHYTQNTGPSLAQKPTNPPLTRTHQQSTVIRTRQFYYRITITLARGIPINATIQEPTQDFDPRHRKMTN

SEQ ID NO: 995871 - protein, 127 aa, Homo sapiens
SFRPHTSQLKQESYTVENIKQDQMKSQKEIERPTRQQNRTPFLLSLPPSSLSPQQSRPDTLPLKSLHYYSKEPPFKEDWIIKNQKPVLPQEQSKEILTPLHQPFHISACPHTYSFALVSPPPIYSSH

SEQ ID NO: 995872 - protein, 256 aa, Homo sapiens
ATERVTFREAGASEEARERRSVAAAAAMNYTRAPDEIGKLFVGGLDWQHDPRDSAQLLFLNMENARTIVLSLHDKHHQPVSMALGVSSPSSQTHTLSWATVLASRPHMHEMADNHQTPQPMPHTLRWHASRAAERQCLTGPGMARTGPMAANKELPLHASRLILSACDLSLTKSGRAEHSSTQEHTPFTAKLRALRHRQRHRQWHPYCIRPRPATITSGHQTDYEWATLQSNLYRKRTDQQTPAGDPSDLDLTPSN

SEQ ID NO: 995873 - protein, 154 aa, Homo sapiens
VIEDVLKSVFDAKNIEKIEKLERTELAYEIKKHKQGIFVLANLKSEESLIEEFVRRVNILKKQVLRFLVINLDSERGMHKTFRPRKNDKHKFFSSKKPTTSTEEGKSFQKPFVKKPFVKKSEETDSSKQNEQDKVLRKPKTVKPAKDSKVAHTA

SEQ ID NO: 995874 - protein, 60 aa, Homo sapiens
FKLLTMYGDMGGARLWPQQLRKLRWEDHWSPGGVEVELSCDPATVLQPGLQSETCFKKDK

SEQ ID NO: 995875 - protein, 240 aa, Homo sapiens
MCLWCCGDVCSGSQLIGRDSMLCASTTPTPRLTATSQPSARNQPPPPHPETHPHTLMPLPPSNTELTRQRTHHKHQGPPPQALPPTAPPHSTTGNKRPPATAVPTPALTHGTHTTDHQGPQPHPCQPPTQHTRRPASPQDAPAPHSTPPHRDTPPPPPRHTHPPPDTTPQPHPALPHHAHPPRPAHNAAPPPPDSQPQKRTHKQPRNHRHRTPPTPPHTTTPRRTTTNRHTTPPHPHRTP

SEQ ID NO: 995876 - protein, 301 aa, Homo sapiens
MTATDDTLQVEPLASTAGAWNHRRLAYLSVLTQLDAELAGIAPQGPLLLDPDQTEHDRWECNVAMPWLCCDLGCTCGTYLPTHIDYVTKIFSYGIIRDTHEPMGTTRQGQTRGDDLNLGLERYSGIPIHYSLRQPYTQHRGLDTQQAADNPTTKTTSLDRRSYTINPQGGRHGTHGNSKPNRTAPLHTDTGHTNDQWMTTRLARRDQTHNKYAKLEDGNRQPESPSRRHEYKIHPQITHNNHLETQLMRSPWGHTNTQVEPDPKPTPQDETLIAITTHTYHHPLTNPTIIGNTIKLSIREE

SEQ ID NO: 995877 - protein, 225 aa, Homo sapiens
LVSYLMSGTDAYLPCWQYPHDTNRLRCGHVSPRELCRLQDENIPGVSPVSHRLENGPECTRFQIHMRSLLSHLVSALIGPLRGFFWLSWISIRSLYTDQRLCRVPFLAIGMASRIALTAMYHDGHLCQCIQLATYSVTEARIIPRARYLDSVMFLTLRRQINAASYYRSTHSVLVSSDRLRDADVHHKRNEVRGPPRSGITGTELNMGQVVQGESSWCDLDDDEA

SEQ ID NO: 995878 - protein, 128 aa, Homo sapiens
MCEVFSPNFFFTTSSSAQQNNTLLHFVGCKKNPAIFHTHQGEELITPPHDNNNTKDASEVSYSSACGGVSARALGGRNSPGGRARGGHPKKAPASLTGRGKTQASHKSERPAGAKVGRGARAKHSPQE

SEQ ID NO: 995879 - protein, 574 aa, Homo sapiens
PEHRMSMNNYPKKPKWERKRLTINTLLAHWTRSIRGKSTTYWHIMIYKLRLALDNKNHLQTTSEQGGCCAWEQGLPSSYCLALIGTNYMNSLSAERWILTHSDYSPLHENTLDDQPKILMDYSLECHQAHQTHHLLKKTLKSTRGNLITDMHHRCNASLKIGLALALRLICAGKSMKRPELILFPKNTGGKAHSSSEASCPPSFMRPYNHQHEKMLAQNNHQNLIRLAYTPNHSGTLHTIEAPNPLNQGTTQREALPSSAKTSDLTATRIQGHPSHHMTNDTTLLRPNQQLTRNRSQPRTNNWMTQHNLPSGLRAHHADETQTALPIAHEPKTLALHKVEHIATTPKGRIGDNRLNTHLVTEEMRQNRPQKENTTKPAMREHSVGKVAIIVTDTQQSRHQTCEARDHLIQPSDTHTHKEVVLINKTCEETNRRTRDTPCLAPNSTTHRGITSHTPGNMEEHTPSSTRPDDAKRDNKNQRHETTTDRRNEDTTPTSRNKKARRPQRMQNTNTQQTTTHKPPQERQTHAQVTIKQSSNRRRKDKSQDKAKIVPKLDYMTQHRTHQTAKNTRPKHEP

SEQ ID NO: 995880 - protein, 124 aa, Homo sapiens
MKRRREVERKHVEEETEKAREQKGRRKGRTRKEEQREGEEMRERRERRDEGQEREKGREKTRKRVHQIRMQRGGRRERREEKGERKSRETKRDERRRERRGRMRDREEESEERRDREEAAKSRG

SEQ ID NO: 995881 - protein, 70 aa, Homo sapiens
AEEPSSGFIFGYQQYSKSSCLLLTDFAKLPLLRRVTDFLLFWDVYYLDTCNCLNRHVNWDKRLTRTSLTY

SEQ ID NO: 995882 - protein, 192 aa, Homo sapiens
MANKRSTPTQPGGMGNKVSHSENNTAPDHVQGTEESMDKPRTHTERNTRHNTWNKRPHIGSTVHDLPRGRVIHSTTARRQTRRHRHTEIGPDKRANTGEIVNNPRRHRRETTHQTHRTRSKKRDTNNIATRAHEITSRQYTPYGAKRGKQTKSIENDTTSHMTSTNKQHRYNEEQNKKHTHEATTEARTSSS

SEQ ID NO: 995883 - protein, 385 aa, Homo sapiens
STELPVTGYSVEVIESGDGNKSLKRLGRKVKINYIPQDIPDVASCSTTHLVQRSSSTRSIDTQTPEWGRQGEATTAAVRQIRDPQHRTSPYTNEGSEESPCSADDQPCRIPEIKSNGNNISPFATNMQQIKQNLTTDYMFKREPPEGCRTGSQDLCRNARQKQGFMKSQNYKYVLTNKTKEEKQNTKKWQYSINKHSDKAITSKAQSHITKTTGINHIKENQEDHREGAEQTNMSTLEQNHYQQDRHKRKEETSPVKPKHKRHRPQNTQNKTRTRTQPNRQHKHTQTQPEAQRKESSRHKENKDNGDRGQGKKENTTKKTDKNRRKRETPTTKEPHKPARKTREKKGKKETQKNERRKKNTQKNEKKPEEKKKGRQNTTKKKRNK

SEQ ID NO: 995884 - protein, 139 aa, Homo sapiens
MMGHDQWTTDYRQSLTRPIVSRPPDASDLWAFVRTWHTHERGLGDRRSWGPVAALLRVGRDSRLWCLSLRTLANLVPPDRRQGNGLRKRVLFSTYHWRAQSSGFVRPGSILRYSVYRIVQEFQIRMWELLRRQTEVSLL

SEQ ID NO: 995885 - protein, 253 aa, Homo sapiens
MRLKPRVNTKGDKLFHATGQSTVRFRRKRRRHRPNTRLRHRRCRFQTHKGDRPDKLTKAHGTGSDEVFSRDDGVTLITRKIPRRQDSTGTDDQGHLCVKRDPNTGPPKKRKPDETVSQRMHSPGQATTQDTGDAANIDTNHTGTNGRKHKERRHNANREHWVTTNRHTRCDTGEHREASPTEQRTHLVGDEHKRPPVESSMANVPPQTDHRQKAEISNGSCKIKEANSKNHPNRNHERLDGERTKRPHAITRH

SEQ ID NO: 995886 - protein, 112 aa, Homo sapiens
MVKLGSVSSNDPCNPCSSVTKSRGVTRLPMTSYRIIAQGRQPDGRIPREAQRIPRLRGRIVPSVIEEPRSDPGEWLFFFESISFHSSVRGRVSDRHKKFTWMGVYHTDLEEM

SEQ ID NO: 995887 - protein, 149 aa, Homo sapiens
MPRKTGGPGSPTTSLMIIQLLDDYTEMIIVGADNVGSEARMHADPNVPSREGVWLHYGAMISPMIASKAITVAAAWKSEAPGSWYEELLPPYSLGGMEAFDGITNGEIIIVKSQRTLFAGHIRVTTSCEPCAGAICPDVKVRHGVRALE

SEQ ID NO: 995888 - protein, 105 aa, Homo sapiens
MPTFSPKESSGAFHPSTGRSFLNNSKRFPLAPQGEQFRFPPGLPRIMLSPVSGRGSSIPWAASARGPRPGHGRPWRRLSRGPMAPPSAPLPCSRDQERPDPVGKG

SEQ ID NO: 995889 - protein, 57 aa, Homo sapiens
MRTDRTEGGTRTEAITGMERATELCLPSTATYALPSSQNPKARDPEPPGSTEPGDSG

SEQ ID NO: 995890 - protein, 129 aa, Homo sapiens
MAITTDGLEMDTLCEIATEPSSRDELEEGTWMNSTKMLTSTLAWEDNPRYSPFLRRGNVMTRTEERTFAISRTLVRPLEYHKKMVMWGLPLNELYLERIGQFVLNPIIPGFPKVYWGFTSLERSGVDYR

SEQ ID NO: 995891 - protein, 163 aa, Homo sapiens
TLAIIQAKTLNITLFRGENGQYEIADFENITRNQDLTTIALQKVKRPSETCNAPLANVILRQVRVKLGNLELYVEQESVPSTWYLLIVLPVLLVISHLCGRGGDQAQIEGAESQTESTTRIAGKRAPEQRYVTAWLSCRWIQLDVVDTVIGTVPYPYDYKHKL

SEQ ID NO: 995892 - protein, 84 aa, Homo sapiens
MCPPVKAVAADVSGAWFSFGPRENVRVFDEAASGFGVNVKRVRAFNRVGACASRAVCSCASCVRGEAALFQQRGAPCVRRKEKQ

SEQ ID NO: 995893 - protein, 121 aa, Homo sapiens
HIDSVWGLMWPWVVQSHIKRHIDSVWAFEKVADAMRNRCRRRTNVGKVLLVPGPENGELWASGCDDPTRPAKGEVGNATFCWTPDLHFSLCHNALPSLHPKCSVVMTRYYAATPCSVLKKT

SEQ ID NO: 995894 - protein, 424 aa, Homo sapiens
VPEPRVPRCHGATREPRVPRVHGSTRRHPGAHAQPIRGCVPGGRQWHMTVRTARVSWGQRHHPGKQGCCCTPVCQCGRVGALTPPLWSRMEANQKAKNDSGEAGDARGLTDCSSPESEVTITRRTVQAQGGHHPGAGPRAKAHQVRWAQRHAKGKATGRHAGTAKRNNPKKQGTSPRTTPYSGDTRARGHDAATRQDHSIGQESGLQKGPHAKRKGGLPATGGMEREHRNGRPPDCQPTALGHDGQLPTEPSMGERGPDTPQHRATATETGAPAQPEQAHPTGGKGHDLRRHRTKQQTRTSDNSQATPKSRQRRTKARGPPARGGKSQPQAPEGAPPTEGAEKPTPGAPPRYTQQTQETNQDNAKLRQQKTSRTAEKNRTLGGNNEKGSQNRSTDRKNRAKNRRTTRKAGRGKTPKAKNEQETQ

SEQ ID NO: 995895 - protein, 171 aa, Homo sapiens
RTRGLGSHVSSASRVHAILLPQRPEYAGIHRCPPPRLLQLRYAKLFGYFLTARLTRRTELPRNQLVYPGETTGVEGLNINNTFSIRVGYKHDLHSRPLTHRQYPNFNRTIVAERTIVYLAEYDITWDYPNHYDTHSSHATRQHYRATPNAQPNIDPAARNQHTQTRTHEHS

SEQ ID NO: 995896 - protein, 165 aa, Homo sapiens
MCQIVVGCVLLHKGIALRWQSMLDEEKWPGVLEQERMAGMIAGQVLILTGGAEPKVNRGKAGVKRSVSWRCYGVLICDFGQYDCNNWDYYGYDSGRYTQERVPPPPAYGSGLYGAHRKRQRVSGNTFTKGEKWFNSKSGPEGILSKSGKVKKEMTFQGIKKDGQI

SEQ ID NO: 995897 - protein, 186 aa, Homo sapiens
MHYITPNIRRQEGHDNPPTPSAPMLRGRSQPHPYKSGVGAHHNLRARSRTPHPNDKRHAAPDGQPNTHDLLEQTMTPTHTPTSTHYARGRTAQTTRRRVGSTSNENNNYTNQGGATVKRTARAAPYASAQTARRAEEPDLRDDTSQREDNTTRSRSATPHSPPAAQPRQQNDKPRTRNERAPSTYA

SEQ ID NO: 995898 - protein, 174 aa, Homo sapiens
GPGVCFLLPSPPNSYTTMRECISIHAGQGVGCLRVAGCLLASSTVLVTLGIQSAMRQNAKVSNDHWVEEHDLPSYYLSSWRRRAWPQPRAPGAVFVRLGGPTSSLDAKFHWHLIASFFHPELGPSQAQEDAVNIYARGQHNDSDWQGDRLTLVLGPELLERLVEHVHRSSSGFR

SEQ ID NO: 995899 - protein, 101 aa, Homo sapiens
TLSILNTVHKKCAYHCAPQENQYQTFLLWRHSDKLDAWVRDAWVQDVDQEFPRSVTGTGLCADKKMWHMSDCCYEEAAVHRCGRENTTEGNDDEQLGATEH

SEQ ID NO: 995900 - protein, 378 aa, Homo sapiens
MAWPWIQLSELQDDLDLDMTPARHLNQLKLDIHRMHKNWALAMQHDMTFPKVKMTSKTQNPTELCHNTLNVGMTTYICTSEPGHHDRWHGGTADAQRYADEQDPSDVITCTDQKLTHSKTHTRYEQHDTDSMRGYLDTHNTPQSEQAPDENTRLHHTTPTQEHQAHHTDTEPQRNNHRPQPPTDRTTQTTLPYNETNKSTRTKIHKESKQYKRDTQATNPEANHQHTVGTNNNNNTATHPHNNHNTPINHKNYTNRNTRDIKTKKHIHMTETSTKKTQRQNTHRHTITTKGTQTKREQNNQRDQHRDTTHTPQHDTTSTAEQTIITHTKKTNQPPHQQTQTNNQPNQITILCKHEQHNHTKQPHHHTNTKPTTPTTQL

SEQ ID NO: 995901 - protein, 116 aa, Homo sapiens
MASPWEALAISLEGEQETIARNSWASEILCRASFFPSGNSRFPDGSTLKYRMTLEDAGGTFPSGSGPGIYSCKTAFPENPKSPFLTPEGNLNSQSRVDKQTLMTEDTCQSLPEGEN

SEQ ID NO: 995902 - protein, 89 aa, Homo sapiens
EPRVPRRAAAACVRRMNAEGAEESAVSDELATAEYGLETVCESGGGSPSRRTLNDAIRDLTPANYYEIDVSNPHDGGGQERACTASPAY

SEQ ID NO: 995903 - protein, 113 aa, Homo sapiens
MTRILCLKLKDLAFSRTRWKACSGVFEDEVNSGVGQDGLAVSSPILKGYLAGYVVGQTEGISSILALLRDLHLGIYAAQAYAVPNVEKTLRDYYAVAYQGARIALGAMEREQE

SEQ ID NO: 995904 - protein, 149 aa, Homo sapiens
AAPTLYRTLDSWTPFMSQTDDERLVSAYDGGYTELLSLIHLCCLPHIVPYNVDSWIPLTSLSFLYLQGRRQDSCTGIQRGQPGNLSVHPLQVMRGVDKESPLWVCVNKGHVSLTVACLTPRDMGVSARSSFTDHLLRRESPFGGQGMVT

SEQ ID NO: 995905 - protein, 73 aa, Homo sapiens
GGMHARIGEGGRLAVWETAITDRARACGVAVSVAAEARIGNRYGAGSTLLLCRRVPQLEWIGNAGQWRVVRLR

SEQ ID NO: 995906 - protein, 232 aa, Homo sapiens
MLARKSESSLDVWLGPSITGRRRTHLGAHPIKALNAGSMNCIETYRMNLCIRYHCSNALYIGNSKWHIGISRDWGHRLSPKEGNQKGVGVLSLPLNLPALHSSCNRKPYVASVASGSYTCTGDPPFPNSPPPLVGKQLRSHANGSLAERVLIAPPPRRALVPIAALKHRSVCASMYPIGTPGKKSSLEMVRAYLSVDNNSVCPRNWGLALPICETRIGRYFAGGLERRGLEP

SEQ ID NO: 995907 - protein, 36 aa, Homo sapiens
MSLSSHDVVKTAVPRYYTTHIGTIRKVVGSWALEGI

SEQ ID NO: 995908 - protein, 81 aa, Homo sapiens
TGVVKTTPKSQIWEMEKTLYQLLSYIGSRRFGQAPPIYLGQYLIYNMRWHLIRQEPIAINCEKEAADDGERVSFKYAWVLD

SEQ ID NO: 995909 - protein, 66 aa, Homo sapiens
PAKLLTEAHPLTTFLVHSQTPSLGEAFSTLCRTVKGVWLCTSRKLLTEGSALCTTLPAYAEVLFMN

SEQ ID NO: 995910 - protein, 112 aa, Homo sapiens
VRGGYGGGGPGYGDHDGGATGGWLLTNYGRRKSLSGSGKVTNGLWEIDYTRKLLIVRSQVERVETLGCVSTVISGGVIRYCDVTCTIMAPGASARAEQDGGVSWRWSVVRTI

SEQ ID NO: 995911 - protein, 149 aa, Homo sapiens
MWKRLWNWVIGRGWNSFEGSEKDRKMWKSLELSRDLLNGFAKNADNDMDNKTQADVVSDGAEELTGNWSKGDSCYVLAKRLAAFCPCPRDVWNFELERDDLGYLAEEISKQQSIQEVTWVLLKAFSFKRKTEDRSSKNLQLECDRKWHF

SEQ ID NO: 995912 - protein, 201 aa, Homo sapiens
LGKGNIIISSFRSVLVSPVRSTTCLVDDQHRPEAAWAEGNIIIEAPHGEVGSYLPGAWKGSVEERARIVEPPIAGGTESRTVYSRGRRDAAGIVLYQVDRGSPKCALSSFLPSSMYQVPVSARCAVASSCSYVLRAQMTQGECSEHIHEAWAVATLTEAPTLSNTSTRITLMMAISRPPLGTVCHSSMGCSEHSDAITQNL

SEQ ID NO: 995913 - protein, 252 aa, Homo sapiens
MGRVRGDLFIGAMKWSARTVGYKAVTFSLYSPCPDLPPSYPCSPTLQEDLSLRGADPKLAKHYYSYGSGQVDSPGLESHSHDTRALMEPWSSQGKDAVIFLNHKTKQVYDGETSNLNTQVTTLCIPLVDPISSDFVDLGTEASQRTQPVWGKGGGKRKTVPGECGWVTPISPKRPDSHGVPGAYQSIALTSTALGRPKDNKCEDNEHSGPKKTRISKRGPEHNPNIKITQQPDQENTSKHTHTKTTHPNLQL

SEQ ID NO: 995914 - protein, 69 aa, Homo sapiens
SVFFVNPLTIGLPVVRHRVRRCRRLQHPDGPLLNAYFNGEESNGNVDETQMAKKFGKKRTARLHNWEMA

SEQ ID NO: 995915 - protein, 213 aa, Homo sapiens
MAFLSQGNTPLVESLNRQSLREIASILKDTRCALAKERCARSRAKCHHKRPNDSIKGRETGTRRILGQKALAKSQGSGRLAPPVEGGAEGDTWSARSAVQDTSCKSKGAQRPWVRQEDAARKLVRIFIVNLWSHQEQDPMRIRSRLGLSHGELKVLCPGKRKLNEGTVHVQRGSKLTVLERNLRQVLQEHARAVDQDGRPGREALRKHFATLL

SEQ ID NO: 995916 - protein, 216 aa, Homo sapiens
VTRGSTHAFGGVDEVNVLVCVEVDDVRRTTTDLSGSQPPKTPIREVSRLTLRAKPSRTRGFFMAASDRETGPGLLSFADGLASNDAQLIRREVLAGHHDAGCRAIHRETNIQTAKGTNGPLDTNSIKGLCDGIHADYSTLDKRTALWPLTWHTPRDSNGNRQHDRCEYRRSARQTDTLLADNGYTYRNTIASGYGHTSVDTQVPRDRSSDPFSRSR

SEQ ID NO: 995917 - protein, 175 aa, Homo sapiens
MQEKKLSDQQPAQTTDNRSTKQRTTNTTHHTTEHTTINRGAQTKHRPARQASRNTKEHSDQPKQRRRDDDEEDQQQQENQQQKTQTKPNTKTQHTARQERTNHHTQHEQGKQAQQAKAKTQQKDKEKQSTQTSEEKRRNPQRNARQQEHEAGNEENTTHDTPLATENRGPTAQHG

SEQ ID NO: 995918 - protein, 172 aa, Homo sapiens
IPNAIQICTESEKHFFTYLLGPVTAASSSSSAYWQNALLEKTLMSPELWHLVHQCYGSELGLTSEDEDYVSPLRAETGLGTPKEVGRCDQHLSDNHTPSGAADRSQEPSHSGFAPRHIVHSPKLIPEPASDRRPWGTGGPTEEQVESQTSASSSTDSEPGWTEDPEPQSPTQ

SEQ ID NO: 995919 - protein, 305 aa, Homo sapiens
LGTRVGHRCRGSGEWGVAASNPAVWLVTLHGVSAPPFDSSCTAHGARLASGAKADPRQKGGRGPQVGACFWTWRSAHCEDGRMELVCRFQNEWGPVVTGEGGQPGLKKHPLLSNSCTARSPGNTCHVDWRRHIALGLEVVDRRPPEMGLWEGTAAGPPASAALSILQCHRVLSGQMPTEQAFLKKGGGLQGPESRHGRGGFGSLCTHLRMEVLVSKCIEHFWLDQLLLGQAGLYPQFPIPRASLPLVTLMLEQQAFSKAQKSEGHRPLVPLGRPESLGLLGALGKSQWPHTSLAVGPAKEFPEGP

SEQ ID NO: 995920 - protein, 70 aa, Homo sapiens
VQQLGGVMEEAEVVDDVVVEDVHIPVTSRPRPAMGGVMEDAEVVAPIFSCMIKIQSCFRLTQNISPVCHL

SEQ ID NO: 995921 - protein, 360 aa, Homo sapiens
MTEELVEAGAKGTGYDTRFYHSPYDRATSSRPLGDLSVRTVNILLTCNYRTARVVFRHESCKGGRIEIVRSTQTNLIANDQTTTPCATNTRKENTNNATPRIGYVTSRVAINSSKLGSHDLCMRVVIHTSGYREGLAMGPVHYVAYRESNEIRNNTSTSTPDPFHIGKPAEREGAVEENPIYIVEQNNHKCLEIIIRADTPDKVYTTELDSVAQEGTDRGQLTIVHPRIMPVRHLQQNVPGENNTNEQPQIIGRTHTTKGHTWGRMQAPNCNDSKKGAEYTHRGYEHTNELTETRPKTNHDPTTEPYTESLTTTQTATHETTPRDVNTQENTQHYYHTRGTTPSYAITADTTHRTGHELT

SEQ ID NO: 995922 - protein, 60 aa, Homo sapiens
MLSPGLAPLAPWDYSTKTLSQGPALDPPTTCGGGHEDEDCQGRLPTMGGPPREPRGQPEH

SEQ ID NO: 995923 - protein, 89 aa, Homo sapiens
VDSRDRRILNDVQDASPSMIMFTKLITIFYNLNVYKIQVPYVTRNESIGTSRTMYSRWYIPQNGMRLLDLVNCDKLITVHREIRYLKKK

SEQ ID NO: 995924 - protein, 75 aa, Homo sapiens
GRIDMIDVIGVTKGKRLPRGHQSLAHHRSMPRQRPTGRPAQCGRYWGYGILARVSLSLVDNAAWGHERAYLVSRH

SEQ ID NO: 995925 - protein, 219 aa, Homo sapiens
DSYLVGDGKRDPVSAPVAFCLLTPYTTMSLSASRITRRAALVSRLTLPAGSSTALCNTVIPSPMATYAECEQRRICGRARMTCPFIAPFLQCDDGATGRIHGAPGAVLCKLGAQSQLMKFARGSLPVSIIRTREAASITGEEECLSDNYARGYYTDLSKEDSLTCVYGPEISQWLAEPRSNQGTSVAYPMSSAELRVGVNLGVVGVSPSLTRGKRSSHV

SEQ ID NO: 995926 - protein, 130 aa, Homo sapiens
PSCCLSSPWFLGGLLFFFYTSMGLLNFIWGEKYTFEQEYTMGKKRSHTPFRVQRVLYFYSLLRVSVNTKTAVCVWTHLNTPHARGPLCVGKKKRKTHAVALPFLPPLVAVRNAVRERGRYKRAPCVWSRY

SEQ ID NO: 995927 - protein, 235 aa, Homo sapiens
MKEETKRGEAQAEQESTRRAKGDKKETEDIAKRKQDREEQAGNAGQERAEQQKEAENTTRTTTHTPHEEQTTEEESNRRNPEEEDKPDHEPEARNHREQETHKDGDSAPANRRKTEEEDERKQEEHRTTKNQRENGDVTQQEQQKKTQNQNKTQHRKDDTKRRPRNKKRRAQERKENNSQAKSDKKEAQTKQHKGQDSKESAEPTDGTRMSETEDKRKQSQSKQRTQETHKAHRT

SEQ ID NO: 995928 - protein, 152 aa, Homo sapiens
MAAIAASEVLVAQRADGGVPRLRRRSWPLEKLRYRDCAYSGSCTCCGMNARKFNHQEVVEDDTQTMITCQMCAKPKTARLEWALVGRGHEHGNVLAEENDYETVNSMHDQCMNDAEQDGRAKKKRKNPDLGFSDYAAAQLRQYHRLTKQIKL

SEQ ID NO: 995929 - protein, 270 aa, Homo sapiens
MAALRAYVLASGVVAVQVLRPGAGVRLPIQPSSRCSVQWPASMWEWAQQLGGASYVPRAKETVHCEASDLGMYVDRSEEDTIVKNITRDFGPQRPQLEHGVLRTSGWEWSCGKNAANSVDPHYQECSVPPERHCSNLILNKEPNLQAAYSTLDRLDYVSMMCHELGAYIIACGESLLNHPDSVLGAQLDPRVLYWTTLHTVGRTHIQWPVTHTTALDHLGPHDTRFTSGLLVTETGRPMVRRFYEPEMSGAQHMLPRYIRPGGNAPGTNP

SEQ ID NO: 995930 - protein, 474 aa, Homo sapiens
KDRRRDYEARLARPHPDLDPTVPTPDTAGTDMYQGDAIIFNNHGKPRLSKILPALQMKIHNSKSSGRIYHLVSNARLKTVLELYHTNAPHSLTLCDATLTNTTCTPPTTHLHDNRITTSRYIYCDENSFKDNHDPSRATTLSNHKLYNDNPCSRQHKSNHTQSSLDKNVMSALRLPDYIHTANHPTRYQHTYSLRQTTPADPPSAKQRNYGNHPTLMTPCTTPTTPPPNRTRPHTTKRPRNNNPATRHGTITTKHTSKDTDDRTLQPDTHHTLPTPTRRNTHNKNNKHPARTHQEYKRSTKQEHHQEHNYPHQTPHEPKQQDKKTKTPTQINHKNKPTPKTNQNTAEPQPLPKRPSPITTTPNKHKLSQKTNKNDRHRSRTNKSHHPTTPPSTKPTLHALTHPPPHQLNAHTTTNDTKHHLNNPRHTKAPTPHNTTIPPNTTRHHKNTHAHDTTHRKHTHIQSHTNKHTTTPTP

SEQ ID NO: 995931 - protein, 313 aa, Homo sapiens
CADTEGCRELLKRVDLATVPRRHRYKKKWAATEPKFPAVRLALQNFDMTYSVQFGDLLAINPCQSPLRAEVWCTGVNNLASPWDHVDVLGWSELQCQGFVNEAISHGDTCSREGWPLVQPISCASGACSPEPSMLHFWTRGGISRRFPPVPDLAAWVSWSTTLMDAASLLPVLAPRLQPGDIVLDLCAAPGGQKLAVVQTGCCCNLAAMISPRSRNRPRPNRKDSFHTANGGLEEDSARGESPKLRVTLHRGLAGTVGEERGGGNLMKRGAGDLAWIQKRDLSYEGGTHSIGTGRRRTISVAKIWKATVTKRR

SEQ ID NO: 995932 - protein, 153 aa, Homo sapiens
MNRRTGAEHPTHRQHRQQNTRPKTPQRRRGTEGRAQHQKCEPTNGCAAKDGKHHAEQNQRKMTSGGRRARPTEGSIRARRAQKDEKRHNSTTKKERRKKATKTGRKRRADDKKEARDQDSHTHKRRPNNRRNDNESHNNSTAKHRIQTKKQQD

SEQ ID NO: 995933 - protein, 124 aa, Homo sapiens
MMDTPAKPPADDHAHQAHQPMDMDTRTPHARHVRHSTPQRNENNAPPPHGTHQALEPPQAAHQNGASKHQHPKQERPSHNPTQPPHTHEHHMKKKPRNTRKAQKQDKPRKEQKHNNTQHTIQQA

SEQ ID NO: 995934 - protein, 464 aa, Homo sapiens
QSCLISCSTLEDFTLREKPYECKECGKASQLLAHTLFSTQSASILEEKPYELEGMWQSLLLARHQLYRTSTRASYCARRNPYEPCPATLPRQALHATARNILHHSHSDNTSLPDRYQPLMHLAHRTRSAPDLHTLPQPSAHPSSPHTSAPQLPITSRKTKPPPALSSTAQPPAHKRPLQAHTLRPPLTPLTTTPTSNRTLPAHLRATQTPPPLQLPTPTTLPPTRPHTHAPHPDPTPNSGTLTHLLPPPAPHHTLCAPRYHAHARHRPPPAPLTPTPSTCPTSATNPPAQAHPTTPAPHPRQKTPRQPRTPPTPRAFRAPHPDPTPPPRRPEAPPPPPTRPTPTHRTPPPDHSTPRHHPRAAPRPRQPPPTPPTTLPPSHTTGHHTAPRHHPPGAHPTRSAPHRAHHRQNHQPHPHAAPRSPHPPHQPRHTPRRTTRSDAADESAPTPPAPHMPPPHSPANAAR

SEQ ID NO: 995935 - protein, 132 aa, Homo sapiens
MASTNYSQAGTEIGLRESRQWDTTVTPPGQRRVPRRRNSSQGARIPPSAWGIVMGTYVAAQVNMPVKPPRKSETALNLASRGSGDTPEASATGQWTQTKRRGVNQHVRSEVPHEGRRDIGRSTGVERQTRMQ

SEQ ID NO: 995936 - protein, 132 aa, Homo sapiens
GKGRRVEQELCASSSAVQNRPLDLLHKMEIIELQADYAGSHVSMDAALGSAGLLYFRIQRTRGALDDRPASSMQGVWTSETLRQSIPKVHAIPGGLQTTISGLHVISILAQGYCPSLLHTGSADHKRTNCDE

SEQ ID NO: 995937 - protein, 103 aa, Homo sapiens
MIQKSGPSLLQAQDVGDTVGKRLCNHPVIRAFLCGSISGSLLYPRFSNLWISLKHAMESSSPQIMGLEVSRCGCTLEGGSRGGVFGPLERDVPFDVEMCPWRL

SEQ ID NO: 995938 - protein, 357 aa, Homo sapiens
CWPRRLVSSSRVWSRDWSCMARSTPSDLMSLAPGPSAPPASLSQRCPLLSGRAPLAPYLALCPPQTRSPPIMEPGSGGGGGGGGSSSGSSSSDSAPDCWDQADMEAPGPGPSGGGGFPGGGGEAQREKLSAAYSRQTQRQRQALYVPNGPTPPEYVHDTFPAGARQAPAPPRTRGRRQITHGKPRQPGRGGRAANLRELLHKEGPAMRRRGHNTGSSDGNLGSNPIDDWERPEVSPEEVMRAQEELQWRPNQGGMLLGQKEGRQSTVPSDMRREEARQQSTLVNASKGPKDRTWMLHAGRKSTHMWAKTRPTAANTYDEGEVRSGKAADEGPQTRKQESKHSHSNVHQSTEETRIRV

SEQ ID NO: 995939 - protein, 36 aa, Homo sapiens
FIHFDERDGAVKAMEEMNGKDLEGENIEIVFAKPPD

SEQ ID NO: 995940 - protein, 328 aa, Homo sapiens
MHCARAFLSASYSTATLQWLSGTLHYTSAKLLYPKLYCTDCAEQTQQAPGLRLSASCPQQPSTQHNTLLPAYSLTASCLNTNSGLGSLYTLTDNSATAASPQHYNYAPTHEELICACNFPKLSTFCPRHLSHNAYFHRKPHALQCHRLHLNFLQHCAHQRQNLHTHTLSASSGSHYYFVSLPPNSLHTVVNKTRFKLPTTHTRNNQPFRSTTHGLLSKPLRKAKVNHHNTHWPVHTLSPPAAHTLQQPPPATTHTRKRLASLPSKGKRKHGKNDTFHYQRQFPNRANFNPWPPTKSHFSPGISSLRARLSPRHLGDTAQLAEILRDRA

SEQ ID NO: 995941 - protein, 236 aa, Homo sapiens
SHVHSEDHSGVLAASNIIKKVTSVGDDERPVVFWHGYGDSYNSTAMQHVIGIVRETKPDSYTYSIKLDDDDSKDQRLSMFSDVNMDIDYVCKQLREVDSLANGFDMIGFSQGGLFARAAVERCALPVHTLITFGSPHSGISDLPKCSPNDWLCKKKNDALTKPGNIWRDWVQNTIVPAQYFRRRDDYYEYLEKSAFLADVNNERENKQQLYKDQFGFLERLVLIQFEQDQTVCAQM

SEQ ID NO: 995942 - protein, 170 aa, Homo sapiens
MGTNQTELHREHIDSDERGNHIIELRYGPRRTTRDLEHDPAFTPRGKITSNTYHTIKLGTHQLSATRRGKTTRIHDWQCHEKPKKGTIINTEGYNISRKTVEPMEKGTSNPIRIRANNIPTSPIEEIKGGRPNRYTQKGAPKGEHPEVNNLQQTQNESSTEQGTKTTDNL

SEQ ID NO: 995943 - protein, 89 aa, Homo sapiens
MNGAGSDKQTSRRGPPHHISTHHNRRTPTANPDKRTTKDKKGRREWQTRQPTTKERHKKHRQEDRKEEQPTTHNTVEQNNSNTRKKNTK

SEQ ID NO: 995944 - protein, 135 aa, Homo sapiens
MSHCGPGLYSVYSSRYNLWQFTPQMCLGHDIEKKCVACAIEIHLCVSRAPNMWAYKSTINYPLLETVWAGISTVALPFHPSVRESARERGFTPRKLPKDDGGPLVKTGYNGGPDIPRGNRGISNKGGTHRPGGEK

SEQ ID NO: 995945 - protein, 106 aa, Homo sapiens
GGSESWREVKGTSYMAARENEEEAKVETPDKPSDLVKLIHYHKNSMGKTGPHDSITSPWVSPTTRGNSGRYNFKLRFGWGHSQTISFYPWPLQISCPHYSEPIMPS

SEQ ID NO: 995946 - protein, 70 aa, Homo sapiens
HDISMNVGVDSDERSCLLCLHAHDGPYHGVSGVTVDMLRVTRWSVPHVTSRVASYEESASTVASVDDCGP

SEQ ID NO: 995947 - protein, 84 aa, Homo sapiens
HWNWMVSIMDSTEAQLRYGSRISQSAGGSCDIQDHPLHASQNSARRERMTAREEASLRTLWKADDGADLAERPSRNDVCDEETS

SEQ ID NO: 995948 - protein, 135 aa, Homo sapiens
MSNVGLSLRKCGALSKLLITTVIVRTFIDFRNVTQEEPGGRMKREQECNIRCTWRARSDTGETSGPPEQDFPSDRLGGDLVQIVQVTGMFGGDIRSAGLLSRVQKNLVTFASHLITSQYGVSMLDKDIVTVQDAL

SEQ ID NO: 995949 - protein, 93 aa, Homo sapiens
GLTLNSGCRETYPVKKSTTGKAKDLSSPMVVIATRRYGGTYSMTGRLIYLMLRPRRLTHRKLRERDGCCNMGLGLHSKLLPHVRLYVPYCAKH

SEQ ID NO: 995950 - protein, 154 aa, Homo sapiens
AEIKMILQARICSEGTKKSVWFHLFGRYAIHVGPQGILCELDFMYGSLYTATYLVAKTQARLQESSLSGLVSPLDGESDATISRYIYRLVGDKTKYEVRTGCKKVVEFSLDASKWGLESLWSMPRDGFVRLYQGRNEVSFASHIRQVNPMWMEN

SEQ ID NO: 995951 - protein, 228 aa, Homo sapiens
MVVGRLPEPLRGLAVLTPDLVGVDAGMDKQSIVQKLLRGSSATGLERSSASAPSDAQHLSKQKKNVKQEVRTDEKKWINLQDLLTRSGKEVEENHSDEFYKIHSPVRIIGCVEDEVLLQKLREESNELAYRYEEIGSRTGYDELTELTELMVEAGANTQMTTYDREEATDSFSDTFLKVVRRLGAKVQRFSQRRSLAKTPSIQHSYWKTRHHAVLLCPDDKLGSSNKN

SEQ ID NO: 995952 - protein, 130 aa, Homo sapiens
MESAGHELEETVVRDKADESSYTGTRSSTQSNSPSDLEAHLCAASEASGGSGDVVAPPRTSAMRSLTPLQYPRVSRAVKAGTFDSYFRNLCSDDNPMVRRAAASKLGELAKVLELDNLKSEIIPMFSNWL

SEQ ID NO: 995953 - protein, 432 aa, Homo sapiens
MVTTGSPRSHRWKALEGISMCTGSYEAFWQSCSLRNSVGQTRSITVQELDVHRWPQVIWGQHNQTQHDRELTYLSNAPKDWAKDVLDETRSKEREDLEATPSAATHEQPQPETTTQHGAAPDDPTQPPPGPRYRRGTQSRPVKKKPSATQARKGTSKKKNKPKTRKKNNIRKTTRHRKKKDRKNTQTKTREKQHRTSTTKGSNPMKRTDTQTTHTPESKTTRKSHAAQTETRKKQTQRKKTKTKQTKNNNNQTAETDRSTRPRRREKQQKRDRQQPAAKTEPETENDRQPTQKEPQEQTRATDSNRERRRSDTEQSQSSKQKTETEGQGEQAEKDTDKNKERRKARHSEKKTTHRTTKRRITRKQQTNKKRKTETTDKTTTKDETRHKDKQNHKTTARSTERQKTDRHNATARNSTTTERKDRRLRGRYSYH

SEQ ID NO: 995954 - protein, 75 aa, Homo sapiens
QASGPGAVPAGVVEAPRGGAKVPTLVHASLHALMRHQLALRERVAHGPVILTLWEAEAVGLVELKSYEMSLGKHW

SEQ ID NO: 995955 - protein, 133 aa, Homo sapiens
MPKMGASALCDRYRLAYGMGGSYLIRSCDVGERLVRRTDSMSDAVSDVRTDHEVIMLMYCEATGKKSSAQFVDMHSYDSEREEWGELLSRSCGYEAGNSGMVLIVRKGQLVLEEIKGWWSVRLSLDMDKDVDN

SEQ ID NO: 995956 - protein, 171 aa, Homo sapiens
MHSVCCVVRHSTHAVYAAWRHTHDMLAHHSLRRDSIVAWYEPLLCVDSTMSVWYECTHVHICCPAYTRTHCMHDMLPGRHTFRTAHASHRCIYAAWIARRLTCFWEGVRVNACSTVLSLLRAHTLDEEDVIACLHPISSPPKSWPGPRVQHALQVTRDYNSSDVIVPHWGI

SEQ ID NO: 995957 - protein, 194 aa, Homo sapiens
MGWTLARAQGVGGGMWMGFCGAIVSQRKIPLIRSTHNSGLKIAVHQDENSPMYSKFIGRATVEYQLTAPRAQRNSSFDRQGVVNSSCRGEAVEKGLGFAFSSLLQVICGMERCEVGPHNVIASKVYQRVSTRYCTGWLYGRFQSLICVDLDGSPEKCGIIFANSTWSLGAIPPVDDGLSRWAGHTIEGLLVKYF

SEQ ID NO: 995958 - protein, 187 aa, Homo sapiens
MTRILPDSTATGTTAAMSSRKLSGPKGRRAQHTRRDLERGFGSAPSRSHVTMLQREATRNRQSLDIVCYMGLPMSVCRGSFVTGLCQVSGICPISRFVSTKSSAALDLVVGTGGNKGGVNHLPEALWLLCHVSSICHHAFPTFPTGYQRLEHFDRILEMQNCEGRDIPNILDIDLIIWFGDMNFRIE

SEQ ID NO: 995959 - protein, 177 aa, Homo sapiens
MRSTDLYPRPSHTPIGSLCPVEVPFAHSIPVIQASSQGWPRVLQVVQEKCSALLRHQSDMSPGESGRSVSCMLFSLSLWDVVSGSSMKTLEKAHGCRGGIRRAEPCPKDNWLAEARRDNSLIRDATNLSQLAIGKGGAKATAKVTKLLDVDDLGHRFSVNSVKQQSFATPPLDSYAL

SEQ ID NO: 995960 - protein, 317 aa, Homo sapiens
MHRDHPQILCGHKEGTTNKAGRENIKTAHEDRGHERYNKTKGRGNRATTTRVSKHARTHLRREEKPKTTSEARGDRHKRGRNQQQHPPTNKQNTKPPKSRKKKHHKPPQKEEKKGGKTHKKGKINNSRRQQKRTDNNSDETTPHNTTTSTPPRGNPRRKTHPDRQHGTEPLKTHQHRTNRQPHTQRQNEAKKARRPDTTATTTTSENAHNRKQATDKAKQREKARREKQKRSGERTRRQKEERGGERGRKTQTTGEETGEEERDERKERGEARDTGGSVERKSRGEGEESGKKRKKKQGEEEETQKKENEEREKRGE

SEQ ID NO: 995961 - protein, 57 aa, Homo sapiens
MTTVHATAEWLASRFPMAPYSAGATRNETTVRGGKGPEHPQTDNRDKKRAVLQVNMP

SEQ ID NO: 995962 - protein, 422 aa, Homo sapiens
IASRPGPRRGEEGRVDRWMDDVHWELTGYHEQLTIHGKDHESVFTVSHVGLRPRSSGVTIRGIDIPVAASEHQILTDISRGTHTSMGNKSFAKLENQPQTLTQRRCCGIVWLEFSIKITRLAHKGLYCTSSIYCGKAPALSSKDLCRVPPVTEIQRAQFSYYSIYVNLLLHQTNASLLRPVENYVPPQCGKIIHARTAADRPKARLHTRDKLTTRTLTKETEQQQQTHSPHQQDTHLHNRHRPRRTGLQTKTQEPAHGDREYRGTKLATPRIAQRQIGQTPSHTQEHHTATKQGNRHKHRTRQQPHNSPHAPNQPTRRTKRTRTAHSTRTQAPHQQTTNSATTYAQKYTTSTEHTDTPRPTPTPTTTHSATLVISHNRNITTTHTPIHDPSLPAETTKEVQYNLLHLDHNTDQHTQLTQQNP

SEQ ID NO: 995963 - protein, 261 aa, Homo sapiens
MTASSKQKGTKEKQQNNTTQQQQQPHAKQKRQNNNRDSSATKEHNNITDERKRQTSQNKNTTRSENKDDAPKKHMKKRQQATTDTHTNTERPRHSEEQTHTPRRTTGADTRKQRRAPPDTNRTKHERQSRRRTNNERKQADQHTQRPDKHTRSNTRDTGRTPDRTVGANTRLATRAAQQQKTQTQTHEQREHDQNTDQERDEAEQDNTQNRDSNAQTTSIENRQRGGEKLAAPEATRQARSRHAAEYSQTTRLEQHTPAEE

SEQ ID NO: 995964 - protein, 289 aa, Homo sapiens
GTEFNSVASSGVEWCGLVCGVRRSSRPVGAGVVSRVKTWRTDGHGKYVDPSICGDELECVYQRIECKLWTFVSKTISHQPGVFHNGGEVSVCQKVTVQEEVTLRSYNFWRYHGPGRQPTFGDLHQTELGPSGAGCHVGINQNGTGKSVQEASSSSSGPIRISLKRTDVKSQDVAYPRRQKPGSKSYVDRHHGILESSQKFRVRTQLHGVNTNVAGQPQNQGNPQQKVDTQTRPARQHSPDEEWPRASHRGNPQQLSHEESRPGQAPEEREDHTKGTNGPKKPRPRSGRK

SEQ ID NO: 995965 - protein, 75 aa, Homo sapiens
LKGKMGKEKNSYQQLSSMDTLDSGKSTDYWPSDHIICGGIDKRTIEKFEKEAAEDGKRAPSSMPGSWYKAEIADA

SEQ ID NO: 995966 - protein, 253 aa, Homo sapiens
MNACVDCTGPGSYARSRSRTQRLSYCVTSDGLLRYLASDFKVQSSTIHVGTLTNMTNSGSHEGEIAAQLLGWCRSFHNSVDSTDHHDVPLPSTLGQLLRQHVSRGYPDVLCKPINMSTNAQLLDTFHTIYNRRTGPAHRQHCQHNRVRKSRKSRSERQKRKVQNDNPRDTRSRGGHPERPMKHTAQHASRTPERYDNSQKEKSRQGQATQPRHKTKQRTRQRAEHAPTDTKGSRAHKTTKLSKQNKRKQPTHS

SEQ ID NO: 995967 - protein, 286 aa, Homo sapiens
EGPVPPSPVRHVSPSVRFAEACVQTGAGLDVIMEALRSYNQEHSQSFTFDDAHSEEDLEETWRMLLDLLSWNRACLASPSVIIWLRDVVPEIPVLRGDPDRMTLASPVASKLALRCLGRGDWLWLMTWSESSVLPRKCVPDPRGWSCQATNGECLVTWGRSPYDTMGPCRLEPSVSVKQGPIVLRYQDLRGDQARMRPRPVVGLHSAPPGCPMLRGTWLPGMKGRRAFALNGVFPCYGVGPLPGLPCIPWLTPGDFADNLQCCRPRQRLILKGTPWEMGRWAGHFA

SEQ ID NO: 995968 - protein, 67 aa, Homo sapiens
PMFCTGCIQLEDVPDSAGLRLNRDDQQSPRAPGLLLQHCKDTLSVPISRGITLNGAIYKTARSCFFF

SEQ ID NO: 995969 - protein, 177 aa, Homo sapiens
MYVAIQVCCCPSTPLGRTTGIVMDLDDGVTHTVPIYEGYALPRAYPASGPGWRDLTEYSMKILTELRLLLSITASGKIVRDIKEEAVRRLPGVRAGDGHRVISSLWRKYELPMAGLTMDARSGSEGVHSSVELGTRHLILYVWTETSTGLGPFGWRKDPGKKIATHGGRPYSIKTHR

SEQ ID NO: 995970 - protein, 136 aa, Homo sapiens
MGSGRKLKVALASWSWGPRKTAQPINYYGSYSKSETRRDHGAKQYHIVTGATGQPQETTNKNTQERTQKRETPTDTKDRHKKTPHEKQKTKEERSKEKKKDNKTTENKEKQSNAKKEKQQRRNTKSKQEKQQHVNK

SEQ ID NO: 995971 - protein, 85 aa, Homo sapiens
DATDNELLALLRGGNMAVMSTYNMSYKKIIYKLNDVVISIPLPSGVGAPVIGEIDGEYLHDSRRKYPGVVPAVIDAKNKSGRLEC

SEQ ID NO: 995972 - protein, 84 aa, Homo sapiens
LERMRRRAQLAGSAAGAEVQLVLPPCTPPLGARTSWSTRIRTNYRNLTYIMHNTYQRNNKKTQSNRHRHNTHNPSGFITQRHTS

SEQ ID NO: 995973 - protein, 225 aa, Homo sapiens
TRGGVDVGDVDATAAEKLIVGVDEKLNPEDIKKTPVVHAPEDKKEILASFISGLIQFLQRTCYFTRTIENLIPQLLVTEQIGDLCPYDKAAKEWTANMPEHTISAKVKMEDDTQRFPILTPFREPGQALVRAEKSPNQYDKKHIRNCPQKDGWAKACTTHWKPYGLAKHAPNRVEAKFLGKTQIGMSAPCMPHREPPIHLTHRTDLQAQVITTISMLGNPKRRAM

SEQ ID NO: 995974 - protein, 115 aa, Homo sapiens
MSYPPRLTHRMLACTNVAVLNAHLLSVTLPHVESIQAMNGHMIVGGAERMTPVRAHQCDPHMHHNSDSIRMNCGITRCGLACTMYVVLLYLVNPHFYDIIHFNIAKSVWVIASQC

SEQ ID NO: 995975 - protein, 60 aa, Homo sapiens
MFGIQIVGRLSSDDTKFREAEMPSSVLKIIWRMDAMRFYPLLAAAAGGLGCVGPVWVLGA

SEQ ID NO: 995976 - protein, 247 aa, Homo sapiens
MRHAGRLQGPPRNLMVCSNLYVFGGAHTAFCCPEKGNRVLITPDTMETLQASKIAYPTITSFKSSGMCHKVSSSPNLRWNESSTSPMGCPEHPEKWIPNGPYTIQPGIPRMSASHEWTYRPHRRRRERAHLAPPEGDPGSDSVGEQTSPQGKGDHRRMSPPLAGRQPVHSHRTETNDQESTAGTNKSGTLRTRIARTGRSEADKPHEKEGQNRPVGKRTTRHKARPVSTDTANDGTDDRSDAAATRT

SEQ ID NO: 995977 - protein, 121 aa, Homo sapiens
MAVARGNTGATVDNQRKLNEDDLYPTSNDVLNEEGQHLGRTGASVQGHRALMRQDRALRSSRCLETSLAMIDGNAESRNKVLETDKSSFKNLKNSSTIIICGTKCVRCNTCDTLGLSPVGF

SEQ ID NO: 995978 - protein, 348 aa, Homo sapiens
NKLRREGSEEGMYVLRCDLYRFDNDPHDRRPCLEKSEQVQGAQEAVQELSDLRCRMGRYRSGIGSGTWRLPRAWENYMSHLKKQILRTDNISFMLKADCQPKPREISNLLVATKKAQEWQAVYPDEPAEIIDRILKKDLVQGEHLGERHENNIYSGTLMDYKDDEGTSEEKKITVIVKVLDPRPQAYFPGLTQRQPDDENRSPKNTSSTSYGVMESRRTEDNIMEGSSKVEQGGPNEIPNQCNQAKDEDQYPNTMRKHTERPKTGMATSDPRRHNSDRSNTSTAKDQRAEKWPENTHTKRPTHIGHQKTGDNKRNSNKQRAHMRRQERTEEPTREAPPIRRESQQRDD

SEQ ID NO: 995979 - protein, 252 aa, Homo sapiens
THASVDPRRPELVRRQRNGAIAVARAVPPRGLSESRYDDASYDVHMNAFYHRVDYPALHKDGAAGEAIKPRERRGEGLSSLYRAYLGQQRKFGVVLGGDQAAPRAPELLGRAHVGLTTVVPREVGGTSVDGPRLEPEEMMQGRVDRDTRNMLPAQMVQLTSRYLSTIAVARNCTDLMTVAACMEGVDKTMVDGIRPTDKLRGIPCLYRTGTVVRRSAREEVAVRECMERRTRDAYPYNPELDDCLGSRRGHG

SEQ ID NO: 995980 - protein, 173 aa, Homo sapiens
MEAQVNLERKEDVTQKRIAKRRSPPADAIPNSRNGEGPHAGPTGENPAGADTRAGPHVGQLGPGENVMERKEAGPVSKPEAVCRPEAGGMHTVCLKAKSGPRVYYHSGGNDEGCPGKGRHQWRASGRMVPGEKLELPTRRGVPTVVPPGRPFTAGSLTDEWAGLTLGLLPGTH

SEQ ID NO: 995981 - protein, 326 aa, Homo sapiens
ALELACSEPGTPGPPASRWDWGCVSRPGVGLLGHSDLKDGRARPVRTWLSSLETGQRPRSETPCLPAGPVLRSGSQENSLGCPRPERPRQHHALHSMELPQAFQTAMDQGSCNGKIMMERERKRQEDRRGGYAGWNRSMKDEQESKADRRQMAQSSNVISEETKAENSEVRKAASVQAHTRKGEATRLIRLRARSTRFTHGRHSTKPEAGEGTQEVEPDAPVDNRGMAITQTQKPDVDTNNRGKTSIYRTSNCKGEGPWKRNTHNLGTHSGNTTNQNEDKSRENDRQANDTPKKIAYWGTPPERRRTLNEKTHQRHDINQFEVHST

SEQ ID NO: 995982 - protein, 78 aa, Homo sapiens
MDVAPTVAARRKDQQQQVKTAYKTQQHTSSTTVASTPARTSKQPRQKTRRRDDRKQETTPTTNNKSNNKHNRDETNSR

SEQ ID NO: 995983 - protein, 178 aa, Homo sapiens
MLYEADETPTRGEGGRKEKTAGEEQHKTRTKNKKKKRNETRTTKKTKTKHRETQKEGATHNKTEPKKTGGGRTRKTEGAENEDKTDLGRKKKYIPPGDKRRKTTQNTKRKKKRNTQQHKDHNPNNQTHRSKGSGESGRRASEGGKKSRRARRGRGAGATGEKKKKKTATTPENTAKHK

SEQ ID NO: 995984 - protein, 107 aa, Homo sapiens
LKCWDYRHEPLHLAGYSLFTDNYEQPSQRMNNRTNGMHVWRVVATSVKREILRLRLEYAAVVPSSSGARAYCDTKERVRIRQLVEQEEHRRQATYGIQVLQDPTVKN

SEQ ID NO: 995985 - protein, 67 aa, Homo sapiens
NEKGGGRSRRLAIADCHYPLLLCLQPTSDVLPVIPLGSRHYGVLSSTGAVMLLVPSQNASVLLCKDI

SEQ ID NO: 995986 - protein, 105 aa, Homo sapiens
MKGTLGQGGSSQVISTVIQSTGSGGQWMTAPGRGFHYRQQLGRLDMEIRAADVIKQYTQQTATRGLTSKMKRVHPRVATDDIQHHRGLEPYEQKDSQPDKSKQPS

SEQ ID NO: 995987 - protein, 158 aa, Homo sapiens
MRKHGRTYVSPPPGDEKDQQITPGGEKHQGAKGPTAPPEGGQHSTAKPTKTLGGRTITHGAPIREAITQRSYTHRPHTFVVTKRGGANTPTELSETKNSGGPIDTRRTHKIERTGHTNNESETPQEEKANRHKYHSSTSKETKWSTPQKAVSTGDKRI

SEQ ID NO: 995988 - protein, 482 aa, Homo sapiens
VQGVGQCWRSKKRVAGDLKACEVVVSEDSSVQARDGCVPMDRREMSCVADLSTRYEGVAALYLTCITSFCVPASSLCIYTIVSLCTIMSDVTGGESTGLMHVDHGSMRRTRTLEDLRYAVDIVRSAVPYRHSIGAKLPRGGPCRKLHIGNVGQFVIWRRWVGQPIKQTQGRDLPANAQGDYTHFDLGGPQGELSNSGSGHCRLRHGEALRIERRTPGWSDTVALWDVRPMHLVRGKGHAEKGPLIPRLSMVNPLARIGGKKNGETFQSIELGITQQFVGNFQEGKGVKEGKQTWGVGKGGEVPLSQTIGAMNLNRAVETFCISGGSPGVKEALARRNALNLRGEGGRRKDWHPCGGSRHGRKSLTHRKGSNHIYIDDTLEKGVPQPTGEARFEAVHQNGTGLEKARGFNSCQQKVGGSTQSKGGLNRAITAMQRTLGHAGTRTWHTLLAIVRTQSEGDNSSVRGERIGRLKPTRNPRSNRYL

SEQ ID NO: 995989 - protein, 149 aa, Homo sapiens
MREIVHIQAGQCGNQIGAKFWEVISDEHGSRLPGPVTYARWDMLDRSPTSWSRISDVLQMNANRCQEYCVLDATPWWNHKNTVDHRHSVRSGHFLARSLEPENSGIWSVWAQVNNVGQEASSTEGADLVDSVLVCGTGRRRDKPVYVPC

SEQ ID NO: 995990 - protein, 107 aa, Homo sapiens
PGLSEAHNPAGHCERYASVGRATRFQPCALAPERPLETPGFIHIHTSHTCCQHRANTNLTRFGVMGAAKVTLGPGAPWGPGLPLTGLAPPGPRISATVSLCDLSHGS

SEQ ID NO: 995991 - protein, 301 aa, Homo sapiens
GTELKDWDLKPHVPAAIPPSLCPPLGPKTLHPTILGSLSVKANGASARSRIRPERKRADSQETSPALNLCQSTPTHFDAAEQTVTCWVAASSGGDYTKKEVKLRGPCADEIAGFASKPFAVRQADPGPPRPHRIIPHTKGTNCGIADEGLRYPIGTEEDDSGDRDAKQDRAEKGREDDQTRARPTRNELTKDQRPAHEQRPRDSEATRTAQELRPGHDTRPAPKTRGHPLVAMGPTEGSNKDKTPYRKGEDNEKNPTLTQATQDSGEPSTQYGQHHKDKLHTTPGRPHEGNNELHTQHPLT

SEQ ID NO: 995992 - protein, 462 aa, Homo sapiens
LLSSIFFFSSSSSGSSRPSLVTREQALPKEGLELTEDEAEKQQDGSTSTAKPAQPTYVTSVTDRTRRQATATKRDHSHHSKTRSPHTRTPLPTQDNYRAPPATNGSAIQEQPQRNFSENTHHRSSLYECDEKDQHGRINTLDPSTNIEGRRIRRQKGLSRPETTDNTAQRDTEQHAHPRGRAAHSPATSKQPRAPRQDTNQRGEHKHTTMSHSRPHQHAHAGAQPSHDSSNIRHIETTKHYKTNQQAIRVKAQEHTGKSAHDSGPRHTATAKEPNKRRLQQHTHSTRASNDTTHTENRDDPTQTHRTISRDIRTPRAADNTHTAKGYTTTTNQTQTPTNPDAWNPKGHNQQTTKQESKPPHSTSHNNTRPTHIRVPHTIAKAAQDSQTTPHQRTTSHKQAQRQTELGQQHSQRKTTHTPNTTNKRLRQPNHHRQNRQRRMPHKTETPHTRTANTTPTDTRDN

SEQ ID NO: 995993 - protein, 352 aa, Homo sapiens
GGEEEEEEEEGDGEEEDGDEETPLLNGQCSMQAKWGSRRLDNAGQHDSKRQARWVQASRQAGKQARCMVQASRMEHEDEEAEIRLRSKTGRLTDDSVMHDVRYQASTTDRPRTELRQTQTRTNVNTKKKHKAADDHIQPIHIPDNQKSKPWITLRDSTRPDPNHQWANANRQMTTRIIQQTKAKNENWQQGAGNKRTNNIQRTHANTTTQATQQQGTLGEANNIINHHTTSTEKHMAHGPRPHKTQPENDKQQNLRKQTKEPNQRHKNEQTTQCPLTNPHNGENHQRWTKHKGQKMKHTETPNLSTKRQLQEKSNRTNAPETEPNKETETTNAERATGRHKHRDRTRNTREQ

SEQ ID NO: 995994 - protein, 167 aa, Homo sapiens
MSRQVVRSSKFRHVCGQPDKAEQCYEYVRVSQNMWDRGSVLSTLVCGPDLRGQRGEGPSWCCPWARVDVWTKMRTRSVDTAACCARYRAGARTVTMFIASGSEECTVMVWEIPDGGLMLPLGEPVVHPGGPPPSVWAIVVWHNRAQKCGCSVRVVTIVLVVWGRGHV

SEQ ID NO: 995995 - protein, 110 aa, Homo sapiens
MDLGHGTHVICGGTSMVEAPCSVPAYSEVQDRTNLTLIVVEPTYTQDQAITLDTYRRMDKQPSPIRYQCGEHKCDEGLHNISIIYTTIVMQAERYQASRPFTAAAQQETL

SEQ ID NO: 995996 - protein, 82 aa, Homo sapiens
MGQIQEILRCGYRKDDRTGTGTLVGIRHAGALQPEEMNSLLLTTKRVYWKGVSEELLWFIKGSTNAKELSSKGVHNLGCQWI

SEQ ID NO: 995997 - protein, 235 aa, Homo sapiens
MSCGGDSAGWDEPLMAECSVRCRLRGPSETPSNAACHLFWGFASEPEPCPREPPGPFVRPEAGAGNGMAGKCTWVGDYSIFENSSSNPYLVRRLAELNNDCKWHNVEAKVVCLFRRRDIPSSLNSLADSNASEFRRGTPSSQGCPEAAAPSTEAPANFAFSASLNHYQPPTYRGTMQCDRLNETDILSQVLEKEDCYVYQMVFDPVHEDSSRLIRAKIRVVLKIPRREIREIRTT

SEQ ID NO: 995998 - protein, 361 aa, Homo sapiens
EYLVCSDSSKWVCEHAESLYAWRGGLRLESPGIYRGAYDGDRGRELQSCFQPIAARINQRTTVARFAMGTTDVVWKNATRKDRRIRFACRRRQHKKGAKCALCGDHRSNDTDYDVMSSQLQDDTRASRLGWYSLEAWRHGSPKRLSKNGTGDGSNTTLDVLLRQGLFATLNMPSIHLRRNDSTRRSLDARASPVMKTVTCAMEISVCALLVGASAVSPILAGCVSLSSEGCPIGRAEHGVVKLRLTWSGSQSCRVIHGSDATELSPPIMVDVHQWVKHLVQLASLAGCHHGDSCLYNGPTDAELDTVKHTPRSWEESTGALPPVMAIVTGTGDHWCTIDTAKVEKAKQTRMYTEGNAGING

SEQ ID NO: 995999 - protein, 339 aa, Homo sapiens
QALHPQSTMFKGTCSWYDLGTTYVLCGCCIQHGKVEIIANDQESNHSKLCQAITDTERLDLVMPLKNQVAMKPTNTVLDAKRLIGTQFDDAVVQSDMKAIGRFMGGEDAGQAARCQVEYKGETKSLYPEEVSIYGSDKKMKEIAESHTLGERLLPSAVVTAARLYFKCTLTGVRVPKMLDRICWVSMYLEVYYMRQLLHAYCYRGVEQEKVGARDERWLIFDLGGGTEDVSVLTIEAWESFEVEVYKLGELTHLSVAERLWTNRHGPPSLIGRSSKGATAYRTRGISGQTREHAAGTALRNGSIDGAKPYPSYCQGQGRRTGDPEHPHLHTAPPTLPPK

SEQ ID NO: 996000 - protein, 69 aa, Homo sapiens
AFTISLLGILVYRAHLISSLLCLEGIILSLFIIATLHNPRTPDSLLAKYCAYGHTSLCRLRSSGGPSRY

SEQ ID NO: 996001 - protein, 294 aa, Homo sapiens
MACEKVEKPHTNREQTRKPSKVDAGEQRLRKECNLKSRNKAREGERPLELAARHIAWYTVSRGIGTDIPESVTATSRKGPLVHRGSYISARMNPQVDERQQNEYRFSQCVYKTQSWVVEKNRRLPVVGYTTSQKCLAYYSRSMRDVRSKSCCMPPWQKKSLPVQRPMKVDDIMLSPSSYPRDALSDSSLNVGTAQQGAQEGLGLSLKQTWRSGLLLVTWTVMVRAIEVPRTKNTPEICHCQFDQRVDISNGKNPQEILLSAYVQGSKKGGGKTQGWPKERGEKSFRPRKKRRKI

SEQ ID NO: 996002 - protein, 473 aa, Homo sapiens
MSTHAVALQLLFPSFAHAPRGNWCSRGKRTGRRKKRKGAAPDRGIPTLQAAAPPTRAPSDEAGAQQLGGQLQSHPGACAGAAMIGQRSASRAGRDSHASDSADRSARGCTTGGLDGIRELREKHISDWYDAISTIKPTDVNNQKSTPGPIQLDTRPYTAHDCTLIPNEERAQSGLEGTPPNGSLDNTHTDNKEHRETGPQTQQDRLSIPQEDTHELTKSGTTGTTLRSMPRTDKHDKQHIVTATLNKHNKHTKGTPEPRPGAHQTDQKATREEHNNEQLTPTTPTQTGMATQQRQQDTQQARSSRGTRRQPTPRHQRARRREGTPQQRPHRPGQTSRKAPEQTTRTGPRKAPTGTTKQHKTHRNTNNTKAQRTDETQNTQDQPPPQQPGAMTDTHTPRTHNESTADSKQPRTTNTSTDQHDRATDNRKRKANHEHHPGGASASENTHHTETRTPQDKEENAGTEKGESHSRRP

SEQ ID NO: 996003 - protein, 94 aa, Homo sapiens
ADRPGKLFIGGLNTETNEKAAVMQVFGKLWSDIVEVLLDEMILKATNQEDYALCLLFETLQSRQLKDCMTHEDMYVNKSIKNGKKPVNGWNNAT

SEQ ID NO: 996004 - protein, 156 aa, Homo sapiens
STPLWAALRRTARDRLCPTHLETRRDSVSRGDLPQWTRALEGDLDHVDPYAQGPLYTPNSGGSCGAVSRASLCVAASMLCVGGGSQDLTLRAALRLNSHLAEGIGLSVTLAERGVRRTPGRVYQRGCDLVHSPLRSQECVVEQDSPEAELLPQGNA

SEQ ID NO: 996005 - protein, 43 aa, Homo sapiens
MHKRGLQRREAQYKDRVIKQPNRGTGRSTSGRTHSEAKNNKTT

SEQ ID NO: 996006 - protein, 231 aa, Homo sapiens
MSSHCDTSREIGLINPYTGSIKCQLLGSDMVEQAMLVSPKCNMPEDQGMAQVTPVRDWHLASGNRQLGLRPGDLHSNIKDVHWTRPWGAGSSQEVTDSRGEGDRGPGGRSVNKGEPINHGKMLVAPIGATTQRLYTGRQNEGGKHGTRKHGENNTLGGQLNASSYYRLSLQDNSSDNRGCVAKHPTYRRPLDEINAATNTHDRLSRRSNKDETHTVAANGSYRVSLNGLEL

SEQ ID NO: 996007 - protein, 491 aa, Homo sapiens
YVSECYGYRRPTLYGLIEEVLPPLPPPLLPPPPAKPELEPHAGIRSEMPDCLAPKDGLGWSIRGTARPGLPSQIRLSVIVCLSLTSPQIHPAPVHRPPTPASMQDTEHGMNSPQTRSDGKEEIRKKTHQQITDRETNKPAPAKPKLHKSDSDKPEETRHNQHKTQKHKEHETGKRKTQTTKNAERTTKQKGQQQQRTHRENQTTKSDTMKHRTHTEDKTARHQKTQRQQESQHNQRTPTHPKDQATQKHMNITNTEEQQCTSQKKSPKTKKQTKHSPRKADQGQNRQRNDKQNKTQGTTPGQAKRGQYKHRNEHSHTGPRTTQNPPETTKDEYAKHRRPGDTKNTHNTVNRKQPKSNKKQNKTSLRKTQTQLKHPQLTTKHHHSTAISTTPNTQQRKPPYTSRKPEGPSQHAGKRPGDGGSNRECGQKKRTGGTKCRGTAQSSKTTHEGEQRVLRDHSRHSASTTKHEEREHAAEQGREEREKAHPHPTAD

SEQ ID NO: 996008 - protein, 139 aa, Homo sapiens
MGAAIGYILSGYVHQEDRQMVVGDISLTAPWSRSEISKCFKRFQIYVAPVSQSFLLPGYRYNRSDIMPSGRSRLLEDFRNNRFPNLQLRDLIGHIVELSQDQHGSRFIQQKLERATPAERQHGLPMKFCKQPINYMTEW

SEQ ID NO: 996009 - protein, 107 aa, Homo sapiens
MRDATGDILRDYTDRSPESYRECLQSRPPHKWIEEHPARVYPRETPPQGASESCLYKRPPTKGDLPSFLPTVLSMPREETARFPTRTLKSLRYFRTLRTHRSIQTMV

SEQ ID NO: 996010 - protein, 113 aa, Homo sapiens
MAVRVQGSKSLFYLAVRKVWCYFAPREFPLRCRRIFDTLPRPETPLKPPNFSEGTLGPRDILGLHLRPEQFHAKKVRAHTMEKQAKYACDVTSGRVRRKVKYTLQRVEELQRN

SEQ ID NO: 996011 - protein, 230 aa, Homo sapiens
MGATRVDRRARLARDSVPGEAPNIRAKGVRDRAQVVGTKDPPRGHTETEGHEGALGPKGGLKEEKGAMRDKKEEKRREHPSPGTLGNSGQQQGNKHVTTRNSREASKDQEKTRGNTHWGPAWQNMDPTHRVRQPNEPQKPEGEPHLPGQTGHQASNMYTYITAKGPHTEGTDDQHETKQRINSRPESGQKTNNEAGYTTTNKRKEEARSKKTTMKRRQKEQPDNQKRVRY

SEQ ID NO: 996012 - protein, 233 aa, Homo sapiens
MTGGGKHKYRPKNVRRGVGEKNMLCGTQWMFLSLLKNNIFIYNTAAPKFFTMRGRTTEQTEKDEAREKHKKDRGKGRETESDKTEKKEEHATDSRKAKPRTEKARRGRGRRKRESAQNAKGKEKTRKRAEQREKNREPTTGGAKNRRKHENKRRERRENLRSGPSDTEETENTPRRPNERDAAARRATRSAGDGDQATQHVQDRRQSTHEAKKGRAGESGTQNRTREATHRAR

SEQ ID NO: 996013 - protein, 299 aa, Homo sapiens
MVNDVKCPHSFHQVKTLPMNVLQATHSHDPQGCSYLCDQLLSHVTNEMPLGEFNEDEDPGMHEGRRKDTRYYAYMLRQQELEMRVESVAADVPGSCQGISTMMGVTPDYDRTELISDATRLYVVRVLQAPCALPRGTNSSLRAASSKTTLIHESSKTRRGGDSGTTPNFGEEVLAPKSGSLDGCEHGSIGPRQAHSSTRNVDGASRSHRKEETDEDSESNIEVYTTYGAAVTRLLLIVQASQRMRLSRRPTRPAGQPDTHWCQQIPTICTTGDDPGSPYSTRMLHSQNSPRARQVKIGE

SEQ ID NO: 996014 - protein, 80 aa, Homo sapiens
GRYEALKKSLSKQKGDESYLSKFPNTRKTLNQNGCPYIRLNMYERSKSGVRSNVILGLACLSILEHINGHTLGDVRSVWT

SEQ ID NO: 996015 - protein, 111 aa, Homo sapiens
MWLLFLRQEFIPDPGLIVKETGKPSWQVRLMRSFNDHVMLFTQTMKLVHRDAHPPGALWGLTRCNVASQWNLSTTTDYGVLRSVLSGPLFQGMTQHCRILVDPSGCWVMPV

SEQ ID NO: 996016 - protein, 212 aa, Homo sapiens
MGELGTPGEGGATQVPGVAQVSLRNLWRLSSESVTNMWRYPYATGPENTTQVALRSENTLRGLTEQEKTPLSWRKGREKGDMRRRAQNPQMNGASVALPIHSGATWREQHIPKWGETNRGANSRPQRGTRRTGGQQKKRPQDGGETQPPKAQPREDKKPNSPPIELYQKGRQQRNHKRGGHPNGTRDENIARGEGDNNKRVINTTEGSAAKA

SEQ ID NO: 996017 - protein, 140 aa, Homo sapiens
MNTIASAIRLSDIPEICRTLSLKGRHSYRERAPEEPCVQQDFNHINVELTLLGRIKKRLRVEQMVGKSERNRVLPYRDVCGYVSANKYIMIIGGVIIGHSISNDDESWCYAHYPQSNTVCVIRRQNVVIRILQQIRKISS

SEQ ID NO: 996018 - protein, 133 aa, Homo sapiens
MRDGRGHRGGRPELRLDERQNHYVGTNNIASKERTQERRERYRKRSHQKVAHTKPTRHMQRKTPNTTSTKKHKSNTDDANRYNQDSTQKRLSVKRTTATVETTQKSYIYSTIPHSTHSHRRRRSTKSKHNRQH

SEQ ID NO: 996019 - protein, 68 aa, Homo sapiens
CSFVRCRSSGSRDSSEVIRKATHEEAAMSQPGVGMSVRTHGVKRADAASSAQRTQSMCAANVIALMAG

SEQ ID NO: 996020 - protein, 30 aa, Homo sapiens
MKTENSSRLSLRPSVAAQLWTSHKYLHGRQ

SEQ ID NO: 996021 - protein, 74 aa, Homo sapiens
VDSYVCMVGYPDSVVLGMEEEKEEEEEEEGYEAEWEGVGEEGKEREEGGLWLSYINSESVEVTERMAVPVSARS

SEQ ID NO: 996022 - protein, 139 aa, Homo sapiens
KGIMDESAVHHHTDGSWVVVKEIIKSDCVAAATHGFDGEVRRVERGTTHFRTDSRRTRGSTAHVLIATELNATQPPPAQHHAEPPLNRTQPPPTKKTTQHTPRTNTTHSDAPQPKTHPDNNHTKHKRQHAPNDKAADDT

SEQ ID NO: 996023 - protein, 191 aa, Homo sapiens
MWQPAERRGGCAHAHHNDVDIFLLTTTQWWVFHKLTCCGSSPPGNTTSCAWQTPSTLLEQRGVVPQIPIFISPSSQDRKCSFRCDNTERFKTFCYDKKGTQVLRTLVGNGLNVRTYQWGEKRPRYLSVGSKAASVLAAQQRCVPDRVWTTTVCVGVIDIPAQSPKIVRALIGSAHLRTCGGANDKVVSSCW

SEQ ID NO: 996024 - protein, 408 aa, Homo sapiens
GNPPVPSPPPAREPPGHWGNRGVTAETGETVGDRGDKQQGMWHGVGGPHVERGARGGNLVTGTQRFKGGPCAGLLTPVCAFANGCRGQPDLPANIGSLDGTATLASGVHVALQTLYYSHSAGAICTWSCCRKFLWERGGYTGETERVFWVPYRGAAPGKGGAKGSEEEATLSCDNNACNSLHAVAPPLRPFTEFSGWRHKDSSSHNEDPGFQCGTTWAVNEHTEGGQHVVLPMRPHLPGTLESEETPAPIGTEKLSSPKNAQSPPVTSGRGKHPHGKPGRDPRGRQGAPPGGRNPQKRRAETEEGKLKGPAPPQGTWRHACTRDTGKNREVEGGTLRKTEKRAAAHQKADTSGAQQSNRRREKRHNKGDTRNTNTPCVTQKRHGEQYQPQRYREMNTHSVCVSATTDT

SEQ ID NO: 996025 - protein, 120 aa, Homo sapiens
MGLHTQCSQCQLHLDDRQSNVSEDTAPRPWRRHSQVQQHHRSEATHPPQDRTAVTAAPTTRSNPREHPCRTGKPAHGNAEHHNDHGSHRHGQPPTNDGPPPTKSTASTTHTSTQHEATPR

SEQ ID NO: 996026 - protein, 69 aa, Homo sapiens
ATGTGEYKRHKHWPLQRPWSIRVEDYVVMASVCSNEKMAGSIMGAMQLGRRNSSRALTAMHVSDALRRT

SEQ ID NO: 996027 - protein, 389 aa, Homo sapiens
MDGSSTFGTKEHPTSACATEPRRIKPFTGWGEDVPKDAARGRHGEGPCHRSLCGTLGMHLMRYTEWFLVQPEKRPCRGAAAAPESILEGQPKDTHGTQTYGVHTCSPEACTAGMDGLVMHPGVITAPEELKWSASVETRRARKGAIRLGSMLRRTVLQHWTRLILVPEAHRFPGEVNKEQSPPLNSQVGTVALGEVPHGHICPLFRRHGVLQATFLKESIDIDAKLYTWVKPENNRDWKAAFALKAPKRYLALEGGSHLLRNPPHNINKGPWDALKEQPKGEDFEKTRRQVQEADTQRDMGPYRINPWPRKQQTLHNISGEKNKQAKQRRKKPNEILNEETHQTDEQRNRQYPGRELDPRAQTAETSNQHKTKRPPSADQKHHAPTNTE

SEQ ID NO: 996028 - protein, 217 aa, Homo sapiens
MEARLSLECHEIRTLSVHFLEQRCHKLTGSFFSAALEYVRSHPLDPIDTVDFERECGVGVIVSPEQIEEAVEAAMNQAAAQAPGWNVTSFNMGLLMGEARAVLKVGGWAEMIAKWLWTCGPTSVLGPRGRLIWRRSPTWQELGRRTDRRRQDVWRRRLCNPFGGPSGEPKSEAVKLRPGGGSQPVFVPWGVPPAQGLLDAPYWAAEFGNHEIWRANS

SEQ ID NO: 996029 - protein, 443 aa, Homo sapiens
CPKKGIFFFFTRRGKRENQKEGPRGGAHLSGDHPLSYKKRRGEEGGAPTPLLLVVHIEGPRVLTTLLGGTLSMMRGGPPTSLAGERGGRGATHPRCRRPATSFFSTNKKIFVGAGRNRGATNTTRGRELGADTKHSVAARGDITHAPAMRSESVYHKREWALFGTHTKPQTQKRGLHKRSMSAGNNHEKEQVGAPHKTSGEGHAWRDHTRKGGGSVEEGAPEERTIEGEIGGGAPQYMEREGDTRGHTKRGENNTTWGGYSGKKHHPENQLHSMGWDGNNQGYEKDPPPGGTKCRTGASPEEHKQSRRTKHPREERQQDVSGYQMKNGRHGRPPPPGAPLVAKGGAATHYEATQRQRRDRHNEAPPGGETQSVGGDLGGAAPPQVTVMVQELYRGARAKGTPTEGRNPTAQRDRQEKEGPQKRRFQEGIEGTSISDCGGKAPL

SEQ ID NO: 996030 - protein, 237 aa, Homo sapiens
MTSRSYVASGTYQVTWAHHSLIENNQTNIIQALLITILLGLYFTLLQASEYFDVVPCTISDRHLRPQHFLEPQASTDFTSLIGSTFLTIWFIRQLIFHFYIQKSLWASKAAADTDILGDVVDYCRMSPSIDDGLNPKNKAQTLRPNKTSARSHRRATAISTTRPPRIPTTALAQENTPQREEINHGAHDTRRTNTTPDTTITPGTTGEPETRTTKSTHTTTQDTTPIEALHRADPDE

SEQ ID NO: 996031 - protein, 348 aa, Homo sapiens
MATAPDYRMSDIENKKQLNTALSTKKYVELQETEMMDPELEYTLSEGLHEQMINEVLSGSRFYTYHRRQVLEAVITNRGIDGSQMETDDRPSARSPQNTRLPLKPHVEEKPVIADIPKFCHGILTKARDDSDIREDKSSPCSEARRCCVIQSTMYFSTVNDLDPNHYPGVRPWTTGWILSSSCTVQTRSPSHMLLEGQSSQSRESETGQVEECLKVNLFQDPKQNCEAGSAKDAEEESKADIFVDPVTLITVDALDIHAHWSKHHPDGASMSGSWKPEVNGVGKPRHKRLRTDGMGVRPRGTTKSPGSDAKGSPPERPPEHGQRMSQAKGEPKGKTRDPSKKITTDPT

SEQ ID NO: 996032 - protein, 219 aa, Homo sapiens
AIASVGVMSVVVLGEHSLGYTGGDAWTRACSRAGLLGFRPGGSTLCRELSRAPSHGSQVSTSAYTVGTLSEGRWCHASPPCRLRVHCGPVGCGSTRMGGSTWDERAALCRCVKPDGVRTMDSPQRAWVRAPVGERRTVRIYNAVQALVGASQCITRWFGQYSTTSTSCRDVWEYVARLILDDFCANKCDQFKARADRHYPREPRYETLRQGVLYAQSRR

SEQ ID NO: 996033 - protein, 75 aa, Homo sapiens
SDRQINLELYASYMYCPLSYYLDRDVMWLRRHFVLSTFFTDLMEEREHADKSDDSCDIPIEVDRMLPSGYQEAIL

SEQ ID NO: 996034 - protein, 434 aa, Homo sapiens
MEGVPLSYNIGHYFAIEHAKRRFLQTFECTTILYNLSHVAGETAKVHSAPFTSSVLSEVLYQCVRRVVHNARRIASQKYTENEGATYTRAIKTPRKKQREQPGGDKTNSYNAIIHSRRELTPRTDLQERKPEGIIQEQDQHDNQRTTHRALQSNDPERTTYSATKKPHRENKRHGTPEPATDSKKHNAHNKAQQGNNTPTETNQPTHAKKQTPVETTHAPPTRTAPQTAPNQRRGNKHNQRRPTQNNNPNQPGTKRVTQTSNNTTQGHQTSKNPTPQSQPQHKCSRKKGPRKTKATDKNTKKKHPRKREKETQQQRTNGAAKKNDTQKNTATPPHHDNQQKERETETKTSSKKHRRHRTQHTNTEDERRQPTPKQATPCDETKSESARNRDNHTRERKEHAEDTAQPRGRSNKAHPKTQRKHKKQQTASRPQKI

SEQ ID NO: 996035 - protein, 126 aa, Homo sapiens
LPLTIGKSQWMTGATMIPSEAAPCSTGRSNLWIVWTGNPTGDRVEIYVKQEERVRVYHTIREELSLKREFPSSLMASSLKRWIDGCPQDTSRWKIASRQKPMCPCLKRRLQEEVMEAMGIKGDPGS

SEQ ID NO: 996036 - protein, 478 aa, Homo sapiens
MHCRRGDKVLEPSQSGPSRRVPITVCAGANLYHNQNTKYVRKSYRMRRVCAFASRTGSRTRAYTSPRSVAPRALPLAYSQSVAHTTRKAQFVYLGGGESSRLEELIRPRSLGKNIPEDRRAQGYRNRVGALMISGVGSLIMGAREPKLSQNLCEPSNYKETKCELYQKGGGTLGLVGMSALGNLLRRSYDSALGNCRFQAGKTGRRFGVLGAIAQPFFVAKWDFIVGVKFSSPMEATTWRGASRTNSAGYGRRPRFDRPKFVPMGLPLSLSTPKPLGWRWSVARQQDNGSKNLSVPRGCAKGNHHHALMAPSSPSPLVKNTQGPASKLEERDRYTATAIYIGTARDKDIVVFYRRWAKTGFRRDPTPFGTTILKCSKAKIYGSGLHTQKGTHKASEALTLYLFSVGGAPTTNIPNGGILGTHTVVRHQQSDSGPRGIWGPNIVSGLHQHKWVRLYRDVVAQHWVHSGGNTPYKGARFN

SEQ ID NO: 996037 - protein, 349 aa, Homo sapiens
GEIATDSDTPCPVDLQRPGPRRARMTSPEPLGSPACMGLCRRVSFVDPVTCGSQGLHSPEPPTSGGEKPGLTMGLRCNMFPRLPPGGELQRRAWPTGNPFRLGQCPRKGKTDSMRAPRLAHACRGRDQSKRSQEAVDRRSEAMRMDCRGSGTVGKRKRLGEYSDQIRDKMLRIVEKHEAGGIRGQQDVDRHDYTKRPYIINLKQNSTSPMRKGYVEQGRNSNMPRDQRQAEREHGLDTREYSKHSSTISTQTRQSTDSRHDAAAGSYDTTRKDTEENGRTSSRAVKRGETRTSGTHRLGSHQRRQPRAAQEHPQHRVTEHRGATAPKNYRPLTTNHPEKARPARSPASS

SEQ ID NO: 996038 - protein, 250 aa, Homo sapiens
VDYIGTASASAHAHRHRVRSQARVGWRTQTTPGKASEGGVRSGPCEWGQARGLVAGSGAFILTGAEHPRRPIAPEYVRVRRALRTHVMCVRSEIRARHHSRTVGRLRCSGALYPCLALAYGRDRAATAVPGVEADPWQSRRSRRRRRMENFRKVRSEEAASGVRGRGRRPGSGPFADLAPGAVHMRVKEGSKIRNLMASRHRQHGAAATRAIVFSGCGGTTKTVTCAEILKRRLAGCTSHAARYRSVREC

SEQ ID NO: 996039 - protein, 247 aa, Homo sapiens
GAVKALVVSKDSLRICIHVPVPGGSDAFPVRSPVHLSVPSAEDRVALVLLWMREFIYDGTEESIEGALGRVLDGTVNAWCKRDVKLQTRLTHMSDPLRIAAAELNQQRKGGHVRSEWRRGRTLFFDRDVCRRIRPGGHTNHGEAGPSSHVHAIPLMLPLVIHGGFWMRAKETLMHRWPVDRVNTIRHRIAIKGKMGSAVYMEIQFTTRPCEKLISACAEYGSVLREHGVQRRSGDCRREPAARGVDY

SEQ ID NO: 996040 - protein, 294 aa, Homo sapiens
PLAPLFHVSVQDPMTDSVSRLLTIVGAVLNCQHHLYLGPNVDACAADPPGQNDGAHRLPPPLRGHTRRRGAWRRGPQRIRKRRGSPLLDPGHWVLAQQVHLASVAPVLPPSPPDHHTAPGKSPKILPDILEENRGHPYGLESNYRSGTKCGLKCELLAKCEFFNAGGSVKDRIRLRMIEDAEARRDAEARDTMIEADIRATPGSGWSLAAAVRGYRVHHRDAREDELREGGRAAGTGAEMWRTPQCQVRFPEVTWGWLWAKKETPSNITKRRRRNPGIPRSKPPVGRTRPGGPR

SEQ ID NO: 996041 - protein, 198 aa, Homo sapiens
MGKVKVGVNWIWSILGAWSPGLLLTHGNSEILKAIQCTPYHMHRRTSQWYTYCPIMYPPYEQIPMATVHRLENRASLSIKWSNPHPHIFPGSADARPHNPKWVPIAGGHDVNCIACRPITTMEHASYPHPTPIGNKHDDHMTVTIHYIGNNHVQILKKLEYHPHSIMEHHQSFASYQHHHQLDYQEIHLWYRSSNTTL

SEQ ID NO: 996042 - protein, 186 aa, Homo sapiens
ERYAYASLGREQALFMSTAQFNRISYTGLREIAETPAGQEGIVGTSKGAETMEDEYISLATEILGQACIALIPRVASKMTPHARTSIASQRKRPQAKRRHKTDSPLHNPRQRRSKRIRRIQCRHKHVGHERTAAESVMSERMKFAGQEYFHEEVTGRAGSHMNFPNPRSDHCRGSALYAPKAVVSR

SEQ ID NO: 996043 - protein, 346 aa, Homo sapiens
MQCVAGLAGGGSGRASGSLLGPPALQARVLGFRYLENSGQINSGAVAEGSCEVQLHSRWHAEHCLHRHCLNKSPPKRGLVVGIDVHRRIQGQKGQPLPGTFTGDYEPGSEYNLNSVGPELPEPGAPVHSVPAVPCGGPGRGINFETVFLLSGNDPAIHLYKENEGLHQCVRNSRGKLFPELTNLSSSVSGWTSTISPGTSRRPLSSGLSEWVCPVSPRGPAESRGLQIVARPADGPISRVMCVSLWTAKGPKGRALTGGVQGLPVGSNFGAPGVYWRPAEPGGVTTHAPAGERHVTALAWNPRIDGSKTRGTSAEGDIRAANVFSQKSGEAHLRYDREECAGGIIS

SEQ ID NO: 996044 - protein, 136 aa, Homo sapiens
MAPWHNTPTEAKERSRGPKHVTTKQKRWTLRQCPTQRIDTCRAPRGPHKSNERHENTEERQGPNAPTEPHMSIDKRTYHGRHNHMGARETLHQDPPPERQQITQQITVHKTPYTTYPTTNSTRREIGTNNAHTRTT

SEQ ID NO: 996045 - protein, 41 aa, Homo sapiens
MLVTEICTNIITKHRRHGHGEFVEVGLMKRSIPWLYVSSER

SEQ ID NO: 996046 - protein, 107 aa, Homo sapiens
MDPQHIVLGRTRETTPILQVVWLGWMSPKHLFSPPGDRRPALTTRGGGPPTARSYDPEARTNTSQRDTCRGEEKRLTPTKRSVSNALANLGEAGPEVYTAADAHEER

SEQ ID NO: 996047 - protein, 231 aa, Homo sapiens
MHPSANRCCVVNKPNTDTLRVGGRPPCPRHPGRTRLFNKTNLTAGAPRGNTYVSTSSHRGHSQPSITSSKETRVAPISTKYHWRIGDRLTPPGGATTTPNEGATHTHLLHTTAGGAKLINVGRPQKPVLVPTHHHRQCCVDFCERTRSITLYRYNKPLSYNVCLRPSLSPAPTTKEDRSGAYQTISKQHRAATKCVLDSVTLKQRQKEHYGEQTKLNIRPLMNSSDKSKHE

SEQ ID NO: 996048 - protein, 272 aa, Homo sapiens
DPTLTPPRGSRSRGPGLSLQALTPTLLASSLVAFSAPEVSMPTGPHGLPDPMLEPHFPHPTLATPRPTHYYSPYGTLHQNSEIIYGPRLIAYVIKAAPTAITYPMTPTQSRANHIRRAPSKGYDGTTRRAPNTHNSTSHSVASDDTGRQHLPILRDPATHEPRGTAPAGPQLPRTYQDTTFPDALRQPLKRHTDTRNGQTRPEKRDTTKTTCQWPANNHKRMKPHGTKNNITIQFSDPPWTKRMAHPTLRATTIGHIATPHPTDGLVAIYGH

SEQ ID NO: 996049 - protein, 393 aa, Homo sapiens
ARSGHHTFYNELLRGPWRSTQMLLNEDPLNPKANKTRMMTHDYVMRPINNPWTMYCGHPVPCLYPLRLLVTTNGIVMDSGDVGHPHGAHLRGHKHLPHAILASGPVLARDHERATYMKILTEPRTTRFTTTDLSGKSCASIKEKLLHTLTMDYRDRRLDTAAYLLLSLEKSYESARMSHGQYTNLSQGAAPGSPDGSMNQNIPILELLGIYDGIQITHLQTPSTDQCDSREHPPKTRRPPKHESHDGRAPHTTTGPHRRTRTARQRRYHRPWKPKHQKHNSRTHRHAPEEKEPPEEDRVGSTMGAKEPTNTHARTQAPSTSTAKDHTDNGGPTKETTRQHADLERHHNSTTNHTRGTGQHADRHTRRPREHRHHKPAQGRQDRQRQRTQPQHP

SEQ ID NO: 996050 - protein, 194 aa, Homo sapiens
MGYPNYALTPFHGGTWIRNGLGFPQDQGANAKNETKEGAPRKGGVDVQRGNPGEEPTLARNRTVSRQGQPRTPQQTRKERTTRKGRDKERGTNTKLQHKMSRRKQQGPTQERQQPGTRVDGDHKQTDVRETQEEQRTDRETRNTWTRRTTERAANTGHHKTRRLDNETPGTLRPAARRKDRKQTSDKQTKDEER

SEQ ID NO: 996051 - protein, 334 aa, Homo sapiens
MPSSWISFGNWYRKVTSPLALPGFRSLAGCRGGRPVPGEVLVQRVKCWVLLGDLGPVGVTSGVWFSRVRFLGLSWCFGFCWLAGPGLGCQVGACWRQSSRNLCPPPAPGPEEVRHGVLVMPPSIEPWLHLVSKGLGLDLSGRGQVKWGSLGATQADSKTQQTLASRCVDITRDEGVHCGVAHRAMASVPGHAYLWTSALDTNKETSDSETEQDLNDQTGTMKGCTKEDRKVNPRPNMVAPKRGTDQYSWSRDKKKAMRDNKKVNNRGNSHKETRKRTQQTQGTKGKNRHQTVDMTQEQGTKEHRVITERNHSGKAATITKEEGPQQTRDHYKGP

SEQ ID NO: 996052 - protein, 97 aa, Homo sapiens
MEHENEETPDSPTGPRGRDRSRKDWTGGSARDVSKYPQKTTRKERETKGTGTSTSQTRGKVHNIKNNTEGPPGTKFTPPNAGFAGIIKGGKPCGGKG

SEQ ID NO: 996053 - protein, 132 aa, Homo sapiens
MESAKPTGSPPRRGVQWWPAPGGNTRSPRCKNHVPTSEGDASSLWWLEATFGPVSTHFGETYQACPGLIWERRACQELLDRTSIEWTHAFFSHAHVTPITRGPSSAPPNDPPGLANVELHFHSIRLPNNRPN

SEQ ID NO: 996054 - protein, 118 aa, Homo sapiens
MCVCERGWVGEEEKMCAEPPQGHVALCRTHAVGGKEETCRCDTVCAPFQCALERTQTERCVDTRVTPSGVSGNRGGPEATPESTSRAKTQNSKRRERRHTGRGTHNTGTTDTTQVGTQ

SEQ ID NO: 996055 - protein, 496 aa, Homo sapiens
MCLLCAALACSPWALLPLLPACLPPWSPGPDVPAAILAPADQSAEELCSSEDLQAVWPWTGPMISIDVWKHACIRPAGSISAYQDHPSSFTASKDHSGKRASVVRTGRQSTVHRTTRPSVLLPRHHDPPTLAISCQDNPQTQPKTVAWVNQAGPDDWSSDPKPRDPYPQKPKHTYKQRRDPDGIQHLTDTNYEPATAIESAPPATAAHNQSLPHKPQGPQCPRHKGDNQPKASPAEPPGDPTHRQHLAMTRAQHRQAASTDNHRQSRRRAPHRHQQTPSTRTTPPQQHTQTGAHHRSAQTKLHTGEPAHNQTRHHEADPAAARTHPRPHKRSIKSKIATRNSETWRRPYGKNTGRSYDEQDRIHDWRTNGLRAPKPKHTPTACQDRQTNKRHEPRQKIRNRGAPPRPGNQVTADTSTTSSERAQARQSARTQAKTATTASARTTTAGSASTPRGRARREGQRAPARTRHHSEGRARTRFSQGTTRQSAHRRERAGE

SEQ ID NO: 996056 - protein, 180 aa, Homo sapiens
TRGVSDLDSKINFKFIKSDPTIRVNQTKSDQAIVPPCRGGWGPQGAQVLQRVARGTGGGLVVAGSAGGPCGQFCKWCCWGGLCRCGSGGLDCAGWPRVGWLLRKAGWTPVAFSIVPARDSRVLPPVAFSAMWGSFRSLRLPVGTAFLNVEGSPGLQNFLWGGSQHLGPLGPTIPNNTLCR

SEQ ID NO: 996057 - protein, 149 aa, Homo sapiens
LAPGAPIACPHAARHPGPCRRSSADSKPFRRDHRCASRARTRPLPPCPVRGKLKFDMSGVKMWELWIIGEEESDPGMLTETETAGQDLFDNLGRGENLDDIINMMWMTYSTGFKHAELLVRAYEDSVRCGTKSSMALTLRFHNSPATLR

SEQ ID NO: 996058 - protein, 104 aa, Homo sapiens
MKPPQRDSAKGGGQGAQWGMAHTPAFPGTRKYTLPKTQGGEGTKEKHPAPQKGTATQIWRTQCGGPEGTPGGNRRPPTRIDVATKATMLGKKRNKEARGVTKQR

SEQ ID NO: 996059 - protein, 313 aa, Homo sapiens
ALVCIVSTSIAVRLRYYMVVLSPFLVLRQLPAVRDICGELVEEAYPLNVYDVLCHRTSDTTCSGTLTGDYQMCFGQLNVRQFGGERIATARVPGGLRQTLGIRQTRRVALGKGLDSTARFVTKMRQSRDSRSRLSIALTLIGGRNLSEYAMTKRVVDRGHFSRVSSLPVTNIGPCPDLRRGGRIPVIDFALFGHGRQSAPLCSVDISLKRIFALSYKAPKVEEDSSLELARAIPKGYYAVILVGRTEGQTSLLCIKGENTYKGRKHAVLLAVTLILVPYEATFQWGGGPMQMLQATKPLEDGSPKLKRMRQPN

SEQ ID NO: 996060 - protein, 327 aa, Homo sapiens
ARHSPPGLAAGVLADGEASPGEGGSGLRLSLKKTPDSPTGQVRWMGQRPDPHPCPSIVPSYPLSEVRAIAVVDQTCRWRQTPETRAPGPRLLSGHAIEPRLIKHLQKKSKEQREQETVLKTKRQRTSKCEETVTQKQGKKTDSHAERNTQTSTGTDRCTTNREDREPLQIEDGPTMKTQDGDNKPGRENTGQYPSERKTGKQRRRRGNKRINRRKPEPRDAQDARTTREEGNREPTRPPVRKRQSNQATAEQHNTPNKKQNNNGKKPTHDNNPKCNSTPRKRANSEIDKTIRRTKTSSEHTASTTSQSTRPENMAKTRPGPDTGHLR

SEQ ID NO: 996061 - protein, 276 aa, Homo sapiens
MWEFTEEPDRYEPDKDRRSSEKCPTSRVYPISLSHTFLQECRANTLALQGTLGTISQGALGATLTAHWAGAQDTGGPVGGHQRGGNTTELLNYGLEPRTTRTWSGKHKNAPDNKGDDARDQTSTTSHRQTQNSDHHTRRDREHPSARAHPRTLTGLVTASNSTWSRPTEGSNKDNDEPNQRGGPNTTGVTNSTTITDRAKMRPERNEHPHKQWRDWGTSTADVTSPPPAKNRESHNHNARAREEASNEVIRHNEERDKVKRQFRERLTQRAYTSPD

SEQ ID NO: 996062 - protein, 41 aa, Homo sapiens
AQTERHSDDLSLGWGHLPSLQLGVSGPTQTERHSDDLSLGT

SEQ ID NO: 996063 - protein, 176 aa, Homo sapiens
LFYNMCNKKRFSQKRPKPMSSSDSSDSDDDMGSRFVYKFSLHIYNMLSKKTFALRAKTKMPVSMYPARASVISDIIVIGIYNLFVYSRHLGVSSGRKGAQDVAAWCTEPMIDIGSREVQTPGLPYVGHGLNGSLPNLLLTDLEGERNLIVEKRKGASGAKQGESKRMVTPEARTRT

SEQ ID NO: 996064 - protein, 322 aa, Homo sapiens
EGLEGRGVRDRTQVQIEHDGWDEDVNKHGQGKDLGETEQDEAELIREDTRRGALHKLPVRAPRGRAGGGGVKGHGEEELQRDVSAVDESPPLEDAIRSGRAESQDYRISGARAADDPRREPIPEARGGAEALSRWGPRATLMYGASPGTCEFPSGVLILDEMAAGGDGKVEDPEGRVFDERYRALYRGLSNSAERGQGCLETPGSAGEEPGQGRLGVNEAPWGVGVLKDACRRSVAERGPRVCPQGLQLAAIGRVRIDGPSYNRGAPVDLMARVWEPAIPICVGECIHSEGMGSSGTRASAGKYEVWKKNVSHGRGGDKRDK

SEQ ID NO: 996065 - protein, 99 aa, Homo sapiens
MSLTESERAVLGVSRKDVHSLTELAVQLARTPHYTGKGPISHRTHTHRRSMNLCAHRSHMSIRHGTGNDVDIGIGHYFLRVSERLNHCIDRLCVEIRDK

SEQ ID NO: 996066 - protein, 202 aa, Homo sapiens
MHSMATQRTWQYVAELRVLDTSHQSQIEHESHPHLYVLAHEEIRSPQYRVQNQWVQYRSNTLLCASDECMMDRGIIGSPIVSELTYSTGDNLHMSAYLKKKDESHDGSSKYLQSIEEQLRNVDGLYDCIALCLLQHQLPQLLVERRQISGACSSYAGLSLDDVSSRDDFTEERLAKLQDPFSLYQCHTIMNCTRTCPKGLNP

SEQ ID NO: 996067 - protein, 111 aa, Homo sapiens
FRRAPATICLVDAHACSDVPQIMHGLPAFYRQMIAVYMILARIISPGTHVVDVTECLVNECPDARYSACFKVYVAPALTPDCVVALSQLGAKEGRTGRWSSTKLGKIRERD

SEQ ID NO: 996068 - protein, 185 aa, Homo sapiens
MCVMLLARCQKQMVRVPNQRVADRISLLVPSRRWMRIEEVYSLRASELPSVVLVYRGYPRVGPAHCADMHTTQRNRCVSKTSTWSRSSDSPSGEDLGGESWAVDFQSRWRECTLAILVGPQGCQRSALELVSAMVYWGYPSDTCQLVFSPQGFWGVAASSGPPQTFVRKCVPWEEVPTQGATPEV

SEQ ID NO: 996069 - protein, 152 aa, Homo sapiens
AQKGQGAAVLEQQEVSSSAHALHPDQITPLPSLPTRTLIARFVQAQPILPKMSRVAKYRRQVSEDPDRSQQPAGRTLSLAMEMEELVGMELDVVVYALERAYDVSRGGCRSDGETIRMKQSTGVYNREAMLNFCETGDQRNLCTREMSTGCE

SEQ ID NO: 996070 - protein, 165 aa, Homo sapiens
MGPPPPRQDNTQAKVRKTHQSKKPPQKHKNNKRPTQKHNERGRWKTNKRGRHNTIRNKKNTQATKRHRTGNHIVTNKQSDDKRTKPHETRHTADRQIHKERSTTARQQDSNTHTRHAQQTKHTHHNTRIRVIEDDREVHCDKSRETKEYRANRRESRQEYRSTPR

SEQ ID NO: 996071 - protein, 72 aa, Homo sapiens
VRRFLLLGLRASLSWREAKCKYELSGKASCTLDTVWEDKHKYEEAERRILTNTEALHRAVRSRCLSHVLANA

SEQ ID NO: 996072 - protein, 72 aa, Homo sapiens
MSSHSLRYTGTRYQATGGGFVAKARGRDSINIESSTRVMQRTQPGQLPDSCTGAGHRTTGQSVKKTVSPYGE

SEQ ID NO: 996073 - protein, 138 aa, Homo sapiens
WSLPAQRSLCRVGRGRGVQDMLAGPHTSPHIRLLLKIWGCQPGGRGPGHASALLTLGSAELDGLSKGRWAPTEATAAHSLGRSRPKRPSGDPPLRLLAVWQVLSHPAQGACLPPEALFQLWEHRQQPPKHCPGARWEP

SEQ ID NO: 996074 - protein, 132 aa, Homo sapiens
MYRSTQAGDTGRTQYERTKTNRQGRAGYNDQRHRERLAVAPETNQALQKQRKQSKTNRTNKQAKRHHEERIRQRRRKKGTNPKENKAKNREEKETEANRQRQGATDERRKQTRSGNQEYTEQTKKHNKTHQR

SEQ ID NO: 996075 - protein, 38 aa, Homo sapiens
MFRGTHEERTVNEMRDRTELRPFCRGKLYTDKGFLNRD

SEQ ID NO: 996076 - protein, 314 aa, Homo sapiens
AQSLAFADPRAPSHTAPRELSHGLMSIAGALSGRTHLAPCTVSTVRAFCGASDAPPGRSSPAIDGGARRSPSGDEWMGMVSEGIPYDGATDGPMSHRRVHPHSWKLPQSSTGDRTTNRGNDNEIQYAVKSQHTFYTDDVYLCCAPDGGTPCVRDRWTPLNTPSDYREKMIQIMSESIQDPSHVRKTIQDCAIPVRALARHQWHRDGLPVTGGHQTCGQSTRGMPSAMPSCVWTLVAGLTDYLMKISQSAAYSSPHGRAGNRALINGKAVLRRPDIEQRWQDATHLLEKSTLLTTGTYNVQIRALRYRSDLSRIH

SEQ ID NO: 996077 - protein, 88 aa, Homo sapiens
MLSLGRLYVVYEGVVDHNNGLGYIAASRKNRAKRALTASSDSSTRLAKLRFDNSPSGKSPNGVYGEGLRKYVETTYPSSAQVIKPRVL

SEQ ID NO: 996078 - protein, 242 aa, Homo sapiens
PSPDVGPRRADSQRLDANGGLSRSLARGRRVRGRQGRGQARSRQSCQAEVEGRTWEPQSDAEVLLRDSEYVTERPSSSCTAMPPRDHPPESPGPKHPWFGSAVLSGARVSPAPLQGRWVSRVPHQNLNRLKSSGTSNPPFHGYWSTARVREPDYRGKAAGKLRWTGSSPTECADGGADRGQCPGKDGEGDDAVDYARKSITQDRIACEAESRQRHAGDWNPEKPVSTARQEWHRGPRDARET

SEQ ID NO: 996079 - protein, 149 aa, Homo sapiens
MNKNCDENTPRAGREQTKREHKDQTSGPQNTHSSSAPHTHIIGKHTKASKATEEKKEKGEDEHPHRREGKQTTGKGRRNTRPRQRRRRRHKRRRNHGRTAVKEQEQRETRGRTQHTDREEQSNQYEGDSRRKDTDEHDEEKQKMRDRTS

SEQ ID NO: 996080 - protein, 282 aa, Homo sapiens
MWCGPDAGPAMLYGLVGDGKISPRYVAQIISGLISHLGEKCSCRCVNAHTLSGPPFSVKDRSIVPQVLFFTIFLVFSMGRGLSFWALRQGGLTRRESVAGFPAEVPRLQADRPLWAPHCVTVGIQVGYDKRHCVQQVWCTEGSHTPEGKCETLWGESVPGLLSPYWTIKHCVGAYFRAGEILRKPGSGKSYSRGARTQLYNRDKITTNARLSHNYPISRILFLHINKERRVHREYPSPYTQFKQFQIGAPPKGGKLETYRMITPGNIRGAGTSNSFRKLSLK

SEQ ID NO: 996081 - protein, 197 aa, Homo sapiens
MVQLGICAFRSNGTDQEDASHIALLDIQLSGRAKGASGPGPAAAHLQDRNQEQDKVERRRQVPLSTLSHQSWSCCELCRTVVSASAPGEIPYMAAMRAMPARSHDQQAVSITSMRVGELIAPAGSPWVHAENSVVAASIGHEDGGLEDLSHVLSSMRTMNGKRVGPFPRYADQVRSHAGYSEESMKTSLRDLALYYP

SEQ ID NO: 996082 - protein, 156 aa, Homo sapiens
MGMWSIGAGALGAAALEIAAMAEHMISDSTVLRLHRKAALDAYLVGYSTCKTLVQGTKGLSKQYGAMAEKNVTHVIYGPCGGQAVSFCREEAADLYSLNKQCWTSVGVPNYAVVKEHIRTEVKDFQPLFQRTQIFLDDNEKSSMVHKGGHDDVDGI

SEQ ID NO: 996083 - protein, 602 aa, Homo sapiens
GGGRAESMRRSPFTLRARCSALSSLFRCPAAAAHELDTGRVSFLLVQIFLCAAMAVVRDCHRRCELVLLCLRTRMLVIKWRCRRIARDHKTDGPYDKCKAVQTRHGTERTTVSETGGHFGSATERIRTRAIRRKSGECQWGLVSHWFPRFPSVTREATPPLAPKPLIEVSMRSRYTPPESSRLAPRLERTSPFSKRRFRPLNQEVASSNVPFFSICVAGSSPGVVERQTVDQPIMAETSTSFGATVDYATYIKLQDDSPRPPRLEVSPVPPWWHHAGLAHWLASRGPGPSNPSVTAHHILIGQVYSRRWREPPPMALFWANFFFQRRTQDNKPPSYVSLVWSGSYVAQGVNHRDYEAENNTRDSYGETQTRWEMSRRHETRIIPPEKWVSPFGGLQQAHHFVPLVGALDTTGNLQTSQKGNFARRHTRGSEAFPPGGSGAPYCNPPKRRAPLSSKGMDYTVPPGLAPTWRWYTVSEASKVSLLTPRVGDTGVALLNQLCTEAPRLCYTGQRYRGAPSTLACRNRFRDWFNPHGGGHNPAIRATTMSVRRKAQTKFYFQGSATLNAGGWTQKVHHFTISQSGSSRRMRIPKERFTICARRANL

SEQ ID NO: 996084 - protein, 138 aa, Homo sapiens
MHVVYSMHMFAAGIDSVAEGRKKIQIRYVTAGSILVKKAGHMRVTDTSLPGNTVPRYKRELAAGKTANKLMDAIKDSELLNRKHSLSEHIDISDRTENGHLAGCTGRRTMGTATGPDEAEHEQTGGGNADSKQNKTEP

SEQ ID NO: 996085 - protein, 218 aa, Homo sapiens
RAGVLWCKNSRNMPCGSVSARELLIHQLCLTYHYRALQKPCNIIVPLKGTQKGAGMRPCTVPTDSVWVDYVVMGTGQSEEAESRGSSPGHRVLYLGRWVPFWTSRNRSNPVSHRSMRGSARKSVCLERHDMRVTFHLKKESNNYKGGSMDFYTGGLRGPKVVNEGEALVLPATVGEKGGSHTGKRNDWGPLPRQLWSILQQVRFEIDVRVMHCFDLVV

SEQ ID NO: 996086 - protein, 112 aa, Homo sapiens
MEVVDPGDPRPMKTETGQCVNPEKINEGKQRVPRHRPESAQQGEKQRKKRTKRPAREDTPGTKKKTRAPKTDNHHQKRKKEQRQRTKQQRDQRNKASHQTTTSKDTHIDTTD

SEQ ID NO: 996087 - protein, 203 aa, Homo sapiens
MDILCHLAFGWGGAKKLGNGITERFDLGVAIEFVSPLQWRSHEGAQKPQESATRNEEFPSRVPAFVADGRTFQGNGLYTEEQEEFRKHGDQQLTGARERNRGNFSNGTISQEGALYPFGERELGGHHIYALGKHSTKPLVASLTKASVNQRRPFHQIFDAHMIGNFHADTTDQVYLMFIALCYHTLWPYQHGKTTCVPTRLWH

SEQ ID NO: 996088 - protein, 250 aa, Homo sapiens
MQWCGTDASREVCHNSSTTLGYKCLNILYLPTLWRGPFPTQEKINPSPRTWWSHAVPNAHDLPPSHSPRGLLTRENIHVGREANKHHDRTHGDTTTAPPHTTTQPTATTRKKIKSTASSTTHNHNPQHPTNHHPTDGRRRPHNHKPHTNPKRTHHHAHTQNPPQAIQNNSTRNNPTRTTTGYHQRSNYGRPNRIPTETANTQPATHFQTTTKIAATWQTSTTSGDQPTYMHHLTHKPIRNSHNESQHPPL

SEQ ID NO: 996089 - protein, 149 aa, Homo sapiens
MRPRGTNYPPIHKAEDIFGKHVEKGKCTQSRTVDHTEITRQNSEAPNRGTYAEKHMAKGRALQTGTVDWEHTHEQTNNWKHKRRCKQGVKPQSASVSHRYANEKDTHVDRNPRIGRREQNTNRDKNNSRHHNNSKREPQNANRWNRDTG

SEQ ID NO: 996090 - protein, 127 aa, Homo sapiens
ALNSCTCKWRFERNILRGSTGQLADIDQLDSRNESYTYSRTQWKTVSDGRRDRSNSHGAAQREREAQATVQESLIAKTWFKASTGLGRSLHVASSDRGATKDGQSSTRLAQNHSVGLAPDGEFHRGP

SEQ ID NO: 996091 - protein, 154 aa, Homo sapiens
GGQNNFKLFCPGKGKRGGPGVWGAVGCASLVSQPKKQFDWKGENTSVLGQHPSPGFGRLKGFAAITETPCEISGVLGEKCVVNTRHGHKNIVCRTACDVEILGVERRENFAHRGVSEENLCDPAEKRLHEASPEEIYPGQKRANTESEQESRQA

SEQ ID NO: 996092 - protein, 148 aa, Homo sapiens
MEVTRIVGRHPYDEGLTGYTEVWYTPVHTYAAHISRKKVCVILDVLNRIARMYTDIPPYVDRVNPLVVKDRISNKWEEQHIATQVQMPMWEERHTTPLCIRNGRKPRNERSESHTHTNEEYRKGLDPKTIETVGHMYVEHKVDYKPII

SEQ ID NO: 996093 - protein, 531 aa, Homo sapiens
ASSPSEKAMLQIRAPRSVKPKWREAGRCSTSGYLPGVYRSDAGRLRLWYLNGSVSGELNYYGRLQGNLKIGMRWSVHPADPLIVLLPPVSFATYDSPVSRSTQSRMSQAEVTARDLDSENTVSAWRKAVCRCYLIVFSERSDDSAPRGHNSDIEKPVYYNQNYRAQKRPFTPREGPISFPEKLDMDVNGIGSKYPFGRGSSGGSFSRIGRGRSFWMEGTKREGKQFPGRIPNRRHKANFASHGTPWACPKLNSTEDYRRYTRGTQNKVTSRKARSGRHLRSGAAGTKKPRASGRTIGNNNPVFGSYYPFGERRVASLIFRSAKTEPFPMRGGRGQHKGGKCWVIYQTYYVVRNNEFSSHHRNGKRVSIDPKKIIGLYNNSGRKSKTLGHASSYNALKPLHTGSEVLPFKLFPNGSYVLLKRTIERHVNKQHKAIENAKTVSTQRQKGHKRSHQKAHHRANNVTADENQHGRDGRLKPRTQPSWRQHDRERSGAQQRRPAGCAITRPDGKTAPQNDPIVTPATESRPTQSDV

SEQ ID NO: 996094 - protein, 430 aa, Homo sapiens
MTVIGYMGLAVSEKGDDPSKRRYPDGIDTVGITVVPQWLTPVHLLSIGTECEYIAKHTVEAEHDFLPKLKTLTLSQSFEATFTSHVLKQPAALAFAWKTVVESVDNWIIAHNTGTESPSEHVQALTLGDSKLKYAAEPRLPNHTSKQQLSGRRTDMGKVTLDASLGEPNLASWTSASAYHKGRINASRHRGPIGAAFLAGSQNIKPQIDARTLSAAHLTRAKRGHEKTKRRPRTPSSTYAQVTDRTTKRHPGEAIDTPSKECGDTHMSTNTIHENEGGQPDRTIPAGTRQGLNLPADIKESIREKTGTSNLNKYPRKLSHAKVRAVTARLAKKPKAENPQHHTPLPKKKLPPKTIQGEPAHSAKTRMQHKPKEKKPQKRRKRDTEKTNRNSRAEQQTRDRDISHRKPEADTQNAKDKNTKKQDKQKKKKN

SEQ ID NO: 996095 - protein, 312 aa, Homo sapiens
MVKPDKNPGQQTHIRRILTRRHPNSSTTDTTVIDGNQNNTLSAKATEFFTAEKPTIEDMKQQTGPTKRLNDHVKEQRPKTSTGHIANRSTVSNAVGHWRDQQSRNNRGTLGSTPPGMANTNCNRDRIKGNTNTCKQSHLTEAMNTTTHENRRTASDTSDTPSKHPLTTQHPRKHASETRNTTGGKKATQDGKPTQHKTNLGRTRGQTTNHNTARTTRVKTAQGHTHRQEKERKRNRGERTRRMRHHKQDGKTEPQLEEVQTHTRHKTVIDIATYATDEKRKGRETRLWKGNKTDKTTDKQYRYDQRPLNLRQ

SEQ ID NO: 996096 - protein, 262 aa, Homo sapiens
GRSWCLMVYAISWGRLDGHRGLTGTAGPQGGGRMLVKASALSGNFYRNELNYAGLFRSRNAGYDPSQIHFAEMTPYATILWCAAQTRHTSCADSGATVMDGPQRGQRRGPGPASWIQSFKGGFGNETSPRTPGRLSLAKGNTEDRIEVVFSHVMTRLPNGGFGLDRFIGKGPLTQKGKTMFLDPFIFLAWGRRFADFNRKGSRVVGDTVHRRMLNEGHPMDAKTRRDNGRISRIILSISRDMKEIMLHDRYGQEAEKIRGEY

SEQ ID NO: 996097 - protein, 443 aa, Homo sapiens
VVPETCLGSRILTTRATVDVSCRRKRAAVQVAPDLGVYTRDRPPVARAPLRQGSLDNLVNIIRVCEETFDANLRQMLRVVVQSLLAWTRHGFAWLWLTRQSLGPSQMGGIYMPESGQTTFLSIKIAVLFDRCTHATRDLTFFKGLRVEEQVTARARSTWVEYCEAAPLRVHKHPTLVSPHTWRGGRWYHPKMKLAVPSMGKVQRTHGLLRRTIEEKQTAGDTRTYRNPLMEEIHPVSGINSDGQFQNILKKDNFEIPRWEVACNPETSQTLQRITAVGSQTPNGRTQYTESSGRPDGTGRRSPDRVQQAPGRETERRSQLHSKARHCTSLAERVRTKTSTGTRHGPSGDNPMRAHKPGAADKENRNATKSNTLAEPTTHRQKMRQRRKKQLARGQHQKREFTTNGEPAKRQTNKTKRTPRPHKDQAATLHTARHSEINNPSPQ

SEQ ID NO: 996098 - protein, 238 aa, Homo sapiens
MRGHRAQGHTGAGPREDDHGERPHTRNGDKQRRSSKETRTQESGPKHSESKKEPDMQRRRSTHQEEEGQHDHTTRRRQRMRDRKHRASPTKRKRKRERVTEREAARTTDTTNTDTKTATGEHHLNPPTRTEKGEGEQHPSSREETPTTNKDNKTETHRHTHTEVREAELSVKDKTDKQRTKQADQTEANPTDTHTTSQPEGETNKPQISTNSPEPQRAKRREATPTEAQQRTTRDTAH

SEQ ID NO: 996099 - protein, 501 aa, Homo sapiens
SGQCGQRRADGLERRNQIAASPKTLSYCGRAWFPWDLFCERCREPLPAPQSPPGAAWPEAGAPSDRQQPLWRGVRPTMSAPVADDGVLCNGSLPVPEHRKNNEPLDVCDRTNIIKKNTVREHERTSKREERRRRTEEKQTEHTREQQGAAKNKKTEGKHNHTEAEKEETDKGTTGQHNKEQNNQERSDVTRNPAHDRTSTSQKRNTEERTRETQHEGNKEGEQRTEQEQATANRTPRKGTKEKPQTTQNTKTHRDNTREKRQQKENQIGTKRDTKDKPHETKRENTRNKERQQHTKAEEQKNQKKNRTTQTSTDDDGEGTDTKNESEKEEEEQNKQSKKTRQKMNSIEEEQERQESDERRTRAKRQEEQHKGGENNKRKRGKERHEQRSEGAAGHQSARASQTPETLRHVVDEKVEKSRGEHGQAGHGTQRIEENDSGKEKESGQDGDDAEDNMAQDDKERERGRTSRRTEKTTKRQGANEGTDQTTKDDERTGETSEQRR

SEQ ID NO: 996100 - protein, 575 aa, Homo sapiens
CIGYTATNQDFIQRLSTLIRQAIERQLPDLDLRLPTSGQEGHGGTRAAGGGMQAGRQAQQEERGMSNLLTLQMWAPYHVGRTDGREGGPRGERKTDGRTRATDLTRHANRKERRHGPPRQSSQHMTARPRKHRQQSPIDTRKKTKFTNKSTNQKRKSKERKDNTQEYPKRNKERNKHTKTHKKTENTIGTHGHAYQKPKSSDRRTKLENRNHKTGKKDDDRKKRKSKQPIARREQRRTNPRKRKDKISLQITKRDRTPTASIRRGHIPTLRNIRDKERPNLRQAGNAYNKRDSIRRVNNIDKRGEQHIRIRIILGHMQTHRQQGDNTREKHKKKLDNKTSTKSTKIIKMIKIQSTVEDKRHRRQKKQQQSTKEKQTRPHEQQEKRKDKGTNNDKQERTQKRTTHEGEKTQWEEKHSTPKKQKQRTNTQTDTSHDREDNGERQRETGHSNRRETAAYQKQNTKNKRSNARNFLNNARAASRTYDQETYRPQSTNHNTKAKRPVEQTSPEDRQTREHQKPEVSQTATTLDKEHEAHMTREQTATQTHIKQTQQQSKEVTRHTHEDSTTHNEYSAPKY

SEQ ID NO: 996101 - protein, 203 aa, Homo sapiens
MGETSSRDTRKSPRCICQPVVGGDTPPREKLEAAPPYPQNNYIEETTKRGGRTAQQKRPPHNTRWVMHNNTNTSNTGGGDTRHTSRRNRGANTHSLFTHRGGDNKICCENTAKKKRATDEADRACGAHNNEGEHNSAANQSRAGNELGKKQPAERKTRGTHEGRSTFCCVHQERCHHRNLWKKHLLIEAAHMPRKKTQSSAVQ

SEQ ID NO: 996102 - protein, 353 aa, Homo sapiens
VYSKQYLKNNKIASDMIPKGKSLPIEIKWSKLVEITHCGQMKRKYQCLQCDPAAQSRSPNIPDADRRAGRRWSARWPSIQGQAQVGSAAEPRPAMLYKIGQEQQDTPSFSLEVCNIVAGQRCIDTRLTDNQSSSMIRATAGSAPDRQEEISKLMRSASFNTDPYVREYVEYMVQTMRMTDRDWRRVTLHPTHSIPLKGSTELKPNWRSPCTRRQYWRTMEGNKSRSSTEANRKKSQDEECTKCRDISGPPQSDTMHGTVSTLRGPYSSRATSEKNLSKETTWACPKSSGPDTGHPAQHNRKWARTAGRHKEPGTLADTALSTARTNEGGHTKAAAKRPGSTRGNDSQHEHNTE

SEQ ID NO: 996103 - protein, 172 aa, Homo sapiens
MPGWRGRTGHTPAHRVERANGSERGDSRGHGTEENQRVRHTERRSQRDRVQNTRKRAQCNGKMIAHNARGQRQDKQEREKRETKNRRTEERRKENRQTTHTRRHNEQWRQETPRHRQRSISGRGGVRSNEGGRQDEEWRRQERQKRHRENKGAAFQGDGKTGHGASGEEGDR

SEQ ID NO: 996104 - protein, 211 aa, Homo sapiens
MRGHTLTLQVPHLSMASYTYLGRPGADLAPQPIYNRDCACALEEQPVLTDRRHHLNPKAKQREDDSRFCERPSTALDMYVDIPGRASTLLMPLGLHQLDICTWTSRSNVELNTTRDDPIITEGDYDRINPKAHPCTDTEKHWTCDRRNLEPVTKRSVAKPSLQRCRPDGRNSALQPIKRRRTAGERSQLTPDPHQGRTALCPQRLAPPGDD

SEQ ID NO: 996105 - protein, 198 aa, Homo sapiens
CLSPTDAWRTDGEREVRQSCALRWPRCMQSLPASGCSLLIALGPAGSSSSRWPGPGHYLLVWAACLPPVNLTLARQIACEPGCCGGAAGLTRSNLRKAPMCAAVLRLCVLRGGACLDTCAVKLCEGCACGGVALLGTLTKTRLMPVNRLLIASREVPWLSRRRTRTHILGRLGTKRQRGNTNFITPIWEELAKGGNGT

SEQ ID NO: 996106 - protein, 102 aa, Homo sapiens
MRTTTTNREKSEETQTRNRDEDTGGKTTEDTTQSERAQRDRQSRTTALQCKHRNEHNKRGEQQTTVAQVTLDRHTRRYRQTCESRHTQVRKCQSDEHNRENT

SEQ ID NO: 996107 - protein, 117 aa, Homo sapiens
VEAESLTRQSSPVDVGGDEPQEKVCYLWKRGRIGGTWNNWLVSLASIHTVMRGVTHQVTREACRGLELVVGLDRSKSLRKPCRSEAPVLPKDGAVNGPSVVGDQTPIEALDFYRKTD

SEQ ID NO: 996108 - protein, 85 aa, Homo sapiens
PGDSHARVLTDGGLAALREVPQWLHGRMVQEWWQCPALRETSYFSVGNHWRIHTVEWAELPTMTTSHLVDGDDSHSNTLLTADNW

SEQ ID NO: 996109 - protein, 104 aa, Homo sapiens
APGEARGTEREAGTMYRRKLTALDYHNPAGFNCKDETEFRNFIVYGLKTRKSGTTRLTTEGHLRHIHSSDWPKFFEKYLRDVELSFHRFKIDKKLLTGFLVIDC

SEQ ID NO: 996110 - protein, 152 aa, Homo sapiens
VNGYRGRGLCHLVVFALRLAVIRTRSRRPDGRWPGETGGPRRLERPELGWSLRGVRVAVEERAVRSACGEGEALNRLRKYPEHAGPSGQVGRVLVLMHSWLEYQNLRVGLDRVAQKQAQRRLIPLDRYGAQGGNYIVGTLYNCCHVSTANPV

SEQ ID NO: 996111 - protein, 36 aa, Homo sapiens
MAGTDSASDAEERTDTRPARMPKEAILLEEDFLLKA

SEQ ID NO: 996112 - protein, 290 aa, Homo sapiens
MSVDKAELCGSLLTWLQTFHVPSSTVPAHQDLSSGLADSLCAEPEVDPILGSTAGMASKGIIGKIHGPQLEQLTGPAHLKHGLTRAIVAVLPGMSMDASMCQQEHLPACEPSLESSQTRQSSGKLLQLVLGCAISCETKQDHIQRIMTLEESVQHVVMASHPRAHDQETIMTTHGHQTDVWQLDRQNRRIQYLSEEAAEGTEIRRADRTRGENRNNRKEEQATLEIANKTHTRIRKKGARTKNQEHTSAKRNQKNNRTERQAEQNADTSEAPQNTQRTKHKKKTRDRRNQ

SEQ ID NO: 996113 - protein, 340 aa, Homo sapiens
AACRAEPADCPPFTLRCPVLRAVLPVPAALPCHHDWNSAISFAKDFLCLEASHAAISKTGLWLRSERVKLLLQCPARHPMQIRLNRQAVPKGIVDCIMSSIPKAARAVTVPSWRVQTYANATFASIHPIKALTLRLQRISSKDRTLHMEGDDGTQGHTRQRNMRGHYRQGDNTMSTSRAGCRARRQTTTHIHSNTEVHHRDEEINNPKETQGLGQRRHRDGQEVKGNKRTREIPEEALGSTGHRRQESTESTRTREIRERTNRKPKANYTERADTGKTRRQIKPKVTPGQRNQHKSSRDGDRTTREHKWRTAHQTRKHKETARTNNSENEGWDRHDDRTH

SEQ ID NO: 996114 - protein, 37 aa, Homo sapiens
MPTRNKTPRLMKANYKYGDISTRYYETAHYREPRRMH

SEQ ID NO: 996115 - protein, 125 aa, Homo sapiens
MIRTQTQGEQKHIEAEDLTTNKRAEADNTQAQHTDDGEQHRPDKRNAETREKERRNATAASRTTGERERAGSTADQTKRRTKSRGKTTQRKDATGRKIHTGRTRRETKKRTRTSKAQNQIEKPQE

SEQ ID NO: 996116 - protein, 590 aa, Homo sapiens
MFSGPYPKCELAAGCKGSIPGPAPSGAALGNRWALRLWNPLGWDTLYEEYELEMIYRHRDTYELTPTDGDQGLALEGDILHLTEIYHRDISLTETVSGHREQNESTRERGQHTREGRLPKNSPGIKRAIVRRHGGRTQLWGAPDETRLIALRQKQHRSDKKREGATNRNNNKRHSTQRHETGVQPTDEGEKSSWWKNKQANYEGTKPQTIQEPHRGHRRSHRHTMRRTTTSDNRQEKNEAEHTTEERNTLDERSTHHNRQQTSSKLTARSHEARRADEGGPSHTRPNITQIEPPTRTQPPSYSQIQFKTRERKTNKPPINEDPTKHSRQEIVRNAPQNERQRQTGTPSRSAPRTHTDKQQRARHKTSPRMVQATTDERRHKVRYRATKPRANEGGDKHHHTSQQAATHDEQHNRPTKTDEITAISITDDPERGTTINRHPADSKSAQTTQEHTNKNESKLNKTDVKTTPITKHISDGHTTREEARPPNAADLSEEKHPPAENKPPREDSRSHIPPTNRNNAQGDHQSSDPTTPARRTIYMDAGHNTTRVGEKQANIYTDGDCKKGGASRKTTVNAEPRRTTKRRERVAPQ

SEQ ID NO: 996117 - protein, 279 aa, Homo sapiens
REKKSLTGRKYNKFQKCLVFSPPYHPTSNRNTNHSITTHSLPQGVSTAANIWVSELRGKRGMEEECIWENTILSLFSPPSGPRLRKNLDCPRIQNSGSGSCENWGAKKLRRRKPLRGNEISAWEPLQNSVDPGALRTSGTNAPDQCDNSVPIESNMSCNILKLLNIIKQVDKVYSSTPKESTSPLINLLAYYNRRGTRAPRKLGREPTTGLQRPATGDTDDERPVQNTVAEQTMQNRTVLDQGISPHTGTPEDREAGSHTPNKHYTTRPARPGTQAPTL

SEQ ID NO: 996118 - protein, 399 aa, Homo sapiens
MPTCESDKYYTTHMRRQRSAPAQIHRGAAQHAPATDETHTRGIQKSHMATTLPARGGAHKHHQTCAQRGRATPPITPGPNASATPREHHEQAPAGHTSPTHRPDESSQQSTKKPVRQTPAEDARLQEERGETKTHTQTLSHLRTTSEEALYEQTPSPHHTRRERTTTHSRPPTRHNASNRERATSSDYNAPQPTAKRNTTQKQTQKANSSHTINQRATARDITHHEHNTEHIVPIYNRPTLTEHHTAAETIPTRLRTREQSARGEHNPARTYGRARARIPNVAQQSQHSELGENSEENNDETEHNRTAQQQRRTTKQEENERDPQNTNQGSSEVTMYTDETSNGETEQELREEEGQQDTISTYRRETEYNEGHEARKQDTKRQQRRGTANQEQTGLPTN

SEQ ID NO: 996119 - protein, 108 aa, Homo sapiens
MTPQNKKEEDVHGGAITAGVAPPEKKGGGRITEREKAREEQACVCVETQQPSIKFLRAEEINNIDRSRNQRVSAADEAACERTRRRAPKKKGGHTPEKEPRYVDEAKD

SEQ ID NO: 996120 - protein, 219 aa, Homo sapiens
KAETHLEFEVKDPDLESPGEMNVSDDPDAVEMTSDHLVRKLVHKGVAPPVKVGFGAFSEHCMPKCRMAAEDIEFPDMFMIGNLDVSSLEGPVVCPVPGSPSTQLSRLLCTHTNAKALTFGTCHPGQTGTVLVGCVRQEVGKLVAFAIPSDSCGVAVAEEECCPPPSNTEAPPGETRTEAGAETRSPGKAEAESDALPDDTVIESEALPSDIAAEGQSQD

SEQ ID NO: 996121 - protein, 437 aa, Homo sapiens
MHDGYHSIATNHNIPILMSINCWHVPAPSMAPKEWPSLRDDICTMKREGSKQRTRNSTVTKHVDVRLDSQETHCSIYIRGTESNPHSKTMNIVGTRNRRKELANHTTPTITIPFTAQTRRDIPRRRHIFMQDKRGSYSKRRINTCRERTTTRSKGKDANKARIDNKTLKWGPQGGKVPSQREWTMDHDPQIESKVGNFPGTTHKESDKRNEHNTNHKSRAMNHREQANPIPVRKWATLQREGTQAHQLELNQQIGPREPKRHKQETRNKAEEHTREETTKGRNGAIKHHQEPEEQQRQTTKSRNTRKKQRTNIEHPYKQDTNRQAQTKREKPTRQRHTTGDKTPKEERDTQQGTKTIDKKREATEDRRRRRRGAKTRQTMNEESTRTKKTGREQQDQQKRQNSTREQDKERSNESNKRQNNREQEKQKRQEREKKRE

SEQ ID NO: 996122 - protein, 215 aa, Homo sapiens
NSQALFFLSETSRPFLPVAVAQGRANSPQEAATPATSSRPIGVWQGSVGGKNSASQFAVTGVATPQDSVGFSIGLCPSKQHLRTTFPRSQLKPKGFVNNPPVRGILRVATGRTTQNLPAFFTHVFVSQGGLSPRASRSSGRPEFPPGRENRLGLTLRKEHHPFCFVSGAYKAPRFGVKKAETANKGGCKRFIRIQGRGLNWKTSPEKIKAFGRAV

SEQ ID NO: 996123 - protein, 307 aa, Homo sapiens
GACGQAPRSSGFVEWNTGVSSPQSRCWEALLVLREDTSKAGALPMEAPVARMSTQSTHPLKPEAPRLPSGIPESHEMLFSWGLHDLSLSTGDVSRAVTPRVTLSAPFDASSVYSLHSSVLVRLPPVPVMNDPVLPDPMSTACPWAWIRRDGHALWPFIIWLARGTRRDSLLESLTLHTVLGATIAHLHVLAVSPSPSGQQGMGPHPAVVLPAPPGQPAGRAPVPPLMCEGRAGTPSMRGPSSTPWAPAPLPVGSLTFMGASTVPAGHPFLRHEQRVLTGCQLGANMIPGLARVPLLMAGRFPRWGRP

SEQ ID NO: 996124 - protein, 86 aa, Homo sapiens
REAARTVQPGRAGGMAGPPALPPPETAAAATTAAAASSSAASPHYQEWILDTIDSLRSRKARPDLERICRMVRRRHGPEPERTRAE

SEQ ID NO: 996125 - protein, 242 aa, Homo sapiens
GLRQPGLPAPARPLASRCEREAPVPVAGGWRLEGPAHPPGLRRLPAAAASLNRGVVFCCFDPAVAACVCAAGLSALCRLVAVVLCLLAVSAELKQGCVELLLRVPGLPAYVNLGPVSPLHLAACPASFAVHAPSLRAVSEPRRCMCELVLAAFRTAWVELSPCHRTIEPVSYGPSCRGLGPVITERTTWRVNERTVICRRHGAPPESTGFRFLVVDSSWAIGTGKRKRLRNPYENEYISLRS

SEQ ID NO: 996126 - protein, 78 aa, Homo sapiens
MDRRQHHELSVKGACAPWWVKTAETHHTRDSLSKITTIYAVFVLRRALHMCPHLGFHSASVITSDKRVQSWLRITGTS

SEQ ID NO: 996127 - protein, 253 aa, Homo sapiens
DVKILVIPMVPFDHPASNRYVSNKPILESLVILPRLSPDVAQDSELLMTLGRNKAKAVMSIQSYVGQLVVVRLNSDHASHSQSPGEAGPELGARLKSSNREKDVVGKGIAFTESGGERVPDSISIGRFRNQQIDLVSLLMPEGLYRDSKFRGHDDVLFCVCRRPRSAQRVGARGVHQVARIRVNQMIASAVIQSAWREPIRHPQCCTFDRTMSSWAHMHVQRILTVRRARKEGPTTSSEGEVVGYQGKGYRMP

SEQ ID NO: 996128 - protein, 242 aa, Homo sapiens
RKLNRNQISSTTRASVTILHGSLFYPSYKPLEILRDLPSPFPTRHLQDSTFVVATGFPRTSRHYGLNFPPPIVRLQSALTQIVLTLSRSQNYLLLWLSGSPDSPRYVTILRKMWLDYVPVCLHLLNDGSLRKKETDKNTQENTYKKTQIRTRHIQYRNAVQRKPRTQRGDKGSWKGTEAAWGASSQKAPPRPSPAYTGRLYGAGRIQQSACGLCRRKNARRTEKQEDPTEGTKREKGVGGDP

SEQ ID NO: 996129 - protein, 280 aa, Homo sapiens
MAFLMLTERKILRYIQLRKGPNVVGPYVAYYNPSLTPVRTLHQGAPKTRTSIITLYITRPDLALIIALQYEPPSPEPNTLVNVKLGLLLILASSSLGVVLNPRDQGDAIKSQINALIGDHVRAVAISNLNEVSLDSHSYVNHTLVISGSFNLSTLSTTQEQLLITPGIMTLGHNMIDLHTYAEIKRNPFDLAEGECELVSSVTSNTRGPFDLMLHSEYTNMIINMHLSINLLDKCEALRRNDSHIGPRPTLTPVVIDSSQSQEFYLIKSLAYYRCPRSGP

SEQ ID NO: 996130 - protein, 333 aa, Homo sapiens
RGLSARSRPPAMAVHAYTSENRRTSDRGPDQERIRLRAGPPSSSPRTQRHPPAARHERQARRLRRASSRATRALLIRRYALPCIMHMRDTHLARLVRYGQRSNVDGSSSAFAKYRRTEWTRYGTAHASSTLASRGPRLGAHGRRIAKATLPGDLEASPALDRPWPCRFGSAPIFGTREAAGSPSTGLCAQITPFNPEPLAGAANGEMRCLGGPRTMESRPQVSPLGLPSLRGILSPKTKGLPSPKANLQAFDRVKLRYKRGVGQTFSSFQGNPREGRGARDKERTGRGLAVLLTRGFRRKSAQVENSKARGGVPVLGEPKAFRFPFSISLRVQ

SEQ ID NO: 996131 - protein, 102 aa, Homo sapiens
MRTDIGGVISNEGCMHPTARELLKMDMTQMEFPDASFQVVLDKGTLDAVLTDEEEKTLQQVDRMLAEVGRVLQVGGRYLCISLAQAHILKKAVGHFSREGWM

SEQ ID NO: 996132 - protein, 192 aa, Homo sapiens
MGSLGARHRRRLALLVCGSAIVDTPINDARSRAGAGGSSPAEAMDGFPGSESRYTTNGDYYVAVYASSIHCTVMFWSRRAYITEVAIYRSLGALRDRCDAHVPVNMCALRSDPSLVASNSHEVVPTLAGDVASTVVYHDGVLQSGASHTRGKGQYTLRKLAFAMARVKTTKMDSTGHCVAYCVKVINEQAGS

SEQ ID NO: 996133 - protein, 172 aa, Homo sapiens
SQVTQRAGSPTLRAARGVWLFAAAVEGTRGARWRWDGNRGVRSQGGASGEQGPKVKGGPGRESRQQGLVRFRASTFVDMMAAMSDTCPLPIMSTYDSSMQDINSFFANPILTLTERNRDLIQIRHGLRVSLTVQFGSASTACDFIFNMSCELTMGVPFTEAISLVHAGPSRS

SEQ ID NO: 996134 - protein, 117 aa, Homo sapiens
MCLALDAPAVCFLPREKILYQYHLSLCPVEFVLDMPQHLSLFPFLGVFDWEGAMCWVSPSRVLTLAWYFNSHPGFVVAAHVSSFSCYSVLVYRSCAVQSLSQGLTRMALSVLFVHVL

SEQ ID NO: 996135 - protein, 222 aa, Homo sapiens
MGCGVVESVETHVGGWAEPFASSFSVMCVRPSGLSRGVFFLKYFVALISGVSHSRVPRLRRGPRGRAEEARGKSCGARHNRVWAVSIPVGGTFLANQAVFGGAPSAKKTRAVADTVCQFVRGARRGDSSPQPEKVPGNKERIPTFVKGLIPEWPIVVSLPNDEPPIFHGWGKNTLKRASGVPPGYYRGAPPVAVNTRTGSYWEALSPRPRGAFVCLPRKGPF

SEQ ID NO: 996136 - protein, 206 aa, Homo sapiens
PKKRFFFFSKNGKKKTKRGPPGGENLGSPPPQKKGGGGGPPLTPFLLVHYWLPPFGLHSVVWRLSPRGGAPPPSSGGAGGFVGPTQRRLYCPSTPLFLPQKYFLGGEGTFCATKKRGGHNEERKKRSWRRRCGSARQKERCELSIQKGWEACENQKKTHQGWSTRVVWWRTKRRETWGPHTPLGVEHEREPKRGGVADPEWKVAHP

SEQ ID NO: 996137 - protein, 241 aa, Homo sapiens
EDPSSMGRCDPWTEEGRRVCVPCVNVNAPIKAAARLLSVDYRCRRTRATSYGASLKGSIIHRYLGTAVSSLPSAKSESFLGVLVSQSLSNARTDHASCADRWSYIMSGAQDLMVYAGQGNGRLRLQAGRHCCPVASTQMLLNGLGEDSWYALSRQGGEERLGRTALDTAVCSLASTLWSKTLWHHTDLSSHATETREKPNAQTPVMESLATTRVFPIEKVYFSLYAQPEARVFAWLVRLVG

SEQ ID NO: 996138 - protein, 287 aa, Homo sapiens
SGALVVFEEAFFSFCEHGNQLEYLVGSLCGSASGWMFLVLLMVALVGELSGPLRLRGSAQVDLLAFFDHHSSFDLSKTLASNAGEGSSRKQSRCDRLAHGSKQLRVVDWLVKNIDIGAWGRIHGCGDSDKRTLGLRHVWARGMPRVAMSQNTALLSLVLMAGTFFIGFFLRRFKKQSVLVLAGSGGELGTLWVPIAILDHGALWNYSIEDTYSQKLERSHVDIGDWPKKRGARVINPLGEKSPFLCGGWFARPVPHLVFILILMETKITSSSSQEGGMLQKGRFHWN

SEQ ID NO: 996139 - protein, 225 aa, Homo sapiens
MVPRYQKHLPAYNTIKTGLRECGGGELSSGLLVSQSSLRVLDISLLKFVVDSDGVKKLPINAVATLVAPRVVDSVLLIKCEKLNPRGGRARGKISTNSEGREKSTGCGLPHDRVSSHSGVFVKRTEKSRGNSRKTLPCLVVKGSRGKAPKHEPCGPPVMWVGVKDFSGKAVRDVGLEKRVAPCVLDTSTQKKQPLQRACRKGPLGGKMGVAQFSISWGTYGRQEL

SEQ ID NO: 996140 - protein, 82 aa, Homo sapiens
KLEAQEMPSQLFTLGASEHRPLKTPYFDAGASCTEQEMPRIPMSCPPLEERSGPLSPWSHIAWGPPIPVPPGPTLLCEDVSL

SEQ ID NO: 996141 - protein, 104 aa, Homo sapiens
MHTHPKNMQDQGNQQNKETQARHEQLEKPNQIQSNKDKSKTENNRQKTSDKPTRLPREQETNNNQHMSRNTRQNETVNKPKKHIEDTHATNPKKQHDNNYNKHK

SEQ ID NO: 996142 - protein, 179 aa, Homo sapiens
MQSLGSLCSRTYACEQTGSAMDRNFGFSNHDWACGQMTRESVFRCVTCQIVMCQLDAPWLAGKEGTPGGKHLVDLRRFEALQCFKKQIPDSVRPQDIPYAIAFPKVFPKVRTVVDVEVTWIAKTLVNKALRIKARMRTDSAVEAGLVPRGNTTGPRDPGGNPSNRTPAWETYSSLQVTK

SEQ ID NO: 996143 - protein, 213 aa, Homo sapiens
ARTPSTRLTAPAGPAALAVRHVPCYVSPTLVCLPETCCAQWTYPCCYFTCGRRCAHAAQWCDVSWLAYVIYLYRVYKRSMTMFNPDLAIHEVSFPVVNQGQLSALCACELPTGIPPYGVPFPTITPQVPLVTRNVVRHIIIHGSGRKLVSKKASTKTYKKHQRKDIQRQLARSIRRFLCERLAEAQLIEKQGIVRATIRKSQNTIVIYITIGL

SEQ ID NO: 996144 - protein, 229 aa, Homo sapiens
MGGDLRIVSGADIMTHACDQPGDRTTDYTIHVWFIAAEAYARLLYQSFMGRIPALPTSSLLQAIDVCVIPEVHACERRLLTSHCVNSLWMLPSLLLRSILVVPRGHWCMEVYQWYLCKGPSFPVAIKRRGRTLERPYRCSMNVGSTCEATAIVVPTPSQLLHDNDLALDVCARMMLAFWVVPPNGTRDDRYMRWRRGGVKASMSSVPKPRGVVIERPQCYSPSLLRILT

SEQ ID NO: 996145 - protein, 360 aa, Homo sapiens
DQDQIVTVADGDGHLDEGFNPPTIVAHMASSSPRQDSEAEPRVHERLSPQTPGCGMELPERGLSYQGSSHSFTINPSRMRAPFSTSPKLTPMDNRPPGQGSLIPYPHTLKLHSSSHNDPGITLATLAAGENMTLSRQALDPGSKPMHYRDELLIPAGIVIRDASSDRPQVKCRYSVLARQHVQSEPGSSHFNPHSKIASFDNQAHYDTASFRLICHNYTGYPTLHELMYTYSTAEGFNNTHRKEDIDYNDTLHRHYNIAHSCAIDHKKNRKRHHDNTMTTEIDNRTQKHNEQQAQKRTHKEQAPKEKNTTTDHKLAHTDTEPHKKHTKKDKDNDDPKQEQKDTEHEPEGTKQNIKNKKRT

SEQ ID NO: 996146 - protein, 166 aa, Homo sapiens
AFPDFVYKRIKARNRLAEIHGVPRGLYDGARPRGDGACQCQGVAAPGPSRHCSRGNDRPYHYLCRNPYDRVAGGCRAVIVRVCRGRDIERINSRVRQLGSMQVISVAASPAAVSKRSRLSSFRRTSQGTWSRAMVSPVSWSLSADGLSRGTRGALRSLRPLGMFAC

SEQ ID NO: 996147 - protein, 30 aa, Homo sapiens
MANYNASRRDTGQWAEISPDFPARFQINMT

SEQ ID NO: 996148 - protein, 131 aa, Homo sapiens
VYRRLGTGVGVARNRVLGVQAAEDPRRPAPVSAWADSRGRQAVPGGHVAANKVAPGCMLTGCDQCTMRGQGPQQGAEHYVLQDGLFVAIVDILPFEWCLTASGVEDFIDDHVASRGLDSCDTLANWRGSAP

SEQ ID NO: 996149 - protein, 275 aa, Homo sapiens
MCSLEILNVVSFTIQNSIECKGYVGRNKCLCRKHNEVKDVPEELMVKVRERGLYYCDRIFQMHTPQEPVALKHGVGGWGTDTDKRKHAAIVNTISRHYNSNVRIVLSVSGSNWPPNNPRVSRGIKNNLNSPTLLRWDRTIADFLKHYPMEPRSNWEKRWRWRLFDALLDKLIILEGLRPQNRNLVTKVLPRPIDELGGKTKAARGKFGGHLGGRAHLIEVAILGTWGSHAGGPRSPGRHKIGESFNGLSYSGKLLHTYSESAQGKMYPSLRLGKT

SEQ ID NO: 996150 - protein, 108 aa, Homo sapiens
APRRCRTDEIGSCSALSVTEVSRAFSLLCKMATLKEQTQLHQVMRERSRQAASKIMITVAGVFGQVGYGCVLSGILGKSHGLNERCFLMGCFWTRSRALRGKKWNGIV

SEQ ID NO: 996151 - protein, 150 aa, Homo sapiens
ARGALTEVACFTFSQLWRNRVASKRLLHAASARSRSPCVAVVRRNRLRGHVMHRRSFPRHPSAGASLRASCCFLSSRDVGLIWRNVLRARGASRRGALLMISHCRTLLRIERRKAVDDASETKGAATLTRNRRMLRRGIQDVTMPLRDRH

SEQ ID NO: 996152 - protein, 238 aa, Homo sapiens
ALCEHKSHVPSHLAQIPQMYVRPDDFPRSVEGVVRRSSWALYRLSSQKYLKLGLGHRPNDSAYGSAKGGLGEGTVVGKLMSQREPRNAQEANKRFLLFPLASAFSLFVMLLRAEGLKDISRRLRGMASRGRPASASVSGRACSLNGRLVRWEHNRGASLGIVGPCCPALHDFRWGSKFWKVCAQRVVMGLACSSQHWGGRALACPEWGRGGSTPARRERRHRVRGPAAWVAKQRMILV

SEQ ID NO: 996153 - protein, 154 aa, Homo sapiens
ASWARVSAAAMAAVDLEKLRASVRGKAIGRPDQAAATRNGMNAAVRAVTRMGIYVGAKVFLIYEGYEGLVEGGETIKHANWVSVSNIIQLGGSLSLAALACKAFYHQWRGAGHAVYKLVHATASSNAVTSSCGDAQSLAGSQSSCRQASGAACW

SEQ ID NO: 996154 - protein, 42 aa, Homo sapiens
MPICFRSLGDTRLLLAGIPSGRSGRASALARDVPTFPLDVVD

SEQ ID NO: 996155 - protein, 370 aa, Homo sapiens
MVVSAVIIVTRGPFSSGTRSTKTVVAFAKYAVPKYRCNAIYINTSRLALLKLGQLTPVLRHSLWAIRRGIAVWHISLGWYSPSFAEAQATGKSRRGDADICKRTIAERRFPAPAEGHTQAGSTQFSEVVAIRAKSIRLRFRHRGGTCAARNPLQWLCNTVGTLAQGNPNKTLKGVHTMGANSRWGGKELHKLRKVVVHTLSNPIKCSPSKSGTKGNTGGLAGLRIGEAALTWNGAELVHWNGSRLGGLDFGRTGGTPLALESLKLFLKGLTQLNGCLFGAHPAPPKDRSCRPNGTPLWEGPYSQTIASVHMETVGLRPLREKALGLGVGVWPKKRPKRKFPKASGKPPPDRLQRAQSGSRHWAGLACEGL

SEQ ID NO: 996156 - protein, 190 aa, Homo sapiens
MRVQQAVPVRGASWATTLDSQLFGSMCFSARWVDWMRMLRGRWDTVYSPRAIIQGLTRAMYSRRSKMTPWWEHHGSIGGYADGETFPGYVGHGLGYAYESPFVGPTGYGGITVGFTPLLRDVLEKAPVLSPEPRARDFNKRLHANCCTTEDAGSYNRFNRHVPKGLNRALVSAPMGMPMSVWNEPMFDDA

SEQ ID NO: 996157 - protein, 82 aa, Homo sapiens
GRTQLTWSSPHELVREVSRSLLSPVAWMAHRLNGKIVYCDPSLRDNKEAIHVSNPSKIHSVVECLDNSLVYWSVCLIYVYCA

SEQ ID NO: 996158 - protein, 96 aa, Homo sapiens
MLHDEASLMIHSFPDLSNKFTYDEVGSLLTPRLNSRYRSDDKETPLELRALAVNGVLWRHDIDDECSNNEREDLTRGPPSSLRKGSRSSLEATRSM

SEQ ID NO: 996159 - protein, 73 aa, Homo sapiens
IPQNNNNLENLINPGAVIRAEGHQMAAEHKSQAPRCTGKKRLARSCRGEEGPGVYTRGYRLHNRLRRRLSSDG

SEQ ID NO: 996160 - protein, 43 aa, Homo sapiens
MRMYEVSDSVYGMSCEQEEGRVYRGTYGPPPLPKGDCGPITRA

SEQ ID NO: 996161 - protein, 141 aa, Homo sapiens
GFKAAVCLTGMTVAGVVLLGSLVQSEMTRLLTIHSTTPYPRSSAPPHPPFQLARVAQPRSNQLAMHARDDPTLAPITRVVERRRLVDRLCRRHTYSLSKFTSQLCVDEGHPRQPCEVAPLRAASISQKRLFPARDNLVANT

SEQ ID NO: 996162 - protein, 480 aa, Homo sapiens
MPSLKKSHCEHQGARGPTKCLSARTWAREYSTKRSGTHHQQGGRHTHIENTVATYIRCRHPQSGGNPTQISTRPQRDPDWMTHRPQSVGNHMRGGITTPRKTQQGGGQAYKIPGHKKRQGSPNSGPMPEPNLQEGPTQHTTKPQATSGGENPMWNTNKPNTMWTPPTNPTQEQRPPKETVQPEAKPINPGATTTKKHYPAQESNLGGDETSGTTPPQGEDIHKLPPRNVSQATARASGNTSHPAHSSDPTLGDGHYSGRQNTSGDTRSAQTPEKRLCSSTKQHNKTRGSAQISRTQSEQTGVTPRQRHNKNRNNAPTREIHDATHEVAIKRTQAHTSTPNNEVDTRITQPGRHTPTYPAETAYPTTPPRAKRASHIRRKRANQTAHPDKLVTRPIRHNSNKPSPSLHHTARIVPTPHQDQPPDAIRQHSDATNDRAPYTQTGQSRPKTTKNTEKHPYTTNHSPRRQQAARSNTNAQAPRH

SEQ ID NO: 996163 - protein, 109 aa, Homo sapiens
MPGKWEEKRTLGPPTREQLVSLEQTEKCIDLHLWSFSKNLRHRVLALGSLLHKAQTCCGTQVGQDWVSSPLGPLEQCWAPLLSCFHNKSGGRYDLFLYTRVHTCGGTRC

SEQ ID NO: 996164 - protein, 247 aa, Homo sapiens
VNRPPSLLVPMSPRSTVLACRRANGEEGSPSRLNGFYYSRGRQQATQVGTGEEVSSHVESHDIRLRFQCKKTFNDASRQVLIYNTCLPTNVHTSEQALTRHRERGWYATERPRHGYTQKSYAESKVKYTFGLFMRVHPSRPICRVSTLLLGTRLENRGYTRQSVRLVPRMHSCALLNAVNTCVGHVKPVVHALRLASQGRRATRGQGGLARGGRKCMLVQAGMRGRPALMCWQQEGKAQAREKVSTP

SEQ ID NO: 996165 - protein, 73 aa, Homo sapiens
MHQVWFRIGPVRVVVQTRGGKSTVCTLKKAGWEPGAARLSYGGKNVYPPRTDVSGGWWEREATWKGPPEGFWG

SEQ ID NO: 996166 - protein, 110 aa, Homo sapiens
WKQNFTLLWPRLECKGLLSASRATFCAFAGVEADSPCLSPPKLAWHLQALRQQARLVYWYFYSRKRDFLSMCVAQAWFSRNSPCTPQGVYSLPPSLCLPKSVRGYYTGAL

SEQ ID NO: 996167 - protein, 81 aa, Homo sapiens
MQELNKYRLRTNCKNAGPCTLLRRGPQPFLVGAGPGLQNMLRRFIIVISLAEWKVPMPSYNTSVFKHDMGNCLSMSVYSVQ

SEQ ID NO: 996168 - protein, 155 aa, Homo sapiens
MGDDCVPPKSVPEKKHKRGPGRDLVSPGGRPPPAGVGYNPLLKDTMMRGISPPREKNLSPTDKNLTTIFTRGPGEKRRHPISIVGAPPWEKPGFGGEHPCVRSRPRDREQTIAADCQHPKRCRYYTPLDSSKQAPPRGETPPTLTDTARESSHST

SEQ ID NO: 996169 - protein, 159 aa, Homo sapiens
MAPPNDEYQYRCGASLTAWRCSVKILDVSNSSRISVEWPEMSVEQSAKGAHSAVVCRVIPSEKQGARFDQRTSFCEMKEADENTAVGGLGYPSVGETGSISQTSISAVVAGSIMRREVWPHSTHWCGDPPLNTSEGVAALVRVSRRCDSYSSGRNLAYY

SEQ ID NO: 996170 - protein, 243 aa, Homo sapiens
LREDGGRAGGEVKVDGSEPKLRQEVVVIISSRVLCHVDRKRAVRLVERGSLRRNLLGMSGVDRELRLGHTLRPFHEAALTKGQGHFLINRSELIGGACNKREKKVSQRRRPHRKSSVEKQLRRKPSACLPSKHTELIDGVGPEEERRGNPGSSLRKIRWIMQVHLGLDMCSPGGSTHNTGHHKIAMSRNLHSTDFYAKNFSHLTYLGITCIVNLLKGGQVGIHDPKEVFWGKAPSSMKSSMIG

SEQ ID NO: 996171 - protein, 241 aa, Homo sapiens
MQSILYLPLVCQRKSNVEAYHTPDVAFGNEIASWSHLPRGSRQAGGQKRQESKLSHTIKFSDPTRLTGFYINCSWDRTRRTYTTEKMSDTSLTVTGGIMKPEQGATTGRGCNERQATPHPHPPCGNVVVTTTSQAPPRRLHWTRGQSSPTQAKQGQHTSKPSTQQESSLTSRGQSWRDSCQKAVPIKAKQEAQSTRNVQPRDNCNEMVPPTGRQTRQSTTRQTTTGRQTEQQTPEQTPAPE

SEQ ID NO: 996172 - protein, 281 aa, Homo sapiens
PPKNRGGGAPPGAPQGGGAPPRKKNTPAGGGPKFCLGPPAGGGGERENTEGGVEWSKKKKGGGGGPPRKDDICAPGPWSEEGGAPGVMTPPPAGMGGGGRARERKKGDDDGRVLTDSRGGVEQGRGGGGGEGCPPAAREQQLAKKEEAAVGVLTPTRGRAIKRKREPPNWGWRAAPHPSVSGELVCWHEEKPPQEGRATQWSGRSLKPGSNYAISAETAILEQTGDDCQTTQVRDSPPQNRWAPPDERERRALVFGEGTPRWCENNLWGDQSRQQKRDPRW

SEQ ID NO: 996173 - protein, 181 aa, Homo sapiens
ATDAMNICPRRAGTFRNKDNVARVRRDEAQAREEEKERDAEGAAWLINEARTEFLRKKARHQNSLSELEASKDGGSPQSFWPLWDLIAAERAWRGTWKGGEQRQLKSTRNNMRQEKERHRKKSFLVLFWTEYLAPEMCAEVTDSSALSTQAYRPPGSEVESARDTGSLHRIIDEGSLVSTG

SEQ ID NO: 996174 - protein, 102 aa, Homo sapiens
MIAQLRMLGFALVMKMLPRGSHVWLLLYPGLRHRGTSLVDRAGLITRLRWLGLRSPSVRGVCFLSGLGRTTPWSFPPLTSDIKGNLGLPRDLHNLVPQEAFT

SEQ ID NO: 996175 - protein, 206 aa, Homo sapiens
DDSLSGTCAVITCRPPTITVLHGTLNRPVSTGDTYVALLARGPEHLSCGRTAITATWGLRISATSQMGLDAKEMACSYTSKTISGPRCIGKVKNRMQVRYHVVHYTYHNAFVCRIEYWNVQTLYAYKMNRSMNPQYVCRLGELLREFVLHRLKPGHRGSALVIPAGGKTDSPAKEDLVMAITSAFGSIPQRHTRLDVSSEANGWAQ

SEQ ID NO: 996176 - protein, 101 aa, Homo sapiens
GERYPRPPRGPPHKGPRSCVAAAAVPWLASAGAEICCTSWGLFICCFFSGFLIFFVILDKMSVRDIKIERGTLVALGALQTVFPRDNFTKHVVNLGKASDE

SEQ ID NO: 996177 - protein, 99 aa, Homo sapiens
MATRYVWWDAECGEMNTWSSTVVTVVAATIRKSFCTLCDPVNKWWKFNCTETRYSRDHLKYDNTLVAVLQTEYTICQTLPRSRASNGGMATLALSIEGG

SEQ ID NO: 996178 - protein, 185 aa, Homo sapiens
MAVEPPVAPLEAPVDRITVILRPMVGGLFSTKCQHSNGSRIARVGPSMFLVNREEHEVYVRGGRIRITGAAQSRSMIRNGGGPSSRIQSAGLVSSEDDVKPWRIRVDAGRSFDTIISPRSSGSVRSDAQDVLPAYLSFPAVTKQVRLLHLSLPEVRQWKTQVTSISGNRLGGPARTTYGGPEKDL

SEQ ID NO: 996179 - protein, 102 aa, Homo sapiens
AVAFSCFKMKLNISFPVHWLPMLIEVKMNAYYVLSMRTRMGTEVAGDALCEEWERVTVAPNQMLGTTHRRSPHVRRVSFEPLRRVRLAYGAKRAFLLTRPNG

SEQ ID NO: 996180 - protein, 72 aa, Homo sapiens
RDGAEQEEPCAMVEKEEADGGISEEEAAQYDRQIRLWGLEALETVAGLSEMLLVGLKGLGAEIAKNSHLGSE

SEQ ID NO: 996181 - protein, 336 aa, Homo sapiens
HAGRDHPVSSVIAASITARLAIPPGLVPHEESSCIVKSAYGSYAWGLTDWMPVITNESPSSQFCKIIEAPRDRGREKRREIQALPTGPRVTEEHVWLRARSALWCLDDVRRWVRLCGSVPVLTTVFRQRAIRGPGLVASDRSSWAPVCRRIALRREQQTRPRNPPGHHWGERSPPRRQSSSSSSPSNEERHKQLVSPASAGGKMHGVLSQPCLSQQPVRHPSDWVPRRRHAWLVSAAGPACSLAGPGPGHRPPGLGRRGPHGPRLGASQAPRPLSNSPSKRSAVDRFSYFPLLLLGHNGVGAPVAACLLGRDTGPRSQAEPGSGVLTSGAEAGPIL

SEQ ID NO: 996182 - protein, 234 aa, Homo sapiens
QSYGFCGKGVCIVWQKKTRKKALGETPAFCPPLTPNGAAVFIEHRGGHTPPFPNLVPGVLPCGQWGGVVGVWDPCGRVGDLRSHSRDVVDIRLPSGVSKLCWLISRVHLAGSPRPRGDPRARANRKPRGRTPAPRGSSQSVGPEVHPSGEPSSYEPQSVLGGKTMCQETQGACIPWKVASGRGGGGHSLPTKSLGDQRKISLGARGISPVAIWAPLPQKAPIFTLRKTFKGQSS

SEQ ID NO: 996183 - protein, 111 aa, Homo sapiens
ARNLNGGTCLSSAAVRGITLLKPLSCTSIRRASSTDNAWEHSVEMVGRNKPRGREETVQEISIQRVCASVATYTLDLETHYNCTQQDTLANETVLNEEFHRTRVRLCVQRD

SEQ ID NO: 996184 - protein, 172 aa, Homo sapiens
DQQFHAITVTQKIVDGPSGRLRRDGREDLHNIIPALMTLSTLRSMSSLLLNEEARVVWSAVSPACRRVRGGPDLPCMKTLPDIDRAPEGGESRRRRDPIKGSPGRTLRTRWSPLTSIGTSTPPVFDAGADIGSSMKQVCQRYISWYEQTNLDYQANRGGGSFMVLINGHSRR

SEQ ID NO: 996185 - protein, 70 aa, Homo sapiens
AQHGLSSRLSLPLFFQKAPQPSQTRWCYVLVAVGGFDRNGLDHLTPAEIASPGRGNDEFLKNSVDDDMLS

SEQ ID NO: 996186 - protein, 237 aa, Homo sapiens
MIFKGGQTDSWGATPLFTRGGQGKTDNRLRDNLQDEHNPRATKRGPKHRGEDTHFLCTTSLEENFRGRTPQEGPKLSAGIQQHHGALLRREPRKNIQLGEQPLYSGGAHRYLSQVSPKGARRKHYASSEGRGKRSSYDQMRERASHQERICRVVEPPPMWRPPPEFEKRSMWVRTPTQPRREKQADHNNGGSSKHYTHQGGKEIYTPYGRFVRHPLVRDTSYFTPRLNNIMVAHLDH

SEQ ID NO: 996187 - protein, 99 aa, Homo sapiens
MLACAALGFDRVEACLGFPRDMIEQPRRIREVEKIMGLVELSMDSSPSKERRRTPEDSPESRNRNQLTNSWTKFSLEGFYWRTLRPWSNVGGPAWANGP

SEQ ID NO: 996188 - protein, 270 aa, Homo sapiens
MEGVRTRTTHSPCTEHVTRAAFTGVLDPVRPAHEARGSTGPASALAGTQPPALRSVWRAEQPTSGTHRERLVRTRRQNVCHGRRRAPIQIVQGAVFAVRTVLLLPLSNRTARHCGHILSVCMSNLYVNVLSVGHTTAREGGEAHVPRGLRSTKMLGWTPSKDIGVFAVVTKADAHSMAEVHASELLSLASPYAAYLQLALMEKYTIEEPLGTYTCRTLEGDKVEAQQIMPRCELAIGSRPLPIWYTDPLGGALCLSSRLEGQNTRKVRSK

SEQ ID NO: 996189 - protein, 102 aa, Homo sapiens
MATQVWLCGVVVNVGVYSPRIESRKWEPTIDSETSEGVLDGESAISHRVKCYTGYGKCVSMNPADPSEYRYPGGFGEKLTQVKPGTFQKIVPKDPDQALAGN

SEQ ID NO: 996190 - protein, 142 aa, Homo sapiens
PQIALLIGPYLKSELINKSWAGGSHIHQLVQFIAPRLLVPRGFSQRTTWRFTIRSASIRRFSQFSNLGASLSIFILSLTERLSWERDKLRLGTPFSLCVLFPQVGLVSGILHYSYVDPTLSLYHKCLIVWVCDTLSLRGSPK

SEQ ID NO: 996191 - protein, 86 aa, Homo sapiens
MSEEQKIKRRQGRGSPVYLFQTKYLKQQNLQKSPSLSIVCVFPTKVQTSRPEQTPLKRALSGANRAPRKKRSGKKRNRFANLTDFF

SEQ ID NO: 996192 - protein, 503 aa, Homo sapiens
KKVLLCPLGEKLQVTRELCCGVPSLTRGCAQVCENVCLSKKKKKIPLPRGWGREITRCVRDTCVEKISAGHILYMYNAQYDVCGPIIHKRGPGEHSWYSVACPRRGVYSARFHKERGGDEGGERSAERERTHKVGRRERGESLTPLETHTQRESISPTTEGPREHLSTLCVTLSERGAPRGEHRLYTLCIPPQSVSTQTTLSPEEGRHTERHHYSVRKREREYSHTRERAPMWGPRGHHWERGALHTPQARNLTTQHIVWGRRESHERAREGGATHTLMRRETTGEENIHPEETPPLSRGGGPTQHKHNRRNTLSKRQHSTPHITLPDKTIDGGRINKTPPLGGDKTGTTYNNNICASPQHDKRVGLRPHTHIQLVRNETPARLYPTTRGGGPHPTTGREWDTLPHPIMNYHTRWREKRIHTKQRITRTENRYFLLARVSLISSHSIIDGVVLTPTGEPLLSFLQTKRREPGDQAVILCCVVRRPRSVERPSVGEQLVWGCTY

SEQ ID NO: 996193 - protein, 58 aa, Homo sapiens
MRGGHHAKILITSESNPSRGLPGVRGVAQRAWPHNTTSGGEGHGALIKKRRPYWGETA

SEQ ID NO: 996194 - protein, 107 aa, Homo sapiens
MAGRLPAGPWGMGSALNLSGWGVRASAGLRMLQQKSCVHRAECAGDDQKLMLLSSSDRVEDAREDHPIPCALTGRSCTRLHYVFLRYPTLIISCNYYRETLRITSKT

SEQ ID NO: 996195 - protein, 325 aa, Homo sapiens
EEEDEEEEIDVVTVGLVVASSDINGVTRWQHRCACHERSPGSREGSSPHEVILKWMPAIHQQHNMPPPLPTCESEDASPLQKMIKSEASPRPLKSVIHPKRLESLSPRNSDSEDSERRRNHIILVAPAFARTFGPCFLTLRDRRAGVGHTNEKAAKVVVLKTGHVSMSTPSKAEETPAFCWNRKNCRRDSSSWYLKIEQRSDLLEASQTVQSLQLGTFDIVEPNVVVALKKCGFTSNRSRVRVRHRVGREHQVGSVERWAAEPMCCGLSSHLTPDMGYVDEGPWGVEPGVQFDTRRLLRHREQGAPGINGRLRKRGKTINRNQTN

SEQ ID NO: 996196 - protein, 261 aa, Homo sapiens
IKKGNLFWGPRAPGPGEGGPLKEKKTFFGPFFGNPVVRRGVTPNLSSLGGKLETARRGLKGTNTIPSGRRNPFVCATDGNSRGPHCGGREKGGLQIVVLTLCAEGPQTPGVSRGCENILYLTVRMFLENNSPVEDKMLSRAPNHPLTRVWMCARGKYIPPKNACGVHNRGGGEYHSPLSLCLVEENVGGLVETLLPREGVCSQVGASTNTLLREGVMESSVLWLPREERGSLSTRRENISSSLCVGEHNNIVPTYLQLCYV

SEQ ID NO: 996197 - protein, 190 aa, Homo sapiens
MPGSSSEYGSGIPRGEWKRWIPNICVLCKVPVPKGESRSPAALSTDSQQVDSSGQQGLSFHYPLLRVLQQNEAKHICSLLTSGIWWARAASNRAASLWDGLLLQQLNHQRCGQAHIAQSGPAGDPVSTFLSLGVFLRAQEGVPNWSREALGIEASSLAPPGGCPTSGEQGRDFPGAPPVVTLSHAVPETP

SEQ ID NO: 996198 - protein, 315 aa, Homo sapiens
GGGPPFKRGFGAKRRPRGGDTGESPPFPPKKGVPPPFSPGGGGSRQKEPARGEATRRDPHEWLTRCSRVEETSQPRRRCPTPPPGCGPQARRMNTAQDRSVHPPTAHTAGNSRRRTTPARPHDALPSAEGGAHSEGTGRQCARRHERGSQQPPNRKETGAGAPPRAEKAIFLRGRGQKKPPREGRPLIRRGVCRSSGDNHHKHPVEKESPPTSRGDHAREKRVCHPPKKKIVPPRVVTTTTDRSEEAGVTNTSQRRTPSDSTPEDKEWRRTTEATAPRLTERHTHSRNEGTNKTGGRQQSTTPQSHHEEPPRKTH

SEQ ID NO: 996199 - protein, 176 aa, Homo sapiens
RGGCGTLGRRKAGKRKWAGVLVQTPVATSQKSTQMVQEKIFIRFPRDPVGHRGCPGGPAVRALATKIQAAVGGAFTCAGKKFLSGEEISHLLSRLAAYRVHSITAPTAPRLPRRTPSSMVPMCGSLVFCIIAWGRQLVSRECPWDTSWPHDFPEPALREASELLRELCIKNMVWKY

SEQ ID NO: 996200 - protein, 137 aa, Homo sapiens
MYRRADVAAKIAVRARCCGRGPRPSSPGLTESPHDDFVFIFHCFANGTFQCRLATSVVQIDDWDMLQMCIYSLIERILCAADTVMIDSLKKTWAVSSNVLADSVLPAYMAMRKCLIGHKERLVEIIVSESLVGGIVH

SEQ ID NO: 996201 - protein, 235 aa, Homo sapiens
VLLSSLLEEISQVCFLRGTSKGVKSSPGPPGRQEAVGGTSPDDCDSRTWAEDTYCVGPLHHGLHKGLVVARWIQDTLTVSVRPSRNILVIEAIIGQAELTPVLGYEQRGELWQVDPGTTLPSQQRRRRGSYPEVSQLHDAIVQQEVTHGLVRHFIDEAFAIEGRNMVELVQGPRSSAIIALATVVGTLDDRLGLPRHGKGTLRVGLSKSGLWVMSRRHDGLAGGERASGEESSRG

SEQ ID NO: 996202 - protein, 217 aa, Homo sapiens
MRKKHPNEPGNKRTREQKQKKTKRGTAQEHKKTHTRKKKTSKDETKQDTDGDSNKTQNQEARKERHTTDETETKVKATKNETQQRTRETKEKTKTKLKPSTNDRKTLRRERGTGQREAGQEQEEAEEPQREVPTDACKTTRDEKAQQEQPADKAQPHNETETREETNKNNPNKHDVNPAQQIKEEHPHTHDKHTQKTPSQTATWREKSINDRTVISE

SEQ ID NO: 996203 - protein, 89 aa, Homo sapiens
KFLMVPILDRNGFATAWRTTEFYADIKILTGPKRLYAPTRASTSHSLHAIKSSTSKEAPKDTSEVIDNRAPRQSSALVSFRRLSYRVLF

SEQ ID NO: 996204 - protein, 179 aa, Homo sapiens
RTSSCQKSRGLFNRTASTIRSRYEAGAIRSSQNFSQSRRHTNKTARNNRGTLLGHCRQCQGKRTRRQKNGQPPPRGNEGPGDKQEKATQRRRMAGSGGWPPGCLKEESGSDEAGSGLILSSPVEKPLIPLMRIPNLALQSRGKPPSSRTKAGSKSASRTHRGSHRKDPSLPGILKLFKQ

SEQ ID NO: 996205 - protein, 213 aa, Homo sapiens
MRKPVHVSTPEQHSPQKESENKTERTSKPTETSTNTQTEAKNNTEAIDEKIAKRSPTEIQQNTRKNKNQNTTGEQSKNKKKRSQSNEPEMQNKGSELTRPQSGRSITRQDNTQQRENTDTNIEQHRHNNNQEEERITHNREPKHPGKRHDPHNQNKRQNKPIEHKADPGAMSEQRDTRKLSKRRNRKQVRDCIPNVTEAPAATTERDSKERAE

SEQ ID NO: 996206 - protein, 224 aa, Homo sapiens
SSLTQDGSTPQPSIPGPGVCELEQTSVEGQLCGIHGHSIQQSHAPGNNEIGDTLEQRSDIIKGPWAFIQPDPHYPDVGSQMSGTTLKYGSEIMPSSDSGPEEKTLNGRWNVTRDPATTHPLIDWMKLFAAGNNPGQEFRDTTMHRTGSIQYRSPDEAKQKTVRGKRRNRYTERNPPQRPAERHTYTSTKAQTHTDEYSSNQRGTRDAAQAQHANHKRQRNHAAL

SEQ ID NO: 996207 - protein, 198 aa, Homo sapiens
MAERGQCRARAVASEGGSPKLWQLPCGVQLQVHRSQELRFGNLHLDFRGVWKCLDAQARTFACRDRGPQDNLCSGPCSNGPMCGSRTPATDSPLRSASWRSETDGTMAPDPRNGGSHRQPRSVHLDQRAQPHGRPPVNAARGRLHCNARRRCNPDHGNPWCSLAAVHCAQRTSGTSTSRPHAPIAAGTLGQSNDNPYD

SEQ ID NO: 996208 - protein, 311 aa, Homo sapiens
MVEKINPLVLDHGFGVCPPGLCSGRYAHPSAMICFTIAARRAARSRKGRLVLVTMLSINDIHTWELTAGTEAKVCESTVGPMHSTSIDPMCESMRPILGGQYPGINESRAYYTLSYERKLLVVPGRDAPQVLAGSRPALKPKGPNREKMTSDYVGDLQHPGMFVAIQAVLSLYASVATSGIVMDSGDGGHPHGAIYEGYALPHAILRLDRGWPGLTSYLMKEFSTEEATVHTTAEPEIVRDIKEKLCYVRPDFEQRLHRGFSSSLEKNLHCRGQVIHPGMTGPCRGLPPSSGRLGSENPYHILSDPNFPVG

SEQ ID NO: 996209 - protein, 287 aa, Homo sapiens
MTLVQLSISCDHLIDKDIGSKSDPLCVPLTNDVGGEQLALSLAGLNGVQELLKTLSSSKTLHAGGTCFENESRSYAFGIYDIDEQDARAEGMMTFLRGAECSLAYRIVSKPRYCLSPCMLIGLDEHCWRWGDHLRSQLTELTDNSCSYTMEVEGHEDLDIGIGLPGKTLESTFMGASPRNTDDGTKGTVVYHESGGHQEQAETHSWKAFSSPRARIYVVGTPRTSVQCDKRPRLQCAVQMTYRYVQTGWQRLRVDRRELNDSHELADGTHSTQRCTTARCGYRRLFD

SEQ ID NO: 996210 - protein, 599 aa, Homo sapiens
AGAQAQHEIDRFNESPENKLWYFIGPGSRRAWGLEDIDERGERKLEGECPTQEDSSLAMRSYQVVISLWWQVELECDSLQEATIFWQQERKRIEAIGRHRDGHSPGAERKGIPDPSAYEIKHHTPDVTRWLGKMGLREGELVYRAMETTPVGGLVPAIQLENRFQPKRYRLGAGHNEELLERLFFLGLAQILIANPEVYISLKGTKGHFGESLSCAVPGRLGKLAKRLREDEITTRRPRYTRKTRRFQAGPFMETVGPIPRREERVLGGPRWFQAGLWSSGEGALLAMWKQFGIRPIPSFESLAAWKQDRPSITGSILNTVKPLCLAPLSTSLVRPFCLVNPWWGHGESLGQRHRGYYNLGAMWRPEAKGARSQARGAAQFSPGRLGGGKRWPTRSPKIPRDPWKREPFVVNIALGEVALGVRPQTGAVAGQSVHTGGAQKREGTPKREGRQQGKAPQGTLRGHRNQGVPEPAAGGCGGAYHDENGRVVQAEAQRAISTRERGEGGPKGAPPEWRAMQDPHEDAAKGYPFTSTGCRQAGDPGLRKHRRPRGLARKRDTWVVSNEGDRKETKTQWKSESKRRDDEDRQRDERGHDTKHPQ

SEQ ID NO: 996211 - protein, 290 aa, Homo sapiens
ASEAYSCFNDERWASPIPDHWVPEPHRSDRDERSHFVLFYVVSVWPARSELLTLWVKTGRVMWILKSSGWETEKTKVVPMKAIGCPLTHCSCPTCILRYGRYVPCYIQTQGITWQTDREHSGLCVVAIVVGANSETLLQSSGSICNKIRRDREFLDREHVYYSALERLGPKRARRIRKDFAIVLYREDDVRSHVVMKALEIKKVRNLDQSTQDSASCYSTCPEHKRRRICSGQKQRTKNNHRKRLQNMQTFGQGELTEAPETAQEQLRRDADFLSASFYSRSESSPNFDL

SEQ ID NO: 996212 - protein, 245 aa, Homo sapiens
MRMEDHAVKDRVNRRKEPHRPHTELVVTQSVEPAGPDEQANELDKTPHKTDTMCNYTVLDNQANSDWNEWTDNNKSGGNNGERHQTMPLDYAKDNDRNHEGQTKNTSEQPGNHAKRTRSNTLGIQPERDANKTKETSQRAAQVTIPRSHAKAQEKRQEHRIRRRMKNEGDSEEKGAQRKIKQQRPRQKARQKGQKKSRREAERQEQEPEKKRTKKSAESRTSTRRSLTPCGNDGKCTHTGKNQLE

SEQ ID NO: 996213 - protein, 380 aa, Homo sapiens
LVAIVRDPAALARSAFSYYKSTVITFRKSPVFGCLPGQSYEAFYRPGARGEQYDVGNLLWFDFGLAFPPEKRAKRGNIQSPRETRQGPAQLQVLPSGAGPRAQHLNPNARQSILFPLLLIIAGQISSACLVAIRGLHPSSSGVWAGWTLSLTWSWLAEYFDDVIGFCWQMTCAGDLDDVVGFMHNAQLDITGRAYSTCQQQWTDCGRTAADCTGPEPGTTGNLGHTIVHVNRDSGTGIDEYGQGRLQTAVAEAPGLDRDALAKHRLATGRRVRTPQYSTNTRNQPRHVGDTNGRGTQLAHGIGRPKEREERGGTDSPGDTPGASRRKRKPERVKGPRKGTPQRPYRSEENHMQTKISGTTNVDEHHAQQLHRSPPGPNEH

SEQ ID NO: 996214 - protein, 281 aa, Homo sapiens
MCYENNHRMCVLWVTIAARRERLRDHHRGAVLEAFAMTCAPCDVTASIMCDVTRASDRVCISFRNIAQISIVRPYPAYVTTKGYLVIAILWGNAPYGGIGPNQRPMLRQGKGTLLLIQSHNKFHYFDARCSDDSSMSSTLASISRSRSHFGSMPPTSKAKDREPCYCVRVREGWNSLEVATCRGPFSEELVSSGEALRPEEEAYCYGRTVEDSPLGLGDPNAEFPVGTRGLAFTWTSGKRFPLPRGEVVSPKGRTRAVALEVGFKPKAIWSHNAKEILDAR

SEQ ID NO: 996215 - protein, 400 aa, Homo sapiens
MSSAREKPTPPAMPAPTVRLLPCCTRPPSRPVRSLGQAAVRCLSSCAWPFDGLTCALLHCDALPVPAHALSCPVQPGCVACGAASVQANGAPTVLGRYVAAPLLSRSLPWSIVTCHALLACRMMGDRVATWERVLFGGPVRAPRASAVWEAARLDRVCGTTVTTFFWARALDLRLACGPARQLGQRSRSLLVRLLACTILVRVALLCCPSAALDAEKGAPRPGRLCELPIANHPGGPMRSTKAACNLTNWAGTDALSSIEHLSLNEVAGPGGAPVAFVAPCVPRACWPFGGRPSRWCLNVCEGTGTPCFGPSVCPVAPALPKVFRALRGHGPGGSRSGLRSLARLARHFPPRWAVPVRLIFSGHANGGGLPRFLTCSPPGGVLSSGASHRPPWETPFRFT

SEQ ID NO: 996216 - protein, 268 aa, Homo sapiens
ALFRQALLFCGIRDPLEVIQADLSDKTGFEQRFSRARTEPSESAHLGQSGFLGCPRQPTHSHATTHLTLLFLILANGAQALSAVCALHSAQRLSTGQGGQEMQRAWTALVRILARCDIMAAAGRWWHSSGSVHPAPASTNLNLISTGSGHLLGPLRQAPAGAAAPTWRRMCTSIGHHKTQVLMFLRSTTIEDERLCPGAICGPVLFGQECTSQPGVGPDGHQSLKARTEEMLKRPSYDASSGVSPQATGESKDVNPAGDFNACLRFTD

SEQ ID NO: 996217 - protein, 69 aa, Homo sapiens
DASGFRVGSGEVWSCSDFHEETAVCDVRMQRSGGTLGEPVTSLNPHCSEEPEWALRAGPRYWLAGRVGP

SEQ ID NO: 996218 - protein, 387 aa, Homo sapiens
MNTGDLTESGVNGAWKESSRPLWCTQEVVLCAPRNGRCFGVPGVTHLLPLGTVMREGRDSCNNCVLRNDQSSRRQRPWDNYLAICGAEHLHFLRGSGASGKVKASQGWRGWYEYRPSIGLHTGDKGEPRRPPRGESHGVPARNIASIPFICVDRQSCFSFAGGIRIYITLCLVRGTGDCHLLQARMDRLRRTVPSTHISHWWNYTLVNAVAANGVTPFGTPVYQGTLTLASAREAYYATARRCESGDEGSAEKGNEEVASLHKEIGGMIVEGPLVATLCPPPLCVYSGGTRRFVSQPYRGVNNGQNLFDNEMPLIKEFYGLGPLVVPGAALRSTPCTDSFSKVRLPVKALWGVNPVALFGQGISLQNLCLLYGPGKTGCTSVSPCNV

SEQ ID NO: 996219 - protein, 113 aa, Homo sapiens
MSKRGRGWVLWCEISGLSLGLRGKRCSQLVLTTHGSNNTMYIISVTRGSEGTAMNEHIPRVHGVGDDGDGHQSRKAKPELRRKVGSSSVVIRTYGESHTGENKMDVVILDFAR

SEQ ID NO: 996220 - protein, 135 aa, Homo sapiens
MDLHLLTLDQDLKDGGRPTPLPFRSKCALTRAREIDPGKYPLAPQDVKTGWQSSPDAPTPRCRQGKELKTSCDWEGWLDRKKSMSEAPGLHREWCFVHEKYEFLILREPFNGEVDGTDFQFRKGEMRSSMQDLGE

SEQ ID NO: 996221 - protein, 127 aa, Homo sapiens
MLVWQIRATLETTKEKTQVWPGAGTGELCDAEEGHQQTDVANSQRFHGQQAIHLPGPNMWSRSGSSRTRLGSGVAYLGLRILGKPDNWARDEHCCLKLRAVAHRGGIPSEGPSVGHAEGAVPLAKHE

SEQ ID NO: 996222 - protein, 310 aa, Homo sapiens
MTLEDGQGMAPRTLLLLISGALAVYPEAGARARSPMTGNSLRTIPDVARERRAEVRMHDLRSSTPPKVGAVAGGHLKTGELFAGWVAHRLNARDDQRRVVDARRRAVDSSRRITARRRILSCVSPGDLAAGRSAADGPQVDGTIVPPHVGTLVGSSMPAGILSNDETQRRFRRIVDRSVVWAVRIVGGIGSRSSVFVRWRFGDRALPYHSGVADFPNQARVITRRSSWRLDGHGCTDSCAWLSPHGHQSAYTVGASVGSHWSVGHGWQRGWTQGPYPLCTRGKLLSVRGMSVALPGGGITPLGRENPWQP

SEQ ID NO: 996223 - protein, 200 aa, Homo sapiens
MCSQGRGIPVSTEESSSSSEEEERTQTPLSPLRSSTKGLGRVTREQRPQGVGVGGLVGVEAVALCHPGSHERACTSRGPHEARMHGKSAETSSPVACVSGSFCSDPRLRRHVRVNHEGIKEFTPVRYCTEGKRTFSSRLILEKHVQVRDGLQLGAQSRGRGMHLARVPVSRGQGARSEDSRSRSDSCSEELRERSASKSP

SEQ ID NO: 996224 - protein, 68 aa, Homo sapiens
EDPGVAMGRRPVRCYRYCKNKPYPKSRFCRGVPVCQDSYFSDLGRHKQAKVDEFPAFVATMVSDELWS

SEQ ID NO: 996225 - protein, 272 aa, Homo sapiens
MIIQVGDFPLHDPGASDIYQAIFHDRTIALKERIGFRVTCGSRSTFGASSTSLICGPRRLTVHIYSSCRNCIMLAMFGSIGKRTNYCRRMLHAIWRSRYHSQGVFVSRQIAYRVSATGVAADEVAVMAYSFKLNVAEKGDRHLRLVPQLYGRTDGSVSWYCVEHLAQRGWGTWLLRGFARDFGSFRRPQPFPLGSLAPGFGLLPPGSPMKFPLGSPLDRAGPVSLLPKGVSIPFPFLFGKTDTPGGTRFLTRSPRAGGLQEQGPRRARGNPD

SEQ ID NO: 996226 - protein, 97 aa, Homo sapiens
MSTAAHSAEKWFPGNFRDLEKGVDPRGHIGLSEKGKATDTDSFRERCTSMRSAPFSRAQQPCWCAQDFGKAGDPTVEDKLNRATTVLGKKRRGGKNA

SEQ ID NO: 996227 - protein, 249 aa, Homo sapiens
LRDLFVFAAYAARVGRGAVQDLSSRCRSPPIVKHWDLPFSIMTPRDELARYGNEHELQMHLVQPYVAQTAILDLHTRVDMTREQIGRSSRSDRFGSRSLSHESRWVGTGCHRQHVIQVLEHVASGRHQFHCNISSSIRELSHAVNSSAVSIHRKDMVRGTQKAIGTKLFAFIGNCYHVLQRGTVCMVGILKDRVTRDLEDSVDWGLRSQGRAGATCDEGVKLQGKGSPTLHKVTAGIHRSTMGKHSVDE

SEQ ID NO: 996228 - protein, 300 aa, Homo sapiens
ILVWFWPHSRSSIGLPKEAPKKKKGHKWSPVVLGFFHSELVLMSAQESVGYQRRTCDHPGRVLSESVTNQASLCWTLSGDEIFQWWIIGKEGDGLGVLRIGTIGQLVRPQGCIGPTYSCGQSQPWKFCDKGPPIITSDSPDVVPSEKVNVVPHETGPWWTREKKPKVPSIVVYIDQVSPQPSGSQVSTVGFSKMWKTRVSPTRECVREERGLSCGPGGKNHLFSRKFPLILPFPWLSMWGRFTTCRVWHLGLWYEPLSQSTGEIVMLQSPLPEIYGRTWLCALGLTGGSGGHHSCGTIFI

SEQ ID NO: 996229 - protein, 302 aa, Homo sapiens
MPLWHVYSHYSENSYTVLSAICGMELRSSSNRPINLDYTVMFLTSSLHPSIFFYLISPHCTSYYIVEIRYTPQCDRTWSPNSPVCCPLVTPVFLQSLLPYRTDTICAPEAKYNAKTFLETGRSAQQIFWFLNRAVKKQQGGSRVLASCGQWLRDGVFPKRDLIGAYLTDEDPISWGRNPNSSRTLKSKDLEVELNDAHRSSFSALNYPALKSEETLAWINPFNQNWLGWTRVRWEGFDLQTAGYTPDQLGENARLVLGLSLGWGARQSKRQEKLVSVFPGISLQVVVGTSKNPGLIDEVRRK

SEQ ID NO: 996230 - protein, 384 aa, Homo sapiens
MGRYWCGMGAREDLSYRGRSEGPRCEGQLVNSFDLRLKVSLDLQAIGRLSRSPQHWCTDPLAWKDSLVYPIKLSTYEALSQVAPGGMRPICLRDPDVPRLEDSPRGTLNDEKENDGLTDLIVLARALYNYTPGPSDDRLCANPMGLLVLVRLSYSPSLVSPSPSLGRKLVQLEPSLWEGPVGGFTPNYLWLSPNSLPGSGGLPARVTRAKPSQFAWRYVEKRLAAWRLGEENAIGKLLELLSPVTSEKEFHVPSVEQTEWALRMAFLPQSLRGTSRPGGKRIPGWPVRSTFPQVGGNRLCSAYSVNRSPLLKHFPESHTERTCGPHRCAGQFPVPLAIFPTLGKGKETSIIVKSSWAPENCVPTRVHVHTHCGGKLKPGLSPVG

SEQ ID NO: 996231 - protein, 386 aa, Homo sapiens
PQNPGGFLGGGGKKNFWGGGVAPTTHVREHERHVSVGPNPPSGALVGEECGATQQSEQPSAMVCPPRETVVTRRKGVPESTVGGFTPIVSLARPSRRSVSPAPLGFTGGPWGAAYLWGRGGGGPPKRVFLRDPPVCDNPFSPQRVSFARGIYIQEDAVCKNTPLMLPMYARPAPPTEHICAPYYVWTTQERGVVSPHATLFVRRPPLRGEQPPSPGERNLWVGSLCGAGAPRGHTLFCPTQCVFSARTPRPRVCSPPRSVCRDASRLKTTVHPLFYVLQETFVVAARPLCFECAPPEENSFVGALCVVHPLGSPLVCGLSRHSSATRRFVDHPPLSSGGYREAPLLLRHHMLLWWVVIRCAPPAPGRHLAPLFCVDTVAGSLCYPP

SEQ ID NO: 996232 - protein, 104 aa, Homo sapiens
MKILTERGYSFHHHGRAGTSCATIEGESWCYVALDFEQEIGTRASSFFLWEQELRACPIGPGHSPFGASERVPGCPGGRLFHAFLPWATWTPCGIHETTFYSIF

SEQ ID NO: 996233 - protein, 291 aa, Homo sapiens
MRERAERGIIRVNHRGDSLYIIGEGHSLRRTNKEGRTTRTPPARPKSWKTRGGEKHPTPHPEGGGAHLPRGAPTQTSSRRGTTCAPKNRYNTTTTHRKNTQNKEKHKTNARPQQTNHCLSIHSAGEHTQSSCRQKTRGVKDTNKQNQKQRAPTKDKLARANQNHRGDPRQTPKTTPNRNRATKSVKKQGNKQKTTRKKRTNTRKEHYSPPKEDKRPTNNTKEQAKPQKKPHPEDTRQTTQTKVGAQHNQLSEKRKEPTTKKETDRDWSKHTPPQKEQNTHTSTHTRTRNKE

SEQ ID NO: 996234 - protein, 212 aa, Homo sapiens
MFPLISPMVTVVGAPQPVMWTARGGVGTGGRQGVAPCVGALLFTKKSSLASSPADPKPRGPYRRVRQALGMTEWPDKPLPKKTPAWALYPRKRTPREKTRACVAPGFQEEKLSQRGPKSRGGKHNYPGGHQWCGAPCTSAEKSPIKISNHLYDHEEGSNPLFLKPQYPGSNPLNFLSWAPFLIGKGHPYEAYPDENIPAYHTRKGPQVCGPR

SEQ ID NO: 996235 - protein, 248 aa, Homo sapiens
ERLCLSLLRRPEDAGARVALTVAGSSHRTSRTRMWAWVEVRCYLDDKLSPGGSLSHLTIPGWLQLAGCSGVEEDVAPWEKWLQNPNRNRPISLHAYHVCSVYPCWDDTGVLITPCFWRYKLYHWSRVDGGSYMLLESVCQMTECLEHGPCLRCTTHAAVTPCVHAIPSGGCRVSGSPFVDYACVFSTTLGSGREVVHVPRRMRLYLRACRTCLYSSLLVLNVTTRAKEDPSCIASSGASIGVSVSQWM

SEQ ID NO: 996236 - protein, 80 aa, Homo sapiens
GEEVVVRQTNSRFSGFRGFRVVWSEGGGSNKKPAGSGPQSSSSDLRATYPPPRWLEHLTLCSNRNGYGEATVRCVVGREL

SEQ ID NO: 996237 - protein, 207 aa, Homo sapiens
MPWRREGHGTEGELPARSLFVEEGPEARRMSGESPMMETKDMALLDGSVWCDLVYYAHKSKDTPYQADTSIRTVVIMDSCIYQELRTRREPTVYTSRTETVARTWQLKTKYHTYESLLRSTGPYNDAFSVQRLDVYISLETLKQYAEQRPQGGTIRRQQRTYMQEAMYGRSVRAPREPCTEGTRSASSQHGGTSAPIRKQTYAWYPC

SEQ ID NO: 996238 - protein, 80 aa, Homo sapiens
MDRERFQNLDKEGELRGWDRMRARAKTRCTRTGLGRSRCSVAEGRVSRVLQADGMDGGVSIWDVKSLEYAVNGLKMNDCE

SEQ ID NO: 996239 - protein, 265 aa, Homo sapiens
MSSCAGVGGGCEGRLMLVQMVRRPVACVCFTTPSFFLLPARRVKVVQTRIGVCPAALGPRIMQCMLVTIIGTDLVKDMKIKSPGVEIYLFFPARLRNQQIIDFFLGGLFKDEGVKIMPVHKADPCRQLHQVQRRYCMHIEDYNGQRSGQGVNVAPMEGGPTASVGAIYPGPSLSIVPVRRGYLGGTKIGKPPHWSPCKVTGLAALCLVRLIPAPRALASSPHLLPKKLLMMAWNDDLYTSARGCTATLGNFAKPPLMPFLEPTGT

SEQ ID NO: 996240 - protein, 563 aa, Homo sapiens
MPSRRSVGAYPCADTAHSCIILNSRELCIHEQRMRNVALIILSNDTEEDRRDGIVPLERWHVRRRIGRRERTKKRVNNSHRTSRFTSRVATDCTYSAFARAPRRGHQGSLLHNKLAEAHIASLVRGSRMHCESDWNTQIQNRGKGEKSKRLWDQNKRDYVTLTKQKKDSPVPNNSNSSPELEEISHNFRTEGEETSVVGKKEEAEGMVKPPKEDDGTVSEHNPPTLLKSETPQRGGGHFGTTRHSRIKGFPQGTNANVTPIGPPITNISWSQQQVKNPLKLTKERISIILNLIGDMEKHATPNLRQPFSPKRKSWGPTFRGFMQSISIITILEALSNNLLYPSASLGPRGERNTYGHASRVLGNTPPPPKALYNLLTFCGHHSIIPCTLYYIKQAGGELYTAEDSIRHTADTNTFGREPPPQNAWASYKTTTHNLRVRAAPQNNRSSAYLLDSATSEQYSPYKISTSPLTVSLSHTFPTIHTHPLCAGPSSPSGPFMCRTTLPPKTHTQKTPNPHRRQNPLFIKSATTQKRTSADSEKPSGNTSRFPKLSTSLDKRHPYPLPP

SEQ ID NO: 996241 - protein, 295 aa, Homo sapiens
TEDPGVAMGRRPDRCYRYSKNKPYPTVIAFCLRVSHDAKDSHYLDLGRKKAKVDELSAIAGPHGCQMNMSRLVLIEATERDYAQTLCSQVKYHAVTQVSSANDRLPIIQECRAPTPYTNAQYTHSKQSMIDPWSLAEPATATPKTTAIAKGCHNRNHTPQGAQLLSTRGYHTIGRPKVHIHLLPKSLTTQHAIGPQTTREAAYDDTDSDPNEPANDNPQGTPTDTTPTAPDTDNEYPQNLRTHENDMRGPIHPKRLQHALNLDNTGPTPLGSDPHTQPRPPHHPPNCPPPAAHQR

SEQ ID NO: 996242 - protein, 294 aa, Homo sapiens
MKDLPTSVPVGATPSLGGTKVGLQAYSQRPLNACSWAPGGNFHSLYWHEREQKGDAKTNAPRPNGVERNAGPCVAPGAHSPTVPPVTRGPNPGGGPPDEALVGQRRNTKVGCRRPARSHPKCTRVTPLSVAPVDEHPHNNPKGGTPPAKRHTRHARTPNNRAARRQQTRSLAHANTSPPPRAPQHNHGAHTTTPYPPTPPHSTRTETVPRDHHTTPKHRGPHDFNARNDQPLHPPTNPAVATPRTGTTLKSTPVRHWHAPPPAAQRPRNLHREKHLPLPTRAVTTHLNLTPRQP

SEQ ID NO: 996243 - protein, 151 aa, Homo sapiens
MGGPWGKTPNQRRPMREQHSGMDARELGQTLGDSRVATQSGDAEGNAKPRRENTRAPLRLAPRTDKLILKSRATFIPKGSEMCTQETIMRGAHIYRGPSRLADEETTTTIPPTIHTRGQHHSDHGRPLIVCDTSTSCEPQHATLKYVDHPW

SEQ ID NO: 996244 - protein, 225 aa, Homo sapiens
LERLWLLLLRAAEDAMGECPTLGEAMSHEHTVIACGSGRKFVYMDEKQYAWMSLTIEIKDRLQLQGALVVGKTSSWGRPMSPDPDRPMSRVCGIMWQALPLMGRYRSSDSSFWRLVLPASRSIDGGAQGLLRSRSLSAQMTDLSGLGEDGCSPFTPGPEAWGQPTHGDCCVSVLASSPSSSASVVAPTMLGSGQEWHRGDGMSSSQVLRGPACSASLVALVTTTS

SEQ ID NO: 996245 - protein, 239 aa, Homo sapiens
GEGMTSHHLGLSWQDSSHCCLLQLLTYGYFHSSRFHCNELCGGIISGSSYLWPIMACLVLESWDLESLIRGVMINRGKRLAQTRESTMRAQIATPALKRTSHSHECTSKTRIRRNESVSVNVDGPTEYAMLPVLPGHLLEEPRFLLEARRSHSMVSPQRSARPSTTHLAKLKIKNTKKTGVPFSKSYNGGLKDDYDDVEIPLQKYVKNRESVVEHSAFLSFLARTGRGFTQYLKTIKNG

SEQ ID NO: 996246 - protein, 109 aa, Homo sapiens
KIKVPERRSSLFSLTIKESEIIDFFLGASLKDEVWKIIVRVDRSQSRVPARRTEVQGDLFAYRVTNKIGSTVLDLWLLNVASKMAGGLPGHPMVAINPWPKLITIDLPV

SEQ ID NO: 996247 - protein, 104 aa, Homo sapiens
MYRALRILARYASPRAGSSRQAEFRFPACGGAGVPSVNVLSETAVRHGKPIDSYRDRNFNDEPSLGGDSDSDGAPSCDESMYESQHPWTTPHGCKLCEELAVMC

SEQ ID NO: 996248 - protein, 129 aa, Homo sapiens
MPGGYSRSSCCHTILPLLVDNGTREKPVQGRIETLHDCSILLRRNCVTVERANSVVPEPRLTKVANANNNLSTLVHTMRQNGGPTVDRHGGRVVVIHFMVAVIHAYSIASYDAWKEAPGMLLRREVMEL

SEQ ID NO: 996249 - protein, 110 aa, Homo sapiens
MLARQQGDGEEACGRSSLKNNLPKAKTRGSKYSYGDAWWWVVAHEKYYPRGGEDPLFEYNLTVGTTWVGAASVGSNKKKVAVVELIQGETYPALPVTPPRREEEPGQKKA

SEQ ID NO: 996250 - protein, 222 aa, Homo sapiens
MAGKLTEDDGYDTVVIRATLMTSKFERHDSKDSQDPGFCVHTIETGIVTHEMGEKSQLRVPNSKWLVGTEPESSVRVTRTRNVDMTDSAPVEGCRHLRVAPFGGPEGREPASRRTQRGSAWWAVPVGCWSGGNVNQGLVRTLLVVNLEEIYSTTKNSLTGNYWTLGGQYSGGGLGTPALGNLGIRRRCGIGRNPLVAGICWGLWTRGPDAGDDKENEGGTGV

SEQ ID NO: 996251 - protein, 115 aa, Homo sapiens
AAFQQPSLPPPAPVPDPPAPTHPRGHGHLARRTVLGAPEQLSSVSGIHLGPLSLIRLCSTKAQIRIARIPRYTRRSSKPDRSGWPDGWTDERLRQTRRRRKDDEATLKTEDDTDR

SEQ ID NO: 996252 - protein, 214 aa, Homo sapiens
GVLKIQDVGVETITTIAAQFVIVGARGPPLSPCNVQYAPPQHVSGPDKSMPPFPRGFNLRNLGHALQCDFYKASHPHRVRSILSTGRDTNVRRASEVCIIRDTRERREFSRTPILSPDTHDLVKVYRLTGVNHTLNSDMTGGAKGPGITMKCCSCTHVKCVGVLVRCTPTGAGSIGRIGGERAVQKPLNPVEEADRRQSTFLGCFLATSRVVLT

SEQ ID NO: 996253 - protein, 241 aa, Homo sapiens
HLFDTLCLPAGIRRLDLSCQAQPMRIDTTHLRPVAQMSPMRLPDYARRCGCVIYGWAIGPDFPLRMTSSIIHIHECCCRVTVPLQENNQGSDTICARGRIVGYDVNLPLDDRASSLIGPRETDQLAVSACPLRHRETGEHHRFESRLSSTVHASLVERALGEIPNPGASTNEPFRTTSEGLPPVGLLGESVEQAPKLLRMNAEGRSPDDNRPNVSQNRGKTTEELNLPCNLSALCRMDTFC

SEQ ID NO: 996254 - protein, 148 aa, Homo sapiens
DHSCCILPARIEYLRQDKLLDESKIGVCLLVRTQPEWHKVMEKSKYETAWIQLTEEECDRTRRSDLALESIITSAEVGDRLCNVCRSHDMLTSIRAEYGWPPQFGDGAEQGTFSGSRAGPNESGPKPQELLMTVGVLPKTHQCVDASI

SEQ ID NO: 996255 - protein, 111 aa, Homo sapiens
SPLLFSPHPAGTPGSRQALLPCRTQTSPARMSPHVAPCSTGMPEPLQGAPSQAPSCGPGLSPRDHERGQEEEECSPKIPTKAVSRTELLRALGAQGLRIPGAHRQNADENP

SEQ ID NO: 996256 - protein, 257 aa, Homo sapiens
DPKQWKTMTTAFASAQDAAVKPKAELVFVSNSHQCHLSEIELHKSTQRGALHSWAHVGPRHRFPDVVPEYSQGPAGIRLPANSAERRQQGFISDAAARASYLTPRWRCSGPRRDPAESVSRLGLPYSEDYSSCLHLIYRKNDSERNAEGSEMGNSQQCPRSLRVAACWVPGPVRSSVVHCPWRHETRHLDSFTLRWHEVRFPVLGVDWKFVGSLFQRQAAREPSWAGCGGYACNPSTLWGLSRGSLEPKEFETSLGT

SEQ ID NO: 996257 - protein, 109 aa, Homo sapiens
MRAKPIWCGALGAPTDHKGVWHLMASGVCPHVNWPLGVKVAKVLWATPRNGRWAIRAFPPLRFGPRRTPPKRRNLTVGRFPWPGMVLPGKGNKETHFHTFLIVLPMGGY

SEQ ID NO: 996258 - protein, 149 aa, Homo sapiens
MLHELRTTGVARDVEKQEFLYQILAETGVDCPSTKQTVSGSDFLESSDDKELNDGCTVPLERYTGAVIIPLALCFGYADMQGGSLKTLEVLMYPNGVHESDFQYVTRNWSTWTLGLHDIVLVVVSSSIPRSDLKSTRIACTTIPPVMFP

SEQ ID NO: 996259 - protein, 83 aa, Homo sapiens
AAAPPSWTPAVCSLSSWPGVTKVLGRTGFSGHECSAGGAWNSWTTASRSIISQCKNGSRCARADQMHSPILEIRAKNARTVCA

SEQ ID NO: 996260 - protein, 179 aa, Homo sapiens
MRIGQPAGDVQALPMGALSQEPMENAKLSMVDMTRGPCDRTSFQNAGIALKVVPDTEWGCFPEEPREDLKNTHGMTDRLYRSLRSWMQPLGPVWNSEHGNSFVEQKAAEAPAERVRWNWRTRLLGWVLTKSGSGAQSPCETQQRAVFSILQTQHEYSFVVPLGPKPSPFANCTLRETWC

SEQ ID NO: 996261 - protein, 356 aa, Homo sapiens
SNWSVNSHKVPRGVGAPSQGPDRPCGTFPLRGGVHAWIFRVLCPTSRFGRQAVSECAGVERLSEGALGEGASAAGPTTMCVWSLETIGGREAPFLLLTQGGLLSQGGFQKAGFTPRDRPVSYGQIEEELGEKCPPLVSGANFSPEGYCPCAPFVGSAKSFKSQVFPHRAEVRATGQDPPRIPNAEEILRAVKTQYYVGHNVCGSVLLYTTPRRGGEKTILVWELSSNVRGYNTSPLWGAIPPWRLFPARTQLVGSTNPRGETKRGAPRRWKIPPGKKKTPKGHHSKKGGYKLAEEETVMCHKMVSPRHATSRLRAVVVYRSIKTIGRGGITFRCSLLTTTVGADQRGPPRRVLVVM

SEQ ID NO: 996262 - protein, 180 aa, Homo sapiens
GLSRPFSLVRSVAGVGEADPESPDAAPLVAAGLVTITPRGGSRSCRMAAPVTITATHELARPDTHAVACVFSDHAGVWDANETEERMYSYTGACKELPVSHLMFALTATGPDQRKRFASESESVLSIVMRCICLVPSDGLSHGVIGLQRILHVPSDPFTALVISLLARSHFQSREETWCH

SEQ ID NO: 996263 - protein, 254 aa, Homo sapiens
MNTGWWQPECRPEPTESWNEGKVQDEATREQRRKRTKGHHRGSNLNAAALSARGNTSETDVVEQRSYQKRGWCLGHAGAPCKYKYFFDFPVDDQAKECATSRDEDTHSQFWEERHRGYRDRVRGGNIPKENPSYTMYRCIPPGGDSPGQEMRERKGAYKRQSKTAADPNKRVRRKPPTNEVNNKEPPTEEQQHNSTTRSKVAGHKTKKSRSNISRVDSARSVGDCLRVERIHSTNENKHRATNKTTHSNTEATT

SEQ ID NO: 996264 - protein, 261 aa, Homo sapiens
MESYLPLTPGLPRGAYIDSIYSAELEVMRRSTHDLLGMLVVVAQLDCSFWERLSGRQCRIYELRNQERVSVAGASKLLANVVYQYKGMGLSMGTMICGWDKRGPGSTTWTVKGTGFQGATFSVVLSSVYAYGVMDRGYSYDLEVEQGYDLAVEPFYKPLQRCLLGRGAATSNTWGDGLDPSLSDMCVIYLRSIVALPLEEGGCVWVLGEAWQTDRASPPFREAHGRILSWADLVPLRGEGCLGDPLKKQTKKPLGKDPRLN

SEQ ID NO: 996265 - protein, 224 aa, Homo sapiens
LVLWRAAELISERGCLLSPAMDVCSPIDIGVLLEKGESSGKNVTLPACVQGCLIRPDVVTLCSLANLHHKLHSTALYLSSGMSRSIRLVLSLWGSLARCCVLEYPEYEVVGLDALAMSCLWKSMCPWRAAMLCTNQKPGAVWRSLSERLTHSNEYASLCLPWRAHAPTQPTGQCLEGHRSEEVPETSFGSRRYVEGYRKSQEADLLLKITSGCHDITRSMPLSG

SEQ ID NO: 996266 - protein, 313 aa, Homo sapiens
RERHGGSLEAECRLRCPKTPSSVASKLQWSAPASYLNSVLSQWTDRNPQQTACVMCTQHTRCLQIPPSLAPKAVSSLSWTKPRGVSLGVLASLGGLALRVPYLILSVLLPDGTILPLCLVPLYSFHGHLAPLDKSARLTTRSWVMPCRESCHGEGFGALSALSFAVLCYGYYHDVRICKAVGHAVGALTLLTSYFEELMLASVPLLCHAVTLPLGRDFLLGPFGGAVLASLSSPDYPPEFISGAHRCAAFSPPCGDLSHITGTLRGCPRVCSGPASTGSSVGPIAPLETLARLSTLSVNGGPSRERRRFPPSP

SEQ ID NO: 996267 - protein, 302 aa, Homo sapiens
FAKARPEDTQAVDFVWLRTTVTEVCKSALVSPVHRYGDTCLEWTERMCVSLRTRRGDRSRKRRKIYSELGCWNHVGYGRVLSTFWGIVSGVYEILASLWMFGDRYSLKMGEMTGSADYGSLWLSDGLISCWARETIILQTTPMTKIVLVTAGVRQCERWTQSVVISVHRIVDCLLLHDSSDRALYRLLIAIIIVVVQATWDDSDVCYWRLSGITQKRVKGSGGNRMLVEFDSSWAERGFQPAGRTCGGKGDQWAVARVDGPGARVDRRRRLAEEDAKGEGNQKERPEGTSHQQRRGRNAKPK

SEQ ID NO: 996268 - protein, 293 aa, Homo sapiens
RRYLLDASERLRAEAPWTLKALVVTVCRKGVQGGLALSPGLRDFRSQKSVHGSLSRPLVYQVVVDRQWVVGLLSRGMAEHAPGQPSGNCRLKLARNPLIAPYLGGPSPYSWSLDPGFYPSVYSIQPRSLSLVGSYVQKILDGVCGHDMCTDMSDITKILPEVSVAPASGWLESEEKVVGMVGALPVDDPTAVRERRLRAVLMLVVDREHPSVRGDSKSLGRELISQFRPGTWYREVILGERTTNFPGYGPLPELGSANGPVLFLCGPAGLRQAGFRSLLGGGGPSGVAKHSRG

SEQ ID NO: 996269 - protein, 161 aa, Homo sapiens
MVKHGRIKPDEDEVDGLEKKMFAYCDPKKLPGGPYFMVLHASGCYIKLSQCVTSWREDGICGGISTPKYQYAIDEYYRMKKEEEEEEEENRMSEEAEKQYSTRIMLPDLIPFVSDRIPPRDKGISRLHSVNCQLFGHGRRTVAVFLDTHANSRTRSHHKMK

SEQ ID NO: 996270 - protein, 105 aa, Homo sapiens
MPYDMKRMRDASSTKHLEAALEQWNQGQKDTQKGKSHRSRSLMSREHDALTTQEGRPERSIDLGHAKKAGAHGDNRPPHTWLESGRRGSERQSMQRGGCGASAPT

SEQ ID NO: 996271 - protein, 125 aa, Homo sapiens
GKKRTPLPPPLFFNPFLKRGENTRGLRIGGVQPWCFLWPPLNSVIYWGFLLSPTKAFIIVGRLHQLVLFYPKVVVYFVPFFSYFIAFLPSFPARWPHNVFLSPTLFAPPPFLGFRSPRYFVTGLC

SEQ ID NO: 996272 - protein, 77 aa, Homo sapiens
EEAAVVLEYYKQKGYAEASTPRSEMRSMPRVTPEGHHSICLLSLGPGLGSKRRPESVLYNTHITHIQITPTTRRQYL

SEQ ID NO: 996273 - protein, 131 aa, Homo sapiens
KTQGCPLTPLLFNIVLEVLARAIRQEKEIKGIQISKEEVKLSLFSDNMVVYLENPKDSSRKFLELIREFSKVSGYKINVHKSVALLYTNNNQAENQINKSTLFTIAAKIKILRNIHKQKVKRPVQGKLKHC

SEQ ID NO: 996274 - protein, 403 aa, Homo sapiens
MRRVQTGCCCQCCCSQGLLVQWHCKQAVLQPELMLRMLEPLSESQQLLAVQTLLLALMPYPARLRQPAAEMAGAGWSASRLACLIASLGSLAYHSPACGTALLPLCRQHHTHACQAATLLRPLVTHHGRPFTAPFTARFATVGKTTCEHTGHGADSHHQHDPGQGTNRPRGAMRTTRNHTPEHMAQNSDHTRHTPVRPKTNDRARTTHPSDKTHTRAAAGRPRPSDDHARAHPQKTTASAGRGPRGRARRTLASSRQHDRPAGGPHAQRERPQGAAGRSDNPEQPPSSTHPTLERRSHTQPPCPQIYRTRTDHSPTHRYSRADRPTVSSLQPPCGGNRAAVLTARRSTTSERRAHAHEQTSGRGALTARTQASTKGMRRETTVTSAGEWAGRRGAMEGGDEEQ

SEQ ID NO: 996275 - protein, 160 aa, Homo sapiens
MPRVALTACCDVGMNRFLTNLLVYWFQSHQNYSRLRSSLMPCYLIVKPMHAPYFKAYSRRQWQRSPIDLRPSMTPEGKLFLGRSLFYPLVHFTSCVVLQTHLLLSSDKCYTNFTNVNRERCRSLSGLATLGQSCLGGDIAKKRIGGLGHMNISALVMTVN

SEQ ID NO: 996276 - protein, 285 aa, Homo sapiens
MSICGSCEIHGALDIATNGVDVRHDHVNCILTALSYRTHCNLRSLYLRNVRVTFYSDNLHGILRDSWDKLSICSCVWVPFLCLKLKQLHVFTPRSNSSRESIYTTRMSESQHVTYYVSCVHILLSTVEGLSIISRYPYMRPGWLVLSVSEHAVNALFVPPRVNGRLYAPGFLIPAVTLAQREHTPVRREPDRRLVPPLVNDLQKSLGLVSGTQLIVSMAPSQLEAKLETIEVGCKNSPRTRMENAGLSDPVRRKKRLTPKATFVDLSMPMCVLHRNGAPQSSVDF

SEQ ID NO: 996277 - protein, 109 aa, Homo sapiens
MMSKGRIGCPWLKIEELSRDTYRVNPEGDHDAALLVCSNGYVRNRRPATLSEVYDRTRVRRTAGRRFSIGNERSQVEEEIWWKNCKMWAIGITVLVIFIIIIIVWVVSS

SEQ ID NO: 996278 - protein, 120 aa, Homo sapiens
MPRGQDYTPYRIPLRSLPGDTPKHGLVHGQRLAGTRTLPCQSIPWHQSLPARGTLDTHATSTRCHKTRRRAHAPSEHAAPPLGTSLHHMPPTRPRAATTDTAPHGPQPQRHNIGATATGH

SEQ ID NO: 996279 - protein, 243 aa, Homo sapiens
GGWATKGRVFSALRTGAEEAAVAPGAFERAHPSPRAIADPGPTGGTPRDSPRAFLAAHGGRSSMNPPRRVISGGAVWRLGVTIRAAERPWELCWVEIQRLRGGAQVEAIDARCEGLEANEGTEGPLTTGYRKMAYGLGKKFNSGPQGRGIQFLVENELLLVINPEEIARFLYKGEGLNRTAIRGIPGGRGKNEPGSCPCVCGSGMSFTPTQSGCRASGSFYGSFRYRRGPENDRMMEGLRPGY

SEQ ID NO: 996280 - protein, 181 aa, Homo sapiens
KCRVCFKNFGGPSPVKKIRESQFENAVLIKSSMMACYMGRDRVLLVEIPSQRCLVSLTPRRYQSPWRTYASTSSSNRHGGQQISIRVLYEREHGTCMDHDKRGSVERSAIQRLHSRLTSSGITSSTRSSHTHLCFLVFNNEIHVNSHPLHVSWQCERATKVGYMHVERVLVRLRLHGSSIV

SEQ ID NO: 996281 - protein, 360 aa, Homo sapiens
GLLRVCCRRLRAAAEPPMEAEAADAPPVRGLSRLLSCFSFTQDCHIPSNSELNAGYNAVISEFCGAAGSKSTATQMHIPETSYNLCAPASFSSRPGWLGRSQLHHTQPTGHTCTPLLLTTPTGTQATSRHSAQHTQPSPPSQHPLHAPITRPEHHRNPAPARATPIRKRKSQRTYYRPTPPQQQDHVPHALVPPTATTLPWRTQYPRADNAHNHRALNAGTRASRITHANYDHSTSIQPPGAPKRHQVTKHPGNISRRRKGVLVTYNWTRRQQHCTMKTTRRHSHPHNGRGPPNRPGKPAPTPAPNDTPITVAPTAATQTPTPSRHASVNTQGHTAQTRPEPSSTPRHGANTTTHGSPPK

SEQ ID NO: 996282 - protein, 87 aa, Homo sapiens
DRSVRHIAAPGVLRCVVSSSTLLFTLLGILARMTREVPCLLMYQAYDKYTTSRRYAYPRDVWPPHDEPMWPLRVRLLLTTRCMFNTV

SEQ ID NO: 996283 - protein, 145 aa, Homo sapiens
KHEFIIENKNDPEENLGNTIEDIGMGKDFMTKTPKAMPTKAKIDKWDLIKLKSFYTAKETIIRVNRQPTEWEKIFAICPSEKGLISRIYKELKQMYKKKTNNSIKKWAKDMNRHFSEEDIYVANQHMEKKPHYHWSLEQCKSKPQ

SEQ ID NO: 996284 - protein, 288 aa, Homo sapiens
KKNKARGIMLPDFKLEYKTTVTKTAWYWYQNRYIDQWNRTEASEITSHIYNHLIFDKPDKNKKWGKDFLFNKSCWENWLAICRKLKLDTFLTPYAKINSTQIKDLNVRPKTIKTLEENLGNTIQDIGMGKDFMTKTPKAIATKAKIDKWVLIKIKSFCTAKEPIIRVNRQPTEWENIFASTHLRKGYIKNLLKNLTLQGKKQPIKTVQDIEQDPPEEDIYAGNKWKNVHNPATNNAMKPGKPSARMEHTGATRARWNDLTGKSNTGKGQNEKNQVTRHKTIRTKNGKT

SEQ ID NO: 996285 - protein, 69 aa, Homo sapiens
ARDSDFKNGGNDAPVSLIFSASSSSSACHRQASATLMSERESSPPEKEEAQEKTGKTEPSFTKRKQPVL

SEQ ID NO: 996286 - protein, 93 aa, Homo sapiens
RVELANQEVNESSSSVLVIVAINTWPLSRQVDGERRIPQPGGICMVGLHDQRYCEDETFKECARYEEPFVKIARCTIVKLFRSERVGTASWVH

SEQ ID NO: 996287 - protein, 282 aa, Homo sapiens
SSGLRSGKARHSRIRHPCRPHCHGHHEDATTYGGKKAKKGILDIFKCWRDCDMEMEGIVLAHGEERATIKSTDLELTESMTDESTQKTRKRPALQSKKFLRRLAQKVMQTFTYYASEDKLDEQGQTMSETKISGTGKSTEDCLARNRPDKAADTREMHRQDRAGEQSDNPTYHIDSHELNTGKIKQNVLTMQTRNEGSQLTRNDTVDEHRNRQQKYKNHRWHDRQRGTSSKPRHKQCGYNTEKKKNSGYGPHIGIICNSGDNPAEMVEMNLDEDTGDKTEHR

SEQ ID NO: 996288 - protein, 378 aa, Homo sapiens
ATRGFPERKAWLPPWASEPWLPPRPRSQQLEEGWRLQPRHHGGQTQPQTAVNCRHSDRPHRRRDHAPHPDVRTHHETANPHHSPRRPTMKETRGLRRGCPPSAPRPPTTPTQACGAAPRRYRPEDDERQPHGAPPGIWRGLPESSDPWTFPITMLAHWVNDGQTHLAHACIGDRRMLPAPGEASASKSFLTVHPAWLALTDLVRGSFLTNPVDNRREPVQADVREHNRPRQGRLQEPYNRELTKDSDTGVHHGEQSRARMARRAGTGHTGAEKGTEPNENTGDTQKGRHGMRKTETHIHHERQGKGSARHPSRPRERSDSTHTTKEDGDCSGHGNKVNGCSPRGDSSNTMSPKELARRDKDAATNKKGGTPATNSHER

SEQ ID NO: 996289 - protein, 134 aa, Homo sapiens
MYTALSQWYVALGVYTSANENETTMYSMFLSNVAFTNKFHCTYYSLIRIFVDDIRSEIDPLVMGILMARFYYFKLVRKNEKEVGLSVGITPVCRMCGPGGKHLTHLTTGSCSTYPSKLLTAATALRTGLNLEQT

SEQ ID NO: 996290 - protein, 105 aa, Homo sapiens
MDEQMSDGKGYRGHDGAGTGMAQQAPPFCPRTSDSDVQGSTGGDRPDRKNHQHRETRIEPGQPTQTNSHRRYEPAQDTRQRRGQDQQTQTRRTSKGETATRHTSV

SEQ ID NO: 996291 - protein, 105 aa, Homo sapiens
MNHRLSWLLVSVPLTALNRCPVRLVVETLRIMTLARLTHGLVGAVSISISDPSDTKGHVKHNAEKAQIAHLIVRVCQHLQAPGTITLRTPQRILHAWFAAKSLVY

SEQ ID NO: 996292 - protein, 153 aa, Homo sapiens
MTVDVVGDVESWQRNSYDYGSSQYLNTLCVDISIVTHLLKSDVDIVFIVPRCDWTSIVFIVVANVAILELSFMMSLLLSKCCFLDTSPGFLPYITRVGSEYLRRFRLFIAQFIFRTSGTWLEAVASVWFASRKKKSSDVVREKYNNLRIRQRR

SEQ ID NO: 996293 - protein, 75 aa, Homo sapiens
EFLSERTEQFLFHLQQMISNFNPRECKLVQKSSKVQELVSLLPVEIETDTVGATWSVLWLRICRPAVEGWTLHRM

SEQ ID NO: 996294 - protein, 94 aa, Homo sapiens
EMESRLCCPGLKCRGQSRFTATSASVGFGRFSVPQPPEFAGIAGTCPPHPVNFVGGFTIVGSGVALELLTLVVCPPWPPKVRGDYRLEPLRLGR

SEQ ID NO: 996295 - protein, 119 aa, Homo sapiens
MIILRVSGTRYLNHPKAKPYGRLEYTYGEKSKRGISHQPNRISLHFRGHSVEEPSLLGLSSDITHHQVIALWMSTLDLVLATLSESVVISWPTMENLCAGHKKPCRTNVMSETGERGIA

SEQ ID NO: 996296 - protein, 186 aa, Homo sapiens
MGNPMAHNIIMHKLWLIHLVIYDVSLMPAKSCKMQVIMVVLFPQQMLLKKLTTNDYNAAQPGINAIEAYSGANGILNNSDEGLNYGVDSEASIVSCSSQKNWAKKLRKCEQFSWDAPVVWWCEELRRSENLTFTGGRSWHYEYAVAQELLRCMGSTVVSVEAVDELGSAGNICDNMLFSYEYEVEC

SEQ ID NO: 996297 - protein, 171 aa, Homo sapiens
DLRVAEALHKLKSRSGGGRQKEERQNASVQSTPQAPLRISLHLSRGPGAGSVLVLPKPYLVQILSSSGLWKVGIGTETCSDEVEPLWTEIPSEVRFWKFVHPGRYRGAQKPVSIGTGYVPKANQKAEDRSRLEALPRDGHPSDGRNTNEATMGPISVKSRELNVLTAHVAV

SEQ ID NO: 996298 - protein, 177 aa, Homo sapiens
SQIVTQMYDLIRAFLAKLCLWETHLTRNNLAHFPTLKLASRNESDGLNYIPKIAELKDRIPEKAVLIFKLYESELTLFSSPFSTKIDSVHEELQMEVIDLQCNTVLKTKYDKVGIPEFYKYLWGSYPKYKHHCAKILSMFGSTYICEQLFSIMKLSKTKYCSQLKDSQWDSVLHIAT

SEQ ID NO: 996299 - protein, 68 aa, Homo sapiens
ASRIKILTDKEEAERKYNASMRRHIEVLSDAKKTGTSDVHIVLSETKGFKSVCKDGMLEVHLDKSILI

SEQ ID NO: 996300 - protein, 38 aa, Homo sapiens
MNLLHRSGGTTHGEETNTGMKTTNQRGGKKGGKDRSRR

SEQ ID NO: 996301 - protein, 69 aa, Homo sapiens
CGCPAVVPATVTTCSKGFILKEVEVFVVNRLKKCYDAAYRAQEYDRVRGPRFPNLWRIWGLFIARSGSA

SEQ ID NO: 996302 - protein, 151 aa, Homo sapiens
DQHREEAEHMIVRYPTRSQATCCPSRPNAGPMAKTHYHEGHLQMICFGLLGFTCAITSEDRLILGMFVEENASFDYYYSTQMLCASLWLILADPYLRISKEISYGPNMNACVLCENTNDRLVQRRALPWCVQVNGHDHNGMTIGLRKRLIT

SEQ ID NO: 996303 - protein, 113 aa, Homo sapiens
MRFLYGLCENGETISVDEGVPLCLTDDQCRPGSNTEEPLLLPNDSRLAWITVLCAPCQYSLATSRHVRNKGAIVAWACRAISDESIRWSPDGRTIPWNEKMHFLVRPLTKRRA

SEQ ID NO: 996304 - protein, 229 aa, Homo sapiens
MLPTTPFARSLSVNVSVGLPSILHKAQADQRHFSQQQPSKVTTLSHLLFLSIYTPLYILNFYHLTIHFSTHILEDNQIMSSAYSKCNTNSSLQRTTIQETTPLLNNTTCSNPQTPKPLSADTHRPNPMNTAETREGREYTPHQLGTHETQGHNMHNHLTHNDANVPPKPKSTTTGLPEQRTTHREHHTPTTPNPANHSLLSTQLLLQQHVATTLPILNNTTPLNLILNH

SEQ ID NO: 996305 - protein, 84 aa, Homo sapiens
DSFDLCCMPCVRRLPPGKRVKLVRCEPTVRLYTQYLQPAQSLKSVTMFCLAKLCLHPLSDPELGSMMLHTDQVSSISVHLDQEC

SEQ ID NO: 996306 - protein, 325 aa, Homo sapiens
MLELSCPTTAAAGPQDIAGTSSTLITSAHRDPDPAPACPMTPQMSHGRPCLDGVRSNDTHQGAPLVTDVGLVCATPCKLNGDGPVYLHGRYTDVEGSCLGDLSDRLAEAHPDLHLSAAVSQRDPVQHIAVPTRSAIYMVLRFLLLDFASQSITLSTVIFDVSVMGATRMRAIMSTGTRVLLHLGPVHSAGWLAIPQWRWLQLTVVHSLSSSSSYILVGPPGCIPRGWPVAWEGPQKALKISAGWLLTGNRGEGKAYLRTPLYPHGIPLRPVPRGRSYLSVESISSTLASSQTACGNSHLTTLWFGTSSSHTRIESHNSRICPLHS

SEQ ID NO: 996307 - protein, 190 aa, Homo sapiens
MQHKNRRNKREQTTKDTENKEQNGRAAKSSTQEARTDTNSHGTGTHRRKETAQNRTTNRRRRTKKKNNTRAETRRKHNHNKDVNPEPNRDKENTKRNRMRYRGSQTRPEHWIQTNTPDNTKKQTRATTDHNEDEQRPEEQPMQGERQAQKQHKTARNAKQTRRQAHEKQYKLRDRSKHTPTTDRSKKLKK

SEQ ID NO: 996308 - protein, 151 aa, Homo sapiens
SRSFWCSLHCSVSSAPRGPASVASLPAGIGRSTAKTPGPTGSLEMVRVPGPTSRERGRGWLELVGSGCGGTLASPQLAPKIRGPEFSLAQLGLSAPSAIGWRRADSSDPGHPVSSLRSDCALVWSPLWAALPPLPELSPIVQDHWTVVRGE

SEQ ID NO: 996309 - protein, 347 aa, Homo sapiens
VDDKYPEGTVSKKEQDRNGLAYTDGLTDGSPNEALALRTLFGLRVSSIVVSNTPVIPAMVKGCGPGDPSRTRGCYRLAVKHERYPDICCMKGTIIQVPMNAQTHHARNLLSSSAWDPLKSLMSRQNQWRESSWARPWPLQQKSRGNKHYNRPLCIQHTCATVVMKTQKWAVNEPGNKPHRQRMTGDASTEPAEEPLMNRDTHEIQPQNNLHSVHTDQTPQNIIDSTTHQAQGKLNTEPAEARNEKTRPERLCERGIRAAQNTTIRRRNDERGRARPKGRRKKEEGKETCTTKGTENDRERHQKYSDRARGRKQQHSEDRTKKLNVSMMDKHAQKEDRADKHRMTWRR

SEQ ID NO: 996310 - protein, 140 aa, Homo sapiens
MPPEQQQPGNRKNRKAAGNVSASIQRNGHIAPTPHLQHQSADARSASRELQLGSPPQMMTVAHRRSPAGKPQEASPSRMSRVTEPRRRHSMQSAEEHGAIGRQRGTMRDEGSTSPKPESTQAPTARQSAERPAAHDVSVK

SEQ ID NO: 996311 - protein, 51 aa, Homo sapiens
MDCGGLRGLNSVEVVAKWAPRALGWGPAPPGGVGLAFPALALGPPSWRPGD

SEQ ID NO: 996312 - protein, 67 aa, Homo sapiens
KSAKYASGGPTIYHLYHTYIHFIRNYTPGTLCQIVHALSLNRKVMYLASTPLEKSLATEDHREDSSS

SEQ ID NO: 996313 - protein, 309 aa, Homo sapiens
ELWERSPDTGIPRCLSISLICTETSDGLAMEFWAEDWSCCLVCIFSKQCVQCCKCNYVHVWEEAWSMPWWWSPDDFIHDASPLNSPREVTDVILMTGVRLRHQGKGAASEIATFVENGGRISVAYHDSVKGPGLSISTDISKNTVYVVQMRQDLRPDDTAVDVLCERLQKPMASDYYGLDALGARGPRSSSPQHPRPCPKVCPAEPRGLLLGQKRAHVPLDGLGDASGANFTWTPSVGKTAVHARLKRDLWWCTAWSLSCLVCRLSLWGLSCLCPRLETPSPSNRVGGALAGGGYTGSAFPLSWAQFPR

SEQ ID NO: 996314 - protein, 72 aa, Homo sapiens
HCHLSSESLSRTKSLPSHILIFPYKSPLILYIILGVHRTNHICYIFFETNTYPHLADLSIYPHRSATMTDTA

SEQ ID NO: 996315 - protein, 272 aa, Homo sapiens
GERRERKVASEPADHHQRSSPGAVSEIRDRTFLTYPCVPHIRPLLSIAYPTIHSTISLKISLGAEYTSIDTLRMGRCRKDIGPFTLVAIFYHREGHYISDKLGQLQMSVRSHDDKIPRRNNKKAETVRRERFNATVPQECKKSQMMTRSTDTEPEKKVSTRQRAMTKSGPLRATAGGHPPEERWVRIQRVVSCAIDESVVTTHGIRGRHAAQGPGSCLGWPIYLVSGMDLCRSRDSRSRAGGHGPTGALTCTGCAGRHDRFGDFVAGRLVVL

SEQ ID NO: 996316 - protein, 99 aa, Homo sapiens
ETPGAMRRQHEGIKSLTWRPKSVGRQWVCERPIRGACGVLRCAIAHMAYAWKNTEKLEQKYTRHRMTLILMPWSAENYKVGWVLAKDPELADKSKHGEY

SEQ ID NO: 996317 - protein, 290 aa, Homo sapiens
HRLLIMTLCDSICLLAWDFRTPANRGALTDVCYVVLWVLLGTPAGRMLAARFYKSFGGEKWKTNVVLTSFLGPGIVCVLDFRTIMNLILWWEKDLQSAIPFWDTWLPYWAFGSCISVPSEPWIGAYIVGCSEEVPLRAPSSTQSRFHVMIPEQSFYSDEAPCLVVIMGGILPLGCICDTTFLHSEYVFGHTRMYYNVGFLFLVFHHLGLLPVLEGKYTSLLIPPMCRGFHVAMVSILNEWLTGFIPLSMQYLVFQTGITVTEPNLCLSPRYGLGSFFTDRPRRSGAHILA

SEQ ID NO: 996318 - protein, 93 aa, Homo sapiens
TVSEPNLVHGRRRALLLVMGVSGSGKSTRGPPACHLIWDGNSMMLSDYYTGGTSKHDVNMAYRFSDQDLDSSGSVTCYDILLIRCSLGTAVWF

SEQ ID NO: 996319 - protein, 146 aa, Homo sapiens
GSDVPGKAGGPQCWGRGLRAVEGRPQAGSLADRLTLPSEPHPRPSQDPSDASGVSGARFFLESGAQCGLNLRPPTSSSPSQSPLGVGAEGARVGEEPSPSLLRDALLAPFLFGELGSGAFCLTRGEKWEPCIIDAGERALEPGSGL

SEQ ID NO: 996320 - protein, 160 aa, Homo sapiens
MRSILERLSSTQQAEDCSYDVSLNTSVFTRARKGGSEPVRPHWEMSHRIALYSSGCSLFHFLHQRLQVRENSFELIQQVEILIFWSYKGMQRLYPGAPHQGDQKSTKLYSLCFSHNKYTNGTKCTKWANQYTRYIFFPQVLPQNQLQILFLFILPEMFYT

SEQ ID NO: 996321 - protein, 82 aa, Homo sapiens
SPIKKRKVLVLPVLKDELRRKMCPDSLYTRSDKALIALFRIIKAWYLKLLCPLLVLRTQAIMLVNKTTVRKCAQLHLSRTMT

SEQ ID NO: 996322 - protein, 137 aa, Homo sapiens
MRVLHRMIRASSYIVACDSRANKKTPGGNSRGVLLEQYSQYENVCWRLNQVVLLIKRGCSNEKSVRNHPIFLRPARPVGGMCMTPPKRQHNTKRHNIPQADNIQQTTKRSSVQDTGRSNTTASPNNEGKGEKPHQNR

SEQ ID NO: 996323 - protein, 75 aa, Homo sapiens
VHMGYSANLPCNCDDCVSFTDVPLCGSCKAIKGFRILQWEYRPQSYEASLTTIENQSSNSYEVALQVWWKWPRFP

SEQ ID NO: 996324 - protein, 162 aa, Homo sapiens
MTRCLVRIYVKNAWRQAEFVLRTVSALDDPDGHNVKSINPESRRASDDSELATHGSCFAGKQLEDGRTLSDYNIQKESTLQTWSLRLRGGMQIFVKTLTGKTITLEKWKPSDTIETCEWPKIQRSTEGNPSRTKQEASSFAGQASWKDGRNSFLTTNIQKES

SEQ ID NO: 996325 - protein, 112 aa, Homo sapiens
SPDEATSQNRLNAGTYFLLLHPSRSPFPLTRSHLIYTSLRRLGSLIHSYYCTLHCPKELSKLAELNKLNMTSVTQLACCMKLKHEPAFTAAPTSWNSREELHVRKPPIVWRQ

SEQ ID NO: 996326 - protein, 119 aa, Homo sapiens
MRSGDRDQPGQHGETPSLLKIQEIGRVWWHVPVVPATSEAEATELLEPGRRRLQWAGIAPLHSSLSDRVRLHLQKKKKKKDLPDFRGKPFVSGEPFTYFFITTFGPFWKTLHGLTIPEE

SEQ ID NO: 996327 - protein, 321 aa, Homo sapiens
DIWAASCMKELPAVGLLFADSWTLDRMTCLNSGLQNDGTEEAVTQTGLKHALSSPCPQRPPNCHIGQVMRRREELWPFREHSPRGSLSQAVKPSIRALQYLGISKLSECQRIPRRPDAGSMHRKKISLHDLQYKGTDRRPQSKDGSMGHPRDTDKGHTRLRQSYGKHSASACRDLQFHVHNMSLVGTLKVEGKNSQRPFAKTWTIWAIPVSQIPMVGIETTSLLRSVTFPIRKVGPPKRRVFPRTSIWTVNKGRKQEVQHWQGVQYHKSPEMTATTNTPFHDNNASEGAIATLPPTHVDTARIAGKQHVVAARHRHCEQIP

SEQ ID NO: 996328 - protein, 274 aa, Homo sapiens
MDRSGSLESFVNAFNCLRGRTLRSPGEIVAGLQGAGAWELGKTGLAYDIWVKLTKAQAGGPTEENTNSNSQCAVRGEKQQGCHRHGQEDPGSWHKGIPITLMAGNNRRTHTGGQEIFIKRGLSWHKSKGGVMWSQDTIWGRAIVHRHQCLASIKNKRRTWVGRGTIKLTHAKEVQWIVGHERPKKEYSPLQRAIVEHNGERFCATRLKTVGYLMVGRDRICHRGEACRPRRRRHIIDSAPRLAKMLVTQNTRKIVTPAKCGATTLSFGGLKHFV

SEQ ID NO: 996329 - protein, 109 aa, Homo sapiens
MEGETKRHRKKEKGESTRIGARGAARRPQIRKKRRRHRATERIPRSKENYPGTNNTKGTGKMIAKHGEKKRTPGNTQGCTEATPTNRGETRDLKRGRQKKREVTHGART

SEQ ID NO: 996330 - protein, 110 aa, Homo sapiens
MLVPAVSAEVGDRVHVWPECYRVMCVVCVDEEVRILTRGGTCPGNLVVPNCSNEPAYSCSERTHMSRLSCWRKNPQIHQILISRELVMKSGLGEEKLLSGTNNSMSSSKQ

SEQ ID NO: 996331 - protein, 168 aa, Homo sapiens
TLSVSEYRAWGGVGGARRCGIGDRNGSVIPGYRFILFRRQQKGSEMAAVVYRHDQVTGLPRQVMSQVVVTLLISEYWKILDVDGYKPVAYKADLPYLTNIPNIQYVCGALVRARASMVRFPTKVMCAVSPCREDLALSNVRNSYGEYKPTGVWEQLIDCARDMKALGL

SEQ ID NO: 996332 - protein, 95 aa, Homo sapiens
SFLPLCLVEPGDGLHAESGARFMNMLWQQWCLTVCWYAISGGKADYVTNIDDVQPHDRPLQPCSGWLGFDRVPPAKAAELAQWAKKQDRPSMITR

SEQ ID NO: 996333 - protein, 160 aa, Homo sapiens
MAQHEYNREFSVLMKHYGQENVRGRSAVVMTGKKGNQTYNAGTNRGDRGPLHQSTRITPDQQARPSNTGGDTAKRNCQNTSGQVRPQGEEQGGRKWEGGRQVQNRGGRARGQGDGPATREATVTPKGYVTRRGEGQTRGGRVQQSTSGQRGPTHDEARRK

SEQ ID NO: 996334 - protein, 210 aa, Homo sapiens
TLPGRRSPALALSAASAAAAVVPFGVPASGHGAAASRKAGLCVCAQRASRCAASDAQYLTPILCQLRAARPSLRRGVHAAAGHRPAAQEACRPRAGRSQQFGAINITFIADVVKKIAPAGGHIDMVSQGFQYSKPKRCRWLSGDESNIVVGKNGTEFVTTLPTLVDQTRHRGSKVDAERTVPTLPEGPKFNGMVDMTKQAEHRHSIQICT

SEQ ID NO: 996335 - protein, 205 aa, Homo sapiens
MNVEKKDKEQAREERRTKSKRRRPRHARGKKRTHRRRHHRDKENNKIAYDSNETEEKDEARGPTTKKREKEMKNGETDKRQRNATRQTDTGQQEDNIIEENNQKEENNRQKPSGKKENNDETTHEKKQAAKKTKRDDKEQTPHERPKPMDERHTKEEQEETTRRRKKTRGRHNTHDTNTKNRSRLSEKKDKTTSNKRNAHTTKHH

SEQ ID NO: 996336 - protein, 71 aa, Homo sapiens
NNEEIQNLNRPITSNKIKAVIKSLPAKESPGSSGLTAEFYEYQAFKEELMQFRLKLFQKIEEEGILPNLIL

SEQ ID NO: 996337 - protein, 131 aa, Homo sapiens
SPHSLQGFGTHRLLEFLYRYPWLVSEQLSITRESEPLLRGSEHVAIKYASHVPETALSTTPAGGPTSNRNLCDRLRDGGNWMARPACWQPPPVVYVGFQETKFVCLRQGVVYDLVFNGLPPRRHGRDVNTR

SEQ ID NO: 996338 - protein, 48 aa, Homo sapiens
MERQYQHYTIPERITNNKTTVHTPNDTKQRQPTPTAPHPARQPQPTLA

SEQ ID NO: 996339 - protein, 35 aa, Homo sapiens
MATVKQLRNYRQSSQVRWLYACNRSTWEGQGQGGS

SEQ ID NO: 996340 - protein, 115 aa, Homo sapiens
TQFDNASSLEDKIHLELPYVVNPLHDNRTEMPTSDKMTYLDGPCYFLEIFQKLFASTSYQTIVSLSVAIAENPLGLPSLMHRDACYVPSSLKRLMLLMDENNIDVQCPSRGVIAG

SEQ ID NO: 996341 - protein, 162 aa, Homo sapiens
MGGPLASWMECAFLSVVAGLNPRLVYSKHGLQTRCRAVRLRPRVGSLETRSTRCPDLLVTVRVGWVIIGQRLPDAVRAAWSILASGRPVRGGLRARTLSHARKEGGAAGEKQDDPQLTWPPVAGGHAGGVLPLPEPLYRLYCQKYLDLDGLRQLAGHASDKD

SEQ ID NO: 996342 - protein, 92 aa, Homo sapiens
MVTRYGDPQILLNNRVGLTRVPEQGGDLLNPEEHPEERRLWEAEDMEGRDSGQVRKYKTADPIDGVLRSWIIRGVRRISFPHMHRGERNFED

SEQ ID NO: 996343 - protein, 68 aa, Homo sapiens
EEEKEKKKKKKTTKDMTIQFLLTTGKDIRGRIMSSVRVPQEVLYCILGPRTLIHYQLDQETFLNSIIT

SEQ ID NO: 996344 - protein, 150 aa, Homo sapiens
NQQPLVFCLDRLNGAWRGKQLYPSGLHKERVTSSLCDLSLTVNPFVEVDACLLGQHLCALTCLASPQKFSPLIYGHHVSWSTPWLLSPSFLPFNVIARLCCLLSKDPAYGPDRHTRTGQHWRKGYHFLKGKGTRLEGDSEIPALLTKRNP

SEQ ID NO: 996345 - protein, 61 aa, Homo sapiens
MVWSPPFLTVIASRDVASIPLLNRRDTHTAEISFSTYLGALRSGNRSNGLAATIGQFFPTT

SEQ ID NO: 996346 - protein, 152 aa, Homo sapiens
QENRLGPGGGGCSGPRSRYCALLLRLECSWAMMAHCSLDLLDASHPPILASVVAGTAGTRHPAWLIFTLMCRAEVLLFCPGWSQTPGLGRSACLGLPKCWDHRHEPRCLASAVILILCFSPGDLLLALPHSCIETTGCGLSPQAPHLTPLYP

SEQ ID NO: 996347 - protein, 71 aa, Homo sapiens
IDQCTDDASHGATRYADLWSSHDKDAGQPLKGQGCEVTKSLNTESNRAEGRIGADASENQRQPRQLGGPRL

SEQ ID NO: 996348 - protein, 107 aa, Homo sapiens
MEEGERHVSHSSRQEKRACVGKLPFLKPSDLVMAYHTPNHHYHENSVGKTLTLQWLSTHRVHNGLLPCECGGKLMGTYKVHVVKLVLGDTSLTISYYYSMLCLNLLL

SEQ ID NO: 996349 - protein, 89 aa, Homo sapiens
KKKSGPSCTKGLCNPLELVITNPPDPHWKKGERVTLGIDGAILDPQVNILVRGEVYKRSPEAVLQTFYDELNVQYQKFQEKQEIVFAIS

SEQ ID NO: 996350 - protein, 102 aa, Homo sapiens
VGIPEADSMRVRDVSLRWLSCVRATLSFWPGGYPAYSKDSGYSRHPAENGKSNFLNCYVSGFHPSDIEVELTERHVGENRESGAVLHELFQQGGVVLPSVYI

SEQ ID NO: 996351 - protein, 132 aa, Homo sapiens
MKLRAHSLAACLILQITTGLFLSQWHLLTKKGLKPPVFIKSAQNHSEAREIMDGIQIRIPVSTAQWEPSKYTFNHDHLPYNIRGERPQILTGSIYSTVQKPLKTIRELIPLLSCNRISTQGLINKRIVFTST

SEQ ID NO: 996352 - protein, 110 aa, Homo sapiens
MSSSMCIGGSFSSWQKDKRASFDLPGTGSTDSEWGAGECGQICGCVVRWHRATLSDSSYGALSVLGKCHSFFILTLMKDLIFSGKIGVSLRYQDLQFMVIHAPQEEEIET

SEQ ID NO: 996353 - protein, 160 aa, Homo sapiens
SAEHPAAAAGSRSCQQQHHGQLHTSKQPCKAHVGIMPIYPNIQVIRATIRCKQQVLAHSTASWVSRSAILGIRAHRYSKLQSKLPLHNQSQGVLHIISQEIIHRSLSSIAHIKKDVNKSGEQKSQADKRNQQQTALARIPGQWSMDVQAYDRLWSKARKR

SEQ ID NO: 996354 - protein, 168 aa, Homo sapiens
MKISWVQWLMPIVPATQEAEAGELLEPRRRGGCSELRLHYCTPAWANRARLRLKKKKKKNSGPRDGDVGAHGQGTIQENIRGTEHKERGGGRTPRGAPQMKDNHWARQGENNTKLIHNREEEINGVTNTETHVGHKTTLEDEGKTKLDKTRTRWKDETNRRHKANDKP

SEQ ID NO: 996355 - protein, 161 aa, Homo sapiens
SKRTVGLFLENTDMDRDISRRVRRRRNATTDPCWMYALLRDCYDVQTRQAREYARRAVEPKRDLGARTDLHGLARPNNQTRRGTTDDGSETRHIGHNTIIPNHAEQTTREQTKVNHNGHEKRQGRRREREHITERKRTIIRHTKEEKRAPHKTARARRRMH

SEQ ID NO: 996356 - protein, 190 aa, Homo sapiens
MGFSPLLRFLAGPPDVRYCISQLLASYFVSTYDGRGLTVPSYRRRFRAYPIFGFTGPPGMRDWTLSIFQGDWYNLLEGPAGELTLFFSWGREPTPLKGGGMTLLAIRSKFGYHFPGLRYWLFPGKTSGSTGPQPVGVREVHYYQGIGTSQSLNCVNCLPAGVKSLNATPADTSLMLTNVTCEPGNWFPAT

SEQ ID NO: 996357 - protein, 140 aa, Homo sapiens
GGGTRAEAAVVDVGCARARGVGGLVRECRALVGDEAVRDGDGRFYVGNLPTDVREKDLEDLFYRSDGPHPARSELKNRQRPRALRLRALRGPPRLQRMLLMEEMVMIMASVGFVWSSPGLMEVRRWSGPVVGGMGSYKKI

SEQ ID NO: 996358 - protein, 42 aa, Homo sapiens
MGMERRRVRVGKHMYHYEMGGAKKTTGVLGWEGNQQAFSRIS

SEQ ID NO: 996359 - protein, 155 aa, Homo sapiens
MLYMQITERADKSMDSQPPKLVEDEDDDTFSYTVEEQLKTCCWLWPQISTNEQCSSPGCCRQFDIYTEAEQTKNSGQLSTGGKIHEACMLALEAQCTAIITESVKNGRDPLYDMHGFMTKCHPLHDTSRPLKVYSLSLLWAAAHYGLVRRYQLVS

SEQ ID NO: 996360 - protein, 109 aa, Homo sapiens
MSGKHENATEGQAPVLKRERGEQKKQESKQNQEPQETESGRETRHEEEMTAGRHPPANQVAERAERAGRLSELKQEEHDHKQRSDRGITERKQNERGRDRHRGPAYERR

SEQ ID NO: 996361 - protein, 114 aa, Homo sapiens
FRPRSMQPCRTHQRIPRLARPTEPAECRFRNVARILHVHEPYCGTHVLSTVSEDSYIFSYIYFGEPFLTSRDYGSCGCSMYTITSYVRTRIHNTTLHVISTESSTTSSYHVIIP

SEQ ID NO: 996362 - protein, 104 aa, Homo sapiens
NTTDHMTLARYSGYLDHHLTWNCNPILFPMEICPQLSHPDSSILQRINLELWLNLFKAILCVCINGLLIIWTFRTYLYNASICLPCFYLLIFCPLCYSLFLANC

SEQ ID NO: 996363 - protein, 118 aa, Homo sapiens
MSQGEVCAVTAFSVGIAIINHIWTLQIRSSTTEIGTVHEENIGNGTTRSALTILDTGAGHYRHDWQRWVSRCPALFHACFHLDDVMFRHCVSVNSATICPWPVASPGDASSIGLYQGV

SEQ ID NO: 996364 - protein, 149 aa, Homo sapiens
MIRKSDHPFTVSSLVMWDSLKLEGTWVEYSYVTKDKGNKVSADKVSKTHSMNGISKKEAIPQYKSGQGTQAPMRTCAIQHGRGTTGMTRIGQERQNRKLGLSNETQKEGKQGMPEQGDPVMRSGQDNTVKRPGDRKWRKRITKEREQKA

SEQ ID NO: 996365 - protein, 214 aa, Homo sapiens
MQPRHINLPDQNVFPRFFNSAEASLGANISLQASLQHSKSAPGMCGVTISRNPSAHGTCNCGKCLIDHCRSLVAAIIALSRPNPFFLLPRNIEPQTTRGQLQDTYQRDTRKPVTEDEETMPPHCVCILSPGNLDGKRIGYNQFMKQGLSRVLSAHGATNPDSYNNVIPGIEIARSGGRCPILEKPKTVHAMDLGRTFQNGLNRNTENSENLFPK

SEQ ID NO: 996366 - protein, 70 aa, Homo sapiens
MITGREQEGISSRVSVPAKPEWRNFSSHLLNKSKAKKSWSGRRRISAMLKDSPVDKNTTFNYIYSIPLET

SEQ ID NO: 996367 - protein, 77 aa, Homo sapiens
EAGEAARSLSTIAASAAGELPESLEPPVNRSRYPRDVEDGSAHGRASEVASTPSLRPGLHLAGKGAHQGQRTMVETE

SEQ ID NO: 996368 - protein, 112 aa, Homo sapiens
IRSRRASEWVGKMEVPRLDHVPQQPHSAPVMEVIKNLSLEAISAVDRERERTSQDSGIAEMEELPVPHNIKMKQYKRVTLFKISWEHGFKIKGSHYTLFYDLNKNENKKPPR

SEQ ID NO: 996369 - protein, 226 aa, Homo sapiens
MTANVSFFVGQQDNERNFGERRINSWTRPYIKPGEFPMVRVGSLGLRTFILPVKYKDNEHHHSTRNWDSVRKNMMISIAKDHLVRTLTQRSALQLLRHLILVTRDFIPRLINAGIEGTTLGGGDVHNGPTTKGHWISQAREPTRDWSENYPRVLAHGADAEQPAKMMPSMTRASEQYAVTGTSNEPESNHGDLEIVHRRREHTGTADGDTRRRSGRKSLTAQSGAR

SEQ ID NO: 996370 - protein, 67 aa, Homo sapiens
HAVRIPWICVKSGFDARRVEIRLVLAYMTDAAQLRDVSPYYDLIPKILTRTSFDLLRPGVSRRDLAW

SEQ ID NO: 996371 - protein, 243 aa, Homo sapiens
MASPCIVRSHIYKASMRAVQHALTCGLFIARHNMILQVAYTLMCPPVHVLLIDSIILVLTHTKAQRKRHYRRTMQWWRTVNYRGKSRYAGGSSQSFMRAAHEWSGKYGKSMLLTYLVCCVLLCDDSRQPRLVTNLHFLFPEGIKGNGAGPLRLIACRANPPQSPSRLEEMRHPIEVGFMIETDDSLKIKLGSSRQAGPFIIWDPGGSTNGCRVSGTEACEQKREPFFIFNCLITFQALDGPKG

SEQ ID NO: 996372 - protein, 108 aa, Homo sapiens
MSTETKLRYSGIFHHWIWTVIVSQGHYNTAYGRVRRGKSIDSDNFKRSSRLTSETLLESWHSRNHFGHLKRRLRIDIMTGFLRQGRTWRPVLYTKACTLALHLLHLNI

SEQ ID NO: 996373 - protein, 127 aa, Homo sapiens
MEFPSVAQAKGAGWCLAPKTSCLRGPGDSPDSSSKWLDTRVPGTVPLILDSADGRLCGPAVQILTRWVSPYPQGDSGYRDAPRLLTAVCFTRLWVDTRSGLDACFRKGVPVSEGSWDMPSLICVASL

SEQ ID NO: 996374 - protein, 114 aa, Homo sapiens
TDSLFGSACLHQGEINSLVAHTKPVWWSLHTDVSEIWCCDSDQEDLPREINPLSSCSLLHERDPPTTSGPQTNQPKEHLTNFKSDHPTSPLLPRLLIARLSQVQFFLSLRSSTL

SEQ ID NO: 996375 - protein, 200 aa, Homo sapiens
MLKTLNKLGIDRTYLKIIRAIYDRPTANIILNGQENGSIPFENWHKTGMPSLTTPIEHSVGNSGQAIRQEKEIKGTQLGKEEVKLSLFSDDMIVYLENPIVSTQNLLKLISNFSKVSGYKINVQKSQAFLYTNNRQIESQIMSELPFTIASKRIKYLGIQLTRDVKDLFKENCKPLLNEIKEVSTKWKNIPCSWIGRIIS

SEQ ID NO: 996376 - protein, 509 aa, Homo sapiens
HAAPTRHAHTRALPPTQRLPCACASCAPYTPPHAPRTLPPAPPSLPAPPARATPTPRLLPLLAHAPRKPPHLSLLRALPPTRTTHRLHTRAHSTGPLPNPPPAPLLSTPHAYTHTPPRTHSPLRPQPTCAPHAPARRAPPHAPRHTLPTRLPPRTHATAHAPFLSTRALRHPAASLHAPLHCALHAPRYPHAPFSLTATSFHALPHPCHAARATPRHTRARAPRAHAPPLSTAACARARTPCARAPPTWPPPLLGTPPPLPSHRRPLYTTHRAAQPLASNSGPTHAPSLAKDTQHTHTHTHTTRAPRRPRPLSTHGSSSPLFPHRCAPPTTAASLHPPVYPPPPLFPSVFSPTRRCAAPPLIYPSTASAYLHLTPAFSRHAGPPGARPPLTHTRPLSALRGPATHPVPLNPPAAPTLPLAPRPAAPPLSPSSCARRLAPPSSLSAPPPFTPFPRRTFPPPPSFPPLRPSSPPLSSPACATLPASPSPTLAPGPFFASAPVRWPHLFRRP

SEQ ID NO: 996377 - protein, 79 aa, Homo sapiens
SGARKCSLYLMIRATIDPHRDQYRISNTGPVRLLPRKICVAAVESDHSLSKIIIAGTKLTISYPHSYYPNSNPSSSRIV

SEQ ID NO: 996378 - protein, 134 aa, Homo sapiens
MDVRPPVHTEISVPPIPLLFIHISQAESNGATFSSFQLKAYDVVRMEVPELSEASLVSGAVGECTVVLLWNSLVQQEKFRDLVGGRYPNQYPFDGYVLLISNLCPLESRLSIATRDLLFLYSIPCKPVDDSHPE

SEQ ID NO: 996379 - protein, 453 aa, Homo sapiens
LGLQFHWQNPRGRTQSTVVLEVCWGKPGQLSSVPAAAKSRGVPGPFNVFPSVSLNFLDHHSLKNYICVVMANPSSPPLGAVFLVFLSPKPSSAGALGPQAPRVPGGNGSFFSTSNAWSERGTHSAAPCGRHEGPGDPTTEAPLSVSNSRVSRGDTARGAWAQEARGGGVLSQTLFFLCENSNIQKGDTEIIHHSRRGASTLVAIGGTKKPPGIAPLKGTPHIAGTGPKRARGSTCVPRESWRRDTSAPKERALAPPHMTTSSRQDKTEQRARGPWKKGLQKSQKAWASQTAAFQPPGKRRPERGPGTYRVTRGRSAAPPRDRAHKRPQAGDPTRELIPQGGTTAHDCGQYDTRTAGKPRKGAPSVPSRAGDTSWRSQGRHTPEADKWSSTKAHNMGSTGRHKAAAATHTCKRRDRQDTTKTDINKGALSNAERLKHANRDRQRQERRSPAPAR

SEQ ID NO: 996380 - protein, 84 aa, Homo sapiens
PERSWRIRHVGSTRYRKEEPSHVEYEARTEFMNNRIGPYIYCRCHPTGILQAQLRTLQYACAYYYSGYTLLKCTLATNNCNTLD

SEQ ID NO: 996381 - protein, 141 aa, Homo sapiens
AGSLHHQMGENFAIYPSDKWLISRIYKELKQIYKKKTNNPIKKWAKDMNRHFSKEDIYVANKHMKKCSSSLVIREMQIKTTMRYRLTPVRMAIIKKSGNSRCWRGCGQIRMLLHCWWECKLVQPLWKTLVIPQGSRTRNTI

SEQ ID NO: 996382 - protein, 260 aa, Homo sapiens
QDWKFLASHFPNRTDQQCQYQVAESLNPDLVKGPWTKEEDQKVIELVKKYGSKAVDTDAKHLKGRLGKQCRERWHNHLNPEVKKSCWTEEEDRIICEAHKVLGNRWAEIAKMVAGRAETRSWREDLIVRKSHTHQREGWTQEASLRRVQRLQAPSVLAAGARGQGRPPECPAHGRPGKSSDQLALRPSYHKGGGKPVKGGTCSRHHIEGTGAHRYRSWTQGEHQSLEEFPKREGQESSPPEKRLLKSGWWGSNLLIPWGF

SEQ ID NO: 996383 - protein, 100 aa, Homo sapiens
FRLRFRNIFQALLEEQNVECGRCVLNYSVSGLCGDPSSRQVPDAPCLVASLVGFPIPSDNLCHACGCPGTSACAACLERDLIYEIIDVWSSEMDIVGRTP

SEQ ID NO: 996384 - protein, 293 aa, Homo sapiens
MDQGQPMKPHRIRMTHNLHAQIYGLYRKNGISYQPSREANAEEMTKLRTAMTYIKFLRSIRPDNMSEYRQADAEIQALVRTVQYSMVLFEFCQLSTGGSVASAVKLNKQQTDIAVQLGWGPAHAKKSEASGFCYVNDIGSWPSLELLKYHQRVLYIDLTIHNGDGVGKRAFYAKDRVIELCPLITGYGRRSFPRILGTYGEIEAAQTGKFYAAENNRNGNGFVTRSIMSTLEGRYIQYERSIHAKGRSYNRGGTRHHSRGNSEKMHSTTIEQTTEVYTLIDTSRLDYGSGHHT

SEQ ID NO: 996385 - protein, 309 aa, Homo sapiens
LLCLMPPVPCLAGLRGTVRGCSGWLLAGVRGEFRFRFFVRLHRRLREDGWPGGFPVCVLQCWLCCRSLRRGGRGCCLGPGRNSGGLLCEWARLRVKGLYRSLDALERAILRPGMLPVQPNDTSRELPWDPLAMGGTLQSDLGCASQGWISPAKRPGPQRDSSRSSSIAVQNRNHNCTEAQKMADKILTSKGFVNLVPESQAYTGLSWLLTRKLDQTIMRKRLDIHEGLKVPIKAKEGSWKLFSTNTFNPGKVDAEDWDKDTVSPWDASGHKSVLEDYAVSNMCAKNKEGVLVQIKEYSSERTGGTRHRI

SEQ ID NO: 996386 - protein, 362 aa, Homo sapiens
MSAFEKPQIIAHIQKGFNYTVSDYRKKANTSLNVAHIWCNHLSQQRYFSYWRSWLDNFIYVNLSTAPAHASIFMKGPSHSTIITCHSMAIGGTQDIGSKEHLKHCALSTPQHCDTCRHACWDPTRPHHPRLIPDSYLLRTLYHTRDTTNDDDLLLGNPVQDISRQLRLYISTNETKPAAPAHARPEPTEPYLLANTSQPYSWTPPRKTNTAKLNRSTKEDNNTYSQQKKGGEINSQSQLQHTYTDHHTTTYHIKANLTIPGPTLQRQHNPPTQTDNTGYSQIDSQSRPGLRKHPHVQPPKPTNGGTRPPTTAHTKPKPRQPQYKHHNNRSKTNPHAIHETTAKRPPPETKWSKTTLIRRTHP

SEQ ID NO: 996387 - protein, 220 aa, Homo sapiens
MAFTYPKHTSIRVERNRMRRKGDSNLDVLHTIRLMFGGQSVCSFSVRGVASRMSTALLVLATDWIRHQKPKQDQLLLVEIQNEGPSVKSRPPKIMVYTAPTGPSCFRETRSGGGEIPKGSSSFTRNVTLGKTFSIGSFTRRDCLSLVVIDLSGWSLDGHIPVPIVRDFPGPGRCTFHGVGLPEFRATLCVRAFLCGPTSAPNGVCTLVTHIGALSPSSSF

SEQ ID NO: 996388 - protein, 252 aa, Homo sapiens
MRMRHSVNLRSAPGPEELVQEIQELDTGATESLRKVTAALLGRVVLVSAYPRASPNVLVTGLALVCTSRPLGSPVSWDLSVVELGELQRSQSFVLNGGCGRTGLDSLSGVSPRVYESLALSTSPRVLHGGAVNVLTRRDYMCRTSIVAPSGRRLTEVRCSPGGGRTLRVCLPGLGSSVKCRFTRRSGNEHAVLASCRSSPSRRACNWLVPLQRAGRLTDVTDEDRRFVSRETRGEGASQAEDSAPKLQAQAQ

SEQ ID NO: 996389 - protein, 189 aa, Homo sapiens
MELSAIVEANRQDSFSCLSSTEEKIEEIHYDKDASIVAFFRLDSFSEAHSEIPKSSQQLEGEHTDLHIRSVESLVNEYADQVVHGYRLITSSLISSIQVCRDKTVAYTVAETPGPVAEFISLSRDSFVVICPHMTEDNQDVIQGKDLLIAYYDVDYEKSAKGSCYWRYRVIDGGKGIPGMLGTNQLCLY

SEQ ID NO: 996390 - protein, 263 aa, Homo sapiens
MHGWGDPRKLTVMADGETNISFYPWWQVGEEGELSEVDAPYKNIRSRGELTITTIRMGEPPNDSVTCPKVSAHQQMGIMGPYKHKDEIGVGDTRPYYISLEELIVGNHPWILNTITARIESSNTKPFSMTADYYCHDPYAQVDCSLDYHSMQETKHPNDRAPGLSLKAPSIGKTRQANQVGRRRANTAPGETDCITITVAARGGAKPKRESAQTETQSGHSWQHPSSRGRKHAQKNTRDYIRAARHLTGTSILWHAHMTNSTY

SEQ ID NO: 996391 - protein, 148 aa, Homo sapiens
MTAPYLPYAVLYQVLNISFGITEDIRTFHNAMSSMLAVSVDPSNFDSYLLGAQWRYPWSRKVTSTSSDIDARQWMISRCYHSMIESRIVTPPIDEPMHGCSTWGLHDYVNSVAASEFPCESTQNALDLLLRSKGQLEKETSRDPYGRP

SEQ ID NO: 996392 - protein, 314 aa, Homo sapiens
AEVLVWCLSVLEAISLMPPGGAIVAEQCTAGPESDGRTRVNASTLLAISTVNNVELPGLSSLRSWMNTETRSTEAPYASIPVDAQHALQIRSWRTLCGGMHAPHGKHRTKGSADSGPVLKVDLTEYPPDVLTYNRTERNGVFLLPFEGRASGMPNRERVLPYRGGRHEFYEVGVEGTRQVTAHPGGEEEKTNSPRSTTVKNETRLMRLPEEQAEERTVENDKLSKCTARRVLKDHGTPWSEAQIKGLLIPSRIKPHRIIPDRTLKQARQDPRFLLCVRDQGNYSEAVTLGHRPHLITRRTNGGTQRGNKHTGGQ

SEQ ID NO: 996393 - protein, 308 aa, Homo sapiens
MWPVHNGDSSPMSRLQTCSHSDDDHAAVEHRRPQALIMSLGVRLQDLDRSTWTERRVLRRDYRSSNLTRKPGWGRRLFPMRTCIKHNTSGLRAHDGMMRCQVEPKRTGGDGVVRVMPGIRNERKQGSERRQWAKQFLTRVGYSPTGTNNTGLGTRARDGWGPRTTNKCSSTHVPPCVPMKGGSTCEPVGDGNPNLSAKGLVPERRGSLKRRIQAQFPLFNPVSEGQAREAPRCLEGGPQVNRPWEKGPELKEVGPGPKRLERAVLMSLRDVGPMHPRWRWAWPPMGVMIRPNPHQEEHLMECVGSFTL

SEQ ID NO: 996394 - protein, 368 aa, Homo sapiens
MPVTPCGCLLLPAPQAALLLLLPIPCEPCLLPCCACCCVPCLSPCDPLRWLCCDLPVLAPGAPPRPGPGRSALYYPGSHYCLCTHTLWRIGTPPVITRECNACHTTTYDPMMCPMEHPLSADIAMATQMQMRTETRLSILLWCSDNLPAVHRLVNLTSSRVGRELDIYNNLRQTPLHLAVITTLPSVVRLLGDSWCQDPWTLELTWQDGQSHGRCEAPQPALPWRALLDRADPGHGLDLEGRELIDWVIQALHVAVNTELQDIVQALVNTRWRTSTQRHHYTGGRSQVISAVETHASLGDGSRCSKGPTVNGNQYYSGEERPLTYSTLARGLTAGSTQIAHDQSRELNTAKSRAYVCRHRLKLMGSEQ

SEQ ID NO: 996395 - protein, 182 aa, Homo sapiens
SIVPILIAVAIPNAYRTKKFQAIYNYAKAPMRCRPLRATRMRFADAIKSASPKEHPKTRSASNIRTRATIKRPAKHSAPLHNAALLLLNSLPLRQYPQWPHECKTTTLESFGRDGFVDQLVVIKAVVNQIARGLPGDRRRLQERTKTKQTRMEFGAVAVVERHGSDHGKHHNMLVVGRSRAL

SEQ ID NO: 996396 - protein, 353 aa, Homo sapiens
MCAGMIPGLVPNIVTTAASCGLHGLSDCAGLPGPVALCWNRACEVFLQCHGATCGRSDTYYQSPTGDRILKKVELTLYLGPACDLTLFDFKQGILCYPAPKAHPSGGCQQEAKEAFKASQDSDNVRLDPRVVRSGRRPRGMRSKDDTDTDPAFIPCSVGAVRTCGISFSGDGHPKARVKSCAKTVEHHDATCPSTRGERSTCSSGLGWLGERCAPGQVDTQQVYGAWAPTRAHRTRPICGKAEGARVDRRETDTLELGAETRKGIDRARERQPERTVGRVQVARRQQEHVYTQKKRRPKTIRSVSRKTTTKLQIDHEGSTNLAPTSVNREKAAGKTTRTTEDIQTTEGEPVRR

SEQ ID NO: 996397 - protein, 139 aa, Homo sapiens
MGLNPSGCSNTIMVTMETTGQETLGQMVPGMVQPVMEHLYRSWGLTCWKSKHFYKTQNNTTPTQQHRQPTNKPHHAAAATHTTKKRQPRTKRGPHHIDANDTTADSDRQHRGPAQKGENAKNKTPGTTAVSNKAPACDK

SEQ ID NO: 996398 - protein, 322 aa, Homo sapiens
GVLQVGVDDHWHVLRCQAFRTREGRLKCCYATLLHALCITKPVCDLLRVTGEPHLGPTSSWNGRCDVCACWSELASELCQIDKEAVQKYAYLNVVGMVGSIDNDFCGTDMTIWQLDSDLHRIIEVVDAIMTTAQSHQRTFVLEVMGRHCGYLALVSALACGADWVSFQNLHRGRLAGAGCVSNSREKRARNNQAEYHHRSAEREQLIPKINPSPLTTITPARDTHLALIDNVVTTIQHDREQKEPLVRSDRTQTKQTLGLESPLDCLDGPHGNPPVKYEDDARGTPSRRRMAGNCTCGARLTSRKWTQRSRRQSDENSEDAH

SEQ ID NO: 996399 - protein, 203 aa, Homo sapiens
IDSTVSFGASTRAYTLREKPHTCHRLCKGDEKMGGEDDELKGLRGGSRGGNGAVISLTEFNSAHNEADFYLCTIEEGNLGHSKTKEEEEELTWVTSSEDDEIIKPEDVDPSVGRFRNMVHDCEWSHVKKKRVEEALCSLGRGGIRVAGAVLECSPISGGLYRGPAPHITSEAGVPVNMASMGQYSSVGLRHARANDLTPGCGA

SEQ ID NO: 996400 - protein, 441 aa, Homo sapiens
DKNQELEVVSASMTRSSLRETELSLGERSTHCIELHTASTAAMLCSSGCQQEIASDVCVDKDRRTVQCWKQNVARASHGRPGGVAAWNATEVHDEAIEGCTVAGGSDENYEAGRPGEEVTPGYNESTGPPDSAQFIVVQGEHTMRNERMHWVHGARVLRNRGKKMRECDQGNALFTRHREDLDTKCNMHLCTGPEVLCQHRQPPSSSYPECGQAAFAIKLPGGDITLCNHHIIPKSTQSWKRYPLPGSGSGQRQEGRKTREPDVYNTLYPQRKEPTLLVENGLSHMFHFSTEGFDLALRPKKPSQDRGSPNIRTTHIEGAYVLTTTAHIEVQNSWQRTAKGEDAETKMCVRREHSNRSYMTHSEQAETKLVPPRFADILTIDIGAILRQCSAARYGRQKTGVYQFPAGDQRWVARTEGPMVVTIVPPVSYARLASRAKSNT

SEQ ID NO: 996401 - protein, 68 aa, Homo sapiens
GFDSSYQRTKVIYYGSAFEPNAGTVVLAARTRISGRGVKCEDFSPMTTATQRRCGNCEIESKHVKTLK

SEQ ID NO: 996402 - protein, 131 aa, Homo sapiens
SSSIAYLAPIARKGNMSSKAEHTGLEALPGLTKVSPVTHSQQEGLSNINDSVVVRVDPSSISNLHDECIGLSSIFSLTTAPAVLPNHSQAGEVRISKVRQHTTCYVSPTGCRKDEKVRYWIEIRDLSISMW

SEQ ID NO: 996403 - protein, 166 aa, Homo sapiens
MSFFLNILNREITQVGERTCRQSKKTYVSSEYSGQYLPNSVTNKNKTNTSRGVHKKVDEGSRSRRARQQRAGHVPIGHSSRSGDLLEKQKRTQKLDGPTPDRKPPNEEERPDTHNAEEWGKATPDRSNRQRTTRSGAETRLARGIELRKQQRTRPRTTRHKRPKPI

SEQ ID NO: 996404 - protein, 281 aa, Homo sapiens
MVLLGHAYQVDVVLTCLCINASLFTTERERDAHLSKGQDLTSPMHPGSFAILEGRRQCLPPVLRVGQGLVSVAVLPRAIVIASPSVVPDCLWPHKRVLGKRLRRAEWALGRRFDVEGLSLCWPFSAKSGPRNCHIAIVPFGDLRAKAKGSQEGDSYYGRDPYAYICEGNGAKYTGSLPTLRGIDLPKTGIEKYHVTQYYILTSLRKVPTRGNFDRPKPLVDEDRAAWAHQGGLNSGVFKVEAHLGGSFVGPMRTSVPKRACSHHGGAFPCGSRTALLHRRN

SEQ ID NO: 996405 - protein, 227 aa, Homo sapiens
MVRATFPHDIAITLPWKGTQRTKHKKRKQKTKKHGKEKEKREKREKSEKRTITEKEQKRRGSKNGETSQDEEAGARDEATIARAGASSEQEAEKDTKKNRKKRSKDKHKLKSDTEPEQGSEEQERTSGEELDEAGQDGREERGGEQEADREETQEKKAGTSNDDNRRGGRGEERRPTNRIGEGRAGRATRQTSERRKQEKGGDEDRGRKNERGRPAARGRQHEDETK

SEQ ID NO: 996406 - protein, 105 aa, Homo sapiens
MSQPGSVSLRRDDRTEPSHNLHTHFARVAAQNSWIDHTNTTNTAMHSRDDTYNNTQKHYYIIILYHTNYDTQLKQQDQLIYARQHSKTINITLYITKHKCHHPIN

SEQ ID NO: 996407 - protein, 262 aa, Homo sapiens
NHLCVSHHVAGFIDLIVLAGLAERIAVGHLLVNTGARFPRPAFASLPRIGAPEPAGVYTHFLGSSLGDLGMLNAHVINCFDYARYIFEWLDLLCRILGRYLSVFAYLSEWLLCRITVRWSESMTASNVHEIKEQLCSFVECIPEQREDGRVRAIPSLLGGLIDVKATFIGYSTGIQELFKLHLQMQFTAMFRRKAFLHWYTGEGMDEMEFPEADSNMNDLVPEYQQYPGTPTGDEQGEVEKEGGQELNGFKNVLQNSFVAIP

SEQ ID NO: 996408 - protein, 109 aa, Homo sapiens
MFRGTLGPLAYVFRHLLPLEGWFMSGVAIGCTGYILSPSWSCYRGKLPEGRIMPLYELKYLMPTFGKGLSAVRIEIKCLVNDRFGKDRSGVSHGLQKNVGQKTDYGYVQ

SEQ ID NO: 996409 - protein, 73 aa, Homo sapiens
VAGMKKKGDLDYLQLVKVEFDEEFSGAPVEGVGEEALTPSVPINKGAKPKRDKKEPWYQTWRIRHLTYIVCKS

SEQ ID NO: 996410 - protein, 342 aa, Homo sapiens
MKPPPPDRRLPSNRCRRRPGRCPRRRGAAEVWCVGGWRVTVLLAAVDREPCDSWRSVVGPVLLMLSSYLPQGPLPGPPGALHRWALGPCLTGAVAGPRPQQASPPPCEGPRWSRRSVPADALGAVASGVGASGRGGCGAGVVPASLSVGTSTRARESERENSGDTHPKHTSEQSIGIDRNRRNSMRHSTPNNDEKLKKKAYNGSHITTIAGNTKIKPSTLRFTMVILEQLRTGLHRMTHIATTPLLHETTEQTGTSLGLLSLTTLRVGTKQVKEEKEGHTKKSASDKRKHKQTTQQDHTLPAASQRNETTVTEQRDNTNAQSPIYTETRNDTDPLTQWRPKY

SEQ ID NO: 996411 - protein, 139 aa, Homo sapiens
VVAGWVALGSRSALALRVVGRGGGGVRAHHRGPRPSGPRSAITGTCPTHDIYCRFAECCREERPLKRFGSRELDLEEKSVLDSDLGRRQVIFQGARNWLQEQTRNPNETTDPFPYTAGLATGKNFCQSNCGCKIFTHKV

SEQ ID NO: 996412 - protein, 179 aa, Homo sapiens
QKLQLLEKSLDKKLPKPLVTHRSPMLAARCHAVVETSCPAGQEPCSHVTVRRCYRRTNTDLSSMDAIYSELVYVARHPSPQWQTDLVCGPVQQDRPCGPGLLLWIVSSLQDRDVLWIAPKMRGCSKSVLLQDICEQIIVCVIMRHNLEEGATASQTLRIPYMGSGHVDWRTVITLTRIH

SEQ ID NO: 996413 - protein, 184 aa, Homo sapiens
MILGSPSNSSRRIARRLSSFDWPVVFRPVSFDPRFLVPPSKAIGCLSMATLCGPIGEPWRGHWSWGGTDRFIQRQAPVKAPTRMKEDEPQGETQGPGGREDTDLEAKRIIQEKRMRENERSHKPTKEQGEQKQNDDHAGRREKTIIRPTPEEPLGGNREHDTKHPTKDRGCEQKLSNHNPLDEP

SEQ ID NO: 996414 - protein, 132 aa, Homo sapiens
LRKEAGGGLCGARLPAYLSCASSNVRGSLTSTSTRWCCGGPGVAVSARYVLPEEAGARGPAEGGGGRGVVVLDQAAATGQESCERRSAARVVLTSLLACLPAGPRSTSSKGDMRLSIGISLSVAWIVKPISQ

SEQ ID NO: 996415 - protein, 66 aa, Homo sapiens
MKLGLTKGMRRRRRISSGQRIIACGPWWSPQLGNIPILASHGDDLELHIVGDYEDMKGDYSWTDDG

SEQ ID NO: 996416 - protein, 126 aa, Homo sapiens
AWRRMCIWAADDACLRVRWVLFVRLLCLALCSGPWAPSQSWWVPSGSRYHLVLRRGCSGVRIWVLIYVLCRKVIGSTVGSTVTQLQTTGTKGISVMHSFCRSQHNVDVVLDMIKVPVVPDRACHIT

SEQ ID NO: 996417 - protein, 260 aa, Homo sapiens
GLPGFPLWMRGPAALLLPAHEVAGRGHMERDLARDFSRNGRRLAPDPASGGSVNDEEAGGGDRPMVLLSSRVLLVLCTLVLLLVPSVLDGGLDGDKGAEHCPGLQRSLGVWQPVRRRVAGDTRAVGLRRRGSRARNGGATTRFSSGSQCNLTRRCPGTACVSRRMQHIYVHDALGAPARPSWANSLIQPPGRMLPCMSPCGTLWPGAVSGRRRELAWARWLHAASLFRADFSVLRCTRAGDPWARPDTQLTGRLFGGAPR

SEQ ID NO: 996418 - protein, 56 aa, Homo sapiens
MSPGDKFIDQYKGGRWYKTLNGDLIQPWLWTIKKSRDYTYYDILLYRHRVSYYNQT

SEQ ID NO: 996419 - protein, 421 aa, Homo sapiens
LLTGWCSCPGTSSVDSIMGLWSGSPGEPEVVKPWRVPVELRGDGVASVTCLEACRCVKPGAKTGNRPVPALRDALVFKTAPREYAYITSQLQYKRRYGGGPCGDLSSGEAVFPFQPGQYVCREVCINRSTQANLDRLMLAQIGLGIQVPRNALNLWVPSNSHQLDGDFQDLNVVAFDVDNAASSMDPNQRQLASDPSELGLRRNIQILDGTNIKRCAGHITNSVGGLTRSGNHQQGSELPGGHEGQQGIPTLDIEASLIQHECFQNDYSSMTRGHLFWKNHITKGVGQGGSPLFGAFTFPGDTKWWTGENNIYGVKTHSDSGHEEMYHDNSSKSETPQPEHPQAGSKRKTRETLITTDDTVRDQHLGRPRHRWSHKTMNRLNKEQSDEDTRDATKMGDPTEEPTRMTEDRAPRTGENHGNK

SEQ ID NO: 996420 - protein, 493 aa, Homo sapiens
MDEDEQSTSLSLDLSVMWDSDFMTDPCALARPRVTQDVIASSETDIDAHPESLLHVVPCGVTAIGARVPECLARAELLLVQVKSVDAARDTSVSCMRDRNMDRRSTQQESSVLDDASMTIEGARKNMDKTRLTNSQGGGDKISRPKSPRRGRGDSSKGVLSAILAKGGPRQICERDEIEPLRRDVVRGCHYSRRHMRQNSCLGKLTNFTEELSLHLEQSPATDSPEIIGQEPVDTNLVRASREHVGMFFPMSTPKTTNGGTADLIGGSVYRGEVPRTLELCDPERVVVWPPVRGHYHTAFNLSCRPKRQENPLYGTAPLYPFCKSLAQVNGGVCFVVGKSSPGEGHGICYFGNHSYVFPMPLVKGRYGKLCVGAYVGCRTPRGVAVSSFGNLKSRRDISQEATLGLVFTENRQMLFGKRHLLASVSTTLTQAVTKERPYFAVKQKERAKEAQAFATAFRGRGANRGGGLFVHLWPSKGPLGRVFSPETLENNF

SEQ ID NO: 996421 - protein, 223 aa, Homo sapiens
MFPVCLFENSLLEETWSTGTYIPVWNNPRRLVCTLDLWYFPDTEWPGEPVTIKLARVLGVHLVNAYWSLRYGGLITWSAVHLSFCCEGACVNPKSLLVSSSTVPLFRPKRFVNLIQGLRIFAPSPVDVPPWDPTEIIVSQLVVHTRGPPPTIHETNGTLHHEPDLPFERVITPLVTFVCERPYGTCVELPSGWLAGVGRSSSWFWGRVGVSKSSCRALGIARF

SEQ ID NO: 996422 - protein, 230 aa, Homo sapiens
AGSGSEVVSGVQKELPAAAPYIPNAGRQWAKVCAVKRHNAVSLSPPLFGLLGVQPLSPRSVASHADIGLWSTVDYWGPGHSRGLGNLLEHVCGLGSQMGTPLDETQLGPDSPWEPSKCSVTREFHCRGPLSNHCDRSLCFRLGSASSVWGFREELAPLVGPTLCATPRCPSRTPAIAWGEVPRHQLRGHLTTTLVCTEWNQPSVCMNVSGNTQKCHPWPDFLGVPVELVG

SEQ ID NO: 996423 - protein, 66 aa, Homo sapiens
AQGFTLYDHLWFSVNNALSTSRLENQQQEKHLVFYLVFYDMKEAVAFHSALCSTCCFESVYAIVCK

SEQ ID NO: 996424 - protein, 242 aa, Homo sapiens
GLPLTHSLGSILTAYAAPMAQHMCVNEEEHPSFTLALAKVHGSGPPREGSNDILSCLERQRAGSWHSPIFMASCILNGTYDNDVRLQMPTMQSDRPVFFTLGFQKSPHLSLLHPVLAHMHLTLSGCRSIKGPNENESVHSSRVLHGVLWEVRHECPEIGSDEQFTLPKRMPLVSYTYSRLFTCVVPEGVRGPEEKRRGGPHDPGGGAGRGWLARTREHMPLPSLGGDSSWRRGQVLWEPCGP

SEQ ID NO: 996425 - protein, 104 aa, Homo sapiens
MSSQIRQNVFDSDVEAGVNRLVNLYLQASYIADLSLGFYYDRDECGSGRREPRSYPTNCIVGEARWRYRASPEDANISVRSGSLPGHQGSQLKSDVVVKPPDGH

SEQ ID NO: 996426 - protein, 138 aa, Homo sapiens
TLNTELKDNLKLTPCTKRYHQPGHECLGPALCDQLQQEFHMLWQQQHHRDWLRHVSWIRSQEAVAVCSQTAAALPVVALCRTAQTMPTNIYKVERRLASPTLETFIQEHLRDIGACRRIGNMPVVAGLKSHDLSRCLT

SEQ ID NO: 996427 - protein, 227 aa, Homo sapiens
LVVVMVTKTKAGQVPQSPPEASPRAAPECLYILRRCGTHVRTMSSSATHVAWTRVGRRARFHRAIRATKQVPHGALESVLLESLPFTGEHGSRMMGSTAGTYLPSDVRSTGSGEDDSMHGKKYLYVETYRALSHAAGAIDPSLSTERNLHGPKRIATQKARIGHVHPFGSNPEQITLGKDPTRIRNWHTHRVACVPKVKYAVGWVLARARSRVPLGPSDLVTETFPR

SEQ ID NO: 996428 - protein, 172 aa, Homo sapiens
QAERMPEQIRLKVGGVDPKQVAVYEECELAMSPWLSYLQMTLSQPTGFLAQADEASLGRQSDVAQIYDKCFTELERHLHAIPPNIGHEPSSSGSSKSLGGCSINLEMSRDAIACSLDCSEKAVEGLLDATSGADADLLLRYRECHLLVLKALQDGRAYGSPWCKKRSARCRN

SEQ ID NO: 996429 - protein, 387 aa, Homo sapiens
RRGESRARESGACARMELRRNALGTSEEFYNHGALPDRGQAEGDAPKNGPGRRFSSSLKTCYRSISIRAVAVYRSCYPGAGWGNAQRRCAYFIWFSELWTHWKDDSDQSVWKEKVPRVYSNFALCSFTKPDWRFMESKEKDRQVLEDFTNESPCEFRNLAEKYQRVIADICRRMGIGMAEFADKHVSSEQEWDKYWHYVAGLVGTRPFRSVLRLRVEDPEWATIQSVQLYGAVAAENKDDRDYVEEHEGAEEFWTAEVGPSMLRSRGIGKARRIWTWAVHVPQGTRAKALNAIQEVLTRHFANVEPARVHCVDITARSPGELERLVHNPQEEKGDNKLCSENTDRETSDRGKNYYTRRINTKPKTESTTTTVRYHMTRARQPTNTIV

SEQ ID NO: 996430 - protein, 237 aa, Homo sapiens
MKRTRRRGEKIKKERRDRARKQAENKTRRTGKRGDRERRTEEEGRKGKKREEREEKRTKREQREEERSRAATKRSTKRQGKRHRAKTKERRKTGKTREKRRGGTREREGRGRREAKDGQPSESKKERAEENQREEEEEREETRNRKREERGRENETGGKEDREEEKKRGTGDDEDASKAREKQEDGRERERERGGEEQGRSQATERGGEEEKAKERGKETRMRRETRRGEGKSDEER

SEQ ID NO: 996431 - protein, 166 aa, Homo sapiens
MIGVVLYVVCGSVNEEGKAVRIEPYVTHAAGPRVGKGSSQIDTTLLHACKPFLNVGRNPGKLPGKGLATPLAHNGGLLTAMDITERRLRALRNTENGLFVAEHRKGPFWERRGALTHTTGLWDTNPLCVPRPLIVGNGVGGEHLGHKASVGGTLFDFQPRLADLAL

SEQ ID NO: 996432 - protein, 419 aa, Homo sapiens
AVTDTRKDEQERSDHRSSQHAASPIFYELSENDLNFISSSKDGAGYPHQTTYDSPGHSRLTPRRCLLALSEYTDWQHWAGRMDMRVSADACDAEQETTLPAGSAICRDNNQALLHRLNENTEWNRRTCHGSQTGKRRTEGRNISRSITKTQLGWTTPLNRIRQITKHITGPDGRRTKPSATHRRATRLPRTRNPKATYAHTPAADLRTDPRTFPPRQQAHHPMDTPQTAPPTCPKRAPKPTHPDNRAREVGHHPRAGPRTAHSEPRRKGKQGHTCHDIETNLEKRSDPRPTQARPTANTAQKIPHHKLSKTDSPTQKSKAHQQSTTTPRAKAENRKHPRTHTAHQKDGNTSNQNHNAGTQRKHLPATTGNNTTETHSVENGNRKRTAEKERDKERKRTDHKTKEQHRNIQEQPENAGNT

SEQ ID NO: 996433 - protein, 103 aa, Homo sapiens
MELACSFTINTANLETKQKGGGDDKSPEGGQVTPTRGCWCNRGDIMAGSYNKATAHEKKEQSETRQPDFSTAALWVEKARPQKEDRGKKTWTTTLDVRITAEH

SEQ ID NO: 996434 - protein, 202 aa, Homo sapiens
PFRQGWQPIISEDQEPFWGTRASELSISTADWVQSATSQHSPHQADIIKQTWEPGSTLENLSLRHGSLEAECCGALLSWPSDEEGKVPWGMGLQLHGKHYPTSGWSYSQCHYNCVSSLDWRLFDERRGIPEARESSEYIGGSCPWSRKHFRVLRPALSDPVPGPLMQLRCIRGADDSRSICMRDSRCQTHTLEGVVTSMGSS

SEQ ID NO: 996435 - protein, 486 aa, Homo sapiens
MMPRLICGYFFKKRVGLLCHIFVPGLWFVELSYTTLKAFSSPHLCVLLPKMCCGTPQRVCLTAQPVPPRDFRLSRGVYVCVLCGLCVYTFVVCESVIERALSQFVWGTERREQHRAIFILSIYDITLCVCLPLCEKGYSQRRESERDNKEEVWRPVERNTQSGCVRNSPTPSSAVPGGGSLYLMPRGSNTTGEAEPKRAEDQRRSVWRHHIGRHRLQAAPLISSVGGGEPPAVFAVFYCQHAENKTSASRMCGCIQKPPSFTNNGYQLWVLFQASQNHLCYERHLCWVCERDAHLFSNEQNKSYKGRGAMWYEERATQPPPPLSPLYVCCLSGPTNTLVLHQFVPSIQTRRRRRQSVEQESKKAHPHRWLETPAAKTRNNNETQQPRKRQQKQRQTHKQPHPSGRPATSLSYHSGDSQQPNKTMSINEKRSRPPSELNRTHRYSISLQHNHIISVSKQRGGGRKPPRAPPNHSGGRAIQTTASPGL

SEQ ID NO: 996436 - protein, 135 aa, Homo sapiens
GGGGLAPRGQNRLFGAERGENQGWDLGHTPQLVLSFLMGYRISEGRLLAALIELICQALSNGSKCPEKAASQAACAHEAKWPVSHTAQGETHPQPVVSQSRRRPMRVESPRGTHCRMRASTQDLKRVFSPVSSVV

SEQ ID NO: 996437 - protein, 50 aa, Homo sapiens
QDEAVVLSYVNGDRCPPETDERLSPCVFPVVWSVVVLLCFVLSFVCWFFA

SEQ ID NO: 996438 - protein, 302 aa, Homo sapiens
ETLGAMPGWGLMSGVGPAGGRPEHDLASLCLKKPAFLQPHTHPGLSWGPKGWGGHTMKRGRWPGRLLRDHAAAGAAGAAATPQSQPSNRCRGDSSRFSPPPSGLRHSAPSGGASPAVASLRDLVLSILVCIIYLRRLHACLCLVALVAQLTNMSSDLFVPFSVRTDIRLHVIVLKPDDTGGLSVPCLPGGLGPGVPFACLGSLLIVPGKDVRSGVPPAGARRPGSLHQGSPLSPFLVRPMSFRDRRGGGSASVRPWLGWRDTMLLCRALKVANSGLMPNRASPILVRDWGGRRGRSDGLTPV

SEQ ID NO: 996439 - protein, 130 aa, Homo sapiens
MVGLSSHNCRWIPLGMEAADQASGGPEHPASTHCGWRLKPLALESSRAREHNVVNQQPRCRHSHNTDRRPNREGRSKAKMRQRQLEEDQQDKRRDREDRERTPDRADTTMRKPPEGRGGQIMLSTPPVRR

SEQ ID NO: 996440 - protein, 102 aa, Homo sapiens
MRPRNSVPAGGGFVTGRRRALLCDRSRGLWLAGLARFGGGPARRRAGRLPQVVLTTEECGRRAPRGVQSALEPWLAASPFLLDHSASSVKIRFTRRRHNSSR

SEQ ID NO: 996441 - protein, 120 aa, Homo sapiens
WRESKTLSQKKKEEKIRKSKKKNQKALRAYKSRGGFLINGPCAVSPVHLHWLASPWVGWGDPRSGGQAPLEGLLLGVGQQATQHPAPWGGAGLAGLLRTSLLGRDLTAGSNSSAGPWVAG

SEQ ID NO: 996442 - protein, 253 aa, Homo sapiens
MGASWVRGGEPPRHQGKIHGSSRAIGENSIFVNSPYAREPGAEKEPCRRTHRAVNWLGKIALDHAPGMGRACVPMKGARTFYEAPEGGDVHRHAVYTMGGGTPLSPKISCLYNRSWTINAIWLNPTLCSVDTCRPLNQGGKPVRNAGHMAGSSKAAKHVSGDIQTSAEVTLEATARAPDLVGSPGSQWEKAGYEQRRGGNGTMFTGSYGGQIELAGNATQAVAPLGDTPGAAPTGGGPLELHSAEAHTERHAI

SEQ ID NO: 996443 - protein, 397 aa, Homo sapiens
MRPLQMAGSPRAQSACCRRQIARPSASERRGRNRAQGERARAPPDPAQPSPTPFPRCQGHAVTVALAEKGERKNTPDRCDAPHHLSDQLNDIVEQTMSDYNDSLEVETGTGDLLRGTRCWRVKQAEEEMHRFDGIGVTSAPSEKAGDTASRNIDRGSSGVSGLRASLASLALGRVISTSEQLVAKAKAAEGNDDEVAQGSSIASNKGPWDFHEPAKASRLGVHREPNAKSWDGKLCTNDPWSIESEDLHPCAFRAVPRNNYTDWKQERYEPKENGAETLVGVRRDRPRAPESKHCVPMPETLTQYALNSDRPSGNTRTVGATTGRPAVPKVAISHHRGKDQWQRGDHHLDNDGEIYGMLATGDNVFPCWFHPKIWMPTIRGKAPDRTADHTRQSIAD

SEQ ID NO: 996444 - protein, 114 aa, Homo sapiens
GQATFHASFSPAVEPRELVGPRLAGLLAWTNGRVPMVRESSAYKLDGNRNLDRETSSRTLNVGRLRCKDAGVTAFSQRAPPLAWDSCSCYIEPDLSSRSGISCWTFTDTCDVMS

SEQ ID NO: 996445 - protein, 69 aa, Homo sapiens
GKRYDAATTYGHDAAAAAASQWAAPSLCLWSSCRMAITAAGASATPSDQQQYGFQYPLGMAANYDVYHQ

SEQ ID NO: 996446 - protein, 134 aa, Homo sapiens
EPCSLARIVRNRSAPQDRAAEPAAAPRRDLLTLDPDIPLDSAPLPPEPRPGRQQTGRMSGGRRKEEPGSAAAGLTVSLKCLRLACKVLRTRPRPWDGLRMNFFEIVIYWFRQIIACGPGMSFEGVVAITRVLVK

SEQ ID NO: 996447 - protein, 167 aa, Homo sapiens
MSSTLDKAWGWCQGVASEVCYQRNGRGKPGCEEENHHPAFLVGTPGPSQGYCSESVHVRRPPGEVTSLVGIRGGLRPCCVRSVVPGPSYAPGRFTGGEEEEAALGVGPEGSGMLVGAVFRGRGGGLLPGVNWAQDGLAHGCAPVAYQSPCWRLGGLCLVRPLVVVRD

SEQ ID NO: 996448 - protein, 115 aa, Homo sapiens
AKAGASESPQSMTKPQLEGASVFSVTVWTDYFMKPLAIESGLGYKSYTMTHGLILCGYEPSQGEVLHGTYGSMDERVPCGSPWVDCALPRLITGTLTEPVSRNDNKIAMSRLACR

SEQ ID NO: 996449 - protein, 138 aa, Homo sapiens
MRYLVGRPWLVGIDDRAVNLSANLSYCARLQTAGRGTESLRRPSQQATEWQSVDVQMSARTGFASLVAVRGAVCQRALRATLTSTVFQSSKGRPVRVSEMFMFLMQTTVRDAHGHWPGQHCVWLACAALGRLAVALRP

SEQ ID NO: 996450 - protein, 146 aa, Homo sapiens
MLQPVNDRRCKNAERSTRVAICLWHRAEHGAMPDKIGWRKIGRTETVRVLTLACSTCHREETFEGDTERMRAGVISTSERLQMNAARVKYAVMLSRDGEEWPSDGLDSPDASAFHLANEDDIQAWIEGTAVRHRMRLGQRRRPTSF

SEQ ID NO: 996451 - protein, 121 aa, Homo sapiens
MTRPCDASSLSHAVLPPASDARWADRMAVTVLEPVVAAGVRDVISRCRGPPICHVWRLAGEVDPHVTCMELAKDDDVVGATLDRVRSAWPSLCLPIVIATPHPLQRPLCNWGQKLPTDLSL

SEQ ID NO: 996452 - protein, 114 aa, Homo sapiens
MCCELNRWGCDCITNDGATILTMMDVDHQIAKLMVDNCPTSHDDEIAQHGYARASGIVRGPWLPLFSKKRQANVLDTRPFTQSKIADGLMTLRVARAGLIVNTCVRRSADSGPC

SEQ ID NO: 996453 - protein, 293 aa, Homo sapiens
ERGKNEESLESYENGFRAAEEGVQKPAAETPDSACIPGQALSIHITLWDGKKRGDLPAEPVVFALKGAVQEHGCMREQSGEFLTRAVLSLSFRLWLSRSPSTIRVSTRLAFLYTYSKTHRNLQWARDDVARQQYPCGNNCSTCRAHGALLREEKTNFFNGIWRIPVREIDRRDSFAWHMNRSIVLLLKVLAELRDHRTLLKVSSMLQRTPDRARSICEIADRQVLVQWAFILTVKGAQRDADRAREGVRTAQGQVWGFPDRMTTMFTPRPSLRWQEAPMKNRWYGRRASREVA

SEQ ID NO: 996454 - protein, 152 aa, Homo sapiens
MSYDQRQRKGRDPGEGGEGAPRSGSTTRRTDANLKIHHVDFISTKPKAVWGWPGAPRVARYPSGEGETRGSGAPPGLKKVQKEEDDHLATGLAYMHIEGSLRDRHGSTSKNLDFRKSLSTKQLPEGAKQSTNSPPPTPTTHQAQTRQARRNP

SEQ ID NO: 996455 - protein, 158 aa, Homo sapiens
YFPAKRLLGSRAQLEKRSIEEKMRLLIDNEKDRWRTVRREKDAAEMLGAEIMAMETKLPCWRNKYMYDRYDMDSMHEKILAKHEYWTMVITCDGGSKPRRTENVRVHRGLRNDQRCSDDLCDLHETYYAQLARRRRMDIQWTDVNSVKSLFLSGLQCE

SEQ ID NO: 996456 - protein, 81 aa, Homo sapiens
MGHYTKGAKVIPIPLQLRGHPCSSHNATRIWQWMARPEPPTKWRWRAQNELCEEHEVGPDQREGSEDHHSPTVDYINPIDQ

SEQ ID NO: 996457 - protein, 132 aa, Homo sapiens
MEGVGGCQPFGNTRWGTTRSSAGLLTVQVTKGYGYPQHQAWLDHQQPSALARAALCELMCPYAYVVQDPFHLPTIPTGTSNETGFIATHGKGVLYDCKDMLTNLGANVIRSLPMEFPPYIGNFQLNVLGIKR

SEQ ID NO: 996458 - protein, 168 aa, Homo sapiens
GPSCPYIQTLRVLSGDLGQLPTGIRDLVRAQCPPVPNQRAIHICDGIEADNTATLTLLEQSGSSSESSLKYNNVRGLDPVSSTPRSVARAIEQDGELEAPSQRGHGYHSRLVGPVGSWATGCPQLISSRAVDERFPGCMQGAQPCMCFHSAWVLWVSPLSRIRGAATT

SEQ ID NO: 996459 - protein, 296 aa, Homo sapiens
MAVAVMVLLCFGLLEAESCWSAGAVHKAILIFDCTLRDKLRRGPDEDRPVIWNCRRSASPVLQVGLSMRGSGHRQWDNEDTSCVLKEEIDTREQLLDIEEIPVSDSLVGHGSKSIEFQAQSRNEQVMEGAGSLRKMSVLEHRIARWLIVHWTRGRRWMRGGDDIAGRWSNQEEDQNEGPLGRMDSPSREDGKRALFIGRNVDAPIFSAIAKIRSLDKTGFAIQRPPVPLRKHPHDEVIAWAMRQRDPCAQAGGRRWKALVQRWSSAVCGTPRADCPGDLCPHRRVRVTGTPHDGVL

SEQ ID NO: 996460 - protein, 217 aa, Homo sapiens
GVPWITVAFDNEALYDICFRTLKLTTPTYGDLNHLVSATMSDVTTLTSDFPMARPSMLTIRKDWQINMVPVPTVSISLCLALPISPDRGTPRSIELSQMTGTHTRQDHSHGQEHEWLAGEAHGQRRRDILLPTRCVVCGSLAGSASSSDHNDRGRVRMTHKNDLTVARKNETGRPTFDWELGITTKQMFKEQGPVLDETNSTTLRWDLKGMDKFNPL

SEQ ID NO: 996461 - protein, 93 aa, Homo sapiens
EDAGAMAGEGGGWRQEFSEEEAATGMTGQIRLWGLEAQKRVQASRRCFYAGTLKRTLRVLKLPRISSLAGVKGLTMLESRSRVTPEDPGASVL

SEQ ID NO: 996462 - protein, 75 aa, Homo sapiens
PASRFQWRRLKEMIKVWNAMWSLTSMELMSHAEPSDVRTPESLLLTHLYGRAVALDTKDEIHWAIKARHCRGGAE

SEQ ID NO: 996463 - protein, 244 aa, Homo sapiens
AQLVLVTKGTGRRPGAHSGREPGCTPGCCFVRLSSRAASHAKRNRSYVTGAGPGERTAPPRETRPTEHGPATILFQKADSGTARECGLWDTRASSYLSERTSKNISSLPAFELNTGTVKDLSASFSHRDWETSVPFTPSVVSQPLESRPGGTHGFIRHKANKTPISTARLDGSTIAILVRAQAAQAHILGTRARKGESAPKVIRALGSKHGSKKLEQRDIASVTQRVKRPLVAPEWRTDGIVKA

SEQ ID NO: 996464 - protein, 147 aa, Homo sapiens
MWTTGLTKSPNVAPTLIHKTRSNCFQVHLNVTIHSAKEDRIFALFREHLAPRGHHNNRATRDRLNFGNEEKPFELRCNRWAPWIAHRNLCPIGNGCEGGDSFSFARNYTEGGDRSSSYLGPVNQPMCNDPLDEAAKKPNNTPPVPDG

SEQ ID NO: 996465 - protein, 91 aa, Homo sapiens
MQLSRATSAEKIFKPFVVVTPVSYKLSIEVSTLKGLLVQWYTVRNKARRLGLGPDWKRSNSSLAGNSGGSNSSVSITPPVETPVRRAHTFC

SEQ ID NO: 996466 - protein, 482 aa, Homo sapiens
RERPPLVLLLLLVQRERAGVCAARSSGQAEGGRPGQQAPGSLCQPTRAPSLSCVLQRRSAAGARQRAGHLPSLLRLSRFAGTRPRLYVLERHAGATTTYPAMFGTEHASGRGAPRRRRGTPGHTGRGRVQRRAPARAPPAQGTGTPLGSARDEPHAGATRVPRAASNSGHHRGHPGREPAHTRRFPWARATTAQRGSHAARKLRRSARTEHQFGRPRSHTHTARATALHRGPSSPRAIQSPPHDTASAPAQEPRDTKTVGSGTLGHPHLATHSGERPLYAPRRPPPHQPPPPRPFDQANPNPTPPNNFRHGHAGTPAATQPRHRSRNPVTHPAARTQRAAPRGHSRTSTPPAQSREQQTHPQRSTGAKPTITFYIYQIATNTIQTITTATNYIHTTPILQHPLPPPLLPLLSHYTRCTILTSLHDIYLHTPCTHTLTTTTQRYLYLHHLFTYTPTSPPTPPPLTLILPLSSHQHDNNHTTTH

SEQ ID NO: 996467 - protein, 221 aa, Homo sapiens
APEAATLRRWRALLLACALALAMAGPPPCLPADLLFLVSGSGFLLPLQKKFGPVCGPKAQSESLPGPGTAEPPPGTLGPKLLHSMGLGVARFPTDGPRKDFPLPSNLALAGAIGDECRAVALRKSAFPARTNSTADRRKSKRTTPLTADEENDEGGPDHNSTPYITPRRPGRINITRKQRRREHSRKAGRPVARSTRPPRYSLEPTRRAQAPGRTKSGREH

SEQ ID NO: 996468 - protein, 221 aa, Homo sapiens
LTFSASDSSAMAPSRKFFVGGTLEDELGGNAESGWSSSALLNAAKVPGRQPRLVCASPYCRILDVSPGEKHRSQELLVGVRSDTAHKCGLIGAFELEESQPLALIRRSAEATWCGPGAHLSRRTGDSLLEEVLDGDKMWVSQRCALVLLSQEPELREENRTCQYGRWERTIDTGESVCQSLGAEGWLLQEPRTKEVYQPAFTVARTGEPQVRSLCLMHASC

SEQ ID NO: 996469 - protein, 94 aa, Homo sapiens
MIDVAFEARTARTLTFVHICRKSSKGPYGLTLLGQGTPRHADDILRRIRKATGITRHGPVATGYRRCDHSVTWDGSLNRVRAVGRRAPFGLKTG

SEQ ID NO: 996470 - protein, 68 aa, Homo sapiens
AVKPDYDGSGLYQSRSLEFLLQFFATMMSARHISDDAADSWDECIQMKNCIGVIKNGRIVPNDARLKG

SEQ ID NO: 996471 - protein, 271 aa, Homo sapiens
MACLRRQLWCRKRGCWRLPGQRLACSSLSARTLPQNWLALPLSAVCCDCLVLPDAYQMGGLGMYFVAGAVAAECMPWGSLMCWFTPGEADGPHATCLFLLLASLDHLAQALARDAPGDALLLACLYCDASLATVGCCDLPLLLRTRRALFAHTFAWIAGSLVVAPMALYGGSFPTAGVPCAWNSSVQFSQKVLGPRLRYSFSCTTFPTESPNGWFGSTARPIYGPHDTNLRAPTFFHWAHWEGLALFSTQRGKPASVGLAIWGNPLVSTGY

SEQ ID NO: 996472 - protein, 106 aa, Homo sapiens
GRKIGIISIILYVQKTQQGTLNPVKGQVLKPLCLFEPVGIRPKNLRTQDMATPVRGDLIVSGHGNGPEIATHQLSQSAYGLPSHRCEGDSGAGLSGGLDVPVWPSP

SEQ ID NO: 996473 - protein, 110 aa, Homo sapiens
MAPAEHGRTTLEGSVMANDKCTGRTSASAKDRPRSRGNGPRKEKVVCYETLSVLGFSFGIVESVVSARFSQIHSKVLRMGPCEVTRAVRCYHSSCELELETAFLMYDTLV

SEQ ID NO: 996474 - protein, 303 aa, Homo sapiens
MLCVGPGALWPWDGNLGCFRGGFCVLRCRGRFRTWAVAEAAELAEARPRIRSGKQINKLGRLVNGTERSSPWRMIYLFSLPIKESEIIDYTILGASLKDEVLKIMPVQKQTVPDTTRFKGIWSAIRGLTIGHVRSRGSKVATKGRVGHRTYQRGHKYLRAKHTPWYPGAAAGILGGNTDSGKTHKTGPIERVDRAASGSCAGYVSNPGHPRGHLGNSVLTKTCGLKEGCTMNGLVQNRQHRPTEPKIKQTTMGKKRKATLYAILKTTVTETRTRKKEITETTNRGRCNSQENNDSDRNNSRGT

SEQ ID NO: 996475 - protein, 181 aa, Homo sapiens
RGRGSRRLRLEGLAGGCPAERYPRASRHSRATRGKAPAERLPGAPNSPQLWAEVCLASPRPTPVRRGPEEQERGTQGDAAFTGGTRWLRTYSCISDRTADSRPNDLQNRVRRPETAEYRDAGMPERAESDLRKTQQSTNMNSRDRNQRLRGLGQTPNGKPSDILNPERIQKNVTGLPDQNT

SEQ ID NO: 996476 - protein, 86 aa, Homo sapiens
GKMASRNRRLPALLPTLPGSYRRGASRKGKRQMAGSGDSAEKASADKMALLVLNDNSTHPSWKKGQWELTVVQGVLLGSGCQTIAR

SEQ ID NO: 996477 - protein, 222 aa, Homo sapiens
MKIWGVCIADGLVWCPELCAGRISSPLLVHMTDPEFTAKRIELVSKSLKRAIILVEEAKTFSKIQGAGANKDGTALTVKSAADAEGYLAHPVTCLLEAGDRRVNTRAGLLAGRDLVLQDSACMVLSGNLSVQRKFFPKLSSGRDEELSKACMRLQRRRYRAGPRHKFQRGTSRNQVPGNAECGMTALGNGPLGAYQVKGDLINHTGGCGIGPTVANKQFEAR

SEQ ID NO: 996478 - protein, 47 aa, Homo sapiens
HGPSPYPQGGYPQVPYPQEGYPQALPKGYRLRIPLEHLEITLIRESP

SEQ ID NO: 996479 - protein, 284 aa, Homo sapiens
MPFDELPWSSSTAFLYRRASTVILQGGPGTSWTANIGACMLGLASDRRGEAHDNDWRKKPEITVAQPSSSVSSYLSRTYRAVPDATQQNDRPLRREMNIIRRLLENVYLRAETTRQPLEAARKRTNIRTPSMTGIPNQDAPCQRLIPNARLGDGEPQGPTDRNDRRHHRKAIYTSMAEKQFGHLTIPNIAHARNWPSNRLTEKISLRTTEEQRHPTTWNKAAMRPYKQTQAGHTQMRPDGDAAKQHPSKTQKRMRATRERYTTPHRTRENQPTQRHTTIDYAQS

SEQ ID NO: 996480 - protein, 311 aa, Homo sapiens
MPCLWLTAGRDLCGGCIESEDPVLPTGLAIYLTTLLPEQCPARPVLALQWLSASCHAVALPTAVGHRFFVCTGDCFLCSMYPMGEPVSDLAGNPDGSLCAQCDYRYSRERLLVASTELCDPVQTQTWVTCLGDKEILGCPRVPLQRAEQTVLMLQVASCLQLLPSVPACAPHRRRPGGNVVGLSDSCWLDPLMRRDEEGGVKRLCPLMGHLARVLQEPEDPCQREGSGTPFKLPGPVAPVPRKILVHAGLPFLVPRAVGPARMLGHHTHGLCEKACGGCVTGFGVPPCDETSCRKLDKSNHMTTSKLRNNP

SEQ ID NO: 996481 - protein, 252 aa, Homo sapiens
MRRQSWRVDIRHRQWTEKVRRQGAPRARDIYPEGCIGHAYTRLTVQKKPIPLFNQDCQLNKVSNHEVSTNRTRTSARLSRDVIRIDEAFLGAGKINYGRGCGDHILTEWCAVSRRYPILKGMCTAAMSSRVPHAASSGQGGKILTFDQLWPLDSPNGSVDTVLLSGPRHGSERCTGHFGKAPGNPDQQHQTYVRSKGRKCERARGRRAAEATKSNPGSYSLIKKDLVSRNTRRGHRRPDPGWATQGMNGDMD

SEQ ID NO: 996482 - protein, 50 aa, Homo sapiens
RCSEKPDYDGSGSIKAEPGSFLLTVFCHHAVSSYTCMQLQFLRARSNKQL

SEQ ID NO: 996483 - protein, 314 aa, Homo sapiens
GACGVPDGRTGPPGPPGMAVVTLVRGATHMDTCTWTLRHLTWSSTATDFDWFFLDCLRARYTEAHGLAQPNWTPSDLASGATCTWAGPRTSSAESPPPSATATEALGCCCPRMLLQQTRAPTWKACLHTDNRTVLAHDRVAWVCMHFSECHRVDVDVDTLVNTEEGVARNKPSEDAEALGEKPVARRGTPTFSRKIDTKRTKTMKRERKSRDEQERHKRDNGTRHETGNTGNQGDYKRYRDRTRKPRPTDDEDREREMIDRRVYTNDNQRHRQKMTQDTSRGTKTREKHRTTKGHDDGTREKKKTQPQEKTRRN

SEQ ID NO: 996484 - protein, 125 aa, Homo sapiens
MVRTRIADEDHLITQFVCHRIISSLVRTGCGILCFLTSYKGGPSVKNKYPDASRAKLYIRIRLKKPPPALTHVKAPPQFNSKKSGRTPSMCVTLEVHRMRIKIRTRPSITIACLFPESSCLQVCA

SEQ ID NO: 996485 - protein, 200 aa, Homo sapiens
AAVPPASAPARKQTRSPAGPDCTLHAAALQASVLLHMFHVLCLSCPTVQCGSIVMCAPLLTVAEEVSCATGRPATTCGLDSMKDEEYEQMVKEHAGDPARAAGGASAAQEPWKQQLTEDGDSFLHLAIIHEEKALTMEVIRQVKGDLAFLNFQNKLQQTPHPLGCDHQHRQKLLRHFWELDVILETPRLSRKYPTLQLDM

SEQ ID NO: 996486 - protein, 139 aa, Homo sapiens
LVRRASSYKGSTFHRDDPFLHVPGGRHSPTHDGHSAGSPSTEAAFLTRTLHLNARGARCPVQWHNCLVHNRATDSQCLSLRAPIKTDWVGVARHVVSRITYHKRALDGVNKSRICSCSNSVDVTSMDDCQSTDLWPLER

SEQ ID NO: 996487 - protein, 213 aa, Homo sapiens
LLEIITTEKTSTDTSAYSCEQYGLKQGKVIIVVKDGPGLLYYQVSMLPMMSEVIRILQEGVDPKKLDSHDHKHLAYPVGCRHTGWMQVEVVDVAETCGGQILGQKTKEAARLAAERTTKNTDSHDSIESHKRDYNITVTSHINGQEAYTQYTYQSVVTAPPRTTQLPDTRTTHITHQTLQDRQPTDKKPDNTHYKTDTHHTTQHRPERTQSHK

SEQ ID NO: 996488 - protein, 322 aa, Homo sapiens
MPNLFKKLESDPRTRTLLSDPTYRELIEQLRNKPSDLGTKLQDPRIMTTLSVLLGVDLGKYEMRSEEIATLHSNPSQKGDQGRDQMEEDLPENKKQALKEKRAGEQNATKKKDKTQTVKPNDNSQGAGPNNMTNINKQAEEYFEKGDIQLKCREARVTKDTERWGEKTRERIYDRRQQQHATNRQNQLAKKKKVQGMHIQECNKVYGQSTETQDMRQEMASRKRNTRRRTDGTDVHKPDRSRPREQRENGTEREHRQKRTKPTRTGRSTTRRNEDEARQRTRRKDSDQKNETTKGTGDRKHKAENRKQKADGRKHTQAGQDN

SEQ ID NO: 996489 - protein, 227 aa, Homo sapiens
MQETDAKSRANVARGPKAKTQPYHEDGSKKAHAGQGTQQTGDTHNKKTMKTNRSSAGKRIDITKERHMTPADRRNGQRNRIVDDTKGEHKGSPEKKTEQQGPPNAVKDNPSEAPDRGNQTEQGRHIATKLDRHGDNRWETKIETENQKKHKEKDSAKTHTENINTPKREGEQDDRQHGRRSGQKRRDAMQDEPEPERQKKELRRRTHKTPKREESHKKRKQGPRRNR

SEQ ID NO: 996490 - protein, 404 aa, Homo sapiens
LSQQADGDRFGSCKSCGWLAGRTVLAPCVETSLQQKMSAQQAQAMELEALALGGSTGRPQLQAEGLRAALAEGLRLSGKNFGTAVVQPAVSWHSRFQQAAPKQQLSSLTTGSTQECSFQFRPCKAAGLCEQVSGSQYLANPAQQPGGTAHRQLGLQAQRGRPELASGKRAGSKHHRQDLAVTQGATLALAHSTEKIYAGRQTRYPYLQNPKTSNWDTEEQTRKSTQGTTHCKRTIAEARNRRDRPDQATQREHRRQGAGMHETKDSIARTGRKDEHASGECGTSQQWEQGVTCRENRQAGNAEVEPRTGTRRSEVYDDGYWVTCHHVKGVGACCRELRAAKDNGEQAQGEEGARRGETHEQRRRRIGAGGTEKQPSRRGEPADRQEGRGNGEDHRKKGGGRQTE

SEQ ID NO: 996491 - protein, 402 aa, Homo sapiens
VFVYFLLLPRRAWRSTYIMMRKSVHLHGQGRAAATKVGSQVYGECDQTSEHEHSDSLAGHLPRGQRSCQLERINVYYNEDNEAGKYVPRPVLVDLEPGSMDSVRSGPFVDRSSGRNNFVLSVRVSWLGNNLWTNGALAQNGAELVDSVLDVCEEQGGFMSLLTDLGWALPDEPTTHGVRGDVSICGCVYPYSLRPITGDRRYGKKKGFVDSTYTGYEAFNPKVCNHKGMDVTNFKDKESDREFLTGTINSRAGPEQANRSNELTENSIEQTDGAYQKIRQQGDDDPPKGNHEGPMRGRATKHRESQARRRGHSKDRQKTNLTRKAGEPKAHESRHEACTSQECDPQRTGTVETEGQHNEKTRQIKDKNLAENPETDKHSSHANRQNDRQPTKQDRVILPLQK

SEQ ID NO: 996492 - protein, 354 aa, Homo sapiens
MKEAGDGSYHCYCTGDRSIAKEGFEKIATGANPGGNQERCDVSCWNAVIAELKKQSKPVHHPWTRLHSVATISAKRKTNDIVLNINLCMHSETTMLERKGVITAKGWQNTPCHCLEFTTVIDRQLKFDSTEYFELQYTFLTTLKKVSKHDPFLGITYVPDGPEPSKQHIGIKAQTEPDCTENAPPQHRKTKGQRDRKSMRTGRQHCPTQPRHTELGIRSETQGARQPRRPQGRGETTKTTQPYKMNYAHGGANTHRKEGSDTAISKKQKGKSEQRREAKQTRRKNRNKRTRQRSANKREEKTEKRSTEETEKKREVQEEEKQGKEKKRGNKDTAQRPTNDDNTTRSKKTNKEKP

SEQ ID NO: 996493 - protein, 380 aa, Homo sapiens
RATRLAELQEQLKAVHEQLAALSQAPSKQTNSKQARQHSTGSTGSTAQQQHRHTGSTGSKAASYDKCTGRRQAAQHRPKVCSAMTKQAQHARQALCHRRPTVTTTGPADQLKQRRHSSIMPSYDIRGTRRRACHMSYDEQRQLSLDINRLPGSKLGRVVHIIHISESPRSGTPTQDEIAHLTLDSETHHLRELGETMSSHLFPAQEKGSTGHHSKTRKAHTAPRSPSSAHSGQPPRQLNKHLRGVQRQEHHHQHPAGQKKAQDTTTTGRPDPGSRTSKTTEIRETHDRGPRRNAKTRQTGTAPTNRQTQTQTQNPQTTENRPGAHRHHEHENRQEPKTNSGNTGAPNPRHPRDARTPPQPHTPPTRHHTQRTRRHDPRTD

SEQ ID NO: 996494 - protein, 281 aa, Homo sapiens
MRLGAPPKHGKPKKQKLEGKAGHGPGPGPGRPKSKKLQAKIQEYDSSLMTLSTVPRSPQEMMPPTGSGLQWQPYCADITSEEVRTLEEWLKPPEDEAEHEKIPPLGKHCPSAGAQEDLLEEQNGWGPGKRMWLTRRQAHGATDQNWTLKDVDALVKKSEAQHGDSGRWVPFGALSKATAGLVKKNIPREDPFCHGVEHNREKEKTHEKKEKTAEAEDKRAKRKEDKDREKGKDQTNQRDRDTEKGTQEQRRTNTDRTRDTKEHQKAEKKKMTTPRTPQHKA

SEQ ID NO: 996495 - protein, 460 aa, Homo sapiens
MLSEISLTNTSVLYKTLCQRGPLSSLYNCISTKISQFNPRRCKGGFRNLPWTLFMLVALVVDTEAHKSEHVPLKARGSQEFTLTNGRANPTLAILYTGSCTRVRYTAYARNRLRTVEKQNTKSNQNTNSKKVAISHNTEQAHENVYVPGTSANGKSPKNPTVELCARDTMTPCCLWRTNMHESLHRGITTEGHDIHIDVNHRKAYTERHAARQCHEPTLKGQLQNRGHTGTILDDHEKHKNSIRTSADKQQTEQPTETQETRGRPKDRQLTRIPRPTDTRQNEKQNKRDKPQAIQQTRQRTAPTMTPHERHTERQKCTRTAAKRNSRHTTQGPAHKKQHEPNALGYARPPTAAAPGKRRRQDDPPSNRAQRTQPQQSTRVARRQQIQNEPPYTGKHTRQRHTEQTPRRRNQEKGNTKPRRRKTEHTAEQTHRRKRTHSAQKPNGAPHTQAHNTHNADEHN

SEQ ID NO: 996496 - protein, 209 aa, Homo sapiens
MIDARTTTTGNPGKSKVATTISYRIDKLLDAIRTSEIPFHFLQGWIPGSSNGQQNLRYYLLDLRNNYYALSRGVRKALIDYPFWMASEREPYWDQGPLGTTETYRITRPRVIVHLVVDADHRTRDRPRRLGTLTREQELHTAEPSQNPQRVGLCNMTNYNSSGAQRGATTPGERQHNRRQRQRKQTKKGVHEGNMVASPRAEMTGAGTR

SEQ ID NO: 996497 - protein, 339 aa, Homo sapiens
MEGGPHNIQADDDTTEKEQIPTLQPTQSQPRFIRTRIRHPGAARTKMLEHQRVSPPDTPAQRPARTATPLGPTMSRRRPPLQQPPPGQARMDAPQGPKETAERTDARTTGNPCPGRTPASALHDPTHRRAADQRPHPQHSKHPTRPPTPPRTATRANHSNHGAPRRTHHAQVTEHATAPHKPTLTTGTPVTSQGRLPVTAPYTHTPGPPLLCSLSPCTPDVVPSYLRRHSLTGTSQQRRRTLPRRRNHRRAARPTESADRQGELVVLSCRPRQPRASTIRKQQSQHGCRRATACDARTTRSPRALSRAPRARAEPPPTAQRANASHRPRPRPLRTPLPH

SEQ ID NO: 996498 - protein, 394 aa, Homo sapiens
WWTQREGEEWWAFALGSEKEKSMPPALGALCGQCVGWMLGTPELVVVTDVCSACGLRHALLPSCSASRSCWCFGRTEIAWVSWQVYCWWPPNLLVVHPNTTGLPIRQQYMDSQSDADVGCPMTARVLSDIGRKTPCVMRERACRPCRGMRRSQGHMTYSSTRTSMHGLPDRTAPDDLTEALSRQHATNHTFRDRQKHSEIIGIHNMHAGFSTGHNVDLKQDERRILIDIGQACNGSSANLKTRKLQFIQMRDEESSSSVALLHNGRTEPERSILAQGRISALAPKGPQRVHEDQRHGERNPDFPTTQHWPPSLERHLAVMLRTISQPVLTPPMPYTDPQRKGIYTPHTKPRIHTVTFMTVSLSKVPNRNATTQTNHHTSLPTHAASPQHHPLFT

SEQ ID NO: 996499 - protein, 78 aa, Homo sapiens
GQHGEDGDPGSTTQTEPVNGFVVTMDDDIAALVVDNGSGKCNGQGYLQVLTDSHHQRVVIYHTPRQIEEQPHNVPKRL

SEQ ID NO: 996500 - protein, 341 aa, Homo sapiens
MSGSSRSEGAEPAMVGIESQADSRDRHGLACLSVPSPVRMSASTPLAAISKARRGHGLDHSDVWTVHERDGAYRAMQHNGLLSWTGGFQPGVTTIGAQKIRASPKSRSMYIHCVTRATGHRTRGHLGKQCLSAAHSFANSFVYKYASGTWHSKDPYFPKTPGGPRIVIHPVRKGQGSPPYAVGLEDPESFLWDPLEPPTSLGRHMGQPRTIHKPEREFHQGGTLALDEYAIVSFLRTRSATAARFQKIPVTWSGAGVTRMGKFTPLYVREAAGREADRGIAQWDTRPHYIRSSGQATIHTRDFSRWFVITCRTGERYAKCTSTVECNIVVATGAETTVRRQ

SEQ ID NO: 996501 - protein, 406 aa, Homo sapiens
DLCTLGEQAKETEERSELQCRRWLLADGGDSAPLSPGDKEDASHQECPGAICPHPSEHNASRMPPGYRRNLKAQGKPSTSEPKRAQNMQATKEPQLSEACGPTAQTWCAGAAESWTGPGLLCHGQRHNSAQKAPCPDNPNTFRMAHCCSEWQQGTTISRTQDLAVYRTRDSPLHVSFAHSNGNHGIPPITASRKKDEHHEDAPEASRLTQKPKPGENTMKETHTTHTTDDRNDKEASKGPAESRPSATGHTASTPAQKDEKKDNSLERQWNQATRGLDEPTQHKQAKNTPSSRIAPTTQRRHTTLAHAKRANELHTRKLKGKNNTLTHSEHPRQVYTDIITTTCTENAEETKHKDLNTTTGRGKSATKGRRHDNEVTSDTTRDNTRSADKRDQAYQTNNTTLTPYQ

SEQ ID NO: 996502 - protein, 221 aa, Homo sapiens
SSFHHTPVEELYKRFHACWRGPRDSMGRGRDWNVDLIPKFLMANGAAGNRCYCMTEVTRYPGTIDRVGAMVQTSSFYKGGSDTDRTKDATPSDGLMVLRLPRSDGLVFEKAAVFRIVSWMLCRQTFDENDPKTFEGVDPQTTSMRDVYRKYVIWGQDVIDLSLAMPWRSIRICDYRGPGHALRPCNRFKLYSESLGRYGKSPYLYPLYGLGRAAQGLQIEC

SEQ ID NO: 996503 - protein, 299 aa, Homo sapiens
SAGASVHHERWWSIVKEGWLHKRGEYIKSWRPRYCLLKNDGTFIGYTEELAAEDVDQREAPLNNFSVRRDVPAELNDWSGPGHSVTFIIQIVALSMVAPAGHTIAQPSHVDDSLYGAGDGVVATVIRDCGCRAHKKQEEWGRWTIRSELTHGDNSRGMKEYVEVSLGQAHRHRVTMNEFEYLRCWWARALSVKVILVKEKATGRYYAMKILRNEVDRGQRNEGGPHSQRVTELLAEVQATLSCTGPGSTSAKTQEPGFCFCPLEYAQRGQLDPPTGPERGVLPGDGPVLMGLNGCSLAN

SEQ ID NO: 996504 - protein, 282 aa, Homo sapiens
GEESGGRRRQRAWRRHFAKWHFGAGGPPGRGLALRGGERLGRRTPRAGLTGGRGPDPAASQASFLLCSLHPPISHAALGQTSTGLVGSGANTEQVGVEQLCSPGGKLNGWNQDDRWRLAGKTREASSLQEGSQPGDSSSPGPAAPISCNTGEVGFSGKAPTVLDPAPPSRSSQRYFLGWPAPSLRYSRPRGGHISVTRLKKRQAAFPGGQWLSKSRCLKPAPFRQEVGQVRWNAGWKAFPEKKGYPLLCMEVTQASALMENTPAGGDQGRTGRRESQLGWEQ

SEQ ID NO: 996505 - protein, 80 aa, Homo sapiens
CKLRGNRYLQCMMKLSQSIRSDGMPEDKHFFAAMELMMLLLDQVVAVAPTSQSLYHRKEIDYVIALIVEGYELWVWFRWD

SEQ ID NO: 996506 - protein, 174 aa, Homo sapiens
MPSANLGRKSSHRGVPPQGPEGKTAAPWDRKYTTRSHKPREGYEEKSTRGHKKTKRGVPAGGNHMKRPGVRRRLPKNAVVCPRPPERKLWNITERKKERPKRKKKNKKYEYHHKNKTDTRKEKAQTHRYHAATHSKQTHTTTQPSKKTNTRQRRQAVDNRRNTSTHPRSLLYKT

SEQ ID NO: 996507 - protein, 114 aa, Homo sapiens
MDAGDRGQGWILSPIFFTKGLTHEFLKKSVIKFKKPGNHDKNLRKQNKNTAASIAQEQHTKLLIHGEANNTYKEKSTHNRASIEPQPRPLTTKTQQHNTQTQKKQSNKTKPNTP

SEQ ID NO: 996508 - protein, 68 aa, Homo sapiens
EEGGRGQGAGGRSPVVSDGGAPGGERTRTCESVKGADGDAGDRRTNRTSRQLSLNDGVTMTSTMNLES

SEQ ID NO: 996509 - protein, 415 aa, Homo sapiens
TDLVGQDCIRLEEQLDNRDQGAPGSPANRCVWTEKKAEGVCCLHGGLYVAVGIGLYASTTVPRTVQGHSTRPVRQLDAVSLVGVPIVGGPGGRNALPTGELSSQLSWRYAYCRRPMLDVTVKSSFPKRTSSGSWGTCRLVGAPDEWRQERRPGDGSDVKRVDGKSVMGAEAEAAVKAFCSCRLEMDGQTDTNRAPLSQEARSKAFSAPYLEEHMPVEPMPSYSEEYRTLLPNKALMKHILELSLEKRVSGTHHGDMTRDDCLGEGQKERVTPRRHKGARGPRRRGARGKTRDKTLVRQHAEELSRVPNDTPGGMRHLKKQGEQDTLKQRTLERGGNRKYRRPNNGARATTEHGRYISRAKGDEQSSIVSATKRSEDHTSPYYTIAKGGTKNERKIRKKNRRTTKKKYDRDCNAAE

SEQ ID NO: 996510 - protein, 390 aa, Homo sapiens
MSRVHSLERRLAQLLLAAHFPPNWQQGRPMRLERLAAAGTGAPGPGRWWWPAATQAHPVRCWRGSVQPPVQACHCKAGISAQGTNCMLDIPGKQLLPVQQQQPSSHSTPAQHHLRQHSIWSGPLPQSSTAGIAIPARLQVQTVGTQATDPREIHSTDDASDARSMTASWRNQDVDTRLQDRTRGRLWHVTAERSRERNDVGTQHAPETASRTDARTTVGTLRIPGLDQAQYPCTEGGRGDQRWGLTSDDEEMTSSAWEQLEDKTHQPMMAENAGDTVGTREARGPSLSQDSWRTGRSDSEVNTRQQAEPRRDAGPDEAKGRPTLGVQTRPETRRGQGKKKRKRVKNKKQEGKHKQKRNKMNKQIDRNPSERHTQRATGDKKRSQRENTKE

SEQ ID NO: 996511 - protein, 96 aa, Homo sapiens
DYVKRSHQDGRRSLEPASPSVSYSTMLIHNRQSQQVWEAARSMRSRTGSRNQAGGMSRNRHQEVLSVYRMLASRYASAMGQDAYGKYCTQMLLEAK

SEQ ID NO: 996512 - protein, 187 aa, Homo sapiens
MGFCSDRICGLCYLLCSFEEAFAVPPRARLCGGVHPFRNCRDGNPFAQRRGVSQRIGRTILCLAWPSYSALGFARRKVISPSEIILILGPYVIHADSRSTRCRWSGKKGISHYRYTIRMKGASQGCSTRTLDQNARFVSYGGRVPRRHDYLGVTPGRARWFKFGAPLPRNFPARKGVLGNGKGGCSS

SEQ ID NO: 996513 - protein, 108 aa, Homo sapiens
PAGSSPAAARRSPSRPADWSRTVLGTGRQKTLAMRAGNQVPAELLAPGHELDVRGLVCCAYPREPLCPCPETAPPPLGPDSPNRSFTEMHCMSGHSNFVSCVCIITLK

SEQ ID NO: 996514 - protein, 209 aa, Homo sapiens
GPTVQRHTGGTHSSAVTLILQARAYVGPHRPGQVVTRTGFCTAKGGLVSSYRCDPPALSNLHMFYYTTSYEDYVGWPFSVPGSLSVTIYSIFYPHTETWVPLNEIVIQGSRSGDRGVCQLPMPAAMTVCTLYCPEPLRRQGIFCIHPLRINLGGKLQLVCFDKTGTLTEDGLDVMGVVPLKGQAFLPLVPEPRRCLWGPARALAAAMPS

SEQ ID NO: 996515 - protein, 276 aa, Homo sapiens
LFNRFSRGIYTTQTIVHMLRVIADELKVKYLATYGNFDKDITGAELYDSSMYLISSETLEMKLVSCNDAQEKTVLYVRHLVSVVTGGNSCEVHVECINPGCRFWWDRGITVNLKSEKYWNRYPTIEWIDGMNKAEESGDMSAAIFPYFPEMSLTLYDKGVLWHRQLGMDSDYTKATYGNLKALFPAEAGHLVHYVVPVAIIAKFRVHSKSAQSLALPSEVAPPRSRALHNRNGLAGGQVLYRKYAHQLNCRAGRKPTRGMYRADAGPDPPVERIPK

SEQ ID NO: 996516 - protein, 296 aa, Homo sapiens
MVIRVGVFVEITSGVGSKRPLCGYNTARDSTVDDSRDSAALTVCSTIGPGMVSCLFQTLYGVALLVVAAYVASVSGPLSVLALGPESSSSAPRMGDLPSSTKRMTWFHRCGGEHPAHRRITTLWSLLSGSLFLCLWRATACGCPSLWALFVSRFGRRNSMTECMNLLCFVSAVLMGFSISGRSFDMLILGRFIIGVSAADHSFVPCMFVQVSTIVARGALATLPCWHLSGFSSPGSADSSWQPDLWLLWLSSPALRALVPCRIPSVSPPTAVSPPPLPLRQIAPPHPAPPPLPASS

SEQ ID NO: 996517 - protein, 239 aa, Homo sapiens
MLGMLLPKAGHLPPQSLILMLHGQELGVHALLASHFYRRMHGPSSELWCTACPWLDLLVSCDILRVDTTWSLFLLYVLQWKLLLGHARKHGCWNSVSSLSGLDQAPCLLDVGANFPAKPYMLSLRRHEAGHVVVLEVLGHHRPWSKRGPGRTTVEAVSRSGSSQMSASVSGSLTRVHSCGQEEPGRCVGPVAPGSTGRSISSKEGIGGRGAGRNEGAEGPGVPPRRPDFPGGRDRWPWP

SEQ ID NO: 996518 - protein, 53 aa, Homo sapiens
LVQIKGHQKGLQRPKGRALQAPGVFGDVGLARLPADSQSRSPWYRVEDATPRR

SEQ ID NO: 996519 - protein, 242 aa, Homo sapiens
AERVPGAGRMAITARRAGTPCVPACWRPAPVSPRPSPGAPLTRCAARPAAPPRPSWILRSDVAARGRTAEPEAMSHEQSYWCPGDDVVLTTRERGYPGGGHQEQQMHASNRNDITINIGAGDNTRRDHGISKERQRKRANRAKQKAEDLTPSATLRGAQAWEQMNPPMANTHESQCGDSSRTEERQKTQIQVDGSGCERRRTTKRHRAEPRMEQRTHRRTDTPKITRIRVACCPRDAAPSYA

SEQ ID NO: 996520 - protein, 123 aa, Homo sapiens
GPAPAQRAQAAEPAVVTEQRFRVMTADEQIRHGDAELRPDSRCALCASHPTCCDPSAESFASDRVFGKVPCVQRAQGRITPLDDPVTPARMLSKANWHESFVRVYSRKDIESNLLLPFAEPEG

SEQ ID NO: 996521 - protein, 208 aa, Homo sapiens
HPTPSRSRRLPSETCGSPRGCVCLLPGPHPTGTAPHHGWHRRLGWHPGIHRPRQGLRQLAYDWATVNGSRVAHGGEGDTRSSLPVALVVMAVPRQTNRTTAFSHLPTLMAPKSSLRTRAVAQASHLSVEVQREVVHDKDQFPEVTVGAVRMRNFGGNLSFRHWPTLFSYYNITLAKRYISLLPVIPVTLRLNPREALEGRHPQDERSA

SEQ ID NO: 996522 - protein, 204 aa, Homo sapiens
AGNDGGHVSARAEWGPYKTEPATDLVPAGDSSLREGGRQTWTYLQDERAGREQTRPVKPTPVRAGHQEVTLNGLAHSPHRRLTGGSERDDILTWVLQAEDGHMEGDYGWPTFILLIMALSVITCTQWHAIPLDSREHDEEIVLDTLRVKCSVPDVWLVAVHIERYSTVFGTALNYVSLRTSGCWRLSDPDLATSPETFLQQAKG

SEQ ID NO: 996523 - protein, 310 aa, Homo sapiens
PAPPRLMATDSRAHRDPPAVAGEAPVLGPQPRTCGDSAAPRRLPVRGEKEILALVQGPAGDRVLRIKVMEKKTNDTPCCHHTSLLHTRDCPQKCADTLSLTDDWQPEHSRERSKNDTYFSVASPEALKRNSASFADHYADHQPAPTHHTTGTTSRHDKSAPPPPDGGTTRDRRKSTDPQRERAHGATDQAPPTPHPRTTRRHSSTPTPAATRTTPAQATSRQRDNTAQTADTAHAREQGREHRPEPGNHAAGAGSERDKKYESSARAVERKLGRQSEGRGSARPRDTPAQTPDSAQEPEGAARAREPERA

SEQ ID NO: 996524 - protein, 270 aa, Homo sapiens
RMKKQTKVELPQEAQIYEERLYVLLYETPRVPTSPAGRPQAVAAGRVPASEDEETFELRDRVRRMHVKRLQQLRVNRTDSGHRDRTPSRSDQDPSGEIRGTGGPISRSPAGNPTPVGPTTNVLTGLHMWVHPDVLGNPRAQCTRGHWRPRMSPRRGPRGDEGWGPRFAHAVAPGDATSLGRPAVLVPILVTIILPARAEAWFWSLGAYGTDPTPAEKLPLGPVQKGVLALSGSAWGDQGASGGCEGPLVRTSSGTGDIHLRVTHAAGIAS

SEQ ID NO: 996525 - protein, 232 aa, Homo sapiens
MTSCDVVCHVKTLTDVQVLYRSRNTGQRAVLKFAADSGGNSNVLERVHSWNLSLEPELPEARPFPSESSGRIFWWYTDPQVMMHSEGVPQRTASYVNRMAYLLRCVHTDSPLHYVDIAIPMSNKQGSSRSGLIVVDAGSGKLGAWRGNMVPGSTKWEGHAVMLELLQEECARDETRRGQLVLKRAAAGRNYGARKGSKTETPVPAGVTTGSVQGPRGIRPSKWERANVPPET

SEQ ID NO: 996526 - protein, 112 aa, Homo sapiens
MRVRHVCLVSGFGPRLGCSYINAQQTSPCHSALLDQALLDSLSWGGGRPVRALTSVRSNRCLGPLPSEPMGNEPHRQERTGVRVCHRSTNEEQGFVEDTDGHSSICAQEGNQ

SEQ ID NO: 996527 - protein, 92 aa, Homo sapiens
MPTGSPSPDLAPAAEPAPWDAAATVRRHPTDQRHSQYLREGVSIDDIVEGKREKIPRLYNKIIKIETILYEKVKKEREIKLYNKKDIKEKKR

SEQ ID NO: 996528 - protein, 102 aa, Homo sapiens
MTSSVLCGAPADGGLVIGGNPVSAERVEPVSSEIQGQSLESRWLLPPAGGQRLLSPDRPPSTNQSGHRTSSHGIKIDLVQKAKVDEQAERDDDIGSLHEVCD

SEQ ID NO: 996529 - protein, 122 aa, Homo sapiens
MCLTMGCTITEDERLEEGLSTGSEKFIISSDKSKVKFSVRWKFCLDMIEAQFLVYTKRFWLVDEQLIRCCQNENDESIPVDLGLEWAGPKTSPFRSTVWQRLAWVGQGSGSRYMCALEVTVR

SEQ ID NO: 996530 - protein, 324 aa, Homo sapiens
MLLEPGNTVQRGLGVQCYKTSSSHPVRSMNCASAVHEPPGALWVSLRWYLQVLRRVSDVATEAATLGLMLLEAVWLGTPGPCEPLELGSARSEMCMRIVIEGNTVCPTSGCDLGGKPTGEHDGTLLLSSGCQVPRCMDRVIITIDNPSRVTCSFQLFISKESVSHMQITKRVSLCCFLLCILVSPPGAAQGPQELSVGKTLLGRGHEPTWAVFARHLAVQSPRSSRGGPWHELSPQGPEQRPAGLVGGTGGKNSWSPGKVERCSAETVRQSSLTGRVKARRGPDPPRAPVPRVEGQSTLTRVIQRKASTRKGAPRPDSGGHASA

SEQ ID NO: 996531 - protein, 361 aa, Homo sapiens
QPHSPRAEPGSVRAASMLKPFGYLLEGIFSLRLHLPMTLFIVSWRLGVLAQVRPGFLGARCAWMLGLQGVACALYRHVGTQALVHIYSGFVSGVPRSRYLPQCVGLRVVSLHTSRPSRVYSLARLGPPRSLLAISSCVQPTLAPDPCSLSAYYCKLGVYSRPVSMLIFEWGLLETCGCAWRVAAWGVVSWLAVGDDHAFHACFYGFTVNPCLFPREAFDSWKGLIYAYRPESAPGVTGVNSCLRHRVANYPFFHIDVPRPRKLISRYSRIRRGLSYRRKGSAQSKFSEDCPGWSSPPIIVLPPWLIRGINTDFGAAHALGCLLERQIINTCVAKAGYQKAGITFHFLAVDHVRGGSRKYQG

SEQ ID NO: 996532 - protein, 269 aa, Homo sapiens
MPLRAKYDTESEDDCKRPFIAAVPYLELLLEAHCIALAACAQRILRPLGDGISAEMLCDSIVFVSQATRISSGALDLLEALRSVDHIVRPTKTLSRCDGLIDCLYRHCLQIRTVTVDPEEDVSLVLLADTGHVESVVMSVPTVRCLVLWHRRTMRYINELETPMVWVGRLGRRGLQRPMEGGLDWCAGSGVLANLAAEGISCEECEAVRGLWRGTLVIDVPVAPYAWLPAWLDGAMSAGGGNLPCLGAPAVGWSVGAFPTPPHPWSSRG

SEQ ID NO: 996533 - protein, 161 aa, Homo sapiens
DTTHRRTHSGGKENNKGRRRTPLTDSQTGPKRQNTETHTLRTETEKTKAEADRRRHKNPTKQEDNKVKTRRIQTLGDSTRTDKGHGRGQGTHRHKHTPTGRPQENKARSSKKIITINHHPNCMIGDKEPDSPGQTPPQKHTRQAQWDNMTRKKTRDDATKP

SEQ ID NO: 996534 - protein, 266 aa, Homo sapiens
RAHPVKRQRMECALDQLKTGSPPWWARHGATSSVHRRVQGPVMLPSQAPSAEFPGPQCTRMPAYQELGGRRLDLPYGRKRGRVTIEDHELQICVCDSILCCWLSMESESTVHEEFRAESIHSKLDSKGVSFDNRCEMVAHEPVRVHQSLSRMGYRLGDHERILNSSEACHSTWEGIQAGIGARGAGMGFTAYDDRYSCSFGQAVGCAEARCDPHLPICCGACLIGMWQTPRRNSMMALENLVVKSVGKIYYYYRRSRYETSVMGAL

SEQ ID NO: 996535 - protein, 111 aa, Homo sapiens
GLLKKVTLLFLLGLWQIKTWHKSGVALWGDYSSKKHQIPIFLRLRSPSRPTSLGFHTYSEWGACTDTTRRESAALCVGAHTRAHTRGEPSSAQQKSAQRGETINAQERARA

SEQ ID NO: 996536 - protein, 319 aa, Homo sapiens
MLRRALLCLAVAVLVRADAPEEEDHVLVLLEKQLRWRQLGVHNDSAGGKFYAPCVVGHCKGIVAPELCQEPDWRNVEGRRFPRSRLARRAGRHGRSLTLAPVDVQGVRRFIPHNQLFLQEWETQAFPQGNIQGGQKRLTDIVNWSEEASRARHVQQPGWRRSCERSWVESSEVAVIGFFKDVESDSAKQILAGVAEVIEDIAFGITSNQVDVFFQNTSVDKDGVVLFTEVDEGRNTFARGGHPENLAALLSNTTVPLVTEVTEHKAENLGEPNSLLVVCPTGCMRDWHFNARASGQLPSPRDRTALCFRRERGHRESTP

SEQ ID NO: 996537 - protein, 289 aa, Homo sapiens
MTAREPRKEPGRCVPQEGPSIAGKVVAHQEEPHKEGDTHCGPLRVTSQNDYEAVAGSTHWQRDGVAHRKGKSIEARRRSPQAQQKLGQWGNITKETWDTNMAEREAPGSNGTRWNNGTGQRAHTGDKGGTGRYKSTRREETSVMPHRRLRARASKKTTVDTRENALGSTHGDREGVKGEGASPKTGAHYAKGESLRAPQVHMEGIKRMASTTGSRNGGPPSRRKMSHGEQNNYRENNKTTKACIEGHRRDHIGRLTRRLLQKARPQEENETNEGATGDESHKKDVVRHD

SEQ ID NO: 996538 - protein, 91 aa, Homo sapiens
MEPEFGGIMRATDVPDQVPCCVTCCGLPDEDLQRCGEDDRGASYLWSRAVAGPHAGRFDPCETPLAQRHGPGTRGRALPPSAQQTRASLAP

SEQ ID NO: 996539 - protein, 449 aa, Homo sapiens
GQLSGVAELLGLRAPGVFRGSVRVWVASGVQCSRSGMRSSYARSAGQGRSQERWQRRHEVSGSADPVRLAAGRDGPCGPGQRLRSQQTCIYPISQSQASECTSSEGMEKTVRRTYGARHRPSGLGLAMPQEASSEVAVCGPPMPAGDDCHRTCWHQPYMAGPSGDASIVEEIELGQAVVAGGELPVSTMGPGVGPRKTKEACSRPWGPRGVGYRTRRGRKQRDRLLKWDPKPLKKRDILAPRSVCAKGSGAVRAAPGGQSLPGGGLMGDMPWGQEKREYARTEPRGYAQSFHARGSQELQVGFIRPKAKGPGTGAHRNRRLGPGAGSHTKIRLQPGWLLPQGGHTRVRRNGPLGGGNWKEPEIIKANEGALAGWTQEGLRGGRGPLGASMTGQQQRVARISGGSRRHTQRGDAGRPATGIKGGRNRTHVKDRGRGGEPQKTGEGREQSA

SEQ ID NO: 996540 - protein, 63 aa, Homo sapiens
MFRNSREDDIKVRQVTQQTATAESEKREHERSAKRSVVVWRHTPVRGVKSDGARTVTEEENKQ

SEQ ID NO: 996541 - protein, 128 aa, Homo sapiens
KAMSKGRAEAAAGAAGILLRYLSESSNRPYSSQDVFGNLQREHVTWATRRCAGEDSWSSWRNQGKINREDVRQAEDLFVRIQDQFDTGVVMRDLQVLDGKIEWTLTAKVQSLQQELPLPLEAELKGII

SEQ ID NO: 996542 - protein, 351 aa, Homo sapiens
DQTIKAPRHLHNVGAGKHVRRDPCRTVAGPVALHQHGPCQPLCLLHGGASSEHAGHLTQIQGPCSITYGEPSNGGFGTQPSWQDLGKRPVACSCAAAMVDMPASKHRCLIFLEQELSTLLQPRTSCIPAGGSVRHEPCLPEAGPCGLKAPASLCSQTLAEWAQSAQNKAAVLGCRDKKSTKNTFTKPYSRGGPHEEQVAPDHTGSGLKSAADIGIYNRITRRSPQMRFIFVLPNSVDYTRMPVTLRRSKYQGMPLQQAFHLTARRLPRAFHPPVDKHLRQRGENRYTDTSAITKSDPLQAPHGQRTSGADATPPGNSTRPPPTYTRRDMVAAQLSPRTAADKPSYDQTNET

SEQ ID NO: 996543 - protein, 111 aa, Homo sapiens
LISNSWPQVIRPCLALPKFLGLQFRENILGGCAICADQIRDDYFLLRWLRLKEGPKAHQGACPGQSRSRVIQCSLVSPDIISSIVASLGSKNKAHLASVSFDHVEKLRGDA

SEQ ID NO: 996544 - protein, 237 aa, Homo sapiens
EQRSDSSVGALYGDEAWRSGPVLVEVLAQMGHGAVVVAPWDRLRAYRAVTWRSLGVAAGGIRRAGHGSLPRLAGTSRAWLPVLTLDMGFRCARSIGRAREWFLGYGASVGPDGVAVVARASHVKRGRGLLYYVTAGGEDRAHLEGPRSLGRATVETRGTRDARRLVLHVWRASRDWFTDLQGGYVGSPGKAPQFVLRECFGNGCGFQVMMMCRHRDRVLELVGSWKEFSDHGGARRF

SEQ ID NO: 996545 - protein, 108 aa, Homo sapiens
AKNGGRDGCGYPERHPRAVTCKKRFEVKKWNAVVPLGLGYCWLITVPSAGTTLWIFRRDLRVWYATGRGSLHTWLHSASLLYFGLPNNVGASIGVHADMWLRALTYFS

SEQ ID NO: 996546 - protein, 100 aa, Homo sapiens
ALGSVCAGCPVALAPSGRWPTPSAPELREAAAGGAVRPGWARWGSSLIATRSLKPYFNVSAALRSCVGAQIEKLGAPWRIEHRSLRGSTEASLAGERMEK

SEQ ID NO: 996547 - protein, 212 aa, Homo sapiens
LALDVTELDKPSGTGLGEWQRRFCILYEHGLLRYALDEMPTAFLRAPVNDDTTCSRMWVDGEGRTGHKFSLCILTPEKGDIAIRCGEARMYRASRVSVDDAHVSIPGSNKAEIRQKKGIVESPHSTGAWACQGGWLPAAAAAAACSSIPSAEKVPTHKIHNLGGRHEDQGTQPDGSSLSASSESQPEPGSWCQLPAGTWAERAKKRESAMSS

SEQ ID NO: 996548 - protein, 299 aa, Homo sapiens
ACRGLGAPLTEDQHKRLSEEIEKNVAGELEKLTLRGENKRVLPHCPAQPKPAESAEGPQVTARGIGERRFRLFGPSWRRGVSKGRLLIELHLMIPVRMAHHPPVATISQVGMWSCSLAEMESSHQQVMEELQRQPRAGAAVHCKQEEGGGSWLKETASLRASMLIDRSSDLRPTRDRAEPEERDQHTPVVVQQGPGWALRERKHQFTIVEAPEAESLESGYWEPSSHESAGDWGTHAAKLEEREQHRCAVPAGKGQELCAHQELMAAVGEDNQLARVIASRLAIGAAPHERGLQLSLFR

SEQ ID NO: 996549 - protein, 296 aa, Homo sapiens
GAVLLVTGWGLPSVKPVTRLACLTYARFTVCSSEGTQGSAHPLRRALQELLPGLRDQFMDEVSLRFHSKESSLQTFLQEEKEQSAELLTRRASIRAKGGQRQRHGPIRCRHPLDGRRVVIARDDVVGYYVGIWSNDSRKKRYVENGASTRYELVVHGWLVLTWSAIKLRIRVRWNRYVDDWRVTMAYGYMTGLDCGQQRGTERAGGESVDEGTTVAEEAAECTDAMTLFSAWSSQQVLSFWRCPCLLGRLRTSDYFGPCLLQAKAAQVGKRAGPPAWACTHLCAICAHSAQSLVTP

SEQ ID NO: 996550 - protein, 60 aa, Homo sapiens
ARLPLRAAALPAHRAQRPPPGFPPPDPCTSGSPCRNRGQGQRSAGVLWADLRRRNDNVNP

SEQ ID NO: 996551 - protein, 546 aa, Homo sapiens
EEEEEEEEEEAEDEDLEELDGGMESEARLTGTVLRPSVPTCALTHWLLSPDVTSEKVTSVHDVRPRWNTHDTESDIHHQSRTPRGRKARSYEGTTLMTLDDRSEPGGHQTHNPTSMIHALTRKILRHFTEEITMEGNEEKAHRWGPGGQLREIRETSRGAKDSTKRRMEEEKTQQNKRDRDRKKKRRTRQEETNRGQTEVRKQETRETAGKERDDRKEQEKEEEKHRDTKRGQQTQERRARKREVAQMRGRTSRQTTTEEGRGRKGRNRGGKGSKGEEEGEGTEEGDRRREGGRRRKEEEGAEGDGQEKEEREEKEGGRGQRSKRKQAGDRGGKKNERGEETRKRQERSGADRTGEREKRTKEREKRTGVRRKRREERRRRGGRRRGERGAGRKEEREERERGREGREEKGRQTAETQRETRGKRQDKRKGKGSQGERERPQRERSERESTEARGKGREEEAKRRNEERGEKQHEEEETKRERQGKGRRRNTKKNATAESETTSRERETRAKRREREEKRQERRKEEKKNSKKDRETTSKRTRERE

SEQ ID NO: 996552 - protein, 435 aa, Homo sapiens
AESRRWFPASTVLGREPGARSPPLAWPAHSQPSVTSITAPIGHAPTAHRPTIQRPRRQPPHDEQPLPIVADHDDPQIHHRRMRQNITKQGLQDGRHQTRTDQHWKLNGLLTDYTLSHVITYHMDPANELVAYAKENLAQKYITYTHIIIDGRRDHIDCDQHDMHAMTRNPNATAGARTYNPYTEKESQDNTRPVMNGTQGDDARAMTTATRRQMIAINPLQGEEHTQWYDTTKEQPYPEATQAKRLTGTHTTANNMQPHKYGDNKRHIAQTHNKHLDDDATDAQAHQKTIEDRTTIQRKIAARKGQTTATHEDIRRKIHYIEAKTKAARKHAPTIKRRDTAAQHLPKYPDRRRTRLPRARHEREREQTHKTKRVTKQYQRQEETHKKETEQDTQTKRDSTKERKKEGESKRKDRDKRQHKKRRKKERRKRGDAAL

SEQ ID NO: 996553 - protein, 78 aa, Homo sapiens
DWIAQRSPVALYGRTPCCVGFEELGDKSIYSHCLSISLLVVDKNGFQLSVIAGCEYINWLRVRSMPRCRYHCEGADRL

SEQ ID NO: 996554 - protein, 433 aa, Homo sapiens
VGKGGGMILDIYRLRKSSLTGVTGLSPQAPRRKQGWEDPDERTQQTSAATTASAANSCQPAESAGKRAAYSIRMGRGHSDSTRHGIPLWTDHMATLLHDHLPEGKGKLDERSRKMRHPSGLETDGDDIKLSEPDATWRPDTAFSTQATIQHRDQKGPPYPQNSRESRWTGDRVRSRGNQRPDRTERTRGRIGQDRTTDTHKKMDTEKTITQSQEMREHREGDQTRTENGRPERTNGHTTTWMGEDNTDAAIITDNRHSTDGLNLGQRIEDAGKGQKKRQHITPDDENMEDKPCKARETELIDTMRYVDQQPGHQRNATLDMGHKKRNNETERKKRETKNKHRTLTHPRNYKEPNINNKQRMRKQYREENKEKQTRQEEARMEQGTTRQQNDTRKYEENLKMKRTKDKNNKGHTGAGKDKKTEAKRDKNREDDK

SEQ ID NO: 996555 - protein, 363 aa, Homo sapiens
PGRAVTLLLEVRMSYPGYTPNRLPTITLDILLQVRIIYYPPSGQYPYPSGLPPMGGGAIPTSDQVDGYPESWRLHLTHWRLSRPTGGYPGCPNSQGGAPILSPEFLQAKELWRSTPGGAGLIWSIHSTHYHSLIGERIPRHRIPHNHGWHYPGETDAVHQISWTDNTNFTLGQTCTQMNSEYTQGTLIQTPDCHTRMLLQTTAAQYIYDRQPTGVQGTRLNQGKKRTGEGHNTATQQGIQRHHTNTHRHHNQGHSPIHAKGITTKKSKHNQTDDTTQKRTSPKKTPKQNPHRNHDTPGEPEPPNAKGHIRRQKQHNNRKRNDPTNATQTKKPTTEKKRGRPDRPGQHRRTRPHKTTKNETKGK

SEQ ID NO: 996556 - protein, 82 aa, Homo sapiens
MWYTDRQGLTELALLTGRAVLWLTLPTNCAGVTHDSPLRYVDMVIPCKNEGSSRQCGLMVVDAWLGKGYCAMRWTDLPGELA

SEQ ID NO: 996557 - protein, 490 aa, Homo sapiens
FKTDSAGAVRSLRNRPRDLLSLEPGAGAWGLAWAAEALSWQERRRGALSQAAQSAENAAAASALPGRPQAPGAGSNEGMGTGSQTLTGSQARPLEGAEQREAAEDNLDPQTRISRTMGAVRDGSMPHAPQGPPLWTRHPASRDHTKHIPIVDRRISKRRVSNGRHGDAVNCTGKGGASRVHWHWNKTRGTNHAMHNCGAPRTFPQPVVPPLSRWYLKAPTGRKTPGVRSETITGTMSGKIPILGPTQGQALTPRRNKGKDGERRRGEQHRKKGRSPRKGKQGRECRGKGTNRVAVCGAEPSQDTKPRDTKQSAQGKRQAGGKEPTTVYRPAYPAKRPIARNGQQTPKKGPRVTQERETRVTPDLEGLSGQEQNRRRDGTKANTGNRSGEEHSGNSKPGKTKEANRRETYPAQRPLDKGWAQAPNYTAHNEAKEDTNDDGDPKPGSATTVAPNTTTKAIKTHRDKTNTGNQKNETRTYKTTYDTNENHIHQ

SEQ ID NO: 996558 - protein, 74 aa, Homo sapiens
GREGGRGSWKCWRKLCHSAPLRPPPRQERSKSGVGQEMELRQETRLGPGGRGCGGAEIGPLHSSLGNKSETLSQ

SEQ ID NO: 996559 - protein, 215 aa, Homo sapiens
MPIVQRALQVPFQRTRPEDGRPNIIGYDVLPDSTKKDLAPYLPSVTPGLKRHRLMDPVPVVECSVPDICLEGSFVVMVKGMGESAAFEALVAGWSDSGDELTYETRASCESRIQERANRELAEVMTGIGGWKQRKEEKLGLSTQWSWRFTVSVEQVSLLLWPNVRSRCYFSRMIGFRLGHHRFSGLRGPGRSCWGAPLSGCFSLPWSYECLRALR

SEQ ID NO: 996560 - protein, 362 aa, Homo sapiens
SEPRGNRDPHGPGPPTRRSPACCSVYCWCLLCLPAACRAMGVPCDAWWLPSMEPAPCMWSLPALVNRRCTQRATRWTQPAAVVPVPTSYRQSSTHTIEDSDTTSRSTPQETDLRIASFRSRAKTVDKRGVVQSRAKEKQETTQVCTKGTNDTLRHDIREYAPRGNTHRRTSHREPPKRDTHNKGTTQNKNPQDTESDKAKKEKNNHKNDIDRKTQMKRKRRKEERKKKKTKKTQKKHSEKRKDRDTKRNKETREQEREKHNKTHRDTKENQTRNKRKKRKRKKTKQERKRRKTKRKRKQRKKTKEQPEKTTQKRTKRRKQKKKKERGPKKNTKLKETKKEKNNNKKKEKKNKKTKKTTKKKK

SEQ ID NO: 996561 - protein, 337 aa, Homo sapiens
MAAVQMDPERSQDASSLKGATDGHPEDMPKGSRVLGYDYNSWECQGPKYPGDVKHDPIQWILSLPPTYKHRDVTRSYITRGQYGTISYEEFRYHYAMQPCEAAAHVTADVSTTRGQDGETMSASTTGSLRVRGQMRAQASKEAGRSSHGDISRYANHEEVDVTHQRSSEKTQWRSYRPRIDRSVPKTMCYLLLSMKAHKERVGQNLPDVAESAKATKRDLGPDNEKMQPRSVTQIRITDRCQSEMSRGSTARMKNTDSWTLRYAGTGPKRRTAKTPKQCKANTMREETQQGSDEEPSTDTGDQSLYGQKQEERRTADARYEEAWQHETRKDKARGER

SEQ ID NO: 996562 - protein, 244 aa, Homo sapiens
ASCRAYARAPGRLLPLLARPAALTALLLLLLGHGGGWAAGCARAHVRRGGGGDGPPGDGEDGQDPHSKHLYTADMFTHGIRAPTHFVMFFAPWCGHCQRLQPTWNDLGDKYNSMEDAKVYVAKVDCTSHSDVCSAQGVRGYPILQLFKPGQEAVKYQLILGTSSTLENWMLQTTERGSQENTTSRKLAPVQLPRCSSKGVYELLRKQTFELQQLHKEDHFIKFFARGVVTAEPGSTWKQVALGL

SEQ ID NO: 996563 - protein, 577 aa, Homo sapiens
MGGTMRNNSAGMEASPEMMGLGDVKLTPATNMTNKADGTPKTESQSKKSSSSTTTNEKITKIVLSMGWMSHEQEAVMAWTSSILALHHEEQKSQWAMTKICTADRDKGHTPYWEPCLQRPYVLAATSQHTRTNYAQRRSRRTTEHTKENHNKTSATPKPTATPQDIQMNAEHHYQCYTRTIYKTLPKDTSYDRHYNIHSRGDNNIDPKREQMPTEMRHPAEQGHAPPIRPQCTSFHQTTTQPRTPPQKETAPPRNHNNRNCRHDVPQQLRRQREKQGKPYRQQRRHKKPVTDRTQTKREKHSRTQRGTGSSITADTTTQQRRTPHRHNNTKPKQRHQQSKKAQSDRTTTPRDRQEGPPQALKREAPATQQEEEHRHYNPGEKPTTNETPTEKKTVNHSNKQPTKRHHYQTTEPQNDEKKSRASIGDNDTERDSETEPRQHTRQKVEENEDHQRESTIERSTRTSYTDKQHRRRAEQEDDRSPEQKKEKTEEICIDQKKHRERRRHISDTSNTETQEKGRTEREVKKGRERRRKSKNDDIRRSEQQRRQEEHEAKNKAGNRAQEKKGASKKSQKPDQN

SEQ ID NO: 996564 - protein, 364 aa, Homo sapiens
MGAVSWPSCEAWCWAGTEPATTALGAGTVAVSCAAHCTWRRCNIPSLPDEEKSAACGQLPLACTCATLEGADTRVETRSRGRNFLPEKGDGEPGGIGRSLGKSKKGLSQHPVMPVLLEPGESPQSSTILTDTSTARESMPEKGHSDSQTWQGTAVEGLTIVREHPATYRRDYMEAEHTPTENSLSLPALHAPLRTKYAVKRGNPGVVLRMQHRLRQKRRTVHPTREARTDRSTEQIPRTHTQDRANTTAQERRRRTDDKTPGATVEQRSEAKTRRRALRTRVTHEKRQQKPSHEAERIQPQTAQETPVHTAVRHSEQGAVDALGEENADQRKGWGEYGAPGYPEWGHIRRRRGEEEAERIAEDN

SEQ ID NO: 996565 - protein, 237 aa, Homo sapiens
MRLWDEYRSLDNACPCSQKIVAVRAWASQLVYIMRREHAHEAIIIVTHEATLSVYGEDCKQVTWVTEARGVVSDSHSTDNEKADSLLTSESDGYCRGLGTGAVDPHASELTRGNSAPSATRRTGGAACEGGRAVQLTGGSLALAESPPYKAIKNSCDRPPSLEVTADAPHDTHQRPKEGQHAGAMSRVEEKEPFFMGPGRGGWGCLLKRRNVVVLKQNTGKIGHWTVDASDLATPFT

SEQ ID NO: 996566 - protein, 83 aa, Homo sapiens
GRGRRLGRWAPRAKKRVLLPTRTPSDNWSCGRASQCHILARNPSPSDDEVRAGEQLYTKRLRVQHVTAARAEQVVTLHERETD

SEQ ID NO: 996567 - protein, 107 aa, Homo sapiens
MPRSVAVHSDEIPARLEDEVGGLAGTPEEATLHGRASLTVRRVQEDAEQSKHVSNLGDGYNQYSIRKHHHSITYQSRQRPSQSRQLVLCARATDRLYDLAKLVRSSA

SEQ ID NO: 996568 - protein, 144 aa, Homo sapiens
SIMKCDVHSPRYDTGICQASVTVGVEHTMYPEDIADRMHKEITVLVPSNMKIKDHTNTPDRKYSRCWHLAGIPSVGSTCRNHSEPECGIYPKPGSYDEFGLPSYRSHLHNAFHKQVTSSSMRSHLAAIGVKYADIETFAPWQMR

SEQ ID NO: 996569 - protein, 472 aa, Homo sapiens
SQISPTYDVPPRDVLQDSRLHSLILPPTAGLLAETTKIPHSDLIYSKSRMRTGDRLTCFAGNSHEPAGSACIVLSTYRRVSSVRLSLPNGCVSSWVLVMKCPLRTLRGTRVTRSFAYYWRNEGVCKTRRSGTQCTLKKHNRAALDTLGFPGNGRTGTRLQQENQRRTGLRPDNWHFIADAWGLGTMKESTTYLQVSGDRQNSSTQFRGVGDCPHYGPVHCLEGPSACTRPKANGAVPPPMGTPRSTLSPWVHYVTIWCQDFLGKDITFPMAAQKSSRGRFPILCPNPKLGSGSTCNWHEDKMKGPGRQIVTEKFHTMNPFPPERCQAAQNRPSRDSPNCRRFGKTIKGFNAAKPPGPKMVAHRVTQSCGHQECRTLVLPALDNHGEYDPRKLRERQHTTGKDTLTENKAAHGKKCVRHSDKRREHTKWTKKAQTQDLEQQTTLYPHIQASPKLPSEDTVTRTNDEALNDTHG

SEQ ID NO: 996570 - protein, 304 aa, Homo sapiens
MPVLRWATHGATGNSCGISLSPQWPASVQPVSVTAASILCCGSRDWTRAVGSRVGRAPSSGPAEPGCLFRLGFCTGTTLRENLTVSIGRTSTRERNTLRKTEWRKSYGYEERPWYTMRPRTFYSNKTSFYFQKIYRVSQAYARRGPLGGGPFSQKPLVDFGVAGRRPSVPSSHKRGDPRLGREGFPQVQWGTRDPLFTGNIGSGRHWFSVYAFRIPRVQFVERQHPGLRPHPKANPIGAQHGRPKAKSVARKVRRTLVESIVWGHEFRSASTFCAVGHCKHFRLPKLRVSDPQRGPHETRRGTL

SEQ ID NO: 996571 - protein, 283 aa, Homo sapiens
MRLRDAYVKSAYVSTRQATDVVRQRSAVDPGAGLWSQRCPRAARLWTSGSFSEAPDSILADNWWIRSLHSKCYMRGVEEHDIRYCNSGWDEKIKRSSNHIYYKAERKRMHTRKTQIDRALGEAEEKGKKRKDRHTQATPRSGRYKPETNQGAKSMQRRQDGTHYRNTKTTRPRRGARHNNNPHQRETTEERKEEAAAETEEGGSSTEARNQRRKQTREEGREKASGSHSTHARAPGGENHTRPRQGPRDTTSKARTDAEGKKQDRTKAREHGKHAGRPKRGEK

SEQ ID NO: 996572 - protein, 365 aa, Homo sapiens
APQSTLSSSATQSCNLSLCYGSQQHPCALRCPHSCDAMLCVALYPSDLCNCPDICVPTQKSSMPLEDVLRAGDMHAPPDDHAQVVGARDPVCLKMEFAPAWEQPEGVLQLSNVQEDANHCAIQTALMGSQQLKPYLTVYWTPERVELAPPPLLAAQWARTLPYAATVEGGAPRAKLNVVLLRGEKELHTGASCSGSQRMRVTTHGAASRPDHHGSQVTRCRTSTGTMQGTKGAGTCTSSTTGPPYPAAKPLHKQESTTRAMTRHGEQEADTPRSPRDATLDRAVPKKGKHQGPAHGAPRRTQRARRNTTPGQPKTGTKPKTNETSPTQSQTRHGPDPGAPRRKADSRATAPEEEAEARRPQRRAA

SEQ ID NO: 996573 - protein, 106 aa, Homo sapiens
MIKTGDQVRARRSHAAEHATTSPPFSFGLVIQRGVLTMTRQLQPMKCIDITEETLHARFLEGVRKLPVSDCRLATQLYASVPHSIINGYKRFLALSVETDYSLPTC

SEQ ID NO: 996574 - protein, 304 aa, Homo sapiens
MRAIFVLRTFWGCLLLLARKRLRGTPGYVRHAMLVPGGYLCDPPCTRQSALSDEAAGSWTVATPTMVCRCFTSRLDRQACRCVSARYRLHLRSRLSCRVLVDCRDHPFATRNEGLRRSQDLQGTGCCVEDSPRANATTCRATGAEALGYHFSQVVFHRWTIQSLVPPVVCTPTQSCAYLPCAACRGTSRPVDGPPMPIGKSVESNRESSSPVILRSQQGPVLGGPGSCQNPMRLSRQYSLSPGWPPLLSPWVCLHDHLCVLRYVYLPGFSPKVNRSTTKGMPGSSHQKYPGLIDSGEKGFRSGH

SEQ ID NO: 996575 - protein, 384 aa, Homo sapiens
MGGSHSSSSYRLAVLLTGWADPPRAQGLMVRSAVSFPQGQVQGQQTFCEALLVPWAWRETLHASHSINRARANGPSGAGATPFLHNSRAHDLNHVLGSIRLSSNVDTETAKDQVHLWNPDRHWGSKPLTHYNAYNCSALSNAFASKADTLFQLTESRPTFYAPLEETTLRAKPSDGIRPSRQYTVSPWNHDMNLTHSAEILPCDLAPSVTQHLLGGCLSEKYMSASSGTFRQVSGTTSHARHSKENQSEATAYALSLHCILYTIISLRPHVQLEGTRTDCTAITLPHVCSGRRPPASTTGAQRRPESPTLRSSCQMAPTAKRAAIVDALTTRELTTPARPRNGTALQVELLRSAQRTADNRSGLDHAPDQGVAECTCKSERSRP

SEQ ID NO: 996576 - protein, 401 aa, Homo sapiens
GAGRLAQTCRRWPEEKARHPEGSLPKPLGTCRGLGDQQATPRAREDALAVCPASPCPTPGPVAPSCIKWRRSEEAGGGWHHGPGLVPSMPWGMKTLLPWTDQCQYRSPIRSGLIHSDYQGLRAETHWRPEPGRARMGVDELPAHVPLIPLTTQHVQRDAIDESTRERGSEEHHKRPQANYTKCQNLIRYRKMRRARTEREEADSALAEVETPQERTENSKSGDKTKSAAPGTATALRTHQNGQSWGRKDMGGGNAQSAHKTQRDAEAKEAKKPRRARPRKGVQRTLETSTEEKRARATRGEWEKWGTGQRHERSGPERARARSGETSRGSKKDGEKPSGEQEERDNTGENEKKGSRKRTEREKDEQQKETESERRKKTENRRNTDQSGENEDGTQKDERRR

SEQ ID NO: 996577 - protein, 396 aa, Homo sapiens
MAASLSSGRLVCPCKDESAEDAVAAGVRSVTEAECVRLWTCVLSFFLWTLCVLELDEWLETKPDACWLLAAGADALSCSCQCEDVCERMAGAGEMRGLGPQGPHWWPGDEVRRGTGTQGGTRSTTDDGGRRAERTELGRHQDTSSRCKKARMSHINQKAPEADMRTNTGTHGKETIEGYTGNQKSKRGKGCVKVHERAAGGMERHVEGTRETLTWERQSKRGAGTKTRTEPKNGPPSGTPKRRSGVGERTSKHAADREVAQERGAGGDGRWTQTAYIAGERVGGDREKRTTKGVYRREYKMRNQEGTGQQPERRTKDERREGNPGDGEMKQSKKVRRGTDQESGEKRPDDMGGHTGKDGGPDGHRAEQRSQRETERSSADNEEGERRRLDQRSRAR

SEQ ID NO: 996578 - protein, 225 aa, Homo sapiens
ALQPAWNAPRSSVHPLEWPTGDLHMAMSRGTVQQKIEKNMMQIWRQILIQWITTQCQKGCGPAPDWTREHSEELAQMDGTVLCETSLIATDYTLEGQPQVKKIQALHHEPHKSDVMQILSDACKQLSAYVHYHHWTSSKAVDLWKGQQAWPVLKAERWIESASGRGSSHEIDGLLLWGLASVAAVRDPKESPRDFSDNQMQRWKNVIVVTDGHTGRVHAGLTAQD

SEQ ID NO: 996579 - protein, 564 aa, Homo sapiens
MHQTLMAQQQRVNQEEAKHHIRDASSISNIHKHAICKTATQHNVCMSHASSVQTSPSSPQEAGNSRAICLTGIQALFGSTTITRFHLAAALAKACIVHSNDILSLSIKCDQTTTFCDNSKHSSSPNSRKHHGQQAFMGSCLMIPASNAVHSSGNVQDIRTDCNRSRKIRVKWSMQEEICDTRKSIAYTFELVDTVQGDTYGQEEQDYRCSLALARDYSVQKDLPDGRQANIMGVSQSGQKGEKYSSYGTKHAETTTTGNRAGRKDHKELTGSAKASAKGKERQVRNARERINRCSHGQSPDMGRFHRRENLKDNRWTASTLSHWGHSAKPQVDQVGHQRPHGDIDTTQLGEDKERAHPEANLKELTTVRRRRQNRDAWGTSKSSGTKRDRTEATDRQKQDEDPKGAGSEDTEGGKRQTEHTRNMVGTEPDRDTKKLKTVRTTETTVGGDKTKDHTEQQQNSKGGGHERREREETAWHETCAVVAKERTLTKDKRADGRKRYTPDRNASGRVESVQTSRDSKDAERKERKKPGGESRTERTTRQPRDQEQTESTDRTDELGRRDR

SEQ ID NO: 996580 - protein, 309 aa, Homo sapiens
GACSGCWRRGSRGGPGGGRGSRTRRYGLRRAKKGKKPGIVSPFKRVFLKGEKSRDKKAHEKVTVEAPSAHCGVVHCLNASSQTRLLTQTILRTEVKYLGQLTSIPRIPESLQEDMKSCISETNAKREPTSFQGQIDVRSTMLCSNCAAYNRQWLALGGTGRISSSGCPSMTSTPISYVRDDSCEHLDGPERQARNPGICPRQRLCAEKFQRPQGVSILSAECSWGPRGTACCLGPSWLQRSRSLGRSLGWSARRSPPAVVTGSPPFISGTSAIGGAYTRTPLSLQENLSVASGLQGARLAEEGGAPTFG

SEQ ID NO: 996581 - protein, 56 aa, Homo sapiens
MVPTYDGKDTCNCAGNLLEGMLVGGGFDMRRFETHAMHELDPPVCDLLCHPDFGGP

SEQ ID NO: 996582 - protein, 66 aa, Homo sapiens
GNLRGRTCQARRPPAAEILLATPRHNPIGAGSPPRDLVSCAYPGGPECMDVVWSPRSAYTETWPLR

SEQ ID NO: 996583 - protein, 444 aa, Homo sapiens
MWYPLSARALPSPRGATRTIASSPSCANLGAPRVGWSSRSFTCSWCKGLPLCRPVAPGRGFTVPGLETLIRKTLERLSTPSGPSVCQSLDKDTVFHIHQETFAERMSPSFHVISTPHILGESLGPSPCLYFSPASWGLFTPLVSGAPFIGFIPRGVGPHAMLARLGAPGPLAVGPNIRRGSPSARRWHPLRRAVSCPPPSGGEPTRGNLGPPFRVFDTRRHSGVARRDNAARGIQRPKLRRRAPYRCAQSRGPYRALEIRDPPCVIALATSAVSPHSPLLRARTTKSGVNLAPVYCYPPAFQIWGRSPMSNVRRHAEAPRDTTIVESAILIVIPPPRVFLLFVCSPPMSLRSLCVSRAVTLAWILLPPRVAARLDDSDAQRIVLRSVTLRSRTRSAPRRAISLRIGARRLHPALHLCCAANYSLAGGGAPRARPRCRPPHRCVR

SEQ ID NO: 996584 - protein, 156 aa, Homo sapiens
MPGVSRTCRLLSGTLTINCQSPGALIVRRTTKGLRHSLSADDMEGPWMKALSLNDRLYAMWSLVELIRRCGPEGRVAAFYAQLKLLCPSGGPRTHCSHAPKAVAMFSPQKVSPLGYRLWGKTTLGRKRTHPLRGFFLPKHNFPFPLDAGAVIPFGC

SEQ ID NO: 996585 - protein, 355 aa, Homo sapiens
MTGYGEITTRDMHEERCTSPPHKERHTTKGGYVGMCSPPLKRIHTYNTPRIKTSPSEARNTSAFRSANTHIRTITFKNIHRGGAADRIIRPNFILSQGSHGYLDHTHTAHTEEDTQITTRRRAHIVPTEQQRMQTPNSFLWPHQTCSNVVNLNTEFISSPLITSKHTRTQSSMYPQHARQVNTTNPRDRIQLIVVNTTQKQSTPPNHNRLAQIDQRAQNTKNAIHRATHAYATQNENTENEEQLANTTTERQDETVRAQQSVRQVDSIQRYVVNRRPIKQNNSPNQTRMRDPKPAHEARQDRSETLATRQQRERRQTRASTRTHRAEHDETIQRDTQRSQQIRTQTQIRQNTTPQ

SEQ ID NO: 996586 - protein, 105 aa, Homo sapiens
ADARCATATIALQCQCASNGGVVLSRAAVLCVHVVAAARQMETSHSGTRLHSSMEQRGRSTVLPQLWGCPPPELRRSMHVMGPFMTVPRESYCSLACRTHSQKWC

SEQ ID NO: 996587 - protein, 305 aa, Homo sapiens
VFKALRWKSLDAPSVLPEARHIGRSGKSNYFLMIIQLLDDPSEECAIVRSETMWAPSRCTQIRNVPFVLVRTSACWVLMRASNTMMRKAIRAHLQNIPALEHNCCLISGWECGLQCSPTEDLTDASRDTVARPIRCQGCCPEAWLRELPPLSKSSCSQGSMQHWIYVGPTNDLLLAKAHSVITIYQSPEGHPFEIPDVIVLLDPTTLDDNTLGAQANATPGLEHAPTSTPPLSLLRLCSSSNVLRTHGQGNPINPEALLCIIHQTEKLLHFSPFPGGGVPHMQPDVCLASIGLPTLFAFSNPFYY

SEQ ID NO: 996588 - protein, 294 aa, Homo sapiens
SPGILVLQYRSPRVGMADFGSSVADSPARPPVPARAPPPTPARRGRRQEEGSLEPGVGTQTGSGPLWCSPLEECRGSMQDAQRLLRGSEGMALQLCALCGCVTRAYAAYQCSMKPLHPGEGPHHAVTPQVKVSGFKVELRKQGPTRVNSQMRDDTCNQSLHCGHCDVRIKTTGNPLVPISWDICHLKTDINEVRPSLGQRSVTGKEQNCSSSRVMQFPKCRWSGGKLKAEFFTVHEPCALARGVVDPGDGDTTGTTNVQRTNDPTGKTAIREKPWQDAISAGPDKVLRANKRRT

SEQ ID NO: 996589 - protein, 123 aa, Homo sapiens
ASALTTPEMQKEIQELNEGMRCATERDGENIKAATNHVTPARERAGVHEERHQDTVKAVVGERKRMATELSDAITLRIPQEQEAVRLRKLGYETDERLRRHTPSTPEGCTVQDCVGTAAMSEE

SEQ ID NO: 996590 - protein, 104 aa, Homo sapiens
GRRELDLAPPNAARTGAKGWSAVVRPWLTATSALPPEFKRSSCLGLPSSWDYRHPPPHPESVTIPLMRLRCSEMKTLALIPSLKRENSEMAPLQIESRYGVSPC

SEQ ID NO: 996591 - protein, 103 aa, Homo sapiens
MVNKLATFGWAFVAKMTPEFRAGVAERLGMVYDMGRMPGGVGERNMECNSKYTQVNALRIVEPQTVDERDYSNNPFIFFMDGDSRGKMGKRRDFNVFPGKLLV

SEQ ID NO: 996592 - protein, 389 aa, Homo sapiens
SWGLFFPGKKTTPGHGPLSGLRTRDNTQHQTHTGESGRGERHEEHRVSKHEVVHVGHRGWVPVGGSQREKRSVPGGWGAHTEHTLWGNKSAPEAREGHEGTGTRRREESKETYGKAHERGGPREGVATSGGGGGRESCAHKKKRRLWREEVSGAHRERKRGHEGDTQQPREQKRARNKKNHTNPPRERKKNGEGHTERHRERKHEGKFTTRGPPAEHQHSPQDSDGRRRPTAFPISDTGLNGVQEKNTWGANHTEEMEEESKQHINTPQEENRAQDKKPFNKNCITAKANKRTNHKKTTHQNHTEETIGTTGNTHGDPSNKETKEHNSDPPPPKRANKRTNPQHEPPLLTPERKRRKKTRTEKPKKNKKGRKRRTQKTREKKGEKTTQR

SEQ ID NO: 996593 - protein, 205 aa, Homo sapiens
EDEEMKRMRESVKLFDSICNSEGGYTDTSIILFLNSKDRGSRGEECVEQQVPWIGSSGITLSYTGGAIVDTEMEGSAGVTSISKVWRTMKKGAERATYEEESSTATSTVAPADCNVTSHVRVFWRPTPDVESSQNRPERTAGLILRGRRRAGGNEGSARLWNAAQKPLKEEWWQEGIDALAGRGFSPGSVSHHSFPLVLCFSFTH

SEQ ID NO: 996594 - protein, 281 aa, Homo sapiens
MNAGDSGGARRPLGPWDGECGGFRGGFGSGIRGSVGSAGRCDGDRGRMVCVEASRRQRPRTKEWMLALSIGGGRIVSVGTMNDQDPRWKDDSYSLFSSVAHLRNQDSFDVSFRGGLFSTDDGLKIYATCCKKARTPCRPGDSQVHTVIRSLSGYYKVAKSVLGVKVVHTEWLVTRPLRCGSFILAHKLVHRSLDACKSVYWWEATIEALTCAIAEVEQGGCGSGAGTGLVLRPQGDRGGRTSGCCWLTNAGPEWVVWMRVNPQPGCEWSPGKFRQGTFDAF

SEQ ID NO: 996595 - protein, 261 aa, Homo sapiens
MATQGTGERDPVLQAVLSVPREDATVVSVRTASVTQLPSSIGRAKDWWGVPRPLPRGLGRIPTAPKGGGLCHGAQCHSSTGGPLRGPGGRAKYSPKGAGRPGGGGERSGESLKKTQRDEANPFINSTRAPRWLKRSSGQGWSPASTPGREVLQKSQGPRKRSREGKRETSRIVQGRSQPAKSLPSRSRGQREQCLRGLRGERKRPSGQGKGRRETREGSPVSDRQPDPPRRAKSSAAKKFAAGGNERGVKGQRGMPRRDTE

SEQ ID NO: 996596 - protein, 252 aa, Homo sapiens
VEVEAVCAWRGRGGGPGLCTLPLSFSKAPGSAGHYELPWVEKYRPVKLNEIVGNEDTVRQAEVFAREGNVPNIIIAGPPGTGNDHNAFCAVSLGPCWAHVTHKMPCCDTRMSSIMTGALTVCDGIRIKMFGSNKKSLFPEMADIDHHSGMKHDSDVPTEPSKPGGVTMVNLSLITTRFALACNASDKIIEPIQSRFVQSSRYTKLTEPRYHQADECYREGERYPTLMTAEAIIFHGPGDMRQALKQPESPSQ

SEQ ID NO: 996597 - protein, 301 aa, Homo sapiens
GGQRSGWSRRSPPAPFSGETWVGDCRPPGPESGASLTLLVPPWENRPPSERNYSQGNPLFRKERNGPRGLGQLPQGGELLTSTWGTLGPGPAGSGYSRVSLKTFFITRQEGLCREAQTLDRTLMSAEANLAGLFLPTGMQPLQPEQSRGSLFLCTTGCPFTEDQACWKVPVGAHVPRYEQLQKRDPGRHQEVSEGKFSELPHFLAPGGARRTGVPTLDTWETVSGEWVLLTHLLLVRANRAGLALARLGLSPNLGGCSRPGYRGIPSCAFSFGIFPRGERPRSRGGLARVPRRAWLIGGTP

SEQ ID NO: 996598 - protein, 361 aa, Homo sapiens
MSASNRSASVDHLAVSQEQIPTGWTGWIIFSCFQKRSSLYETRCCTQNALEFNLGVHLTEKATIESWPGSKSTKTFASILGGKRGVRTKQALMNPQHSKLERSTCKAGWAWAYDAKGQAGKRYKSKQVEDREQRLDDRMMEWKTAENKIYSSGSETAIYVAWVITLVQTIDTKTRCLIEKWGYPTLEQANIDVTFAEGKLCESHYLDTTPGRKIVIHRGRFTRVGNNSGGMTERIMDPSQSCASILQGSPCRIASCIVERSLRARKKSLADRKMSERMITQRTDDDWRVDEHITWGNAAQLGEEHLRNGNSGAPIKREGSRSGTTLVYQDYLMEAPHTHLTFTHDIMYNRATVEHTRRIEQ

SEQ ID NO: 996599 - protein, 55 aa, Homo sapiens
VHAEKKVKMLEQQRSELLEVNKQWDQHFPAMKQQYEQKITELRQKLADFAEQVTD

SEQ ID NO: 996600 - protein, 145 aa, Homo sapiens
MPFWLTHPGCDNNYLSVLTTMDSTESTLQPEEIMRKSLRKSSTYIKKNWNNPDTVAFVAKFLLDMVTTWLGASANMLGSRDGKSPRRSGMAVEPRVESRTDPTQLASESLGCSRRHKWGRTSWHRLFTGGAWPNKVIRPKDRRKI

SEQ ID NO: 996601 - protein, 112 aa, Homo sapiens
MTAMPTTSERTYCSGKCHSTRSQLPVGGSKPVYNLIALLVKKGLAHSTRPEELSVNDGRVDLRILDGAQKPSYGLGSVTGRVLALRLVVNGTRVYALGVEVTVHVGSYPIGV

SEQ ID NO: 996602 - protein, 196 aa, Homo sapiens
LDREIWAETRLVLMATDRGSPALVGSSTLTVMVIDTNDNRPTSPNLGAPSVRRCVIGPQRLTQVTGNDVDSGPVHVVCAKPIMGPRIPSDVGRYGGQCLPHGDPWTFEQMDTAEQTAKLLAHDGPHEGRDQPSQCYVEDVNDNATCLHHRASYQVMLLSTHPTGQSPFISVSATDRDSGATGHIYYNWIPLRWLQC

SEQ ID NO: 996603 - protein, 141 aa, Homo sapiens
MVQQAPHCAVCMIFQTYHQVEFGGFNQKAVESASDLGPQKQRTKPLIPESVRSLRLAAGADIKLSYSLSLSEDGTKTYFVSLQECAAVRVHASRYGVPLLKDSEDWNVFSVFSTMPRGGAAVNAHYEEGPCNSNDDWWVTF

SEQ ID NO: 996604 - protein, 203 aa, Homo sapiens
MRARYKIPHFKESYLSMATNVLENCVAIGPIEVKSGGAGRTLGHQDHPPTSLDASVYDQRPPQALRLACVETPRARNLNWEWQSSGCNVQAHWKGCVKDIRELVDQKFLSHWATDSNPGQTERLQEFSQKMDQIIEGYMKATFIMEIQQETVYLQNVYAPEDDPEMKRGAVNKADFDQNEELGLHELKTEGLKELVEGRVVQA

SEQ ID NO: 996605 - protein, 309 aa, Homo sapiens
MRDPRSWIEDDDEPANSTEEAPAGPGLAVSCRILKQSPNVVVTGTEPMRCAARAPGPRGSWDLDGAHLGECFQRSKSVFVALERERLLDVTCDHTNPRLPASSYPARRYGDPGDTRKGYRVPTPSNPGHHGPTCAGPAEVLTNPSVEPEPLRVRRTALRRGPPPHGAGMLQDNSQAVTWEPPPACDTRICPLPQGGNLPLLPPPGVRPLASGHSTVFPCLVTQHRNQHQPPPRIPSRWSPCTPACHTPSTPVSHSHGLTLAAHGPIGTPPTARRHAPCAPCVPMDLAPGQNSTPKRVTPRPDNTASCTA

SEQ ID NO: 996606 - protein, 218 aa, Homo sapiens
LQESPCIDWRVALRFLSLTLRAHMSVSNSVAVLGLYRCISRLAYPSCIHVGYRLGVEWICSWRSAACQTDPRVNMSAHIVVIPIPIDKCYHCSTVQLSAHMEYNLRCTSLVYSPYSYLCKIRIFPPLSSGGDALFAWSYDLCDVPRGVIQTSAIGERLGLICSGGEPKGSVIICPLLLNAPMFVMGVNHEKYDKQAQDHQTMPPAASKCLGPLAKVIA

SEQ ID NO: 996607 - protein, 102 aa, Homo sapiens
MSHCLRVFKAPIRPAYCELVQPQLAQKLTDRPMLSSELRRSIQHVNAAVLGYWAQIVVRNSQNVRGGWDSPLLGLGVSFREIMMSWRPQCYAPTKYLEPLAS

SEQ ID NO: 996608 - protein, 209 aa, Homo sapiens
MAHRTWHVEKAVSRIVMSSRENEREDSSGHSAQLQGTCSGAPPQQSPGTRATRGILEVQAAELRSRRDPYNQVQKNRHESHEISLGRSPELTIALACSNEGKRDHLRFRRGRGPRVASESCRNCLECHLYPHAGARLMMFHRWSMCTQGGPGSGGSDDDVDMKNSIGYRGNEIVTWRNRSNVIEDRKSERIVDESMGLLWDDINLVRCN

SEQ ID NO: 996609 - protein, 168 aa, Homo sapiens
MLGRGRSSAWLPASLADNDWSLSMPPRMVIEEFYNQTWVHRYGESILRRTYCITSASWSLSVGIVFLVGGMIGILLCGPFRYTGLVRRNSSADDEPAWPSCPPCSWASRSWASPFEDADPGPFIIGCVLGLTQASLPMYVGESVTQGLVGALGTLDQLGIGAGIFIGQ

SEQ ID NO: 996610 - protein, 178 aa, Homo sapiens
WRISGRAHLTVYRHDSRLLPVWTHTWYMSEHYAQLFDDAIGVEGAAPRVHEEVQLSSATLCTEAIMALQGCQESRKLKPDDSSRKLEGQQQLGAKSWNERSCESQAMFIMEIRCKILTSFKIDEIMLFVVDAISPEEPTFHAPCETCASDRSTGVRLRVRNPVRDCVIDVVPCGKMRT

SEQ ID NO: 996611 - protein, 225 aa, Homo sapiens
KCVIALQEKDVDGLDRTAGAIRGRAARVVHVVTSEMDNYEPGVYTEQEFWVEAHYSCISQASSLCSGRFTEQVEAAVDRPSARSLPSPMDENEFIECVSRLVYDGYRGTSGKAVLMIKEPEELDDSEFETEDVMSDSRTSVQTRRRSADRLGMSARAIMAQLPQDAKKREICGTGGQFPGRKEQAVDAEVSQMGRTVARTVIVSGQADVHDYEGDDRLYPEVKVH

SEQ ID NO: 996612 - protein, 319 aa, Homo sapiens
HTFYNELRVAPEEHPVLLSEVPPGMPKGQSREDDRQIMLETFKQPQLMYVAIQAVLSPATPLDRYHHGIVSGLPVDWVIHHCCPIYEGVCPSPMATPCVMGAMRLYQRDLELTSFTEESFTWARDTVFTMHGRAGNVVRDGLRRSCATVLSLVLRSKEMATACVRMLLRWEQSYELPDGTGRSATWQMSGSRMRLRHSSSLPSWALESCGIHEDYLAIPIMKLLTVVHPAKDLVLPTHVLVWRYHLCYRVAFADRHGRGRSLALGARPMNDPDPCSSCAQSPVWIGRVHPGLGCPPPEMLGLQPGYEDSALIVPEWFRG

SEQ ID NO: 996613 - protein, 296 aa, Homo sapiens
ADSVESSCQGRGRLRGRDDWGATHARRSRYRRCGPRILGFWGGCSGLGVVARSSCCCLWQPPGPQAENDFVLVQPLVTMDQHAVACAGSTDRLTWTPSVIPFIRSHSAVGHSSLPLSECEEVMCSSDEGANVRRPAEVPGPVASAWLSYSVQLSDDCGMSPTGLNLGADSEPPVDDLSIVMCWLVPIVLSRTDVWSAALTVVGLSCWMSTMECMYRPSCPRKIPENCNVFRHPGPRASVDSREYHVQPRKWGRPPSRSVDMGKPAKWKRNTLSLPQPNENGSKLGATERGDMGTRT

SEQ ID NO: 996614 - protein, 336 aa, Homo sapiens
AIHAAAPIAVMQPRQLAVTSRQLPAIWATGQQPIDEWLVLSYREKKFYDRPEVESRPVTLSGEPVFLVGITLSVLGHHFEERHMQDNIVCRQTHEVEGIERTDLSHLMKGSTGISVVIILTLSNIRKQPELAVIAPRGGSRGTYLMLNSRGKKAALCDDARVYDAGQQLTYPLVQAIPFACSVLMANVKPAWQGEPFYLVLLGATGEHDGERSHARIWSAHGILKRDKWHPYHEKNTLPIWLRTPIFQESTWPDGIGMRRNGFVEKHGIDQVGMGHPYPVHDTRPVLTSVSFDGLVATPTMGTEGLWSQCKEGKFPNERGLGLLQNTLKRRFRHMT

SEQ ID NO: 996615 - protein, 256 aa, Homo sapiens
MANTYSGYEGHKMNKGANSHTQTLAKHPQHGSTKGDTPKYAQTKLKPATLRKTGIDHNHKIMNAKNQKKQTSTHIGGERSQRKGTAYKRDHGHTTETKLQPAMRMGKQSHRESITNQQENKKDRQNNIKRTHTWTSDPPVPKASGTRAQGNRRTKRPDTQNTRKERDKATSRTVGKNTMWNQKVGTTNKREKQQPTQKSNRQAQTEADTCNTQDKSKKEQREKTKQQEAKNKNKRKEKPDRKEKNKKERRERRRRA

SEQ ID NO: 996616 - protein, 305 aa, Homo sapiens
YFDFVTRCVRAVDQGCGDLRPVEDNSSCGMISLKTGIQVLLTEYSFDSRHKPAFTEEDVLNIFPVVKHVNPQGPRMASISSRRGQCQEMQAGLSCKEGCELINEALNLCNNVYRSHARGELCLSAPPRPLHYIMGDYAEALSNLHEGGADDASGVDGHRGTTNTIQEYMHLALYCFASSQLSSRLSLLYRARTHAAGVGEDTRDGAVDNNIGARCCTAVVEYDLSLRFWKNALAATPNTTGQAPQVASSHHLIARVYQTKLSRARPRRKRGQPPQTRGGELENTEPAPRLTPAGRAQNDTAGSNA

SEQ ID NO: 996617 - protein, 176 aa, Homo sapiens
MPEREVLSNELAEWILRTRRSLTLLRTWTALTGVCWTSTFEKTVFYLPLTHQCLCLSGVVASTFKAVGWNVSRLHSQCPVIATMFPQPPQPQVLVPSMTTYEIIDSSCGAISRMCCSQFSHTQQIVNLEKQAKLSRAYDGTTLTCGYCGLVTLLAMIIATLPQGSIYGLSRNTSGT

SEQ ID NO: 996618 - protein, 193 aa, Homo sapiens
PLARRVASSLVCCVVPAPWLLFCAVLLCSRPVLCALCAPACCPVAVVPANVCPTMLVLACHSMCSCGPAMHVPNCELLVASTVVHLGTTSVQVTYTPTATSECVHNMAHTSRWPKSNQSIQLHAVLCPCGIIAHTSVTLGGSNVGLVQSPGHNTHILRKTLYHLKQPLGEVCCGIQPTQLNALVPAEHTCHRE

SEQ ID NO: 996619 - protein, 445 aa, Homo sapiens
GAILSHHADAPSLEPPSIPPGHHPTITVLGRLTIIDLETRSHRRLRMISRSDHWLHLQSNQKIPPTSQVDLEWCHVVVYARPAHHSNAMHLDNVMNMNGYTREVLTPYVGPNGAHRLRNPSTCQCTSQEQMIELGTMNEVRDEPPRSNTMYPCMLPTEHEHHVQITLIHQRPKSKRHDEPTLHHTAPATCHRRTITAHGRRNNRMTYQHDTQLDTTRKKTQHQSTNALDQKRDYNRGDREQTPNNNTRKQNNNMETNKNKRNPRHQQTTRRRNDGRHSTRKRIKQGTTTCRTIQPIGNNAPMGTHNKEPDTDNTSNDNRDLTLSTTERRTHQLKQSRTKHANHSEPLITTHNLITGTPTSTTTHKNELKSSTYQTTNKASGRTANIADKNKRTYKTGHNMTPNNEPTNREPRKETLSPTQSPQQRTKRRKQVKRTVHIKDKIGNA

SEQ ID NO: 996620 - protein, 138 aa, Homo sapiens
MGTVKVGVDGFGPVLECALVDQGVLLISAKDGYCRHQMTPSLILNYHALYMLPISFHTMDTIPIGTCTMAEERRSLSSMEIPSPSSRKRDPSKHQVGQMLALTYVEGSTTGVFTTLENGLGAHLAYGGAKRVIISATL

SEQ ID NO: 996621 - protein, 174 aa, Homo sapiens
MPSMLVRYVILTLQSYPIKHGVIINCDEMEKIWHHTFLQTELLRGPEGAPHVLLTEAPESQGQHERRMTQIMFETFKTPDMYVASKARSCPSKPLGDTHWHCHETLETGSPHGAIYRKGYAAPPSNPASGLVGRELTDISMKILTDARLQLSPPTAEREIVRDIQEKMCRSPGI

SEQ ID NO: 996622 - protein, 132 aa, Homo sapiens
GTCAQMTPPWCGGPQPPSWGSLPMCLELDNVKSEIIPMFSNLDSDEQDSDAACCASGRRAVNISPDILHPGRILEALADALLMRQDDRRQVLARPLRWWLTSSRELQKAVGPRDQPRQTLVHCHSRTIDERL

SEQ ID NO: 996623 - protein, 335 aa, Homo sapiens
IVTVHCARTAESQTTMQPTGWCTIIDKVISTITNNIQTDQLRSRTPYETLRSCCGCIRDQHDDLKDNRQQYTTYMAHRPTEAISQKIPIENIMNRYPGTTQEDPEGEHDEPSHIIEDATYCCCMKDHNRSAAADMIMLRRTPWEARNGPPRDKAEGHATEERHNNYNILHNARKEPTTTPTTINKNHSHNTQPKRGVLNSQHNPLAYNAITYKFTQATSTTPKNTITLRNYRDLRPTRMTNETQVQYPKHRTQTVPIQPSTNEGKRTGTQDENYESDKSPKILTQLGTTRTQQREYGNRHVNHEKHHNARDKIVTRYYRKQEDIEKKEPTTQQDK

SEQ ID NO: 996624 - protein, 189 aa, Homo sapiens
MPIEIPLGALLWNMGPWVYRGMEGGDEGHPLVEAAGKCLLRLSRFTPGPGRRKQLLQLLKLGHRYRAETKHEKKHETVARAEERGCGHRDVPRGDNRPFSRSYTPDLGGEQKAQRCVHRRDRTSGAICCRKKGGRTYPGRTRGCQDGTASQNGQAAQGLRHDEPRGTAHGHQGTTGVKNQKGRRRGEDI

SEQ ID NO: 996625 - protein, 347 aa, Homo sapiens
MARSQTASSCDPPPDAGTTHLPGRSAHVRMRLHRARAEDEVVRLRTADPEPERLSEELRGAPHRHETRLHDSAQTPHRLTRTRCSARERQKSREGQGAGRELAGTDRFGLRSLDDRSAPEARRKDEGRKEAAEGTGSRDMRSHYSEDADNNKSRYTHGDRPETLNQKKANHQTHRNGERRNIAATNRTSTRTHEQIITSRNPGGQINANGATRSPYTRANDTMRHQNVGRSVRKQKKTKNKEGNDIRTAETLNQTADDRKTRSKGEKNTPTLTGRATQKMRNKEDTKHQSEGNTHQTIQRNERQRKTKRKRKGEKHNDGTERRHETTTGTRKHHRRRSKKANRTNRE

SEQ ID NO: 996626 - protein, 171 aa, Homo sapiens
MRSQRMNRSQDPGMRCLQVLLVTHYPRSSQASVSRGIMDHIHYMTGPDYPYRTMRALKNKVVECKSLANEFLGRPLRCSTDTRHPRKDIEGRCLHDNKSRGKQWRQEFDRLNIEALRGNITEARETASAGKNEPRKETAHPLVGLPPGQVARPHAAPPGLPGYENLSGNLG

SEQ ID NO: 996627 - protein, 427 aa, Homo sapiens
MPPTQTQQRRVCHAVIEGHHLALARCTLRDTNAHATTDHSDLITAMTCTDTATTTFIFDWNARSTPLGHQAPRVAPCERKTTRNYIKPSSCKDVPTPMLRRRGLFKQERIVGAVEERNGLGLRVVPLVTAGRNLQTVGRPILRVGKALGRALVLPIAPSYRFPRHWRFPGQGAEALVSKARGHSAMPLAKCLNPPQERKPRGADRAFLGPTGPLWGPLPVSRISPGLSMRPNLQGAVSRAGSGVPPATQSEPAGPFPWGWRPGDQARGASPRRPFSTAADHLTRSVLITPHRVAPDSRRQSPWIERRAPSSVPGPCRGTEQETRRTKPRRSPSVEQPPGVITEREHYRPRIRTSHTRRPHRRDGLYLLQHTTAADSRAARQTTRHKHMRAVTKSSSYDEQVTRKITEALKRNPQISHEAQKGYYHAR

SEQ ID NO: 996628 - protein, 66 aa, Homo sapiens
DQWRMSRQRGAGGLVAWDGDRGGFRGGFGSGIRGQGVAAGGRGRGGGGRWGAGRGGGGAGAWGPGG

SEQ ID NO: 996629 - protein, 275 aa, Homo sapiens
GTRRMELLIAFEVIGGDPAHKGPLQVQAAALHVESPGSILWPSDRSLCWWTIQLQTLVLVMDKSPVRTRALFWRGGHVGIEVMSWTYRYHCRARMVRNAPLPHGLLNDKLGRNRREGARLGTGDRLGHVRLAVASTEVSPWAKVCGVAVYATESIDQCSMGHTEDSLVLCTETTLWDEFSSLEPLPRKLDVLIVEPLWSKHGCDASHLTVVPVGPNDVDRNRGRGRLEGALRTTLVAPVIERGALCGKEEPMVMMEHAAEKAGGLAMCSDYQHGE

SEQ ID NO: 996630 - protein, 128 aa, Homo sapiens
MGVGVPAPLHVCVVASVLQRAQRDHVQLQLKAGPDLSELHVAGGSGLLIHLGAWGGNTLVGVNVQRSTRYTGGGAYRGTCARGPTGVDIVVVRVGKGDDPGVCNLGAREIGIGGCHSAVDQAGRKSSV

SEQ ID NO: 996631 - protein, 101 aa, Homo sapiens
LSSSLHTSTLYPKKTHGGALQTPPSSRARKPSQPGPGMPEVSQVIYGGGTQAVPPCAQEEEASRELQFPDPFPGSRPGWKGRGPYIGGANSNSTASWEHVA

SEQ ID NO: 996632 - protein, 79 aa, Homo sapiens
MWSLGRIVGGGRVSSTTDLFGGNHGIIETTRGQRGAQQAIFRSFEAPDNLSHVPSPSLAQRPQGAPGRPLKRVGETHIM

SEQ ID NO: 996633 - protein, 82 aa, Homo sapiens
FRAWTRGRGGTCPTFLVGNPSPPNARRNPVIDVSSLPQFAEYSLTRSHELVLNTHKRILALSNGRCNSPQESYRLLYVEWPM

SEQ ID NO: 996634 - protein, 96 aa, Homo sapiens
AEAEAWDASRIQLHPLNPSPWSRKVAAGGVVDVNTSLQEVLKTALIHDGLASGIREGARCLRLAPSPSCVFASNCDEPMYVKLVEAFVVNTRIVDA

SEQ ID NO: 996635 - protein, 133 aa, Homo sapiens
MGENPSLLKIFSKNLAGNGGQMPVVHLLGTMQARKVEPQKTLHCSPNGAMHPNRGRNQPGPHKQHTGRAWPPRMGPRGAFPQLLPRWATCLGPRRGNSPKRAEDTRVSEHGTRGPHDTATLPRDRTHHKTPRL

SEQ ID NO: 996636 - protein, 388 aa, Homo sapiens
PCGPPKSRRPRPSRMENMAEHSRKLWCCLPVTPEQQEALQEGQEVRHGAEPQGVCMVKQTIAHQQQQLTNLQMAASDNGLWRSSLTFATRQAGSSGQRALAIMCRVYVGSYYYRAGESDTNPPGLSTPIRHHKQHALDTVHGTSDITMQDTTRFALRAHAMTDPPDSLHHPAPHTGSHTEHPHNATHDAKHTHTQTPHTPRPPPTPTTHRTAPRRHPTTTSPHRRTPRQTPSATHNARPQNDATQPTRTHDPPKPQPTPAKKDPTPHKRPPHPRHPTTDQRPHTQPTTRTPPQHHRTHTHTPTQPPAPHPPKRQRPHDPTIPTPAPPPTPTVQTNPNARHTHRPPHPDSPTQTTPSHPTHPHPRPPHTHQPTHPQATRTTPAPPTPPQ

SEQ ID NO: 996637 - protein, 51 aa, Homo sapiens
MTHCTRHKTRARPRAGSRDDPLNDCLKVAWAHYYALLIIYAIKYRSVYTRL

SEQ ID NO: 996638 - protein, 181 aa, Homo sapiens
MLEALINPIKHVSLMDQRARQLACPHWGELRLRLAKRRARTPSTRAGWEVLRLSFKIVQAPLPRMYHTHRRTDFPHPHIRSHRSISPTLPLHPHAPTAFSSLPPHTHPPPPLPTTPPSLPSPLILPILPPPPPHNTLLPTPPLHPHSLPHPPPLSFLPSHPHHSPPPSLSHTLHTSHTNLP

SEQ ID NO: 996639 - protein, 191 aa, Homo sapiens
MIYMLTGTRLAGGEGVLLANPTKDFGLEAVNDKEGTLAVLVLFVSPPLQVIAWGCLPCPPFRCRLIWEISTLKQGLGSVVWALGVSPACSLYVGDTDFGACSIVGMQVQVCVDLSVEGRSNAALVRPPFLDPLAGSDQGSLQHLALEAVAWAAPFLAILEPVCVGDASLGRGMPFVRTLRSPCRRQGFVCA

SEQ ID NO: 996640 - protein, 268 aa, Homo sapiens
AHLKGVPCMECEQIPQEMTKLGHRADAVCASMYQCAPQGLCLPPSKQLTLHGPVVVDIRSGCLDRIRDASMIASVAVTWSYFRKEHAGEESNRRPLTSRGASFIVSAPTLDRIAPMKSEQLLDPGGPLGPLRAPVSSYLKAMTLVIAPVGLDGEPRIARSCPNAPVWQARMTCSCLCKAWTEVDVVAVKKLACLTCNVLYTPEIPLHKYDAKGASLRGAAMRRTFKDAYDQDSCVWVHYPTSNQAESALSPESNDDELGECLPRAHAL

SEQ ID NO: 996641 - protein, 309 aa, Homo sapiens
IQEWGGGSRGLQGSYILEGGGESSSMIMSFQKLCLVGRGREVGMKHIENAWEESHPKNGIDIGAKGPMEGAAWILARSPRSIKCDASLPEHQSYEERAEAKKRPHGKKQGGYRDTQRYSPRTYYTPKFTILQGKTIEPSGTESVHLPTDEKGYWSRSEPCEQGTHDMTSWSREPGETKEYSQRALTSGLPLGFAIEMRGQGRAGGQQQDQQEKEQYQHKDKRERRKKQKKHTPQKTRAITTQKTMKKNTQDTEKETQKKQEHRKEKQQKEGQNNKSKRKGNNKEKTRKKRKKQRKKGKNEKRQQQKRIE

SEQ ID NO: 996642 - protein, 429 aa, Homo sapiens
GYLSSILRVLCQDPCAEQELRLALAYSATYVIIRPSVFISRMWTETTWRSVDSKYSSSFLDSGWRDLFSRFGANQMAELNVDDALRVEVMQITSNGAATNNTSFPSVPEANADVAGITFPDETTPISKFIARSLVVAEWWVWLNESRLQRLVRLRARTIIPVGYSPIRGSTVPRVIHAIQSSRPLSTKEGLRAKPSLPPYTIEQLHPLAQSRGEDAPLIRRNYWATVDWGHPWVEQIEMGATPRGEAGRKLRGNTERNNPVSKGKDRSEETGPSRPPKAPGGSGTVPKKVRRGQDGIPGGPWGTKRQWGDSREKRQQKRLPHEIPENKHPQGKQRVVYKNAREERNKSHTKRTTKARKIKNIKKEKRTQTNKGTQLSHDGKNKEEKEQDKRDQKKTREKKTREETTKEKREENATRESNKKKKDDTRTR

SEQ ID NO: 996643 - protein, 172 aa, Homo sapiens
MAKGTLDSDHWKAMGMQRRDNTRPIRKGPHFRRGPEELHRCQRHWGGIRARATHRIPKGVEELYQAPGDRYSHGGHVGWAPCITTRPPGTPGRTQRTNGQTTGGPEEQRQRGQERHRGGVPRRVLGWETPKARLYECYSKDTRRNCCVRRQLPEERHTHKGARQEKLHTSSR

SEQ ID NO: 996644 - protein, 283 aa, Homo sapiens
RQKQLVGNTEAQSAKSKDPSGLLIICAQALMSHSVHACRKHQGTNANRVSLASKPHAANVDRAPGMQLHCTATHTAIDAQPIRTIPERITAAHPLTPEHKHNSQVQREPAFMHRCCCTCKTGMQLREHCGLHRQLQPSSHVTDTCMDATLRHHQARKPQTAANKCNGPDKHISQMPHEHVRMSAVESYGGPPASRMAGLSDLRLELHSTKMNFNLVLIDEIKRHCTSNQTREVVAGVTKEKGENQDPRGKMLDVHMIDVNKLTYYIEDIPDITNHNDNDVKPQ

SEQ ID NO: 996645 - protein, 166 aa, Homo sapiens
MQDDNEKISEKRADITNNKALYQLTRACVGAHLPHYVGGGGNHCGLGNVAAGNTKSTVGEPEITHSLWETTTNHKSRALRRAHSINPKRGRMREEAKSSPGGATQRHFSTTSTSQGVGPPSEDERRRGRAANYGGHDREKLAVRNRGPRKNRGCAQHSQEEGPLGE

SEQ ID NO: 996646 - protein, 118 aa, Homo sapiens
MGCGASRAALLGAARIGCATIGCSNLDSYGVAEGMARKKRLSSRILLSTVKIPTIGDTGHRSPICSRVTGTHRLLGIQILFIYGEAADAQPLLNEVYALDGCMNADGRAPETCDKEAT

SEQ ID NO: 996647 - protein, 291 aa, Homo sapiens
SCINPGQAAAIASSTIMVPFGLIFIVFAYHFYRLIWISHKTDRQCQELKLSWREFARYYRSSYGTQLEGNATPLTPQVEQLMPRSHVVLGPFQVAIGLTPFPLEPVSLAPSLTEQTCAGRLVLQSKVRQKHWTANEGCCSIYRGILACTYMNKLDPRKVRYKQLALSFSRLQGPPSRVMVKAVEGGQKVGPRSTSDGGSRSSLTLMTICPSMGVSVRPVHDADFNPSTSPAPKQSDAVVQLWWWCSTSQIVPSLTVSPSIARVRCVSLGHGLRAHTWIMGEALRKKIMPSL

SEQ ID NO: 996648 - protein, 628 aa, Homo sapiens
MGPRSRPDSREGVLYHEIIDIMKCREHSRAWDTPQVSQDRDQCRQGCRKVCILANVIPRKLERMLRSVGQYFHVFIRFNGQLFAHEKTDTTKRNAAQYYTVGATTPDHSRRPEHCTRMMEGIRERKHIISFVLGDRLVEDAFVEFHLDVSNCGHRLTCAICTYLERGIELASKYGVYFGKRNPVGEATSLCQKPLCKVVANVPTPRLTDGLWRLRLGRPLVHRTTWAPLSVGHKGTVGFPEDNSSYCNLFGSRLGTLGRGPKVGILQSYIHRVPEADGNQENFTPFSQQPRPSGRFTDTCNPPRVATPLIGGKDEVAAPAAQEQTQPCGRKHRPLLENLIDGPTEELGAFGVNNRGESIGGPLAGSHIGRGLLVAVSPYWRRAANVGETRGTHSETKLPSHSYQQNLTFPTSTPPDRTNFHQRVNILSCKSFPTRLAIRTPRVTFRKRVASPPKRRTYFSPPQRHTDLGTCGPPAINHRGFPLGGLFQGVAQWAPLTLGSFVSNSNPTGAATREQGHRDNQPWSNEADFHTCGMLPPPMAYATLQAPPRDATLVDAIAQSLHHLPPGRRRKATSVHFPPKRHRVTHHAGKVNPRSCCTETRTTHSHHADPTADTTSPAWSPLYHTTAT

SEQ ID NO: 996649 - protein, 210 aa, Homo sapiens
MVWNDCWVRASCASDARDRGSGRVVAELSPAVAVPEAPPALGPGGSDVARAALALIVSVIGDEEDLRQATRVDRQHLDELCRMCNEYKDLCVAPEAYIAWMRRWRVEAAGSTVAQVRPGVCEPPQVGERVSCDVFPDIETTSSAFIIVAWGGIVRLPLSCPDPRREEPLQTRGTAGSSHDMSPSPQNERPFRSALPTTQETGHTSWRTIA

SEQ ID NO: 996650 - protein, 104 aa, Homo sapiens
MQKRQIGKYEEVARKWVIIEGDLERTEERAELADAPVCREMDEHGLELMDSDTLTVVKKLLLYTKQYFSYRNTKIRYEERNARVLTDSYSDGGRDPWLRLLRDR

SEQ ID NO: 996651 - protein, 264 aa, Homo sapiens
FSDQCYHFFGELSWCAVKDYLVKTCLSTDHDGSSEASKQDSLAPLPGASPWAPDVAQIVLTIHVTHVPWNLYSARIAHSAVCMHLFMLNSLWMRRVSCTRSADNTCMAISRQCRRYVVNGGGLGRQRELASRMDAPARRQLATCLWQFGMEEAHRTHILVPSGGRLPRTRVGVRFGEAKATLGRTLRTPVVGFPRPYPLPIQQGKRVGGKPWRVGVFDPRPSNFRGPVNPPESRYGGLGLITGLQIWVHPRSRHRGWNRRPRST

SEQ ID NO: 996652 - protein, 139 aa, Homo sapiens
MRAQIGLEGCSPEATEGMIWVAKITPQVTLIRVVHSSTGCHLLADLAIPWTQSAPVASHNYLTASLPFCQPTTLACHLHPLSSGAVPSQQPGTHLALGLPALCPWANAPRPRNRFSACTSLLLHILPHPCPPPRSHYGV

SEQ ID NO: 996653 - protein, 492 aa, Homo sapiens
MRVEAAAWCYGQRLAGSASSLSLPQQLVGAMAAWWLAEVGCPHEFLSCRTAGWLARRHSPTAAACGPCTAPWGPGVLECCLPGPDSHRGPEGHTTSRTTDARPSSHLVDRRPDVPDQGPHSRRKARHIVKKVVDCSVHWSTWPIAQVTFDLPYADRSIVNFMGPSLLARNRLASSLAPPGEQHPGGTSPSPLAHHRRPETAVGALYMDRPTTRNYGDFRGERSGSRGDSHSLGPAQQTRRVFKYWPTGSDVIPFGKFPQTGLTTTPCVHKSRGRNRPPAVRNQLQNIHNGPQSLMYTINGTHCRVRVLPGISSCGTEGTLNRDNFRRGPMHLGPGVEAMCAPQQVVHRLAMYQNGLAKPCEQVSYASLKLDDKPLWHAATHIVGANAAFDDTGNTQRWDNQTTERQWALTARIQHTSGRKYTPDTTTTKEGPTSPPAHTLTSSRHDGGRKDPRKEPPHRQTNDGPNDKPTPAPTAQQPSPTTAHHHHNTGQG

SEQ ID NO: 996654 - protein, 108 aa, Homo sapiens
DSPPRCSVESWQCPLWQDWDLVQTLGRQVPHGASSTCCAIAVTEASSRSEDCRYASVPLSTVPGTIFKQQQHLVIHITQMLTIHANMSDKDSHGSTRQQHRRIIRIIL

SEQ ID NO: 996655 - protein, 321 aa, Homo sapiens
AAVNLPLERDAESFLLKSPIAALIAWTRESSIIIPHVNSLSDALVPRDVPVFIEGKRDLCDVNYYAAAIVRSPLRSSYHMKRQAYNGSSIPSRDRERSCEAHRHYLAACKPRRRFNGMTLQDRSTVNDSADMELEEAETGEEAHDETRLTGPSDRGLDAKSLHTLHIAIIRGREAMLTLWAMPRLRACLGRPSRCMSHEEADEQMRVVLTLLMTASTTISTLMIIANQYNTNTSAGRTHNPLSTRPAPRTIGRRHQRITALEALRQDPTQKTTGAQQHTSTVTTHPTGKGAITTGYTTTDTRGAAEHPSKTSNPRREYPEH

SEQ ID NO: 996656 - protein, 217 aa, Homo sapiens
AGATLGGQRPLPLGGLAGDRVGPWMRSAMLADAPQCAQCLETLPGESGVPDFCSAGSYVASEVGDGMESGCTVSHFGPECAFLRGSAFPCGCNRRALSCVGPASLRRLGTLSRSPTALTDAALFLIRAGLVSGLGRGYSTCSPGSGTLTQLVYRRLLFPVPTSKTSLSACTNRQANRLDSGTPLGGLASHRPRLVSSQGATVSTSQAPAPNSSSLGP

SEQ ID NO: 996657 - protein, 618 aa, Homo sapiens
ESPWRLGPCTRIHENWRAIQGVIIACFSTGGAQVTRCVSGTSTTSDFGAKPTDTPGSFSREISVPAQAPQPSRQGCMHGIPAVLLQQTTTNLPSRHAAANGQADCWRASYIHRGQSRPNGLAASMVLLPYVALTYHSSTWIAHSQDTRITREEMIPATNRYVSPVQLDNANETDKHRGHNDGQATWHKSGMGTRWQGPATYPKGELVALTHTARYYHLPHHGTRKRHHYPPSRMRSTRHTEQLEPHSGQPSDTTVPAHRTRASRGDPPPAAATQHSRHCPQLTQHHRQRHSRTRHTNHYNSAGDPRAPHHPPHETIQHQNPGTSRAIHSKTTRTTLGPPLHNPSTGTRLNRTTQRGDHLATFSQREAEHNVGATAPVSQGYSKATQSNIGATPKRTREHGRRNAHEASSAPPSNTHTTPAQHTQGAKPTTHRYTTLTEKQGNAPAHQTPRQAPRHQAPTAAGRTTPDRNTTDTPTAARARSPPGDNTRDSQHPKQLAQTPPKFTDTDARMTRQMEHTRRQEDPRQSHTTRGTDRTQHTTAQRIAEKRAKMYTPGGAAHEHVTHDTQQRGHEDQNTRGSTPRTHNTKRDTQPTRTNQREPTHRYSADRRRRQKTHSHRR

SEQ ID NO: 996658 - protein, 153 aa, Homo sapiens
LSRLPDLTAIDASTAVQPKGAPQYGTVVHECLDDSTAFRARDDYGARPEREEQSVRDSGIGGDSSCRRPIGTRELPDRALKGIVHHTRYSHTSVDNNAYRPGHPVTPRDSRDIQSKKALCYLLHIERHPGPKRFHFGTGTHGMLSYTALIDTP

SEQ ID NO: 996659 - protein, 301 aa, Homo sapiens
MLASMGSVDRLSVIAHGVSASDSMHVARKGSLCDPCWLGASSSSLVLAGSVIVPCHLRGPRSHPLCLAASKLHTRGETGPKSVLKERLGGGGPAVRWTQWTLAREQGTGRRTSGQIMPGKNAPGDTHHRRQGTRNTPANRHRHTNPKRTKHKNKCPNRTTGTTKTEAIENKARRTHHADKRGGVTIPSDLTPHGDRGRRTQGHSQSSGPKTRGTNHERTSEHETPQTNTRRKKNITNKQRDTTGANTHEKDHEEQTRHTEIAAQPARTTSTKHKHEARKHEEARQPIKQHTHSEQNKELQR

SEQ ID NO: 996660 - protein, 174 aa, Homo sapiens
WTYMRYQVTAPRVNSLRVHLERLLCLRSSRLQLFVPYSISLRGRTPAHSPDPQQPARSTPKHSRDGLVSDPGTKPQAYNLPYGNVHVANEQPDSVILGPHMSWWQVVPKLITNCSISILLFSALSGELVYPFKDEYTPGASEHTYVVAGHTEAMNALGFWPNGHRGESISSLEC

SEQ ID NO: 996661 - protein, 467 aa, Homo sapiens
LYYVYMVAAWQLVLYQVPSQVSQQELTGLAGWPGHIGHFCLPVMCLTTVDSSCKADRSGMIMVFVPSTVTAYHVLYVFTHYCEIALTDNWLPNHGLVQLRQIRFMLTLSLGHDLMPLAAALFEDHFSKDHCYYILTCPNGCPTFLLPHLAYTLLAYSSRCASSTRDYLMTQLSSTGNIWTHELSRKVPPTNEPPLPWAPSIPTGGERALQPGDQLHHECSTAKIVVHLRLTMYTNIDPSSTLTTFTALGAQYRAAEHASHIRAPGRQRWQTSRAKRRHTVPPTSRKHHTTHRNTHTTERTDHTQDTNSAAQPHTATQQTPLETRPNQPSTCESTQRATMHTAHDTQQTNKTPSRTNDATHTFNLPPQSTCHTRQGYIMTHYTHHALDLSHTLLIHITTSNYSPHLSSYNDDTTTPLPPTTQSQPLTPHRHIIDPPHISNSLTLILITIDKLLISEHQHINNHTATIH

SEQ ID NO: 996662 - protein, 405 aa, Homo sapiens
GLSPGHGCSLQGWWCVHRSPVTASCLPVGPACGSEWNGVCAPCPMCRGMDASVPDKCMKHPAAPLEPLARCPCSQKSRSHVDRGGRILPKHFLLEATPDVLPVRLAGRELCLPRGYPLPAAGTWECWRQTVSIFPTFIARTHPDPTGWAFAASRAVLAGGVSVILSYAGVCTWLYSHILCTPAISQAANAEKSWEFATGHYSAHQSISRPWRSTGTHGPTPNNPAKSIMYTPRCTRRCSVNPGCPNGPPQIPPDLQISLGDEAWRLHPPTYALPPNAYRGSRASRQVLAASSPSWLASPYACSPLGKHLQHPLCTSPFMRAANEHTTLPTPHHSSCHSPHPLATQLINHTQPQPTPTPTHHTTSTPPPTAITTRQYTQTLNTTSTTHPLLPFSTLSPAVIISPLY

SEQ ID NO: 996663 - protein, 414 aa, Homo sapiens
YNNSTKVAVKTLKPGDYVLCTAFLEEANLHDSTLPAMHTCSVSALTLCVTQWQEPHLHHPPEYMAKVPVLPSAFPCTAAALHRCAHSCLLSHTASIFTLFLASSICQHGQHRPITIRQRAQDTTNYNLVNLDDARLNLYPRILPTVTSLVATHFGTTLSEAYCYARYTSERLQLHRYPPCHKRCTRVALQSFRTSLYTLADRAHPMTGHIPHFMELANPPTLNVLHLWSGPFLGTLPLPSFTHTKLMIRPLSCRDTNIVPTNSPRGHATPYNVGAATDCNPDTRTRRSPSGRFPLSNLVLPDGLLGNHAASQLTAFHYCKHIYVGTNLVCLGSTRQSPGPAPVIDNLPTRHYARLTLTQDSRSLANVNLSNLPSSTCDNSGRQSTTRHILVAPYRPTEGTDDQSHHYCAHACYM

SEQ ID NO: 996664 - protein, 321 aa, Homo sapiens
RLRHERVTLVPPALSQNSYEPAESSLLLMWIGHVVHRQKWDPGEPAGLDSRGREATSDLAVMGSVLYQKVTRYFLFLFNLIFFSPGAQCSWAIGVWILADKSSFISVLQSSSSSLRMGAYVFIVRGGSHYAHGLPGSASDCRLRRLRSPAVGCTLLSCLLILIDQVTVGDLYKFNMGKLKQEHGPGIADLSFIRRSTHTQLAERQSDDAWGLTMQGSAVKCCGPGSAFYKRGQDATHELMALALKVQLPLVPCQSVTCGIEEQAALLCAGMGSSALPWERGIPNRDQLYGNMLPCVTQVAILWELVPVFYTGLMTAIKIIS

SEQ ID NO: 996665 - protein, 126 aa, Homo sapiens
MGLALYVSSTALLACTVAYHSVRELPGWCPRKCCCSWVPCPDLGPPLASIIGKGGMNIALGVLAWINMCRIALGAGYADDEWPMCRLCTLARLIHNRWFRGVPGSCPGLDPSANLAAMRLSTPHHT

SEQ ID NO: 996666 - protein, 272 aa, Homo sapiens
MRSATLLLTACTPATLHLTALLSVAGCDWARTLCVVLLTSRTCTVLTSGPWVDPRNRCRSSCVACWFYRGDDGRLAGRPALGPSPAATTRLTAVDPRHRTQSTPGCYANWWLSKMTQCKATPSCPGAHNFPVAVTIWKPGNPQHLHSGQGGKCSVPVVRTVPVSGNPFYRQPTVPISQPFGLTATPNHYSDPKILIPDDPSAAYYHSPQFGTWSAADINRVDVTPRTVAPHWDYHLARHSGHTTHTLASDYVECAPFLITPLVAVPSNMSPL

SEQ ID NO: 996667 - protein, 247 aa, Homo sapiens
MAIHSRKTIWLQRASPLIQGTPIWVGSSSRLLMQHFGFIGRLFARDDSRNAPALIHGRFLGNPRKQQLKPLRAIPSVATRAFLCLLLVWWDSLSRQLGLLLARSVFGRGFHGTTWLAPGQPPRARVFLPSEPLSKETPRAENHASHRQRPVHHGDRDRGLSFRTAVTLFALAMTTYHGERAPGHIPSISGSQIVACTEEITAAGKHPEDEDHSPGLALHAVVPIQILTTFKAFSRRPSYPCSLDADS

SEQ ID NO: 996668 - protein, 237 aa, Homo sapiens
SISNFEEARTSYGTDEDILFVYLDRMTAVSLVLPGPSDPITHHQTVALLMWLPCDPVLGCCLVCLEMWNMQANQTQSWTEVPRNIRRTGTACFVLPDCRVFAHCHITTNATCMRCWTRIPPKRPTALTSTLLPHHVQCPKLPDKWPLFALLTHQHPMRNWYSPATRRRQGTCTHWQQAGPLRYGPDWPPRSADQLLAELILGRHSTIAGPPRSSLSPRPDPPSPGATLILAIGNDST

SEQ ID NO: 996669 - protein, 111 aa, Homo sapiens
GQGRPSRATDTRPRVPVYTTSHRGAPPRTPMGADVMGMEFRRIPMWAHEDPEQERHSSPCKYTQSKHGIDQPTWYDMEKIWHQEPFYQMTLRCGFPAGSTTRACMNQRHPL

SEQ ID NO: 996670 - protein, 251 aa, Homo sapiens
GIFSIADSPCRICIPCDTHRGLLFAASHSGVSMCPWPTACLYRESVGTASLPGDPYCAWSGSSCNHVNLYQPQLATQAVDPWTSREPAPMDLCTRVCGCVPVFCTNRGERHVSKSSFQPNTVNTLAVRLLSKLATPTLATQRGPRQCLRVSCARCYPLGTLLLVGTQTGWGSSRCWSLERGLTRQTGSQHTAQKVVHGRGGRPKQDDGWKCTPSLVKNIGVYNAPSLLAIGSWAVKTGLLGKELMVKVHAL

SEQ ID NO: 996671 - protein, 279 aa, Homo sapiens
MPCCPNQCIQSNIACEHALETVTVAPQEGPPCATNNTGIGKLLGNFWAAIKTGNFVQLRSSREGNYEAAGLKLFTRAGQVGEIPLRQRPRAKHDKGRRPWYTHICCATRGYKVKESFRKRCDTSATLIMSSRTMDQEQNHVYTWIRHTAIELVQQGDITDTRQAEEIARRRSITTPQNYKKGVWTHGAYIQTRYTREQPHAETGTTRATEMRESKEEEMTHQQTQTEQTTVRVPTEGHRGQDERHTEDIDSRSTTTSVDDHDNPTDNTTAETTRQSSRS

SEQ ID NO: 996672 - protein, 72 aa, Homo sapiens
GDRVEIRCVADGNPPPHFSISKQNPSTREAEEETTNDNVGTCVAMEPARKEHMWSAIECQGLDLDTNDIRSS

SEQ ID NO: 996673 - protein, 112 aa, Homo sapiens
MGDLEEEPAGVSARDIEAWASSEQRINGSITRGTALWHSAYRPGAPADNALLSADVRTENLLGAETRINLCNANCDQCARECRGEASFERQPLDGTPLGVKARTEGCDLKIS

SEQ ID NO: 996674 - protein, 188 aa, Homo sapiens
MLRTTPDNRSSTDHIQTHSSDQARQDPTNTSQPIKPLRPPHRNCQTYQQSRNANQQTKDMCYPPTLPTHSYTSSRTTHSTTHPLPQTTPPTTPLPQLPPFTLQRYDSSHPPPPKHILTPHYPYKTTDTLHHHQPIPATYTSQLTPFVHFYPPYHLILHSNPHSSYSTLQNHKHTHPYRTPHDNSQQNK

SEQ ID NO: 996675 - protein, 421 aa, Homo sapiens
MCALRRTAVGPELLLQWFLMLPASWLCAAHCCSFPCAVCGCAVVDAERGPCSVVSAGDVPVVHDWGLVSPVAGNPPVQHPVPHAYDGQMLKKTHHGLLMLASWGYFLQDSPQCRLQSHYFQEDNSHSSSHWYHSALVTLGCRPLPCINGPSENPVQPYIKQTVLYFAQEAIVSLGRGPAEAGLLPGSNKAGLLSVYRGFTCPGNQETVPAVHHRARPDWDQMRQRKRSINGPENVSLWRCTWKLAMPEPHTARTHTMTPKGFVRIQSISRAHFQHAHKRGHTHFTLRTVKVIAQLLYLTNRVKSSCTYNYTHQLHNSRLRVPPILPTTKGLSRTDRLNRERKVRTPRTNTLASRTKSVYLGNSSHVCDPLFIASLERLVRARVQNDRCKSKRYTRVTEPATRTRSSEVVGLTSSKLDKLRG

SEQ ID NO: 996676 - protein, 143 aa, Homo sapiens
MPRMNARRAEKDTVICVTIKRSLYPGNLRQTIVNLYMRAAQLIVYPDNDPKKRAPKSSVLQTLAKRVMCSYALDMDTTCVTNQDPENDLCNGHMAMFHYDPRPVTVYTPNTGSWQCSVYPKVRSIDTSSLPVTRIVPKQASTH

SEQ ID NO: 996677 - protein, 280 aa, Homo sapiens
MSNQVESCKIAVSETSSYPEHVTLLAVPHRPRATSAYDQSEVSAVQLDQAKGALGHTFYALQAFAMSLDSNAVCEVKGVMPKESILGCAGFAHLTRTFLLPDSSEAQGSPELSLLKFTLVGPFHRFLVPIGCSTSFATVGTRSPASQLPRKVLDFALALRCMSRSLTKDVTLRCRCLDLNRVVVMSVCPGGALRGTLWWYHSPSTRPPRKTFRLALHPSDPALAFAISLAYTFTHGIRGPWFSGLPLPHCASSCVGMRVPLEGSVSSSSGDLTLSCPEVY

SEQ ID NO: 996678 - protein, 229 aa, Homo sapiens
RLFGCKRALIRRPTVAGLSEACAGGQASVRTSSHVLAVVRLLYQLEEAEGIDPQGAMVICEQLGDLFSKAGRLSHGQLRLYLEAAAVIADLLVTDRVLQRAIIHVSLDSTLGDMKDHHMVAVSPLLRRNCRLRQLATVLDEAKTWLNLLHCACEEAGDAFTRLLAPCFQKALSCASAGTRVASLQRARSLGSIYHTCAAEAAAPVNAPVEETQTAGAFSVAEDEDDGWT

SEQ ID NO: 996679 - protein, 301 aa, Homo sapiens
GASRMRCLNRAYAAAGPGPRLHVQRPPGGRSLHQHGCTWQPIYNVCEHAGIPEMDMKVSDLTGLARSPAVDLELFRGLGMTLSYLFRGYRAAILGLSRSEKGPLSPRFRGEHALLRYPSGEERCIVCSSARPSGPPSAITIWVLSQELYGKPRDHPSMSINMTKCTLLRLLQEACPVDAIVEGPNFEFSTETHEELLYNRRSSQHTGTSGEGRDRRNIQADLLVSGDALRAVALLTSRPFDLILLRWASAVGRFFLAARGPFSKTRGGGVSARLALGGRPGVPGRLVRHALVPGPSLSRGG

SEQ ID NO: 996680 - protein, 226 aa, Homo sapiens
MAGPLHAYVQEQLSYLLNQLNVARIAGCLHMTVETAVLIETLVTLGAEVQWSSCNIFSTQDHAAAAIANAGTSVYAWKGETDEEYLWCIEQTLYIQRTGPQPMILDDGGHLTTIIQHQGTAVLPGIRGISEETTTGVHKHLKDDGQGILKWLHQGHDQTQTSCNLYGRRRHHNGTSGTHSQNAQDQGPERAGKAPSEGRTDKQKAPQRQRQDPKESTDPKKQQTKK

SEQ ID NO: 996681 - protein, 412 aa, Homo sapiens
MRQPAQGLLLQGARRQLAGNTASIQLFLLLCTQHSSIHITTLTFTHTHHQIHISASRHSIISVHASPQLSLSHRSHLFTSASQASFHSSTPSCTALQHTQSAMQRTRQHSITPGSLHTPCTAQALQHAQLSVHRPGKQHNGPFNHSHHIWSSTQALTSSAPHIPITAIQHKGRDASFKDNGKSTAQGSSIGNSTTPHQIHHITQTAQPQAGARREYPHRYTMRQPGRTRCVQRQDALQAPGTGRDIYTTQATLLATKCPIGTDMQGTQISGRSQFVTTGHYTEHTGTFTPPTPPSNDNHWRIQHLTFGVKVGERDLHNQNFARAKQYRTGSGPLGTNHLGNTTTRHTYTGHAAATTTGTSAHTDRRHTQQHHMKSHTPSSHATTIHNNRTPRNHSLGPARTYIKRATLGQHN

SEQ ID NO: 996682 - protein, 302 aa, Homo sapiens
MKPAEQVFFNQTPSGRSSVAQQPGKWNQYSQYSNDTDFPKFNHRFPRSSIYIPTWVSTHQQPEEWYSPGIYAHSGVCQLRLSTREKLQVAEMPVTKKPRMGASAGRIKGDELCVASGDRASGYHYNALTCEGCQQVPPGTKPFTTQRLVYTVYKPEATGLMAYCHMRTATCPECRLRDNGHIRLAHAWLEWYGIPGLLNPELHTRYILTQTGQTPVPPALHTTTVQLQARDTAPRLRRTTGDTLQHKTQSMSRYAPTLNSLNQRINDADSPIHSTIRTSHNHNHVLVLSTNHTQTSRITDTT

SEQ ID NO: 996683 - protein, 299 aa, Homo sapiens
MTTASTSQVRQNYTPGLRGRINRQINLQLYASYVNLIQVPHYHRPRMTPRPDDPLPQITSIHQLSCTTRTHCPRHPTECCQTHPTARRHPSLPGPIKHTPHPATDRTAPRPALAKDAAHPPPGNHHRAITHTPENRHKTQRHPDPPPTEPAPTQIMTTTLDDPPSPAETHAALNPPHHQTLKIAPTHDHPPEAPHGQAPRQIRAGRDTIPIHKDTNPGGNPRPTRRAHRLRPQQHMTQTVPPRTAGSPYSIGDPTNPTPSAPNRHEPQQAPPTPHPPRQYGASKETHTHPSASTTKRET

SEQ ID NO: 996684 - protein, 188 aa, Homo sapiens
MKPEPDGEPNAFNSRQDMTWSSSDDNTAAGPSSVGGELEWGGIHDEDCMGHDMSGSQVSALNRQAPQRKEPGPEDKLHEQCRPWRKNACCSTNNSQEAHKDVFPTYIDSTGTTVREMAHCLQTGISYQDTCTLRVLPQLAGPGSRQVESELAQHERVLNVTPVPKRTVEQWWRRSSAPPTPERAMAQG

SEQ ID NO: 996685 - protein, 253 aa, Homo sapiens
MLVTEGGVPHTLCHRGLIWPHCLAALSTKWVGSYRRASDPLCPPERVLLISKARGECRILFTTKDCSLVCKSKRNIFYFLFFKTCDQMFMPPTTTFLLGGTSTDMTTIFCRAPVSFIPMITPTFSHATSVLPCRINLVVIHCGRRVVTPMGGATDPLVLGSCAIQTGGVTRSPMALRGLPRTGTSRLGANLYERRGATGGVLSSYEVVHATNSTITGCGTQPVPENNVQDYDWVHLDRYDISPRDLLNVLATR

SEQ ID NO: 996686 - protein, 214 aa, Homo sapiens
MAYLAWRLARRIVSDVTTCPVVQLALEYNSNESQQKDFDEFIESEVTCLWINGSMVNERCTRYRALRCYISTATEGPCNMPKPGVFDLINKAKWDAWNALGSLPKEAARQNYVDLVSSLSPSLESSSQVEPGTDRKSTGFETLVVTSEDGITKIMFNRAKKTNAINTEMYHEIMRALKADSNDDSIITVLQEMVTINSSGNDLTNFMIFPWWSN

SEQ ID NO: 996687 - protein, 237 aa, Homo sapiens
FQGSHCILTIHGAVVINSFHIIIIHTLSSINQHTSHSAPINMFHVPCNPSRTTHLPQPPGPIAHTTLVFPPKLSSHGAQTQVVGTHCINTQFTISSQFTFHRAKSPFISNIPLHRHQFPPLFHYLFFLSSSPALLSTQQSVSSFSQSDSLGTVSGYLVTLPLILINLTPGPEGLPISIINLVQHTSMQATISRATLPYVSDKYTYIPNPITKSHISYVHKPAPAAQLFSHMVKTGYI

SEQ ID NO: 996688 - protein, 487 aa, Homo sapiens
GTTPGMVQQRTLLTLLVDALSLDSLPCTLPDGAPTRDPQTTVTFRTTTDVDTLSYLHTTPGHDLTGPSYDVWTHTPNSDDRHQPYPWSSDCHADYDTCLTTARFDTPKLPDTTWWTHTLTTLTNGTPLTCGRCDLWDDTRTYRPRLCVTRTLPDKRPSTYLTKTTGVAPMTPDRGTNQNHYAFTTSVAVLSMTVRQDGHATHSSFQSHMAKQTSMDVAEQAGHSPSHIATPPGKAEQRNALVACTLSTARQQHIGTRRSPCAGWSPGHHWGATSPIRIEPKHRTQNNGRTVQPEGTLHAWTPTTHNGETPDQPYYLTDSPTTNDRDTQQRGTQHMAGDRQQPDNTGPPKQKTEKPTNPHNNRDQTNPTSTRAKQQAARTTNNNKSHTTATTKVITRNRLTDSSTADADTRPLETADQQHTNPQYTQQQTKPDDINQHTTRPRRTKPTQRHRTATTNLRDHNQTTSKRATDQQGTSELAPDDENENHS

SEQ ID NO: 996689 - protein, 294 aa, Homo sapiens
MVYERGGEKPSLLDGLREKFPRSAHLGGPENAPSAPLRLKPSSAELQLGAVPVYFQPLGQVLDTACRAARLGALSPGFWHFPDPIDTLIYLECQTLIEEVSAGFPIVTDDDVTRERLAMRGPGFPELLMPHPFLEGRDEDLDGAMRAAGVPCDPDQQQPFICVATWTGGNHRDPAFLIPASGHYPDLRDLREPTAPSSSRNAWAHLVPEGFYAATCIPWSRTTLDTPRTTLPTESRSPCSQAKFSDAGQWAGANTHPARPPILHTYTLATSGMTARCQSDTQPRTADATTLETG

SEQ ID NO: 996690 - protein, 217 aa, Homo sapiens
MAGTALKRLSGRDTNKLTLNPPGRNVAGPMNEENLIWNGRHLIMGPEDIWLELGCYSYLPYLSFPLVLPVNGHRQKYEIYLWDVSSQHLTLMGESAFPSSYAQAMTPMGSESSAERWSPVQKCGEDPAVSGEHAGRAQLTTVELTCDASKDVGDDRRAVLLTLRRDRPESLWDWSDLARDRRAPSRLSTISIIPAHLVTVMVCAGTNKADLQNHGTF

SEQ ID NO: 996691 - protein, 166 aa, Homo sapiens
MPGPADCHINLSYLSYGLTPDRDPYDTTTLTAYTRRHVGIVVGYVSSNASGDTPDITVTHTFIHDCDDTQFDVHTWTHTDLIYVTFAIYALLMESTPTCVPQLNKKSILQVPMSAHNLTQLYEAENNGCTHYVPAASVMCLFCRRHVTWNTYNTVHGVPNANNTDT

SEQ ID NO: 996692 - protein, 151 aa, Homo sapiens
MGGTRVSWMWKSYSSYHPDIGASSCQLSLTHSPDQPDLTFITILTSLGTISLGDCVLCEADSNTVYITVTPGTGRWEERDNQSLGDYYRRAHTQSSIQKILVLEPVLPNSTSRTMLDASPSWIALILRIRLHPPLGHVQTCTSLAPLDMYN

SEQ ID NO: 996693 - protein, 413 aa, Homo sapiens
MQARHNRSNRFPKTNARRYENASYPSMAVTNNMSSLKEKLQQQQDYQQTPQFNNPHQHRGHIVFSGFTQCTGRIMNTRLSQGLQLLTKSSVKGSISPNQTIGNGRIILYTQPTHFNTGRVEFHTQNPLKHYRMDRQGARTFCRYTPNQALKDYTTIKHNHRIDRHKLGHHALYIGAELGPPACNNTNARGKTNNQATGTGNDGATNLGQQQTRTESPRRTERTTTNSITTPRRRYTHHLTSPCARQPGEPRDKQHNSRQNTHTPQTCSSSADPPTLIVYQLAQTQLTLHKVVSAHRDRTRGEYDLRASDQTTPQQQTRASREMTNPASELQTHNTKNDIKRNVTLRSHDDNNRRKHATTRRRQTTVSKAREKRRKIDTPSSTKDDDKKKKRDKTRHHRRPLPLECHRRPETQL

SEQ ID NO: 996694 - protein, 192 aa, Homo sapiens
AVQIIPYSSYGCIPILQMGKVRLRKSRWKCTQRANGGGRLDSPVLAGSQELGLSLESFCILEPIPQGLFSGVQGSPRNVSVLLSATSLNPFEAPGTTSKQISWEMAVPPRGQMANPRHLPGGGEGCVTGGAVVEQLVQALLSEGGVTATCALTAVLLGEWQPYRLTTCLLRVERRGLGVSVLNQELSWKVGT

SEQ ID NO: 996695 - protein, 297 aa, Homo sapiens
PGIEQAVSAASTTTSAVSEGAFAAATHSCATHSRLRLGSSSAHTTTIYTTLGQLSRRRSNRSRLHQRETGAQNNERTGESRREENKKSDKRRRKQDKDIKQLTEQSSNPARAGQEDTSRQGQKANRSNQKARMHAQRENEYTSGGREARQQHATEGRKRHNTAKMTTERRPERRHPGPPKGDNARHAHRSKNERDEQVRRKRGTERRRTQTNRQSKEERRADHYGKGRREGRGQEQNGTRRQPAARARTTRERREGRNERGRRADQRKGGRRDATEAARRERTRRASKRKGERTNQR

SEQ ID NO: 996696 - protein, 259 aa, Homo sapiens
MLTRLASRDFACGWENLGSCRDWIDIVWLAMNRISNRRVLDSHVLRSMLSIEVRSHLLATTQTHGHEHCIHIAILIHHVTQSRNIPAIQRAIPTTDVILDTTRGGVVQAARNQTYDRGTREHHNKMTQQQTRRRQLAHKRSSKNNITTTRHTNDSTQRGHYHIEHTRQARHTDRYGGDINPREDIDTEAAHSSNDRDDDHQTETKNDITRRASQVHSIEMNRRQPETEKETRRKKKALSTHVAAHSEHHDTTKADTERR

SEQ ID NO: 996697 - protein, 398 aa, Homo sapiens
QWLFPANPSNFGRLRWEDRRSSGVQDQTGQHGKTPLCCKQLTNYLAWHWCHYCLYSRLLWEADAREDSHSAPSRLNGCTPCPAPLPTDTYKEGQRTRLRLTCHASGRFVTTPWPHTDANPALYLQQYKQSGPGLWLEPGHVLNPKLLPGRPAAPATQITFAHSMGDALAPGMPRRNPHDLTTPPARHQAYGQRGTTRTDLMSTPTDTTHPQTKHKKSQSTNRRNAKDTKDEQTTSEHHSESTQHLKWPCEANNTASWARPNERGTGLPRVPPCGEIKTARAPSNTPQRERSRHSHHNQRQKDKPTHRTPQTRATPRGDPRGAQQPYPSAPAHADKEDRRTLRGNNETKSVDSAPAVPRLRDKRSKDTSKKREKNYTTTPTPPRRGQLVTPRPTRTAQS

SEQ ID NO: 996698 - protein, 429 aa, Homo sapiens
CIYTLELLFSRTKQNEILSFAATWMELEVITHYGDMSQEPEPTNKPSTYWSILTMGTPKTNRGFPCGWHEKRGQWQVRNAPSTKGTRTTDGGEMATQTVHPHAVTNTIPVQAHTVQRRLLPNFAINPPSTRCKNTYVSYTILMVNAYSKKIKPSAPGRKRKVWPVANSPNQHSLQLKADAGQVAMRNKKPTPNPTKNGDEHNNTKKGTHNRSVSQQQNYPKLVTAHPTKNDNANNKNDSGSTNRRTDVTAYTHTETTREHWKMARASTPNANGGNESATVQPHRYRTTAPDHDQGGTRSKTPKHANKESRLINSTDQLCQNRHTDSNHYGRGQDIAHENTRTASNKRRGHKGKADITTNIMRVENGRVQNVLRNKTGKSKAAQQTPRGRNEIETKMERRTQIKQATPPRRNEEKRNKTRKRIETDKRHN

SEQ ID NO: 996699 - protein, 290 aa, Homo sapiens
MRAHTNAGAHECGRTRMRAHTNAGAHECGLHTNAGAPLSLSTADMTKGLVFRNLFQRTQEDDVPQFTTVQESNFDHTLSELATLQQSTSEPYLAPPLQGQGKHSQPSHGLHSGLPHAWLLAWPSANTQAAGTRRNQATLACTGHRKHQSCCCSGVQADSRTGALVCGGGSLLETLRLLRRERCFGLYELQMTLHATQERWLVSAKIYGSGAQDGLADRSSVWILVPDTSGHRRNWMRRTRTANSNMDSPAAFGPTFSRTNLTTLHSVNPQVLINTTVCIGRHGLRILTHV

SEQ ID NO: 996700 - protein, 150 aa, Homo sapiens
SIHHYSRTDYNHDNDMKNHRCISTTRTPMTPIRKINPLIKLINRSFIDLPTPSNISSMMKLRLTPWRLLILQITTGLFLAMHYSSDGRQPPFSINSSTYTRARTLWLADLDHVPLHANGAINYSVSASSYTLGRGLYTDHFSTQKPETSA

SEQ ID NO: 996701 - protein, 423 aa, Homo sapiens
RSDQWCVNQRTMLVVSTADAELRAAKDTSIGRTSTPVSHCKAIQHPSPATTLMHDSQLLNALISRHNQSPATRAVISRHDPLQHHGNAHPTIQHPMPKHATTHCPAPSIHQSTRFINMAAPWHFITTLCSIASAHAMRKLADGNLTGRHSRLFPARMPLFKPCSAQPGCSLLGNSTSDDSMRPTALHWPHRTLYHTPLTPHLTRHLCNGATQGLITHVFTLAHPVSHCPGLDMQMATTLAHHIRPPRDRYSWMRSNLAPRDQQPRNAIVTNNSALTRNLGNYLELASGTVTQLLPHTHTCHTYRSQLLPSATTYQTPADQLTRYLTHTVTSFTPDRIPTQYHLGQCCALKPHCNPPRGHLTPLTLRPHHNRVRIPARESANTDFQRIASYRRTTVINHTRSNIIATHYTLSQPRVTHPTPSTP

SEQ ID NO: 996702 - protein, 116 aa, Homo sapiens
MLAFICPVAIPETKIAVLVPQNAAIRYLLHAQHYARYISPVYIAILFTYIILSRTRMNHNQNTSAIKYFIIKYISNWLIAIKTVRNMPPTQLLSSRRFTAWHPSDIRAASAHMTEH

SEQ ID NO: 996703 - protein, 31 aa, Homo sapiens
MRFNTEVPTRSMVCWIHPPTKGQRHPQSPPW

SEQ ID NO: 996704 - protein, 167 aa, Homo sapiens
MWSHPKFQATNKHSPLSTSPPISSSLPSGNNHGRSSQLTTVKKEAETRPVIQCTSDIMKGVDIHQTLDGRTQNTQSFSHLTVPKVATVISTYGLTLSRSDDDPGLMLCHWRWMGLRCAGNDGCLRITPNAECTSTPHGKPGTRTIPLVMARPKTRPPHRTPVTHNVH

SEQ ID NO: 996705 - protein, 88 aa, Homo sapiens
MKARSPYNFTFHWPRYARRFEMTLLPPWILSTLSSLDNLHRRLSSALRVSQHSPYSSPNSVQPSTAYAIRRQSYDPTDPTITTAHRTL

SEQ ID NO: 996706 - protein, 302 aa, Homo sapiens
MPECPVSCLLAVVFAWVMVLMEMCACVAFLESTWGWGIVALSGGVAGDYHAAAIAKNWLNWCDFIRSGSITCTYVLEAWRSLGNSNRDVAGWAIDTILQSRTVSGDREQWADAGQWATIVYAVDSQEGQGPSRASLELRGLPGAILQYVLLAAVLLSTQGPRLMPHSEIKTPVCCRHHPAEWGIPAGMNGTKFTLVGPERPGNTSVSGTTLDRRHQMVLVSFDPGSTACGHANDEMWLARREPLSCTGFACWHFTRRPTLGSTPTVIGGRAHNTAQTKTKTLKMTHTTTKLEDPSDHDIVVL

SEQ ID NO: 996707 - protein, 133 aa, Homo sapiens
MLLMVSYPILRSPCSLAVVGVLTGLAVIPEAVNPSRDLGTGMVDKHSKVRSDYYTNHTSYVVMFSMKLPHYQSKYLTIFEYHAVCLVEEHEYSYYTYVFMKFLRMNGINHVVRTILQISWHDFSRVQRRQLAS

SEQ ID NO: 996708 - protein, 146 aa, Homo sapiens
MAKSMLLVNAVSIRSVVRSKIRVSSSFRIYAMIIVSIVLLYNVEILGTWLHQYLNRLPLVPYIPLLRDSVVGVPEAKQGRYVFDTAFPYPKRSFPASGRIKVAKDADEIIAGNAHNNKRRKPLIGPMMGPAKAHHTIHKGQRTPST

SEQ ID NO: 996709 - protein, 601 aa, Homo sapiens
GNLPTQPACKAQHASFAIFHQPACIPPATAAISVGNPCVLFAVPQHTHAHSGMHSTMPSSTHIAKGSIAHLICNTCLFIAHTHLPPRHEHHTSVAHTTHDFLHVIYEALAANGYINTLTGLADSQWVHSLIRWLGPHLPPNTPLGTFFLAQSADGVGPIGYLHHATHTIPQQHQHAPLVNIYKVHNRPFHTRAFYERPNRCGSHAIGGRPQPSTRVAPQGQHATNTRQDGPVGGTTFPSTTTQLEDTAIMSSHIADKDQHPAQEDTTQTTDANLTGGDTSMFQPTVGKHEAIQRNRMAKRSSRQRVHTQPGTPLGRPTDLTECHKHANRNQWDDITTNGGQPQHYQVGNHNIHTSAAPMSTDETAPPNTQQDDSHASRESPRTTQSQREWATQQTSLHKTAHGGIFRDHTHVGQRSTSTHHANRQAMDNSRTRSNRQHHSIRPEWGHKTRLWHTRQQARHEVCGSTHSGVFAHTHEGGPVYIGYALTYTTGINVQTRRGDEYTDTAWRLSVRSSPHEDNHPPKETTEHSSSNTMSRPIAHKEQLTTHGGHHPGMGEQHMSRATGRMHKRDNHPIALEHHRRATQQLDQLTQRKRTTREEEQ

SEQ ID NO: 996710 - protein, 74 aa, Homo sapiens
RETGVRCGPNGVTVVGRNPEVVPEMVSAHRSMEIVAWQWYSMELLLIGLALLLHDGKLDITDEFMTEWECVHHF

SEQ ID NO: 996711 - protein, 230 aa, Homo sapiens
KNSRLYTTTRRPQRVGPYGLLQPFADAGRELFTKEPLKTRHIVPSRLYITGTGHLGSHTSIFYYETPPSHIHQRPQGQHIKTRTVANIISRPHSGTKTEGRSKAILTQGLRHLREQIERRMKKDGKSIRKGRRDRPESSILNRSTRTTIQNPHLEKQQDATTAEPQCKMRTSQTPLHHQTTPTIRNDRDIPRQSTNRRPPWRPTHKSNEIPQKLDRDNRQQRRTNPRGKE

SEQ ID NO: 996712 - protein, 350 aa, Homo sapiens
GAGCTAPSSGRPGSTINFSSHMVQYVDYLVKATGSEDTFLCNGHNQADRPVPAASPAASPRLPEEWVTNRAQDKLASGDQFTVGALQLDRSHRHTGPNMQQQHRSCMAIAVICTFFLKPWTKDILINFPKGSGLLTPLPCHIHYYHIPALTGVNDFVLRSSRTGTLDKIPHLPRAEQFQCYSISETLRGQAVDPHIDRHTDWHTYQEVAEPPHARGTGRMRHNWTQRRRHILITLGNTRTQPDMLRGPHRTPTTGTHHDAMQRNHEAHSQKDFKQKIGQTNTQGIGRSMTAKPKTQPSNNQEPSGTSPRGHTRGSPSSTRAPGEIAGLASNTTQQHTEGITINQRHNEEE

SEQ ID NO: 996713 - protein, 136 aa, Homo sapiens
MPATSDLAPNMDTVQRPEPMSNIHNKPDTGPTQQAVTERARQTQTHKQRMHQRSPTYTQTHHPTTPKASHPNQTEKQNQHQQQAQTTPIRNPHNSNATQDPTPPTPTPPRTCYKHTTPQHNPPPHHPTATDPPTHH

SEQ ID NO: 996714 - protein, 428 aa, Homo sapiens
TAKFTAHIHQQQAHINVSCNTVAASIGNHFFIHSSHISSSFIAQTKHSWDPGHSSTAPVVPQHFEGNNTVIFQTTQTGERHTSYLFRAGLSFTLHQSTITSIIHRHTSRQSIARNSRSLTPPACQTNLSHNPQCSNMSQHNHTNIDDHSEGYHFTPSNMYGLGPTFHKSPVKLSHFKTAPSKMGYRPTANDKTSTIPIHALRHFEPKHRHIQGIYNLGKGAIMGKNRHTANKHTINKRTIITQTKIQKMKRDDKIRPKALPHVRPGESEDQRTCDRLYNYAHKTTTMVKEDTTQKEENQGVTKTNQLRRKPHDRGGPQITQQRAQYVGNRQVDATAELHTREGTTPSTTTSQRTKKKSKHNTQENAAKRSSTADRHPHPHMNPARSRTWKHTESDTHTQNHNGQNQQKVDHALTNKKVKNKQGTPHTP

SEQ ID NO: 996715 - protein, 430 aa, Homo sapiens
MRRAGLGEGVPPGNSWAHSWLMLHQWGHQVPCCKHSTQCSRPPLQQSAASKSQLLITQSSFPSGTHQGTIGKAYRDLKQITTSHLDLSHMGISTTLLEFPTKHGHCLRGQTHLIGANTLSQESDAIHHSRGQARNLKSLAGWHSSWHRPVFHFLHPGSFSLLIPFSCGQFTSTPGGWHGHGFTLSVAPLRGTHLWMPQTFVHLGFWPALITLFWDYTHPIHGNPNRTHYSLRLGSHHINSGGAIFVPSVDDQLWVWNIVGPLRSRNIPESNQYTLTLYSKGGAISGKITLVAVKDEQHHMHQGHRYIKVTGGRTSCNNRGTDKHTHQQPYTSDVGHSTTGTRATKPHNIHQHDYIRNSMCGALHITGDGVNEPTGVDDNLDESTALHPTVPAAHIDYCATMEGTLSHMRATAEVDIHIAAPLMKRITDYV

SEQ ID NO: 996716 - protein, 187 aa, Homo sapiens
MDPPISTLRRTQGRPYVAKANIDGNTWGPSRFPHIARSTDQRRKEAPLREVTPHSLQREHTGGCSDPSYPQAKANNVGAITREHNLDTLVQTATGGRNNSTPRLPHFVSPTIGNNLRTAFGDYNAAFTTPFGDCIYHHFSITHSAINNHRAIGGSPAPHMRTTPTVGGTCDFFTIPHTVWGALRYFA

SEQ ID NO: 996717 - protein, 458 aa, Homo sapiens
QLWAHPFHINRWPSANAQGGMAHKHSSKQTVLHKQHSRHQASGAVWQAHNSPCNGHAEGTHNQLCQHSSTAAQGRCQGYPTTIQGQAADLKAQSIHTVTPCHTQHTSPKHRHAQGSTQQPFHCITGPHLISVQPPLKPSAHNLYQAQTGGSHKQAQHTPRAYYRKHQHTPWCRPNCKSHYPRQIIGRMRGHRTAGNATHTYARSRSSPMGHTLAFSPTTGSSKGGHRPMCWRSPASRAASLLPTKPKPQTATQQNCTIGRDNTRRHRPQHMERPTSNDYNSYNFRPFQTPTRRGRNKPRPTQTHEATTQRTSGRDATGRTIDTNRTGGGNTPALGVNREATTTQTQRGLVAQHAEGGNRTMDTPAPNGGASGTNRISVDSPPQLSHIGYTMHICTNEHTRQSAGGDSHHQAKHRHPTTTHHKPELTTEDGCPATTRHHSAVPTQTHTAASSEPTTPKA

SEQ ID NO: 996718 - protein, 135 aa, Homo sapiens
ARHFDHVNFQPRHGQQMISTTPWHLAANHMQHCIAFSSLTNCPASFIMVPTSHHSLHSTHSFSVSATSNSELQSAIISIIFQHICNRCIINRALSLFISDQAPIYSSHASILLVFIRNHHITISVVIVQQHITIQ

SEQ ID NO: 996719 - protein, 133 aa, Homo sapiens
MWTLVGNTRGTWPYITLVGIKPFNNANAGDLPMWRQYFLYKPNCDHCGHAGHHTRSEPQTELDKQENTVESGPKRDVHKNHPERMRQENVSSKQHARQTKNTNYNHEAHSVPQTSQTVFENAALAPNVVERQT

SEQ ID NO: 996720 - protein, 148 aa, Homo sapiens
LPAKNVCTMAGMHFHVRMHAGKALTHHGTSLMHSISHTTAAQHVGIMAQHHSHIITVTHTSHSHTAQHRTPTHSRPYHKPSISPHHRVYNRHTIAQGLHTHRAAHRRHFPHRPTVAHTHTSTFTEASPTYPTDIGTHTTYITQGTTWQ

SEQ ID NO: 996721 - protein, 414 aa, Homo sapiens
SSTATQSTHFKSNIVAQTAGCISSHVLVITAARGQAIHNTHSSSTISQHNIIIINSNRSHHLCVFSHRYVVMHRAPPQHMSPTEQHNNTHQRQPIYSAAVMRYKQTTTNETKTTKARHQRIHQPKNPTIIMRYTISNNNNTMHTSNTKPTPANYDQYTTTNTKEHAKRDKQRAQFRRRTLNIGGQQGRERRNESTPAAYQGAPHLLLTPNENHRNQRGNMLPQHTGHLGYTHQRGHPKNERTYRKSEPQAHQTGHNKIRIYTTNHTEDTFTAAATRNPFKLTETTAYNTDDSIHNKMYSTRPMKFTVSVTPYKDKRIISTPRRCAKPQANTQLITIQPTHTNTTHTQSATSIRMLIRIITTHIPYTLHTTTLSYGSIQNIPFYQQQTHKTKKTYNLHITTKLYYFNNITTLHTT

SEQ ID NO: 996722 - protein, 143 aa, Homo sapiens
AAIIHCAFIHNQCTAHHAIILLHSSSSVPAHGPAISTATQDTHHPANVILIVMSIHYGSICTTFNIHSFTFTSQHTSNIWHQHTHMYFLFLCSSAINHTSSNHSTILLYSNSSSHLSHSISTQLCRNRQPRHTHIISEIKHIH

SEQ ID NO: 996723 - protein, 47 aa, Homo sapiens
MGETVARLRAPGHETADKEIKRAKRETEPDNRPTSTNQEGTTHEDHH

SEQ ID NO: 996724 - protein, 145 aa, Homo sapiens
MVRQAQPIDRHGRYLADTRNTRWDNRDTHTNDHPPDSTDRTPQANPRDTHQGTNTVTRTIHTQLNAYLPTIAHPNTPTTTSNQTYKPDKHTGNNIQRTPIVAPPRPIHRTQKLENTNEHRQAMQHNTNARNHTQEHKKTTKQQTT

SEQ ID NO: 996725 - protein, 152 aa, Homo sapiens
GERVASGLPRLHAQGRRRNIILSHPPILRSVAALWCIPLLILFCFFFGFWRTGFRFGRPGWNCSAANLGSREPRASVDSNDIPCLSFPSNLSSSLYPASDSSRLRMERGDTAGRERRPEMRVQGQHRLLRELSPGGPGRGIRTPCRSVTALL

SEQ ID NO: 996726 - protein, 36 aa, Homo sapiens
NKATNNKPLGRKRYHNVAGRPLSERSSAAKLVARKR

SEQ ID NO: 996727 - protein, 73 aa, Homo sapiens
DLQTLPWRMPEYRPSGVEVFGCQKEPEERFFLMILCNITNSTVTYGKAAEGMSSHDKAYGFGVVKIDLINQVL

SEQ ID NO: 996728 - protein, 258 aa, Homo sapiens
MTGHRDHIKCGWHSTKRTFDNTWKKEAAEHGERGSFKYDLGSGITLKAERDRGITMDISLWTIGDQQVTMVTIMDAPGTQKNFIKNCDFTGTSQADCAVLMVCCMVSANLKAGISKMVADPRACPSGFTQWVGEHNYLVGVNQNVDSMSAQPYSQEEILSRKWVTEKVPRTYHLHEHMGYEPPEHKMKQFWVPHYTGVATLACNHNFAGSPDGAKPIALGIQRRHVEKFHQRIESDVTTWPWCNHNDGLERSSELDFT

SEQ ID NO: 996729 - protein, 117 aa, Homo sapiens
MKLSCTRIASHSERYLLTDSTEDSLKAHVEARIAGSTSTLPQLLLSTRRRSGIIRLTLILKAPEKRHNQYPFLCTIPMRHNDSSSICLRKNRPKSLMAYSSIRQIGLVVTGILIQTP

SEQ ID NO: 996730 - protein, 106 aa, Homo sapiens
YITQQGCQKTYTVKSRKRVSGTDNDGKHELHSSYVIIVTKRREVLTTGQPRASGCRRGVPSYNSLENPLGIAGGPDGDVSGALKDITGCTLGTNKAAARTLRGEHK

SEQ ID NO: 996731 - protein, 113 aa, Homo sapiens
MRSYTSLRHDGNFGSPPWSRAVSPPEVDPMRHYSVCAVHVVTRRPLIRQCIIKIDPRSFDDVTLLVNHPLTFTPMAPQYSLSASSYTSGEAYITDHFSTQKPETSALSSCLQL

SEQ ID NO: 996732 - protein, 300 aa, Homo sapiens
GQGMPEPARDIDGNSQLTFYLSFFLETECRSVWPRLECSGAVSAHRQPLPPGFERFSCLRLLSGWDLQACAQPTLTDFVSPVETEFLRDGQVGSSNSQPQVTLYASASQSAEDCSGLELQNSGTSLITFLDENPLPSSLRKRAELTQYAPTSNYPSQGRSQVAELHDNSYQGPANTGPNLTWTKPLSDSLDTYARSRPLKRNGHGTPDTNYRPLTETARPTGWTTTNKSQARHTAKTMREQQHGPPALERNITGQQYNSAIDYLHKAGHTTQRPTSEAPASPKKHNDQACKQSKKKCQNT

SEQ ID NO: 996733 - protein, 122 aa, Homo sapiens
MPRCISPYCLIVTHLLYLYAIPITINRRGSKGIPCSLSIIDSDSGTTRKWYLDAYGVDTDFGAGRKILPISLHTFPRIYILRNPGQNLGGHPMWPDLTKLRKYKYFAEMGKYPSNFGYLNHS

SEQ ID NO: 996734 - protein, 288 aa, Homo sapiens
MQFHAIDGWPDNRDVLPLPSYEYKFRQDAISNPSLILAAVTMIARHIAMAACSGSEADLLRMGQGYAWAGVIAEDQGIKKVLLDEHFLVLFGSMETSTEDSGPSIHRSRRKGSPCDQGCDGGLEPGGVQSSSTKEAGDQLGPEFFMKLSSSVGRKFRLEPELEEQQLESTWDDDVTSSSFAQACGLLPRRVLTLILPHKVGLQSLTGACWQTMRRRRRMEPLEDPWGTTGVTKDRQVVQGSSVTQTVVIVGLFRKQGRDKCMGRWGFLNIKPGSGKLVYEGHVVHVLA

SEQ ID NO: 996735 - protein, 410 aa, Homo sapiens
SPRTGSREERARSDLSLPCSFCSPAWDGRIPAGRALALQSLKARGRACGAGGPESPTRKSSLWATCECRAEGPGRRSAHSCDVVRVPQCWGRERHVPHRPACRGTGGVNGATKGPAGWQRFRLPADTPQTTGSQFPGPCGQMRRTGRLRHLSTPDRQWATFELGPGGQTAKVYVETGNEGIARPMARRQTPRRGKIPRATGAGSQMENSVSTRGTPRTRGRHMAPDSMETHLDTKQPQDTPSSARQLGNTTTDGGTPLAAKRKNTGSREPRPNEKKGKGTADEKTCDRRPPQPNQQHTSDAAALKTEARQQDRGKYQGQPTTHNRQKHTHKQAHPQSLHVRAHRNRHGGRRHNQTHAANDQHPSTLEGQQVGDLQPEGRRTRRTTRTRGRGTTENNSTKPVHRGTTRADK

SEQ ID NO: 996736 - protein, 309 aa, Homo sapiens
MNLARNDESKRYTFRYTRIDPSDTSGTFTSISCNLLRLIQAPQLCPEHDHAQFTHGGIQSSATPLGHAKGNVIGQHFKVPRITAEYLKRIGPRPNKAPIFLSKSTPHGSTDTATRYEHLRLTLYRFGNGNSPLIRTGPTTHLIRAKGHTQSVSSINRKQHEQREAVIAEIAGIHICTINLPFLTCSIATTTLGPDTVMIRPPGRTLHRNSPKSTPLDEQRTYQHTGAVPKERNSYTARRQSRPPGRVTLYTNFRSNYNCLNCLGDVMATEKPCTTEVPGNWGSSQDGSGIVNNNLVHATTGTLCENIFN

SEQ ID NO: 996737 - protein, 428 aa, Homo sapiens
MCLTLCAASYKSVKTRYFPTSVKTTQTYVAAKRKSYPVHVIANGGGLQIVNPRYIEEKENIQGRLTMVKTHGGESARKVHTHGIPIQRLLKLIKVSSNTEICRYEHKILTLGQHETYTRTSNRASLLITRNSPMLNTNSPFASDAGEFHLEKAKPLLRMAVTSTVPTEHYPSEEHRSGAQPHRMNAAQRRERATVTSILHSESTTHRSRLKPSCKRTASFGPVTETIERHYRHFYIRTPLGTTNGRPNDRDMAMTSPQAQWCRIDYAREDLRHKERQPARLTIGSPQHAIGANTPTLRCVSPPRSYVRPQLSEHKQDPYTYTSCLQEVTPVTPGPTEYCQQRGSAHMRSSPIHDPARTRSTETMSCHTGYERHHLSEQLYEITRTTTYIEIGDHTCIRPTRHRSAAQTATRRTHTATHRTNHTQRSQN

SEQ ID NO: 996738 - protein, 258 aa, Homo sapiens
LALIHFPPTSMSHPRPNSSSSSSPSPPASLCPIWVYVSFFWFPRGPSLVPFLLSGTPLAPTPSHASDNSSVKMSHPPRGLLDHPVLNTLLSLSLFLLEMESRSVTQAGVQWVRSTDQCNLCFLGSSNSRASGSRDSWGLQAPATTPGIIVIRNSQARDQGFTIWDQAGLKLLTFVSTHRGSQSAGMTGVSNRNRARSNKRGTALSSDWSGHGGTIATGTRPLGQGTLRLSPKQWDRGQPATGNSAPRHTGERRCRGLE

SEQ ID NO: 996739 - protein, 94 aa, Homo sapiens
MAYRIRGLTTGPVPASKDSAGSTPSRERVAPQPNRPAGGSHRKHSQQQQEHDMWPPPTRAPHRDPPPKTQQRSAAHRTNEQNEPPSGRTTDTRD

SEQ ID NO: 996740 - protein, 334 aa, Homo sapiens
HEAMWGKALVTYDLETAIPSSTRQAGHHSGLADIGTLPYSFRLFNQDWIMTLQHWCPELEELHYQAAWRNMQWDHSTSVQQSKKTGTSYHESLYKCSTISNETENSLHFMTSLKYARVTTQRGKRCVSAALSLCIRSIPQLSQVAGHLESWNKHWGRFTHRSVTHKKLSEVYITWQHNTAQTSPRTRDISFSRSLIMASKAPDTTRAYLTGNTALGAAQKRRSYYRTILTPNHLRHTVTNTGPATPQKATPKPPPGNEAQHHQHNRTRREHQYKRYTPGKQHNTQSDSPATKQPQTTLTANKHKTTETAHRAAEQTTTHTHHRVPNRQETHRGK

SEQ ID NO: 996741 - protein, 95 aa, Homo sapiens
SLCRMEDVCEQHLKFWEGVGCLASKTRRRQKHQHRRDQTLSSWPCCMSFYSRKRRATGKSQPSYENLQVTLRGMHSYAQSIRGAEYLCIKAGWNS

SEQ ID NO: 996742 - protein, 116 aa, Homo sapiens
EIAPLYSSVATARLRLNKKKKEKSQKKTLGKYIQLNGKLRIEIGGFKNILAMDFWTTNYPKLGPNFTDLKGIILHEIGPQVQTTSSRAQGVSRATLVIWTNWPTISRDSHYPWYMG

SEQ ID NO: 996743 - protein, 335 aa, Homo sapiens
MGLTSWGILHSRHWELGDAEHRARPNGQRGTWWFANGPQLALWAGKDTCARHTRRKASFATRLCAKRNGVNAPDTFGAALGKKVNVSQGQQFDMRRARLKYSVKHIHRTIYGSGAYNAQEDKPFQGIAATSKLFAQVSNMGPPLGTPHFCREHLHKQGGTSYAVTPRGQSASYTRDNNTHMRGTEVRVDTRAEHNRRTSQGTQLVIPEDPTAVHKQQAAGHTPVDDQHSSHGYQGQGRQPEEIKTIRKHTLLATRQRDHTCGAQHQYDQTEHNTVRQASQKHAKRQSDDWGRPLRLDGGTQHRGAEPNRTKNHTMSDQMWRHPTCGETRGGTPVD

SEQ ID NO: 996744 - protein, 223 aa, Homo sapiens
MEDSMDMDDEPSCGPQNYLFGCELRGRSDRLSTLRWIDDEKMSTRFIFKNGQYRGWCYRMRLHYVECRGNELRRQFAIKVILVTLKMVCTDNGFPVVGFEHNTRPSGSISVDTCRYQGTVHYYLDRYLGAVEEDAESEDEEEEDVKLLSISGKRFARGGGSKVPQNKSQTCLLMTMMTMMMNEDDDEDDVMMDDFDDEEVKKTRSEEIYRDIRGKNAESRNEN

SEQ ID NO: 996745 - protein, 274 aa, Homo sapiens
KISRKGGLDTGQGDPFVLWTQLSSLFAHGMDTAETASNNEFGATKRNSEKANLFQTDGNPIAIELGGFSYAPGQDSWLGTGEVLNLHETKGPDRASKHKGLNWRRSGMAHIFRQGGPLNQITGHEKCLEASIPKALPRHVFFPPILPVHLEQLSNYGSGKWILRCQSPEKKTEPGTTSSHQIPPSLDLILERGSLIHGLCLELEQASAPLRRLFALTRIRWGDSEPGVSAPEYYREPKYEPGKPKTDEPLLHARSTSWGQWSHPEKWDSWTNGT

SEQ ID NO: 996746 - protein, 143 aa, Homo sapiens
RDTREIPHNFLCFSILETGVWLPVTQGLSHKGGDPQLMATSASQVQEILPPQPPEGVTPGHASLGLKSSGPPGDLAHLGLWKCRGRLKGVSHWCQALPYFFHNGEDTSKAIYEAGPHTRTINIAQVAWIRAIKSMVGSKQPQV

SEQ ID NO: 996747 - protein, 131 aa, Homo sapiens
MAVALGLKRMLQEISLPRSSAEHERAVFKRKNSKERPRSSGGGGIESPRIKIDDTTRVWAHSKRDCLTVSILWDALCKDTFSVKLSGVLTGIYCEACSHVGVHKKFAVDSNDEATQSVSRNTAIGLGPGGK

SEQ ID NO: 996748 - protein, 111 aa, Homo sapiens
MTPIRKINPLIKLSGTDITSSSSPALNRNISGMMKLRLTPWSPAGSSNITYMDYCQTMHYSTETPYEPRFSSIAHDHVETVNDGCIIRYLHANGASIFLDLPLPTQSGEGL

SEQ ID NO: 996749 - protein, 225 aa, Homo sapiens
CCRGKQTHPGTSSAAWCCLAMRMCRMRTAWSGCSCPAAAACPAAGLWACVAWPPVLGHVCTGLRGSAGCPGCSCKQLACVSGHWELNGGTIGLRQRNRPSGREEGDVVGSQGCGALYGTGCPLGIGPGVTLDKIFPREHTPFKGVTPTLGAPLQHFIWGPGSYTREPERLYYQHFNQNCGDLVARLILLSVRQKKPSLVGRDRYGHLADNGPQDIELRSMCGAYL

SEQ ID NO: 996750 - protein, 75 aa, Homo sapiens
GAPRVPNLRLDTKMPGEQQAEEEEEEEMQEEMVLLVKGEEDEGEEKYEVVKLKIPMDNKERHDLALSPRLECSGT

SEQ ID NO: 996751 - protein, 215 aa, Homo sapiens
IPKVAELIAKEDVDFLPYMSCAGGIPKEAVRNQSLLASSEWPELRVIQDEHMENSIFHKRKRVELVSARMLAEQILHRRMPLGVLPAFTSKFGKRGRSGTTPYRYFRVGQSLCKIKHAHLNPLFNDTVKSMRKNIYLLDFFLHIFGIRSQLGFPNLNPRTARLLNRSLLPLSFGLDIGGSIVYGSSCVIPKKSFECISNSSQRPLLPWAPLVGLN

SEQ ID NO: 996752 - protein, 227 aa, Homo sapiens
MISPPELLMFSAVCVEEKLFFPRSFFKTHHNQVTTRAGPTIQSAARTHRGEKHPTLSITLGRVPQGADIIYPRAASTTIRAIEGGRPLVGRGDQPWVATHFVATENKRPPTEECLGGNQLLDTALLVFHKVWLNTGAPQVKESSPIAGQKKGSDILLTTADGRRSTHSSAGQQHNSVFFWTQQELFCGATPPQLLVASNSIQSNNTLRAREGKPSLANHHVRHYYRA

SEQ ID NO: 996753 - protein, 104 aa, Homo sapiens
MAENQVTGRKSGLDNRELGHWELGKTGLGAMELGYSLKEQAGFSGDINKAWDLGGKQVGQMARGSGVAKGCIPLGVDWQNPEKEYLHELVRKHRVQGQENGQKC

SEQ ID NO: 996754 - protein, 80 aa, Homo sapiens
RNILQERGRRRSVNMGVAVTEEILSQIVLSAWSILLSESTNKTPRVDGPERYHWTLFLGIAQSIDRSIYVGSNRTSSAES

SEQ ID NO: 996755 - protein, 78 aa, Homo sapiens
EEDSKFEVEQLEDQKYGTGEENELDDRYGTLRQTKNHTFRTTQTIHFNTLNNVRTVRQNTKTQLGKHKRLRGTTCTKR

SEQ ID NO: 996756 - protein, 182 aa, Homo sapiens
MEKHSPQIASRWEHSPANIFVFIMCMLENGYLTRVCMPEVCVRSGVDRGSGGISSRPPRFGWLFAHRLLVTVLHGTSLTCVRSCEDRKWGLHWGFSMRILPSSSGFGFTRVSVLPRSRRGSSSRVYEGTAETRRSLPVTENNGRDSNDHSGMAIVSGLRGVPTETSVGEGVHVGRLGSTRRI

SEQ ID NO: 996757 - protein, 66 aa, Homo sapiens
HNEAGWLLLSSVDKVMKENDELGDSISRLQKQILSLKSAKIALSESLISCRERTEMWKNRHKLLSC

SEQ ID NO: 996758 - protein, 69 aa, Homo sapiens
YTSKMCVIRLPVALGLCDLLSMYPAASSSAACTYSWTRTAPYVCLVLILSHRGSCDDTLRCNTSSYVMA

SEQ ID NO: 996759 - protein, 47 aa, Homo sapiens
MCTGGKTIPPGARTHSVGATVGHPTLKKSGDAHNPPGVHKLPGEGEQ

SEQ ID NO: 996760 - protein, 142 aa, Homo sapiens
MGRTCSRYLLVLDDPVARGFFARRELLPGPIRKGASRERLPSWALSLKRDGWRSARSWQVYTARVSSREDCPFPELRPTKRYTGVEAPNVYRQSLRCPAVTGQTPEVSLLLHQCPWWALDYYQTCQDWWGLPGWHLAGPLSE

SEQ ID NO: 996761 - protein, 201 aa, Homo sapiens
MMLRQIHRYRSNEACETSSIVTDLPNVLPCVLSMSFEGAPSCSSSLGTSIDLRAHLLVRQMQILTRLVLCHLSWSQVSVKPLRHALWASLSDRMDRRPDIGRDTIQSKFFLVSEYRKQSGGRSSCARLCWSRRDEMCACVGHETSIGQVPYVFTISGGLWYSPYAPTGLRYITGVRDSWNPHLVMDVVVRGKLRQCGIFAV

SEQ ID NO: 996762 - protein, 410 aa, Homo sapiens
SSSLLSPLLFLVLDRATLKKQFRVVTKNKKHTKRLAATKGMKFLLGHSSWVLPLLDRLASLESFVKLFIPKRRTTQSPGEIVAGLQELGARATGETGLAYELAVNSKTQAGSSGDINTRMATVEEHSLAKIAQGTGGGPRVSIPLGREHTGKTHRRSIISHAPGHHERVELRRNLGDDLAHTATSSYRTTTTLGSAGIKLHKLALPETSGLLAYTPTRISLSGIVDPHEPFVQTATTGYPVPPSSPGGLTTNGALLPSPCDTMDRDLHITAIGAPINWCPPSGWRHFLRLTPGAPICLMRSTPPYLFNFVNSTTGVTPDTEDLRDRPDRGSSHQANLIAPQAIKTPASVPLTQHNTSDRSDKTTKQPGDGRTLNSRTAHTPPGGFTTHHQSPQHQTRVCVNTPPTWEATP

SEQ ID NO: 996763 - protein, 84 aa, Homo sapiens
GPRSRRQGAEGSEGRPRRGGGDGGAERWQLTVLFGPTFTRMCDPCQRNISAAWMIIGISMYVYTELSAFPQGLGRHPRTVTFRN

SEQ ID NO: 996764 - protein, 236 aa, Homo sapiens
MLGAAQGEGSPSRVRSPCRCDLSGHHERCPPVVGQDEAREEAVLERLNAGEIVNGDGGFVFALEKRGYVKAGPWTPEAAVESTQKQIRQLHREFTSELAQNVMQSFTFYASEDKLETQGQLCLRRRYLAQEVNEACLRHRPDKWLMTGDAWVAGGVSHDTLPYLSCKSETDSHNQSFLQQSEVFMNDGNVDFLIRRSILNTLKKLCGQFDTSHSLRNPVGSTHVHSAQNATLAMAC

SEQ ID NO: 996765 - protein, 67 aa, Homo sapiens
RNIRVKLVDEYAGARYGDRYAGGSCLLPRVDTSYGCGTKDDRGYSEAKVVSRSAFIMTGRAQQRQTR

SEQ ID NO: 996766 - protein, 109 aa, Homo sapiens
MTNVQWRLTKQVVISVTEIICVVPCAREVDSVMKIVLLHYSSTTNVRIRLLAVSRCTLPCCSCITQCPICSDNLTLELGYSCSGELLLRTMRYRSLRYCVTKRTLFKLY

SEQ ID NO: 996767 - protein, 102 aa, Homo sapiens
LLNYNMHSHRSNHIGYRSSKPTLIPHRWVSSPDEAIRQNAVNAGTYFLFYTLGRLPFPLLIVLSLHVTSTARRRLKIRTYITLSWPEGTIKTPEPTNCNVVT

SEQ ID NO: 996768 - protein, 119 aa, Homo sapiens
PLQVRNFLESASPVPKAPPASQVASFGQPSSWSSRLAFPGPAFGFWQPLQAQNLYLQSAFAGRAPASRRPALGPASASASQGSPAQLALASMRLPQSKSSVPFRSLRQGPASCPASVLV

SEQ ID NO: 996769 - protein, 188 aa, Homo sapiens
MRPRTKTVQKCVVSEGFSFQPVFETTTRNNGPSRVRSQEKLGGTKEVVVHGNCSNRQGPGRMAHLGYLYSFQMSYRGGEQAVVRPFAVVGFQKAGSNPCAWPLRRHVPWKVRLGGNSTEGSTNRVEYKGPPGCKILQRVRFHYRVEHSNQRKGVIHPGLCLSAKGGLRNRSGQVSLDPLRVISNAANR

SEQ ID NO: 996770 - protein, 106 aa, Homo sapiens
ACCFLLLGSPCQTNKGRRDWSGHGEAEEEEAASHGEWMMKYPWTFRILVATKYILLQKMHAFMQYLTSCQCYRNVTAHKRLLGPTPRQHCCTQFWTKGRNMPTAQS

SEQ ID NO: 996771 - protein, 94 aa, Homo sapiens
LSLQGFFLVCKELFLFGLTVKYYNGDLEGLCGPSCLELETEAFVSLAPSRAYLPTAGVASRSARRYHQGMHIEDKQIVETLSPTSTVNSGRRST

SEQ ID NO: 996772 - protein, 141 aa, Homo sapiens
EIPGSRESRKRSWWAAMLSPEESDVLRYLVEVEELAEEVLADKRQIVDLDSKRNQNREGLRALLKDLSSSEACDGSASGNMFIKMPHPETKEMIDKDQDHLDKDIEELLEVELNSEWSTAVCEAQGKPELKGFTVEPPQPG

SEQ ID NO: 996773 - protein, 290 aa, Homo sapiens
VTAMTRRWFPSGRVQLQGAPGRFISTVGSMDGSERVGSGRVSIQVTGHRSSLLSEEALPGKWGHSSHSLYGCCMVFAYLFRVPWQEYWAYSCIGHVPKDLYYRGCCVQCELYFGSWVGTFPIALAGLPPLSRLIWRRSIGPAVGEAFPVGQAWSVVFAFWVAWWSPPWVLVQFHRFAVHFGQLRNGTFSRVAFSSTGTLWATPEGVPGALWWTTGGAPSFGCQTVQTNSASGFGHSDCPGCGVTSQRLLECGIDLERPEVYPSGVRDPGCVDAFPCKQVAAKRIRGGLSH

SEQ ID NO: 996774 - protein, 155 aa, Homo sapiens
MLGFTAALVHTGGYRLFLRLSIGASHSGSGNLTRPVAATHSATQPCTGDKYLHVATVGDLVHPMGVGHPSAVGSLREERPLSNCSTGLELLPPRTLGAHSPQKVVPKSILATAPKWNPHGGHPPGTPKVYTFMRLQCTSSRSEGTRSQQWGDHML

SEQ ID NO: 996775 - protein, 104 aa, Homo sapiens
MNMAVGVGTDCSERRSARTCECHSLVAFLPLKTLRPAAMLERTEHRHKIYYVFWYPCLSKKLLQHPVPLGAMLAMLVTAACTLFERVRPVSMESLKRPSALMTF

SEQ ID NO: 996776 - protein, 146 aa, Homo sapiens
MASYTVSFVATTDAVVSGNGLAKGWHWRMHPSSRETTRRCSPSHERIGNMPPTVTWEYHNRQCRTTRVAIACNLEFAILLTYTYFRLEVRGLCPNLSLSSLAELDEANIALWVLFPVIYESAVSGQFVSVYIGLLACQKRTRAICR

SEQ ID NO: 996777 - protein, 232 aa, Homo sapiens
MPPPVRGATAAPFRAPRGCFAYRPSPFARGFLFSPPASLFCAVPLRAPPSSCAALPSGAPALSPPESSTASLFSPPAPPPPPPPVASLPLVPPPFPPPAPLSPTNPYHLTRTPPPLPPPLPQPPLSPSTIIPHPFHINHNETKPLPHTNHPHRTFPPPPQPTIHQHHHTTLTTHPSLPHPPTHHASTPHSPSLPSQHYITPHYLSTTPPQSDSKPSSNPPHYTHTTILPLPS

SEQ ID NO: 996778 - protein, 133 aa, Homo sapiens
PLDREEQDNKGFYNMTEVEMKLLHGVKIVFKKKIDEKGLTRAPELIPKRTGNCYKINTCTGDLKQLTVIVQQRRQVTFQDTFGKRRSFLTTGRLQPDTGDLTQALENSHGRQGNIGRHLKAKVKPLFTKTQTK

SEQ ID NO: 996779 - protein, 178 aa, Homo sapiens
MLSPGDLVCGNCGGSSEGGLEGQVMPNSAVGQESGEARTKLQAHGIQTPLSVYIVRNAGDSRAACIAKSMLRQFGRVKRLFRRSVFVAANHNGSPLSIQECAQRTQVRCTCSSLARIQPVCLEASQAYAGGKGPSVCLSCGCFTGHESLWLLKADAFSDLVIRVAEDFRVDDWSGLPR

SEQ ID NO: 996780 - protein, 67 aa, Homo sapiens
MACISHVNCYGKDSEVLLHLVRGKMGRRKWPMNGKGSVLSYIRQIEGLEGIGGWCMRQLANSIEGII

SEQ ID NO: 996781 - protein, 112 aa, Homo sapiens
ITSVVSMLSSRIEIREIRNGLLILSVTGVHPRVNLHIFPQYLHSFITASVFLQRGICRSSSDLIGRVRLRLSSMEHTYHEWSHDSQVQCAIPTVEHRASGPVMPFECVTRPQ

SEQ ID NO: 996782 - protein, 103 aa, Homo sapiens
SLQNLGLSYKQIAQTTRDVSQYLEYRSIEDHTVSPAWTIITRVRQPSARDAVKRRLGYFRILGPRSRLPVPRTHRRSNCTSVHEAPRRLTNTFVADVHPQRAQ

SEQ ID NO: 996783 - protein, 161 aa, Homo sapiens
MIPPTLGLNLSGAIRSRVGGSHASDANLKGRCHDSEMDETQLRRSRCKNLLPVYPMTIGANVSAFLRLLQRTPRHVLIVFPVLSQSKHLLTMIDHFAYRHENLSQKLRTSIYCEDTKGATWHLPLGSWNLPLETGQALVPYLRMGPFTAVCAFGTFNWPLH

SEQ ID NO: 996784 - protein, 33 aa, Homo sapiens
RWLMPVIPALWEARRCITGPAIETILLKQETVL

SEQ ID NO: 996785 - protein, 101 aa, Homo sapiens
KGAVSQPPKDSSRVCVEEGVAKLALVNLRDSDRVIEHRRPGDSRPKVEYLLAYRFAAVQGTDCEWQMHEVPVTRQWFYAIYLPKTGELEGMITISAAALSS

SEQ ID NO: 996786 - protein, 259 aa, Homo sapiens
MRTQRHCIITNHVTMHLSEKDTHKSRQSRAKHTNSPHSTSAIHSASYLTLSHTQKSDKQSYLTLVRPNAFVLSGPPIQQRPPLTTLTHTQPCTFLPPSSTLHGPSPKAAHINSASLTRQRNSNDKTHTLYPLPTNSYTRSTSQTDTFPITHNYTDSTQPTLRNRINLPHNLCQATRCTYREVNTQQHTISYPPNDAVGGQGLARPHTTGSGKAHTTQSTNGQRAACDNAAHVTHDCTLTTQHDTEEADIAYRGCHCTAD

SEQ ID NO: 996787 - protein, 35 aa, Homo sapiens
MYFIPVAEDSDFTPYQKLPYGVFSTRGDQGARIGV

SEQ ID NO: 996788 - protein, 153 aa, Homo sapiens
MAVLAPLIAARVFWCRCTFTDGSAPSFSNLMIGAWLYVGLYSCAGNCPTLPGHGPATQCASTVTRVHFDLAEQVAASCMYSTVPHCACNEATRRSIHCGGKHHRQHLSCLRYRVANTIYSCFRFGIFCIGPTFTYTLCIVYLMTCKPHPIYGP

SEQ ID NO: 996789 - protein, 111 aa, Homo sapiens
DADLRDVNAARVCECCRSFIFPSLAGTSQCSPGTTKSSYCVASSHQLGNMLSQASGPPNRQYVEANKLCRSRCCELWWCMGLLEYMLLQEVRVIPWKQTNFITLHGGMEDV

SEQ ID NO: 996790 - protein, 41 aa, Homo sapiens
MGVPWKNQCARDADYRHARVLFDPLVIWGYGNTWFKRLAVT

SEQ ID NO: 996791 - protein, 79 aa, Homo sapiens
LRQAGGVPQVAGSAWRTSQAAAIDQDPRAQESARQGIHGGLKRCNWTCPYEGHWMTINLHNHAWGMWNKRWIHCTKKGA

SEQ ID NO: 996792 - protein, 184 aa, Homo sapiens
MTPYAVEKQCDFRRFGQGAKCSKVKHCSKHSSFVQQVACTAAPVHTATSRMVPCAFLPSKMHKAGTPSPAYAPVTNHEEGDQLSTTQACKGTGEQQYFNDSSTVSIDNEKLPTSIQNNKETRQHGLLQKNILAHQTTSYIVKPTKNDKTYRNQYRYTRCQDTDTNFDIPLTRRQHQTQNINRQE

SEQ ID NO: 996793 - protein, 265 aa, Homo sapiens
MAKACTYKKIQQVSQDVVAHAYSLSYLWWQRWDSLFEAYGGYMAAGQAEIRTQIRFQDHVLTRGRKPVVFTNNKMWTYQEFQEPDVAKHPVQNPLLIRKERPQEFPALEHQNSTMDPATLDKYPRTQYMRKGPKGSGEIVHDATGDHRRVYEERQTDEHPTYLDGKNERKIVHNTKEKSNKKNKQRKTKNEQHPQGQMEKGHDKMANIHRRPKRKQDRERKRISETRKEEINHGERESKRKGKRQKEQLIGEKNTNVDKQQEKTQ

SEQ ID NO: 996794 - protein, 135 aa, Homo sapiens
MSKHSTKRQGADRYMTSMKRKIKLGTKDETKRRTKVIPETKLERKNTQEQDSVNNNCSSEKRAGQTLTEQNELETPFKTYHNINLESTRLTLKQGVNRCDNSGSRHSADKTHREQGGKKQEDATRGAKRPQRNDK

SEQ ID NO: 996795 - protein, 170 aa, Homo sapiens
MGKLPVDTTRQNCAEAHEVVTQTHANIRDRATLNTCYQSTYTINTGQTKDHVANTRPNNGSHEQSKKIKHRQHIDNQNNQTNSDQQVRRAEERRHKQTQQAEETTTQKGYTHAKTQRGQSTKKNATKGIRTPEHNETKHGTRHQTTTATEKNTKKKTDTYEATQRENNNS

SEQ ID NO: 996796 - protein, 80 aa, Homo sapiens
MGYVFTPNSANNSTSRYPKFFTYRIRHCATNNFQILITRGNPAKLCQLTIFTFNTTLKLTLLGSTFGLQYNAYRPEVMCP

SEQ ID NO: 996797 - protein, 243 aa, Homo sapiens
GAASRKRKKKEKRRNEEEELRRTKKKEKKKERRNEETEQRNEEELRRTEEETKEKERTTPEKDARTQANARNGRTERGRKKLKKTRRTEDGHRTDERTEDDTNRTEPRTEATDGHERDASETNATRRNRSDRELRDATPARHETQDETTGEDSDLDGHGSGTRSGGSATDTGPRQHTENTTRLPHRFAKHTPNRDTAHGKKATGPDKQTLIANVGGKPRRGRANRQGIKSKRTRLWDNQKQRE

SEQ ID NO: 996798 - protein, 97 aa, Homo sapiens
GAVQREGSANLVRIRVDHLSGHHEDASRLAGKETAKKGILERVNAGRDCDWKMDGGDFALDKTGYVRRQVIPGAPESCIMEVIHKTVTASFIDQVPQ

SEQ ID NO: 996799 - protein, 72 aa, Homo sapiens
QWLTPAIPAPRKAEGGGSLEVQEPESRLANVVKPCLYQKYKNQLGVVVGAYNPSHSEAEAGESLEPGRQRLQ

SEQ ID NO: 996800 - protein, 119 aa, Homo sapiens
EPEMKPLHSSCGQHSKILISKQTNKQTKKPLKPKERKREEDGKEQTRGATGGDERVESPRNIPSVSLAASLSRVLSLSTIFLFKPPLSHCGLGQGLWGIPTRRALGDRWCHVLAFCVSP

SEQ ID NO: 996801 - protein, 140 aa, Homo sapiens
GACRVSASRALRGAMKMAASIVGAQWPMDPAFVHFLYLHACMHATAKPTSLGVLQRAQIGFIAGYVPTESYHSTSTWKNEEGYASITNDADDGSDLLEVDWETDDDIDRRRSSTSYKKILLAALSSFSERYDPSIACEAY

SEQ ID NO: 996802 - protein, 224 aa, Homo sapiens
MVFVAQGMDAAAAGSSVLLLFLLPTLGFCSPSAKYFFNDGLLLMAGSSSWLCSRSLCVPCEDATSRTMKHLASNAGSTSKLPVAGIRVEVLRGSANSLPRKRLCCCLQALMSSLESACGMMAVLPWSCVAIANRELLWGGSAGTGLLCWRGVMFIDRKRNGGCQSESCLRSSRSVSKPGREGLRCEPEGKGRRPTSVIHAGLSHRGALTILRQCRAPGCPFVPQ

SEQ ID NO: 996803 - protein, 109 aa, Homo sapiens
MRWWTELIPMMQNMVTPYMESDMKYKIGFHRGHKQVQVAVPKHLDDIVKIIGDYKSYTILGLRCDDSTQKTYILLFDVVPEYVVDTVGHVPHDMSMLPGSVIALKELLI

SEQ ID NO: 996804 - protein, 119 aa, Homo sapiens
MLPGLRLTLQDSPRAGPAMSSTSQGLESGTPRGFLVLYPSVVELAAEVQDKVPFTFSSVILKQVGSLTVTTTAGKCAVLHLKLACLRVSPSAIAYYLGYCCYYSGSQGLFSQKGDGSSH

SEQ ID NO: 996805 - protein, 103 aa, Homo sapiens
GKTAATMEEYHRHCDEVGFNAEEAHNIVHQKCVAWEFYGGRKIYTVTNNINPGETASIVEQVLNTPGSVGKQPINICDPVHVARSKSAYGFHTASSCSLGYHI

SEQ ID NO: 996806 - protein, 221 aa, Homo sapiens
RVCAGHSGPLQSTPSPVVSGWPSTRWCAWVVPVSLAPSYVGFLHSRTMPILSPASVPFVTARLVLTAHLSGVGALASRSSNPGRVDYAMRLVCHTICCPHYHLWGSSNCRSCSSVLPDMYASELSYLGMAVRLDALPKQYGQMHDIGWRRLGPNSRNASMACAILDVAATVGAMLRTSVSALLLVARCIIARLTCSEGAAISPNEKPHRVNQSSDLVVQES

SEQ ID NO: 996807 - protein, 81 aa, Homo sapiens
GRGGIVVKTWRLPHNSRVVRGPAQWSRSAITCNRPTIVLMSTWPSSVIAYAFYQCRSIDLYVEKVRLFRLDHVVIGGRLWL

SEQ ID NO: 996808 - protein, 286 aa, Homo sapiens
TNGSSLVYRMCDDVERLGSVSDLEENFGEQKSSPSKYVDVVLYPRPQTFRRDLPVLMSPTQSYQERTFQTPDVICEQSISGGGLVMKLDELTRLAAAFSLKSFLILSFQCITRPRYCCSVNILNRTQPGSSEEEEASEGYDQALEQLIRDCNTQCPEYATDRGANLAEPEQIEFECKIFPLISQSTAGWVKSAERDCLGVHVRSPGHTKEAEHASVQLHLFNDCLAAVSAREGSRFLVFDHAPFSSSSGGKRVHMKLTWTSQKAVPTLSAENIRRQAESSPDGDSL

SEQ ID NO: 996809 - protein, 150 aa, Homo sapiens
KKVHDNLWEGHIVMAAMSPLGALNNVVEEIVLSSSIAVNEHVYLGACVKCCLLPSSFSFYTYDMNTRSSEHGHGTIKTCDNLSRMMRSLPIGYQEFPGSYVVWTASAGHRWIFNAYMLKLSIYISMWVKKWVVLIKWSTMGGDSLEALAQ

SEQ ID NO: 996810 - protein, 198 aa, Homo sapiens
MNLNGVELCCYNTLPHWLNNRQGERTFVHHWTTAATIKNLVKTHPQGNWPDDENNIFSNKPFERDNKAKVSHRKHAIILRTNICRNLPGNIRSSRIFNSTSDSTNPFQRQPLNGTNRVTQRSATHIPYYQTHRLFIGHTETFRTDAISISARPTTCCTYPAGINTLCYNLLSYRVSYTQARQNPAERDLRHTPPSEHH

SEQ ID NO: 996811 - protein, 123 aa, Homo sapiens
MSENRCGVVIVLLILRSLGIEGHVEYCDEESLDDVETGKDSCEFWSSLLICDGGSQQHNASSCPWINSRSPSEGTRRQEMLSDFTSAGYCTCNSMIQIGFILGGGPARPYMRGGLVRILVGTH

SEQ ID NO: 996812 - protein, 249 aa, Homo sapiens
EVLILSEKGHTKCEFSQADFPGPYQMKQQKLFTVLCPMATPQTDNTKHLRTVIRKVMPEIDLDHMRVPEISKAWTNELRERQRQEAGGLFWLRKFKDSLVEEVVCLKIKFKAEKQTGEYWVSTSVTRLNSHWPGAISNCTVNQDAGVISLETRNMFNSWLTTKYMIPKGSFLMREDDIKENLKKSIRERRYACEGPDSDVGKVKRKELVQTGADEFVNAIASYESLQINGNIVAIVINTRVRMPDRYRE

SEQ ID NO: 996813 - protein, 85 aa, Homo sapiens
GVRYIGGCCGFEPYHIRAMQRSWPQERGFIATSFRKTWQRGEDGLDMRTKPWVQSKGQEGILGSNLRIASCRTIQNLQCRKPDGW

SEQ ID NO: 996814 - protein, 103 aa, Homo sapiens
MISMDSGSIFTANYYWRLGEIIVIHSSMVVTKCMASIASAFPCLTRVLTEILSRAIFKELHSIALNLEISALRCHIHLTGIMHRGHTTLNYALIGRVMYGTEG

SEQ ID NO: 996815 - protein, 82 aa, Homo sapiens
EVEARSSVINLCRRRPPMDPIDEALSAPVPFRLSRPSNVDYPLYDFRYRAYLIILGSYLYSGQTFMAVFGTRDRSSHGYSTV

SEQ ID NO: 996816 - protein, 54 aa, Homo sapiens
MYQIAGKTAGITSNTLPAFEPREVTLDNKLPPRLTQYYPQPHTHSKTLMYGHEA

SEQ ID NO: 996817 - protein, 136 aa, Homo sapiens
MWCCWGGPGDVIEDPLRCLRLGHQSSVCSILLSYGAKVNPPLYNSVPPARGLAMSGQSRMCEASHRPSRANLGIRTDLPFREPLCTLPVPGEHLDCVNSAAQMQGRTVNCGKLHENCLQHAARFQNDDLHRNAYRD

SEQ ID NO: 996818 - protein, 71 aa, Homo sapiens
LNRDHLRSRISYRDRSFQVSAKKRHDHMDDMDDEDDDDHVEQQEYIDSNDSDDVRMTLMILSSPDELHHSD

SEQ ID NO: 996819 - protein, 30 aa, Homo sapiens
MKEKKHEQSKNARKATKTNDKAAPATRHKK

SEQ ID NO: 996820 - protein, 97 aa, Homo sapiens
GKREGLQISIMAYGLPVDKRVIGKDYVRHSTMGAKPRERISYWESYSNLCFPVKDSWWEGLPVPGLLSITTRHERGSSFTQDSHNHPELKPSERSGS

SEQ ID NO: 996821 - protein, 125 aa, Homo sapiens
GVRWPNRCYYFSEVSSRLLAETHLTAKMPRIMIKGGYGGIPRDEILKAEVMKYGKNQWLGIAVIAAYENQSNASGKTRVVMNGCIQAIKKKNGPENKRKNSCELANVDANSVDEIIALIIGKNSG

SEQ ID NO: 996822 - protein, 105 aa, Homo sapiens
MRRVTSVPVVIDPVDNEEKKRLRSLRTCHHRAISGRWLSGSSSQEQLSTQIEQYEEKKPLMLEAGRFTLYPRPGGLWCPNRMSVATRLGYGHGKADQNVVLTELQ

SEQ ID NO: 996823 - protein, 172 aa, Homo sapiens
EAQRAEIAIVPICHRTFLRRTYNESLRSRGKRPVGVLRSIFTLWCREVLALSFPSSYERLELLQLQSNIGKCYRELKEIAGRSIGEVVMHRSEKNNCRASRCAGRRFQWRLSKNLLVKRLGRYVDGGRMKTSIVGGSGGALKDFFKNSFMYSFCRTMSEPIAEEATETRGMA

SEQ ID NO: 996824 - protein, 104 aa, Homo sapiens
MDTPGPSQTFTFKYIYMSLFRRGLGLALQTVGHTDSLRHFNAHLISLAGKQTEGFLGAPLPIITGEHSRTKDLVLHPMGRHKRWGTNTLRPSTRGYTPKIIREW

SEQ ID NO: 996825 - protein, 111 aa, Homo sapiens
MEPGAGRRWQVEPQIGAIGNSERGATRPEELPRLETQKKQEARTWRTLAQGEPTWAPPRKEKSAQRQHGAPWGRPLIGGRTHWLASGGERHSSARESPLWAPAKGVNPGGG

SEQ ID NO: 996826 - protein, 76 aa, Homo sapiens
MQKQIRIYIKNAVELLLTKNKNKATRKKPKLWNRLQNTNKKPQGTPNSANTQGNSTQILRSLIYPPNYILFLNNLP

SEQ ID NO: 996827 - protein, 70 aa, Homo sapiens
DIDFARWCGARSHCQNDEALVKVKCIDKDYYHTASLDECTLINMIVDEECAYSDQDYMVCSRRVITLNRP

SEQ ID NO: 996828 - protein, 128 aa, Homo sapiens
MRLQPWEGTRVPFPKAPFLSPLIWGTKFANKKCGGLSPLGAPKAFTRAGQHESTEHKQGFFLNKRSRLNPDFCRIVSFRPCWRYLPLGVWFFQPFPRRTPPVGAALKYTVNPKFYNQFSKRATKGLPL

SEQ ID NO: 996829 - protein, 67 aa, Homo sapiens
GGDDPNMPSDVSVLKSRWLFLSLEWRQACCLYIATVSTPDYQPSSYYIISTAHKIIRNTHKLIFNHL

SEQ ID NO: 996830 - protein, 114 aa, Homo sapiens
MVCQVPRSKNSVSTVGVTWLCKSPFHYDFYKISKAAPLRTKAISGHHTNLLPGFAHTTWRRQTSFSGNCLPQQFLGFHLSNNYLQYTPEVHISCKPVEHHGGNHAFTTGPFQII

SEQ ID NO: 996831 - protein, 279 aa, Homo sapiens
MIGLRGSQEVSLSVPLCAPSSGTTTFHHTHRTRGECLGGLAIGARESQGQGPKRKLLGSLDLQEEERGGDAGPQVPLSQPPEDELDRLTKKLVHDMNHPTSGEYFGQCGGCERQMWMGTGAGRCGPLHQQSFHSGLLSVFYMPRPASRPAYLRRGRRTAYCEGLLRGHLEKCATCSQTILDRILRAMGKAYHPLDASTWMVCHPRTRGGIPLHQGDCYEAQIHCIDGTVHQGQASDPKNASAVAGQRPQTMSWNPESRRETRRRSRVRPAHTKDRHNRT

SEQ ID NO: 996832 - protein, 123 aa, Homo sapiens
MGDRMKVVSALMDHLGPETKRGDCEEINRVYREMCKSDLEKDIISDKSGDLRKLMVAVAKGVEEQEDGSVIDYEMMEQDARGMLMNAGCEEGKEGCSQEWIRSNDERRVPMSRKYLKSTRSEE

SEQ ID NO: 996833 - protein, 151 aa, Homo sapiens
MIPICKSKPGNKINLKAELQFIAEPRTRSHSNDLSAVSECVFEAQIHWRACGECASRVSQQRVIRIVHVTTHQEASNEVLHQIAHSHSETETIWAELDPRTFERRIGSASYILYRALFAYTIGRGPIVTDQFLLLMNTLKRSGNYRSCFAS

SEQ ID NO: 996834 - protein, 246 aa, Homo sapiens
MDRWRCVLLPKDFLAGGVAARLSPRQAEQPIERVKLLHAGAACQQVRCTADKQYKGMIDCVVRIPKEQGVRVLRGCGNLANVIRYFPSQALNFAFNDKKQADLPRVRVDRENRSVWRDLAGELWHRVDAAGGHIPVFCVPLLILRVTRLAADVGKAGAERECRGSVSAWCKIYKSDGMKGLQQGFNVLVQGNDDLASRYFGIYDLQRECVRIQEQSIRHQGMIAQNVPAVAGVDPYHLTPFAAAWI

SEQ ID NO: 996835 - protein, 150 aa, Homo sapiens
MTPIRKINPLIKLINYTHSSILPNRHPSDLRMMKLRFTPWRLSDPPNHQRTIPDHDTIHQTPQPPFPSIAHITRDVKYMAEVIRVAFIANGASEYSLSASSYTSGEAYIHGSYLYSEYLKAIGYYPLCLGKYSKHAVHMAMSSREAKYRF

SEQ ID NO: 996836 - protein, 71 aa, Homo sapiens
GHSRAISHGVSNLECESCRVCDPYGDLKFIQAAVLESSTAVVRYLQESTQLQLECSPCHVTITDLSLLLST

SEQ ID NO: 996837 - protein, 185 aa, Homo sapiens
MIKQLYLVEMRQINPRLIDSMTIQPNVLGIAGARVDQERWTPCLKQEMRTTWMKTHDRTCSNSRELWERIVSSENGVASFSAEGGQRQCGRTREHWVTERAVICVLCRRSTYGSSWGHLARFADKIRRCRTFVVQPTGFFEAAGLISCTPPVWGRKREPSWVDALRLNKCSPAGNSSSPQAWRWF

SEQ ID NO: 996838 - protein, 67 aa, Homo sapiens
RTGRWRAERSCVVREHVTGGICRGLPDDGRPPGREDPSARRRGAMGVVRSRRWPNSKISSKSRGRPS

SEQ ID NO: 996839 - protein, 171 aa, Homo sapiens
MAGACRIRCAPGQSRGPVQCRSAWHLFDLRWLALSSCKYLKGLGWMMRERCIIRHPFMCCFWGAHYLASIPYQGATYAVHAHVTLLVHRKLWRPYIYTGNQPVCHIGKTSPKEPYAFGIETFNSGETKFLGTFFIPNPFVGISTLLVGASYRKIGLAFKWTKSLNEILTDG

SEQ ID NO: 996840 - protein, 140 aa, Homo sapiens
MGSQCLYVCFNRIAKKESPGSSHRARGIIHIQKTFLSPMFLMHILVTHLGHPAKFLRYEGRTVSYINDTKGGHLNFGNEDLPFTMKKFPDVAPVNYGVLSPGKFINRKSVAAHSRENKGLKCILTNQLMGFKVKGINAED

SEQ ID NO: 996841 - protein, 193 aa, Homo sapiens
MHGNEAVGREVLSCSWPSTYATNSQKGKRDKLSMLIHSTRIHSHVLPCNPRNGFENGSVSAGELMDWLVGRSNAQGIDLNRNFPDLDRIVYVKLRTEGGPNNHLLTTIFQNDLGDLISQKLGPETKGLSLHWDYGIFRLGAFCPSLHGRMTLLANCIHMMTNAEWVVLRNNSSSPDDAIMPKLGPGNTSSFKP

SEQ ID NO: 996842 - protein, 102 aa, Homo sapiens
MPHKKTFTKVQPSVHYVGESSFLHADTEPMEHNELSTIPRWLHLTKNCNTSTNKTKCLPPHLNERSQGTPITPDILITQEETSDEPLTLYGGPGLVHLLIAN

SEQ ID NO: 996843 - protein, 79 aa, Homo sapiens
INPLAQPVIYSTIFAGTLITAHDARTDFLPEEAVEITHAELVYSQFCTEEKHKTLRSTKKLGIKVFSLHAKQTVSINPF

SEQ ID NO: 996844 - protein, 429 aa, Homo sapiens
HETTHQIKTSKQTNSKQETKNTTKHHNKNKEKQKIGQETRSNGTMTDNRTTNYTEQPDRTKNEDKRKHTDHKGQERDTTGVQQVGRNINNKRIHTARRGQWTRETKEPHRITTRDNNKQANNRSRHRHKRLRTGTKREQTDRDTAQNARGTQDVTTNKRQKDQNVGHGGHRDATTRRSTQSAHHPAQLSPQTTENTKIGETAARSATKDRSEQNQTTRKTEHQLTTMWAQAHVNTKDALNWPQTKETNRNERSDQEQARHRGNTHDTRTPDAMSNHTPSNTSCTPPRHTTGPTRSTPQDHHTQRQTPDKQKENPDQRTTPPHHHPQATTKPHRVATASMHTHAAQKQSSKRPIVHTSDRRTVATHNPPTLDERAKHKTTHNVKPTTPTRANTVGQHTDEEQNPEIDTRSRRHNQYEQIRMRATRRTTAE

SEQ ID NO: 996845 - protein, 393 aa, Homo sapiens
DICEELRLRELEEVVKARAAQMAKTMRWWSDCTANWSSTQWQSQFELKGNKCQRGKARPSPDNTQTRKTGRIDKRTFAGYHLRQQGHQEDCGQPPGTRRAISGQALHCVNPKGILGTPFPCGLSGKDTENFPLSGTPLPRNPKLFQTWDRFSNTHLAPDGSLFPAGRYFWGNNTMNHTFLPEQPRGQGTHQRLHLQRTTKGLVALQSRISLFNTQLPRWTARMTPPPNFLREFGLASHFSIANTQRAAALSLANHRRLAQTPHTHAACLGSHLGTTPHSNNSLAPFSGQPPLRTVLTPGNPLPWHLFGHTDSTHHCGTLQTFPPNDNNLPTNWRKRGNPRTDHTPPRPPRSSGRTKPTATTFRKETTPGDAPRRILGSPIGSRQPVDHRLCQT

SEQ ID NO: 996846 - protein, 157 aa, Homo sapiens
MAFLRLTERKILGYIRLRKGPNVVGPYGATYYTRFADAYNNLFTKEPLKPARTIVLSHRSIIMDPTLGLTHRLFYYVTRSSTDDATAWSKLQTKGRAYTITQHISFSLNLVITSDIRSEYQGMEHQEGSEIRSTGFGGILRKEVGRQNAISIMQVIL

SEQ ID NO: 996847 - protein, 159 aa, Homo sapiens
MVMQYFKTFATTLAPKHGYQESTKLTPYLHICRALINSYTSMVEAENNQTEQGFTRHKDKLHSAPRGQTGPFRQRKKREVGPARFKKDADGDTKGGEPSQVGADKAKTASRGGGNGTAVVIEHTGERHDRRTCEWRDHKNSEVPVCGTRHPGQEEDKRT

SEQ ID NO: 996848 - protein, 93 aa, Homo sapiens
SWNSPAAAWVSGGFLRYWSQVYSPASMFQGMRATICVLICGQTLYILVWVSCAVERKKFDDNLPNDSEEEIETISNRLLIDRLRDYLERVRSG

SEQ ID NO: 996849 - protein, 248 aa, Homo sapiens
AAAAAAGAREGGGGMAVGRGAENARKRPAVSIVRPARDVKYPGRTRESTRTGVHLPGHAAGGSRHGHTDRRPPLHLLLMSGKRLSMRRASPVYGVPVATCEGNSLWTPGEAFLGVLWENFSGWRRIRIRGKALALSISSFVKLKLVWAVGRSKWVLGGLPQAGSEGGVLCGTICYQAVPSPVFYMGGPRGCANHAMGPIWGCGAFEKIFGLALKAWRTDLIPVGETFRVAPVTLPSYSGNQMGSQVIG

SEQ ID NO: 996850 - protein, 188 aa, Homo sapiens
MCETQKARKEREVEEKRHWDSSWEYEDYGSVRKRNLTVLDGLYRENDLDPRYWAKGQHQPYRKRDCGYWDFEQSEPSYMDCGEAHESGKGCVYHGGHDGYRSPENVDYESLSPGTKDNSPTRSPDVTSKAGGYGEANGYSDCKNLNYNPEDSKKAEQLTDCRGMDDSSANLGQPQLWYIEHENVNHKS

SEQ ID NO: 996851 - protein, 104 aa, Homo sapiens
MRQTPWWWYHITAGTILLQQQIKILSLHVEKALNAVALDLRCYQMNLLRGVLLCCKIKWHYTSLQQPKEGFAPYCMLNVVCISLTILTILLSLPKTCKNKAVRI

SEQ ID NO: 996852 - protein, 72 aa, Homo sapiens
RWLTPAIPALWEAEAGGPRGQKIETILANTVKPRLYQKYKKLARCGDMCLQSQPLGRLRQENHLDLGGGGVQ

SEQ ID NO: 996853 - protein, 260 aa, Homo sapiens
MTQPERAVTHTISSFFLNSVTEGAFVYLFLGNSASPLKVLCTPEGIRLQCFMKYFTDEMKVNWCHKDAKISSSEHMRIGGSEEMAWLQICEPTEKDNGKYTFEIFDGKDNHQRSLDLSGQRFQMNAFAEFQQFKAAAFADEAIVARLIGGLPDVVTIMEREDLESDLHGVGNLPRSDRFKNRTTDIQLSEHFSVKVEQAKYVSMNIKGSDSEDSGKATAFSIKALSIGGTKIDRDRAPCSNTRETDPGQWPRPTKQAQAI

SEQ ID NO: 996854 - protein, 168 aa, Homo sapiens
EIPPELQTSGSGAPGGLTLNFCRSSPFQASESSSLRYQKGETRRDMGGGVRRRAENRSIARRRSRRAVISRKHSIPVIVDVRKSNNVNTGGGVTAGVADCRYWRAMPESHVRDENAGRLPLRRVCTEAPWVHPKAVTHWPIRLDVSSTGIPSILQSVAARGPCIRQAP

SEQ ID NO: 996855 - protein, 66 aa, Homo sapiens
PGVNAQRKEAGPLASGCDKPEQVCEKPGGLPWLSVSSHREDTESQDQSSLCKQTPAWSIRASTIQC

SEQ ID NO: 996856 - protein, 317 aa, Homo sapiens
MPQHITDGVACIVPMSVDGSQHEAKRAHYCPNQYWFERTLEEKTLPGGTAPITMYADKTQPPEGLGVNTLGGRRASAGFEILRRIIPFRAPQVARPCIAHGLTTRCRHEKSSPIDYPYSDSNNQEHPTVGTHSGHTRGEGTPRGPPHPLGGPDPRIALITYWYSHGRGPSNPTRSSAPTARLERTTKRRHQSHHQAARVPNSAWAMARRHIDITDQRGIRYPYATRQSYPREHHGRCRTTRQLTPKAARPRRDSSSSPRVHLTPKVDSRTRQRTPAHTHGLARTHDRTHHGTFGSTPHSRPLRAQQPAPYKTRPCPR

SEQ ID NO: 996857 - protein, 118 aa, Homo sapiens
DTTNMYTCYVYIVLETVVVTLSPRLEGEWRFTAHCILNRIGGSRSPPDQSSQVAGHVAEQVQLMFVSLVEMGFRHVAQVGVEFLGSSYMPTSDSQSAGITDVIQRDLVQICILFEHFL

SEQ ID NO: 996858 - protein, 225 aa, Homo sapiens
MRIPGGDFTTIVAILERPNIIFGAGHNFKTWHRGAPPKKIYLWAITYTKNAHNLLATIDKTVGPYINTSIDSTCITHISIYDIRMAQKSGHSVIPHQDQFRLGVPPPPRRVASARHVVRTHDIVTGGPETLPPVGHRTAGTNEHQPSDAITPKEAIYTQRNKSCVCHTTTGHFTPGTDTTPRGANPYKQDGTSPYNPKKRREHRVRHKTLYSAGGRAELTRIQHT

SEQ ID NO: 996859 - protein, 345 aa, Homo sapiens
EGTCEECGIDEDCGNRSNEADGCMRKMHISRTSKQSTCMIILILGSNRASEMQWCLYGTTWKALSACVPMMLTHGNEVPCVLICTKRSRIVTLEVDYAECGYGAYSKGTQKERYPGSTWGCSGYVETHYDRVRTETTWWGTGGKIVGNRYWAIAPNVIKAEATPLSYPWEQNKEGVHSEFSVETFQIECNIRFHNYVTMHPERFPLEETFEQTVRVVAIKDPGTLSKYQTVGSKDGFDKLLVRMRVAGLSESEKIGLQHGVGEVEICASPPGFSERTPPNYIFKPTGDETHLYSKNGFAQFAGPNRQLGDRSLGRRFIIYITSAGLREDISVGFTGIWECGGRQL

SEQ ID NO: 996860 - protein, 283 aa, Homo sapiens
VRDVKIDWNEECKSPNEGSVLCHISKCPKLRSGSARAMSSTQSFHRLSVCVYGNISMGNSEVNLHGWLGNLGVETLGSLFRQLTIHGPNQLVDDYVGGDAYPFSPGSIAEKTSVRLSLVKGQYFPLRNDACGLARNGHSTKPIKTIFTYELIVSPSKHTRLLHSGLHDAFHVPHATIVPQLRHVISPITMRNIMRQPRTIDMSFPERLEHITVRASQCAFPEHLCKARSSSKQLPWLHGTGSPKHGFNALIVGRKTICVATMSHHSPFLRHSSNAQRRYTRVR

SEQ ID NO: 996861 - protein, 191 aa, Homo sapiens
EVGGKRAVSQQWRRSQLPTGTGNWLFGFGAAGDSSQMPSHPHIPFHSILDATPNTGLLSLTVCQYHSGYYDGNFSSGRLDYPPFFCTGLSTILLTLSPNTSRSTNMLNCPLTSTLTPASRHLYSSPRSISPLISYAMLPLSASYCCSAHVPAKLHRTAHNTSGVNELTATRHKILFPARVLSPSCWNLSRA

SEQ ID NO: 996862 - protein, 335 aa, Homo sapiens
MALQHKFFLLFYPIYLSSPSFLPLLSILSTPGIPVLTSSHWVFPGVERAPWVTTLQPSLCNLRDLRGLTSDIRACTSALPSIARDVQGHAHTSPGATFAHYSHVQTRGIPPQCCGHAWLLETSVTLAKPVPCPVAPPKGDPPTGPPGGHGIGTSRRTPDNALGPTQRQPLLRCDDKTASSVRYKTHRVTQSCAQHLFPLLRPPIRATGNFLPHNTANTPSGGSLELFLTNTGFPHKENPYSQQAVMSQPNLISHHFATTAYTQPFSLPPFGAILDVRRNLGRDQHTATSSFSRVSVREIFYAYVSLYATSSATLTKPSLPQLSSSLSPSDEQAYK

SEQ ID NO: 996863 - protein, 194 aa, Homo sapiens
MVLDLLRVRVTFVEVARSLEGGSVLLTDGVHEFQGLEPLLTWFYQYPVLRLWPMCVPGRSSWGPGYMVVRPIDGQFCCRVEVTHPYSMASLSTFSYEVIGMLLCRLREWLSNACVLCCLSSVSTCLIISSMLVHGATLLIKMGWRDSMLLLPTLMTCVLSCRGCLLVLSPICQESRNIWINYLILPTKDDLLVL

SEQ ID NO: 996864 - protein, 139 aa, Homo sapiens
AKSKGVVLMALCALNRALRSLNLAAPERRPPHAHRVVFPARPDDEQWTPSKQTIMTLMLHHPDAQISILHVEHLMHNYLCTWKSTVTKYKHYTRFKMSEALGVPSNTQCRIPGCHGIGQGSTQKKNGYSEVNSELISGD

SEQ ID NO: 996865 - protein, 129 aa, Homo sapiens
VLWRLMRLRGGASHPANWSLDPWYFTGCCLPGRVTALSDLWPAHHVIRTRRLVPDGGGTRSDCRCRRSDHEHDRCRGSIRKLWRLCESVPDGPQHCASRFMSIRSVGPSVEMGVPASKCKSANQQGGLG

SEQ ID NO: 996866 - protein, 114 aa, Homo sapiens
MSSSTGQQEECHEQGLLERDGRVLQKDFERADVGRGDLWVQEKCSLQVIDLMDMASDILQPKEMMWPDQLVTPLNIITRYQENFNVIERCPKPVIGCVHGGCNWRRCGPWLPAC

SEQ ID NO: 996867 - protein, 107 aa, Homo sapiens
MRKDQDERLSKTMTEVEIEALFMEEQNVFAEDTLRELELTELAIFNTNRMGQCVIRFNIAGDLKVVKVSLKVVGDEDNLKAIFSKEIKAEGDLQDLEIHDRRESCVM

SEQ ID NO: 996868 - protein, 75 aa, Homo sapiens
AWCDSVLRGCSPVSERSVVSLSHALSAPYTKVSVPDILDGKIRWDMDHEPPEAPELSFRLCTRGLTKIIDFKVDK

SEQ ID NO: 996869 - protein, 74 aa, Homo sapiens
LQIIDAERENVLYVCMSIHALCLWLAEKGKVDGSSFLEGWTATAAREESEELPANTLDVCKQPSSICQMTYIRY

SEQ ID NO: 996870 - protein, 135 aa, Homo sapiens
RVHGGTHTGEKPYECRNVGKPSDLPHTFECMVRTHTGEKPYECKECGKAFRYVKHLQIHERTEKDSKNALLEKDLINVVYVRKAFISGQVIFKKMTKVTLARNPMNATNVVKDLQMLANMRIRYHERTHNGEKAL

SEQ ID NO: 996871 - protein, 69 aa, Homo sapiens
MTPIRKIKPANKLKLIHVYIRSTRLATLMPITRPTVMEDFGSLLHWSHGLESRPTVRRYMDSFSRPSAT

SEQ ID NO: 996872 - protein, 87 aa, Homo sapiens
DNTCDRSEGEGENNSNNKWSCIREGMFRPYGRWISPKKPLHVSRSDHQVDVCLLCLRILFNILLSHFQYWLSAIAQSDGDSSSLWYI

SEQ ID NO: 996873 - protein, 103 aa, Homo sapiens
GGQVMCWYFSHLLYHRELRFPASLLYSCSYSDGLAQGGPAPLPLCVCLLLTCGFAEAGKLLVDAHGWEPLVHHESRWWRNSLLRGHEVVSSHARGELGNWEDH

SEQ ID NO: 996874 - protein, 183 aa, Homo sapiens
MRECIRQVKYQNSESSEDIIYRKVQQGFGFVATKGNRLQPNEMEMRKALSHKYGQRREDGHGPMDNKGASPDRGEKNEDKQRRVGITALKGGETHPHGRGKERGEKPCDETECVSSTCMTGKPKAGRHRAQHRTKDIDYSGQKRDSRHSDMSIQQYATRTTDEPEQGPTTRTMNQRHAKATAR

SEQ ID NO: 996875 - protein, 384 aa, Homo sapiens
MVSTETMAQSIALTKPSAAGKMSKYQSDDYINILAAPSVQITMSEYPEKQMQRFNVGEDCPDIDGPVTELHVTRSYLVRTCETRCMDENINKDSKKGTFSMMHIETMTRPWTATYTRRSEGIWLHEKQSEGHNRRDGETNPMRNGDKGTRPTKRAHDTIGPVGQIQPNERPGTQANEGKNRKTKRHQEATMKQARPAHNKRLMEATSIRDRPNGADRSETLTGKIIRSKSGQRGQELTNTERTDNKITPARTEEKGEEGGARRPQVRGQRKNKARDTHDSQKAEKWTDDSTPSEQENAQEHTTQRVIDITEQRHIHRGKKTTKTGEPQTPNESNKQNNEQRRHEHTKRTTTEQKKDIIKARQSEEPKTAPHSTAKEATSIGHNK

SEQ ID NO: 996876 - protein, 187 aa, Homo sapiens
MSASSISRIRFSIYTSMCQPICCRISGSRISMWISKYCRQCLSSSSDMPAWFAMRKSLIIKSQQVKYVTAYRLTRYGTLMDFDLTHVAYESPHTPGFLGPYYGHYAGDELNQPDSLQVLKRCIQALFAMFWAARTVPAMVQWVSIDPCESGNFRVHYESMTLEPAGHGLAIQAQTLVRILSHGGFRK

SEQ ID NO: 996877 - protein, 126 aa, Homo sapiens
MEKTPTQPVVTRRVRSGHHLRGGSNPTRETGRRYNRATDPRRDTMSRAPGQGVHHFVHTTERTSFPRRAPTSACEAVHTPLPRVWDARTHSRPISGTESHIILRHVQHSLRKVRRATPAVVTTSSG

SEQ ID NO: 996878 - protein, 108 aa, Homo sapiens
MAYGLQMIGLRTHPQQTTWTNVREPMCLRYATLCADYLSPGRNGRAFYVPNITFVVTLCVESLRKQLVPWTLSLTCIMMVSIAITSVGVIAEVAVSRSQSVHLSSRGY

SEQ ID NO: 996879 - protein, 39 aa, Homo sapiens
MALVAKRPFRTWNWSGGHNPNGSNKQKNTKRKIPKTGFH

SEQ ID NO: 996880 - protein, 123 aa, Homo sapiens
TVTTAILSGTRGLIGSINMVHTCFLMRSCSMSYVSLLYSSLICLASKSLHTSGCVDITVPDDAQLLHACTLLVILFITRECADWATTYILYLQTSGLLKLIVFSFGKFLIFVYFALFSFSWKP

SEQ ID NO: 996881 - protein, 177 aa, Homo sapiens
MPYPKRSRAQSILLLKKLKQLEEGLAMYCDVRDEQQISAAVEKAIKKFGGMDILVNNASAISLTIHWTQLQEIGSDDELNTRGIYLASKACIPYLKKSKVAHILNISPPLEPKSSWVQTALLLYTIAKYGMSIVCAWKWQKNLPVHIGSQMHYGLKQHTHWCYGYAGRNRYREDSVK

SEQ ID NO: 996882 - protein, 266 aa, Homo sapiens
MKLVQGELKTYRERYTNETIIPALKRLSHGPFLASGATHCISPHIYSKYYSPLLKIYDNQPFVVPLHVHADLGQVRAVQEYVTCWLVHTKEYAVCDGAWDFNGLEEWGKAIVGCLCHIMKVWLCETNLPFHMGTIALIQGVLEHSNARGVDPRSSLQTDLKFLGNSTESLSGSLVADSWPSGHGLRLRIPGLLARWNSSYVMVERPGCEAHSREPEPGASWNAHYCPTSPSTNFGCKQDLSDWALHGLTAMNGFLPLQGGDQMGLE

SEQ ID NO: 996883 - protein, 106 aa, Homo sapiens
MVVRHSGLSGSSALSSSHICPIGHVQEVPCVLLSRHPMLYSMFQRSITIQKDKWYRPYISLVGAEHWDLHHRDACTDAWIVAHVTQRLRGSLVLYLRKQSSGVALV

SEQ ID NO: 996884 - protein, 77 aa, Homo sapiens
MRIAKEDLQQGVRPSQVLWQAARTALFWYRGLQVLVCKDTCLLCTTFHILLLPTNVSFEFPKSNVNSGRAASLLTND

SEQ ID NO: 996885 - protein, 131 aa, Homo sapiens
MRGYSVFLGSGGRDLSVTSASCETSLPVERFNNPNCGVEELNEHQAKKEFLCKKCLLHVISSFQFYQSVKTNGEELKRFAQGDFNRSVVERYTRKEKGYGNFIDWKVNLEHCLAVHAKLDNLIRMDSFWDA

SEQ ID NO: 996886 - protein, 73 aa, Homo sapiens
ALCAVVALLGPVADRTTLCGFVWLGIAEERVRDSLYGIARQGMKCCREDVFNLAMWVWKKYSPPPDRQIWDLI

SEQ ID NO: 996887 - protein, 139 aa, Homo sapiens
DSSAHTQMIRKQNNLIADMETVLVVWIEDQTSHNIKPKQTQSKALTLFNSVKAERGEEAAEKLGEVGSQGLRKEDSSKSYKWKANQEVADVEAVASYPEDVAKIIDKDGYTKQRIFSVVETAFYWKKMLSRTFLARGEK

SEQ ID NO: 996888 - protein, 329 aa, Homo sapiens
SEIQDGCCTMSVVCARAPSQTPGVHVSGDRSKRDSLLNYVVCCWVGQGKFQVYLVRQLVAQGAPSSSRAPSLPYQDSFGAAIARELHRSDHGSSHTAITEIAGRETLPNVAVSLMWLWREGKSPWTVFLMYPCNSYLDTVGLSVGTHFLGPRNDFAQWGFPYHGFALGYRIGPFGAIRALDFPWLGLVWGLGTKGLHWALTPQRARDFGESTQGALFPSALSRNPLHLVNKWRRLKSFGEGASPTCGKRNMCFWVPGTLAKGSLGRTPPMAGECEAAISRFGGPTRGYFEHRVLWEEGVTPLSNRRTKVTYAALWNVATPGGETTTKQL

SEQ ID NO: 996889 - protein, 145 aa, Homo sapiens
MTPLTQNLSPNHIQLRRSLSRSVRYARYNMLRHDDNFGSLLGWPGLILQNHHRNYSLVHCHVLTSTPSIRAVSFYSRAYYSLLRMVTLMGLNHHAYLALPRWRASEYVLFIVHSFATHRGEGLIVTGVSFIIACEKTRDDQCVPI

SEQ ID NO: 996890 - protein, 277 aa, Homo sapiens
MEFLWAPLLGVCCGLADVDRHTVLLEQFKSQVIREVTDYHQYNVHVCNDHTDGASIGPDILERSASVDGQLAHGSKVPLSVTPVWKHEGRIHDGARPQVQRTTCVLLVSATGLSGNAIGPENACLMNVPRRLHTLSTAWARSSTEGGQEYYLRSFRELIRSRHWERRCFEGWTGCTCSWGQVSLRQCPPGPMAKASREGDFAAGMETYEVAGFVLVSTRFQQVLAPLPSWTNLSVELVLDPFTTFLRAWKPRGGGVPQPGLKEGTGPEKSGGLARTD

SEQ ID NO: 996891 - protein, 346 aa, Homo sapiens
MHLDMTSQQILTRAIYTGPDPLAFNQNTGGVKPSICIHIMMHHDNPIFTHEARDSMRTYDRQRHKECIRCTTCMTANGIHTGTTLVEEQQRNIGNERCHEQNPMDHPDRYHYMETPQEAHQCHPQNHRLTHERRNNTPKRDTTKTTSRADTNTGEHDHTTDVTTAGTTNPGANAHKRTETSGQQRTKTDTKRQHPCPCNTQNHRHTNQAQENTPPESLNTTNKTNEHSQNLHAQDQKTHKQQTHTRQKPTHNDANKSTAQRHKQQLNRRNKNPTKKTTPQHQHLSQTEGPTTKKTINKQNKNSQNNKEKHTDTKTTQNKTKGRTHKRQQREQTPKRKEKHTKKTNK

SEQ ID NO: 996892 - protein, 247 aa, Homo sapiens
MQEPIDNQHNKSKTEQQKHTDNKKRTNNQTPNTDNNKTQETTSDQTHHSDDTRPTDIGKHKGSNTHTDRSNNKKQPHKKTSNTRQATTDKPHTRPHNQETTTTDKHYAAHTHTNRTNTDTPTGSGQHKQTNTQRTRTTPAEPSRTPAKKQHNTQTNTTQQKKAKSRARTRRDEPRQRACRNRRAQRQRHDDRVAQTDNQTNSAQTTLRSAETTHRQQQHGDTGTHNDTDRRPARRHSTQNKHTSRDI

SEQ ID NO: 996893 - protein, 293 aa, Homo sapiens
MCNSTGHSPVSFMSNDSSIMAHAPCTCHVIQGTHNVFTCLYHSNSTTSSFLITGILGRHEATAGVIGIKQCAESRKHTKQSVSYCNYSKKKYKEKREESATLGEGNTAFPNTNTTNHPTSGSVTHKTRDAPSTTHTNVTTHTGQPQYSHHARDTSKCTQHAQATGLKPPHTQNRHQTPPRHTIRYTTTKAGETPKTNRDPNRRRNTSTRKDMKKSKEATATANNTTQRHRTDTRAKHKKNVNERQGEHNPTTKDRSHQDSRTTNKTTQAAPGKKRRKKHTLRPTRARERRRQQ

SEQ ID NO: 996894 - protein, 138 aa, Homo sapiens
MKTRNSTIRAYTSPPKQNPGTQATKRSPKRTTTKQTKQTNEAKQNNTTKGHKQQPTARHNQNSNSRNNTRQTTHHDYRRAQRKRTQQTTKNQRHRQTTETRKQTKIQKKQKHKPATPKRKPRKINGRDKRADKKNIMN

SEQ ID NO: 996895 - protein, 121 aa, Homo sapiens
EQQQEEAEHESIVGNHDSVSGPRCSPFSRPERLTKEKLTYLVRIASDFAFALHRLVTWCPYQIEDRLDSWKVLEEHTQTLQRDTSMMTVGNMGYICLDPVRSEVRNTLIVRQHGMLVFHLT

SEQ ID NO: 996896 - protein, 192 aa, Homo sapiens
DVKVRDFVGWFRDHMQTSYGQKMGSNGAQTQGLASLGEDFSDAHDAKPGLNDLMENLPLPDNIAKLRMARLTSWPPRLPSYLGKGLDLGPKDVQRLMGFCINQPRRTNARSGIQQIFTFSMLSWHAGPICTARLIAQGNSPQSGGTRGGIHGTRTRRTSTRNQYARTVKIRRHERENDKQEQNPIEMGTNRR

SEQ ID NO: 996897 - protein, 387 aa, Homo sapiens
TQYSEMPKMVLANCSLMCSTTMLLFCITITLLTGQQHTIHLNACSTLASVHFRHMQNHSIQHTITQFMHQGTHYHIVFGLTIDHKASTLITSSATVVIPILVWGYNQIGKHNTIGSIRINGKRFTVGRSIFILNAVVFSEEQVGSATHWYRSFSRINYLLRRLFGNRFHWHEVGHWGQNSNFPKFVGILVTHGRVGASHMGDNTEGHPRIDYYYNTTLKTVYFLGEQTGYTTFNDQKPFGHTEGNSFPLGVIPSFTFNRQLPEKGALKQQNHSGLEYGQRHGNRNSFPKPPQRGGTKSSTTGHQILGTHNGGAIHLPKATVPTGGYHQFQKTPSVDPTITITHSQNSQGESELNNHITYTLGAPTTRYRHRKEGKHSTTPATSSTRG

SEQ ID NO: 996898 - protein, 228 aa, Homo sapiens
IVVVMKVAEQTPLSGLYVAKLQLKEAGRYPPGCCVNNCALRFGPHELRSLAFNSHEDVGQSGIQQAPLRFGRVIQCCCWEQTNLQESELESWGGEGAPKHHHVHDACYGLGPVGTGPFRPVLQQGASAVLCRLPVTFRAGRTSIDEGNVEMRAAVARAKDLRVDRWKPALNEAKNQKTGVPHGWTATSAFNETIRYVITIRYHGGNPNSTAERNTGPVACAEQANLEW

SEQ ID NO: 996899 - protein, 86 aa, Homo sapiens
MQTYISVVSDANVITLTAFYTMTLIFFHCIRSHTDSKPIKNLDSINFYRPSTDNGRNLEPVHGPKVKQKRKAPKLKFGAQCRLPIN

SEQ ID NO: 996900 - protein, 139 aa, Homo sapiens
DLEHVEVLQKKFEEFQTDMAAHEERVNEVNQFAAEYSSRSYYPEEELIKTKQDEVNAAWERLKGLALQRQGNALWGSEKFERFNRDVDETISWIKEKERLMASDDYGRDLASVQALLRKHEGLERDLAALEDKVKSPVC

SEQ ID NO: 996901 - protein, 185 aa, Homo sapiens
MRDSRCAHETWALSHSLQPRTSFPEVYVDHSGEENYVADIEVDGKQVELAMRDTAGQEDYDRLRTLSYPDTDVILLCIPSTDLIVSENIPEKWTQKSSFLSQRAIILVGNKKDLLELTSTQGGSIAKTKHEPVTPERRQSIMATQGMGASGVPWTEDHQHTKDGVKRAHDNGTQTPPRPPNHGRQ

SEQ ID NO: 996902 - protein, 213 aa, Homo sapiens
MGIGADWTGAHEFGVTFKEQAGSSGIITIKPWALGAKQLAKMARGPGSPRAPYLWGQTGQQPGETYLSTSSLAQYTSVASGRTSGPIRHRILHVNSLGRVQSGLITFTHPLLREPTTRFPSENLGHTATPFCENSLNWGSPWAPILSGSIYQKGATYTSPLAIVNPLVQLSPKGRHEIGFIWGLPFPETDCGNNGSQRFPPFLLKRGSTRCST

SEQ ID NO: 996903 - protein, 37 aa, Homo sapiens
MVCRTKIGLKTPVVPQRRTVDVKNDDALRQYFPLAKN

SEQ ID NO: 996904 - protein, 70 aa, Homo sapiens
MRTGGNAPPFAARWGTSAEHHWRHGRTQRGHSKRDTLGPHEARHNVQERRHEEAGGRADTPTGRMSTQRT

SEQ ID NO: 996905 - protein, 179 aa, Homo sapiens
MRRPVGYILVDTRIQSIGQGDNKRWHRRVHNTGVTTPLAMMQTHYQYAMHRSEYKQPDAEVTRDYTSRQQLSNTVDLTRSNRKEPPRITLQRKTTTECTKPTGYKSNVPDTKEQERSTTENSQGNVNYKRRGKRGSQQQRSATTRDHHRNERNTHHEHRERPHKKENEEEDKPQHHPRD

SEQ ID NO: 996906 - protein, 216 aa, Homo sapiens
MLSRLKCFGPRAVDSRTRVQPPHPRRPSTSAHDPFMPHPEPPPAASTPLTLPPTPLPPGRTPPARPHPTPQSPRAPTPPRQLHHHRHHPDRSPPPPDPHHPPHPPHAPPPRQPAPPPPPPHPPHTPPPTHPAAPPTRHAAHLRPRPPTATRTTTPRHDDPRTPPAPPPTPAHSRTNAERTTPHGAPQQPEPTDTQTPTNTPATTLSPRAHARPHHG

SEQ ID NO: 996907 - protein, 128 aa, Homo sapiens
MSEGNSYIIIIIFFWRRCLALSLRLQCSGATSAHCKLRLPGSCHSPVSASRLAGTTGPRHHAWLIFLFVFCLSLPTGWDCRPLPPRPASFLVCIFGGDGVSPCRPGWSRPPDLVICLPRPPKVLGLQT

SEQ ID NO: 996908 - protein, 358 aa, Homo sapiens
MDITREVCGAMENRSEIVQYATYMTIGNTTFIKAEDRENISGDILQYKALWDTWNGKTTDSETQNSKRGSMGSMAKRVSPKTHIVRDREHTDPMGTTTQATTGTTTRNILSTHHQSNSHANTHDRQPERSEPTTDNATNHLTPGHTHQEAHKAKLVDQRESQPDTLGAKERTADQERTHTTRPHPSAPTPTPSEAPHTTRTQTKDANQYQTRHKAARKRQPLTYATTRTPTPRNPKQRDPPTLATGRGHTPTTTTDARQPNNNTRPACAVRSEPATRARQHNNANATMNDSAEGVQHTPTPDKGKRSPTDKGRSYTETSNTTAEDNRATIRSQPTSPPHPTITCTKSASDKTTPEEHE

SEQ ID NO: 996909 - protein, 91 aa, Homo sapiens
QTPILCLFGKTKIFFADNRSMRKCHHQQTVHLIEWYSEFHEQSICVWLHCIAFSTSELLSFHPAAQTLIKIVKKTYRDLSIAGCDGRNTEQ

SEQ ID NO: 996910 - protein, 103 aa, Homo sapiens
GSPNLEKVISHALLRGLVLGKLGKAGHKATLEEARRRFKDHVEGKQILSADLRSSCLSDLVRKHGDGTTLAYECVRNFINEADMQEENNRNRKSPWSLLFGLT

SEQ ID NO: 996911 - protein, 201 aa, Homo sapiens
MFNVSKFLWRLYTSLGFLVQRVRTAFFPPLSLSYLVFWIDLTLKRLRELTKLTDFNVIWWNNGHFNDCPGLAGVTRICNPSAMNGRRRRQPLDRKYRDQAGPRVGETPCPLIKNTKTLVTALRTINTTQKHVKHPHSSTGHRTPTVWDNHQKETTRDRHSARGPDPTTPPPLTPHSRRDYSDGTHHPGRHPPTGQHTPSAH

SEQ ID NO: 996912 - protein, 72 aa, Homo sapiens
EPYIKVRICFVAGATLLIAGTPGNHWLCVVMLFDVYVERSTLVFAQYHFLVSNITFGWSCRLGMARVSGLLI

SEQ ID NO: 996913 - protein, 39 aa, Homo sapiens
MTEEEREKATREVNDGETRDEEEHEAKYEKCEERQNNTD

SEQ ID NO: 996914 - protein, 76 aa, Homo sapiens
INPLAQPVIYSSPIVCEAHFIDQRISIARDLFTVVVPRNKPCVALDYQFVTKKFKPVSSTRSLPVTYFHHVKQPYP

SEQ ID NO: 996915 - protein, 97 aa, Homo sapiens
GNLLRTHKTKLKSLFGSTVKRPEHILQKAQRKDVLMDYYRKYAAILLVTLSAGVCMFVRFRSCCAGWPENARYEENRILLPDRVTQYFSAMGMHACS

SEQ ID NO: 996916 - protein, 78 aa, Homo sapiens
TLYCCGTSGSVFVGILVMNSRRYIENMIVCVFHVYIYTTYLYPFGITANVTRSTGMRLPFIACVVCADSIHTFGNKYD

SEQ ID NO: 996917 - protein, 72 aa, Homo sapiens
YSGINGVRYAEMLMRELNPSVDYNLLTVPCAAQFKTCQSRLACQGNFRRKTVVLDEIIVTNRYDSSFALLSR

SEQ ID NO: 996918 - protein, 108 aa, Homo sapiens
MHVAVARVNGVLYLQCFKERTREVRCAKGGGAHASHQSFDSYLKKGVKVAKSICTLLERVRSKFRCRGEWEVWVSGGELKCSGIMPMEFQGCEGMGGIWRRTIRLELD

SEQ ID NO: 996919 - protein, 172 aa, Homo sapiens
AVRFCFHCDKAASNSMQCLTIAALSFFQAQRFSLYATKPLPWDGDRWHQQLKTVFPTLFIASFNSMKLKSGTVSAHPIVGSYDEGAFLCVDSFKFYVPVGDGEMEPSIQPSCSTSYNGSPQPPGHGLVLVCGLLGTTLQQQEVSSRQASEASSVFTATTHFSLPPELHLPSY

SEQ ID NO: 996920 - protein, 69 aa, Homo sapiens
ECDESPKGATVSMSQCLDESSDATESVLSTCASTVSRSALRILWVLGAEVLSSAGVALVVWFLMAKGSF

SEQ ID NO: 996921 - protein, 300 aa, Homo sapiens
MFNVNATYLVSTKRVKLCKIFQEIYSEPNVSDQWPVTQPSGDPENMRPRQLSYNLVLYISGRHNTSINICKMYIGSVQKAGTIEQVGDFPGRRQIQRFFCWVQWLIPVIPALREAKAGRSLEARSSRPAWPTWQNPISTKNTKISQAWCVHICNPSYLGGRGWEQSFSMQEARGCTEPRKRHLHSILGDTEDSNPQQKHSATDKTQETISRQPHRTENRARQTHRSAPHGPRTGTGRRLPDTARDPLREDLAGETKGTEHVHPSEEKDPAAHQAVLEQHSERGTLRTHKRRNNTGENNRT

SEQ ID NO: 996922 - protein, 291 aa, Homo sapiens
MREKPRATKHKTVREERPPPHSTKKRREESNRDTLREQQSPHQRTSPRRPQRGNSIQTHREESTTEQTTREIFKNNTATGRCGPTRRRQPEETAGNRAPKNDNHVAHHTSRHTNTTRHEDRGDNTPTGTKEHEDVKRRRQDTNGQSNEHPIGENNKPEADAEPIDDPTKRTARSSTTNEDVCHYNQNNHISHHIHTTFKAAITYLNPHYIYNSHTRLPPHITSTKNPPPPIESRPHNTSGRRARKHKESGRTTRQHGSITKDHSRKGKEGSTTKVAHKGAQTEARREQPAG

SEQ ID NO: 996923 - protein, 200 aa, Homo sapiens
MSEDEHLYMCLKAICMFFSVIFFGRILCSFFYWIIHLFLIHSGKSSLYIEEIGSSYTVGVINIHSTLSFNFSSPRRKSHPGCPAWACSGPDLGQVQAILVPHPPEELGITGAYHHTQLIFGISSRSRQGLAMWARLVLNSLISGDPPCLDLPKCWDYSQEPPHRGHGPLNLDLGISHYSFKTYWNSLICNFHASELWHDF

SEQ ID NO: 996924 - protein, 213 aa, Homo sapiens
NGMEWNRMERKVMEPTRVEWNGMEWNGMEESGREWNRMERNVMEPTRVEWNVMEWNRMELNQLERNERNGMEWNGMERYRMELNQPNGMEWNGMEWNGMEWNRMELNEHERNGMECIENGMESSRVEWNGMSWNGMEWNGMEWNGMEWSVIEWNGQLLDLEWNGNGVEWNGIKQSGMEWNGMEWNGMEWNRMELHKPRGMACNGMVWKGKDCN

SEQ ID NO: 996925 - protein, 85 aa, Homo sapiens
QSDMFDQRLQIKSFKIELIYPMVVKMDSTKLVELSTEVLSNVNFHLRRQKIIRTITLMKSSQDTGKLLSWRVRRYTKRLRKMGAV

SEQ ID NO: 996926 - protein, 128 aa, Homo sapiens
MESRQNQRRGTRVAKKPVYTVGGWSNVDGKFAWEKSVVTWTCEPAQELIAKCCGQPLTKRDLSQYCKPRYIVQCDDFGIVEQFCQGMSRDIELPIIDEGSQPILSCPCVMRCLISALDRIMQVSEKFH

SEQ ID NO: 996927 - protein, 67 aa, Homo sapiens
LKKRQKTERQQKETKKKDTSTERKKETKQKTEDQKRRKKTKQTTEDKKKTHRQHKENTNKNKTTTQI

SEQ ID NO: 996928 - protein, 174 aa, Homo sapiens
QLLRTHKRKLKSHLRIRQFKRPEHTPCRKAREKWSAMGLLTGTMYADSLSGHICRDGVHAVILQFLHPDCAGICPECTLTGKDPVSFLPGRRVSQVHSGAMGLGVLRLEAYPHVQLNRSIEGLIVWIARRRTGDLSEVAVACCRLKVHINLGCDQLIWGGFQKGVRNLNGRANG

SEQ ID NO: 996929 - protein, 75 aa, Homo sapiens
GKWVAALDERGPPLYVPAARVEAVGLSLAADSCCLVPRCWSSRRRGLREESSGARDARLRRLPGGIGSVSKLRMT

SEQ ID NO: 996930 - protein, 282 aa, Homo sapiens
SPSSEPQPVQPCHGAKTLQDSLNGSSRCSMVSLRCSQWLSYGGALSLADGEPVQVSRDPSRVYTPKSPDSDSLLERLTRTLLNSRLQGPSRAGRIRYDTSSVPGPPCKFREYIDAKKSAGLGASRAEAHLDNTGQYTLLSALSLCSVVALLHGVLLTELSLRVFVFPELVTPHRQFEWFGVNCLYNVKRHDEAALTFRMTYGKLLPSETPRSGRLFDRKRGQADLLDSTTSGKRNFACAGNFSSGFPELGPKSWNVSQLVACPGTAVHGWAASVKRALFAPS

SEQ ID NO: 996931 - protein, 169 aa, Homo sapiens
RKIKRDKEGHYMMVKGSFQQEELTILNIYAPNTGAPRFIKQVLRDLQRDLDSHTIIMGDFNTPLSTLDRSTRQKVNKDIQELNSALHQADLIDIYRTLQPKSTEYTFFSAHHTYSKIDHTVGSKALLSKCKRTEIITNCLSDHSAIKLELRIKKLTQNHSTTWKLNNCS

SEQ ID NO: 996932 - protein, 100 aa, Homo sapiens
ENQSTEVYCYLMELDGVSYQVEPSNVAPFSHRKLCRITSNTTGLGREGIGRGIHVNRTISGPCLLIEYSPKKQSDLHLYRDRAAVIPALLTNRKHKSKYQ

SEQ ID NO: 996933 - protein, 70 aa, Homo sapiens
ETDKWVANSKVLCLFQSQVVKFVFRYLWMRNEETLEYMKNEVDLADSIRDSNKYATSAVFEEYGDKVMVR

SEQ ID NO: 996934 - protein, 118 aa, Homo sapiens
MDPQTGGAISSTGSVMMDSGYCFPIPSWPFGHPAIMNRSCVGHMAAYEEKMLLFPFEDGKPFELCIYVRRKEYQVMVNGQRIYNFAHRFPPASVKMLQVLRAYLPDPECSSRASQAQH

SEQ ID NO: 996935 - protein, 93 aa, Homo sapiens
MITMPEELIDDYVITYMREKERTRGRIVKRYLWKMEMEVLVVHYVFYSLGRMYIVESTDMQHVWLICHELRLYGRDDFGIGFVLQEAENEQFP

SEQ ID NO: 996936 - protein, 101 aa, Homo sapiens
KGLKIQPWVTSGRSKLINSCNFFMEAMNVFSGTDRLRKIVSLMAIGTINGTYVVLCSAGALLDRPSVRSTWVVRGIRLLVRLVWHILGHFRLLFSENTHNN

SEQ ID NO: 996937 - protein, 215 aa, Homo sapiens
MPVDLSKWSGPWACKKWNEQRSTVMSLRRGGVDELASADAHQVRIDHSIRGWSDQEALHLVWQTRMLQRKDPNTEMDHSVVNMKGNDISSAQSLSDLWARAPKARLHRCCWLRADSRKVTAISERLEHVESSGVFVQVELRPGLPVSGEWMTMAKCRPVWSRGSGDLMLGPACPVRVLFWSLSALAVHCGPWIGASARPFLPLPVSSAVDSWGVG

SEQ ID NO: 996938 - protein, 162 aa, Homo sapiens
MDCFLSILKKLINMTELCHSRKVGVRNSEQDNGDRIVLVMDMNFLVYYRVGSRWLKRDDPEVDYCVDERPGFVNDYEQRKGWLGLIAKELVTLGVPSHQGIGQEEALSSLICMQLVLWNVVWTRKSVSERRAFWEQPGLCFSPVKPSDHGQTRSNDDYFYHD

SEQ ID NO: 996939 - protein, 47 aa, Homo sapiens
MNEPDGPGCGRIAPAHEREKNRGDTEKAGALEKEIIQTAPHTRKSQH

SEQ ID NO: 996940 - protein, 402 aa, Homo sapiens
GSQLLTPCLSLSSSCYFSLQSTHNVASRQSHKGKSQHMSIGAAADIYCMMHHTQNINQCMAKLPFHAAAMGYQALCVGTWINAHKPIRTMTVIDWLPQVKQWGPKPFILEILGKGCHRTRSLMPANPQWTLLDSLCKDASVTNRKMVAGSLRESPYPGTNKGSQFGGAHGGGLVGKGQKVNRFRHKWRHRPEHRPQYTSGSTHTCHGKRENSHRWKGNSWRKGNQEGRIDGTAHNARTRKIRAKNRDTTRDNPTRNVRNRIRTNNWAWATHQALRIATPPDRDTADPDTQGKETQGKQPTLPKPTPGARGTNDNDTARMNRENAHSHHMTVQDKALTRIVAEKAPVTQVPISTRNVRARKQGHRNTQRDEKTNYHSDGTTTKRPHIIKNITETSVTAIHHNG

SEQ ID NO: 996941 - protein, 208 aa, Homo sapiens
MLIRCCIENVERHYFVGIFAILMNSARVGDENASATNAQYERSMHVSVTVLYSIRAMLLCYGMSLLFTAAEEGLMATLCGSGSAMGRRECCSITFLNGFCMLALHSALRLCDSDGHFSTDTFGLFAISYHEIVILDGNSCKCRGLNMVIVTPSTSSKAHDLGAPWSWTEEEAAQRESSWSKTSPAAPTQPAARWPRRPPGMALATGPG

SEQ ID NO: 996942 - protein, 246 aa, Homo sapiens
MTAESTAQQPVGSRVVPEQSDALILAHSILVAMAVNEDRDLRRHWTRSGDSTTHGARECQHVLLELTVLRAGLLSWLLIRGRPAAHVVVGDVLQAADVDKTVAGQDAVIVLLGTRNDLSPTTVMSEGARNIVAAMKAHGVDKVVAAPRLSCSGTLTKVPPRLQAVTDDHIRMHKVLRESGLKYVAVMPHTEETSHYTGAYTVTLVDEGPQGSSPKHDLGHFMLRCSTRMSTTDTGLTLTQYSSICP

SEQ ID NO: 996943 - protein, 116 aa, Homo sapiens
MCAYSRIFQPLWGETRGGKHGRPEGTSLQRGPPQRFTTRAHASVGTITKRRQILVGMVGTRGEPITIRRGDNNKRGHGLEGSQKRSAKMTAPQRGDPLKECKISRTEGGPRGKIHP

SEQ ID NO: 996944 - protein, 96 aa, Homo sapiens
MCCTFKQHERHTISGNLVEQGQNNELHEYYATQGVRHTKGKGGSLQNRLPLDTPIREDRNPAARRSQEQSPHKESLGGIQPEAGERPPGNTRKAHV

SEQ ID NO: 996945 - protein, 60 aa, Homo sapiens
MHPGTGLTPFYAGLDLPNKVFKTYDGTRGPPERTVNTGAKAAPEEKHGAREQGERNATNT

SEQ ID NO: 996946 - protein, 284 aa, Homo sapiens
MRLYLRRFTEKALITVALALGSFQIGGTLKPSFPQLVYLGPITHSEWGFIFSQNGASWRLIKRPQRAWWCSWGGANKNWWVWGIPKRAPKGTSFNRFIIFGSSHTTEVNHVGRQVFRKKAPRRLRYTLLRGEGNFIIKGTSVGPEGIFKRSRTRKDDLWGGIFLFPQRPQKQPSTKEQKNRQTVFSAATWAAPREKRFPTNTMGVGARRHPTMGDAETHVGKQGVPQEEHAGDTNRGGGISARKIKERGRGTNRAVLCNTTGEGMRKGNRGDHNRRTQSEDDKN

SEQ ID NO: 996947 - protein, 116 aa, Homo sapiens
MLSKTRILDLRSPPVAQVFLRGSFEWRLDPRGRKLVLVKMWGLLRDWTGEILGRCICGQKKRTSPYYQVKTMFGIASLVSGKKPLANPWLLGEGRALPVDGHQLIQKCRDEGIPGK

SEQ ID NO: 996948 - protein, 172 aa, Homo sapiens
MLVSGGVLLVALLPMCRMHGLLLSRGPGPGSSAGAEAPQALILAACVVVRAAPASRRLGRCCFREGEEYFLWPGGDRLQEPGVPFRPPPRSSPEAAAAALRRNRRRQLFPRVLQQLLLASELARTARGLAERGLGMPSGAPGGTGERKGVRGSSISWISLPLLRESLWKWQA

SEQ ID NO: 996949 - protein, 239 aa, Homo sapiens
MIPMMARCRHEKALYQGHSRHPTCPKRGLRYGIIPIYYLEKFVFFARIFLSSLTISSSSSTSTLNYREGPHGIALKHGHHPVIGNPLRSLHVLNDYSVFTALITEFIRIHADVFTHRCIVCNMANSYKSIINFSMPSWLILQYVHSGVLLIYVTPTLIKDSFRKLTYTDRYFTLLIAIFPEGGNSYGASISISAGYAARGHIPSGKVYHPVHFTCALRDLFAHAKLRAGLFNSRGQKQK

SEQ ID NO: 996950 - protein, 337 aa, Homo sapiens
GPAPAPSPDLARGSLRLRHGHLPAEVAFCPQVYTLPKSPRSPQEEIDSILGETLEGPWTRRKKAKEVSELQEDGHELTINLPPQTNIPNELDPEGHECWKDNERAKQRTRSQTSNAAEPHKTINTTLALTGYFKSDPGTSTDCSTRLATTTDMHKRHTTPRLESILGYIDLEEPNRSHSTRHRIMSTTKQLSGRQIDETAIQHMIAHSKRITTTMTHTNEHHGIQDNRPQHAPCARHTWYTIANHNMKIPQRGNKAHPREHIDSHSPPIRKAHISKHRHVENKYDIAEIITTSDNTHYDPKQKTRITITRYERNNNYLLTIQHPQFSNYHNLLRTPI

SEQ ID NO: 996951 - protein, 129 aa, Homo sapiens
IQRSLYDRPASSSDRNLCSDSEVQTHLHFEHASTPAQAFNYQFGILVAAYTSSKLPAGTWQFIRRSTKISVPPCIWLLANVLLATKEQNIEASDRLMAMASSTSIAMHSETHGSRTQAGHPYHCPLQVA

SEQ ID NO: 996952 - protein, 36 aa, Homo sapiens
MAREEIIEEGADYTNNGEGGATKEAKATPNKKKKNH

SEQ ID NO: 996953 - protein, 100 aa, Homo sapiens
MGRNGTQCRRERVPKPRSGGVKPHRSQWLNKLTWSWEPPSAGALSSSTVRLFHNKRVGSQCPRTQSTGARSKRTSEEKTRARRVCRRGNCGKCNALRGGG

SEQ ID NO: 996954 - protein, 101 aa, Homo sapiens
MNSEEGNIARQSYPLSGIVDLIMIILAPFIHMTVHVGTMCWAVTDLLACMTGTQQCTASEECMLCSTRVDSGGLPNAYLHCPRWTLGLACICTCTTPITEH

SEQ ID NO: 996955 - protein, 233 aa, Homo sapiens
DFATELILAEKRGDLTERECEPSAVLEMLISSILDRCLVIFVLSCYFLICKCSAKCQQEAHNKGIVHDVSIRWSRVHTRLHEYTQKLQGEWKNVHFYRDRTRVASTSRWTLDHAATAVEKSDVNRWSTSVSNRGQTVIQNIGEDAQTSSDNPKSQMKYTLENLAENVALYGTFSHLASGPVAVQESTSPMVMMKAILVTLLRRFHVTDNCKDSGVDEHTDRYTDLSLAPKMQH

SEQ ID NO: 996956 - protein, 352 aa, Homo sapiens
GVRSPPRPPRGPSRPSLSCPSIVHVCPWIFIIRRLKPGLLCGQLSRPVCACVPESPRGPLACMQPSTASGPRWLRVAGAALSYWWGRGWCVPALSAHRAPFYVGSPCVALTFSVFGTVRAHSSSIGVLQRRGELVKSRGPSNVLRVCPPFCSCSGARYPGGPVASRIWLVLCTAGDACLGFVSQAVGAMVLGGVPRTFFGGSQIGWGFRGAPLPRLCGVGMVGSGWECASLVVALAGIAGVGERSRSQCKSPEGTDGFGPPVLPWFRTCKFVGALEDRELVDLLANALTSRGGTLGSAQWVHVLALCWGCNVAPGNPPVFHGELAPSPVRFPGDLRPILAGVPLPHGPEASV

SEQ ID NO: 996957 - protein, 294 aa, Homo sapiens
ERTRRNGKGGGEKKEGKIRKRGRQAEAARCQAGNTGSQTVEEQAASTGSQEAAASSKGDGARTKQAMLELLNKAARHSNKRQWTHSEEQASNYRQLPQRKERSTASKRHSSAASRSATQAGRSDRRQGTSEAAQHNSGHKAQRREEAQAQRAGGAPHTHTQTQRAGTGTRQARGTQQGLPTRKGQHKHTRQFTHKVGATRKASATHTHRGRLSGKGQARDAKAHHGVCTGHVNGTPTARSTFVQDTLTLNTSKQAQRDGHHTGEVWGRNRGRERTFTETYRGGYATGTAGNDRH

SEQ ID NO: 996958 - protein, 40 aa, Homo sapiens
MRQALHIHQPARGRCTHNRKRRVERYIYKIYNRAGVYCWW

SEQ ID NO: 996959 - protein, 157 aa, Homo sapiens
MGVDLFEKVYGWAVAGGRGYTAQKPRIEGASRGPRGDHSGGRWAVLPVVYVLYFLNWNNRIDATRVQNPPEGSLGYPWARESPKWGWNLGRQSTGIPRGGGTDTELVQDTTHRGGPPGQGGTGDTGGGVPSPAALGFCAPSKGALGHARGYLWGGGE

SEQ ID NO: 996960 - protein, 106 aa, Homo sapiens
MKLLAHSLCAVPESSKSPRGAYCLAMRYLHQIAVEPLLFSQFGPTIYSETVDSEAEIIRVPSRQMAPQYSVICLFRTHRARPILRIIVSSSEDAETCGHYPPAMQL

SEQ ID NO: 996961 - protein, 191 aa, Homo sapiens
MLPFRGDRTVVSSSIEVAILASSCKSVPCTFKERLVERVHGGRALCTEDSWNARFLITLHVSIPTRSPNATFQGLFKWILGLDPCSLYLLSNYTGWSKRIPDGSLGDLHLTFDRGAKVVVPLNLFTKSSKNLVAGLPFLDMVFYCFPRIFNGSLLLASGAHNLAYQCNTLLAAKRRNRSGTALLDIVGLRS

SEQ ID NO: 996962 - protein, 92 aa, Homo sapiens
TQRHKKHNQTTKNTQPSRAEKRQRTAKDQPPRPAAGRQSNEPYLEAEPDRQTPTGTRSNGQTAQDKAGHHPPERDKTTNRQQRREDRKKEKN

SEQ ID NO: 996963 - protein, 164 aa, Homo sapiens
MVTMQALYMVRTEDAYCHPSHKNESLIILVMITALISHVSCSLLFRSPGMPFVLTFTKKVSNTNISDSQEIETVLKLSCPTVILVLHRPSHPYAILYITRRGQRIPSLYLSNSIGAHEMVLNRTEYSRLQAGRNLSISLTYFPPIDWLEPWRTCRRPLTVDKST

SEQ ID NO: 996964 - protein, 144 aa, Homo sapiens
MVTSQSFAIVPPDEEHGKQAENLAYRLELNGHYGDDVTWESDSIDLFHDGMATAIHEIRDLSSPMTTSNCTAYGRTMGTSGIHVNYFHVSEIGKSKHILGHGGSQLQFHQTDTGTHLSGNLEALTGTGDAQTPWQGYHHDRNGL

SEQ ID NO: 996965 - protein, 82 aa, Homo sapiens
EHVSTLAERSNTARMVLREDREMKEEEIQSDNFHRIYRTPAAYYTQLSHGCRTQERLAHILPCEQSIQLYTSAQSEYSITHV

SEQ ID NO: 996966 - protein, 394 aa, Homo sapiens
MCRCVLLDVESTHRIQHMGSVHVTARQNERFSRYTGGYLGSEGCDMEEMRYWNYVVYSLLQLSKLRRVDSRGKLREQIVVNEVHLGESGLKHAYVGRIVGPIGIAYVLESTLVTGHGRAIWLAGYAQASISSSFPFDQLPEEGSQYWPVSGPPADKTRGPISRPNKPLCNSTLDNMEWNEEPLILNNQKSTRRSVNRLFEESKYTMVMTTLSHREKPLCSSPLFGNLRILSRRAPQFGFIHPIFEIADSKRANFQTFRRELRIYKGDMVHEHRRFYTTSTCLPNSAPISNIFVVDTPTWRNYISKRASLVDLTEDKRSLHWDLGSFFPGAEDRSGNPCIRRHIPIHTESFDETNGDTPAITLGKFPLWPEKNSTPRRRATDHEANTRSQSEIES

SEQ ID NO: 996967 - protein, 154 aa, Homo sapiens
MYCYPGSHLARAADCGRWLLALVLALLVGPFLSGGGGDPMRRGGRWARDGPVPPALTQGRIGAPGRLVRDRLTYGGRNATLTPDGHWSQTLTKSHTERLGLGLPWSLGTSRPIQMTGFAGPYSRRDSGERLSLCTRTAHYIHTCNKRTGKHRQR

SEQ ID NO: 996968 - protein, 212 aa, Homo sapiens
MPFSPGPLAVHVSSWERVLRLMEEDPAFRRGSSSPCGIVQRDSYGCRGSVEGVWGPWGGGAVVDGPPARLCVAHFDEGPKRIDFAHTVHMRRNPHEAKRGKYFEAQGNYGGRRVWRACLDHLVVPNGPLESNEIQRQLQMGKGAKTTLENQAQEGHTPKRYTQRVIRRSTQGREAPLVQREYQCPQEGKFWVDESDLGNTHRRGSKPRDDYG

SEQ ID NO: 996969 - protein, 280 aa, Homo sapiens
LRNEKCHDYYTTEFLYKPVLIEQGKGRSSDCRYLTLSMRRTLAAMGWTHPNPPLTSELCGPSVVGEWPCMWFVSEKLREVDLLKGRVFIQLPQTRPCVIGLNKNGGWLVLAPVTEAQGKTLISMHRDATGAVVAEPAAHAEDAGTIPHQYGRLRVRGAGARDPPDPEHGQGLLRPAMPTPLPSPHPCQRSARAQMGPGLLCLEPAGRWGLRTCSAHPCLYAWAPARPPSGWCLETSLPGPPDRRTEYPGAFNFLTRGRGSCTAYGGYCPWLKETHEASRI

SEQ ID NO: 996970 - protein, 65 aa, Homo sapiens
MDEGSPSTFSSSAHLHLTLDQSRYSTSIVLSTTRTFRSPSVHTRPETPDYTPYILSPVTCKKVLS

SEQ ID NO: 996971 - protein, 167 aa, Homo sapiens
MQPLRFPNTTQFSCECRISLILNTSLYPHTLLPLLPVSETYVELAIYYVICALSVHPSCPVPSLPFSSGAIQSLFLPSLLSVPSPSFVLSASSRRPPAFPVDYQRTVLQPCALPLYATPHARRSRGGGCALPTHVTRSRLVLLSSSRHVHCSRILFCALVSTALASP

SEQ ID NO: 996972 - protein, 225 aa, Homo sapiens
LESMIKKPRPTRGLKAVMWPMQSWMDPELSSCCLEKQPRGDYPLEAVRYAGTLIRPLRQKACSSTSCKLFRGISCQRMAPITRRPQASIALACTMGACERPPFYSDCKWWPIISPHPVSVQVVHHSGWPRYLSSVTAQIIACDPGIPSTALSGPPVLVASSLCCARHPVQDGLGLRTWTLRVNFAYEVLAKARGFFKKGDVVIVLTGWRPGSALHQAACVSFPVP

SEQ ID NO: 996973 - protein, 73 aa, Homo sapiens
MGEQVESRLESPDRKGHTQFSRKAMGPWDYWSPWSRKGMGTSVPYQQILMSGRLFTFWDYTPKTHLTYCSGEP

SEQ ID NO: 996974 - protein, 215 aa, Homo sapiens
MCYWDISGHECKYGGNTPKAPRGPPDSSQPTSPITCNVATEGYTSVDCSDSGVVSPTLHQPCLTVVRIFPVTTIIASRSMIEDALKHTHTTYTILVYPVAQQASALPLSSHTPRVHHVRSRDVYCILALLSSLITAMRAIELKIHHTYVLVPSHRSTLRTTRITALDRHYGTGAYCIDASVTKNRPRDMDAVVRHVIGPPLDPHYYTPPSSSIDR

SEQ ID NO: 996975 - protein, 181 aa, Homo sapiens
GHTTLLYQRGPRARPHALRIALRVRLGPPPSRPFTLYTSSLCPGEEAIVVSLVGPVRSMADGGGGRGNWQRWAGQELARLCRGSDWRYWASGGGWPHQTRLRCLPGEPAVIAHIGGAAQEAGASEDSYRTGRAWPDVAHQASVTKTEADKWIIIVSTHLDKQEWNPTDEQNTDAKRSEAEC

SEQ ID NO: 996976 - protein, 254 aa, Homo sapiens
LRPETHPSVLPVAPCIESANLGCDGSGEDEFTCYADYIAQRSHIQSKHMQDMQDLNSGSCIVVMLLWTLCCPCLTAAASNIGHMAQSYVTSSSHMDVQCMSLCIDWFSQTSDVAEVRALGLVQSPGQSADVLVAEHCSMMHQESSSNALEVVSTVEPSDPHCSLRRSTDISTFRNHLPLTKAQPDPAGMTVEEQPLPPTSNQDLGEASLQATLLGLAALNKAYPEVLAQGRTARVTLTSPLARPLLGWEYPGPG

SEQ ID NO: 996977 - protein, 111 aa, Homo sapiens
MAFPTHTGVGVGSPPHNDESSLITHYISENRGGTNKREGSPTSVGCAQFPIGRRGSAIPPKERPMGIFYHGDGGAVAEQGLLNNKGGAQGNTYHMRTQRSETTQAGIPRRH

SEQ ID NO: 996978 - protein, 113 aa, Homo sapiens
MATLRDRADRMTTLVRIAVPCIQSNLKSEWVFPKFRVKSTRIGLLAFCREGRFLEHMEQLNNTYSHGSLTCTFARLFDTESISRGNNAQSQVISWLDCEGPNIGTNLSLENLP

SEQ ID NO: 996979 - protein, 121 aa, Homo sapiens
PTAAWSLAPDPAPAPSVRRAGVRLPVAAPELGAWGATIEAGVPAAMCAWMLERAACHLHALRKLGLALPCALALEALVAALEHPHMSLIQTWQKEYKCGDLVFAKMKGYPHCAWPWIDADA

SEQ ID NO: 996980 - protein, 99 aa, Homo sapiens
MLEESVGTGEEELIGTDFLSTPLTGGWKMGYAEEVSYDALMWELQPLLYPMLLIDQLKPGGRLDIACGCWRRETKCGEQCDKLQDGGGDFLAGGGGDMR

SEQ ID NO: 996981 - protein, 167 aa, Homo sapiens
RIKRQLEQLQLADKPRKMSNSRVPTHPVEKGWPQGPNAQPRRGPYPPPFRENSLSNLFGHLNDKASGFLGGQGGCPGLTIPQTPKKLKGSKSRGVHVPRRFCVRTQIDKTWSVSKRCSLSRTPGQPVQTLSLAPPRESAPAGDLLDLIKGCARHTSRNVVPPSYNVR

SEQ ID NO: 996982 - protein, 161 aa, Homo sapiens
GVEHAPGRPWGLTVGKCLARRGSGLKPRAGGDQCPYQGLLAACGRAVAEGAPQCLRPWGFSEPASGREDVRRRTEKYNSKVGKGTCSYSLGCRRHCPRNPQKPWQVQEVLGRSHVAIGEPPPCGEVRCTHGEPWVSTGIIPKENTPVLVTQAESIAVEANV

SEQ ID NO: 996983 - protein, 147 aa, Homo sapiens
MGGLNTETNEKALEHIWKYGHLGNTLDENLKPQIRGLDFGHLLKAQQTAKDCRQKPAMEQSLDAKTTIQGGTRHQTLISEHVVEVWTGLQRSKKKRPSRGLRGGTSKDVNGTQRNLLNGEGQIHITGDISKHNVKHVKYFPGNQSTI

SEQ ID NO: 996984 - protein, 167 aa, Homo sapiens
MKNINFGSSLTNFDVWKKYLYFVARRKQTIVSRPLQRTQVNNINNHYLLTISTVRIKTLLFSRPRYNITSPVFPSSLPLLSLLALAGGLVSFPLLSLPFLSCLRPLAPICFVSSPAFHLFSLHSRRSPLHPRFRHPALLYSFLLTSFIYGWFSMGLAPSVTYHQRPA

SEQ ID NO: 996985 - protein, 124 aa, Homo sapiens
MVGELGVEKGRHRIGEQPSRTLVVLLHFVVYSQEVVVWIEYPRGVTGTPGHSIRPTGGSVYTEGNLSRLDNEPTADYCHGYRAILKRNPPVASLQEVRKDTPSLKGPQNTYHEQGSILRDPGNE

SEQ ID NO: 996986 - protein, 109 aa, Homo sapiens
RHQVSQDGCIQVHPGNYGERISSDVMRFLLRVRCWQLPPTVSASPAWAPRPQPVSDQCAPYLASTHGPQSTRSRYYYYGVRCFARGWPINVTSSSRVAYFIAYTSCSIR

SEQ ID NO: 996987 - protein, 323 aa, Homo sapiens
RSLIQPPPPRQGHCDPEFQELTQWQKKLHRGQAHSPASQNFLGQARTKSEMQNGGPCSTSSQHENSIMLAIATTSISPFLRQLTCAPGSWYSCTSLSSYTSTNTPHLRHKATPLYSSPATAEPVHPPENQNPTAITYIIVPHPQSLYSSLNYYSPPTTPYNIPTITPLNARLPHDDDVPRPPYYIITTTNHTPPYLHASPIACSSVPFIFSPPLPSCSPSSTSSPPPHYYITLLSSTYRYTQLRLPLPPNPYTSCRIPLTETTAHPPPSPHEPHITPRHFHPTITPPPAPTLLTTLILRTKRPLTRSPTHSHFPSHLSIIAIF

SEQ ID NO: 996988 - protein, 136 aa, Homo sapiens
MRLAIELPTSGDPAVSASQIGAITVREPTRHGQESKSVTESSTAGSGRVHEELRAESPEHMGVTRGDQRGCVENFRSLSWACVTEQSAGPGLDGETYGLMVPQRPHMEPIGLAREKAEGESLQISRLKDARSNVLT

SEQ ID NO: 996989 - protein, 183 aa, Homo sapiens
PREHRASPFADPHDRPHPPTSYTMDDDIAATRSVDNEIRHVQGRRYAGRRCLPGPVFPSIVGRPRHQDVMVGMGQKDSYVGREDQSKRGILTLKYPIEHGIVTNWDDMEKIWHHTFYNELLMWTPEEHPELTEPRTPLNPKDNREKMTQITCYETFKTPRHVTVAIQAELSLYASGRTTWHRR

SEQ ID NO: 996990 - protein, 271 aa, Homo sapiens
MWGLAGLVYSASIACCIWSREPKAPGAPGPHQWGTMTEQGRYMDRGVLNVVIQMERMTLLAPRPVDICAIAIEPGWRICDQLALVNICLIGTQKLFALVAGPVGMQMTGASVEDDRRELAAFLAHDIQQWLLAMDHPSLGHPANSGLELLAQMAGSMASFGDWSISLGLGVAKLCVLAVTVDCVGIRKFTLMVGYQGTPASSMPGNPTTVFEKDVHAELISDIDIGPPEDWSRDWKRSLQAGELGKTEEGQLEAPQGWTYQGTPNRNRRQE

SEQ ID NO: 996991 - protein, 270 aa, Homo sapiens
MRLCQRRHEQDQRGREAAPCACLQLGQDPVRCSSGSSSWRLLQRLIQEQEQELVGAAGLLDLHKNEWNAYYEAVVYGPSSEIRSTLTPGRLLEVGPRHLRPWEQEAHIDFSEAELYDRTREATWALGPSVIRATLGIFNPFKRYKRIPRHHEMVAALSGLDRWNTCNVGGSALQEAARSGHRRMDVRQATHHCGRQALGFEHNPIQYHTQVILGTNGDILVTPQDITSNIGGDLDPPHAKQTNRRRHWAFQRGTARVYRNRLYTAWITQS

SEQ ID NO: 996992 - protein, 363 aa, Homo sapiens
GAGQRPTTLVQHGITNLCVIGGDGSLTGANIFRSSGGSLLEELVAEGTISETTARTYVATEHRGPSGLIDNDFCCTDMTIGHGLGPPPNHGGHRCHHQTLTQSHQRTFVTGSDGTDNAWYLAHGYLHWPPRDRVDCIIPRGFQTEDGMGETPCCERLGDDSETRESRLNIIIIDEGAHGPQGEEAISIQDYVKGPGRLKRTGTFEQTVYNVAGANVQRGRGQHNAAYDTGYVRQTRWGNGQSRDELGSMDGNDPTALEQRPEDLDVSEQNQSYKGQPHVDEAGMDTLQGKLRQTRIHHKGKDAHENDASVKVTRKGSEGQSNTKQNQREGGGTRRKQHQDTIKRGNNGPQTAKTHQREKRRSE

SEQ ID NO: 996993 - protein, 293 aa, Homo sapiens
QSGGGVRRKKGEGWSHTDYCLLGSIFKLNLGHVGNICSKIFCSIGFAIGPLDLDDFSLNRWGQLQTALRYDVLKTRGCDNGPSQSMTPYIVSEGHQAPSEPGYTRAGNGKVTSGGEKKNRGGGEQMHEREPWVTGGTGRRTTWVWRRDTWDKGRPRKQGTKRAGAGGHRGRHRAKENEKPKRRDGNTLARHPGGGAVGDRRERRGDVAGTVRAEDGWWRHTDLTETRSQPASEGDPQRASPAAGGVTRQPLGTRAPTTGGGAGTRVGAAPHSTHTRVQQPRDTGGQTQHETVV

SEQ ID NO: 996994 - protein, 167 aa, Homo sapiens
MWKSMEVLLSWKNCKNIWTIHKTDPSHILNTYAITNILLPPHILNVTCSPTTTFPTPPPSFTPAADHFPSPRRPILLTSIHPLPHPIPLPTLITPPTKPPPPLMPTHTVTPPLPTHASHLIYTILTPYKPTTPHHLPPNPPPPYALTSPSPPPPSPLALYVPPALSP

SEQ ID NO: 996995 - protein, 229 aa, Homo sapiens
MVHVADLLSGAPGQQEGAKTMQIPVNIPVPVLRLPRGPDGFSRGLPLMDAEPPGGQRFLKSRSVLTMLKNPWNPRSQRARAGHFGSVDLRRPAWANGWVMQVRLHVAIEGVRVCRPLVEPPTWDVDNFLRVTDAAFPKVCKARGADSEVKYDIIVHYTLQAELEDYWCSHCVCCEGYSDLYPRGTSPNGSHELREPRGARQWEVYMTRPLDSFWSPNAFNRQRSGRFRE

SEQ ID NO: 996996 - protein, 197 aa, Homo sapiens
MRTCSKTIWVSAHMSLLKIKLTFTRDHGTLTHTKLNPNPISTLSAQLPFRKPIYLPNNLPFYLGDQKNPMFPSLRNSLPTTTKPAQLYWLLQPSNTFLLFILNTKQHRLFASPRNFPTPPLPRRTRHPLTNPFLRPLVRQPPPPPQPSPVSPIPGTPPTPLPLPSPAVPLTAPSRPSLPRSLPITYMLSSRCGPHRL

SEQ ID NO: 996997 - protein, 253 aa, Homo sapiens
ARTLFFRRSAVAFLMPCRKWNEDDRRAGHLTMAPDMCKAGFCLGNERIPEDQVYSVPYDTGGTQHTQGRPSDVAIGGPETDLTKPVGAEQKGPTEANAVGQLPLDAPMNNVTPHNMGRPLGAHFRYKPKPLVQNRTHLANGTRRFLLGPQHQTQPPDSTVKQKTRHGPIGQTPELGEPHPVSKRENDQNTPNARRTNGPVRDTPPANAEPTDTPTNSPTNPTPQTHGGTTESPQRQHDQHKNGHTLRHPIPNS

SEQ ID NO: 996998 - protein, 367 aa, Homo sapiens
PLAADELQSSRYRQMLADAPRLLEKSIHGLRKVIDAHQVSTSDMLVVADSDLRRLQEGAALQLKKNHEEEVTGLQAQIASSGETVEVDAPKSQELDQRSWTDIRAQYDDAGSGQNREDATTTYWSQARLEDEQCTVVTLDSLLRLDAAQSTDAHESLETVQSTSLRESTLELHEKSRTVQLGETCLTPVAALVMPYKIEKHSSNGILPAAFEVQELGTGSRGQKGQRTRSQDDMGALVDNMNGQSVVGLRIAQPYRTPCLERWRGHFRSWIECLGESSNNPMQNRIQRRPAQALPGQYVQKRNRHARVLKTQMDNHRVQAAIKSTPRTQRIRTMGANKEAPNNRAHRSTKANTNTTRRRRDTLRGHD

SEQ ID NO: 996999 - protein, 129 aa, Homo sapiens
EGTFVKAYMAGRPRTSQCGPGRDIMPGNTAKMGVKTIFLARGGDGMVARESEVGCVLGLAVCRLLCAGLRVGKIQKGSCIAGRVGLCLGVALVCVRVARFFSLLCAFPVPPVPRTRAAAPPPPRPPPAR

SEQ ID NO: 997000 - protein, 180 aa, Homo sapiens
ASSQLSVLRPQVTDSTRAASPSCASPTSGRPSGAFSQQQAARRTVRQRKREKTSSEVQPVHGAGPGPHSSEQALLRAMGPRLDIIFLYLVVHAMRNSAFFLHVGTCELETCGNSTATGHGPHGLLLTRVTWWGHSVTGSYKASHGVALSFLTQVQGYSKCLSVARPYVSSETQLGPPVEP

SEQ ID NO: 997001 - protein, 102 aa, Homo sapiens
MYTLLARVTYGMCDLLTHMRQGRSRNPIDTPFAERIEARKSVRCQTRRSLRSSEPIRRVSARQEPTVSGPLNVPSSRHRNLTKKRGNSLHGLNKSSACTTSK

SEQ ID NO: 997002 - protein, 136 aa, Homo sapiens
MFDVYAPGRKDEGPPGRAQATKRVNRFALDNAQYAEIGRGDHGQLRRAIQTSTETVPTTGQRKNPKRGGERKELYTKRGGSNPRSGYGGDRPRKKIAIDTQEEMKPPKPGMGHLRATRVLALVALRRAVVHFLGLR

SEQ ID NO: 997003 - protein, 135 aa, Homo sapiens
SNRRSAALLQEHEVLQVTAGKLATGDRLIPEESRGPREIARSRSSVGLVSTRRTEIPECPSGTHGSRRRVCAGPLFGQCRLCQVLRDSRDAGSPRIVFASQRLLPKSVCCVKAALEKGGMMSHWKVSSSTGAFCA

SEQ ID NO: 997004 - protein, 174 aa, Homo sapiens
GHTRLPPNKLKNRNFQQLERGGLVKLKPHEEPLRSEIFSGKFTILVHLIILVKVDSLWKALFAHYKYMLIPEGMRHSPCAPHHNNPPNTTLSGPSIPLLQNANLFISHNPHYPHLNTLIHPPTPHNTYKTAPRPHPHTLNNTPTSLLSTHPIKVKPYIHSYHNHLPTPPPPLKH

SEQ ID NO: 997005 - protein, 122 aa, Homo sapiens
MPSASVPALKVGGPQSSSSKRTRAERLPLHLVHRLKGLPFLTLRFGHFLGEGRRPGRVGCGRRGPRLLARRFRVGAPDFCCRRLWALGPSVLIAIRRLGVTSPLVGPLWHLCGLFVRQRGRI

SEQ ID NO: 997006 - protein, 213 aa, Homo sapiens
GFNPSLLSWLSAMMCVLTCSHGGTWQHMPVRALMPFSDTLRSGLRDPTPPDFGLGVERAIWSVQACIREERSSLKQLKRVECFPQDLLATIMASKEATVPRVQLTVYRCRRGASPRGTVEHGDWKDSAALDEQEQSLLAVWHVRAPARNGGSLINSRQSTFMSAVRRGLKPCIPLRPCKLSSLTRAGLVFVFAYIEDGQKHRKVHRIIAIKIP

SEQ ID NO: 997007 - protein, 102 aa, Homo sapiens
FLSSSNNNNIYRLQLIFLLSISPLLLHISLHNQKCSADMLLSLLIDQEEILCSIRATLTHNVHNHNQQNPLNMYLYYTPPTIQQHTISIITPSSLLPHTLLS

SEQ ID NO: 997008 - protein, 129 aa, Homo sapiens
MQTWTQCLAIWKHNHENWSRAAITSSEKRKSPMHRQPGATEREKQRPIIGSLALVIPHQSTLCLAPGAIRRVLHYGEGVTLTDTGFKNREIALEANYPATTMRALSSSSPGGQATAQLRQRNAFGKHYR

SEQ ID NO: 997009 - protein, 489 aa, Homo sapiens
MRLRYVPTCDDDYDYDGSDTEIVLSRRDAACDYARCCDVAAAPREISSVQPHQVTVSLRIIYAICSHVVSRNPPVSWTVSAISLADVCYYNYRLIHNYLPHHCLLSLASVMHYVIANTGVASCVVTYSAKYIDDLSLTTYHYSLRMSCVYYNISIYYYCAVPRSGALGYTPIDYSVSTCHAPMSMYASFAREYSSVVSYSPSCPRRSGRYVGVHLIVLRLARSLQLRAGCVYASADSRADACVVIWHVLMTCRGKMLRCSSRGGELSTRRHRLRAYYYLLVVRCVASWTSVYRDSTSVLIIYVLFHTLQRSAVLRASTACQIRCVSRARALSARCEPRCVQSVESRVAISVRVAHASLSVHSSRNLRELMERCVSLYGLHSSSLSTHHVRECLASVTLDYIVLRMRAESTDDVATVCSVDICLRRTSSSDVTELSGRFGADYDNKRGHAIRDAPTARYDRCLLRVIAYCYTRPDSNRVTHDVWGRVRRA

SEQ ID NO: 997010 - protein, 316 aa, Homo sapiens
EAAYYGQTPGPGGPSRRPRSRDSSQASGELPSLLTPPVLLPTHRHTVHSRAFRWRSAGITPSPGGVPLYACELVGRVAGGSRGMSPTATDQGKPFPGAPELRRRMVLLCAGLACVPCCCLCARDVLGHPLTTRRAVTSEAAGESGGRQTCADGGHLARAASTSLHNLATWEENVLSIVPFLCITFADFGTFNSFHFFKAHDLFSLCPSDCVAGWPVLWQRLVGTRGSAQAPCPPGSASHALALALCPGLACGSGRERSLPPFQSYLTGVVWLDPVSLWALSMSVVLRREASAPPETWAGSRKNRTGVRLPGLLLQV

SEQ ID NO: 997011 - protein, 144 aa, Homo sapiens
MSTYSDEIISVTRLPWKICASYHQSSVSAMAVIPLSESWMSHPRHTYHRIHLVPRGVCPWISPAAMPMFQSGPCCNGAVVPATALKLGNGINPSPDNMNRGKVTPYAMVPPCCGIRLQSCLLPGDSSVNDTPKRVGSRDNRVAI

SEQ ID NO: 997012 - protein, 240 aa, Homo sapiens
VCHLKILVSPWASAPPDSYRYCEEQEPVPIMSPSAEDVHCIAKRFLHYYDRGERAHNRLTVGWSFRLVANMVSDEYEQLSSEALERCPNLEPHKYMVKQLWQEMASSIRVRLHPFHVIRINKMLSCAGADRLQRRHARCLWKAPGTVAGFTIGKLSLSIRTKLQNKEACDLEACAGPKFKFPERQKIHFSKNVGLSPEFPCLLNFDRPWWVKRRSSQMAVRVQYIPQSLTSWDSWGALLP

SEQ ID NO: 997013 - protein, 108 aa, Homo sapiens
MRRTEPPRPTHNSRTRQLHRRTRRQRGHTARPTHTTNDSHPHASVNATHRSPPPSPSGSTTPEKSNARKCETYYKSELYTTPLTILYSIHLHMIYYKSTTNCLSFPPP

SEQ ID NO: 997014 - protein, 360 aa, Homo sapiens
GSVGRSSALRPRKYPQEHPQEELEKASSPGSAVSTEEEPDASERRCRGPLGMGLAQHPTSFLGPPRSQRQDPGERSPRGTEATRQGQVAQSGAQSPEAGSQIAVPTVEGTSSGLEWLLWLHYLERLPEPGCPLTLPLSVADDLRLVPPYLRHVADGSGPMHACHSTEHWGHKLGLANLHGEARRTSQKDMRVGPLGFLALLRRVPNIQAMQNGRVPNTDIRIARKSPTNGTAFPWGENERLAGLVSNDVHVLCQVGCDTKHPYSPGSTRGKGTPGTPFTILASDQPLGGRPGETTLEGPHRVTRTPVSVRVSGPQEKTRESWKHGYGAGKRPTRERGRDQQRPKKALTGQDHPRDTKGRH

SEQ ID NO: 997015 - protein, 125 aa, Homo sapiens
CKYPRRGSLSTDGISKAVLIELLTTGGWSERWPHSGSFEGAELHLNHGLVRSSILRPSQKHKKCAPVYDGPGGIRELTGVAAQRWFGFSSTGRWYKLCIADMRAGRLEGSRCRHVVHGMTLILSG

SEQ ID NO: 997016 - protein, 147 aa, Homo sapiens
MESHSVPRLECSGAILAHCNLCLPCSSNSRALACQVAGTVGEHYHTWVIFSRDRVSPCWPVWGILYTILLVVGRYLLGIFCFIKLKQKYSRKCCQAHHQTRIFVRQNAQHESYFWYALLLHVTAHCHSQLHHLFFLAAMTVKYHTYL

SEQ ID NO: 997017 - protein, 216 aa, Homo sapiens
MYNEKRDKPQETVAYDTLLSWHKGEAWPTDTNHSSSRFPMPFNWSKRTYQVLSSPTWVQRKRLGLFPGTCDQLCCCPTLLLEHLAPLCMRNLGLVAPAPDYYLDFFLPCLEVTCASNTHPCGHPPTLVSTLGYFGSYPDFTLWGSPFIPKTVGFLPIGNRSIGVIAVLGTLALYTHISKHAEIVIGSHSRGHLWVRYPFFRKNVLLPLLCVCATWS

SEQ ID NO: 997018 - protein, 189 aa, Homo sapiens
EIVRLQKDLRTVEKGASAENWKNTKRREYDQEREEKIKQEQEDLELKHNSTLKQLMRESNTQLAKKEQELETDHKIETINNGPGRWRLRLVRKASQEDDKSGYVRERLVRKMSDLESESDKKNEEILDAREEEDDCKSNGSCRLNWRSSRRNSSNKLEQEENPGDDNVTIMELQKQKEQKTTFNQVIRN

SEQ ID NO: 997019 - protein, 116 aa, Homo sapiens
PANMGRVRNQKREEGGPGFIIEKYYTRLGNDFQTNKRVCDGSIGIIPQQEKLGNKIAGVMSRIWMKRIRERPSSEVSLIKLLEAGRAERDEDLVISVRSVPLVSWSTDRTYMILQQ

SEQ ID NO: 997020 - protein, 357 aa, Homo sapiens
RARLRQTHSGTQAAPCSWGRDGAQCGVDGALSSAGPALLKAHPEGFPCPVSQYRCSLGVLTRPCGPEESGLDYTVVHTPACNTIKADVVPCMPCKGSYTSVSPQPTSTGAASQGLMHARRDRAEGAGPSGGAGGIPFGLLQPVLTDTRRKRQGRAVNPWRLSVVKPSTLGCDCAPRHDLAGSRRQTGRPFLPNYDGRHRKMGTFDANSGTFPRKQQGVHLVPWEEQGPIFAKEGSMEGPKAVACLNGHSKVDLCGNSTPPWVPEEGYSEAPPWSTGGQQARGWELGLDTGELGVRPKPRMLEPPGAQEPWGQANGDTKSRHEHRTGRESKRPLHTTGNELTRSTIIAERSEGGHMDI

SEQ ID NO: 997021 - protein, 136 aa, Homo sapiens
MCFLVTNNAKYNARRWVWNTEPFATTPSTLIAVPHAPEIKAGKRTQLPGCVPIGVGPFAVDHTGVVAHSLLAYLVWKATTRRASGHIVTGDPARREYGHSERLTFSRLALAGGWAVYCTNRGTRAVWREDIMARPV

SEQ ID NO: 997022 - protein, 281 aa, Homo sapiens
MSRVHSQECAGQRLRTRGPGDEHRQGSPEIRQHVILQQRGTAGLREGIDGLGIMGPGKHMGEANLLESHIDVHRWPPSVGTGTHTDCPHYYKNTRGKSPFVGTTTVGTFQMEDTWDDASFIPNVVQQWKPAPRRNTEATGGVNPRKGNLEKPNRVGGWEVERTTPWGNTPTIQHPDNEEVPPGGCNSPKVRKEQSARMSLIESPRPGRANHISPNVYIAQTAHPSGMRAGHWRYGRSTRAGSKRNPPVLGTRTVRRILNSDPPYRCGTANHDGTGRRGVNN

SEQ ID NO: 997023 - protein, 100 aa, Homo sapiens
GSAAAIILAHTALWTPSPGTQLTALLHVCRSRANQEISGGLDAPQALVDLEGASATYVFCDMLQGLPHPHTWERHIDDWLVPPEIAQVSKTAADIVLAIH

SEQ ID NO: 997024 - protein, 274 aa, Homo sapiens
KSTLLRGFSKMFELYPEQRAEGESLLDGDNILTNSQDIALLRAKVGMVFQNRRRFRCPCGDNIAFGVRLFEKLSRADMDERVQWALTKAALWNETKDKLHQSGYSLSGGQQQRLCIARGIAIRPEVLLLDEPCSALDPISTGRIEELITELKQDYTVGDRHPQHAAGCALFHHTGVMYLGELIEFSNTDDLFTKPAKNQQKTTSPGRNGDSGWRLDMLIYKHISASHRELEVSDPVRPWADGGHHFLIITDSNQTGLGIRFSNNVIDEVDVISC

SEQ ID NO: 997025 - protein, 156 aa, Homo sapiens
MPTIGGLVARLGEQAAHSLDSSGKVAPLGTLWELNTNSWGLAPFGPLMRSTQHYGLQNVTLGCAKDSRVKSCRIASTVRRVRERGSRRPKSNFAVGHFETRADRAYRGRFVPGPYSQRATLRNSGLSRSGGYDFARFWFALGPHFVFGNGGYRGGR

SEQ ID NO: 997026 - protein, 427 aa, Homo sapiens
GLPLGRDPMGTVRRHESLKRDLDDGFVNCKKLFNDGTGQGPDVGVGLGVTDEAQRWLKEYPADRYGAAEALVAIEAAPGMRRQEPTKAWSLHECAGTQCRRLRRHANGCTRDSETAKGDRQRRRGHAVCQGQWQRPLNGLRPFMNETLARGTDRGASVIVKFVSERVRGHQKIANERRKPGVKQIVSQEHEWTESVPLDRIGEFTSIVQKIVPMQSRFANPRGNNAPDSEGNLYLTQGGGLRHWCPLDSERKQGRCDKITGGPQGATAVRNGLGNPGVAIRPRCCDRGHPCDLSLEEKERKGKLQPLHGGGHYLSELSPRGTLKRNRARSMLRGTPEPLVPGPPGFHCRWVIWETPLGGPITPLTFGRGFPNARGQSYPGGGDTRLLDPPKTGTKAASLDTNPREDLAYEHTHLNNGTIFHLPRPLR

SEQ ID NO: 997027 - protein, 331 aa, Homo sapiens
ETESDPSELREPRLCLIRRPSYTRRHAHHEDDDIAALVCRLTRSGNVKAGFAGEDATPRCRLRPPLVGLPQAAVGRDGGPWVSKDSYVGDGGPEAREAVLTRECTAIEHGSRCDQTEDDMENKSGTTAFLQLSMRCWHPREQSNPVCLNEPEVPTCNPQRPNRGESMTRRSVVGGTVQSSLQAQVLPDSDLIRKRLDAIVPLVRRIMRPERNWDNPAGIGSIPEVEQGEYQLRAAEVDAQYLRRTERVIGPVHHTQLTQFAFSRYLEEHPVTWGPEETPGTVGSLIPCPIVKGIPIRPPNVDRDTYQVAFHHEANQGPMSVRNNFDCTVEA

SEQ ID NO: 997028 - protein, 110 aa, Homo sapiens
WGAKSPFVPRVDSQGVAISGSTGEHWFSGSLASLRPPGYSRRFSCVLSLLDVRWGLRVLAPPRPGYILWCIFLVDKKTGGYTSGCVWRQESVGSHNLFRAPRENLAPHSL

SEQ ID NO: 997029 - protein, 122 aa, Homo sapiens
MPQEELGIHPCVLGPWLSPRLEAAHALHGVVDLPFPPGEGDERLVISERALFGHGDRYASASFLVACVGPASVGIDVVDAALWDGSRHIPRFWSASGGRGIPIPCHSPTFAAKGETRVRFHF

SEQ ID NO: 997030 - protein, 52 aa, Homo sapiens
KKQKSLTTRKKIARTDPTREAIRTKCRIVIHGVSCGINRTILKMQMNKSLVN

SEQ ID NO: 997031 - protein, 358 aa, Homo sapiens
RILPEVAQWSDLQERAPAPAPWTSPLLPPTPLSSPPLLTQSQTQVLGANLLALAAAGEALAGADFIREAVAGADTCVFGRGQWRLSVGNVLFGLALYLGLAPGPRRERTGSLRAARQLLDDEEQITCGKPLYMSHSSSYHAWVSFIKTWKRLTWLTTIVDQVWNLTWARYYGEAYCPETVAPAVRGSKPPVMQTYTFTTTWNWSDKQSAHSLESRVHPGQQKQSTILQALDTSSHCTVQGCRLNAGNENETKSKATHPNHGRPPPTDQNCTRELPSLTSHHKERYTCLGQPGTAVRHTGLTTTDKRTTPCHVKKAGDTRTPVTANSDRAEERQPPHALVAPIPRKLTVMSGTNQNPHS

SEQ ID NO: 997032 - protein, 239 aa, Homo sapiens
MAPSMSDSSTMVSQGDQYNTRLLRGTTKERTVPICPKGPFLTAKFKPKLNNILLPSRGANRNFGIIVPLHAWNGCQDHRSREEPREASTQVGAKAQTERYTTGRGNWKPIAFHTKSFHPPSYTFSILMTGVFEHPSTRVEEGWLADQKLEAESSSLKHKTAFETVAFSDNIQARAKWKTTTSVAKYTIPDIVTAWSQGRVCPRCRNWFLRTKDGLVGSAGSGTFGGYKPSKLGSASSYG

SEQ ID NO: 997033 - protein, 329 aa, Homo sapiens
GETVAKTGASQGPTTPVDRSVRDEIRPWKLNDQCTQNPERMRQPGVHEGCIFLLVGEWPSHARRHLHREVAEPSVQEIMQQGAPVSVRVVDPVCQSIGATRIAAQCTGTAETRTPNGSAKDSADGTYSCAIWGHLKERLCANFTGLGNALISRKDKLQDVDSVGPICAVPNEVDLWGPTIAEPLMKPEIYALVDIAGKGPNFQFALLSHNTELGNCRSSGRYLTAGTPKPMCKHVGDYDRIQGSRLTLASHVGPLNNVDPKVMLNLNLLMEISKVGPACVHMGRLGRPMRHGSPDLTWYRIGLRGATGRSRKRNPFGNTYRGHINFKEL

SEQ ID NO: 997034 - protein, 41 aa, Homo sapiens
MEVEFTWHAVMRALSTFLQRALRKSISLEKSSPFRRHLKPP

SEQ ID NO: 997035 - protein, 278 aa, Homo sapiens
ESPEEIANPLLDWCLSPSPEHSSPSVRLLPYSLQPDSSLTGHWPVLPECRCSQCHCHPGTPEKPGSWLCRPQDLHLAFLEPSGHWTSQHWCAKHLQEMETPCIHGTPGAPDPRDIGAAGGCPCWKHHYSELRRTNNYLTGNNNFAEIHELPFRRKRVMPRNIRDGPPHEQGGWESMTPNIGEITNAKPTPYMDHSITSTRGIPRNDKNQQNPRDTGAGATGHRDNRQRGKTLTDKGVKNPWAFLFTSKGPSHEKRTTRNEERPIILGPRQGRKDTTSD

SEQ ID NO: 997036 - protein, 53 aa, Homo sapiens
MRRLGFPLIARTRGLPVARERMAFVAQVTRKGGAWAGGKSPKIRDEMSPRSMD

SEQ ID NO: 997037 - protein, 295 aa, Homo sapiens
MAEFKGRPRPTARPEVKRLFRPTSTELNERLRLTLKCSSLTTDHALTHWYRLITQSFHQLPRSTLLDTTKIRLRIILIFDTHYAPIEHGTNCRSDLVSFGAGSFTVRDSTCALNSRHEPLAATEYACRQCLRPLPFFPAYPHMAPRLRSALRHAGALQQTQLQTFTDTPAGMPGLNVGHRTRPVPRSRPGALLVLSPLCPLLPLSGTFSVPLARCLPVLAGPLAFATGLNGPPGSGCFRPSVSGASPLVPSDPGFPWTPPSFASRSAACSLGARLIGYAERILAPSISSRRAPSR

SEQ ID NO: 997038 - protein, 216 aa, Homo sapiens
MTEPKLGSPRASMVFDPTTYGFGQARDERCAKDSAAHSLENWYSVEEGLTRRARAVEDTNLAWVAHLTVTFINETASGSLHYAEAKITYQEDKDTERRTARLTAQPGKCAGNHAGEALTTNWDKWLAHGHRRTAAQGRPTATWTTEPTSSAHAVGNHTTLMKENGQVHKYHRQERTPDAAADHDGDKNSTGYASQKRLPGMETSMTIDVRGIFTAA

SEQ ID NO: 997039 - protein, 363 aa, Homo sapiens
VPQYYTLGSPVCGWLPDSARPTMLIMAICTMSHSTRGPSERKGQMCIAPCVAAVFGSVASSHVFPLMSQTGPWIVLQANQWETEVRLSDRSMPHVTQDGLIPSQWACTPMGEGVLRVCMSKCPEAWWRERQTSDRCMVGALYTRDEDGGRGKHECRESVGDLMAVEVVLNRHSGLDRGRSVWIVGEACGPDRPRVDAQIPRSHPCRTNPSIWVGLGKNSVVEPLIRESSRAYQFRRPWLAWHHTGVNALSYPPHMNSEVASFLRFAKETSQRRKFVPGDRGTSFNSNVRPSPSWTLSEPLELGIFPIQSAKLRLRIGVRENHQLVWVNHIGSGDQKDSGLAHHCLGALAAAALLSFPTQWVRD

SEQ ID NO: 997040 - protein, 184 aa, Homo sapiens
MVVRKARKSGGRPGTVVGIRIPNWSSNNASTFNRPSLYLQRCCGAFVNHFHEVDRLVCKNDQKGERPFLGGINTPLSWGDLLYSFGQRQSVIHATVGQRYLIRTCYAYVASRRLSPCGKRCVLSHNGWPCGGPGQATFVVLPSEHLGSASSSGTTPRVHTVPNPRQGVLPTTRKLSVVHPMWFL

SEQ ID NO: 997041 - protein, 296 aa, Homo sapiens
AAASLCPLHPGLPHAVAGGCASGALNIQRDWQDCGGGGGGGLGRRGPDHEPLSRETPGHEPADPRSAPCAADTLQPGGRRQRTEPGPPWRRAGPGALRWRRYWPGARSRVPEGALSPGCLLSTPRAPSPLSSSPAMSPQNGQELGVQELNTFYGCTRKSCNCLWCQDTFKEDAPSSWWLPQTGDLDQNTIDNYAERYLCETQMWPITILPSQGPRLDKTQIYLQDHGYHNLIWTKTVADALSCYPSLKDVTPNAVYRLPDAHGTLHDHLAPGAWLLDPLEEQDLVGFAREGREIPL

SEQ ID NO: 997042 - protein, 203 aa, Homo sapiens
MSDVLVENFVPWEFTYQRDSGEYKHFSCDRLAVVVPRGHLVDTKFSRSVARATYLSDAWTDSDGHPVEGRKSANNLGRMTLSWGNANRRTLFLPLKYNKGQPLGPTFIPPMRFLARKFTSTGQQRNRRETQHRFPIARHVYSFACEPTMFEGSTTPGFKHDRDANNPLAALSSVLVNSFPPPGVIITHLWGKQQGQAGTQAVP

SEQ ID NO: 997043 - protein, 262 aa, Homo sapiens
MTLVFQGSDVPAAPHSVAPLPVKSRIPGRPGPRRHTKGLQTAQSAIRLIRGELTELGPQLGVTAAVSQGGFQLEEVGGNPGQLTDCMRRLPIIPGVQKLPSQFRYRRCSTRRAQHRGANPTDSGNAPQIVVPIRQRVEHERDWQPLYVALAHGPAIPLTSPKTNNLAHSSSRPHLVALPKLLSLHFNEAAISNQTLPNTRPCPERSASRTTSLMAKLPANKGQHFVLAHLAKGPLQAYARNPPEPCVGTEQRGIAPKDVPHI

SEQ ID NO: 997044 - protein, 166 aa, Homo sapiens
MVGGIEFKAVRDGQSGKITVECTMEPEQADSPGDDAVDLSINGSSVCGVVMKENCVCITIKGNDMRGLVGSCISASSELSNRLTQFSLREKIARGLRTKINALYSHVYIQLDLLHGEHASLISSETFTRVPSDLLPVWYMCQAQCIHGVMTLNHEVSSRYEKLTPS

SEQ ID NO: 997045 - protein, 361 aa, Homo sapiens
AAPARSPEPVRRVDCPESLRAWGAGEDAKPDMAYHSFHGGAHQLPRLEQGPDPDCHLHPTNHEVHIYEKSWCQMDQGARAQVSTTGQVTWHRHGPPRVTDIVTCGHRHATPTVCDCMKGRTMESPSLVHPDGSTGLPAALRWDPQRETRYAVGSGSRVISICILSSRRLTEWSFASTIKEDPIQTPRESSSLELGNTKKWCIARTGQGITGELTKSSRIIYKSYTSNGTGWRRHVDGKPKHPVEGLPREVPPNGEKTLTDTGKSSGRYSMTEWGKHVHYIIELSRTDDEAKSSLLGALWSITDQGTRGNPEAMPFGNGNCPRQDNRHGAGQGKDPWDVTCKDEKNKRAVERHGHLINQKYK

SEQ ID NO: 997046 - protein, 251 aa, Homo sapiens
MLPTLHHHGYKRRCTVDSGLVLQYRTDFAFSAIPRITSFHDTSGPSNGNPARPPQLTHAKITNSHTLPTQTVPNTPPSLTPRTLPVALSFPTCLAHEFPSTLNYTDALPAHAPSHTSTAPHLLSTTTPSHLYAPDLLATHHHTTLSHYYIITVILRRHTPTSLPIHPSPNRSSAPHAHLPPLSAYYSSPITHLIKYHPTTSPPASAPPLLEYAPALPPPPRHPHPILSPLLPPVTSSIHFYNLPPAIDATV

SEQ ID NO: 997047 - protein, 501 aa, Homo sapiens
MLYLIIMLVGERFSPGVGQVNAPDEIKREIIHQIEIITAYGSISAIGQSLITCTDAATRSTGMAEMYIASQFAHFQENRGFNQARRAMYATENPAHVPKEDTNVDSRIIHIYPGQQQNQGQKKAHTRKIDKRHKVEKQYSTIHNIRQIAHQKTCDPSKITAQKPHENENQYTRTQESNDIGFNSIQTGQITMRGTRTDNQGHKRRDTRIEANQDTQGGTYIDPYGIQERVPTEARREKTDGRGKRNRPSTTYGDRPGEQNETRRRNSEDDRHTTKYTREGTMEPNRWNRDTTMDKEPHRHVTATTHADPRTQANSIPQERRGHEQDLGHTQNTLQAPVGHSNHKSRTRPWGHSSGTRQDQEARPARYRTAQQIHKQETEDNLTEAQKREQPPSGQRNTILKHSGHCEHQHKPQNERSTHAPTPESTQTQTTEQNKTQRPNEQRQHHRHTQRQTTAKEQRRSTTPIEHHNRRCDKRGRHRQQRHNDKQPRINSNTGGNTNKT

SEQ ID NO: 997048 - protein, 69 aa, Homo sapiens
GGARCGWMLGLSCGYAVSAGHREKNIYTIREVVTDIRDKATTQAGSLSCPYEHAGSRSPLPGILCWLVT

SEQ ID NO: 997049 - protein, 102 aa, Homo sapiens
MITGSVQHALVDPSGLSLTSLAYCLHQTAVALDELREADGQCPVDRNLPEVEMVQVSVYDDEEIDSPLKPHPAGRKQVELEHTRLIRRSQPKLSLIKTSQQI

SEQ ID NO: 997050 - protein, 253 aa, Homo sapiens
MSREYTRPICHYTPTHLLQTPLRYIRHIVSPISFLVSAHLTAAATASGVSCSGGMRSSLVPLVRRVSDAPQYRSRTESLRDIASEYDALHVVDTARAAMLTGRARVERARVVLAAYAYRDTTPCCLARPPITTSHAQTGRIAVVIAYNRIYNRRASASPDSIRMNVAARTHVVEVYVATDARLITVLASLCAYTEVTVSIAHCVATEYAHHVSHVRSMHTAYPVRLVQPCRRSDGVLATLTRSRRLIALRQPP

SEQ ID NO: 997051 - protein, 118 aa, Homo sapiens
LYNMPGNTLLKAPSAFTIMYNPKFQTLFQPCNLMGAMHEIEDFNTHANIDCSPHKTVQNTANEFALFAKASGLNPAHNQGFHELTPTSPPRSLKANNTHDTTLFTNADDNLPPIRLNN

SEQ ID NO: 997052 - protein, 149 aa, Homo sapiens
MEKVLAKMLDVLQELILSMLHEEKEVLKSRPSTMFGEPLDADVATVTGWADGEGGHYRKGTPHVRRWRYYNWRGFRGFLIRTFWPKFLGESQEAERISPLLRFPKDGQEGPVTKGIPLEGKAGNSLVAWNLGGMPKLQNARRDGSMDGE

SEQ ID NO: 997053 - protein, 252 aa, Homo sapiens
GALVSRERLGALNAALGPGGPVWSQGDAHPAHCVPDTFWHQNRALQARFDDGQVPEGGLHALACLQGPGVAPVLLLRADPRRVCLSNCSGPPIFDALSSCAVAAYATPASPASLGQRVYYTAQHCAAPPCALRLSHAAYGCSWPDHRGAEPLLRSRGLCGAALVAHAVRDPEHCLTLPCRYLRGGTGPLASRESFTHNDPEEPIALSQKLKPSANMTGRTTVPLGIRRTELGDLERELAENHKVARTSTETY

SEQ ID NO: 997054 - protein, 341 aa, Homo sapiens
MTVYASSYNAVLVSSNHTHEQAIYASPPCKRYVLVEHNIANTLTPTHSNHTISISSRKSRRTHTLPNHTWHPNNRRGQRRRITYLSAYTLRLAHAHPVVHNTYTAVHHTIHRCHNISTTRLLSTSSPILLTAHATFKSLSYDTLTPTYTTTPHVTSSHAPARHMITAEHRSTPVFSAPSPTCTSPFTIISRSRSPTTQHPHSPHNPTSPPLPYIIDQHTISLIQSHQSRYDQHTTQYGSSPPSTNRVPPLQARTSTPVPLYSLILHAYHYPHAPQTITTSAHTETRNTLVRHYSTPLAAARTRHRERYQKSYASTTSLAYSSPKELTLTSADTSTLTSRRS

SEQ ID NO: 997055 - protein, 87 aa, Homo sapiens
GGSCVGSMGVVMAPTVMTDGEQRIPTACAAFAQQPAGGTSSAWLWEESAVPSAFGVTRGVAHWQVSWCLCLRTVPSSCAGGNSARGP

SEQ ID NO: 997056 - protein, 320 aa, Homo sapiens
HNPPLPPHQKTTLTQTAPGSCLHSDLDESHTIGGSPEAHAEMFWILQTHSFHRDANSLTNCATATPGTHTHHLSNPPSRFPSDPSATPTLLPTLHPHLNARTSAPAPADTHRLILPHASRPTRTPLFSASYFRPLIPNPISPHFPYLPAAYTPYHDTELSRPPNPTLHTTTDPPTAPSDDPSLFLIYQLLSHPPSPSHACTRYIRPRIHRHPTHRHRASYNPTSALSAISSYDFDTAHLNTSHTRHIHPHSPLDTRFIAFARANCSRRIEIHITPRSRSLNRTPFPPSRPTPSRTNTYTLIIATPRHRHFSPFHAPHPSS

SEQ ID NO: 997057 - protein, 242 aa, Homo sapiens
ISRFLPGGGASCRVLSPILRASLPSSVPRLQASCSVADHALGRALTLLVLLRGGRGRAGASSGGLCPVVRCEPCERVHWSSARLRRSVRGLVREPGCGGFLTFALSEGQPCGHLHRALWLRAFVCQPSPELGATLRGLLDGRGALRHASGVSGCAPTLLPAPPVQGHASESEEDRQAGRCGQPVRLQQRHGWLIQVHPSIQRIIINPRKGCLRKAGYKVIRVSKHRFQNFLRVQAETDIGPA

SEQ ID NO: 997058 - protein, 68 aa, Homo sapiens
VTILQLQVWRWSPDTGTFLPAGLQCNGKEKANAIMEEVMSLLQPLSITQDLSLDNGQTSTFESKLECL

SEQ ID NO: 997059 - protein, 190 aa, Homo sapiens
EPKTGVQRGERTYPRRPAGFNRPPSQAQDCVWSCFREKRLQEARARKATRGPGGARGGQLLVSSVCDPPAPSSTTPHGRTARVPHVLNCTALWAWGTRSSQSWHFWLLARGWDFRPTDQETHPPCKPCPLRLLSISEAEGTDPADSQAHDLGHRTGSHVRLTREWTRDKSQGHLDDSRKQGLHEETTLTT

SEQ ID NO: 997060 - protein, 120 aa, Homo sapiens
KDVRRRNLGGRSRSQLGMRLLKVLTVWPMMKPSWLSRTEFSKRLLVQKPIWCHERAGSSWGPHTTEYCCTDDQHTIIQTDQETSTKKYSIHPTRPVPDRQRVSIRGYSAFYHTWQALAWH

SEQ ID NO: 997061 - protein, 296 aa, Homo sapiens
MGTAPDLACNFSLSQNRGTGGRGALVEEYRLAGAGPASRACTGDIDVYKAGGGHESIGPKENLELILTQRVEKCLEITGLTLVSGEETSLTPENRRHFLKGHGARFIFAFPALNNQRRGLVLHTMRQPHFGVREPRNREKTLEDGLTEPKGTEIAGRQKWQASLAKRASIAHGNYYAAMEQKAQVEPNDGGMPWKSHVKTYGSATRATRLNVRDNVNKGEEWQSNDHQAIKHNTQGNAENREPYITKRARREDTNRGDSRAENGDHSGADRNIENKAAKQRDEEGATEAERQRRAT

SEQ ID NO: 997062 - protein, 147 aa, Homo sapiens
GSDPSIVRLLECDASSAIQFCIDRPLEQLREKAAGLSCRVEAFALRGGGMPAPYRYLRLLEAPRSWWQCCCGTALGQVGCWPCLPSSLIQATQIPSGLTTWRRVPFHGPTSQRSVREHARGSAVFFEFSRHARRIIGVRLREGRHCA

SEQ ID NO: 997063 - protein, 230 aa, Homo sapiens
MTDAALHTLPLSLCQELAYLPASSCSYQVSSTCRPEQKKELSDIAHRNRGYLAKGILGADEVHRGSIAKRVLSIGTENTEENRRFYRQLRGDMVTDRRGTPAIGECHSVFHDEHSIRRRMMGVLSAQGESNTIGGRSEEGSQRVGPKGVVTPWHGTRHGRRLTNPKALVIGACSGARLLAHDSPCSDRHAELRPKLTVGVALKDWGNRSPRSERSDQSSGTHGHWFWGTG

SEQ ID NO: 997064 - protein, 102 aa, Homo sapiens
MWTSAGILEETVAQTGGFVVTEFGLIGIGDVNPFLDAKHQSDPGNPRYKTSETQVKTMVTRDVTMMDSMDRRERRNERQGQEIRGMQNEDQHLESIQTTSQN

SEQ ID NO: 997065 - protein, 210 aa, Homo sapiens
MFVYNNYIFLSLRTCIAKPGATDVDHASCGYPERGEAVLLLPPKAHDTSIKHCLYCRANLNLRNAENKRSNNMRVIPWVKIIQRLASVGLTRWNYDAASLKRGKILDTALNNSNGHVCAVPPSGPRPLKGSNTCIPQNQGMTQRKNMYQNRKKRPETRIGPRPWPTLHGPGPLPSITKLELKATVSNPTGLLNTRRSPVKPLCRPQHQPA

SEQ ID NO: 997066 - protein, 270 aa, Homo sapiens
VNRWSREMGLGRGACTASQAHLPRTATSPRTVIGRAPGSNTRRRREKKQKTERKRKRKKINEQHNKRKKRNRTRKKTEENNKKNKNRKERKGEKRRERGRKDGEGNGTEEERARSEEARGGKNAERAKRHSEKGNTQRAASKRQQQRRQSTRSEGRGGEKEEEEKREKEEEEKKTKKKRGEEKGKDKNKKEEEKRAKKKQREEEHKERKRRRGEAKQTKRRRRRREKEEEKKPEKGDEDKKEKRKKSRKRRRQEKRRQRENGGEKRKEKR

SEQ ID NO: 997067 - protein, 102 aa, Homo sapiens
MCWCEKPPVGEACVLSAARLPAVPTEDVALVVTPAAACCLAVAPATRLPAAADSLLTPTSSASNLDLGEQLGALGDVPEAAEAYPPEGAAKLLLDTFEYQAW

SEQ ID NO: 997068 - protein, 103 aa, Homo sapiens
MALVAKSIYAVRNTLKMRNFILWHTGPGILSMAEMLEPTQMVPSFSSALPMTELVGWQACGVMANVKEGMTYCGRPWSAIGSRNGKTSKKITIADCGQTSNKL

SEQ ID NO: 997069 - protein, 72 aa, Homo sapiens
MTAEATRKERGQDLREGNKPERGKRAYTDGGENHATDQRTTDDKRTAQSAPANTRTAATERSSDDTRREPRA

SEQ ID NO: 997070 - protein, 181 aa, Homo sapiens
PTATQGSLLPLLKLKTHERQAIHKAKEGSGFATECPQAYIHIEERSALSPLAFRRVRKTLQYSRENYTNVSSCNELLHQEEIDSLTTYAIIQVSADHCVCALQDNIRTTTSYTLCTLVDSIKAYTTHQIKAALLKKHLMTVECARKGLTSPEFVPDGVRSTWHHGSSWLLIDRCLCDVANQ

SEQ ID NO: 997071 - protein, 153 aa, Homo sapiens
MGQQTAGGRVITAIRAGPFKGLSPRGPTVNRPGRPKSLGARGSLRTRGAEFFGKYKPLDGLLSLKKRFVQGGPFLDGQWARVITLGTNHTGKNPRKKGTFKVVTASKRTLELSVCGREFRKAPLNTLVVLPTRGKSQVKSGTTVHSFMVQTIR

SEQ ID NO: 997072 - protein, 67 aa, Homo sapiens
SRGFCRFPQSLDTTVLHRVHHVCEPIVPLLVLSHYTSNAVAILVIPYSTHRGNILECLAHDYCKISS

SEQ ID NO: 997073 - protein, 337 aa, Homo sapiens
RRVRLPLPRRVRYLGKVMYLETIFDCILQQHCGGSGIGGERSFWIGLNDQVLLATGSGSVVNLLPSPMGEEGPLHAPSLERAVFWFIYKGEGKQKTVGEPNLIIMCVPEYSKYNRPYGGPFGNLSPINSEDVANMALYENKTGRMDWGNLCQQCARETGSSRRGLATLIYCLVLLLPDYYYELTPVASENAHPADISSDVLQLFMHLTPPARVFICRNVTWFVQPVKKPLYSAFVVPLGMGITQNGTCECLPPQTSGIEKVTHRVGSEDRNHTIRHWSAIARHFVHIVDSKNTGERSPCFGSATSHLALHRTPHYSCPASRLFYSGEGGTRKLTQIW

SEQ ID NO: 997074 - protein, 390 aa, Homo sapiens
MTSPGAHRFDDILLVSCPGGAVDLSTAGIPDGLCIYLTLYLGLLLVLQMSLLGGLLPSVTPVRWTCLESWCIEGILRRLYSGLNEVLGLLLYPLDKLLASFDSTEGTPDYLELAVIITFLISRHPLSIKNASRDHVPYPQPRKSLQLCTRHMYIIARAERSLGTCRTLFLNMFAQFRHRNNKGAENVELGCNSFGVCAFNSSTSQGVNYLCELYPHSMDARGEGTLIYNTWYGLNARLIHPRYVCHLPEVRQTSPCVARDGNPPSSTHPSYIHTMFDHTLPSHSTALIFLLPRQDVCKRTSGTTGLVAHEVLLAIARHLIGDLAAIALQVDRFAQHTPTPATAGVLGGGTVTQLLGTLSPLGLGPRSHSQAPRRWAISSVTRLGQDTLFT

SEQ ID NO: 997075 - protein, 99 aa, Homo sapiens
DKHQKHHKYHKHGKHSSFSSASSCILSLLVQALGAAKQVTTEANATTQSQKHQDATIDNRSEKKDKRKTQTNHNKTPNKQAQQHQNRKTAHRRRHQSKH

SEQ ID NO: 997076 - protein, 223 aa, Homo sapiens
SGGRTGECGLGREMSCGLCLGPWFCTYGSLCHIPCCLRESGLWVTTWNGSSGEMDPQPVEEEKSYLRAPVRIAIWIELLGKDQMQVVSLNGTQSSNLGPEYAVSEAEQPPRDRINVRTQGPYGPTVGGDLSCYHVDRAPVSHIYLALLLILALPTAQRHTNTGCSLMAMADPAAAEGPVKRKAASVVWWPQALRHLSLLVHCWEESHEMNIECQSLWAGGFGL

SEQ ID NO: 997077 - protein, 95 aa, Homo sapiens
ARRLHRPECGAAPDQPLDLNDSSIYSQASLDNTDDEQPKQPIKTGNGIENSAKHRCDCSIYSLQSLLRVSPFITSMIRVRHKEFLDHPENIDRQL

SEQ ID NO: 997078 - protein, 334 aa, Homo sapiens
PNPLTPNTKPPSGQTQCSCFYDRSRTPDRIAYYSSAAHPPGVQPQKSPYTGAHTQAGQIEGQMTNSTSYRPAMEHSSRKLHLSSLNRIGLSLLQPAYLSPRLRPDHLSTISSDIGQRPTTQSTRLLTSHGHTTRTRLVLIRHSKHHGEKLTTVKKLSPRHKLVIRYYIYSYCHLCTLNLCNCASHTILDDLIYYETRILHYILLQIHHLYSVDHPCHHASTPRRSRTDLENKVDFDMSGLKDVQCRKLIDRQLNGIIIITIMKPRDYLINAPINTRQTPNFITCYSHIHHEDKYDYAHPVHEEPPTIEQSLLHHPPTSCSLYGQETYCTHANFD

SEQ ID NO: 997079 - protein, 295 aa, Homo sapiens
MKRPRTPAPPLPTGVSQHTLHGTLTAHTHSFTLRLSQIASENVISPNFLEGYLLLRAFLRIEKSTHRRGVPDIFTHPYTFSATWCVHTCGYEQYIYKCDDVIPPRNRRFPSQAVSHLHLLRAYHSLNAYRLRLCNNWPRFCFSLSLLYSDLIVPPPSLKLARYSTYAHDEPTATFSQSPHVYFHIRQCRSAVEADVSHILRCVTGYVICDRELSRYRQSSLRRSCFSVTVTRIAERDPSTRSNISTVQCRTRSTNENTADTCNSVAVSDIDLLCSYDSRAADSWRCTHHVSRYDV

SEQ ID NO: 997080 - protein, 110 aa, Homo sapiens
MTELDKEISTLRSGLKALETELEYQKSQPPQTGDKFASVDSHFITLSTFIFSDDEDLLAEANDLFTKVPEILLGKRLPYLTPSEISGINDAINHTRDINPPGCPLSETKL

SEQ ID NO: 997081 - protein, 99 aa, Homo sapiens
MPSLVAVVHIVTKELHDTLLLGEERIKIYQSLSQTLNLLTKLSTLLVTIITAAQEPIESACSPSNLGTCIHGFNQQTEDIRDKSLKDGYYNYTIECDNS

SEQ ID NO: 997082 - protein, 257 aa, Homo sapiens
AHVTVSRTAAPARPQPLSGHLLASCVSLASSLCWFCKEWLQGPLSLRKPLLTRQRICLMRLRATGEDENILFSPLSIALAMAMMELAAQGSTQKEIPLSLRIIDSLENGIDSPFSNDISHIPPAQHTHPRHAPRLLLASRKLDPPGNEECAARCQEIRPPHPTVTRTSCPPGASSPPTHPRRARLPRPPTPVLPAVSSQVDIPQSTPHSPRHHPPPSHHRHITAPPRVRSLDDPHAPRFPPQPTRLSIEGPPAEQPP

SEQ ID NO: 997083 - protein, 106 aa, Homo sapiens
MSLEIIQQAVPVQVLTLILYPENTVGQKDEDRHVGDLGNVTADKDGVAEVSIEDSGISLQGNHCIIGLILVDHEKADDLGKGGNAEGTNTGNAASCMDCGDIPIPT

SEQ ID NO: 997084 - protein, 142 aa, Homo sapiens
MEFQTLNLTMNGDKVRKFIKAPPRNYSMIGMFTALQPQRQCSVCRQANEEYHILANSWSYSSAFWSRLFFSMVDYDEGTDVFQQVSMNSAPTFMHFPPRGRPTKADTSDLPKNWICSCATSIVDCCHNGWSYSGFLDHPTTV

SEQ ID NO: 997085 - protein, 278 aa, Homo sapiens
PSTSRRAGGRGAYIPTLAVREDQRKPYTREKHFLGLEKKLKQMEMRHAQREQELQQIIQQTHQVVETEQNRDVEKWKRLVQLKNGDLEKRRPARHLAPDGFRELRRYVCEAPLVYSLSAWGLGTASFTLSRHLERVCRVRLPVRHVGPLISPFADGCWCVVVVRLCDVRKVAVERVFVVWILVSIPACARASLLVITRTRSRDVSRLAPPHLDTECVRAADCVIRRAPGGLCVRRSVPCIRKRTLSAALGRQAGSARSRVLRSRLRPVRVVSPAVACR

SEQ ID NO: 997086 - protein, 32 aa, Homo sapiens
MSGRVRGGVGDNGSVEMAVCEMRCGGVDQVSR

SEQ ID NO: 997087 - protein, 74 aa, Homo sapiens
YMITLTTTQANNKNTALTLFSTTEPLTCQEPGEDEGIRGSLPPGYLVVPSGAYILGRCTVANKLHDGGLHGCKL

SEQ ID NO: 997088 - protein, 108 aa, Homo sapiens
LRGDNSLDPNDQVAMVLQGLAIQKLRSKIHKKVDRKASEGRKLRFHVLSKLLSFMAPIDHTTMNDDASIYCTALFMASSTLPTKATGIDIAHLRHPLGALAGAADGPN

SEQ ID NO: 997089 - protein, 80 aa, Homo sapiens
VELSHSDLFVQYSHSPAYLLEEMWRSAASILHDQTPECFGIVPHCLDEGTVRSMVTDEFIGGDWEKAMKEHKTITNMSIE

SEQ ID NO: 997090 - protein, 201 aa, Homo sapiens
MRADRLQGTPLSIKNKCNKRFYLIKNMHLEERITLRRTDFNMMGLWRALDWDDGVSFPYDRCYITTRIAKTGLFLFDEVYGPVNRDHKDNAESWKGVSLRMLDCHRTFMTGDHWECVILFVGQPTGCGLIMKVNSGRRGRGSIVRVRRDRRAEGGEPRVRVGSCETQCDRDRLGKSEGRVEEMRRWSCCDERRCSSNETHG

SEQ ID NO: 997091 - protein, 229 aa, Homo sapiens
MNTTSERFQCLTRIRYHGRGRFGFMEKVYSYYFLKNRSIIIQQYQEHQSYTVSLFLICVLRRLMIRISIDGRLLVSSYASLFQSRSHPARKRRRTHSICEKSFLDARRAVANYAEMCYIVVNKATPNSDTPEHSTVPLIHYFTGLDFKFSPPPRTHLAPAADHHLRPSSSFLTHPYHADNNRRFTGRAVAPVPTSNVISTRPHDYRSASPSPVFLIITHLLTQHSLLIP

SEQ ID NO: 997092 - protein, 165 aa, Homo sapiens
MCYGLRICMAKYGSVAIVVRREYDANLLCPTTSYNEICDVHNLTWLRHDRGVRRSVEEYKQINTRSFRSEYPARRIDRETDSVVLQLWCNESVQVVMTRPIESLTGALRYRICHTQSHMTQCVFVEAGQGAGGIYNIARDVVKFPHRIYNVFGMETDDGVESMLP

SEQ ID NO: 997093 - protein, 111 aa, Homo sapiens
MPPSTSINTHVTRKGSYLPHTPLWPLNHHHLSPPSPLLPPPPSLSASHVMFFQFFPPLSLYYSSASTSQHSTTLTPPPPLLSLLSPRRSGDPVSPITADRRSHPHLSTSTL

SEQ ID NO: 997094 - protein, 103 aa, Homo sapiens
MSNHVSHRPRPGKPYSHPSYYNSAVERYPASARLRNIRTPTLFVGSTAPPRAPPLPRSFHARDRDAIFPYTSSARLSLSVAPPSHSHTPLHRPQGAETLTSHP

SEQ ID NO: 997095 - protein, 68 aa, Homo sapiens
MPEYTQYRTRCSVCMHARDTIQNEEKVDGDVMDEHIKVVIPDRDVVFNEARLTTSSGCYICMGQGVWR

SEQ ID NO: 997096 - protein, 74 aa, Homo sapiens
MYRILLYNHKSVVPSAVLAALTDSHGRCGVHGYVERDANARRQVFSLRTQRIVTPSLSRGSRRAPSDGGMGRPR

SEQ ID NO: 997097 - protein, 117 aa, Homo sapiens
MKIGKVPSSPSMSRGSEPVLKLLDDNGNIAEELSILKWNTDECRRIPELIRRNAYKSWLNLCPILVGPYQVGDFSALQTPLVLPLFHSSFFYLNLNLFSDDKKRQYGSLIYGGVCQG

SEQ ID NO: 997098 - protein, 149 aa, Homo sapiens
MTTEMMLWIIGPKEEEVVVLFFVADGALTSKNQVAVLTGLMTHTQGHGTCTHTRQHHTPPYDTQIIIQHYLQLNILSLVLFLYLTSTQCMSSVSLHLSITTHYKTITTPEYKQEIIIPVIQTPLNLYLDINASPFIRHYITKSHNITNN

SEQ ID NO: 997099 - protein, 189 aa, Homo sapiens
MSRTGSLIRRRCLIVPRYASSTSTSSSFRRLSISSILRIRVLIRVHRSPSFVYRFSRSPYDLSSFTFTSSASFIRFVPILSHSSLLSAVGSYCHCRILVRRRFVSYIGALLRLSLSSSVFCRWDVILITRHIVYAYRSRYSPPYAIIISRRWYRIGPVSIHSYDLDYVHMFSRDWAFHYVLILLSHGST

SEQ ID NO: 997100 - protein, 106 aa, Homo sapiens
MITPACSREKPDTTTLMVHIVPPLYSLAVHLWPSWRNEAVPMILIKYKTLQIMTNIYLLNLSSFRPAIPPHTFHSASTMSEGHNCVCAHGMCKLLFRVYTHTGLYR

SEQ ID NO: 997101 - protein, 177 aa, Homo sapiens
SGTLRGVSVFTLCTDLRMGLANLWRLHTRTCPCLKTNTCTVALFPSQTLYPRSRWTAPRHEEGILAIFATYKFCKIIDLLKRFLLIIPTLCNWKGHCDPRVSNKQMYLTPSESFSHSPWVRSARPRPRRPRPAIADRTWEQLLVPPTAPGITTTITPRPTLLPLDLSMWMVFSDSNA

SEQ ID NO: 997102 - protein, 211 aa, Homo sapiens
MKCQLDRTINLSIYLGPIPGSLFCFIDLFAWLGTSLVLYYLLYTEHADLNCMCWRIGPCLSARPNRCTVGTESSPSASSPSPIPSYPSPSPTSVDRPSHRNFLQPTPLPPSPVPASFHLSLSSPPTLVFFSFPPTSSPFSLHIAHRPLSTYIRPFWTRARTDRVCPPSFPPSHPTVQLTYPSARLSLTPGFFVPLDSLMLLSHSVTALPSR

SEQ ID NO: 997103 - protein, 111 aa, Homo sapiens
LMLRLEAMILDLPMMDRWGESSKLKNRTVVDDLLLQKPFHKENMEKVAHIKLQTELLHREDALYRWFHLISMDAYQRHTKVVNDYILYYGGKNEDFKRLVEYDKTDLHVIR

SEQ ID NO: 997104 - protein, 166 aa, Homo sapiens
LGLAAEIPVKREEREPAANPYDLQEAACAKPPSAGASYSSANRSTRHSPPSEGAGVCGAEWAKHALWGWHRQALKLRTCSPQRLPAALGPQVPGPAFVLRNKRPGSPRETSPDALSRNSRTLLSHQPASCGNPVLVPLIYHFVLFFCDSCGLHCAWDLANPSLILG

SEQ ID NO: 997105 - protein, 232 aa, Homo sapiens
MLSLPLWLNLDLPGSAPHTLDLLKEDARQHHYQDHVPPPRPLPPNRPTTSATSPPHAAAPVSSQTVPPPPQSCQSPHPYSTLNPYPTAHTHAHLHRHAPPIPPCCPTSIQSRATYERYAPPSLFPPPLSSTAASISCQSGLRHIKSLYSPSLIHRPPHRSPPRPTTSPTPYHFRRRYPTTLTDSFMLLHHIPYISHPLMFALPLPPHPHLLHPPFTNSPIDHKHVLTLYIPS

SEQ ID NO: 997106 - protein, 206 aa, Homo sapiens
MNTKRQKTKTKHVPRANPSSVCSLKQLIDITKESIRSNAKINPKNNRGTEGKEQRFQTLAQALRATRCHDAGGGARQGRSRTECEGQGPRWRKHRQDTREHDEEDATPTTTADDTATKRMNQTPILVPGQPSHDTSRARHHVMSEAPDERGGHTGWTATKNKANQTPPETTMDGRERIAELRKPPTTKRKRRNYHGKNGEEIRIEL

SEQ ID NO: 997107 - protein, 128 aa, Homo sapiens
MLYFTSYSEWKQLERLHHEHMSAVKRVLSSLQNCESNTPFLFMNGNENGQKSKGFISKPLTLKYKRPSLRLGERYYAPVFLCGRSNCQPTCLTPYTWGFLHADSDVISLKGWDHTCILYARRGITPRN

SEQ ID NO: 997108 - protein, 244 aa, Homo sapiens
MPVVSLRPGLPGARPLDPCICVIFQTVSEQFAYEECSADTRILPYHSIYLTLYGADARASISHGGCMIKPLDNVPSSNRLIAVMIQRSRGKLKGSIHEYNNTIRCVDTVCSTEHVPVDLSVESVSPSFSVSAPHCPTPIVPPTMYTLMSSRFTATLGGLDASRTDDDAGQGQRWITVVLFYTSGCVLASSVRCIAVPYHHYVGAAQCLHVQFLARFSLLRSTHPLSSPALYPYPPGSSAHRGMA

SEQ ID NO: 997109 - protein, 140 aa, Homo sapiens
MRNFLLNRYVDVCAAPSPPRFLLSRSTDSPPTCRRYKSHSISIAPLSHLPPRTLSYYPYSSLYPRSAAFLICRHSLRSTSSIFYGVISRPDVISYLIPHRHRLSFPRTCARSPIVYRESFTVPHIDHYLTHPSLTPIPIS

SEQ ID NO: 997110 - protein, 249 aa, Homo sapiens
MPGKILVHPSDYFISHRPDLKDSYTTETHIERFFLQMGTDSLRILQTPTDRLSLQVTNPPSYLKGPSPYSNYHTLGPKGPPHVLAIRCFTHTPPLPTTHLTPPITNNTRTLTHHPLSPDLNYPRTYIHPRRPTRHSALRNPTLSKTDFASQRLALHLPYNILITDQIRYAAPPTMDDSLPGLTSLLRPPPYYTYPHTVLTHPPLPPLRHPTHPPPLPLDSYSHYPRLISFPLTSPSPTRHLLLFYTSVP

SEQ ID NO: 997111 - protein, 250 aa, Homo sapiens
DVTTNCAPPGQTQEHLRVYSKFLESASPSEKQTNFMTKLGSISCKSLKGGNISYASPASSPLLPPLSHLLSLQSAPSITHLPISQDTEAADLDSLLGAELGKGQLTLPRTQDHTVWLQRETNPYQGLGHSKEYNPTFFRWQLDKPGAQYNSIENFIAPRLIIGRSLGAQVFLGSIHATRPPTWDTGPWITVTTRCYTTANLPESHKVLAIGYQQNQKGLPRWLRKLYQQYGNFRASELGSHVPAHTPDRT

SEQ ID NO: 997112 - protein, 116 aa, Homo sapiens
MHKIIIRILVASPALPPFRSREEVTSPLSPAWPMFSAPSSPMPTSSTSSDSSAVSTPFRKAKALYACKAERDSELSFTGGTAFDNAECPSAFTAIFTATPELQAPSPLTWALPLVV

SEQ ID NO: 997113 - protein, 248 aa, Homo sapiens
MFLSKLCSLAYAHSQQPMEQDHLHTGRMFGDRTRIPESNYPFYNPREQKSSLCYDAELKALRDIISTQRSASCLRTQAQIRMGSQICLEKIENNKVRLQLENRSSSSRRRAAPAADMSPDISNTATYPPRKHKLEPLPSYRAAAANTPLGTIDTNSVSQHGATASSIARARHVVALQRHTPPPLSRTTRSCQPRAHCCNYIPPHRQSRIWRWTPAQPPARLGPDLATLRPPRDSLCYINRQHACLDVY

SEQ ID NO: 997114 - protein, 121 aa, Homo sapiens
MPHDPSTTYLSSSSVASMTQPARRRYQRVPHIFSQHVPSARPRISTLQDPSRIPATSQHATFPTCPRSLADSHLSHSDSSPAHRSPSFPTTPDRTETESRAHAIAHYDPLFPHSSYPVPQS

SEQ ID NO: 997115 - protein, 69 aa, Homo sapiens
PISVIAITSPKKKSLSATTLLSTTRYRWNLTLSPKLESSGMIWADCNLHLPASTDSTTSAYIVAGSRGV

SEQ ID NO: 997116 - protein, 67 aa, Homo sapiens
MCPHSYSTKRPTALSAQRTPRIPSPPRSSLQPYRSHKDDPDPGNHEPETTTAQHQQAYPAETTPHSN

SEQ ID NO: 997117 - protein, 69 aa, Homo sapiens
YVIFDRRSDSSADSTSVLGQRPERIRYHGRGRFGIMEKAYCHYFVKLVEGPPPSPEPPRTAAAHAKEDI

SEQ ID NO: 997118 - protein, 225 aa, Homo sapiens
PQHACFRTMFSMIRAPPGPTPVSWHVFCMQPTSFLAFMIFMCWVGDFFPWPRLEPKQYPYNNLYLERGGDPSKEPERVVHYEDLRRLQGLRGSQTEDLTPTRGRAPPIIKLIACKLLKIPGRLWPHVGELYCPLPFSDRFNPCTLRYWLRCSSVYWPTARGPGITPRKLTLCITPLNGVSRRAPPIMIPGNSRVSPTLAMPPCRVYTPEPVIEPSPREERPTFRI

SEQ ID NO: 997119 - protein, 131 aa, Homo sapiens
MSYLLLFRGKESPPGALPPPDSMTSFSSISPNPPPTPSSPPTQPSPPPYHPAPPPGPPFHQVYLLTPSHVPWMFSRSLPAGSYPPPSRFSPFSPASRPRTSGSPLRILPLRSALLDFLLFSHSPLINPLRS

SEQ ID NO: 997120 - protein, 266 aa, Homo sapiens
MVDPLCLNICLYWPRLSTNKLIYDSPYYSKGSQKWPALSSPSVTLQILETWASSLKAEPGLHPNQISPPACIISRYWTIQTERGNVLGLFLNLMERITLLPCFPDLELSVPVSGPWPHKHGLAVNAIELGTTLDVSCHDLAMIPPSSSKRPESLLAALTAPPFVPACLTRRSINDSQTPAHAPHAPPIHPPRHLPPSPHSTPLTTYNIAIPINTPVTHTHFYISTPTTLSRLPNTSNVIPHSSPQYQIFSTHLTEILIPHPSPPHS

SEQ ID NO: 997121 - protein, 89 aa, Homo sapiens
GHSMKGRAGAPSAPGLTSCLSYLRVLDHPDGEGNALGVLRNLLWPDPTFYHASLTKNYGYVYSGHWRQEHGLALHAIEWEPPWMYLNRV

SEQ ID NO: 997122 - protein, 281 aa, Homo sapiens
GTLHTTIGSSYQLVDHWVIPAISAVGDGLMMGYTWERTEHLLTRHPQEEPALDTGQKKPLLTTSTDRSLASRALSVLRLRVSLATVETTQQPLPFTARQRASAPFHRSAARGGAPNRDAHGPQDPAFQESRCSPHSPLWPRCASALGSAINDHYRRYIQHVPQSPPTLQPTLPTLLNLPPPHSCYTYFSQTNRSRRSPTPTSFHGVPISVSAPAANTRRILSRLGPGNNPPHPPIKFVNNHYQLHHNPPPMPYPSHITNPGRNATPKKARDNVGQSLSRND

SEQ ID NO: 997123 - protein, 58 aa, Homo sapiens
MIYVYTSSTYTHAHRPSLPLPSHHLTHALRSCITYDRHERQSAHASPCSSVPPPPTHP

SEQ ID NO: 997124 - protein, 107 aa, Homo sapiens
MPPSYTTLFGPHPYQLLPSHATPTCSKPLLFPTVRAISPLGFYPYPTNNYTLSSHHTLVANPHALTPIPLPAPPDQTHSNTPHTHNQPPSSILTPLNHRLHPSDPLH

SEQ ID NO: 997125 - protein, 91 aa, Homo sapiens
SELPRYRSIMVDFEKLDDYTSAFQGHDVGFCRLSTTRGIAGAEGFARVDRDYVLKSAQLAKAGGCKHFNLLSYKGGDKSTTFFISTSYGRR

SEQ ID NO: 997126 - protein, 133 aa, Homo sapiens
SYKPHLPPPPPQTTTQFPQHCVRVLLLLCKKRWWVVLSTFWGEGGVMTTTDLTTLDQHEEYHKAGRHHPPHTQNPFYIPRPSCTETTITTLSYASFIARRGRSPSSHSPKNYNIPNKSSHSPSPRYSAPPSPT

SEQ ID NO: 997127 - protein, 126 aa, Homo sapiens
MKQDVTMWPCMDWHLLVQEIFLPQPSKYASDYEPLLVHLRLMKRERSSFDGRVLYYQQNAYDLGWQLKMAGSTVCTPTTLCYSGSNYEEAGAFFFFLVTEIDKMTPFVGPDTLTYTGLQEPIATIC

SEQ ID NO: 997128 - protein, 111 aa, Homo sapiens
KKTPPPHRKNTNHKTKILFSKSTPNCFQLHYEEHSWKSGLLFVGGYEEYNGNKPFFIKSIVEGTPPYNDGRIKCGDILLAVPGSTTSGTTHACSATLPKEPNGTPITPIHH

SEQ ID NO: 997129 - protein, 296 aa, Homo sapiens
MLPSPIALNNQTRSLGSHPPVLLLLHARTFYFVFFYPFPIFGILIITILLVQFKSRNSSKNSDGKNGVPLLWITEPHLNYYTTCLEPSVLIIHPLARLLTPMMPPPLEATAETSLFLPCAMEHPTAVKLLQPMPARISAYTAPPPSCGPSVTRTRPPPTIHPILVRSMLHAKLNVPTSPGGPIPIQYPPPNFPAIRNASRSGFEPTPYYSPVERSITYPYLTACQITYTSYSSHPQLAHLPNATIIIYIHLSVDPFDRPFHTLIPRARFPPYVPTCSPAAAATTPLTVSCVATQPA

SEQ ID NO: 997130 - protein, 369 aa, Homo sapiens
PVATAYALLDWDWNGHHQKHHSYFCRDWKQGAYCPACQGSGQTGGRITYKGFRLWTERGLLRDFVDPLQLRAVPQTTPPPSVPTGGTDPPVHTTDLATIKHALHQHSRRAVTEDTRLCRVCLDLLREARDVVTLLLVRLSRALSDRPIPCRLLRLLLPPATLYPYSYIAPAHRARRPARLDLRHMRTPPRLRSRARRSLSTVASAIRQRSAEGERDNVEPLRVLCSGVTAAGRIRGVVRRLPQRRRLLHLPAAPRSRDHTSLALTLSVSSALSVTPLLSSRSVTGRLADVMRQFSSLLFLYLSVVINMLCECRRQTHGESSVRYRSVRFRRLVTNVPQLLYTLEDALLYYALCCPRACPPRHPTLPHFV

SEQ ID NO: 997131 - protein, 269 aa, Homo sapiens
NERRGKGGEGRGRGRKEWSICFYLCFCPCGGFKGQTEIEVNCSTAVSDNKTVTGTLWLFILVRTRPHFIYHQVQTYKTHNESISFLYEINNILTSYMRPVTLFRIDCQSALAHNKATHQGPPHTPPKTPWSTHHLTPPSHNTPPPPKSPAPLTPRHPTPPPSPPLHLLPYSSLGKKKFQPNSSLITHPPPKFARPPHHPQPTPKFPTLQSPSSPPPSVALLAHQNPPTPESRTTTRRSTHATNAIIPLTPHHCLAPPIAVLFFLLNLLL

SEQ ID NO: 997132 - protein, 109 aa, Homo sapiens
MICDGHLGCHPTCSLCVVSVLANTSPSTHESYGGARLGTQIDGRYDCLRFCNPLLPRSVSPPHLHTPMHILYDHHHTFFQLVSHSTVRDSHRQSTPTLSPLCIVTTQPA

SEQ ID NO: 997133 - protein, 69 aa, Homo sapiens
MQVVTQRRRDGDTNRPDRRSEAGVVGDGDPEDLSASYTLYVRFEFILTEGQGRVGGYTPRRCPVEWREA

SEQ ID NO: 997134 - protein, 129 aa, Homo sapiens
MDGDYVSFTSYRCKNRSYPQRRYLTLSSLVTCAQRVARILTLKAAETPARTLSPSLTRPPCMAFGRSSRGCRSDALTIAECVRRACHTVNSLSCREIRLTQDEQTAANLRHTFPPILHASLNHHLALEG

SEQ ID NO: 997135 - protein, 64 aa, Homo sapiens
MGSTPVSSSRGGALRAVRYRAWYSRGNGAHLRACGAARMQVRSAPRAARVVAVCVGPRASGARS

SEQ ID NO: 997136 - protein, 137 aa, Homo sapiens
GLEEQASESSPDTTAMDTGTKEAGKDGRENTTLLHSPGTLHAAAKTFSPRVRRATTSRTERIWPGGVIPYVIGGNFTGSQRAIFKQAMRHWEKHTCVTFIKRTDEESFIVFNLQNPVGKVNESRATFAEYSRMAHDC

SEQ ID NO: 997137 - protein, 179 aa, Homo sapiens
NQEVVDFEKLDDYGSLPFKVMMWDFCCLGTTRGKAGAEGFRSVLTRDYVLNSAELAKAERCKHFNLLSSGGADKSSNSLYLQVMGDVEAKDEELKFDRYSVFMPAVLICDRQESLPGEWLVRKFFGSLPDSRASGHSVPVETVARAMLNNVVRPIDKLMELLENMAIHDLWKAHGSLKP

SEQ ID NO: 997138 - protein, 229 aa, Homo sapiens
MNGAEPSKHSPPYHPYSQMRHTRPPYSPPPSPAHLWAVTQDTPHPIITRYAPPHPARHRYRARCLARPRPAVRDRARHAAPPLPRPCVTIPAVLILPSTRGSMPRRPIHPSRYVPSAHRPHKTTRYSDTTPEKARRVRPLSPRVPPDYPRAPDVYAHTSNTRGRGAGPEAGRASLRHRTVALTVRALYRMSPRDVPTHHRLADSPSLLTLLISPMTPPRRSTLSVDPPR

SEQ ID NO: 997139 - protein, 166 aa, Homo sapiens
MWQHVAVMISHKITFMFILMKLPFKIVTETVKKSDLTTFILLLTSKLDFVNSSGLIVGRNSVYSFQFNTQHITDLSQNNPFLPESRLFLEDNTLLEKYNSGLGVPQLEMTHSDPPHWCCGSTLCQASITVRISAPCLGDPLTSQTVIRFSYCAPPELPMKTLSYSL

SEQ ID NO: 997140 - protein, 97 aa, Homo sapiens
PASAEINVCGGTRGGRLKDYPLLGFLQTLTPTFHFGLCLSQPLLEFLLEEEGLQSLLVVVNPVDKEVNVTLLWDELEELLRAGASHTSNWVPFDPKG

SEQ ID NO: 997141 - protein, 252 aa, Homo sapiens
YQVLTRSEREAPHLGHPQEDYEGNKQEKMLDEKMSPVEHRKDITKQDQVTILIYTYRTLCIQKLSIPQYTITRNQKEKNIIVAHAELTEYYTLPGGLITKSTGLNTTNTFKDHQNNSPIPTRKSHNRLPHHSNRSATAPADAPPYITNIVFATPPSRHRRTNNKPKKHALHTTRIHQKRYGGMENVLVTNTSRTSLHQSDTYTRPYASPNTQHCPHSSHKSKHHPYSPRAAITRSSLITPNLLPILHKSIIE

SEQ ID NO: 997142 - protein, 72 aa, Homo sapiens
NKPIRCIVGGSFESSVSSLKDHMMLVKSKMDAEVVKYLNDNKTSFEPDYDKMKDSMLDHMHEYSTTHSLGRS

SEQ ID NO: 997143 - protein, 100 aa, Homo sapiens
KGRRNEKNYLSQGNMPYDFEINKDNCTRGILTLGLQIYNELTIKLDEINKELFRLDKELDDYREESEEYMAAADEYNRMKQVKGSAYYKSKRKDCKQLNS

SEQ ID NO: 997144 - protein, 314 aa, Homo sapiens
AIPHPSPHLQRTDEPRGPYLLLKREHRLTLKVSYREVQRHLESTDEAKRSLWNLYNTQRRGSAKQHPLNIEPRPFPIKKSHAPTTKNGPPFFSTRGPLQAHNLYSRATSTILHPLPTIHLRPTPPLLNAPPPLCAPALPHPPLPPPSPQTIMTRSQNRSPPNPPTTPPVMYCPRTTPPHPPSSATPEPTYTTLLQNPPSPPPHLPPLPPPHSPLATHPQSPRPQPPAPPRPSPLSLPLSSLTAHHTPSPLTNHCARLSRSALAATHTTPLPHPPRPSTHISSPLTPAAPTRLTSSPLLHPLQYTAHPPPAPPHL

SEQ ID NO: 997145 - protein, 102 aa, Homo sapiens
MRCTTYSHFLEPLNDFTERIATQHILHAPRSPDLLETQLELAGGPWILEPFSEDYSLFLALYLIVGRNILTVMVQSLCGESKASRMPTAFLSKTLTLTPLKR

SEQ ID NO: 997146 - protein, 158 aa, Homo sapiens
MHPINYYIQVVLFIYNHLFKSKKAFQNKNTSFKSSASHKICNTLLYILPQTHAREVNERMMRKKGHLLARPDGRPPRIFCISTVLCLYSPRLTPAPHPSAYYSPHYSSSIQCSPSLFCIAYSSLRIPPPSPDRVRLQHCSSYLLTSTYSHLFIDAHVS

SEQ ID NO: 997147 - protein, 332 aa, Homo sapiens
PLSYLPLHNAHILNIAPISHKARNTATFLPSLPSCSTYLLTSTRHINHMNHSSIVSTPTSPTLNNTRYPPSHLHCYTTHRSPPPYHFSVANRSSGPPSPIHLRPPPRTLHHPLSIFPPVLLPHHTLLSSYAGHRPLRIPSTSHDTPYHTHSLTTYIISTILSTLLIPHISSPITITTPAPLHSHHLSLVYKQSLILPLTHLPTHPPPPNIPYHPLTSAYPPPLSLPPLPPFHYRPLPPPLYSHLLIPHPLPLTLLPSLTPTPYPSSLPPIPTPPSSPHSNISPAHFLFSLYNPPSLTSSLPPTPHQHTSPHYISSTLTPPRSPPISSTDPSH

SEQ ID NO: 997148 - protein, 111 aa, Homo sapiens
PIPTHTPQTPPHYQPPWLEENSLGTRAVRSILPDHRGVETSLSHPPGQRPNSLTAGTSLPYPAGQQALPPTPLLPSPMITPAWERQLELGVSWIPPLQGLASNKGVAVEAV

SEQ ID NO: 997149 - protein, 263 aa, Homo sapiens
MSKRTYSISNSKTYNSHLFILKILIIGYYPESVTERHSPPNYTHESRCGSDPSPWKHDIYNTPTPMAIVICSTLNSLCHYPELLRATGPGYQPIYEFILLSQPTMNIIDIEYNTLLHGHTTPPRPCHEPHSPTSHPPTPPPPQPPPPHPSLPSTLRPYCVADNVRHRAYHAASYSSLTFLSARHLTHTLTTLSYLLSYRPSPLNQRSTAVSRWVVPTSFTVLPSTMHDSSITMSDIYTSVNRVDRPTSRSWIVIISRIVTYLV

SEQ ID NO: 997150 - protein, 56 aa, Homo sapiens
MASTALNRQNPTFFFFSARRTSMNHPHRLPPTTPIALAPPQQPRPPLHPKHSPQEY

SEQ ID NO: 997151 - protein, 219 aa, Homo sapiens
MFLLELLGIHNNYRTEKMGFNVLSYLRDLIYALKAVLCVGRIIGNFYHTNPCYKENKSHDYFSHAFTMLDQSSFCLYWNQAGQTRRVILERLSNLGRPPRSLGFGYNVVEEIQRGMPLRLTARIFPAIVFFWGLRIGIAYKDNSITTVALDRYMRWFLITMGQTYSQLGTMRGDKNLGSESMGTGLQILAERGSLIPRNLRVGIPFETYLFFCIIVGQK

SEQ ID NO: 997152 - protein, 105 aa, Homo sapiens
VVARCPAPRDPKPSPLEFYAFVLEPDLHRPPNWATKPASFSGGVGERHKTKVNFGMYLMHASLDLSSPCFLSVRSHVLPVLKENVEGHDLPASGGGSMLPPKKNF

SEQ ID NO: 997153 - protein, 81 aa, Homo sapiens
NFVDSGVWMDQQRALSPTGKIVRPASSTVRRRRYTMESRSGDQAGVQWCDLGSLQSLPPGERRSPLDFPGLVGTWRTFLAS

SEQ ID NO: 997154 - protein, 258 aa, Homo sapiens
MKTSCCHSCRKPCCCQSSCCVPVCCQSSCCKPCCCQSNCCVPVCCQRKILRLWTHTFTLLLFGERIYYGSLNHFFPHILPEAPKPAICFLSLLTTYLHGSHCFPALPPIFSLHTPPHPLRPPSTPPPPYFHPQPRLSINSRATHYHTLSQRIRPICKSPPPANLIKFFQTRNPHNISQKSPTQRHHRGRSRPRPPPPRTSSPPTPATRLQPPHKHPPKETPTTHLNHYNNISLTSNAYTISQDPDKTATYPDHLNANH

SEQ ID NO: 997155 - protein, 67 aa, Homo sapiens
RSRITHPPHNPPDNLLVDPPCLEEERLKLLGSRDLPILASQRVRITGMSHCTWPPTSRKNETMILGL

SEQ ID NO: 997156 - protein, 355 aa, Homo sapiens
QTNITDWVHENTWKGCSIHILLQIVRKDTPLRGMEKDMHIAQTNDHANRHTLSERTPTLSAYSGNIPRMTPPNHHKTGDILRQQDTRPPARHAPRRYYLTTHAQERPESIRENTIRKTQTTAGSQRSESADDTVTPLATRTSDPETSKDIAFTSHQARRCSAHPKYIGIPRGRIKDQNSTSRCIPSRTTRTRARPDKPRTQTLRRRENLTLTYPDRERIREEETQTYNRRNPRRPAHDPTVTRLRARAWPSKRIVEARMQRRSGDRVIVRGHAHHSADRRARGHSLSSNTIRAEHYEDYDDRRACTRRIVRLTSRESSTICNATHTTARMRHRHAVAHDLCIKCQRYVTAIHMKV

SEQ ID NO: 997157 - protein, 120 aa, Homo sapiens
SSDTHREGDGTPLRPSYRGEAGHPQPASPTPPEAQKVKPLLYFMATPPVHHDQRSHGDIRYVCNMPADTRNGRLDQLANDMTNVYWTGSECHSPLRYRMDTYPPYLSHANPQSGTPAKRT

SEQ ID NO: 997158 - protein, 97 aa, Homo sapiens
STSLTLFRDERRGVVFERYLRIGYCVCTFAVPAFRYLPSTRCGSGPTLTLRMQHEAQQRWRRSHYHTRRLECRAISPFDMNFPCTGGRAGNWRIIRL

SEQ ID NO: 997159 - protein, 267 aa, Homo sapiens
FNWKIIWPLSDNAQLGPSLTEKLCLELAHTSIRNLTLSNSQLSTTRNTTLLGLKWTNLTNLNLSYRHSHVDANHPFAWITQPHSHQLTHYHKPRSAPTITSSHPPPAPTPQPHPHHLHPTLFHSPSPHRRPSPPSSDDPQYRSRHTSRLKPITVGPHAFYIHTERQDNLPPPPLPLGSDPETKQLDPNAPAPDDVPPHFSSLPSPAPGFDRYTPGMQRAPPSLKVHTQHPATYIASAPATYVRAMSTLTQHIFYRTTLQLPPRLRAD

SEQ ID NO: 997160 - protein, 109 aa, Homo sapiens
MSGISKHKRFLNLSLSNSSAVHHQPYNSLATPAPPAHSPRAFLPPTYLWIVDVLPRPRLSSFSSSRFSPSTFPRAYRIYLPDPRGGPPGTNCVYHPPLRYLTPITLTPI

SEQ ID NO: 997161 - protein, 266 aa, Homo sapiens
LLDTKLMASTQAFKDIINNTSLAELEKRLKETPSDPAKNEPKVYQVMTHPLNNSTRQATTPTSQALRFIVMDKDLMLTFEAITYYHEVNSTKARAPFFNAVSAATHTLPSTAASIWPSSIYSVATVDGDRHDRVVILIIYLRSPCRAGYIPPCHSHYTPGPRTRSPHRRSPTPHSTIAVSADLANVEGVSIATFVRLPPATARLVLPRNDPGAFFEEKWNALDRCRPTRFCPRLAGSCSDIRKCASAAHEIRPHRALAPALQISSG

SEQ ID NO: 997162 - protein, 101 aa, Homo sapiens
IILMLQANWLLVPSMLATRFLELKLAIISHAVMTKVVLSKMLSTKPGALDKRLWLRALVIALLDINTGIKIRGIIPAIPFGWGTTHYSRQQQPCELHSYKT

SEQ ID NO: 997163 - protein, 131 aa, Homo sapiens
LDLHPHVALSVPITSPRHRPEDAAPRSTGSNGRSSATILTTTLSGQAVRSEWTSTGTLLDYIMNMTSDWLESSGRVFFVESEHECFSHFRRRCLNSAVVTFNSPVYHSTIFLAVPRHIRKDGIEVALLNAE

SEQ ID NO: 997164 - protein, 76 aa, Homo sapiens
DEDGLETIFLDRSIAHAWDYHGRLGQGPKGYIWSGTERIVRVHLARIGLATNGYNWPRTERVVLNALAASGFSTYM

SEQ ID NO: 997165 - protein, 281 aa, Homo sapiens
SLFFRSHTCDKGGGGFCWLEDYYFRPWTEKRKNIKRNAYTKSKFLLYGCKMSRLLQDHHGFQPCSDSGSLWRLFNTAAPSYPTNGRTHRWVLISKRPALRVATGSLTFNLSGDGQIGVIIPAHNGKNGYQTCCPPLRLFQRPTRPPSCSRPFPGSHPPPTHYRFAYKAADKFVLCRGRCVPTSSRAARLHPLVIAFAYWRQYPNQLTTALYVPVSRATAVDRPMSFAASPLPPSVLYIHSPHSHIPPLPFRARSVRIANSVSFSPLTTGRSIGSAIFSLIQ

SEQ ID NO: 997166 - protein, 68 aa, Homo sapiens
KGIDIFVIVYKKTTNFSTDAGGKVLIFDDSFEHEVWQDASSFRLIFIVDVLASGTDTTAETQPSSNLA

SEQ ID NO: 997167 - protein, 38 aa, Homo sapiens
MKEKEFYPCCAAYIYTSACEVDLVTTSMSDSINATAML

SEQ ID NO: 997168 - protein, 112 aa, Homo sapiens
LVEPKIQQGSKEVPPRWVLLRTGRHFLWLEVSGNRSSGSDELPGLRSIQVDRRPWEVPEAGATGQAWIIVKALGQQVYTLLHEKKVPGRSEFCPRSLEEKPSGTEDSQQVYF

SEQ ID NO: 997169 - protein, 173 aa, Homo sapiens
HAVSVLTLSNGHRWFCRPTSSSRQPLDTNETPYFMKSIDCIRALREEAIKLSEEQRFITFLKALEEKVEINYYIIGGKPVDQDGITLITKREPLERLSYPEEATKSLAPTQRTRGNRRVDSNKAVSATTYCPDDPRTVAPYKKYTKCRCLLALPSHEDLASHSSTDHHTITRG

SEQ ID NO: 997170 - protein, 135 aa, Homo sapiens
MRFLGMIEGSGHINFGDSVRDKDPKLPNTVTPGTDLCPSPDEKTGPPDARITYDDLVYTTRHMQQLHNSGRQPITDLKPNTLVVIYLTEMPAILFTYIWVRHAITMLAIPTDPEERPCYQLLFAANEARRGDACH

SEQ ID NO: 997171 - protein, 222 aa, Homo sapiens
ESGGEGRRPYEEEKKFMRRPAPFIGRTWLTDFLSRPGKKLDSVCGKKRKNKWFWLILYLSTLVNILNCPNKHSNCSLRTHFPMFILLPHCFFGMYCTLFIMTVDTRMFYLLILQGEFISFMQSILEFGNFHRMKKYTLQFVIWGKGDIRLRRLFGSWKKELILLSLVTLHGKETQLGGKRRLPAVEVGKSRPELGSTNECEEGYGGVREGSVGQTPHICTSR

SEQ ID NO: 997172 - protein, 69 aa, Homo sapiens
GFCFDGGYEEYSGNKPLFIKYIGEGTPSYSDGRIRCGDIRLAVNGQKYIRNDTCLLCLDCCKNLKEEGL

SEQ ID NO: 997173 - protein, 107 aa, Homo sapiens
IELDEDVLYYMNCRSGFYNNETNQRLVKHLYIFLFIDQFLNAQKTGTSVRFNSGKGDWFSGSSDTTTDPSDNTVVQRRLLYVLCMLDSFLVNNTHIIAFNTQLHSSI

SEQ ID NO: 997174 - protein, 151 aa, Homo sapiens
MTTPSKTHLHAQSSPPPPSIPPPSSPLTRRPLYIPLHGVIPLSPNSDKTAMHAPGYVPIIPHHPLTHTQHLHLHQTTHFLHITHHAPLFTRHVSHLILLIHQSPPSPPRNDDLNAPANILFAPPPDSYPIYYLHISPSYLSAYHMFQVIYT

SEQ ID NO: 997175 - protein, 60 aa, Homo sapiens
MQRSCTGETPVMGTSTTPRGYAPRGEGLPGKHRQGAAPGGGHYSITSSGKKNTTRSSEIG

SEQ ID NO: 997176 - protein, 313 aa, Homo sapiens
GLAVYATTRSGSSIDWHYILERWSLNISQHTPRICILLCQLNHSLGSVTSVLRRLWNGAGSSHPQHTNAGSDNPALNVPTYQRDLTQQITWTYEGEQHTLGPVRCKDSPSKTPSCPLGLISVRYPPIPVANPASSARHYNYIQFIMPPAMSILYRCACQPYPRPPATDKVRSVRLTTPLYATTGRLPIRHYWPARHSVCHFTYRPSVSLYDIPPAPLCLLFLTSAFVLLDCSSPPCPPYLTRSNHLIPRCLSPRSPIPYIHSPIYLPLSYGCHRLALSSLPHFSLFPYSLSQQRLEPNPPLTRVLGMLAMSPH

SEQ ID NO: 997177 - protein, 154 aa, Homo sapiens
MSLTARGCIPHAYPSARLRQADYAILTACRYDSVVETTNTDKKKHLNITLIVTCVWSHQLYRCLGAVDASQRRLIDYFTIVYSSRFCVTVFYYSSILTHQTYHIDLNSRTHLPTDARMRVLYYVVQSYVLDASARRRPPSYLVYCYVVTTVLSI

SEQ ID NO: 997178 - protein, 168 aa, Homo sapiens
MTGYAEITIWMTVLYGSDLMAHLQEMLNTVTNQPANAQKLESEDYVSQALLEAVREDKPHVKPYFSKTIRDLKGVDGSAARFDCWIEGYPDPEADWLRDDQPIKEFRHLHIYYDEDRNCSLIIRDDRGDDDPKYTCKAGNSLGEATLHSKLIVETMEERECEGEEEEE

SEQ ID NO: 997179 - protein, 157 aa, Homo sapiens
MKLRLQQITDQKQKWALVKRQNEKRVGVVLLRGRRSCAPLSFAGGLVNDHRLDDLLCLLVSVAVRSASSLHRRSYGPIEYGRHPLHPAPAPARRVPSPRSARELRAPSASSAPAARGIPTRATLGRAVRDARGACGGRAVAPCGADPCRGAAVTARY

SEQ ID NO: 997180 - protein, 289 aa, Homo sapiens
PALLSVIILLSTNVGTSSKTSPVSVTCSAPGIQRPPVTLSLLQDHQAHTRVLETDVCLPHAHTYTDSFQPPNGPTLKRSMPKHHYYPNIMSYIKSHNSSTQHHAQHINHTYSHINVCLSPREEGSEAPYYPLINMHSSRLSVDLSIITIQAYHPIFAIATVRTPTFLYLLHIRSCNRSTIRKNAQGIARSRTTSKGGITQEYLRPARFVHYHSSTSTPAIVQTNIIAAHNRSAFHASRSLASLPSSPGRIMIHSLLADWIVIDPTLSFTYQPHTLTITIATVKYIDYFP

SEQ ID NO: 997181 - protein, 171 aa, Homo sapiens
SLLPEWLLLVLPAAFPALQPPGEDSNYVIRPHDTATALLQNRIDKQSSAHPPRHIIPDKGYMYLSSSLCESSKLRHLARKLTVNSSHKIGLNNRLDRLLLSSVCHPVVVDVRPSADHAYIYLWIHSRFLISSATHSIIPSPNPHKSCLVSTHTSVIHYEVVLYIHVVRLVC

SEQ ID NO: 997182 - protein, 158 aa, Homo sapiens
DRGGLRGGCRIPFFGIHSEVTYFFSMPGDIIFYTGGGGLITTQSQILSPHLSASFSFVGTFHEAEWWPLKKSPQPLLQEMVGAPGGGAHKLNVVFTLWVKGNSPSAPIKTPPLSFQKGGNLAALVALPLWAIGHIFMHWEHQAGTLSPPIAYLAEGEF

SEQ ID NO: 997183 - protein, 45 aa, Homo sapiens
MVVSMHYNSDVTVYILWTEPIRSPNSVCRCFRAACLYTPHRRLIP

SEQ ID NO: 997184 - protein, 105 aa, Homo sapiens
LGDRIMRSEVVWARAEPKDYCTRESNAHCGSYVHSTYGNKCALCEAHEGKVSGKIRPKASLENALLKPMFLGDLPAFAAFFTHLCLYFSWWIPLIHKDIPTLPGS

SEQ ID NO: 997185 - protein, 102 aa, Homo sapiens
CEWSVILEDLDANNRNRQTLCSLLPKKSRSHNTDAALLPCISYPAFALDDEVLFSPTLDKVVRKLKGKYGFKRFLRDGYRTSLEDPNRCYYKPAEIKLFRWH

SEQ ID NO: 997186 - protein, 65 aa, Homo sapiens
MIDRYTIAVNERHLTDDTSQQDSTEPTELHRMYTTLPPRIVTHSMLDGFNAYRQSMDPRALMNYE

SEQ ID NO: 997187 - protein, 33 aa, Homo sapiens
MPSRTARTTLSDSQGILCTHGQRHSHILTTTSD

SEQ ID NO: 997188 - protein, 160 aa, Homo sapiens
MNVSWRDETKSFRTWITLLHGGGFEPKQSHIALSQNTKEKGGYGYVDHMFLARCKTPGILDGACYYRQRIADPGTTGLSTRNPPSYLKTLEIEAGQSHQQPAALLPPINNGTSRVVHRGILYEYHQIVYNKPPITLCPEVDTTHSDQKERKVIDTGEVGQ

SEQ ID NO: 997189 - protein, 183 aa, Homo sapiens
MILIKECMDEASISYITYLTVCLVIKYTQSCTSSAKTPQPPPRTNHAITPHASYFPHVRRLLPKDVIPPLTRVYLLIIIATITHRVKGLSSPPSSPPHHHLLPPPPPSPRYYTTSSYLLYSLTPTTQPDLPTIHTSTPPHIPTNHNIPHSYSPHILYPFPLCAFFGPFMRTQILHVAPPRQSK

SEQ ID NO: 997190 - protein, 48 aa, Homo sapiens
MLAETVSPALPGSVCADHRPGGVVASEAQLYAEHFDVGEPNTYDPPHA

SEQ ID NO: 997191 - protein, 111 aa, Homo sapiens
SLPRYTKKKNLPKDQKSREELCLRKRIHSSTLSSSPDFYYSKAAPEGEAEGAETTKRPAVCADALRTPRFEHQRHVPSFTLSYFFFLRLYLYRLDSNYRNNSLYHSTLMHN

SEQ ID NO: 997192 - protein, 74 aa, Homo sapiens
EEVGYPEEAPYDAMDVGATPVVPQALIDQLKPGGRLILPVGPARGNQMLEHYDKLQDGSIKMKPSDGDIRAFNK

SEQ ID NO: 997193 - protein, 107 aa, Homo sapiens
MDTTCLIKFHNAKALTDNYEQYKNNGLDQSSSLLNQFKFCSAIKVWDYVIIYIFAISKEHDKILMSLCEEYELGRKEIEVRKAEKKSSIFGQRIVINLPTKNTTLYY

SEQ ID NO: 997194 - protein, 180 aa, Homo sapiens
MCVLLRCLLLGSPLTQCTLLSYESLFSSPPPLSFVSSHPPHSSTFPPPCFLILPPYAPAPPPFYILPSLPPPPPSSPPHPAPLLTSSATYPPLHTTSKSPTPLYTDFPSTPLHSSSSPPSISPLIFLYSLSSPTPPPTTYSASVIASYHVITSPHPSFPFYHQSPPSSPTLPHGSLPTTL

SEQ ID NO: 997195 - protein, 194 aa, Homo sapiens
PGPHPDLFFCFFLYFCFLLSIVCNGLMERRKKVFCPCVGAGNSEKAYFKTYASARNKTPRIQHCYNRGKKCLIKLAFETPKNTRRLFLMASDSFKNALASRKKPFAFFKKGVFSNRNLQTSRDEENEIFEEVYAPCVCSFRPIVRKGGPFLFFAPCPPEKKRVIKTVLVFSGDKIFFLGTKVFFGGGRGGYPRF

SEQ ID NO: 997196 - protein, 79 aa, Homo sapiens
MRGHRDDAANNEQAQNPAAHDTGHRSQFLRPPLARRPRRSNAACRINRAAKDPKRANLSHPRIVRPHPPVDRPRPSQST

SEQ ID NO: 997197 - protein, 201 aa, Homo sapiens
SQRYPAVGKFVSELDDFVELNESYIGERTLHDRNHITNLMSRCWHLGCQDQWACGELRHEQLMLLMPNMFLLFPLTVERTFWSDMMDSAQSLITYSWTLYLQAEDGKIAIFQAKPDIQYAPHLEQEPTILGELSVSTMSYLHMRNSHAHRSLLEDGKSDGALRCLSLNCGRTQTRLLYSRRWYWCGFAGNLCYNRGATRAI

SEQ ID NO: 997198 - protein, 127 aa, Homo sapiens
NTRKQNSKGRQKKQRKLDGKKVSSAWTGEAEPRIITISSRSQPQTRGRTSKSRQQTGAGATTEQQTTTTTTTNRHRTPTRRPRRASRIVIILTSFGAWMPLWRLYNKIMNLMRKYQLKLDLSCVPPS

SEQ ID NO: 997199 - protein, 134 aa, Homo sapiens
MAVINLMVVHSVILLTVPISLTYPFGLPFCKYVSTMLNIHMYLTILILWRDPRARIKTKRTLQSAGPRGCQSWHVDPVDCTRGPPACFRVEEAALNSTERWFTHGRESRWDKWACHRTREYPWRSSLHPTLICH

SEQ ID NO: 997200 - protein, 70 aa, Homo sapiens
PLRRRCTHTPYFTTSLISLSHYLPPHITSGKLTDALPAKVEGWKEHNHKSAGEMDVGGVCFMYLQKKSCP

SEQ ID NO: 997201 - protein, 143 aa, Homo sapiens
SNNHRYRTIEAKFQCENAPFNCADEVIMEVTVIKDFLALSRAVNRDPSSRQTAQNLKICLSKASFKPQGSSVPGRGGAGKEETKKNVYDLKIWPKITHHAICFLRKGKTWCTFIQRAHHSCLNRDIWSCPALIWSLLLHLEHF

SEQ ID NO: 997202 - protein, 148 aa, Homo sapiens
MCAKTAKQQKLRGLTNLLGEETQLCGMGTEQGCWIPVSSDKGSCPQVMERSFHMPSYGTQTLEGGVEKPLLSYQLTHYGNKGPWTFLPNGADSVKTGIKRKVKKNELCRCTVSFLSKVEQTYRFLVPQSLRLITYLMPGDRCISVLFV

SEQ ID NO: 997203 - protein, 314 aa, Homo sapiens
MRAFYSAIIVTSTVMRTYLECDTQSQYTHQTFSILYYIVAFFEPLYNAPPPHELLVNNTTGRNRYTSRAHNQKLGHLSHQSILNTPINTLPHYSTHSQSCNLLTHPRSGEGYTIKPLSPSRPLFATLTIGLTHMSSSRSRHNQLSSSCATDKRTYRHPQPPYDRTRNAYTPLCSYYYSLSITNNPVHYTHGKSIMVNQPMCLLNIFTTFPDSHRPPRPAVAHVNSITRRPHRTLPAYDCPSHTHCTRAHPHSAIQQVSEQIVYDDAAESLTQLLRRQYIDMRSGHRDSMTVTRKDMATIHEYTVWRNIHSEPFT

SEQ ID NO: 997204 - protein, 168 aa, Homo sapiens
MAQVTDYNELRTQDWGGAGKPSLNRRQTLLSPPHPVSPHDSQRTPQGHFQAAHPEPGRDRPAAPYQRGACTSMCSRTPCRSRGTRELFGRHRTVTPAPFPGGSPGAHPHSKATPAPPMAPGAQPPRQGNSRHTHTAAPTGVGGEKGECDNKKGHGGGGQPPHINAPHH

SEQ ID NO: 997205 - protein, 128 aa, Homo sapiens
AVTGSLTSSTPPIYLRSALTTSPTDDINTDLHTLSLSVTQPNNHSNVARDIPNITRDGRWPAAPIANSDNVHGSIFRVITAHKYVNDTRHDLRRRRAYCYPGYYCFRRASSVIDPHDSCVYSLFQRSA

SEQ ID NO: 997206 - protein, 85 aa, Homo sapiens
HIHFPRFLINLPSQNFRWICKRPQAANLQAVINEVCRHRPLNLGPFVVRAFLRSSTSEGLLLKIDPSVPKEVKNEESEQQDAYMR

SEQ ID NO: 997207 - protein, 67 aa, Homo sapiens
LGQLNHLLLVFHDCLQPERASCSSLFPHLTLSPYATAYLDPEDPGKKSWEEKTPSIALPSWNNLSQT

SEQ ID NO: 997208 - protein, 42 aa, Homo sapiens
MVVAVSSVEKYGLTDTYTSVSYCDLSRSVAMLVVSRVSQIRA

SEQ ID NO: 997209 - protein, 116 aa, Homo sapiens
VNALSEATAFHWITHNPPECTDYKIQARVLGNKSNIFRVGHLSTISCYQTMADASTELQQVILISRGTFSMLSVLAGGGVFLVLTYRGLIKYWFHTPPGMPLQIEEYLKDPAQPIL

SEQ ID NO: 997210 - protein, 83 aa, Homo sapiens
PPKRSTQDLITKKAGAHFLFFFKIVDSIHLLDLEQSSGIPSENPPLTFLYVLHASSVFFLPTVLLLVMSCSNTRWGRSLSLAK

SEQ ID NO: 997211 - protein, 302 aa, Homo sapiens
VGAQCELLLCGCAFTLADVLLGATLHRLKCLGLSKKYLGKMAAGQTCSASLRGYRDSFAFRKVLYDSHTTLLAARNPLCCTGGQEEISHQPCAPARLKESLRGMVCLRRARCTSSSAVREWRTGIWRAERYASKGTGIVRPTWYLAAERECSIQTYKKSTCADIACSFEVVCMDAYWCINFSLIREVAEVSRRSYVEVSSGAVANNLMIWAILNEYMFVEGRRDARKKIGERAGRVCGRAREIGSVSNAGAGGDYYAVAEAESAVMDGGTVLVDGLLRSAKYTPSARVLTVTINLLNKCKLN

SEQ ID NO: 997212 - protein, 225 aa, Homo sapiens
LCTTRTSQTPDQLAIKNAGKQDPKRHLEEHVDVLMTSNIEQCLAAMKDTDPFKKAEKNAINDAFTEYSSVDPMLIIKGPLKENLDKSKTFEIIRQIDTTKKSDVNLLILIYNMNSENSKATPDYLLSHTTLLTHPPHAKSHLTFSQAPLLGTLFSSLFHAIPDNTDTTHHDEVFNVITANSISQFMKLPSPYTHHLVSLIYRNRLTHYPVTPTDLVQYSYDLRSR

SEQ ID NO: 997213 - protein, 73 aa, Homo sapiens
ATWLITFSKILWPTCPSSCAHKTQFIGGITQGAGREEQKSRRTHQQTPADTDRPSTTGQRGSLAGEELEEPSR

SEQ ID NO: 997214 - protein, 114 aa, Homo sapiens
VGLHICGSPVLESVKEKFSFEPKIPSPRGGGNPPTPSPFNFSPGDFWGRGASGSTANPQTPVEYPMETSGIKHIDLTGGGESGPLPIQQPNSGPYKKQAFPMISKRPEHLRMNL

SEQ ID NO: 997215 - protein, 32 aa, Homo sapiens
MSVGRHVISCSRSRVPRPSHSNAYDSHIDAHY

SEQ ID NO: 997216 - protein, 113 aa, Homo sapiens
MDIKSKFNQNFSTYPYSPHAHLRVPSSTTQAPDVERTPTNYAEHPPPPLDRILRCRVDHKVQLDDKELRVMFSLAIQTDYIGDIASSSSDSARPPRLCSVSVSYVMGDRVNSI

SEQ ID NO: 997217 - protein, 92 aa, Homo sapiens
PVDEPEACDQMYESLRRLHSNYYKHKYPRPRDTSFSGLTWEEDKMILWTDTLGELKEVDKGMGKKLGEKEDSWALRRSIRSELTSILDSSTV

SEQ ID NO: 997218 - protein, 187 aa, Homo sapiens
FKFHTLTTTINKKTSFLTLHYLSLLNHPLPNFITTSPTFHFPPPSGYPWGFNTKKLPPNLLPPTTLTPPHTPNLTVPSHKLSSHPSYFIKPSFLPHSNTVLTLLTFPTHFFQLFLLQQTSSRLTYHLFSTDRRRRKNNKYKKPIIPPFLFSLSTQHSPLLFSPHHSFLFPLQINPTNNQSQTHSQLP

SEQ ID NO: 997219 - protein, 166 aa, Homo sapiens
MSTTEDRTGRRGDPGRLESLSRTQTHGVLPPPRVQTLSWTSACNVDTPSIVCGGQRIFIHPQTFRSCAESVPQPVSLKNPRALSLLLLLSLGAHAVKLQLPYPSLKGDLLFFSSWPVALQAGGFRPPSLSSERLIASLMLRGGAVFFFGRSAYHLYNSGGEEMFFT

SEQ ID NO: 997220 - protein, 85 aa, Homo sapiens
GENVVNKYKEEKGLDGDRAYDVAARTYLHERRMKRFRVDEEFQTPFASQSRGYFLFRPGNGIKIIGVIKNGCQVMDDEKRGMRNN

SEQ ID NO: 997221 - protein, 73 aa, Homo sapiens
PGGNSHLGDDATEELMEQSEELLRCDGKHWQPLDTVASEIPAMMTQAKGQARLHDVREMRDSFLKIVKPLLEI

SEQ ID NO: 997222 - protein, 268 aa, Homo sapiens
RRFLVKMMSWYKRTSSNHEGALLQRKLEMDDYPTFMANRYAYFTVYRNRSLHKWHDYDQCCLLGKLAKGFGAFERSILTHIDHILMDKERLLRTTQTKLFDYRVLGKPEPASKTRPRQFAGEPNILTDAPANAHLKDLNEELFDDYDFYHQLLPELIERKTNSLDPNDHVVMGRPCLAIQKLRSTVHTKVHRKASKSGTLRLHVLNRLLTFMAPIDHTTMNDDARTELFRSLFGQLHTPDEATVIDNPHLLHPLGAQAGVADAPDGRN

SEQ ID NO: 997223 - protein, 241 aa, Homo sapiens
MCGKTSGSSGKSKELQEGKAAYLKDETTFSIAEMRTDDERPTTHDDGSPATAPNETPPLTRPDTPPPKDEDGEQPSTSPNSHNPSSLPDTTPSTTTPPPNPPQPTPGALTNTLTTAPGKPDPYRLTQHPRHLNHLRPAPLREGNRHNTTKTKTPPPTLYLYPLPTRAPPHPNPPNTPRAPPSRRTPPATPAAPPPTPTTPTPPPIPSLPPQHTPSTSTFLIINPLIPTPSNCDDTLYTQRQ

SEQ ID NO: 997224 - protein, 54 aa, Homo sapiens
MGFGHPEGLYVLKIGARAFGDLLAASGWNVVVGWWLHRRGKELRELPRGGYTGW

SEQ ID NO: 997225 - protein, 430 aa, Homo sapiens
MATARSQRINITYTQIHLYAYQFVLRYTRYTNVINTDMGRIALEYDAREAETSAVRSKSARRRRLAEIVSDSGCTAARHSTDYDMTYNSDVTEIASYKVEEYVRAASRSRQTSRSVLRSARRSYRVLASAHHYVSTPIGKFGVVHVSCAGRSRPNTWTLARRDRRTRQNKSESYSSHCSMPRIERRTHLARLPVVVMLGLVRASRRATYTEARFTRDIERPRHVKSLTLMDLASYSIVRTRSGDTEEVSTSSQRRTITEEMCNLLSLSQFASDYAAHTTRTRIHHIRVRVLTACLAHVSAPCLSLLLCALVRERLDDDVLSVHYSGYSALLCPGVLYTCGCKTSLDYSTCSCLIAVNGEMSVMRHLDSVRGSHRHTAGRLYMCLSIDMYDMRDYTEYTSMRDEFGVYVYDVVHDGGADRSSSILLLLHND

SEQ ID NO: 997226 - protein, 80 aa, Homo sapiens
KQKKTKKTATDAGGRGCEKKSLFGNPQRPFFSGPPLEEYNAASSSTFHLWKSMTEIDKGTVEETAEEKFAPKGPEEDHKA

SEQ ID NO: 997227 - protein, 149 aa, Homo sapiens
ESLYVAQVGVQWHDLGSLQPPAPMCKPFSCLSLQSNYSSASSLAVGPADPLCGLRTQAARGGFIKKWPQLEDDFPGESFITNSETPCDPWPKEDLLFSGSIKKGLVDWMRTDIGNMPLPEHYYYIMKPLVNIHNQDLYWNQAWCLAFKR

SEQ ID NO: 997228 - protein, 105 aa, Homo sapiens
MIAGSIYIADTYIVCAQSLTDHRKHSHQQLYSVENSIPSGLHHTMVLYLLNSSNIIHRAESLSSVVTICGNVLVDINATLSTYVRSVLADNQSYEFYTHAMVMRA

SEQ ID NO: 997229 - protein, 181 aa, Homo sapiens
PDFLAQHGIAMSPLSNNSLFLSYHRNPLPEYLSRGLMVYLSTDDPLQFHFTKVKSHCLGPNYTKEGPEGNDFLRTNVPDIRVGYRYETLCQELALITQAVQSEMLDTISEEAGINHEPKALMSLIHEMPTTLQHFYHVLSSDSAHAVWTMTDSIFHDSDCMFSTNVLFLGLHEKTSLGICY

SEQ ID NO: 997230 - protein, 152 aa, Homo sapiens
MLITPDEKYGLHLGIKGSMGWGIWGDPKKIYRKGIFLLWRFKNVLRPLKSPLEARGGFFCFKKKKKPRSLVFLRNGLAALWGGYIHWRQSRRSCRRPEGICGENIHCPAYKVGKQRDDALKRCRGRPRSGNTMLETRVLDNRRGNEKEVRKG

SEQ ID NO: 997231 - protein, 100 aa, Homo sapiens
KVIILLIVSELAQPKIQKQDNNCNYTRAIVVRENKTIHETEPLGRTLRLNAIHQTMKNKNQPRKLQKDKKSSGNAHEHKSGRTVLHLAGEHDNISLAGCL

SEQ ID NO: 997232 - protein, 72 aa, Homo sapiens
VTDAWAKEHQGEMGQLPKPSLRAWPSSVVPANNIQVTKTQRHIDATEKPAKTCQIQDGNKSDFWSSSLHIMC

SEQ ID NO: 997233 - protein, 165 aa, Homo sapiens
MFHYTSTLSPSTHHPFITFPHSPTYFNYKTTIPTPPLPYYPSSTPILHPIPLIHYHPPPSITSLPSLPLYSLSHHITSQHPHHHPFTYHPHPPPNYLHPNHSPLSPLLSSSFLPTHIYICLPTPPPVIHLISSHSSTTHTLTFFLSPTVFLFYTHISTPPFITST

SEQ ID NO: 997234 - protein, 45 aa, Homo sapiens
MLRLPNFVNCYMSAAPKRAIQTQWVPVMPVSLRREVNNITRSREL

SEQ ID NO: 997235 - protein, 115 aa, Homo sapiens
MTYPHTNIAAPPLTSHHFYFASPAHSRFVSTSPPIVFMAVQDYPPCACPPLVSSPPPTFPHALPVLHPIMFCFSLRHTLGFYPYLPPPLLTTPPASTTSDPQSVRAPSLLSPHLS

SEQ ID NO: 997236 - protein, 125 aa, Homo sapiens
AGSRFITSKPCGGGKQLIVSAHCRSQAGVVIALGGRALDSIACCSVEDDKDVPEVRLLGLCPAGCDKDVSAVRWLGHFSQGGVPMECFTPTRIWASFMLPSSGGPKQKHGAIPRRGHGGNKKQPQ

SEQ ID NO: 997237 - protein, 408 aa, Homo sapiens
HLDEADLGRPYPPPPPRRRPPSRRRRAVRLTVTLNPHSDSSGANFMCSHISPSVVHSHVSQHHRLGYTPSRSTESTHRILYPVLIKRIRKYKHSIGKHCVATVTLARPTRSHRKRQQPRQATQGLTLARTPRRSSDCDAAHVGVALATSILGHSAPAASPELVPTARRRCARDSKPCTSPEQRPTPLSVRTLGTTATGYSPRTLLSPSPVTSRMPLLILHYALSCGAARRLLSPTSPACILVSTRLFSLLPTRPDAFPRCPIYSPHIRPASRVCAAPVLPGQAASDPPIPTSAISAIPPHHIISVTPRRIPSRRIPMSYFLPSRRVRSRDRPTVSALPCSAILPSSLILYIQSPNCPHAVQCRYTLPAPHSAPRIPAVSALTYFPLALPPPKPPSHPSLPATQFHGDP

SEQ ID NO: 997238 - protein, 112 aa, Homo sapiens
TLLSSNSSRSNSHDNTPPNAFLALASLEAKQQDLYLRIMSKFLAKEKVRILAESSKVSKLQQSFTNPTLTKGATVADSLDEQDAAFESVFVETNKDPVAPDFIGNDGEKQDL

SEQ ID NO: 997239 - protein, 185 aa, Homo sapiens
MAARSASGASARASFWRVVCNPPPSRALRSPASCASRSPAAVSSPAPTPLSLTCLPRTLPSLPPLTPHPPPTPAALSVLVGCALPHAALAVGARPPRPALESPAPAPSPPRPRLYLPPPPPASRPRLRGALRAFPPPHRSAPRRCGRLQRSPLSPALSPHPSSPPTRLAPTPAAPRPNPRPTRNT

SEQ ID NO: 997240 - protein, 67 aa, Homo sapiens
GGRPPRGGSVTNKVFQDEYLLQVAQLCLDWNFIRGGGGFRELSFNLYRFHMKWECKKAYIFLVDSIS

SEQ ID NO: 997241 - protein, 267 aa, Homo sapiens
APPPTNITSPSRHTRPYLGTTAQDRLHLLWQEILKNEKHLEEIKINSQDFYEKEKLLSKETSEELLPLPVQTQIKGHASAPYFGKEEPSVASSRPGKTFHARYWMPPDGTSHNEWMHYGQILHMPTDETILTPDKSYKRTTSSQTSAALSRRDHDSPPSSRRARSEPLYLHLLTPILANRRKRTTPLHVDPRILPHTLTPSTRTPLTLSELAGPYSSHAVLRAFSAKGHSLILSLQLPDRHTSVARHYYPQTPPYTFLVHQLISSLT

SEQ ID NO: 997242 - protein, 170 aa, Homo sapiens
MIPTPCVDQKRRINEADQHEHICFALLSPDDNAVVLHTLTTRQLDAEINNTEPHDSDNPQTIEPYRVQTRMPACGQEEHERTRTDPAEGAPRTTRATDCRYLTPTHPSAALSASIDARSSQAWSGPGISHVLPPRVAHKQITEDTASGGGSPRQDLAYGRSEKPGSTKRV

SEQ ID NO: 997243 - protein, 115 aa, Homo sapiens
YLLLRSRCVVRASATPFTYRVCACIHIEAQGEEKTTFVFLFGVWMEGQKEMTYLKENISHSRTPKDQTSLWIVYTLSKIVSGAIHFKWRRAYRGKRHGLRTPITKSLEEKNFLCS

SEQ ID NO: 997244 - protein, 164 aa, Homo sapiens
MKKGKLWHDLGAASFLESSAKENQTAVDVFRRIICGGMKKCDWGMLDKAWSVMLRGWMSAGEGLVGTWVCVCTLNEGVLRAGGLENEAVAGVVSTVDAPRLCSSRGVGSRRLRLGLCLLGVEQERRVICSAILQCRLGCCNCWCNADTTGYCHTGMLRLETPEW

SEQ ID NO: 997245 - protein, 83 aa, Homo sapiens
CAKLSYYCVFISVGYSPNTTHARDTLIAARLRLNGVVVWERTLGARCRVVVRLASSYHSPTRSNNITAVSRRLPRIQIVALPV

SEQ ID NO: 997246 - protein, 175 aa, Homo sapiens
PTIHIDHHKRHNTTTHTRNFHRSTWKDYCFQHDWQHQLMYLIESYFLSLTRLGKELGVVDISSPLPGELFIHMDGPARLLLCPITTTDDVDIILSIPMFLRLYMIATVMLLHTKLFTDASSQKHMELLNTTNFHSPSRYEDSHCLDDPQLILLHFHNLIIPTLNASSVPRSWHRS

SEQ ID NO: 997247 - protein, 265 aa, Homo sapiens
SLSYPFLHHADLKAKYKELLKHPFILIYEERTVEVACYVCKILDQMPATPSSPMYVDGYRCYIRLYKKGLRGSKTERIFIPYHSVFIVRPDTMCNKIGARSHHVCLLLSPPTRIFAIPTDHTVFVLDLETLYLHFHDVHTSAIVPSPPPPIYFRFSLYLINHPHSTSYPLFSFYRYSLSRPIPTRPVTATNILPLAPAPSPFFFYFAYTSLFPIPTIPFSSAPANHALPYPPLFISSFFPFTETHNLPIPHHHLLTYLPPPSIHP

SEQ ID NO: 997248 - protein, 377 aa, Homo sapiens
AAIPELPAPAVYAHRADVFREAQICSGLVDYVLWVQRLQLLAIRHANSSLIDKKHPAKSLQYSLISTDLAYLASTEHPSVITTCYQWYPRAALDRRLLSRASAAARHAAPPLHLHVCCRGASPRRMWALAPRRLRRCTFPALTPSATHVAVSLSVPSRSTSPVASPPPPAPVPPHAHRVTTSPYRIRGPHLTSLPPPPRSGPAYPPAAHRPRTHPLPWRSARVEPARPGSAACADPAPRRGGAEPRISSRVSAPAVALPTPSSLIPCRRAPGSPEYMRARREHRPTLSPRAAVRVVPAPRAPVRLPRHSAAIPQVTPPAHPAAFTPRLSRPRARAARRVLPVGAGAGATVGGSLFLRQIRVRARAHTGRPTLAYARP

SEQ ID NO: 997249 - protein, 174 aa, Homo sapiens
LGEPSLGDTPTTQHNRRGTRFSTFTPEDCTGIKARTHQPFPPTVPSKAYDSTVLKTRGNPYRYELIDIPKVFFNKALTGPGQGVYYDFSRGVEKNKPVFYPKPPKTFATNTSLKDGTLIALPKKPSYTEILTAPHWLTSYTHDYTGLGPMDPLELHDYREKMAAQSTREIGSDP

SEQ ID NO: 997250 - protein, 141 aa, Homo sapiens
MSAPRPPPSTLPICHKHARRPLTSSTTRLAARISAPLVPPLRRYRRTYAPYSPPRPTPVELSLPAYGARMFPTPISFPPSAPLYSRPRLSPPLAPSPIHCYSPYLAQLVLAPTASRRQSHPTAPPARCASRRSLLSRVSLP

SEQ ID NO: 997251 - protein, 132 aa, Homo sapiens
PPSFLSLATPRILRSPLRLVQESMVWYRLHGNLHSWQKAKREEERLTWPQSCRYISNAGRCSSLFKLPYLMSLPVSKTYMDISSIPAPHSHSFLSLSLSPPSSISLFFSSSPRPPLLPFTSPFPSFTFFLFL

SEQ ID NO: 997252 - protein, 107 aa, Homo sapiens
MSENPHLFPTPDKNLLIERASAPRRAPPDPHTEVENGIPPNVATAPAQRERGRPTHLPCPLDPSADRPPDRDEFPSRARRPRLRITPRYQHRRHTHDAAVAHATRGT

SEQ ID NO: 997253 - protein, 165 aa, Homo sapiens
KHHNEKKKPQGYESRTLNMCYYLCICPSAWDTRNKESDQLSTVESTLPWSTRYPMYGKRLVSSSQITSIDHPARVLKEKHAQDKTTSAQHRFETSGRALVTTSRTATTRPVLARARGDNNPPTIANNAKAGPAPYPYDGKASKYTLETSHRRLRTRFRIHDKRPR

SEQ ID NO: 997254 - protein, 246 aa, Homo sapiens
IIFYLFNRYNLIVQFSYLCLLYPYLFYDTIITFSIEPTTLLIPKHHYRSLLFKHACSYIPLLVRTRMVTFVYLYIVILPNGCNTFYVARGHNYTALLMYSVNLSLVLCLPVMGQLTYSPDRSTRLHGNHDHIGSDSSHILDGFTSIDNVSEHNFPHQLLVYSCHVCVIPLLLFWYSTDHNIITLTLLRPPSAPTLLELYSSDQATHDRLLQIPDAISPFTVSSISVVLTYAILFILNPSLMSFIIA

SEQ ID NO: 997255 - protein, 348 aa, Homo sapiens
PGRLRGRGDWQHTDNFGFAGLRMWDEHISIVFTLDQKQISLSAPHQIKYVEDITATENLAIISSASLQYSSVRMQGNRFSSDRRLIIYGTSRKEQICFERIRVRNARRVLVNSIVDWVPGRDESRCASGAAYRFDRRTSHQVHADPCSDRSPAVTRPCRVLHAASLEQRRPPTRPRYRGRIQYARPRYPQQIFPLPPARSRTMRTPIIVIPHPLHNTRLTDIRLPRRHRPPYGHAVRPRAGPFRSVLSCSTYAIALSRDRTFTTQMPAAPASSTDLCACRRTITISTRRRRRDASWRRPAFPHVIRVKLIYSDLRDIYYTRRDNCCGVDSTRVVRRSCVIERLRPRRA

SEQ ID NO: 997256 - protein, 172 aa, Homo sapiens
FTSLTPPRPTPSNITALILRSKCQTDARMTCLQATMCAPIPVPPITRKQCHEVAVPVINHSTGYFSLSPRINRSSIMPIFSQVLDDFKFYLRTPFCVHCSRSLIYLPSLTQFYCHDSYPLPIRLTSYNIPSHLLPSFTCTPRSLPPFYSLLHSIHITPYTDFPYSIFFLPNI

SEQ ID NO: 997257 - protein, 158 aa, Homo sapiens
TDTPPHPPPTPKPQHSFGVTNHTFGEHTSSSTMSYRRDLEKYRDLHEDEILGALTEEELRTLQNELDELDPDNALLPARLPQKDQTTKALFVPFKTEELLDHLEKPAKALTDREDLPPHSGEKPTKGLGCQPLPPPPPARKPDPPATTLTPPLAPSPT

SEQ ID NO: 997258 - protein, 163 aa, Homo sapiens
ENWNAEKRSPTFHLGDAAHLQAEIHTGSHVPLRLFVDHCVATPTPDQNASPYHTIVDFHGCLVDGLTDASSAFKVPRPGPDTLQITVDVFHFANDFRSLVFLPCHLKVTLAEQDPDELNKGLFLHEAFTTACFPGEGSADICQCCNKWDWGTLNHFREASFMS

SEQ ID NO: 997259 - protein, 318 aa, Homo sapiens
AGNKYLTLIPPLLHSALTCYLITATDSCEAPPPMREEHASLPQCLTMSSRALYRPRILLGRPTASQLARYSHSIRGLLPTHPRRVVSVCNGPLNSTILPWLDRSTRCNAITGPLIVSLITLSFIPLLASYFGHTILPPTYTLCHLPRPKSPNGIFSGPLLSPSIAWSIIISLCPPSVSSMIPSVSVNGRTPIPCDLFPLTLSPHQCYTVPTINPIDPLASSSFGHYIMRPIHPTSCLTLLSMQRPRTLIATRIYFTSYFPPFATTIHPRGLLLYLCGPSHHSSTPASSASTCSRTDRAAVAHIHLTPFHLLSLTTSSL

SEQ ID NO: 997260 - protein, 218 aa, Homo sapiens
YCTIHSTTMRRFWSDTVEKRKFPRSSGSEPFDLPYWTPPAVRIRVHYKKHISTTTLKLHSLPVCAGERWIKSCMATPGFHFETARVPSTMTDVTSGEQDRVASLFDRSSVAEQNGTCVFMTFFNFSGQSLTHIITNIIFSHLRLRDFTLCHILILHPLQKIFHLLHWAASNIRTCNACGFASRVNGTWEQEYHMIQCMVYCVAYWWWCCDQNDLVSSG

SEQ ID NO: 997261 - protein, 271 aa, Homo sapiens
MTFKTYTRHIPARRHRDEKQSTTFHGTGHTPSGDVTLPDGGVLSSRVNFHISISHTTNCSTRTLHAASNTPRPGNALYKDTVPPHARPSNPHTNELRTRQPAFQLFVTAARREMQKHRPFTYRLDTRTTYDDPPPIHTPTSLPSLLPLALNPCPATRPAPIPPPPPPLVPDSTLSPPPPLHPEHPQHPHHPDIAPPPPSLSPATPLAPPHFPQSPPPILRLQHSTALRLITAHPNPSMYIPPSHTAILPIPTPSPVSPSTIQPPLLHPILM

SEQ ID NO: 997262 - protein, 262 aa, Homo sapiens
MLLSLVEKLSEEIMEIMRNLSSIQAFGGQLESLKILLESPGAHISEKEKWRTPTNYDLNGDNQNWLTKKTGTFSPRHSALLAAAGTPQAHFKVGASTKKQHLLWAPKLVHVRLPISKGNKNPVAWGRGPRNQCGRVRVLAPRPTPHRPHRAHTSVLPPGAPDAHPRCAAMRPPRPPHRSSPPRATTRTGPPRQPPPPPPPPPPTPPPPARRPIPSPAVRPPVPCARPPCPLPPTHALPHLPPAPLLVHPFPTLRSRSLANPC

SEQ ID NO: 997263 - protein, 217 aa, Homo sapiens
MFYSLSKASTDAEGRSFIDRPSTYLRPILHYLRTGQVPTQHIPEVYREAQFYEIKPLVKLLEDMPQIFGEHVSRKHILLIAPGYSENLELMERLARAETRTVPINIALARLLESREHDAYHLDALFFFPTLDVSSFLTRCTRIAAPIINNPMPCLMTLMNAQCYSALLLCLLISSHSQSISFATCIPAYLFTAVLITGIARLWLALISRGSRNITLS

SEQ ID NO: 997264 - protein, 106 aa, Homo sapiens
MSVSVACDWCLPLYVTISIIPSSTSLPPPPPPPPQTPTSFHVYDTSFLHCQLIPPLPATPSPPSTAHPDSPASEPTDPVVLPVPCLLVPTPPPRASLSHLFLLHLI

SEQ ID NO: 997265 - protein, 110 aa, Homo sapiens
MTNLKTHLATERGCAHRGELREGLPSVCVTKMHEMDDETDYDTAEWGTAANNPEQRGSIVTELSNKGVKFYGAPPTQEDRDLPTSLYRSCMGNIQCRGEKEIQAKTRAIK

SEQ ID NO: 997266 - protein, 173 aa, Homo sapiens
MYSSATYSDICRGTARRVMRVFSAYFIVGQNTASELCIAYSVTPVPRYIMKSLQYRIYIDTDIYNIAKSRLYENSKKKEIAEYCSDPPLYPDEEILMSICPRHDQIATFDGLEDCNHVFFIIIIIKRYPYQSRTPRTLPAALGAFNFIYQAPVHTLLNIRRYSELPSTPRDLI

SEQ ID NO: 997267 - protein, 184 aa, Homo sapiens
DKGHHGNSTTPADGSNRGRLYCISTASGRFSGSHPLHLMCSVHEPLSCCHRRTDVLRNDRKLLLNNCQTSLLYGVGAVLLPLSEVVPRLLSNEDGYTGPSPRHTGALLRPLLIYRARCMAYSLAYQSGRFVGRVRLVLFGGPVMFPIPLLSTMSAYAKRPDLTKSLDARERERRVTCRKAEDFV

SEQ ID NO: 997268 - protein, 126 aa, Homo sapiens
YLESAFESEREVSPDAKSLLLNLGKDSNNAGALLLQLLCFNRTTDDPNTIVRNRSDGGAWEHRKREAVFPLHPESVAEVRIILDQPNLTVKLPYGYKFKFPNRLNLEAINYMAGDGDLKIKCGAFD

SEQ ID NO: 997269 - protein, 168 aa, Homo sapiens
RTVKESSESISAIVVETSVKNAINIGELFQGISRQIPPLDPHENGNNGKFKLRSQPCMPDTGADDPRAVVHGTKKKPEPTSCALMKDPTLGGLSPHFEKSEHTGFASCNYLQGAGQEMYLKRILENSVKTHHTITEWPLGHEMLMEGMPSHFCYDKYHKASVTSDDDT

SEQ ID NO: 997270 - protein, 74 aa, Homo sapiens
GGMYVERHDAADSPYFDLTVKTHQGIGYQCDNCQICLHLLTSSGVDLKRVLLDPRLETNSNYLNLFIESVSELA

SEQ ID NO: 997271 - protein, 171 aa, Homo sapiens
MHLEAPQLFISQLFQPGRCPIDYVPQVCHQLTTTVSYVIQRYHTIKRCSRCSPHTHSNPVLAPCDPPRSTTQTLIPPCPHFCFTLPTYHATSYIRHNYPLSSPSAINLRPPYLLTHGPDQLPAIHSPLYPPLPLPLRPIPPPFLIILPIYKSTATRRNPTPNLPPYSTYRR

SEQ ID NO: 997272 - protein, 136 aa, Homo sapiens
QGSYKSYESEERHTLSNNLREMTQSAYSLLAHNDRDRYCTIQEHDNENKHQCTEMTSQCHTSRQHTHHNIAQNSPLMPAHQQHFVPRSPPPPTTPFPDPPPHPYNLHLPGPTTPLQLVPPPLHPHHPSLSRIHLFT

SEQ ID NO: 997273 - protein, 112 aa, Homo sapiens
SRATSLHLPGSSDSSASAFSCAAGITSAHHHAWLILVFLIETGFLHVGQARLKLLTSGDLPTSASRISGITGVSHCTQPKENIFSIKNTIVFRKESIKVMRNFKYINYKLQL

SEQ ID NO: 997274 - protein, 103 aa, Homo sapiens
IPSSPLTPVTKPYLAGDTALNFPNHAFGILNAGPSSDFIGHMGQPQLKGNARTAFTPRDSEITFRSHFRPSHRSMEQEIRTTGVLHTKKHRRDFAARFSKVTI

SEQ ID NO: 997275 - protein, 260 aa, Homo sapiens
MVLQVKCGVSEVKPRVTPTTRPAPSARDLCVPEHSNGWVCMVDDGAPATELWSPSDAGTPGEEPVGMVQVGHGEDRPGALNAPKMSKKRNAGAEPAGSSLPTEPGPQSASEVEKIALNLEGCALSQGSLSDGDPGSGGQDPGEAVQPCRQALRSQGWPDNGEGSGGKGAMRDACRTRMLAVGPVRCVTESHWPLCLGSHRGASRAAKRRRDSDPDGGRNGGFCTRSVTPGPRVRTAGPPNGKAEGTTGAQPHDRRDPPRR

SEQ ID NO: 997276 - protein, 86 aa, Homo sapiens
DSWSQNKLNSNILGTKFALMKPWTVAPLRGTDSPGLTVPEVSCGNGACDWRLRRNCVRAGPQLERKRALAGGPGLQNHCNWGVDIF

SEQ ID NO: 997277 - protein, 102 aa, Homo sapiens
ILYSSHDITFADRYYAYSNRCGSTHPVKFPSGHESLQAYPVLSILQTFADLRREPCRSARADATDAYWTSSTFDRPDAIVLLILCISIVVTRQDDPGGCWDK

SEQ ID NO: 997278 - protein, 302 aa, Homo sapiens
AESDAGRPCGPCVSWCGLNSSGWWLERGAQMVSSALCAADWTPGGASYSCCLSPSGQIGHNTVSSASGCAPARLMPTALPGHSCIFTCLSGLPVAAPSQRPWHAGDGITACHWGFHCSADVAILLPNDQCNNSVGAIQCPEQSVRMPCDFSTCCVMVDGSWVVLAHAPVLPAVKTGCTACPALVPSCDLGSQPAASHPQGTHPTGKEAPCTRGLTVAVALSSIGHVVRTHGPGCPDGSTAVNCQVDILVVHQCPKTLMIRYTGMVTPGHCVLPESEYKWLSRSTATPSISHKVTGTKGDVNS

SEQ ID NO: 997279 - protein, 423 aa, Homo sapiens
SPVGDRLSQGPLLVFEEAFFSFCSRQPPGVPGGPCVDRLLAGVPWTLLMVALEGSFLVPHSYSTHSPRRYYTPIYDLTLFSIYENFYKLVKIFQEHTPCIGCFRPPTDSEVGRRMRNDIGPRDKNHSWGRAHRSLAREVLAQGKDPGAKPTTQDHACRMDASVSQSTIYYQSEHILPCSTNLQRNQAQRYIYHRPGIQSRGLKHERTQHGEVRHKYDKIPSTHMAGKAGAITTTTKEGNQAITRPQEHSLESQTHQGGNTTNQDRNYAATHTKNNNGPTRKQIQTNPMAEKDEEDSDPENTMEASNIATSSRPAQHERAPSTNHRARRNNVKCTPYAWGRTTRKKKHRRQPGKQNTKTAKKRLTKKDKGNNEDVKHSRGTAGDGQQHTEDNTGDRTNYKQAPEIGDSRHTGERGSKASRRETS

SEQ ID NO: 997280 - protein, 278 aa, Homo sapiens
PPRKVERLWMRPTYAYSFKYLQNKPVKELRDDQFLKICLAEDEGLLTTDISIDLKGVEGYGNDQTYAIFIQQFYYRDAFSHQVQEWTRKRTMAIERALQQFLYVQMAKELKNKLAWLKPQDILSLKACSRKLYNLVERWHPTDQISQVERRRRLKWTRTKGRAYEIHGHRHKLLCTEHPPMTSCRTWLNRDTERDQHLNIRPDHIPQHNGQNTRHLDEEGKEAGAQTTGDQSTKTKGQTEKLAHQHETDRTQQRNTGPPATTDTHQRTTHHIEERQPT

SEQ ID NO: 997281 - protein, 79 aa, Homo sapiens
ANKDAPVPPTAVSHSEGFKRAILKAAVEQVSTAILQKKIRERHPPSGGRETLRLRRQPKVSSVNELRPRRNKLDHYAII

SEQ ID NO: 997282 - protein, 143 aa, Homo sapiens
GSAGRAPAAAESGSADESSLSTWSRAMAPDAGAPGIAVVLEAAEGRLARSALTFSTMPLRSSPALAQDQTSGGSLEAWCVVSVLALRKHRDGWCTSDGLLWQFHVEEAVRIPPSIVDCWGQTQDLQVDGCSMIVYHVFHLPDE

SEQ ID NO: 997283 - protein, 215 aa, Homo sapiens
MAGAHARAVRLSDPYLMAGWLSSGMGSLGCGSMWDLVWSVADGGSSERSGGLEPPLLRLCACGSGEPGSAGGDPLVGGLAPRKGLSRVPYPGGAVCWGMVGTDLLSSLWYLVGPSGQDSESSVALLTHVDLVSLGTGMLVPLMSLTYPFLSQLTGSVLAVMLPVVKCLEWPELACVLALVQGLLGPPRVPCRPHQRNPGPPIDFLEAFSRQDFFW

SEQ ID NO: 997284 - protein, 216 aa, Homo sapiens
HRERQQLAAADKDAGREGPRAALHSVASSSPAADQGTSRAVHGQPGPVCGRPSCVAWGDESQAPGYEGMTGEDRQRPMLWILTVGSSSENSASDVKNPERESLVVPNGRGFRTGGGIPHQSEHLLSTERVSIICGMSSEAEFSDNNTDCPHARQCYSIVHRRVIADVCDWSSLDLSPMCGKDDGRRLKYNRDVSRARALTDGKIANIYTRETKYDT

SEQ ID NO: 997285 - protein, 140 aa, Homo sapiens
MSARVCQRHTPVLRASVRRLYVVDLGEEDRCFDKVLSIVSPLPGVTPQGSRPENSRMLSINLGKLQRRYTLGDSMFEPNDNSLEHAEDLSRSPDWTFRGNSRWALGQFRWALGRFRWALRDFRWDQGNSGGDKGIPLDKG

SEQ ID NO: 997286 - protein, 224 aa, Homo sapiens
MAGLPRPKRSERGESSPVEKREGNLGGSSRSMGAQEAGRVLGIIPLLGSGETLGARFTRKRPIPIWEKISEQKIWGGGGDSPYAESGQSPMESCTENTMGAPQPQKGVGERSRGWKAPPLVREGALPTQKNIFVATHQYMSHKLIITRRQKSSQTRWTETPSVRNHTERTWERQVGAKKDNNHVGTIDYSNTRKKIGDKNKTTDVKEGTKANPNSIRQPTINTK

SEQ ID NO: 997287 - protein, 369 aa, Homo sapiens
MAQMVRILLLGEAHVGHMTSPDPVPGWASVRSPMRSLPARERDLPVPRGTVSPGKACPLTVSGTTQEYRKLGLDDGRCCGGDRINGTIDGCSVGVMNRFYLHASATRIVMKGVNSKLKCSEYTHYALEMAAATSTAMEALKGYAPIDHVAGDKRSSDDRGPVAAKRHHGEDSGDVILRRVQYQLVSPDVNGNKPVSVVELRYGTNLRPIGRNHIVEKLDSYQYDHKNGLGHWKSRQQEHYMSVNETHEMRPKVQVYQSAPRMTNRQDRQWRYANSFQKTSIKIMEPLGTPERRQDERIGSFNSNVARTRQGRALLSGEQTMRDAARDPSQRPRKERMEHRHLKASSKGRGEQSEEGPKAKEQKLDTLDT

SEQ ID NO: 997288 - protein, 237 aa, Homo sapiens
MDRRPRETHEILRVAYEGSDSEIEVGGCAPLGASLGGPRTGCNRLVNIRVHEEQQRMSPCAYQSGVTEHLSSDLTVSPSSRGYSWYQDAAVHMSALQPNERPCDRSGAMHRLRARGLTVDSILQTDDATLGKLIYPVGFWRSKVKYIKQTSAILQQHYGGDIPDSVAELVALPGVGPKMAHLAMAVAWGTVSGILQLDTHVHRIANRLRWTKKGTKSPEETRAGPGGVAARELWHEI

SEQ ID NO: 997289 - protein, 445 aa, Homo sapiens
MEEEIAWPAGDVTRCASGHDAKAWIYAVRTVRSPRSTMVFHSDLVLGRLRATTPRGRRWLGVNGAREIGYSLTLERRRAAVDIVCQSRHLLQVTSRCGTIVHICRAYTLGTDYGRTRIIGIPTILILQSERAADWAPREGSNRELVVALTGGAPLIPPIGASQQDDMYRTSYDLSLSDAPYQTSAQDAMYLLDRYSRERMALISILNGRSWSATPTESTLPLGYILRIIWAVYTLTIGDGPLIPNRKCAIPALILLRQRNYPCGVIEQPRALGAECNPCTQYLGTFNVQAILLQTSYDRKGLTTGFASGTPYGGSERLVQKSCRSSRINLRKRIEKHFVCVIRCRSQPCQLYREDHDEELGSINRPWKITFPFFNILGHTLRSALNESVAPDLEYTNGLIVTRFWGKFVRRGFPGAPQSKGPPWIGRVPVRLSSWEVLRKTLRVA

SEQ ID NO: 997290 - protein, 218 aa, Homo sapiens
MSTCPWRDVEGPEAEQSSRRALGGELKGIAEIALGPKLMGWQKPRCHRHLNHTVTKIPNSRPSALGQFVRKCKGDAPRRIQPFGERKGPLECRPTGARQHFMLLGKNRSVVQGRSGANSGYRGAKSLRTGASETTSSAGKRTHIVRTKLPLANAHRKREQQATRTRHHNSKRNLWAANPKDHDKSCKQLIRENLQQLGTTVGQEGAHSHAPTFSRTDK

SEQ ID NO: 997291 - protein, 67 aa, Homo sapiens
FSSALGGGLVPGIGFQSVEGEAAWTCGPGIQRPVARKPSALSELSYRARPRSSISDDPDRRAIERRQ

SEQ ID NO: 997292 - protein, 279 aa, Homo sapiens
MCQLLTPIKKSKAFPPKCDLIAPHCAIKYTLPRECEKISRRDKKRSTQTGIPRAHGPLTNRGQFVDTIPPRLIFSPPFRVSPLKTERTHVSPSFRKRDSVQHLKSVDHFFFSKKLHSNLGVDLKLVASSTYSFLTTAARVERNTPTRVYVDPLFMRRLTYNELSEYVAIPPQHYSLAYWAIRRPTKYPPKILFGAATTARGLNTVGNSHVERGLLGHQRTHSTSFIEPTSEPSKYTMNANTSYNAGCAVPTLMYRYLCTIIRTHENSCMLSSEDFAVPA

SEQ ID NO: 997293 - protein, 89 aa, Homo sapiens
MKHTRHSQGAKTNTHRSIIENMEVTRQGCGNMQHVQHHGENTRRGKSNPHYGHTWNTRTRPTRQEPTTGRAQKVPEIRHGPHNGNRHMA

SEQ ID NO: 997294 - protein, 84 aa, Homo sapiens
LLYMAVPDAGGPSDPESRMHTLSKLHNEEENEDARVYGSSCCIPRWDPDANTVLELWKVPMQRWKLQVQEQSEDMSSIGTRCSS

SEQ ID NO: 997295 - protein, 312 aa, Homo sapiens
MARTYLKSVTGAPTGARPETKSSLVDQYYQRWLTNKEPREVGSEYRMTEQKLSGDASSSRNVVELVPELEQLVVSGTERQASEPSPWFTRWGKRCLKVRISKGQKEVIRTTFGYYVHSWLEMLSWDLILWQHTRNASHALEVAHHPKTQRNDRAPRHRTVQGTDPIPFAAKHVGGRTPVVRYLATTLRTEGCKGGVAHGRVVIHAKGSFCGTGLEHLGNEITHLKPMGKRIRTAWPTKAAEKEIRGPSRGQQSQGPMRHAPSRRKTARQYSRPQRLESEEEGNGAAMAAHCAYRQSCRKNIKPTHQNNSGHN

SEQ ID NO: 997296 - protein, 364 aa, Homo sapiens
ARAGAQHPPLLEYPYAPLPFVPPGKPTSVGPQAAGRGLATRTLRHHVRRATYLDKDVEHVALAPCATTRTALNLAPQNYRTAPPTVPGLRTVYHVAARQLQRQRTWTDAQYPGAILSQEAYGAPLREDWNGYAPGGAEDARQRRGLTDLKLVGLPPDDRPWANSSTRKTTHHRTTHAEINPHRTTPDRRGPSMRILELTAKRIKAPALPWGPRRHQTRRTTQQRYTTEGQRRNHAAEVDMRKTRAANKHPQPGRPTVANTEGPEQDHTVYGRWLLTPGSPTRASNWEAQWYEQGRYRTIPRVAITIRASFREANTARENKCHDPEHCRAPHRRNARAQHTSVETRGTTAHQDRRHNGKHRHAHN

SEQ ID NO: 997297 - protein, 319 aa, Homo sapiens
AAWKDGVRKERYRLYCHLFQLHRACVSQGKGKRQRRLGRFSREASARKMALWIFRDNHIAIIKKKDKELNVVQGVLWGLACEKIGVVTLPAAFPYPQASQRMMLTVDEVRISRMEDRKRRPYADVNIGSSCTVGWYQSTYYGLIVHPGLLLDLSDYSYAAMAFEESVVLMNDPIMNWPRISLTKGIAAMTPKLMEVSTGRGIDPLESIDKNGRISALSTCTDASAACNQDNAHLINVLTVENSDTRSQLSAHNPCIAQAVGQAGKSLGGRNPNKLPNWTAWHETAARIIVQIHTHTLRNHYPNNSKPSQINLTKSTPPR

SEQ ID NO: 997298 - protein, 198 aa, Homo sapiens
MTEISEMNRIISRFLADIDGPREVHEGLPLEAALIAEDCRMQPWQRLGSIKVMPHAHKLVPDACDGPPVLCVRLNAMQYIGCVTRLHEMLRRDAGLNGQRLGSWNTRGIRPILGQCKLAVKSAARKESPWHRSCYSCALATYTYRTLSSIDLIGIIPSGGVMARRLDPRGLQSHVHEGVLLSRRRAPGFNSYALTTVA

SEQ ID NO: 997299 - protein, 84 aa, Homo sapiens
MLSTTTDRLQTNSTPANPRTYINYTYDDPPKETSLDGPSSQAHTKSGTDNHCAHTTRQQTTHHSEMYTHKSSTSPITIDTWLTH

SEQ ID NO: 997300 - protein, 128 aa, Homo sapiens
MESIGAKGPKYYKYPDVQELNVALTMRTAPRGVKDQSFKTDLGQTLVLIGKKPSDNGFDTVIARIGSDEHDACPALSLYLDLGARIHANNRAMKRETQDTGVTSTTTPQEPQREDLQNTLGLSPRQVI

SEQ ID NO: 997301 - protein, 243 aa, Homo sapiens
EVNPERWGACSWRQRMLCGWEWGLARRAHGAPRQGFLADLPSRSDGEQAGRGAPKGRRTVRPLAGARVETAPSGGPRNGGPRNEVHDGGIHLGSIQEDTQRSVFNPRTGADRRGALEVKKQRGRAFMRRGIWAPGSYYGWKTTWIRQPGHVHYMAAQRRTSSGLETNEQEGRQQAGDSVLQRGHIEENVSLGPLQKCGHDMGAIERGEITGETVEDVGTLEKGSRRTHCCATAAKNRVARPRM

SEQ ID NO: 997302 - protein, 93 aa, Homo sapiens
MRDCNIDAKEKQLLEMRAKADKLKRHEQHGLCRQRQTRKATEAAKGTQTEGYTHRAHKAHQYYGTPDSSQAGFSANSEKLERQTRTDASKATQ

SEQ ID NO: 997303 - protein, 74 aa, Homo sapiens
DCIRGLDLLTVERARKHSCIICPDAEYLLYTQRCNLQVVNELDSFLYADVFVVIASSGITHIILLTHPRWLSKH

SEQ ID NO: 997304 - protein, 244 aa, Homo sapiens
MHLFSSLLWGTAHECKNVLCCNYYPKWGLYNREVYYFRLCKSVSRQFTRFSTGYLRTYNVGKTYRSRSLEQYELHDTTTRVDIPPLSVLQITHCRDPTHALGTEIQPQKTPGRNLTQLHHEQRELPTKQRRQRAQTQRHIKENKQEDNHQNTPTRNPDPPNITQKRNPQKNRIQNKQTTTATTQTNTSTETTKPPTTQNTQTSQNTGKSNHTNGQHNEKNTKTDTTHQPKRQHTHKQENTTKPQ

SEQ ID NO: 997305 - protein, 345 aa, Homo sapiens
STLCTSAASDVRVALPVAMEDEIAVLDHGHMSSGMCKAWLYSMRDDISPIACYAYPSIMAPTENLEGLWMSACDQKSILQCGKPRVPESKGGGAFHGGLEDVTPRYRGHLAILSTRRLADEPLVRKGFYGHRMRRFLTTTGRTMASPIGRPPRRNGNNKHSNGMHIGHRISPTDDTQQPMRKAPPPKKDSKQRKHGRETAIVDHLPKETPQLGYKDRMQFVKKTKHPGDPKLGQREHGGPQSTQTGTTGTHTDSTTYTINMNTHSISESDRLNTQNRFVEPTNEAFTHMRAKRFPLGESDNNGSRELQQPARATRGKWAATKYSYTRQTGDDNTDTSAIRSTKQA

SEQ ID NO: 997306 - protein, 147 aa, Homo sapiens
MVTNTVRRRRHSRGGQWGQQPRNKHPRTATMETDGTARPRRTDKSDHQYGKDQAARRPRERGDRGKADTPGKRDMDECRRRQKKTKAGPTKRQAHANDASRNQSRYRRHTNKEREVRQTNGRIARNRVEGQTEGRDKKRDSRIKRHR

SEQ ID NO: 997307 - protein, 43 aa, Homo sapiens
MVDTHPCRAIHSGEKNPDLGKITQCRRYGCGTRDELLTDTKCQ

SEQ ID NO: 997308 - protein, 74 aa, Homo sapiens
ALNDPGVVAWAASRPVVTGIVRTKPYPKSRFSDGVPDAKIRIFDLGRYKAKVDEFAAFVADMDAQMKYEHAVHL

SEQ ID NO: 997309 - protein, 143 aa, Homo sapiens
LMQELYSTPASRLDSFVAQWLETHLGVEGRGARRCADRGGVSECRSISMGESVGWTSDVLLVLKVVKVGSLREWTRIYSETPETVAAGGVHELYTTDLQEASKHHKDVTEADMETHVDKDRTMLDLGTRGPEDGAESPQMLLN

SEQ ID NO: 997310 - protein, 314 aa, Homo sapiens
MPKHCINGAVMGLPCVSSYAVIYHIVHAESHYEGSGAWFRFASRPLACQSRGPIFTCLLVGPKGVHVTTIGALADIRSRFPWALLQQGDPGPSPWYSRPQGSRVNAISIHEVDAHDIVPYPVWMSCPCLNPCVGSEDAGPDPSHSNAAVAHMNLYYQTSGSIVTRILFSIFAQAKDCSLSRNAHGRSNGSKPSGGSNKGCVPTRMWTGEGQKGSFLGKPLPRFHGPFRALLQRKGTWVSKTDSIGGAHRLEDFRSLKAIPGRKSHRFWHGFPKGPHTIAAHDGGGGKERTTQGWPVGFSNLSMVQAMGSPSSKL

SEQ ID NO: 997311 - protein, 266 aa, Homo sapiens
PKEAMSVEPVRSSPCWLLKRHACLTGCRVSAGMISAPRALAAPVDFQLLTQQVIQVLPMTSANGCQAAVSPSPPGEKKAVTVSPTYAVTCIPRTSLAIGAGPLLRALSLPAPNKSHLGTKVALTLLANMFPWTSHGCTMGIATKHSLSEAQHLNGIVAQSSRERWPEQVDSVGLANRLIPIDHAVSPTVPSISKVRPVPVPHGRISRKGRPHNSGATPGHKRGHYKEFSNQGSPRSSHDALREEHRPISSATAVRGAAHIYEFTTK

SEQ ID NO: 997312 - protein, 257 aa, Homo sapiens
TIFRSVPLELDLGGGDGKSMVCVSGPRHWGKGGEGLRFPSSFSLLLGEGEAWANSHFLPFQCHNTPFLNPFRGGSGTWGFHSIGVPTFWRFQEHYLVPLPNPPIKVKRFPPLFKTPLVPALGSPHRGGGPHIGGGNTPLGEAVQPLSYPPLTIKGTVSSGQTGAGNPGPLTGAGGTQPKHGGRYSWGSRQRRVIRHVARSFTMGETPHYFGGGRKTSGDRRILFKQRFKCYPQQSVLALAAPHSTTAHASVCTPYRI

SEQ ID NO: 997313 - protein, 321 aa, Homo sapiens
MSLELPGSIMGALWEMPELLVWLPRGGSFQSLQCLWVLEVKLGALVLLLVLTLLCSLVPICVLLPGTGANHEGSASRQKALSLVSCFAGGWRLLWPLCLLDLLPDYLELRIDEAPGAACHVTHPGSQLPRRYILGTIGSIRSLRSWADRQQDSHLGLSKGRPWSRGTVQPFLGREHKVSLLVLSKPSVENWVGAQHTPIRGTCNWRCTMRVDRLTRVTTLGKWPTRQRLPTFKVAPYWQSMDPVAICLTHWGAIGLAYSPKVGDTPHHRKFSAGMRIYQCNEEVTISVPVVNYVADLWAQRAGKGKPMGSGRVHEEGAPKM

SEQ ID NO: 997314 - protein, 127 aa, Homo sapiens
HIGEQQSMVNPGCSSQSPPVTACSLSLVKSVQHACGGNHCRYLGLSCRLMSNGTRRNLDTRPGDSQRCLHDCTVVADVWRTSRSMVPVYTQIVGIDPFGMKLYYLFMVYFVNITSVAVASRVCREQI

SEQ ID NO: 997315 - protein, 82 aa, Homo sapiens
IPSVSTHTYKERRRPYNEKRQHETVKLYDTLDRISQTLKITIHTPPAPLPVVRRSQTECTSKDYLGSCFNCPLADYVDSKFV

SEQ ID NO: 997316 - protein, 86 aa, Homo sapiens
LAGLLVIVPGTRRPTVTQDIVLCVPALPAAGKHAGSGAMGATLPVPELSKRAPYLSRNLTGGSVGAMQQAEREISARSGQLTNLLA

SEQ ID NO: 997317 - protein, 211 aa, Homo sapiens
DNPSSYMELRCVTDNSRERSPLARLIYVVADALFSAVVKNFDINHFAQDELETGCSTVLRWLRKLTHAGRGLRTRVGGAGEGVSVLMCPHSRVQLCHLYPALRLPALRERLRYSPLTKAPGVNGPRASAPIIWDRVYAGYCIVEHRLSKLSAGGAGRRRSCQDLRYLARASCRNGFDAANTRGSTTQEETLETVSSHLVHRIPMAKNAAQK

SEQ ID NO: 997318 - protein, 333 aa, Homo sapiens
VHCPYSAAGAPEDAKPSWSTTRFLVRGPSGGTPVNNGPGPRLPSAPTSHEVCIYYEKKRCQMDQGARVVKEHRRAGDECIDWAPESNRIVYLRLQTENAYMWTLKGLNIEDRTLVILTDQPGLPSMLCAVSPPRENKFACVAAGSRCDLHLLYSTHGEVHWWAPCKAHSEKAHPAQSVLSLASENLQAMSLARLPGSLCPSTVSGILLSPYIQVNVRGTGLVEHRPLVGSPNALPHQEGTLNVSTSRQVTLRVGLHWQQCNLTPAEMPGVGPGVNAPGHAPFCPWFDALRTQDAPAAALSGLLHPVALGWRCPSCQTPWLVATGPTWLPGPFP

SEQ ID NO: 997319 - protein, 298 aa, Homo sapiens
LGLGPPDGQLTPPPAPVGTPRLWPQSASRKTVGLCRRPPGVSLLGGDPTKDYRIPMNPYLNHTQPASRDSNLDRGKEARGWGERTGEAGDSSMRGTHPSIGSTSRHSWAAKKRKRRETRKRGKEEEAETPTRSKKTRGGTVTRGRAKGGESRRNRTAEKKNAGRHTARTERETKKDTDEDNNKTSRRTKSKSNKQQRKDRRAEETERPYTAEETSEEGQTEQNPRRTERETHAREGETEAAGEVGRRRKQRKPTEREERTARRRGGARRNRERREDNRKKISIDHGEQTPDEKRERYP

SEQ ID NO: 997320 - protein, 86 aa, Homo sapiens
MRTRQCVAEREQSLEHLGARYRVADNEAFVPARKKSGTARIVARWLAPYSSTRRRAATNAKCVAVDKSVSAEESDNRGGYPAELSV

SEQ ID NO: 997321 - protein, 84 aa, Homo sapiens
QAPGASEETGPEREGDLKVTDIILVELNKNPSLQSAGDERSFCCLYLLERHILRSLSDYPVEWKMPKVNKKSGIATPQSGWDVD

SEQ ID NO: 997322 - protein, 194 aa, Homo sapiens
EKVLWGLMDPSAPLQSMQDFPVVDSEEEAEEEFQKELSQCRISKKLTAPQKELSQVKVIDMTGREQKVYYSYSQISHKHNEPDDGLTLQYQQLPQSGKEDKDTGYSAARAGAQPAAAHRPHGARRSSRMTGSLQYERDMVVNLYHDLEKMTEVPGTRRAGHLEPQTTVLQMAEDCRAADCRPTCPTPHNQKRTI

SEQ ID NO: 997323 - protein, 433 aa, Homo sapiens
GGYAVQRGWALGCPGGPGMGNLRCASCGGFGSGILGPVVSGLWTVAWRPEAAGASRECKAEGEVVDAQSSNVGAGLCQGTVNDQGPCDGDLSRLSSPGPVSATLQEDQLNVISLGGALFFRGIDALSRDTNLLAQDATQNVMSPRVARSTQGPIQPRGLSRGAELQRIVAVKLRMRILKPLFGPQTRFLVNTLRDSIRTLVLPENGETGDSGSRAAVEQQDVTTGDCEREISQSSEITTFSKLRKRDLHVTPDYSEILDHRGLSLRSCMWRVIKPYGSALSEIIARGANFTVSAQEVCSTPRCTGIGQCPPLSCAKQVVVWADHRSWTRPALSACVRYHSLCRFRPRLCTHYNRLTPTVYRHAFTAPYCGRLDVAPHKSVGVVSAPTPLVVHDRTGLSGRVREFTIGSPDPALLDSARRALTRARTDAGPLSA

SEQ ID NO: 997324 - protein, 201 aa, Homo sapiens
MEGAKRPAQERIRQHFTEHRAEPLASPVSREGGPQSRPFAPSPSGSPGLDTPCHTGGARNAGAEEEPTPGAGLRPAEEYALGIKSRTSEMARLRDGRLIERRRVIDENYPIKDQNGTRKRRQYQHLYDHWTQKIRGKVHTLLAIMNLSTCGEPFDKKKAIDKFENGGLLSMGTRASLSSIAMSLGFHRQSTDAVNRWKYTN

SEQ ID NO: 997325 - protein, 157 aa, Homo sapiens
MVVYTGDRTVMATDIATLASRARQRRPRPPLLARTLNILSTSSRVLALCSWRVLVSLHSFLSSLQYTCGLHAVFFLIGIIVGQLCPEKAYAWPLFTGPCLSNVDLPRTCHRARHKKLALVGTQLSVQARWKNAMRGTNAPTPVCSLINIPVKRLDLQ

SEQ ID NO: 997326 - protein, 277 aa, Homo sapiens
MTVQSMWMQEMDVLAVLTHLRQLSFLEREFQRMVWRSRWQDDEGQDVVWRDHCDRGQKRGTGTETLANAGQSLAHDHMGEGGASSRVARIQYHETRTQTNLNEQTKTEGSITPVNIGEGRQAEGATCEEESCGQSSSRQESEGSQRPGDTTIAERTRGLGSKGLESINATRTNRGAKKALTFIRPGHNKTMGARTDYYTRAGKKIPKQQQLKGFATTGATGAQARMTWRGKDQGTTLGRTQRGPTRGSDGEPRLKTPVRKGTQETENGERRRKSTGG

SEQ ID NO: 997327 - protein, 97 aa, Homo sapiens
RGIEGSLTTDCCAGKETEAAVAQVIRGCSGGSRKMSGEDESTLEQHYQLERPGSVTEYNAWRGRGSPQPRDERCGYSCVLWKVDLSIRVCRLHESLM

SEQ ID NO: 997328 - protein, 139 aa, Homo sapiens
MRHVSGKFHMGWLQAVVARRVGGPNGRPSNALLSWKAALRYTCQCYASQSASDPGRATRDARAVDVERQMPGMPLEEDGHVEPCHMLKRGLDGWRPKHADARRRSALVPRAITMTTEEDSGPRRKGRNVGPIDSTNHAW

SEQ ID NO: 997329 - protein, 365 aa, Homo sapiens
AERGGKMAAQISNEEEVCRCSGIFRSWKLNWFLYSGVWLKMASSGVEVRGYDREPWTEIDYLSPSREQQNVLGGEGPAGFGNLTAGSFRRGWAFQKGSVDAFMLKRWATRGLCAIDPRQESRALQNLLGAAGLVASRGLTYGVLRFITGEWGRRLRGLWCSGRNSGGTAGAQLPFRVRWNGLNALHEWARSHGIELTYRCTTWLMPSTAVSSGRGRGSLGPYIRAAMNRIAGTLEGRPNIGVEEFGPVKQKAGENFGRSGRSNGVGKPRKHEWIGSLGTIQERHEDELGNNGTGKANTPVKFRELTNATKAKVRQGSKRTMGTFVGARDGDYQGKVQGEGERHQKRTHFLEDWSTIEEKSKQKET

SEQ ID NO: 997330 - protein, 270 aa, Homo sapiens
PGIGLEPGPHFLLLPLTPVPIPAPRRSYLVADTGPWIMVPGVADRASLRAWSPTYGLGVPLTALREPHCWGQYLAPLDWRTWLLHLRKRTVCLISEMRDTTESGGSEEMDDSCASPESRLVHRGRMLARATAATCNTAGYPTHWYVCYPLVPRSYGVGLVRIDATCELIAVRDVRRLRWHRRRLGIDPDYAEALRIRGSLTIGVQRPKDSKSGERRKSKRKRPPRNPIRRKRHSGPVRRALAYPPSHNGDVEASQMDTYIFPPDPVENPQ

SEQ ID NO: 997331 - protein, 225 aa, Homo sapiens
LLSLSLSLLSLSLLPLPLPTVSLSPRSPSPQVPSPQVSLSPGLLSLSYHGSTSDARANSLDCTAGPPRFRFGGRYNDAHTRSAPLFPGLGKKYDDPIYHALILEKPAGYLKGEPPQVFGTDPTGTKKGKYYGPHTRNYGGTQSVKKRVHMYWGPHTMMAIEYQGTPRKSQPQRVKTQKKSQCETHTPNDEGEAKKATHAYGRPDEYNHDQLPTTGIRRQGVFTEK

SEQ ID NO: 997332 - protein, 77 aa, Homo sapiens
ERLLAVAESASRCMLQSVMALTALAVRDVACGVWGREDHARSLWLRVSVIMFLMNVGSRGQRVLSTLREKLGCVAFR

SEQ ID NO: 997333 - protein, 230 aa, Homo sapiens
MRRERLAASKTLGTWSHLAALSVCAQELALQMGISRHCVHQSHSFTHVTVLLPNSVGTLVVICLPMPLHNLGIRESTPLIPVSHVRHESNMPLSLVPLCEQVLSRQSNHNPTNASLAHVSNPISTTRMTTNHFGLIPSESYDSRTPHCVLNAQNTPRSITSPLVYLAENPLGMGHRGKGLFSTFIHYIERAHPVHGESTCQLTRVCSWKNTLSQKRVTFYLHSADYHYNT

SEQ ID NO: 997334 - protein, 328 aa, Homo sapiens
VLVLTMDGHLGLVNEDDLQKLVALAQAVNARALPALQQINLYQDLIRKLCICGLLEDLSHPLISSFHLGAWHAPGSLCKACIQGSSCPIMQWHILLMPLRCLPEDKEVLTEDKCLQAPEPLMTGQVAVFGSDLPEKLGKQKYCLVGAVAIGLELLKNFAMIGLELTERVENIIGYVTWEHPLRDGQTSEIRQVSSFPGPWDCHQNDKGHDHGMLQAVAATIDIHISRGDKATKKPSWESIETGKLDISMNGNESVHNKSRRLEVDQNDHEKKRGNAPEIADNGKARTPKCRESLQYTPRKQVANMWHAELIHEEQSTLWGARPNRGKH

SEQ ID NO: 997335 - protein, 393 aa, Homo sapiens
MIILNMLHLMSESDIMLGSKSRMQTRIRHVLFVGANGCGCCIGTDHLMYFAMPRSEVHLRNTTPVSGMKLLHSYSAAGMWAEVVHANDGASPETHEDNSSLGQVRYAIACQTRSLGCHIDPMLKAHLMAIGPRKQYETYGGPAGHEPSLFWPMAWYRFPHNTLQNSSKWRQHNWIRPLMLECLHAMTPPNLGTDPKRAEVHDRQRPTSIVCETIGSKLILPPPLSSTLGGIASIPGSGVTGQSGAGQILADPLARLPRNNPPGRGKPSLTIFFRVSLGKRDGPRGNCLPPGGYRVASAEFGRYPRKLDQEHSRVNRADIRNVQSQTGFTKTTGPMGTLYLVSKNGNLRGGLPTLATNKGVTGPLSGEHDIHYVHHFVDRYERPPCDAIRSATP

SEQ ID NO: 997336 - protein, 151 aa, Homo sapiens
MGNNRDKRTTLSVRKYVVLYRGRVALSVQGLDVNKGHMIEHVSMGSNPGVPLTMSGPWRASNDIRRTSMCTYQVRDMAEFPVEPEYGAGTRNHSVDNKNVLYVGLGRPGGHGTYGPEPELKIRDATEAISGEAKWADIVGSTRHKRAMRVS

SEQ ID NO: 997337 - protein, 273 aa, Homo sapiens
EVTEDVRRETQRQRRGRQPPSLGGALSSLRPGVPPLIRGRLLNAHQRTDRPGLPNGMPMLCSHGGMQVGGESRAEMPTVTPGGEPSDVRSPLSSIAATCHRNGDPSRLTTDRPRDNTRPSYSTKNTEFTRVTNHSKRPWHMPARAPPWNLGLRIGHCAATSDGKLPATALDQARSRHAHLRAPNNPRSTNHLARRYTLGPNKQRRPERRAGVGQAAHPLKLSGPEAANEDTKPTTRAHYPPPWKDPKPALPKAPTPHDQPHTFEGEHPPRAPT

SEQ ID NO: 997338 - protein, 203 aa, Homo sapiens
MPSPVSGSEAGPESSPVACAAEASAVPERDAAAPVPLSAGSLGRCHSASEEVLESLEGENGFSSDQIICSIGDLRQLSGDHPTIRKDELQQCPGPGAQPQSESNIVRAFFDNRNLRKGTQGLADEINFEDLPEPIMSYFRSQSTTTMDEELVELSRNGEAEISVPHVLHSDSDGRITLEEYDNVVEELLSGNPHYRRKESVSL

SEQ ID NO: 997339 - protein, 73 aa, Homo sapiens
MARIGKRRCNGIRDRFGEEFFYWTIQRWPMEVSEKFRKGNKKESNRLGGKGGGFGNRRGNRVGRIGGSREERD

SEQ ID NO: 997340 - protein, 426 aa, Homo sapiens
SPPESEHCEEEVRIEPRDDSIEPGAPVASRVRATYSSRRALSQSGQPTDEPNEGTEADRGMLRGASKTVAEDEATNSLTASCGCWSCVIGWLACAKWPRRLQGPNSYMGHLTHTNGTTNVYRPKGCTHRVEIYGSNWHWAKCALGLTKHACRPEEWVGIDSFITRNTMSSHNEEMHCKSGSLANAMAHWCIAASLASPSWNRRCFGTYHLECTSSYTVCLPVLSVVWSFKLRGRFLLLIRPKFSPRNDLVVRCLVTPILGWALGKGFFNKGTMPGAANVAELTTEGKDHLGFFPNCASGVFATQRLVVTNQWRNTIFGLPYSFFKVRVTQGMIHRLANHTLNADGPVLCSPGAFQHFGHNGLGAEFPPLRILGAFAKSHLSLPRVRLKLISRGEKLAPRTNCTLPDDGVLGRNPPPNVVHTQRAIC

SEQ ID NO: 997341 - protein, 101 aa, Homo sapiens
MLRNAVAPPTSRETHTFEANRDNTQRGYTAGDHTVRPRVREPTTTSTHHNGRPTGRTHQTRTKAKHNTQQEEPPKTARRRNNRSSDTRDNTAKHTQTHKAR

SEQ ID NO: 997342 - protein, 175 aa, Homo sapiens
WSQSVRRLRLQNYRLRINCKNCFVRAAVASGLCVRAFPTGGRDLVSPKMAWVYHLSLAGKGIFHGSSNISILTKNLGIWLENCPLYFLERDARYYSVRALDIPLSDETSLHNKLVGPLSNSISRAEDLAISLAPRRYHWWVLDETVVPTARENKQQCGVTQVITLYTKAHKQTGG

SEQ ID NO: 997343 - protein, 355 aa, Homo sapiens
WTCLGCLTPDDPDDGDDLFVTKTTGSSAPGLVSLLGTALPWPAHSDAPNFIMAQLRKIHPDRHILLRQLARKCLGVNVMREEDRVVSCSWSLAGLVVDLYIWREVHLSYDSKASDQPDAATEHVGNYTSSTAIGEDGMSAREASIVLSWEMDPWSRQPCVGLGGCTDETHTCVPLLAHWKKVVRMQKGAFTRGTANGILGEYPELITACDQDVNGCHTVASRWERNEGRKRTEHANVSREPSGRPHASHGIRYEGRARGPELRSPEGPCKSAQFRIWAASLAFEAWTAWAFPIGPAHCLCDFGPHRSPLAVGPNRPLWRPPLTRLVFAVCLAGGVPQWDDFNLVSGKWGVLALPP

SEQ ID NO: 997344 - protein, 172 aa, Homo sapiens
MRHPNRGAIVVPSIFVRASKDSDVSKLKSQVRRHAHVCRDNCASSAPSGRSDSLQENGFRTSPGRPPTSGAPITARAITRCRMPYTWNIPHGQPLVTYNAAMRRFCRGAESRVRPREPTATNDNAVPHSKGTQSNPNITTRGQSTTTHHNKNKGAPSTNLGARPFNTGETPG

SEQ ID NO: 997345 - protein, 297 aa, Homo sapiens
MAGDAAFENAAVVPPRGEFQPSIAGGQFPPLVSSPATEPRFGLGDRSRVVSIRLIRAPMGASFLSQWPSPLSAPGSPSLYVIAGIFHGLHFKGGFNRNEDTHPRLYATEWIPHINSPPEGQRGGASTPKAPGTETLRCCATVVLGAIGSNPPIGKASTVGKTVYDQSKAKPFGVATPSRERAPTGKEVTICDHNIRPFEFVIAHRHYSHNQSGRPPQENLTLPMRGVVTLRDQGNSERRASVSPRIKGLRRVCAPVGVMCKTTKYAGLTTTRLGDTENYLVRTRSQGEYHTTDGFKG

SEQ ID NO: 997346 - protein, 45 aa, Homo sapiens
MIPYRKSNMCRLYSAISGAAPALDSSPKLHPIKPDVGVQPLPHLV

SEQ ID NO: 997347 - protein, 249 aa, Homo sapiens
MGGPLSGAISETYMSRRQGAICTNMRSQHSGTHTGRPLLRDSWNMRHTAQDLTKVSQAHANATYSMRHSMCDEKNPILLNVRNQVQCLQFKTHLHTYSESCDTHVSFRSSYWYIHKCDYGKVGLTMVYIAKSDGSQWGETCCTLLMHRYYYEGEQKLIHRRLQYARGKNVNIPKLHQPKIPISICGHVTPSELRWSDLVGGVELRNKGQIRNNLRLAYQTNARLVRMKQSIRLCQGKACAVVVICDWGQ

SEQ ID NO: 997348 - protein, 118 aa, Homo sapiens
MGYRMWIRKNVVGRVGSELHLAVSIPSKFASAWNSNADWALKGLMGISLLDGKFGVRVDQGARRAEFISVMHAEEELGGDESSNLAYWSTRSQINSRKNGCRNAIEESCIGAKEGNDW

SEQ ID NO: 997349 - protein, 188 aa, Homo sapiens
RTSVVHAGTDTNGDIFVAWSVCALTRVVMRSNIGTVYERWWYEKLISMTYVSHDERCCACGVRTWLLQDPVSTKFYTKKCRELYYMCCTGQHGSALPPDSKSQTRDLQIGVASSLCTDLNELVMGWTCSQVTLGRDQPLIHAAIRFAIGCVSQQLTTSATTMYRTASFRPAEELMLPWNFKEVVSHDM

SEQ ID NO: 997350 - protein, 143 aa, Homo sapiens
MRIYVGPQGAHLESDVQHFAQRQSTIGARSDVKSIRVQGTQSFPDFRTWRTTGEQIRNKPMCCEPNTLCNGRRLRRVPEICPKKFTPKTIWNSAQWGMVRTSVPLAAIWLKGAVGDKRVSNPGWTRGKFASTSENTETLEQAV

SEQ ID NO: 997351 - protein, 157 aa, Homo sapiens
MGQASSGKTRRKPPSQGQTSKAGQLCAEKCTPDIYGTEWKVSPGCGPIQWGAPTTESSSRERVRLPWETTTVEDHQTHTEAGIRKKREQRELELSQHRTSDWKKNPRESRNKGSGEQDPRDKSHQQTPYEAAGLRQTEEPHMRHHRTTGRPTATDET

SEQ ID NO: 997352 - protein, 77 aa, Homo sapiens
YTTEVLTPVYTNDKSKVRGIGQGPIAVPVDRILGQKTPQVWHRIGVLSRVPKGDAHSSATSRGQISHEDTKWLLQFK

SEQ ID NO: 997353 - protein, 380 aa, Homo sapiens
MPQRRNSDLPNGVWMMSDVIEDRNPFVPKEEAGGPCGVGVSAVLGACSSIGYNTLLDQRWRTRGSMIDGGGPSKILSDLCASRRTCTKESRTSHDRTHAKRRWGSFSASRTHSNRGTEAITGCARPTVSIRRDGEIYAIHETPGDDLREVPEEKVLSLGSKGNSDVERWKGSPGRSPGQPWDQGGPGSHHESFGRRRDGNQAVGGPRTVEFEGWPHKAPYVGAVRTVSRQASPILAIRKKNQKRTEGTTLWERPDSMVRGAPREQNVKATNAAREGQSWAATGASRSPPNNYAPALPSLGPWGHPGKAHARSDIGAPKRPRKLGWRPPGWTQTRAIEEGHGNPRGEPPEAGKHEHGSYIAGHGKRDTGAERLQGSHLRET

SEQ ID NO: 997354 - protein, 262 aa, Homo sapiens
MYADHVAEYGALRTPSLVQSDNSYTAISQHAYHISFSTKSLTQELLVCVCIESKVPEPPVQYETVWPDQVLRHASVPGCESTNRQSILQEGGTIAKLGRTSVEIDQVAPSVQTSCAVAMWTSPVAGTLLEGSQAERCPHSYSIGDFNILNKRKGSMVARKWHRTWAHVARTVGMGTEWSSPQLFANFREGDIDGICIGTERAYPCPSNASLHPIARSCQSGHEPYPLIRDYMPPGAATLPLIPHFTSAGEPVQGASIAEACT

SEQ ID NO: 997355 - protein, 100 aa, Homo sapiens
PKETSAAHTGGCSWLVNKLVAGAKGLTAPCSAGGFCASPWARVLLRRGVPGSRGAGHLGRTDDGLALAVTGDGRARRLRGAQRDAWMEPENARSSKRVAM

SEQ ID NO: 997356 - protein, 76 aa, Homo sapiens
GVKEMNDVARFLLGVSRALGVLAIRLYSWNRPSIASPLSKLAPTCAYESDHVGCRSQGWSRSSYMSTGTQSRITCV

SEQ ID NO: 997357 - protein, 323 aa, Homo sapiens
AVRASRIGSAAGRREDEAAAAAGGGVTDRAGGRRGTPPRCHLAPRTAPGCLAPRLLAHRIAAGFTLGAGAEAPGPELGRRSSPPAARPKQRDPPRMNLLPDWSAPCGLGCSPMLPDLGLDGLPGVDRGGKERCPPDPRGDPWASPGMTLETWNNAAGLACSHSILLFGGCRASILFISLAGTLRELDTPQAGCKELKVQTSGQWQAHQQTFHTRRVPGLVDLKGSPARRVVNSGIYSSGGPRMVAGNLGQAALTQAFKAPGLAERGKPQLFDRASRTRRLERQTWLIQRKIAQDRERTIPGGKEASGNAPFTILGRENPGNQL

SEQ ID NO: 997358 - protein, 358 aa, Homo sapiens
MPVPGAWMLRGGMSLWTFGAAPSPEPPCCCREVAELADAGCCWLSWPCCDDPCELAWHCLRDAPSDCRAGMTLAVCAKWHRCSAGPAEWCLILAVKSKMPEGLRAMVRRAGVHACMTHKLHKRRPLCVLPMFADHELQHQLALALSVVLDSLVNCLGVPKSFNTVRCRFLSRPKTMFTSSITNYTLRALQWEERHQQAPLIGDILSLVETTKIWLGDAKIDPVGEPDVEVDHPLSMVYWRPVCSVGAERRTAAHPGGPSIRTSRANDAEERDLGKHPRGNRSAMTGGNPPGDRATRGTHAHRKARTKRNKAKRCTDRRGTRHPYRKHKKTTAQNEKIDTHHTQANEDCTHDRQTKKRA

SEQ ID NO: 997359 - protein, 220 aa, Homo sapiens
QNTKWRMTPVQRGGPGVPWWPWDGEPAVASCGGFGSGILCGLGSRPWTGGRVAEAAGARRSARPDWITEWIALSPSWAALVKDMKINVPGGDLSLLPGPLRNQRSLIIFLGGLFSRMRFEDYASAEGRTGDRPVHQCSQAIKYATRGHYTWDKRTSLGLFNVASKWSVGLNPAILLGPSFLVAKGFFPIVPAVTTAWHTWGGNPRIGPRPHNNLSPYAMA

SEQ ID NO: 997360 - protein, 327 aa, Homo sapiens
LLPPVSPCADAAIMREHRALDSAESNVRVTKSVPRLLGWVISDDGTVYRSSTRSSYHEGTSDLAAGNASSCHLSDVGRAAGKYVPRAVLRGGSMEASASMDSSARRAAAYLGRVFTAGENFRSTGHEVVAREQTGATGHLTNEGSEMLVDPQVHGSVSEQRTACMSPVIVPVDGVSTYEHQLPCDGSGTGRSVVMCGNPSDGFRPKNPGGRTEYALGQVEFNALTTALTVMRCCTFDPRTACVRTKQVWVSPGTQYQLGHKTRTFHETQRNSGPIQHEILTTHTIQTRNVCSFEISTETVLLTLGVAIKGLAQEFLGKFRGTKASGC

SEQ ID NO: 997361 - protein, 328 aa, Homo sapiens
VDDLPALVLILFLVQAGGERDVCAGETGRAKGAGHVVSRLQDAFAATRAPSLSCVLREVERARGQLAGITFAASFGSRQRRAVVSAEDSGSNHTEELMFGEEASLGWRTGRALAMLAKTDGAGTKRRDSGRAQTKRAEPQWDETERTTTGDKRHRDVPRTNDGRSHYEKPGRGGTTPDGYHGEGATPVNREEQNTDPWQSQGTCDDAQRETMTQPKGNMTPGRRRELETGDTSYPQTCTHSPPKVKPTSAWHTATEDSRGRPHAASHNRTTTGAQQSSHHTHGKKRTPLKTWGDNVAYTHTRTPVTRADIGATYTMYTPKTLSGAENS

SEQ ID NO: 997362 - protein, 298 aa, Homo sapiens
MGFTPFYNHHTQHDTDPLDGRRHPPADEPPPTKQATHKRDTPRGATSPSTRDDRPSELRSTNTGAHTSRQMKGRHHVEDSQQPPLRRKKGVVYEKTLRGADLTSALYHGSHPHRGGATTPGGAPHNPTKTNTLAGRQRDSQTNRNPHPREHTTPRLQRSPTTCEEATTQAGQRDTKPTTRTTPGREGAPNTKKGDRQSTRGQQDDLAGTQLRSPSRQKRAPRVAWRHPKAVSQTAGQHTNAHPSRHYQNAGTQHNRQRKDSVTEQSARVITTPQPYNGTGAPPKSIHRLVLPHPAPPP

SEQ ID NO: 997363 - protein, 257 aa, Homo sapiens
MGSNPARAGALGRLKAPAQPWESSTAKPASYTWPGPELRSCSLQSCGSAEARNRRKDFGSDIGLRLNASADGELTPPETAYIVSGHLYELASTFSFLADSVSLSPPPPTSKPFPMVSTNDPWNHTHRTHLFDKHLLSAYCVLDHRHEHGDEARPLAAVSLETEAWREKGPSRPAPKPEEAENTPQLCISCVSDLSHHPNNVVGGVMIIFNFQMRKLRLRGSRPWVGHHAGCMSHALSWLHDGFRGDHVTQFRPASHQ

SEQ ID NO: 997364 - protein, 240 aa, Homo sapiens
ASSLVWPAPGSRFSHVSVQDPMTDSVVIVSFRVRAVRELSAPSDPDPRHAFMRTHQAERGDPQADPQPTSGPTLVRRGAMEKRVPRVITEAKGAPLWIRAQMLRDRCTMDRLEHRPAIQRSPHHHNMTPVKNLQKILPRYSEDNRGTPLMVRINQDSGRQFRPYTCELLANVCSIFTAAPDRRDKDPHSSLQDDMRTAETLNGEQLNAPVAHDISETRQSRGTPGTRTSAPGMPQAEAPC

SEQ ID NO: 997365 - protein, 178 aa, Homo sapiens
MAKKHKRQYGTMNTKRLDSTLKINYKEHTNLRPKASRVNYNGKYQCSRASFKSLRIAKNRFLYPNRTERRANGFEEARYYEASNTLNLHSAAVNHMGNVRPKLNGKTRVAHLEMESTTAENGKTNTQRKRADEKTNRPDWATLRRQGPETNRTAGKEVPNSKPRIAGLARHTPDDRKA

SEQ ID NO: 997366 - protein, 417 aa, Homo sapiens
MARRCLGYHVFRDTSRGVAVTILGIERLGVHGQGRGADSSVFPSTQTALAILGSPVPSSPTVTTRTTCSVRSDLCLSKGCLAGSADGQCYSKTSGKKGMTFTGKMCTGVYVSSKGISGLGPRGNPPGPGGEFFLGLRKSPGAQTRGPGEKPNICVALTLCKAVSPPLILPVVRPIAVGFADRRSRLLCEELRHTINPTRFSPTKVACDMRHSFYPPACEEDEKMAVPVSCGSPTTAEKADKGVEAPRTRHSVGPVAEHLVAGQSHHCFHANTFLGRHTLPKQFGYDLHLWVTPLWVLSNSNAPPVGTHHGEKRRGSGNVKDSATSGEAGKQRVPDNSISGFPPLLERGGKPAKKEGHKFFVAHIECPFLCYDAEHDVFPYDTAEDWTSSGTPPGYGPALNPRTDQRCRRDSKILRAT

SEQ ID NO: 997367 - protein, 364 aa, Homo sapiens
AVSGDVSAVHLSSLRIAVCLHFVIGNTWDHVHHADGGVVHWSVSRLPVTAETVVLLDGRPKGIPVTDELKNSGLTYDNSRAWRVSQLRSGYCCKYSYQAARIGRLGCNYPYDQLICTLGRSLTWPECVLVPFRVHDLVSYYARRISRVMRQTCETHSESAKVRTEGPKHMRFYTRTVNACIVPPIYATEFLLTGASEIDLISGVGTWPNVGGSCALKYLLVGHVGEVPFPPKREGSQISPSLLFCPLFVAARILAPHFRELETRVCLPNFNGNVSLYEITESTSEAFGDNVGEPMATYLREDTCRINNSWANSRVFSPPLDRMAVGAPFDLGVKTWDNTRSSVFGAAHVGMLAAVLNLVGRFTL

SEQ ID NO: 997368 - protein, 104 aa, Homo sapiens
MCAVTAKGASPLSCAIDKSPYSVGDKPIHSRQTPQEFSEARDNIETIMLPNMWGPFSPVSKFQTSTREGINKRGYSHVERPNFLLVSTQRVCYIYPRWCLWDNP

SEQ ID NO: 997369 - protein, 115 aa, Homo sapiens
MESQFWGRLLARCGATRGSISGTQSSVSPGQAQFRSHGGGVFTSGGFVHLGGSPYATSDLLVQFGVSCTPFGRYLCKSLSSPRLGPWSHHYWYDERPPVFSSNRKSFRTNIKFGA

SEQ ID NO: 997370 - protein, 216 aa, Homo sapiens
PNEVVEVAKRGGDNAALGSGVSQSAKALSAITMDFHASPRVVQDRVELWVRGLLLREQTVTAGSALPVQALALETIDINKDPYFMKNHLGSYECKTLPDTYTTTERELTWHIRRGKKHQTNLVPCEPAKEAKEALPKTEPEKVKGVEVKERRVNDSGRTGSNKVDDKTERLGRMGTSSTDSLFQTMTHPEITPEKGQSTSTLSSRRPVFLRLTRNK

SEQ ID NO: 997371 - protein, 118 aa, Homo sapiens
MNATYEDINGARDGRHRIREIGHDDPVQDSNQTFTQRYLQEKHGPWKRKRIRKRKENIGKKKRETVHSQDKMTRKANVNKSTKTRGTKRHQRTRRMTQRKQTDKPTQKKKAPALEAKT

SEQ ID NO: 997372 - protein, 41 aa, Homo sapiens
MALLAEHLPISKATGSLDDKRKTNGTLNPPRWGRTWLGNGV

SEQ ID NO: 997373 - protein, 141 aa, Homo sapiens
KKTAKDEEEDQTLVNLGHVYLGSAIFKRAKTCYGGQSRFLREVLPAFVSGAREYLRSDKGKESALRQDGNPESPNDIERLHRGPLRSSWGGLLHVFPSSSLGEDELRLTVYEWTRIVKATYKMASITTESGDQTIWGRNDG

SEQ ID NO: 997374 - protein, 179 aa, Homo sapiens
ALRGRVLLWLLMLQLQKSQYLHLGLGRGQYYGRVPAPNAETMHRGDGTTGPALPRPRFQILSVPGQHQPVTTLGEPMRAEWTAVYREAWPASDPHTARHPCQMDKARHGRPDSLHPLWQHQWVTVRSTANPRPGEPSHKALGRSTTGNPKVVLGTHPRDHLGKSQGKAMTLAPPTTGRP

SEQ ID NO: 997375 - protein, 89 aa, Homo sapiens
MDDLVGKLQIPEAGEGTKALCGHISKMDGQILKRYTRYTIPPEAPFRDPPGSLTHARPISTLILDTAYTQRGFGRQMTQGEVCGDINAI

SEQ ID NO: 997376 - protein, 151 aa, Homo sapiens
DDILDYWIGRVGPSQVLSPPRRRCPLEQKGCWIHRRDSWTKSANLPDTGRLIGKHVTSCGGLLAKGMVRNGGDADVSVSYVPKRGEHLSPDDSPCCVPEVHGKCACDRTRVMGTCSSMNNNILDIDMSIIEQHGDGNISRENGDAHLVRLE

SEQ ID NO: 997377 - protein, 217 aa, Homo sapiens
MDYNVEYQYSAPPAIAKPSPGGVPTCPQFHRPTPSTRVGVQDSAMLGPRCISFYYSLVGDRHADMLTVRAPWCRCPVVRLNAPCSRCPAAPVMRVRSHAFFRRRPLVRPETSTNDGSSAASPRSKLKRTSKWVCGTQCIPARTHRIADVSLHLAPKVILRGPRHDFEETMIGKQTTIVQGCERVQHQHLRIYIHGSAQTTNCTTQTKRNRQLAHSED

SEQ ID NO: 997378 - protein, 86 aa, Homo sapiens
ALPAPPAAQQGKAKAKADRGDSAVKQVQIDGLVVFTDNHHIIKKKDKELKLVSRSAFWDLVCRRVGLERLPSVLSVSPQALRGVTD

SEQ ID NO: 997379 - protein, 230 aa, Homo sapiens
RENYRVLNRLHQVQRKLARLQQERRFLMRVLDSYGDDYLGQTVHHCAEKDEGSRDTDAIHIQSNAEKNEPPEERDSVPGPEKDILKNHRNRKNQNPEVKGPRRADKEGRDAHEDETATEQGHELRSRRRATEDRVTGRRKEKTRIYGKEGGEEKPENITEEYERDNKRVTANKHMAEPLNAENSETRRPGHSEPRRHGHREALEHQPRQKKRKQGKKQRNTETKEGEKNE

SEQ ID NO: 997380 - protein, 291 aa, Homo sapiens
LSHSVLPPLRRRVSLPVSNGRRDRRLVIDNGSGIVQMLVLLGTTLTEPCFLPSVWVAPDMHGSHGGHVATKDRPTVVRLRSHEQAVAILYPERYPHVSDGYRSAELLDDDGSKIVATTTLLQASCAWPREEHPVLTDREAPALNRQGRNRRDRMTSGLCSEDLINTHRYTVTVVNPRRAACRLYSLLGSTSWHCHGPLETGVNTERCPIYEGLRPPPQAIHASWTLAWPGTLTQTTLMTESSPEQQSYQHSDNQRTEPGKFDAADINGRKLGATDRPWDIRGKEMGHRPHS

SEQ ID NO: 997381 - protein, 265 aa, Homo sapiens
MTLTVTGGRPTVLMDEHEYIFWACRGRQTLIHGNIAVKDCDFRVDRSRLVNDTGHVVGALAHSVACMMMRLIGTGGIILLNVTTYAYTIEEDVSSSLVIAVGLCLINWLVDVNHGRKGHIFLLYLVRQICGGTLWSRMRYGVTCLTTLVEQVSKMGNQMCFPVPLMAAIFKGRPKQYTDPLCWVKVSIQRKEVPIRRTERTSVYRVQRFTLEQQVYFGRPYLTTIDPTRWDEIGEHTGWTPIGNSHCPMWGNQKCRHISPIDREG

SEQ ID NO: 997382 - protein, 159 aa, Homo sapiens
MNKGTQEMTGAPIGHEDRRPKCDGANAHKSQGHEDGPVKVARNPWTFHTDVGYDRMATGTHATQFNGAKEGHKERRQVASGGKCRIKRERGWTLERTQRWGHIARSPFSDPWTGNLTREMRTEKSDAHERYDRPESYHTVKVNLWQPREHKWTKRERTM

SEQ ID NO: 997383 - protein, 157 aa, Homo sapiens
MPRGTIRSCYSAMYAGDRIEHERLAISSVNEEYTDRTIKHSHSTCQLPRFYNCFQLEVILMFYRLTSPKADQEVRCGSLSRSSRMFPSTGSRKRAGRNNLIIGMPHAWACPTRDPYPPVHSLTVGHAKTFVPVPTVIFWPVCKSRATTTVEVILHLV

SEQ ID NO: 997384 - protein, 59 aa, Homo sapiens
MAFLMLTERKILGYIQLRKGPNVEGPYGLLQDLQLDAIETLHQGALKPDRSTINLYINC

SEQ ID NO: 997385 - protein, 154 aa, Homo sapiens
MLTERKILGYIQLRKWPRTLEAPYGLLQNPFGCTPNKMSSHQGSPVITRHHRSRSPIILSSRTPYFSFFTSRSCLLIESPHPQYAQKRALVNRATLALLVYSSPHSKPKRVILKSLLIKRLSIRESSKNYGTLEFETTTCRRQDKDAREIKYFD

SEQ ID NO: 997386 - protein, 339 aa, Homo sapiens
PQPEQPCPGKELRTVNWLSYAPGVCWMLSVDCREWRAPHVFVARGESCAEFPVDTFYGVATPEESSISESCGKRYEDTCYARLAGQTMRLGKDFEHPEPSFSGPWRVPGVLLLHRSASLEHPGRTTLSTLALIIIRCAQGHFPVGGHSPSRALPPLASLHTQVGHSLISPEDDWFAHKESAHQFKIGGSRIGRNRALVTQREIARTGWTCSQAIYKEAMFGRESPGLVVPTRREKYNHHIEAVDRISPTGLMYSLIRRYIRPFWKRCTTHIGDVTMDTHVDTPPGRHPVIIIQVFTHKKRTLQRRGLKPHPPNKDDPVCDPCLVFRHHTRARQRIFHPI

SEQ ID NO: 997387 - protein, 74 aa, Homo sapiens
CLTHLSEDAVSDAMDARQRDLLTPETNYRTCTYQRWKSKSNRGRTASTELNKMCQLYPRRAQTDSKYHVGGFPG

SEQ ID NO: 997388 - protein, 39 aa, Homo sapiens
MPANGPGAGGKVVRALKAQCPGCWGVLHPRGRGPPEEPC

SEQ ID NO: 997389 - protein, 102 aa, Homo sapiens
DRSSEHVVTDAAGFPAWHAALPDIGNNIYIDSVQVVTKRIRAHNGLMTAPRTRCLLSLSEAFRFVDALHPEINVAALVDKRLSQEEKPREYVTPRPHLAYWT

SEQ ID NO: 997390 - protein, 72 aa, Homo sapiens
MSGQTWKYRGKLPLGGEHCSFCAQQAGRKTLRTLMPHPSSAQSPRTQSLRIQTELYTGGPNGPEQVPIQPGP

SEQ ID NO: 997391 - protein, 110 aa, Homo sapiens
MSNRKQAENRNNAMHCSLAILLGLYFTLLQASEYFESPMSISDGIYGSTLLVATGFHGLHVIIGLNFPHYLFHPATNISLYIQEITLASKPPPDTDIVVDVVGRISGMSP

SEQ ID NO: 997392 - protein, 150 aa, Homo sapiens
LIGALLSRLSDMVCARPLISVYSANKGDSSGQKCDFAWLYFMAPIRADIVTCVCALALQQKPTGQGADCWCSVQYSERHAGLSGVSLGGTGQTLQARIPKMCRGGGDSALWHRGAFGNDGRLWMADMYVTQARNSGRPIRSIDRCESQDS

SEQ ID NO: 997393 - protein, 393 aa, Homo sapiens
AIYELVVRLHMQAFAVPVELHPAKIDASDQQGTIASQAAQRMRRSKYRLWPDAEDPRTGNSEHVIKACSRYNRQCLKHRGYDTETSEGCGAKLYVVQAHAEGRASIDDSKITYEGRAVNELSVRIDSALHPRVYMLKHVHAWRSVRKKRPKYDQPKYDVTNNARPCRAINSWKASQESGLIEPRMTQGKFSTDPPTVVASKPPVRAVQTRLRSQSEKAMLDQEYQSTETHLACQDTVNSMHPGARMRVNIHSVLKAEALGCQLDPHNNSGRIETFRNNASLRLDRNITLRIASQHNHWIARGYQKVKAAKDTSTVRRTFRGQEGVSTDRQVDTATWVLTMFPKHAEKKRTDETRLCKNVTEVRKSETMRRRKTLSKLGGGYKDSKQWTPGTPR

SEQ ID NO: 997394 - protein, 70 aa, Homo sapiens
MAQKGPPHAGWTAGKQRREATKQQGQALAPVGFPLKGREQIWGIDKFVGQQRLAASIGLTDTRMCAIGTA

SEQ ID NO: 997395 - protein, 116 aa, Homo sapiens
MGSPGGESPWGNYGTGALVRELYGVGKMTSILGRYMSSDRRAWSTRTEFSRSRAESGGPRHLWPEKYVLTIRVGLHIETEETFHLRKRGKNQVLPILNGTCIVRAHGWMASSNYTR

SEQ ID NO: 997396 - protein, 397 aa, Homo sapiens
ARALPARSCCRGLAAGEAQSWWGRLIGLGPLPSAMTPGNIPCHGPRDGGGLEPKGPDATASFPQYTLYTYHSPLISAIVGVISGHSQTCKWNTAPRDLEDPGAPEHIVIMEHLHSARRYTVIVDKEKKKKTKTRSKVGSERAFLEETHQRTRAGTQTQNAQEATVVEPAEHRGGRQEYRNRRTRKVTSRQKPWEDKSRAHEKITPHEGTDNPQRTTNHKDEGNEHPKLQKAQTGGEKEQETSRKRGATSKSRNKTPRQGEAQQRSNHDTRRSKRGGDNNSELITKSGTHSERENTTRAQRSAEGGKNPRKRDAEKANMTNTHTQQKPHATPGDKQNKTSDEPGQENTTRRRSAKQHQNKRRQPTTNHPPAQQDSGRRIPEVATDNHHTRMIDENNEP

SEQ ID NO: 997397 - protein, 144 aa, Homo sapiens
MLQYKKLLGKDARHQDPRRPKLHLMVSEGRVFRSESLLIRRMMKLHLGNIQSLITVGCSGVQKSCAVANRSMAVAVLPCDKHVFHGSKNWQTMIEAHVDCLDYRWLLAFDRVSVVGFTIQTQTIRVRKTSYAQYQAGPPKSGRR

SEQ ID NO: 997398 - protein, 496 aa, Homo sapiens
MVAQPEWHGLECPTSTRTGSGSVATWFNQHGPVRSSRRKARASQGAPASAPEAHQKIKEYPDHGNQSVRMTLPYEITSYQTIRTRDAASTETRQGLLQYPCGTERSYKEGLRPRDNIYTAESGTRDSDHPGNQLNLDANFIPVGVEDIPPEGEYLSTATKTETGCTDMAEQNPPHGTKWYRTAAVLTQGTRALHWTTGESYKRRVLPHKSINVIRNVTPISLNTTPTKSGANIGTPRTVSRRGHDPPRRQQTNKGSENTDNTKGLMPPWEHYRQQQEKQDSCDTRHIRWSATQTAHTKGTVGNQHARKTTEEAVHNMWPNPREYPTGDKQPRELSQFIFKTTHHSAERVHNRRGRNPRRKEFPNISHIRIVGISEGQNMGKKPNNAITKRVKWTPQNRTGEHTILVTRQRDYQENIRRSNGRDKIVGSTHPRGYEDPKDSEEPPPPETEHPTTTQEEAQQITTGSERPAHQNHKDKESPQQGSQKMAHAPKQRSKG

SEQ ID NO: 997399 - protein, 203 aa, Homo sapiens
AADTCVRPAAPGTGADAEPEAMFHEKSFLVSGDNYPPPNLDIRGGPGHTSATHYVRNTLHHVGRLHNEKKMINGMKRQGKNRENNKRTKKTEEKRRSKEKEKEEKRNTKTEEKRSTTTNTETEETAATETRKKRHQKDQTQTRDKKRASRREQKEHRQENEQEREMRESDRREEKERTEEEREEKRQREKNKEEKKRKKRKKK

SEQ ID NO: 997400 - protein, 129 aa, Homo sapiens
AAVAKYRLRSNCIDSVLCALLTVVFRAFLGGPDWSPDMLWVRLSFAAGNFHASNTHLQKTGTAECPLFLTERIIWMPDTLMLILKKLGVIIEVLGECVVARVHGLKEVFKREKTMVEVILSVLRNGYVR

SEQ ID NO: 997401 - protein, 121 aa, Homo sapiens
WFQGLNQALFFKITLSLLLLKGFSLCFGPFLLFPTWAEIGLPGPRTLLAGLAPVYAIVIPTFAGVNAYVDSCGRHYSLFPRCEPRFKCLDNKYFLPVYKPWTYLLQFVREPYSSVLQVNKP

SEQ ID NO: 997402 - protein, 227 aa, Homo sapiens
ACSTHAYLRSVIILHQSIALSSRRHIVESYGLASMRSNREEAYVVGKTCAAFRHVASVAEDHYYRSKISVKEVCADCWIRTVQSALAESGVTQGFYAQHKSTRSSLCRSLVLEPGSRLRTPQSMSPGMGGRTGNLTTGGRGLSIVKTVAYCVARHGSSGPEDPVPRKAFKDASRWVYGTDGLTRDNSWTYICKCAAGSLVTRGSCALVAYKPFGTTADWDPMGNQSR

SEQ ID NO: 997403 - protein, 125 aa, Homo sapiens
MNESSSRSHAVFKHHLHPEVAMTQRPISPRTKVSKISLVDLAGMLSGLTPREPRALRLNGVGPTINKSLTRPWGKRSSPVPGLQMDSGSQEGNTVKQNMYRGLRYRAAAKKSVLHMANREKDESG

SEQ ID NO: 997404 - protein, 147 aa, Homo sapiens
MHNENSAHDEWSNERNIDWTYLDALVLGTRLTMQTERTVIIGLIAKAALAHLVPEEYSNDVSLVDSPLMGCGLTSSGQGFVGLSLSYCPTLGVPFLHSDETQTLGWGFAIQAGHYNPRMALVSRVLGYQCRQGSKSSLRETRFVRRS

SEQ ID NO: 997405 - protein, 354 aa, Homo sapiens
WLFLPAVFGPWTWTEKLRMETIHGEEAPLMIRAPCTVPFGAYCGQGEMVAGHRWLQEMQGEKLRLIFEDGLTHRLLSVRTDADILQCHRRLIKDGRKWGTERGLDTGYRNSNNLKGSSSQIEKTRMSETVLTQTYRQFTVAGAWNGAAYQMASQMDSHPDSLIQIAFKSKPKEAKIKNPSYSGKHTGPLNAVLETISHTIPKAVTRTEFPKKIWKHVNKHPPLLPSRETGYTKGRFTVTNLWTFKLDTAENGRENFGIAKCWVREAKGTDMRTTKGQGIPELAPFTSPTTQESPKGVDKASIGSTINGGTPSVEHIRYDTPEKKRQQTDKQKEEEHRRKHNDAINQEKPKSKRT

SEQ ID NO: 997406 - protein, 241 aa, Homo sapiens
MMAEVDAEEDDRDFRKFAYRGVDLDQLLDMSYEQLMLLYSARHRRRHRNLVGSLTRRASPATSPHDMKVCLVAYGQERSESGRHCEKAREVVDRLICGDMINLYPTMVCGAMVVLVSRRVRELCSQRKVWTSHTRPKKCVRETTVTPRVRSFGPTPTRIKKHAGKNGHLGAGPLVTSGGVANARSLAGVSSPLLQYVIIASSMPYSENGLVDLLNLPKEIAWKGRIEVGAIPKKVGGAGEE

SEQ ID NO: 997407 - protein, 185 aa, Homo sapiens
APAWPSLTLIVGSYVGYTFSSSKLERRPRLIATSTQTGPGTVVTTDARSPPRSCPSVRGDVLLVSCRERALVDWTAGASAPYTVSRALCASKQGEALACCARTQVAALSPCVPSPDWLTIVQTQITGNEDQEVYVVPHPGSAPVQSSGSSRLELVQASPETHRTKSPELVGTSLDDPRDCPWDGS

SEQ ID NO: 997408 - protein, 107 aa, Homo sapiens
MPSQVANQPPYQPIRLHSLANQKNATLREQKSCIKAVLTSNPATRDKGYPRARECPIGDRKHTKKVEPFFCEYQPPIVVKLDTGPTYASSESTQTVVMRFPLIVPIA

SEQ ID NO: 997409 - protein, 269 aa, Homo sapiens
MCETTNSVRRIYEYEVLRRLVRLWGVTEGLFYEGRCGANAVCSAGKGVHDGEYLGGTYPRGVVVSRRPHRKTRRENSPYYNKVCREKVLYGGGDAVVIRGEPPMWGADVYQEVNNEEDNPWGVVAAIILDTSRQDLIKRKGSSHNIRGGGTYYPMTRYTIDEAMVCCLLSEAPPALILFYTTVWATKLWVTQSYFSPHSWWVFLQQHSCYNLEIATTRCRVWRRHPASLLVYGSKPTRIDSTNQYDRRGPSPPDNVCSKEGRESTPRRR

SEQ ID NO: 997410 - protein, 85 aa, Homo sapiens
MPPQANKDPSFALRRGRAYVTHLCTYKRQNPCGTHNCRECSWNAPNAMFTLDMAGAMHNRHGGPPRAPQKPKAKHHRDNSPAGTR

SEQ ID NO: 997411 - protein, 331 aa, Homo sapiens
FAAPESYEEREISVVSEDRWIEQLLVVAENSEVQPPESRSKEYRRRNIRKKTALAYLVGSTSAIWLQMTHQTVTGHLIELVVQRYIIVCLDVFLNLQVTLIKFVLRDAMHEMEDKLLRPKAGRHSPGLDVLSCSLKTSHVAAYFQTFSDFWHPVVTPALVCLSQLLTRVPHPVPPGRGEGGLVRVLPVSWMYVALSPEVYYLSYIQFSSWDSLEHRQRPNETLSRRFPRLVHPFRALGKNSELLVVSCVERMSGTWAAGGRLSLRCASQTEGPKFDKKGKSHSDLSCLGVGLALLKALGAHCTGPCHPSKAIHGGSRTLPPGSPGGLQHRR

SEQ ID NO: 997412 - protein, 198 aa, Homo sapiens
METWRNRYSTREGKMKNYSSKHRYQQGTEPPHTCAVIRTFNIEHNLVTREERRELKDPPEDRNAGLPEMNQRKHRADTTVVWSAKNAAGARHSITVTRLTTLIADALGIRLELRRASNHGHALRFETYLKMSGQTREDHSRNSPRVVKSVYSVLLGYATRGNARCPYWGADLGTNDSRLGMTKEGYNTTLCKCRFPRV

SEQ ID NO: 997413 - protein, 286 aa, Homo sapiens
EPRLPRAGRRAWERRRLARELRRESCAASLRLFFGTAQWIPGGLSCHCLPWVPWQIAEVERACQLRGTAFRVQLAISWDAVGHQHDLCPDPAMTYKGALDWAIHWQASRPLSRLLGTLGKEHRSALRRGNYCENHSQGTMQAETDVGGGALLLIPLNACPIPALRRPEGGLDTKSHSFAPDGYQPSEETLNPTAGMGSMGSGCDDWAPRLALPGRTRYDTLEGDIATETANVGTTLTAWSDRDITCHTLGMVLLGESNLKPPDPRMRHQAGPRDTGQIGTHEKRTS

SEQ ID NO: 997414 - protein, 141 aa, Homo sapiens
MTHPGAKRDNRGPEKLAQEEIDPTEQQEGVHTRQTKKANQTKAKTVMQHHNNRRSKHTRKNSPTTNKREDHTQQKKTYKQSNKKTKNNRTQPPQRKIKNDTTKTRKQTRNARYTKEKIESTKKQTQKQATSKKGTPHKTTK

SEQ ID NO: 997415 - protein, 230 aa, Homo sapiens
MEVARVISQERQVLERQVPMVRYRLEQPWRVVAGAVQGRAQRLSPGAPGAGAGDKKEGKGNRESGATEGNFNTEKDSNQGPVKTPKERKHETCGMDTLGKTPQAQWSANVQATGTKDHPVGGTNTGEEHIKAGSFSAWNAEKKLRGLQQIETEQHGFNSRAIPKGARPKGTWSVIPVREPTVDTSFKVRETPLRVYIPPHDERILAAAWNSEERPVVEEIVGKNTRANYY

SEQ ID NO: 997416 - protein, 181 aa, Homo sapiens
REAGVEGSLQPEVKAHCPSFVSCCVPRIRALPGVASSVRNSILGFPLLCVNSSILVHRLVFHRMLAEEAQSRSRLPLLRPCTAQIMARTSVEQVSSWTMERMTDGVRQTVVGGVLGARGLLPAKRCREGPRYVSTPACSGVALTVLLQARVAPGPSVYMVGPYAASSQKLSMQWSAITVSA

SEQ ID NO: 997417 - protein, 208 aa, Homo sapiens
MIGGKKGAKKKVVDPFSNENDGYDVKAPAMCNIRNIGKDARSSGPKVTKIASDGLKGRVFRSESVLDSQNDEVAIVARIQADLLEDVQGQLDCTDLFPWHGSYPVDKNSSSMGSIYTIADENGVCDMAFKRVSEIVRKERDPGLGSTYVCPVWILVMRVCYIDKRRNNQHTVKMHLSALDTERGACISPRREMIGNHDPERCQTNDLK

SEQ ID NO: 997418 - protein, 450 aa, Homo sapiens
YSLYKVFLLVSKKRPLFGNKGKKFYEGSQIREVNNVQEHGGITDELASRDEKSISMTKYRVMSPKRERVVQSHTVQNHTQAHKCGDTKRHNSDREWRQRRAKREARQCDEQNRRRKTTVITAAETMKQSRKKQSNKARSNKNEEKRGGKRLPKKEQEPKKRGQKKEKTDAEGATSTNKRGRQSTRREKKKEGEKQREHKKTQPEQRATEKETTQGKSTTVKQERGDERRGREGGRERREEEGKRRRKREKTERARGRRKTEAELQDKKGERGQEDTHIKEKKKERERNEGSTAKRAKKTNQDTNKNERAKNMTEGNESSKRSTAKKRQATEHAQRRRARQTSGGDRSEQTADKRREEETHEKRQQVRDSRRVAEENQRRTNKEEQKNQTTNKKKRQDRHNTKNERTGKTRNTERERERTHEREPPKSSKQARTSQETTEHPATQTREPDH

SEQ ID NO: 997419 - protein, 237 aa, Homo sapiens
RLFKAQNAPSPGQSQADSSSLEQEKYLQAVVSSMPRYADASGRNTLSGFSSDPHGQSRKWGSVRTSGRSSGLGTRCGDSRTSWQRRTGHHTQDTTGAHHTKPGTFLTSADGDRPSISLGGQKHQRQGCAGQNRLQTRWELDAHRGNSRTRQVKARLQEAAERHVSQACPGCLRPKNQDSFLRLTGGLREDDPESTKLLQVSVHGGEAPESGSSEHMGHEDGLGTLTPKWDPWRRGSQ

SEQ ID NO: 997420 - protein, 36 aa, Homo sapiens
MRGFTFADTREQVLCLLVDKAVVPLFPRRFTVCRRL

SEQ ID NO: 997421 - protein, 128 aa, Homo sapiens
DEYVPRAIHGWIQNLGTMDSVTLSVRFLADDRLESMIKPFGTFGSGLVSSEQHGPKGRIHEKASESWVESLSMWMLDTERSGRAGCDCACQGFPGVDPGHMERVAQGLVEVRAASSIDSGERTREDMT

SEQ ID NO: 997422 - protein, 76 aa, Homo sapiens
MQSGRLRGVITRRANRDDLPFAQGSRHRSSLAWFQRRMTSKASGDGHWRTLTGLLCKMSPKHGRRVQGPLPTRMAH

SEQ ID NO: 997423 - protein, 410 aa, Homo sapiens
GTGAAGWSTLCAGDVGGSGGAERGRLGPHPSGRMLAGTLGPHLTTALAGPEMNCRERGPEGGPMPPLSLACRPIETPNCWRNLSHPATIHPAVRVPRQRDRTRDTSRNPTTEWAIKGIVSHKLREETVNRSTSKGSTQFGRGPPLTAGNTTELHRHWHTRSWYPRASLEQPYSRCLRLRTSEPNPLVGTFRHEAPKRWRIHRFPVESHKQSKDFRFTTTPRSKDPVLERWALHNLCDAKELLAWAGYTNAGVDLPNMHGAATHGANRRRYEVTHYGGAKVHRGTQSRVVPVGRWEDPNCHDAVDRLVALKFRRKDSDNNAPDVKALSWTEHYERRRGVQRKGESNRTHVAHTYVRTRNTYTQKREETQLDHSHTKAGTTPNQVERIQTNAKEISPQPEQQTSQPTEAAAR

SEQ ID NO: 997424 - protein, 152 aa, Homo sapiens
MWVSAGLELLTSGDPWASASQKCWDYRREPLGPAFPLSSPLLPRVDHACPGSCIWVIGSPACIMGDCEESSSPVGPWTSETWGLRPRSRLGLCQRSPKFQASSVRMVGFPDSAHAPLWTFQCRAHTDHTLSDMRETPGGTPKGPIGDNISQA

SEQ ID NO: 997425 - protein, 107 aa, Homo sapiens
MFCPGCRNALIVDEGQRCHRFACNIVPYVHNITRKGNQSEVPKKLKEVDDVIAWSSAWENGDSTAESCPNANILMLTSMQVQTRSADEPMTSFYKCCNAQCGHRWRD

SEQ ID NO: 997426 - protein, 158 aa, Homo sapiens
MIIRFRHRQAVRGKTWGRLLMAGGAFCSGPRRSGRLSVSDPRSRRTLRVARIGPAEPAVQSNCACQSDRYAMAQMYTKRSTIRVPRVKRSNPIHPEVCSFHVRFNPASRMTPLSHCISESPYNEVLYDERSRITPFELAGGGDVRRKFRVYQDNIVEP

SEQ ID NO: 997427 - protein, 421 aa, Homo sapiens
ECENDPRIDQSPCAVHPASEHTSVPAAVCFSRHTVPKIGNGVQWRMLERRDKRLDRVNGRNPQQKDPEQALLLKPCSFHSTRARDALKEAPLATVQGTKRGNPEWVTETGREAECMDHGKGKVTRAETTGRCQEIMNHGYHVNVVDRLPEKNAKLKVSCTCKGVHVCTFLDDLVQVCDNYLVLFVSKGVLSTKYASKCVVNPTLYMLHFRLVYHIGPISYVCVDDKRTMTQRTLLQLSRCRLPWWSAHKKGEDQYVVSRHNFQHNVWSHSPNKDGLCRRTCGKPGFARSKTDKPPQFSAPLYSFKSNRGECKDRAFYPRVSDGGAITSQEEINVETDGRHFPSPVSHTFVGAHITIARLVTANNTQCCWGPFYIYTHSALFWRSGTIMLRRTTSATHATVIVEEDGTLAKMVWHRDNYGQL

SEQ ID NO: 997428 - protein, 146 aa, Homo sapiens
VPLKILVSPWAAAAARCYRYCNEQALYPGESRSRDLEVVPACQKIRHFMTVGRKTGNKWMSCPLCGHMCVMMTMSSCPLKSLEAARICANNVHGKKLWQKMRFHNPGAAPTHSNVDPHQTSMSVLVLGADYGSNTGMLKVPFVKAT

SEQ ID NO: 997429 - protein, 109 aa, Homo sapiens
MAPSVKIFSKGCEKIFVRDPLPSSVREAVCLPVNPVGTAHLLLWCSPRVLHKVSLYITAGETPTVFPQALQFLLGGPQVPGPISNRLYGVLGCGKWRAQNFVSSAIEFG

SEQ ID NO: 997430 - protein, 274 aa, Homo sapiens
MTDNSAQESKDVGSDEEADEAGEGNRKNTNYASIKRMKYIDGAHKRTQEHRLFVIQNTLYVQSSRAGTYWRKFYEESVTSCTWGTRTTEGGQATLLIEGQLAHSRAIRECYLPSLGGHPRIDPFNEVSNERKNATYESRNYVMFAAAGGFIQWGSRDLVGMNVSNKPTIVNTSTLCLLPASVGLRYDLPWQGIFVLTLDLTFISRKNTLLPKEPVERETKSFMKKVHFPAYKKQFGIKSRRSDLWKGFPFPSLKRGATLRSHGEENSHQMTDVS

SEQ ID NO: 997431 - protein, 116 aa, Homo sapiens
MDARQRRVNLSPEELQERSNRYTLGAREYNGWLKGHKVLAPRIEHRVGHEFWRTANLAENSSQAWGGPSKGPAEEELNLGWYTYWRDTPVKGKEETLLTPYYKIDNKQGAVLHKGG

SEQ ID NO: 997432 - protein, 196 aa, Homo sapiens
MEGVGNKFTLQHNGPTRLTRNNTGTVGNGVARRVARTHYNDTLNTGAPSATAVITNLTGHNNCAPGPQLANAKRRTPPIQRGGNSAKTMSHSDASRYRAKTPREQIIHTPQSSPHKETPTRGTKYMATVERIKKQNDEAPKMATPDGHFACRDDRNTLRETYSRRAQPTWGRTRPSVEGTTKQRTGRPTLSYRTTI

SEQ ID NO: 997433 - protein, 370 aa, Homo sapiens
PVVSRLFGRKLYQEDVGDRSVKYVEPLIGDLRSEKMVKNIESQTRHVSIATHLTFSSVAEHHTHDRDVSLCGIWHCWFLHEDRWLSGACNGSNTTYRLSRLKSAQCRRLNEVEDDLVDAPSSSLRHHVVLYTKVGEFTVEHTYEHEKMLWVCTSGYTTIDKMEGLLTRRHEKHSVGIDWHPPIRRTEDPPLFLRGPRLDKFCFVSSWRKRKREVMGELKRLKVWVKKSTRYGAKDIGQRGENPRTCSERGTFPGDRWRIQRGNTHGRGLAGAPTGNTGQWASEAHQSGGTIPKVNTSSPGLKGEWTRGPLQGTVGTPETKTEVPRRQGKHTVWRKDTPTDGEPTRAFRQERPFCDNQRSGGEVETHAEEN

SEQ ID NO: 997434 - protein, 259 aa, Homo sapiens
MTSPRPRGGKEQSRGTSRGLQDNSDPPDPASRDPLTTVTRVTSTATYVSDLDDLLGYLGLFDIMAAHSLMRETTSRTGDRMWPPPVFPPKKRGADPKAGTPKKAFMDPPKGATPWSAFRQQRRTRAPGQSCNGKAGCQNGSVPFATRPREEGAPYTYLVRVPRAPRGHSSRTPTNGNPHSPPTKGVSQPKVHQRDRNPPLTVQRRKLPLIGLITVAPKGGYGLLKHAPNSPKKRVLCVTLKPLAIGHRFAHSNRPPHTF

SEQ ID NO: 997435 - protein, 149 aa, Homo sapiens
MACRSGPEREKWVRKTILQRESTEGAPKVHHRIASDLSFPDLMNMGLGADRSFARRRPSRLGPSLIVTSQSSRGKDVTNAFSRVVGGDLGALGSPLRGVTTGAPEIRSELDITFTTSVWGLSPQIGITREAPKKGGEYGTRGGTEGEFA

SEQ ID NO: 997436 - protein, 174 aa, Homo sapiens
LSADALCVEPLRADLEASCTPPGPPACRGYASLFVAIPMGHRKTDEEFDARWRNSSLQARLRLSHACGIAVIGINHHLLTYDMVPGAQESLHAVFCGPCYARVRDWLLLRYSSYPKGVRGQMHGPHKEIYPYVIQELRPTLTELGVSIRRNLGLDKRVHRHGMGFPKDFLTLRT

SEQ ID NO: 997437 - protein, 86 aa, Homo sapiens
LYWLLADLRSAPPLDCTRTQRDTVRDTVSMMDVMMVETEMGLSSTVILDDTAVCEHSCIACRNIQGSEYVAMSLDRERLLLSKLLD

SEQ ID NO: 997438 - protein, 204 aa, Homo sapiens
MSHECETRARPAHPVFKAFVAIVGPTSGLTGSGRVSVNVLHWRVCTVIRVAIDPVPSSHIWPPLCAEATGGTRLGKPHTVPCKVTWPFVALVLVRLIPGPRGTGIVSAPVPKKLLMMAGNDDCYTSARGLHCHPGATFAQATFDAISKNYSYLDPRTLEGRLWFTKSPYQEFTDHSSRTTTESPAGGLKVPVWLHIGFYPQKVS

SEQ ID NO: 997439 - protein, 264 aa, Homo sapiens
QRFPSPVAPRRSPSPFFMASLLCCGPKLAACRHRSISAWGYDHVDNARNDFSTIHSADVWIEVRSLSAEQRFLMNGARENDIAEPYSGDRVRRTELYISQCAATVLAVAPRDGFSLSCQGSGYKYKRQGTTLGVASVPRAALSPRSSSSPAMLTRLRAASCVTPRSLSRIPFARRRHLGAGLGFAQGCDDVNRRSRQYSGITDPVGRRAAGWGGLFQSRHNSMLRVIPGILNKRRIMHLVDNQNERKEDKNGTIREKHIREGKK

SEQ ID NO: 997440 - protein, 37 aa, Homo sapiens
MRSGYGGWGLSQAVEPAWCCLSLRAGGLFRCQAFCAH

SEQ ID NO: 997441 - protein, 94 aa, Homo sapiens
VEKPDTNREETRIQCKVDDLVCKVKKGNLKAKKPKKGKPRIASTQSGSDPLSASELGLGILADLLMYFQERSDDSKESNVRRDQLKSPKGCAET

SEQ ID NO: 997442 - protein, 260 aa, Homo sapiens
MGARRRAQSLEPWFICAPFAFFLSRLKRGLAEALNRPVGWLMGLEGLLVAGWQADTWTGFIWGGQIWPSLPDILTRTETILCPLNGCVRPGGTMTKAIHTYKHSLSPMAFTEGSSSFLGLQILCPSGHEKGVKHIFSVELIWGDYCGTHGGVRHYCTNIFLKDLSLGCHIIRLHWGTPNRGNNVGPIGATKEKTRIQGSCYKKTPNKKRTPFIPPRNGYEPTPPRLDERTEQYLHAMKDKRPPQDRNDTVEEQHHRQSVK

SEQ ID NO: 997443 - protein, 72 aa, Homo sapiens
TPRRLRSRCGLRLKLLGCAPCVSNMIERSVVEAQSRMQSVCDETIEQYQYHRSIDIPRLVYHHEKNQNFFLC

SEQ ID NO: 997444 - protein, 195 aa, Homo sapiens
MAVERSDYWRSEQNSKMCFQMYTYLYSWTTSFAGEISYMTVIGVRQLFDYRPFPVKTLDPLELEAPEIKACVYNAFGYMNVDRRVETPPVANNEHVSLSRINSTQQGNDPEQRKRPASNGLVPLMILSKSLGPVKSVHMRPTNACTRGVRNQAIKASRKEKINEKTVQTEDTKETTLVNNKNARNPIDARPEAYA

SEQ ID NO: 997445 - protein, 268 aa, Homo sapiens
SGYNVLLALHGANSILNCVQLGSHYMVAVPARMVYLTVRRFLPDLEGSGVIQIEYRGPVNTVHHMLQRMHDCYDARMNHCMCLCMCNRSNHRNATHDAWSPDASRGHVVSHEWKVCRSKMLRSHRNETMNSRWVRSVWRLAPPKQECDKVAVVVIDPVARWASMNVRPPSSGKQHLGIHGAVRMRISRSHVTLSLCSSAARSFRLVLGYTGVEGLVNDDGEYPPEGPTKHIIEIARWMYRSYPVNVTHGTAHVFLTRNTGPRIVTGKE

SEQ ID NO: 997446 - protein, 253 aa, Homo sapiens
MWNDMQAGRDAERAKELLQITLVRWIGRDLVRRRWFAGLSIVPVWIVTETTDWIALYACPALFLWLLASIRPVACLPVCQRKERPAYIAEPDSPSRARIYMGSGPMIVVPVCSIVYILEFITTCCENPLESHQVAPLALMNSTKYFAEQKSRPIEGVLDTRNGTGYRGAREVQGTWPTYLGIAWQTAEPHFRAVPLRSHVLPLARWPSLGNLVFYRKPSYPTRLEELTIGPNGHSHGPRGPSRNLDPFSPAKS

SEQ ID NO: 997447 - protein, 218 aa, Homo sapiens
ECVDLLVGPGAAQASIQEDPWNCYMCGHKGTLRADGWDERTGLPVQMSSTNNHDQELTSKGYPLSRHEKRKPIRVLSLFDGTRYQGSWCQKDLRHSGGPYISTRKVCEELPSQVGHGADTKEKDHVRVRGHVQKTSTQEAYPRGNEGPMRNLAWNMGGARYHLQIERFLPIQVKHHDTQKRAVLTDGAQDTDTTYQKYTNPDRPLPLSATRTHRKREE

SEQ ID NO: 997448 - protein, 99 aa, Homo sapiens
KWRMTPVQRGGLVGPGGPGMGNRGGFRGGFGSVHPGDRGQRTDGLSGLWAEGQGDSLEGKGRRHTELDALSPKLEPALVKVTIEDHDPLEGDISSTIIH

SEQ ID NO: 997449 - protein, 134 aa, Homo sapiens
GQPHLRDLQPRRPAEAPRAVGLIQSMATWTVRLPALRCLPPRVPSGGSVRFCMNDPRGASWLLHFAAISHFSLHLFRGSSRCSFSIRPGGMLPWGLSQGNVRVVPGPCEALDDYGVIQEKCTWRGHARGPEHQA

SEQ ID NO: 997450 - protein, 401 aa, Homo sapiens
YTHQHFRGMVLIHGKLYTLVLTRPAYAAHDKEGIPEIRWMNGESVYPSVVQTMKGSMTHLARWRLAPLFQHSLVRLPGPVLYTGELGAPTRVMVLAWILSEGQDERSAVNIVLDRSSQFPSSDTRARGEYQRVCADNLYMGWLVPSPLIITYVSSKGSAWAGPGHVDFTKSPVGLGDLELNDCPLNNLVNRPQDLLLVGIAQSASSTPPGSEPLYTMDRLGPGARPYTGANIVFPPASGVPFDGSSRGGATSDLMNLSPFAVPIIAVGAPPLLGCPCGGFEGPLCSPFVSRRHLVVTVCFRCGRGLAAFSSAPHFALFGPLESTPYLLLELPPCNPYQRFPGHFLSRTFCNPSGSLRWHFPKGLFLDLSVLPECLLRGAGGGHVVSRGRSSLWVRHSGGGG

SEQ ID NO: 997451 - protein, 180 aa, Homo sapiens
MASMVDPSAYGCKYVAPFPHHQDQDRKSRLMGLEALKSHSNGEQRLERNTMRTSLGPNGLDKMMVDKDGGCSTVNLTDEGRPISTHCIAIVDSLRIAKRDAMEHVPKLLSACVKLEMEHNTADAPAPGAWNALQKKQAQARRPNEPKNPSDQSHHKNEKYTPQDTHATKDDLSDERMDKD

SEQ ID NO: 997452 - protein, 96 aa, Homo sapiens
MGGYCTTLTGPRVAPILKFANIDDVYLRGLFTDTAIEAAKDILCSTARKFALLPVGAVWLLTRNMLLRFILHTFSEWSNTLHPVGNTHYQDISFST

SEQ ID NO: 997453 - protein, 186 aa, Homo sapiens
MNTAADIFNTVYEDYNDYGDIIKETMRKNKADRQQCSVLRPLYSVCNSFLYMNMIHDTMAYHIFREIILYNNSGHKQNYDYDERRIKTKEDIDSRKKNEENAHRHNAYTNRIGHQHTQAIITNKNALNIPDTRGEKHKSQPYTTKHETHNAFAITHMERWNITPKVQNIRLTEPKEQNRKPGTKHG

SEQ ID NO: 997454 - protein, 123 aa, Homo sapiens
ERELVSSFLGFFQAAGKNGGIQTERAYQKQPTIFQNKKKGSGVGENVASEKLPDGITHKNHSARGPSRTPKEGIFEGTIHLTTKVRHLSNVRKCEWSHIYRGAETPPLSVGSVDVEPNTSDKQ

SEQ ID NO: 997455 - protein, 226 aa, Homo sapiens
SPIICNFQTLFYLYLAVDACGLSTLRHGHPVVCVVHTGPVGARDIMQVWSPSCDDTMSCLITSMLASLTLIMQFSTTYISGYKEASWYINVDREDANIIHTDRNRGRVWDIRIEEQSLFELVASHLHSICEFHSAQHGIPPKVARTLRKKGRSFGHEIGNTTVGQRYPRLPEEARTNTNGETYLLRGPKDTRFRISHRNYRRCHRRNVNVEKEPYFDTPGNPWLRH

SEQ ID NO: 997456 - protein, 104 aa, Homo sapiens
AGDEREPDHASGFAAVRVAAGGRGRRCGSRDRRLPPRPPVDSERRCFYSDRPLHLGKRLQELPLAAPGPQLQGNRTQTCRRARDYSAKLRGPGSCPRCPEPLCE

SEQ ID NO: 997457 - protein, 411 aa, Homo sapiens
VSVAGSGGGARRSPGASTVGSASHGGRCSTMDDHRQTLSAGRCTSVSSRQDFLRITPRHAAAARSSCDAQCRAQQPAVRRRSAATVGTRLDTFTVVTTGTSLSQRITGMDPTLGTPLLAVDWRLVRLPAGWSRRTYPDWVTNQKWSDQSKFPPAVTHTTGYKSNRGHQVAPTPCACVTQSFLPEVSPELNFVIRKLHGHDRPRFMVPLVDTEHLGQYVAQWSTLHDSTAPNSRTCQVDSPHWNGDNRRHQTRGYGGTTRRPHNREWEITPRDTPGGTPERNKEAHRSSGANHRTPKQRAAMRGRRQIGNVQKRHQHRGKTNNEGLHTGYNQGDGDSTGAPSHHQKRDKQASRQNGGDQGKERDPQSATPEKGGHPGSWGENRAVGEIIEPPQSKAKRELGDNTNNTRATHR

SEQ ID NO: 997458 - protein, 125 aa, Homo sapiens
EPRVPLGRVDGPYSRRWRLESCAGRAVPRVFVSFLAPALVVSPWRLVRHRPAVYPARSRVWHSVAFACVGTSVSYVAVVSSPVHAVGIHLYLAHATVTTAGYYELGIHLAWFPGDTWSSALCGMM

SEQ ID NO: 997459 - protein, 111 aa, Homo sapiens
MKVGGGEPREEPSPEVDMSDRGISKHARMSTDLFTLCHITQLVLMRYARLTMVPAKHRRTEELGGAQTFLLTKIEELPTTDHVAFRNSNSLNLGMKQAEHFGTRLRLPASS

SEQ ID NO: 997460 - protein, 218 aa, Homo sapiens
MKCTHDCAIGAIEYPRSKNVLSCEWLPTFRHTIRLRRDTDQESDFLWLITIEAACDEDLYVTLRYSHEISEDTAQLNKLSVTHTGASMSQQVDDKMKKPDYDESLSRGNLGRLAGRGTKGNQCIVGPELFLVMCLGDVVKAASLSPLWDQVPEVPIVSRRVVMTGLPDVVMSELLGSGLTVSTELSIGTKPGTGWSTRLDRLVRPPSGERLIPFGQLD

SEQ ID NO: 997461 - protein, 121 aa, Homo sapiens
MNLENPKDSANRRIPKAYNATGNYWPQKAPQGTCKRKTGRTYAKQGALTPKTQKQAADNTHMHSADTMPQIPLYHSNHDIDRAINNKEHSRHTPPATHNKHHKRITTTATTQNPERNTRHP

SEQ ID NO: 997462 - protein, 38 aa, Homo sapiens
MEKGKFHADRGYDEYTRWNIPWWDHGPLGVGAHILLDW

SEQ ID NO: 997463 - protein, 341 aa, Homo sapiens
MAHPRELVNVLVTVRRRGRTNGLLPVVDSHMNDLQDTDRGMAFPREGGRETLLRHISRTGSGSLMSILDAQAGTWSSVLTGTFNGTTGSSCLGSYSPVSHGKQFDCIHHGSRKRNNARQFTKVVRQLELQKNPYQGAETNVANNKREDAKKVCYERFPPNGLPLNLQRRTAFYRAALSVCMTEKGGFSTIRGELDNAPEGTKDDENRYGVVIRIPVQRKTVVVTVLGERLQDAWTNFGQPRTAMMIGTSNYPKGDLVILARNGRVGTAPISLGRNEYPIARTCDSLHTDIIWIGQPYLGLGMNFKKGVDATDCYRVHYFEQGHALTKRYNPDKNDDVQVIT

SEQ ID NO: 997464 - protein, 145 aa, Homo sapiens
MGAQLHMTIAEWTPQGDWNQEDRGTMNGSPGLKLLWGGLEGAPQRHARQPSRQAKGKRSVNTRRMVNSQTGRANLGTPTGHHRPARWKSGRRDHELTGGEIGAPHNEGTTRAALSKTRKDGFKPRRRRAHEHDTTHKDHRPLEPP

SEQ ID NO: 997465 - protein, 278 aa, Homo sapiens
GEERDSAGPLNQLPRDDALHSRFTPIEQDGVLIAPKVILPACDVHYLECRATCIAECVSHQIHAWDPRWDGNTGLIVNMVEQCHIADRLSEMHVGPTNSGHAFCDGCAIRDQPDKTFGETISLDIPKGEPEWVALCIANQTFVVDTLLGLRTHGSPRTSHGLDIAFIVGREKGIRYAPTENPFDSDALYTQANRARNSPSLGAMFGDPTGFRNIEEDSALVKLSSRIDRRQNYKPGRALPQTRKRPKLGETQRGDPLEPAFLESSRKGMKSFPSAEQS

SEQ ID NO: 997466 - protein, 76 aa, Homo sapiens
SASVVQRHGALQEVLRWWKLEDERDGSMSLGDVSSAFLKTRDQRLPGLINTAVRCVVAAAHNQAYDSDCSATRQER

SEQ ID NO: 997467 - protein, 290 aa, Homo sapiens
ASRSRWAPLALPEAGPSVGDPGRVQFGISEGMPRNGRAEPGRVVAHILVRNPVPGVADGCPRGRQKDSQHFSVERYHRDPGCSPSSVFHPLPQLGHTRINLVTELNEPRLHMKIEISSLWHYKTVRWCQAIFHGGVISRHETQKTMADGNENEIWRKFNAYREKDLRTEPGDQYCTCMSMIILIDKVPRITDTAPSIIQVLDDAHGCYYTLEHLTGVDYLHSTHYAPRQLSTPWHTHSKQPKHGDNHTAPTTQTCTYQKDQHHKAKLEHKTSSTDNPQRQSPNPEHENPE

SEQ ID NO: 997468 - protein, 175 aa, Homo sapiens
MCLETLAWESVRSSLCLGYTRDTVVFASYERRSNRQDNSWMLLLLCDDLAPGLSEGIDRQSSMASYEWMNVGCMEPFVGKQWTTQVYSSPYEAKFDLLMELAPAGTKVPAPAGICNDETHFDSKLGHCVRSCTAILIGWDEEAFRCKFTVGSMPWSGSRYCNGHRLRVGPLVSIG

SEQ ID NO: 997469 - protein, 261 aa, Homo sapiens
AVSLLSLVLLSQSEPQRWVPGVVSGGCGGCCLTDGVRAVQLPVMVTWIRSAPLPVPLDDPALRNTEWPVPSERRSGRVPFLAQQGRARLLVNRRTTMAFRLSWTATPPVLKTAREKRRRGPECWLGSVVNESGVIMWADRNHVHGLLIIDEASQPLIVPTEGGGIRIRCVMETVSHTNIPGSEGVTAHEPDVKLLCCMSPSGIITLLPAKTITLEEHSQVTGNKNRLAEPCRDALVGITTCIVNLIDDKSRTPRGKLSGRT

SEQ ID NO: 997470 - protein, 114 aa, Homo sapiens
ISSLKNLWVLGKRKANFASRSNSPKPSLFSRVPLEWERFTDTLKGEMRQRKGRFRAVAPGRMKRAHNIIARKQGRTAFQDRPRGLRDTSSGTPGEDQVSQDEVVDSIKAKRRTP

SEQ ID NO: 997471 - protein, 247 aa, Homo sapiens
MDLYDLAQAAGGAIDPDVFNILVDLLNLNVPPLACLTVCSMFCVCRAEASERSPKTLRSVSLPTVEPCPRPEGETKAALPSGEHWPWRNAAGEKDPAEDARQPSANRLPKGGGSGKSPRGAASRMGQRLVVSFVPSKGYVFPPSSDNTLFVRCKRVQCQKKTYRQPHLRTQNTRGRHFMRGASKTASYNGATGSHYWIQRPHLFLKGSTHRGDPKIEGVLHSTHRASRLAFNKRNAAHYHQAGGLPM

SEQ ID NO: 997472 - protein, 197 aa, Homo sapiens
MPHMWVLALGKAGPLTLGLMLEKPKNKRLHLCLDLPAAPRGFRQGTHPSKCALCKGAVVCKSLQPSPLVDARKGKMAFSPKRCCSQRGARNGGQLPTTHEAKWPENPWGCSPFVGAQNAALTPADPQRQSWGRTQTPPCEEHSGYSVPQIHREADFPLSLWQGGPDKKAKGRVRRVVPEDQRDPENDLVEILPMDEH

SEQ ID NO: 997473 - protein, 196 aa, Homo sapiens
AVSGPCWTVDPGSGVRGGSATEAFYSPVLLSGCGLAFSLWIPVVNTLGHCELSFYHQWNLVRSGAPSRDLLRRSYPLSVKKLSRPREARVACREDWIRAVDTNTIDPKDTENSRCKTLIRVANATARMDASSHLWQTIDLVRTPGAMCATFVVRCGPTSQACVPLRILDDSNVHTEFWMCTKPLIAVSPKAHWSTL

SEQ ID NO: 997474 - protein, 241 aa, Homo sapiens
LRAEERGTCVTADAFERGRGPERLLAARVLTPARLPSGLCRRAGELRETAVDLVEDVSARQRMRGIWMSCTTQDKDSDCAEDQRDSKCKWSNGPMRKTEQTEMDLDEDKFWKRQGLEVPGTDAEFPNTELDTAMPSTRVAESYMKSKTYVKEAMGTKKRKTKKKVIRSMRIHDSIGTKKQRENMSCTKTALKGARDGENRKMHRRTPAEGNRTNLKHREGWKKELGVRTQKRTRRTTKYIH

SEQ ID NO: 997475 - protein, 325 aa, Homo sapiens
GKPSSSWFWKPRYKCVNLSDSIQSPQCTVYSLSVDPNTWQTLLHERHLRACLEHKVLQQLRSRGDNVYVVTEVLQNQKEVEVTRTHKREGSWPVFPARSHCACEGDGPGPSEPRRTTDHASPQGRTTRHFQGGPGWLLTLIETSFSSRIRSTRTFQTARDKDTKRSTSERRLATVDPLASPLMRCSTLPDQIGVPDGGGGYTERLSRAYGQRWRPSPRNLELIGTREAVPAACWRALDAGCLRDPDGPGALDEALDAGPEPLGGGGPGRSSTRDGTMNALVVRPPGHAGAGTSLINGGYMVGDTTMLTYTQNKCYRKHWTATRGA

SEQ ID NO: 997476 - protein, 249 aa, Homo sapiens
HRAMSWKVHEMLKKWVEMLKVLPSEASRFRPCHVQHLPGGCAVFMTQKERKPSPVGRQSLILGCPFLDPMHSRELLDYVITLAILSFKGEPEPFHTMTIDNLQHCSSRRCGARHAYVRWPLWTDYMSERCTKCRQRISQQIGITCLCLHSEHRQLQADMSLYSPDSTSLLKYETAITVLHVLMGKDVDVEQMDSYRRKLAKIKSKVSMKGIWLTCQSKCGKGTGNIAPDAIMEGDDITGGRHIPFGHHI

SEQ ID NO: 997477 - protein, 244 aa, Homo sapiens
GTLPSCASAGATAARRRKPKPSPGPSLRGPILPWCTLGSRSASAAGAQSCAHEPCAVEGVGVAPKGPWVFDASAGGFLPPCQLDPWAGAGPAPARELAHRHWACCCFYTGGTFVPAPAGDQLSPLLGGPGSFHGRLVAPRSYRASTQLVVRTWLRDGIWTSWAHAPLCLLLYFRFYLLHLSPISAEGEILQAGGRTPPRELDATCGGPITTAYGAQPRETRDGTQLFPSWEAYIGNNEDIPVAC

SEQ ID NO: 997478 - protein, 155 aa, Homo sapiens
DALSAPAQQAAARSADSSCCARSCLPNCIEAVVVADSVPTVQASVGCVHAGPQVRQHGTTLFTVTANAQGLAQHATDCQVEKSQSCRTQAPRDWPTEDNFLHEWPEEGVDRRKATHLSEGIRLTRHSDTGEGAGDPKYLRKRTSTQQGTPCHERV

SEQ ID NO: 997479 - protein, 717 aa, Homo sapiens
MPSDVLEVTKKYIAGPHIGFLIKTRNTLDPWTRYPPRSTLNRANRDGTWTQHGPHIPADIATATPIDPLTTGQVQSYHHTPTRWTGDGTYGPSTQKRTAEPIASSRHIQTLRIFPDTQCPLEHNNNMRHPTTTQGTNQPRTGLNFDLSTQRTQDSNPRSPIRSNPEETTQHRITNNHHNTTPPHHSTHKHPIDNQHEVENQGDNGQRQIDNSAIGAKNDTDRTKNDTSTSPYKISHKPINIWKAPNMPEPTTRNRTTKRATSTTRQFTHTHVDQRLNRRDAVRGTNTHERARKASQTPGGPIKNATATTTRGHTTTQEGTTPTLERPQQQRPTTTDPTNHREKSNKHTERTKSEDKKRSDTHVQHTPQQARTKHNNDHHTRNTTAGQTDQQHTPKPTTQSTQQQQPHNTQSHINHCKQLTHTRNIAQETRPTAIPPHANTYNSETAHNTSSYTSKTTYAIHTTITTTINPHKHINQTSINLTHTRHKTIHPDSYPKHRTTIWEKQRMESEYTHDNYCDDITTSIVSKEEQRTEPHTNKHEHTTQQTTHTQGKHTHKTRGRERKPKKHTQTHTMRDSIHGQIVQHRKEKQVTKNNRDIRPRRTTDHNNTRDTPAQQYAETHRTKSDDETSYSISTEKQEGDNATASDGDRHTETTQQHTKTNEAYTNNRGTRRTPETALSRDAECTPRTQADTKSRAGETRSHQNRHSRSNQHKIREN

SEQ ID NO: 997480 - protein, 485 aa, Homo sapiens
LPPVGSLLGRCRGMGEAECVCCAWVRRRRQGPGGECCATSPGRSETVVWSPEVECGLFHAMLGHKPVGVNRHFHMICIRDKFSQNIGRQVPSKVIWDHLSTMYDMAGAALSLRFLPFPNPGEELRPSRRRSFREVREGQHVTDQNEAQMTTQADWEGRQGGPPENRGPDQMPAPHTFERSCGRRAVRTRSSRAASQRAAQPPVQGARERLTKTSGRHADRGGATRHGRGIHAGEKRAEGTAPRRRREHAKCQERPQRGTAATARSTATAQARAGPSGRARGMLGPPLSRKEHALRPGNGVTHEAGIPSLREAWVDIEAVGRSHKKGCTERRPERRQQHMKSFTLRAPRSAGKVSMSGTQTDEPDSSYSTVGNDTAAMQTQVEHRDTGERDEHSTDEGRPPAGGDSHEGERTRTPEDEDSPRKREATPERERRARHERSRSTPDTGDPAETTRRHRRAERRATPGRAARVSEPTHRRASGGKATVG

SEQ ID NO: 997481 - protein, 139 aa, Homo sapiens
ARKPDDPESNEEEGDSSGGEDTEESDSPDSHIVTWNPSVESEEGKRECQHEMMQDGMTPGERWFDKRQGKTLVKLPETELPYHCFGSPCNPMRKLMISVVSDTNRLGKGSHAFLVLELEAGSFIECCETKPAGLRTRKA

SEQ ID NO: 997482 - protein, 81 aa, Homo sapiens
AQISDLWVLRGYVQKVGANCTDQHIRDSLASSDLRYENMSDYRSMHSLTLLSYQTLRLHSSSVLLWEGGQLWTVEDSYHHA

SEQ ID NO: 997483 - protein, 363 aa, Homo sapiens
GSTTLRAELSGAAAVWAAVCGLCCVCAWRWLAVPGRKTNSCVLGGPQPSWAPVRNPAWMLAVHGRLFSTADLLRTIEEPLHSIITQHMRCCAVVPTIPRHEFQAWTQEAFGHCMPGSLYSAKRRCLNTGTLISNASDALEQTCVTTMLVSDGQARARTVDDSLAGRNARETAPSPFQDTGIGMTTGNELVSNLGTDCPDRGHTAFLDALHYPGWGPASTIIGPAHWQWVSLLSLSPLRWLDKQGGSVLIAAHSAQDAGRQDLGLPTLPFQAWIAGRTVTAESRLKTRHRGKVYDTRAEAAHSTSSITQPCTSSDLCTVRTFAQAVVDPGAARRLVCIQQANTATLASQVYAIERFAMIATNER

SEQ ID NO: 997484 - protein, 221 aa, Homo sapiens
GDGRARASRAEGVRRLPGTGAGDPAEVHPDPRVARVTPSTVSVHGGDGAIVSSGKLELASKKARLLRCQEEPVADCDYWTEVGVLALQVCGTTSTMLGRRSGTVQGANTLWALRIWLLNGRLGSTLNSYSLSCANVALDNASGQRLNAVVGESRLRAHLKIETSWHRRIPLELLAFPSLSVFHLDGIVGPYCHANFQRWQTLCASGYWVGGDRALQATQSD

SEQ ID NO: 997485 - protein, 411 aa, Homo sapiens
MRLCAPSSALQSSSGPSFCNDRTSVDMSRSDNAASDRHLNAWRSKVIVEAVLIGPRLWFLATLGPCGQSVQTGNGDGLQYFGKPVVRRPWLGPDSLPKTATEELALASSERCDGVTKPPPFSSIWRYGVWGHPLSVRMAHWTPRHEWLGERATVTEQTGQGKIPLEMQDRFHRTSDFCNPVEGRPFQGADHIHSEDTVQNNDVSFDSEYTATLGFDQEDTSNQRAFGNTVSLAEQQNKERNEAQGNITTSRTNEGAKSDTKRTAPDGSAKPRERHTTTHDRVRLEARAQKQERARPKKVGGHNRGNEDVSQDREEDTHSEKHYQIVTNTNKKAGVEDNDNTGAAPTKTRPPANNRGRREKEVSGQKTEEKKETAQTETKWRPPGEEYETATERAGTRRVPRVTNKRRAETR

SEQ ID NO: 997486 - protein, 171 aa, Homo sapiens
KDQCTRNLGWLGPSRRTSAYVGSVVFGSRMTCRYSLHISLMASHQHSFMTTGILLEDSSLSLSNGDSWMSNHSGKSNLDPVMEVSQLIKSRVLVYGSPYVRGMWLVERVRSRSPHERCVAGGSQAKIAKVWIIHVAALHREEDSSELELNCLLCTLDQSSDEGGQYLRCAW

SEQ ID NO: 997487 - protein, 179 aa, Homo sapiens
VRNRKVVITHSFRNLMMQMKMMEEIRALPLREFDHLPEKLKNKRRSGKNAQDDSEDSEDKDVKTKKDDLTQQRIVKMKQTDHENVRQQRQAASGSNVFKRREMLMEDVGSEEEQEEEDEAAIPGERFRRAMHDSYVEDDDDGDYGSSKKDKHNNDWLSTVHPLSTNRYKHLSHPLWGVV

SEQ ID NO: 997488 - protein, 85 aa, Homo sapiens
LVLNSEVELPVEEAGSDTAKMRRPYGSFNSSECKTSTLSKTQRWSIEHTKPAIRIISELGGDLVSRSRESPESNVQCLMYFDLGR

SEQ ID NO: 997489 - protein, 108 aa, Homo sapiens
MAFLYAYRAIKFYAIYNYAEALNVVGPYGLLQPFADAYINSCTKEPRNKPADIYHHPSDITRPRDRIKLSTYSVFLLVILFDLRPRARRYSNSKNPFHGFQSPFLNRV

SEQ ID NO: 997490 - protein, 171 aa, Homo sapiens
SINSAYTTKILPPENGRRPPTPGGPLRRMCALLGFVLDLKRDFLAACASMIPVRQCFTNVYTFNSVRKSMSTVIRMPEGGFRLFSNGGPHEILLEKVQPTVLKQHTGELRWLSELGTGDDMCEDRSLESEWLAMAVTIRICSQAFTVAPFVMQGHGSPDLVSNAELMDRMA

SEQ ID NO: 997491 - protein, 110 aa, Homo sapiens
MTPVRTWVARGALRGPGMGYRSGFRVSLTAIGSTGARGYARAMEPEVHVATRPSETCDESECDAMRVKSVVLSDMQRRAALVNCTLHCMQRFHWRGKFYVLRYSPDAIYH

SEQ ID NO: 997492 - protein, 108 aa, Homo sapiens
VRRLPGTGAGNPAEVQPEPKSQSDPVDHVSAWGRWSQPAISVSGSTLKTALQYARESLVLTFTLARVWLSGPSRWLGRVPRVQTLAVPLSGTLWPDIYLPCYWVHCIL

SEQ ID NO: 997493 - protein, 378 aa, Homo sapiens
LGERGSSDAVSVWARAELAADTWCADEPSSRRSPEHGSVRDGGALSWRRCCTMFSGIRAAVQSAAWRSSSTTPADSSTEILQATAKMLNYQGHFTLVMTQCCKTNKRILYKNWPPTTKTSTDSVISRYGKAIDKNVDSDISSVGIDGMLAGRQPNGFSMKVRGWSTSFRPGIARMWHDGASDQELWIYTVRAQDQKDTIMMELTTRILDGIQSVQSHEETMTTERRPASRSKHHAETSDLIAPPSKAEHPYGNTPGQPPERENKNDGKRTKRTSRTAATTTRQQTATLHKKQMRQEKDERRDEQRTKNNTILTRHAHYKRGVGDSAATTRGKYPCEKQTETIRPHSINATKMGYNQTHIGTDHHPQEARNQIPRQDHT

SEQ ID NO: 997494 - protein, 115 aa, Homo sapiens
WKHSLCHPRPECRGVISAHCNLCLPGSSDSVCLSLFRSCAWDYELHQPPVLNFFLFFFGRRGVPHNLLCPEAVEVLPRGVLNSSGLSTVQHPSVPSLEVLKKNLLACAYKHLPEV

SEQ ID NO: 997495 - protein, 211 aa, Homo sapiens
MATGPHTRWWRRGRRTEKVNAQAGARYTTLSHRGPDRRRAPRGGKGIATGKEGSTRDANGRYIERTRRAFEDDDPKRERGKNGRGNPVTSMESAPSAECGRRESRYATGEHRGVEQPHKYKRGRAAGARERQRTREVVDRRRGVMRAGNTEARGNATEKLAPKRTERLLSQWVNTGEVERRKVPTPSEADPKRGQTHTSPEPGRKNTYIGT

SEQ ID NO: 997496 - protein, 180 aa, Homo sapiens
VEVTSSLTPACQSLMHRRDAQVRQVDLEANYFLKIMQLLDDYPEMSHLWEQTHVGSKQMRRSGMSLRGKASGADGQGTTMMRQGPSEGTWKTTQLWRNCCLIIRRNVGLRSPEEDPLAEIREHCCWPIRCHTVCPSAVCHLAHVNVSLCQPRTLVSGPEKTSFIPGFRVSTLKSPGDHHL

SEQ ID NO: 997497 - protein, 179 aa, Homo sapiens
GSEVPYHLDWPGAKLVAVCAENELSWTAIWTLCLDQCPPPPPTETPYYPQSSYQIQDSDEDVRSRVRHYIRRMIKSGGRALQHEPWKKLIVMMTLKRLHKKPCPERHQKIGSKRRQVGPQQPVAPASRKDTPKKRASPAQGGDTAAEEGRARHGKRRKSERGKERCEKEEESQGEEEAG

SEQ ID NO: 997498 - protein, 156 aa, Homo sapiens
TSAFEGAAPVLLRAPLPCPDVTHPRSGSADILMLKEQNRLLTQEVTEKSERITHAGAGRSQGSSLKQRVNECPPALSQQDGETSWIPHFIKSLVDRSEDHQGQPGTQPFEEWAPQSEPHHSPGLETTAAGDRATVPASGAAFPCTTLAQNRATTKG

SEQ ID NO: 997499 - protein, 146 aa, Homo sapiens
ILDELESMPLKMANSMLDFEHKDTAAIRELIVSHCMAQYDLVLAASRCIGEGGSGQCLRIGSDPIAFNYRNSSKVDATGAAQEGILVVESEYLSNRLYMVNDITEGVTLPGARSLMFGLSLNHLKRKGELFRGIEFWQSMEFAYTQ

SEQ ID NO: 997500 - protein, 195 aa, Homo sapiens
MVGGNPETHQPQNTAAHRGDHKRKTNIPSKSVKKHHVQQHHYTLDGKHTSPRTHAGQERLTQRGSIYHEERRRHNQRKQQYGAERITKLHIIKSERKKGAQRELCATKQQRTTTPHEKGAQTPLSEKHTRSEKHKEEYGRQTTNALSHRDTQHATPTQLIPDPTRLATDRTHQENTQQTARGTPEEKRSTPPPRH

SEQ ID NO: 997501 - protein, 312 aa, Homo sapiens
AQSRCVLLWGLLVHEVMLTPGCPVSCTKDAQTLGVVNDRLEATSASDRAGRCLLQPMEMPVVKRPASRISRLDAVLSLTYDVATTSTVRSSQPKKAETARSGANDSEIGALGRPEIIGFLGTDWSDRTSISRHDERVRQRSLNSSRIKPLGTQSDVKGYPMTGKAKRRNAGITTHRKPARIGNPKSNPQRPQPRGTPQTGPETGCVEALAHNAVSNNIGNHNVRSTLSLIPDPSKFMEHKTLLSHGHQEGKGLWDPFRCAFEATQFEEEIIRGKQPTLGNKPMSWAQCDNPNKFNTWERTYTWGPEAKRYPS

SEQ ID NO: 997502 - protein, 239 aa, Homo sapiens
AFEVKQTLVVAMGIAGSDVSKKLLSMILLDDNLASIVTWSESEGRLMFDNLKKSYCLYQLTSNMPEDHPSSVIFHLLQTFHYHLGTVTILCIDLGTVHGFLADHPVAYEQAESDIMKRQARNPKTDTTLNERLISMAYGQIENDPGPVEASYTYFVILAENGFLPIHLIGPPEMDWDDRWINLMWKHSYGQTRGTYEQSDIVEFTCHTAFFRQYRGAVQLSRLATSVRPGGTPDVPATR

SEQ ID NO: 997503 - protein, 267 aa, Homo sapiens
RRPEKWRTFKLTLPTKRQAGPFFKTRERGVLAGEEIGQGKKSPEGHYKELRSLGSYKDNPKEALMWRATYTIVKQRKMCPFTAWYKVVSHNLGGAESPLFCGAVVCNTKEYEKKFCPKKREPMCVLDTPRAREENIISVEHTYRFRSAEKVLHQQRRDILREEKKSGTHNKRKTADVVLSSGAYKHTPVVFSPPPADDATSYGGGGQAELLRKKNLREWLNTQILAGANNQEDGWRQTPEKRCGTAGRATYFLLEASARKRTQQKDV

SEQ ID NO: 997504 - protein, 144 aa, Homo sapiens
MLQRGPGLRVTDIDELDMLAPVERSDDLSPRRPCFLGRGAWFPRVERLGNQTRSMLKQQAPWSTLHNLLAMGNIANSQQRTWDLKTKACRGLPKGLLIAKMAFASAPVPCGLVASLDSPLLLDVVGKTRSAPLKSQEIPRRVYT

SEQ ID NO: 997505 - protein, 214 aa, Homo sapiens
LSICAPRSKVAITVPAPQFGHHRHPRVWRVGASSDEESGGINLSTIQTFQTRTNVSRTSEQSILHPPAVDPLAKWSSGSGVPVMGSEMPVEPTQLTQRVPIQGHPLAPSAPIKQTQHFILVRTCAMLGIDRSIARVDSKNGQSTLKAKSVHFGALGVVCHWQRNQDGIPRQGTTHDKHVKVPPPRSKMDLGTYRTGPRIKITTEDQKITEEESK

SEQ ID NO: 997506 - protein, 123 aa, Homo sapiens
MAEPSGASSDPIPSPRRPSEPSRPGPSERQGCPESPDPDTVRRPKSVLQGSILVAGNNESETISGEDVNEDWVIVFGDTPTGIMHALSHGLASQADQSRDRINMKRSIHGSPYRQIVVNQINA

SEQ ID NO: 997507 - protein, 205 aa, Homo sapiens
PRENRARCIRLGVARGDGRFLGRAGPSVPLDFVELILGSGDTLRVHEDRAAAMRVTIIGRRWPWIAAPHPKPLDTPDCQGSTLDLCLTGPESVILSALADRREGPENYSSRTWDGRSEFGRYLEGTGGGRIACCLASDLARRSHWSKSTCMKRAGRLPRISLVIRPKAGTLGFMLVPCHKRGGQAPGGKQWIALGIAHPRGMCKD

SEQ ID NO: 997508 - protein, 184 aa, Homo sapiens
MPGVLACGPGELPIGAGTKARPPGASSAALSLGRTAGAQHRATPTAIDMMFPQSRHSGLLDTYPSNSNSPPRTPAIALKDEFPATAMLSTTASSSNVTSWPVQHSQRLQRHLCSTLYLRACPTGFEHRRCTNRLKIRQNGLNRGIWMPKGPSLNLLPRRHQQQSLEETHGRGPKYKGNTIPPKL

SEQ ID NO: 997509 - protein, 254 aa, Homo sapiens
MDLPGDSSPSVPAASVPPASDSSIYGEPWSPKRPRLCSSRGSHSSRWSKASRRVLAVVLERCHGVYTLVPVVPSHAGPPYHRHQRYHQDPVHRQATASPPRQGRVVLAGQVSMAGWGYSRRAQVSHLNLPVNIARASRTSVKCQRALEAESSGPSSTLRRGTRTTLGQKEGPFTKGGPGATQIQPWVVMLGRHRQVHRTPSSVEAFIGVANPAKFTSIARYTEVEAHERIYEAQNNCIQHGRPYGTTIQAKFAS

SEQ ID NO: 997510 - protein, 111 aa, Homo sapiens
HIDLPCTVTAGTDLEGTAVWATYTHDIWGVSSRAERAQYPTFDTQGLREARRTIVRITRDHCEDNARVTTRHRLNKSYRPSELLVSLVHRGFSVPCRPKHIVSARQSLHLR

SEQ ID NO: 997511 - protein, 103 aa, Homo sapiens
MGALLTSNRALGETLGISKAQERQRRPLEVPRRGGTERAPKGKCRGADVTIPHRVEPGRHARGKSYIRHKIRSWNPQLGQTLKGGKVITSPKKTQQNTTRRRE

SEQ ID NO: 997512 - protein, 133 aa, Homo sapiens
GPYVPVGWPGWPDDVIWERRLAAAAAVCLQLAANRDGVLALWTACAGSRRTESDVCACSKTPAGDHVRAHALRSGPVWSKDGEEEQAQPPVKTTMPHRESTSEPTREVDTWTETHSTERDTQETGHHQETSDH

SEQ ID NO: 997513 - protein, 132 aa, Homo sapiens
LACAETQSLEQLRQAPFADCSSVCAAACISAVRSQCEIVVSYRAGRQCSVSVAAAKTSKHDPARLEIEAENHYWLSMPYMTREQELRLRRLVLQEGGLRGLTQACAHFQVPPVIDSLAGRSSSISNVTMKWS

SEQ ID NO: 997514 - protein, 103 aa, Homo sapiens
MSKLVNMQLAGNRGECCDLGRSATGQDMGPRPYSAGGRITDMIAVTTGLAHGASAEPTYGLLHVVGSPFAAWRPIREFHDVTPRACLVGYLLTESMHGPLVNF

SEQ ID NO: 997515 - protein, 238 aa, Homo sapiens
EYFSDEQMRFRAPQLYEQYIGQYLIQEELSAPPQNPPDQPSHGSHRRRPCVAQHHQTLTSTAVPYRRKPRETTQHTRLCCRDTHTGQARAGTEPCLSDSAHDGQHSASEATTRSNPPTRRHPTQSDNRHDTNPQQRRHIADTTPRRIQRKGENRNNDRQHSVKDMNAATEKTRNEESTQDTAEHTHQQGPTQTHSKEPTEPDSSRRRPQRPNTPQARGTGTPRKGQTQRTETTQRTRT

SEQ ID NO: 997516 - protein, 154 aa, Homo sapiens
MAVLTREQTCVAMGQQNCAEQMIELLTVDFLELHDGVLVFDRVSVVWILTNKMADTSGYRTDSLIASVTKQGTAQKSRNERMMRNHDDREVQTECTCNEVVHEIELPVQQLEQDIRKRLVRSIYPLHDVFVENKYYLLQEAPSLNSERRSMELH

SEQ ID NO: 997517 - protein, 349 aa, Homo sapiens
MSKGPAVGIDLGNTYSCVGVSSTEKSTDHCHMIRETDTSPSYVPFTDTERLIGDAATGIKVASEPQQHTVYDANKSDWTPAFRCMHEVQICICNNIGPVMVVHMHGWPGTDGPQVSNTTGEEDPKSVHHPRRQDVIAVHGVTVDTHRTDRGQTTHREDPNTLGNRTWCNPSAKWVPQEGPAVNHERCNSSSRSGDITQSRMPGNTVIQHRGNSQRGYTIQGTIEAEDRKEHKTRRWQMPIKGNKLTGDKGQTKTTEDKGKSQETKANTRVDDHNQLRTPQHNDEGTNTQTRQWNEHHTNTVHQRKERRSHGENEPNKERGHPRATHQGQGNETNNTTPLGTTKQTRSNT

SEQ ID NO: 997518 - protein, 91 aa, Homo sapiens
MGSRRTKNQLLDKRSAQKTTQAELDTKDQPPNHRTKPPRNGEKPPQTQKKRHTKKKTDQPTRGSRSTHNTEPTHTQKQKRSNTDEETMKNK

SEQ ID NO: 997519 - protein, 317 aa, Homo sapiens
MREIRALQAGQCGNRIGTPSFGEVIMTMSTVRSDPTGTYHGDMELASWNRINVYYNECHQRGKYVAPCRASWNLEPGSHGHPVRSGPYRADLPGRTHFVYGQSGAGEQSGPRVTTTEGAQLVDSVLDVVTKGVLRAVNCLRGFASVTQYPAVGGTGSAMGTLPHTERSERSTQSRIMSNVNVWVPTAHKCQTQWWSPTMAALLESDQLVARHKTKTLLELMTKSLRALLQKPKGEQDQPMVTCTTWCSCYHEWGTTCCASRHFNADLVESWLETWPVSPDGLRIARVCPINYAGKTADGGYRPRSPEIVCKNCGSEP

SEQ ID NO: 997520 - protein, 180 aa, Homo sapiens
MSIRKHPEIPVAHGYGRDWFAWLLSDTCLNDSDSVGGANAEGFTHGATARNEKGIHILMSWPNRASPQVGVCLPLVDAAPWYHTTRGMKSSKNARHRDKAQTKIQREKKAQNEKTKSSSHQQDTQERRRRRERDMGRPHRKRPRGPPQEDRRKTLRELPTRNRADDDKTMTGSTDRESPK

SEQ ID NO: 997521 - protein, 101 aa, Homo sapiens
SKASRAGGSLAADRTSCSQRACALARRSQLLALACCPSLACRAFARLSSRIEGKSDQRSVAREGENRRAAWDQVKRGCSGGSRKMSARTSNRSKVSLRTWS

SEQ ID NO: 997522 - protein, 222 aa, Homo sapiens
MAAETLYTYPENWRAFKLLIAAQYSGAQVRVLSEPPTIHFGKPSRTLNLSQIACRKVPALEGDDGFCVFDEQRHCLLCEQCSELRGSTPEAADPRWCSAVSFADSDIVPPAQYTGGCSPHLGIMQPNKQATENAKDGSERGILRCCWQCITLKEQRDLDLVGRHRDDICGWTTPQACFDTPMLGEPRIKARVTYERHLLTQELAVPQYQRRWYHSTMTYNRA

SEQ ID NO: 997523 - protein, 224 aa, Homo sapiens
MESYHKPDQQKLQALTGHRSNRLRTHAPSKANTCGWASGHHHDHACSAARIIGCPSFSNTMRYKSQRPRNPHNDRICASPRAMQLPSSTRSGLKREFPGRSADACLNPCRHRFRFLTLEPWHPVSRKQAFHQTLGTGSLGPGPRGRIVAMAYTGKYFDKDSYRVYCLLRHRTAVRGLLYCGGHCAFDQHLSRWTNLVAHTYDTFNPPLCEPHRTGGNPRGPPTP

SEQ ID NO: 997524 - protein, 117 aa, Homo sapiens
MYVRQEDSLRHVYTLADLALKSLDCWPEWRGMVMAVKYVPGTPGTGLHLDLSHTMVLEEAQSHTTVDVIACQDKESLSPRHALGMGMKPPVPNGRTSYPSTIGDQMDPIHIPRKRMT

SEQ ID NO: 997525 - protein, 264 aa, Homo sapiens
MEFYEDFTEHNEGIPTTEIKYQPKNGMRTQQATLRGQHKRPRGPRKTKRRSKTRENNAQLQGSEDVEQRPPNRETRGNKKHSKKEEKHPDGGYYRNTTAQRNIKGDTQKLARKKLRTPNRRQHPRERTPTSNEWQTQREHGETTKAKQQKQPNGNNYTTHRNYENTIPRREQNTERERPTQDQQPNLEEPATHSTEGSTQERDRGESIETTSKTEEGIDTHRETATPNRTTDTHKEDESATTNSIQPPAESHRRYKKCVNIEDE

SEQ ID NO: 997526 - protein, 113 aa, Homo sapiens
MKHKVAGRYKYHIPFPTRDCEYGINVLAITKVVYSPITNILHQFLSRDLGMLTYCIESFNFILTRHVIENALPSQEMVHRAGPGCMWLPRRVNPEHVLGTGRGNVDHVEVTEF

SEQ ID NO: 997527 - protein, 374 aa, Homo sapiens
MVIGGAVELSSHEGGELASRLGNGINGSGFRVLRKSEDTGRLDGVEAVSKVKPGSEREAGIADDWRSSESLQDSGLGLESPEAKATKFGLWESNLLDEKHGRSPLFRKSGKLSHKVWAWDSIWGDNSIAGTRGLDVKEADDYSDLDGTWVETKVREGGTQEKSLVEAGTPKAKGEAHSQEDRSFVQTQREEEDTMDLNASDFKLVGAILPQEVFGLWLAKQEELMARVYPSHGTKLRKRGRSVCHIGQEKRLKKRAWLLAILSGGLQRYVTHNPGSDFPQGLHPIQHWTTGIRCADAGLPSPMRTLVRDLPQWMLQVCHSHMWAPNVARHVVQPLYREAKKGSPRGSRFHKCVGGSRWKGRELCSKREHHEGPL

SEQ ID NO: 997528 - protein, 116 aa, Homo sapiens
VQSTAAAHDRTYRRFLLSSLSEVRGPSGIKSLPITQCSQLEFLLTITGLLLDSGCRSEVRITKLRPCNVWSLQLDTCPWIMEEQPPGILSLAIDPGPIAIGAKLTTEYSQVLYDMP

SEQ ID NO: 997529 - protein, 134 aa, Homo sapiens
SLFTPAGPCLSQSLLTEPDQVRKLFIGGLSFETAECRSLKDDHFDQVGEQLIGRRAGHVEIRNDRIASQGLMGVCAAQVMRTRGRQVRCELMDIVRPTTQVGWQRDMCESQMEKLSPKQEEYLQEIQGALTCNV

SEQ ID NO: 997530 - protein, 128 aa, Homo sapiens
ENDARSELLGQYSACWVGRLYRRATEFPRLLGGAPPILSVLHGTGPSFFYLTAPVFCRLLSLSRWADSRPSSSWLPIEGSRNECFRLFRDEPDYDASLSQKKCVSIAFKELDYIILSSLIVLALTIRA

SEQ ID NO: 997531 - protein, 115 aa, Homo sapiens
MRIKGIRLCLKFAGAFSLGKSVLDSRLGTALATKSEGPKAQTGPVCLALFEGTLDASSRLLAQVHPSRTRIVCQSPGTPVHGDITARLNLLDPLYSVQGLPSVALYKLGSEGIES

SEQ ID NO: 997532 - protein, 448 aa, Homo sapiens
PLEPPRGLYLKGCQKPPSQNRPKGGRPEGSRTIYSSPYPSGGKKEGCRGTVRGACRGGRERGSQTTMAQWSEASGKKRAKAVGASSREIHVEGGRTDSHTVKRGENKTPLLHDATTAEAAWELYDTDTQQHHMHAMTDTLMGDNRGGSPPGEHNKHTQLERQTLPCANRLRPGHTQNHREEAPKCETRASSIENQASPEKRGHNKLPPRIPYHEKWLERPPHTTCEREEHAKTKGGKLPTDEHTLATTRQRGGPPTPKFVPSVRGQKGDKRDIKHHSEKGPNPKKWTTTKGATTQTAPTPEKRREKTATQQDQHRRHHEARSEPQTGNKYMINGTTKNNLMTPHDQKSGGDTNQTMGEEGHKKDSTQEWPTGQNTPPPPQEQRRQVNNKQTPRTTDATTPHEARQKKTTYHHKTAHPMKNNKLQGQPTTQKERRHNHSDPPPTTQQPQ

SEQ ID NO: 997533 - protein, 147 aa, Homo sapiens
MIQGITVTDSKTSVDRLSVHLKRDDSRDCLQYDIKIADVTSIEHRFFDANTSELDRTSSSDCCLLQLLILKHIEPVYWLSDTDYWTVPQRIHTVEVPRREEPKKPSVSERQDDHSIGFVTKRMKDHIRRHAIPMGNDMYTKVLMDQQ

SEQ ID NO: 997534 - protein, 91 aa, Homo sapiens
ANNSPALTGNSQPVAPGGMQLRLSNSSSACGVLALPSLCGLRVKHGQCAPALVATEKTMNLNPMILFKILSSPYFKSYSVYELKTYHEVVD

SEQ ID NO: 997535 - protein, 254 aa, Homo sapiens
MSSNVPPITIVRTSTQDSFSDVLAAMLRKHGALVTSRTGGLAGPLWWVGRLFLMGKTGVVPGPGCGHVAPYVKTRSLDALRFLAALVRNRASQFMQSIDARRCRSETRARMSKGRCPRNRGSQFKGGRSPRATHKGPRLRTFAYGDPFVCRERGSNGRPSRLTPSAELYDIRQEAHLVPLEWGYIGPQITFALVEAAREHPFIEWGKVAPCFGHPLVRPLEVPAILERCELPEFHNRQGEVLVPAPTLVLNRGE

SEQ ID NO: 997536 - protein, 103 aa, Homo sapiens
MQIKQLHLDHKRDHLPTPYKHTQPYHHSHDLHHHQNTTAHKHNNKYNHTPHHNKTQQDLDPNTKRYTHTHKHHNDTNVTKHKSKSTHYQNNTTNLTHHNIDTS

SEQ ID NO: 997537 - protein, 102 aa, Homo sapiens
MGFAARDDRQGFPCVSVHAEGPLKDPVVPGAETPDVEMPARVTLYPPRNSGRPTEGALGTYGISFAVSFSLIIQGWREFYITDYMSILKKSYKTWGVYTHSS

SEQ ID NO: 997538 - protein, 233 aa, Homo sapiens
MCMADVAGNGSSCVTASEFYQLTYRGGPAMVPQTIRKTVPVSLVRREFHAGMYVSTGAHVVGGCMTRCGEHEQTKVLRPSAFSHSGIPGIASVLQGLNCEGSGSKRGLTQSSADCTERRRQCCTVLTWRLHPRSSQVQRRNDVDYLLGLEADGTMVASTTPSIRADHLAVIQPQNSIRPLLVHACGKERPYERVLARWVTEDQPESRGNLKPKSRDISILHRGCGSPSASRMW

SEQ ID NO: 997539 - protein, 249 aa, Homo sapiens
MAKKSAENGIYSVSGDEKKGPLICCPGPCLGPLANGADWPLCGLGDTLAACLACALLRETLDAARWTSSLSCCGASAVRLRATVVAPSPYPCAYKNRAEGVGSYIPYVPGSPWFGGIPFLLRRSRLGPVHRRPCSIKCLGTSCPLFKGLGYASQMVIVFYCNTYYIMVLAWGFYYLVKSFNSTLPWATIVATPGTIPECVGDPSSHERLVANCHALGQTFTVLTSFVDRGSLVIAILAAHKAEGLPGEL

SEQ ID NO: 997540 - protein, 197 aa, Homo sapiens
GDLVLVLMHVLNGSLIVDEIMHQFLTSWFMMLWLGESREYEMCLYEESIERKRRGLVEETGVVVEMACWLWTSQDKHTSQQSSAISARHIPTRQQDRNALPHCEMANGAGDLRRRIEQNGSKGATTQKTYQRGEEQRLTQGEPNPLMKHSEVRRHCWKQGEQEPHTPKADEPKSASQHAKPTQKRKTRQETKRRTTL

SEQ ID NO: 997541 - protein, 104 aa, Homo sapiens
ESGCAALVAPQSGIGPCRWISTPRYRPRVQAHEVEGRNLRNGELTIRSSASQRSNIRSFSGHDAKRGQGPSTVCRHDDTLSRGPGHMARLSNCWEGGRTRNGEL

SEQ ID NO: 997542 - protein, 63 aa, Homo sapiens
MQASSVSGTVLEPSLISDADHKRPTLMDTDPVAQHALARTLWNLSSRPLDRPGGTWVHGTKLL

SEQ ID NO: 997543 - protein, 115 aa, Homo sapiens
MANRAFKAEFRPFGFILYSLLRRSPRVSFATLRWQRPLTKSLTDARPLDVAAGAKLYPHLAISFRDDYQVQGQGRDQNYGLRRLFNPLKAPTSEDAPLGCQQPIEKPPNFQLGPR

SEQ ID NO: 997544 - protein, 72 aa, Homo sapiens
WDRGNRASPMSGQRGLRCSALRPSTTSDTPQGGSQLGHCISENEGGAHGYVNTLAVAFRIEGEGHGSIASRG

SEQ ID NO: 997545 - protein, 344 aa, Homo sapiens
PEHVDAPTHQRDVLMERGNIMADVAVHFSREEWQCLDPGPVGPLYEWTRECLGATHRVTLMARNLDYDVLRVYCKACMSRVYCEHVQQRENQPMWDPRTCKRQHDGGPGARAKGTHPKNRFLTIYGPLQDLTSRAVLAGHWTILKHSESICATRRVTKFSPTEDLFASKSRALLRDRPSCPRVLDSVLRFMTNGQSWVQGSPVDVEKVDQGPFLHVLQEQLQTWLGHHGRGSTMEWAIPKWNPFSNRHGNTSHTPQVGNSYMGTALRAQTAIRAPHGEHSGSRRLLLVGHLGSKRSCSECASDEDETQCVSQTLRLIATRQVSVTHQVTHYSIAVASISTSGLA

SEQ ID NO: 997546 - protein, 500 aa, Homo sapiens
GFESDRLVCDQGFVTTQVTSKAYARSDEIPQVIPASFRQSNGYVVLNRTDDESTTLKRVLIVDVNPFRSCISTINHGACTQYGSGPLPGTTHDLACLYFRRVFVHPCVRYAKSSLACTLFCAGDPICEPPQDVLFGLLSEEGLASVVAPLAFVQSFDPLRTHPGTRIGYEVALGEAKRISEAPVSCKIAYLFVNASFRARRWRDGDEARKGSPLSKGPALRKAYWGTPFHIAWAPPADRKPQGGYDHCPLTRERNLLYCMSICLAQKGWVRLPPVIPDLLYVTHCPFPIALALAVASPGFFPHCLALPTRPHGGISDGDGSGSLGLTTPFPIADCPLASCDRTKFAPYKRCPPRGARLRTLEMHTGRRLGGSAEEAKRRCQGFGVGANHRPCAKAALNATCCTTAIGARAIFFLPQHGVDPLESLLGPHHRTFLGPIRRLVFDTPTSHFGVGGIPEGKDWPRASILHRGSCAVDACVPGEQRASYIAGADTLRVRCAQAQ

SEQ ID NO: 997547 - protein, 75 aa, Homo sapiens
MCSLGCAQILVNLFYTPGREIVLPGIQPGYSWERIWEEAPRGRGRQKSQGACAEGGSRGGPARLRGIGGPPGNSA

SEQ ID NO: 997548 - protein, 249 aa, Homo sapiens
MATSRYEPVAEIGVGAYGTVYKARDPHSGHFGGPQELLKVPQVEEQEVEEAFPFSTVSVRVAYTCGDVEALEHPKCLLRLNGRLVPNSRTDRENSGVTRGCLSLLDQDLGTFSGQGTPTRFASRNDQGSDAPVSKRPRFPSCQFALVHRDLKPRELSGDKVVDQSSWLTLGLARIYSYQLALTPRGCTHSGYQRSRSSSGVHFLHPCGHCAVSAVSWRRCFVEGPLFCGTSEPTSGANLDLIGCSEDHA

SEQ ID NO: 997549 - protein, 282 aa, Homo sapiens
LVFSNSDHLAAEECYERSTARIEPDGPPAQVPLIAWNMGAVAPVVQTGPGSSMDAVDADSCARGEGRVHGRNGLRTTRVIVCVVRVIVGCSLSCFFLRTRRPLTTRKLVTSSVPWRAPDEACCRDEYILLTWVDRPSYAVSWYIAVPWHAQESLGRLSDRVTVIVLTCRTTVHGVVNRGHLQWSPIIAAQGMRGPEQETTEQSGKPIMSSADALLDLIRNMFPGQPSRSQIQTSTEARTIPVVKSAQWWHHEEAPSIVRDPQIYVGPVRRHGSHVQNFDLEL

SEQ ID NO: 997550 - protein, 66 aa, Homo sapiens
QISTLLEYSFNHTISLQYRMGVLDSCTCAMETYQYTVMLRCMVRCAIIFDGDPQIGRRRAIRRVIA

SEQ ID NO: 997551 - protein, 254 aa, Homo sapiens
SKPKLSATESRDHPVRVVIKQNDSEILQSTSAQNGSDSAAQMELLQLHGFSIDSGKNNQGTVGRPCRASRTISSISLYALRNTKPGEARMKAKRCEEKVAMDVESNEGCNGNTPCVIRKIRTNQSEQDTSTHNYSTGTAEVKQTPMTKNQHGTKKQRGDINPVIQGKNYTEPSCIGSEECAKTWQLHNVKFANPKRSENSTSKEDNLEIAHERITETAGTPLENGEANGTRRNKREAKEDEDWAPEGHTPETDD

SEQ ID NO: 997552 - protein, 124 aa, Homo sapiens
MCGGCAQPPSDVGPVGRAPFRESCLTRVSPRTRVCEVRVCSHSPRGSQRVPLSFLIPIFPSASHSVVGTYVGGTPSVSRVLCGSLVAPTRLGGTSLTGAFPAILWGSLWSGPPLVWVPVYLGVT

SEQ ID NO: 997553 - protein, 479 aa, Homo sapiens
KRFHCDVGPYRPLIDIRRSVSLRSQASSTHGHQPVAPNVLTLGYGQRELVLTRWSRVRRYRVGGLVGQLQKAHFQYGPLATWSIRNLRCMKTAHESERSWSCQDHIMFCSSCLVDRGTSYMDGFTSGFRPVGSLFCIGEVSGAVGSRFIDLICAPKPWFLIESSWKELGSPSEVIVRPREGPCVSQCDGAVIELWYAREGNYSYQDTMEDVTLNGIKATNGEAYLIKEPPLCYCIMAELDGIAHQLGPICNKPAKYTYLFPARLLDWHVHQLIIIMCILSGQYFHRDTRQTLIYERVISTSLEWNRTKFIEEDRGLLYSVSQFTKETPKVDATLNRRPSIGTGTMNQSNQKVTDISFNSTVSFMGRTSPFEICEILHGILRSPWKKTSQFEPATFLKLGRWKTPNKLVPETTLTARKWGTKPSVPITKGERIPYGKSGTQSFSKGNILWRVDTYKLCINIPGVSVLTESSEETVTRHSA

SEQ ID NO: 997554 - protein, 120 aa, Homo sapiens
MQGGPPPRDIQEEKRLLVEHLVCPTKYSDVGENHPLIVGFSPKRGGNPPSLEEKFYQPPDVWLSYKGVGFVGSSYRGRQNSQAARWFASSLARRAANYNEYHTRREEQGGVMISLLTYQS

SEQ ID NO: 997555 - protein, 104 aa, Homo sapiens
MVAEVYDVDGDISYERSTANRRYYSYNKRECAHYRCVIHETDNCDSSSNEESKPMHVWLCIRMVHTEQSLGGSRFFDRRSDYLLLYGIAHLKHLPIDALRIAFP

SEQ ID NO: 997556 - protein, 274 aa, Homo sapiens
ALALLYFRRSDVAFLCLVCNVKKRSPLLVIEQWLRAMCKAWFCWGLTLPEPWYPFHRRAPQNIDGRHVWACGQKDSYVGEEASEHAWHPDLLKYPIEHGHSSPNMGLTWRKIWHSLLFYYSRRCRSVPLGRELAQVLRDTMAPVNPKGQQREDDSDYCSETIQHPVHVRGHPGRAVPLAPLGSDHWHLSWHSWRRGHPHWCPSTRDYAHPPSHPASGPVLGGDLSRLPSCKILTETRLTASPPRPRREIVRDIEEKLCYVDLDFRAGDGQRRIL

SEQ ID NO: 997557 - protein, 569 aa, Homo sapiens
AVARPMAANLQFWRRLYDARHIGLICEAGQRASRSADCALISRMTGHQSLNYSAVAVQPWRRGGACHVEQWLDVASDRAVHSVDWYAFCCRAVRMPYSETCLRSVSSRQVISCEQVAQGPLESCTVAGDVGAACWSHGATGSGPALSRAPWLFRLHEGVGVTLVVAPRVHTGPRVPLTVERSSARDRALECLSLVQIVARKRGWSAISCPFPGTLAPGPLSEGLSQNDRETPLLERLSYRELGISLGGKSASKRVTRNLGEGNLPVELSFPDGKKLPLGIVAVMDAFVMALFNNTGGSGATHGHRGRFSLGVSQNKAKERTKRIRRTRQVSPQLPVRYETGETKSPVPYVGTEKSDSVAHSPRTKDVYRQADDEVHVPGGDRPVRRPLRRFRRWRFAAVSRGYTPLKGYSLHGGRARRDVGKKEAQVHSTRICSRATCLCATPCHTTQSNIVGAYFQQAVNNPRIKHFAQASVASVLICAPDVNIPSEKVAGTHSVLSQQMGTRYNAGNDDVLVAINEFSDNARVDVVPELHSRRIRISTRPSVATCDFDYGQDAPMFTLSTASAHDSE

SEQ ID NO: 997558 - protein, 112 aa, Homo sapiens
MALLQWWPVVCRVMEGVCAAEYCGHHRERNLDLRRPGGGRPSGGALVGFGSGSKRTLRESFASYTHTGCFTLADSETFISLEECRGHYESRVNTTLGWKRHLPLGEAIAQRQ

SEQ ID NO: 997559 - protein, 370 aa, Homo sapiens
MKKRTRHKTRAQHTTESYDKQQSSSTNTPRGDNCYSNRAKTEHARPDRETNGSRGQQQSSHRRDESASRTQDSSPKNKSRQHTTKPDRERNTPNTRSTAERPRTRTRRRHDRTNRKRSEESAGGHERQNDESRGPTETARRMLEAKEQQNGQQRREAGHDKKTQREKVGYTETDRRKNREQQQRREGGDAGQETQQKKRPGEERTANNADEHERRQQNGRTEADSTEHREQEARKKDERQNRKQQTRGHSGPTGETKKRNGNAKTMRTNETARRTASRTSTRRERERESTKTERGESGQESNERRRSEERGAYERGRRETKRAEEREGGAAKKQSVHEGRARESSAEQASSQTKGTHAHNREQDRGAGKR

SEQ ID NO: 997560 - protein, 112 aa, Homo sapiens
SPKGEASGWEKSDGSSDQSQCFWNHRCAEGSQEALNGLNVPCSDFKGSHSLYGPAVASKDSVGLLECPESLALPEINYNARRGKARRRAAKPPDHPKSLKHHQRRDCGPYAR

SEQ ID NO: 997561 - protein, 392 aa, Homo sapiens
TEEGLLMVGGVWNCEEGQQRRGCATPASVAVLGLGCGRHSARDFPFSLGSIPWGSRHSPRKISAFKPRGSVENLSVIRHHRGYNIPFIFTRVRASPIQASSRVPDTASWAFFQYNVTERAHAVPKPASCPPVSVTRRAPTVCPREDKAVCLAKARHSAWHSTDRATFRGKSRPAERPWVTPPVHRGHSPGYAAAETSRKPLRGPKNRSKGVLEGGEEPYMAEPYLWGDPLRSAQQTHTRGAPSRGPHGKPRGEAQHHKYSLPQRSSGAEKNAPRGVVRPALHRTLATPMGMGKLHARGPTTHTVDTTTVYLHTTEALDWKEPTDNDVTRATHFGGMPRLPNYHVGPPTKQEYALGALTHGTCRSNSGTTTCLNKLSPHQSHMRNPPKRLPPK

SEQ ID NO: 997562 - protein, 150 aa, Homo sapiens
SWWRGTLGRRKAAKRKWAAVLVRHLGYKPEEYKMGRTKIFIRFPKSLFATEDALRGRRQSLVHKRVQCCLDGAYHWRTEIPPGEEISHLHPDVLIRGFILTQRTPAAPENAFFLEPCAHLILFAKSLRRQLPRNVLDTSMALRAPKTALR

SEQ ID NO: 997563 - protein, 197 aa, Homo sapiens
LLTAEANGRRRSGGCRTAARGLTRLWSCSNPPRPIPSSQRKHHLLTADMHSQAVFPAVRRPSGEAQELAGCKGRLPGDLTRSDGPGLDPPRPIPSQPQVSFLTPFERLPLYGLASPEDSMSCAIGYLIDGARRRLFEVYRWTSWSLCSFLFCGFSEIHVGSTEGRAISEAAAHGGGLFAGRLVRLPPLTPKKSSLKP

SEQ ID NO: 997564 - protein, 284 aa, Homo sapiens
EKKPCITYGLRCICYFYIEVECRQLKTSFWGVQGALVHEAMTDLISADGLFMVDKRGNILIPGIERESWTTSQEEEHKLYDDNRQFDIEEFAKDVEGADPPDSSTMKDILMHRWRYPSLSLHGIEGAYLLGSGAKTVIPRKVVGKFYHQALCRNMNPEVVGRAGHKLPNYRSLHELQQTPSEFKVYMGHGWEALGLRLQITLITMAGRRASEDKILEVEPDLTRGRAADIPVDLDFSGVPRARTVMLDACGGSSGLTEAHSTEMKRLNRYNYIEGTKDAGEVPV

SEQ ID NO: 997565 - protein, 274 aa, Homo sapiens
MAHRESESETVNVSDTTVRLCCDPMMRSTMRPLVVKGEFGPRCGGGELFDKHIERWCSSHDQEAETRVDLFQDFNAVCGRDVTKSGLQSLWIVEKPYGGTPLDYGTVGLEGQNCECRTTESKRAITPKSYVLLGLWARGHNGCKNITLDKRPKRGRGYCKLSVRNNAGCGKCNRWAHKVKPSGRQEKDTPNDRPTRQQSETQRVVAPPRIGKVANPTTPSGMGPFEDHTCNPWGQGSERHPLKERNSGKGVVYRNPAGWDYPQRFDITLHTNMT

SEQ ID NO: 997566 - protein, 148 aa, Homo sapiens
MWSLPKCLADTLHLLMTWPMCTRGRPESEAGCDSLLGTPSLTRDALVALASIHAAYLSIMQEGIIVVHSKASGLSSFIVVGPTRVVNCTCADFRLAKWREELWDLTHNGYDLATGEREHVLVVPQGFAAWVTFGGTPMLPSVEGAAIS

SEQ ID NO: 997567 - protein, 120 aa, Homo sapiens
MWDAIHTVRRHDPTIQPKSSIVSEDPDIISIARTWTAQRRSHSALQNEGLTQVHKNRFAPRSTELFSRVPERPVSEAFLDRRHRIYASYSSFQQSSTQRKGEGQAESIPKVPYGYMGDSS

SEQ ID NO: 997568 - protein, 267 aa, Homo sapiens
MDKIGCHKYFIYRERGDLNKSKILYSCTEAQRGSVLSRRVVYQGYPSEKGSLRDAACRKKHRTTGPLFRGSLPRGLVDKVVAVEVNASVPVKCASVDSLNLCAKLVIVGLSSGRVSSTVASLSKKPFVQYSIRAVNSDGKLCVKAHLVATWGPLKTHSGPPNLWVPEKKPPEPAKEGGSRVRHGVEDKTSQGLWSRETLSPKETGIAGRANKRQRYPRDVVYYTEGPNGPWVNPGLHSPLGKRAPKNAFGQGNTIGGNAADGVWGRR

SEQ ID NO: 997569 - protein, 215 aa, Homo sapiens
MRYNTRRDSTSQGDSAQNMRETANKNHAEQQTPLVAHTSAQYNTTSGTTTTDPTQQNNKALLGQQNNNNGTRTRTQQRREGERKKRHKHTANTNHSRHERTQHETRKNTERETRAHKNSTTRLRDRNEAQQNANVNRKTVDDNDGGGRTTEQDKKREQKDAAGRRERGSSDERNGQQTRQEEGGREGAGGRTQMPGGRDAAGERDRSKEQKGSSE

SEQ ID NO: 997570 - protein, 185 aa, Homo sapiens
MACTTLTVLAANRQRKLRPPQTSTGTRTLTHKRFTRHKPSNPAQPLQHDNATHTTPQPRPHAHRQPAAPPTPRANRHATPRTPQQPPTTQRAHDTARAKHRSGRTATTNTAPGTVTHHYDHPTRHTPPARHLRTANTAPTPRRPPIGPSPRRPRPAPPGDQPLHAPQDQATHVQLTPSVARSRPH

SEQ ID NO: 997571 - protein, 177 aa, Homo sapiens
LRSPPSEARALAMSRPPPPSWSALACWAPCAVWGAALDSALPSARGLCAACSGARTYLNCDSCLHVHATWPVRDHPGRPGARAVCVADCRVKIVTQGPYALGLERITEKAVTVSGPRLGELSLNDVLHLSPMWTSSSYTQHEVTGPRMEETSACSAKRAATRRAEYVGCLGLFQHIA

SEQ ID NO: 997572 - protein, 68 aa, Homo sapiens
TESNPFLCSHQHDSTQQLSVQVLVVGAFAKRSMHIMLISYSLGIFREEEPQDIGPTSIQVSVLHRYMP

SEQ ID NO: 997573 - protein, 109 aa, Homo sapiens
MVANVVGKTPFSFAKLTCTNVCGRRTSRNDLVSITLVYVNHIVAKRDDIISSATYASATLQACNPLGTNFGARQENTPYVEESQQVHKIYCQTNPRDIAGGNVRAKHQA

SEQ ID NO: 997574 - protein, 127 aa, Homo sapiens
VLYWPAWHSRDASRVMPREDRRPGIPTIRSSKIIQSIIGMYYSEDCLDLSRQTEYDNCECIRRQCIASEEFSAMMHVQQGKCMWVSDWDKDIRPMMLQGPIADEGLPEKSDSPVFWRIDCMCSLSRW

SEQ ID NO: 997575 - protein, 372 aa, Homo sapiens
MSWARCKSVLRPPPSFWDTSWSKERLGSTNPPPSFPIGCGSHADQTLASNPSGVTTPQRPGGRGPGKRARGQPGPFVSMRERVQISERLAPYTRRFHHFVSQTGPGCGHESGETFGPSPQPLDPKYLRIRQRFPPYTSGRHRVGRRNGIGLPRRKPHCAADTGHNVRGVGQLLFHSECVQQGGHISRHATTKQAALIAPGRYDRHKCDRCELHKVGELPPKRRGDISNSWGKFGPPARRTGGSIPVHTERHRNEGTNTVRCPSPQLAEAGNPITSANRPYTDMRRALPTTPRDIGGSTHTQNEAVRGPQTHNDLAAQTHALSHQQHTQGTTETTLVAQQRRLRRSSGRPSATRGEHPPPPSGELTTRWRQHR

SEQ ID NO: 997576 - protein, 214 aa, Homo sapiens
MGSSYTKVVGPVAKGWFDGTHIARGRVGMHITSRGTDAMSALGRHEGYTNNTCKAIGQSKGKDTIIWRKKDVAHHYMGGGGGMKTGREYEAVSRREFPLGKNNNIGKEETIVKGSWHCNRHYGDNRRTKAYGLKEGHTRGENKYEEIADTCRRDATTKIQHTRDPAENSNMEPEEHSTKEDDRKCNPQGRVKRYDTNNTHSGKTRENRTREKKK

SEQ ID NO: 997577 - protein, 120 aa, Homo sapiens
MLQVCARPYLGAWCSKRCSPGGSWLSLVRAFPFVCASPVPSHRSCASWEGSPTSASSVVLARMSSWSLPLESWSSRRCSLIIGVLWLCAQGKGMWCACGCCWRCVISESGIPGYSPIKIV

SEQ ID NO: 997578 - protein, 113 aa, Homo sapiens
ALKDRQQKGKGSKPLMHYLRHILRLLAEFGEVLMIGIATLSGTTYGYTVGQSETDLKKDCQLVLAFWFMDQLVHRYPECRRRWTRTCACARLVHSTSLAACKGSWHRCPVLDH

SEQ ID NO: 997579 - protein, 265 aa, Homo sapiens
GAAAPSSASASAFGSGPLLVPTDLEPPDDRASAGALAPSIRIGPQTGRVLASGRRRAVGPEWCRRCRKPFAPSVARVTWVLLSLLAFPLAAVVVTEFAEYDREGIAALWYESCDSHVEMFPYMEKGSASIDIWDFKYQVCVSVGNLTGVLGRMVLSLIAQSDCKVTGMFHMRNSLSVTTRSHDTHGITDVVRSSSNRLLGRLIRKPQVSNFRYLVTQMRNSLVCARQPGCGQIVGSPSDWPVPRTPTGGPRTISLDRPQPLRQEL

SEQ ID NO: 997580 - protein, 142 aa, Homo sapiens
MEHELARSYATENATLCTEHSVNMAGPHPRKPSQQTHQGDILLTLRHRRHHELVHTEYFNEHCHWFGDNHQHWTFQHFVLRRGHLRTEDMRRHDENIPTLQTPIDRRRSTTQHRPDIHTYVNPPKYAPADQIKRQKTYEGIH

SEQ ID NO: 997581 - protein, 175 aa, Homo sapiens
MEKTHISIVVIGHVDSGKSTNTGHPDLEMRVASTKRTIEEIREGGVLRWERAPSSYAWSLWYQGCKAGCVKRWVSRNVNISSVHSHEDADKYICDQSLDAPRTPENCIYKTMTYRGHRQGLELVRRSVNESAAGLSSESLSNAWISYATEIGPGSLSTKHLPVRRPLTTTVEVDE

SEQ ID NO: 997582 - protein, 66 aa, Homo sapiens
MTLHHRKLMAKETTSVEKLIPIEHQGLSRPFLLLCVDSLTPPSVLHPRKLRDALNAAFNRERSRTS

SEQ ID NO: 997583 - protein, 67 aa, Homo sapiens
VAATPLDYVYRIPKKSLIPERRTICILQTVIGIDPFEIVSPVRYNHNEGSMSESTLIVRTSNHGVGY

SEQ ID NO: 997584 - protein, 251 aa, Homo sapiens
RSMEGGGGAGGGGSGGCAGSAGGERLARLQPGLAPGRESRAARLWATDYGRIALTTGEGPRLRNHGAKHSAVLGEEDGADDFYQLRILTLEERGDQGHREPGRAAGQDAAGETEYSLCLSCHTQDGVVHHHGSSRTAPVKIVEDTRIPARVVPEDERRRILPRPGLASCASSRSAIKTAEPHPTLQQLRSSRDDRGPERHETTGGKSLAKRESAWEEALGPEGSYSWSDEDRGSWSNMVPHTGGQRRKHIA

SEQ ID NO: 997585 - protein, 135 aa, Homo sapiens
GCLVCMCGESNIARLIRNCTTMATHTSIQLGHCALRQNLFRLRNPHEDVLSAAAMIPLTRWLKKLQGTPRSFITGFSFKQHKLSSNPPLSLPFWSVVIETTVFARTRVLSHCAICPLDPRRVCRKHWAIRTYLMP

SEQ ID NO: 997586 - protein, 62 aa, Homo sapiens
MTNAKCGDLFLRSHSGGLTGPSQRAIDTCTNDHEGTQRARNEHVKPQTMAKSPVQHIEVDTV

SEQ ID NO: 997587 - protein, 335 aa, Homo sapiens
GDYSGTSPSPAHAPRSAPCSHARVVEDPDSPGKASECWCALGWALDWAGSRGGAWRQGAGPQRKGAEHTRQPESAEKSGARLERQVVARRSIARSQEPKPRPGQSCSVASRGGPINPLLVPFRQKGAETEQDIERTPVGLEVPLPPLGKKPGEMIPQDGRQRTCGHIGTENSFPEIKGAALPRKEGPQKQKRYDGATRKVICAATTEDITDTTHNWEGTPLAALRVAEEATIAGESQRERAQRESNYKETPWHRTQRRPTLPTAMERQKTRQQQAASTGPIITSRRYDRDRKNTRKQTNPGSTERGLEQNYTTNTDQHAGSREQLQSQKETSQRG

SEQ ID NO: 997588 - protein, 138 aa, Homo sapiens
MIKPRDKGENTDADKTNEEHKQSQHKKERDKKTNKHDTGTKNPTQEQKQRRRDRTSHKDYTRRHTAPDKPKRQNSKKRTKTTKSEDKPKQTDNHKTTNRTHKPRHTKGASTQPIKKGHEPGAEKKNSKSRERKNSHQK

SEQ ID NO: 997589 - protein, 373 aa, Homo sapiens
ERLTKGGKKGAKKKRGLDPFSKKDWYDVKDTCNVQYNEHYWAKTLAHQDPRKPKLASDGLKVSCVVNVVSADYAELTEVAFRNLSSLSNWKNVHGIKDCHDVTSMSMDLTRDNNMCSMVKQMARQMIDSSVDVEDYRWYKLGFQTGTDVMAIYSKTIEQGNIERYGNDPSLLLKNHKQGSLTTLPGQTRMTGKFHDPREGLHRDPNWQRSNEKSREIHIKNLQVARYQAILAKHRPTRHTKRPWPSIDYNTYLHPTCIGRDRVTGTKVNNMHRTRKHPTDLGHVGAQKARHMEPDQPTGEARGHGHEAHHENKDHKGEPDDQRCLKEEKNTTPDMRNSDPQAEYTRKTRPKEAQTRTEQSAHDRTTAEQDNTT

SEQ ID NO: 997590 - protein, 151 aa, Homo sapiens
ALNPAWQSLTHRRDAQVRQGDLEVQHSFLKIIQTLDDYPKCFIVGADNVGSKQMQQIRMSLRGKAVVLMGKNRMMRKGIRGHLENKPALRERLAWPSLFREADVVLWMFHRSEEPHLRSGTCCWPSKVPAAARAGAIAHVKSLCQPRTVVS

SEQ ID NO: 997591 - protein, 517 aa, Homo sapiens
GQLDPVSQAGVQGCDCNSLHSSLGDRVYAVTRADIRHRGRIATIKEPILVTGHVVKRERETNIRETQRRAHSTGTRGGATTTRERRDEKREKTGRRRRQRRERAEAQEGQQTRRPKTTPKNRRTKQGTHTQTSTEESTHTEETASKKGETDTKPRDKKNKEGRQTGEQADTQAEQQATRRGERRKRTGERDEKAKTEKERESRRRGDKRMERDEQGTGTRRTAEGDQQTHSPRSDTKGDTGRSERREAAAGDTAEGTEERDRQAERERDRQGRRETERQEGARGGGDGQRATEKPSGKRRRGGGQGSKSSDTEGEERRTEPAEEQREEDRREGKTRAEAREEREESGGDEAEHARAASEKEKERHGAETRDNSGRRSERTTRGACRRTTEAQARRRSGGGEGSTEQGGQERKRARRTHDQDKRRTPEEREGRRGQEPPRPAPEQGTQRQTGSRTDDGGAQGQKREASKQSRERDDAPASKKKQTLEESNGGESSEESKRQGGSSGDAEQHDGEERSS

SEQ ID NO: 997592 - protein, 516 aa, Homo sapiens
RARTLVCKGAVPKPERGRRRAGNPLSDPPRAAGLKTHDHGPELDTDLGRETEHAPARGTPRGDNESNENQGTGMAMHEGDRRKTTSGPITGTGWPAGTIVDRNNKPEGPQGTGDHPGKTQRTNNIDHTLRENQKKRKHAPRPQEGKQTRKDRRWGNTRKRRCEEETNTDGPREEKMRPRTESENSDKGEKRATTKTAKSEINMGNDNVYHGEGAPHRRHAPTFTGQSTRKTVSELRAIFTPRTGYTAKEGADINTTKDSEHTPQITPTRHTLGGWANNVTYRISTHRWGTRKKRSRGDRKRRHQYQEKQQHDDKTSGGPIPPKANTGPQKRHPRTKRGTKQLGQQQQPKSKTEQPRKSDAERDLVRERDVNAQDKGGHNTREKASEAQRDHPGTRPQDEGQPTNTMTQRGLTAHPQKDTRTGVGSKQETTRKRHNHGQEHRTTPVTRQQKTKIRNSIPTEASAKENREQGPPARQEGSRHSPQRERKIRERIRASNDGRGNEPQGNRTEHSKQGGK

SEQ ID NO: 997593 - protein, 331 aa, Homo sapiens
PDTTVASRAGSARGPRANRGCVVGAFAGRCRAVCLCVDVPVMEPLRMWTGRLQWSELAWLLRLSCVDPDCLLWAAGGGSEAVRVANGSPPVGFANQHSRSGPLRSSSPSSNRIGQGARIGDGHTEGHIDKAHKGGWCAIQESSDLGREAEAGRSEAHPGRRFTVYPTRSDDDKTPVHSALLTSWVRTRTTGATQSLLGFNSLGGYRRGMAVLQRTLWTLLYNAEGPPLAAKNHTHLVRPESLGEEGYLDMGHGIPLLGDDPGDGHKALRDPGSDPLPRQDLATTRWANQSFGQAPRGIDGWKRPGPGDRCLEGYRPGGARIPAGTDAERLP

SEQ ID NO: 997594 - protein, 324 aa, Homo sapiens
MRHIVDTRQRTKTGPISIRADKKKMHTSSERKQRKAKTLHRKVNPWWSTQGTGKTQGDRTKRRKPTKESHKRQEHAATATREQDENTDHGTQAEGPKRISHHITRGNATEAIEDDDNARGKKRKTPRTRTPTIEGKIQPETRHGQESARQSQREGERKTTNRQKTNRTNASKGTMEGKTKTKTTTTIQAKHNNRTHRTPNNHRKRQAYPWKEYHPRKKKERDMQASKIPGHSSKTNTKAVTPRDHTTKRTEDGHTYMRGQNDMKHRTQDRRANKTAEKTKNNTTTRRGKKARRRHTGKVKPNTQSRTAPQRKRKSTVEERNKTQ

SEQ ID NO: 997595 - protein, 254 aa, Homo sapiens
MRHRKSAQHNKKTRPNSERIRRNKGRPERNRMATNNKIPRQEKREHTNTQRRQGNTIGEEPRREKKVHTTTMRSSNTRDKTATQHRKETDRTRSTQQKEDTYTETEQPTGTHTTREAEKRPKRERKHHTQHKGKPQDSRGTQAEVKRKTRRTNHHEPGNEEAPRGPHQRQKHPPSKEEHLGATLKEEDKPRQGKETEHEASRTPKQTTTRKRGTEKEATPKMMTRAYSGENQHDNNREAEKERDEQHTTTGDKQ

SEQ ID NO: 997596 - protein, 169 aa, Homo sapiens
PKSGARSTEARAASAARPTSAAAPAPFDPPRPPRERAPAAATTSRANLPDQPPPRRLSREHEEGGGMSDGGRGHNQTPTTHPSHDKGLRPARGHATAASTQREPPQAPKEATSVGSKAALQAAQVPEGTPGQPQDDTNHSQLDNPTRVGEPADPPARPQQRNRRPADTR

SEQ ID NO: 997597 - protein, 112 aa, Homo sapiens
MTCLRRVGYGPIDYNTELAALRTVGLPSGAGQYVIGTSVFYWVTVSINDIGTVYALVRPYNIDGFVRGSHQRLFATCYQMGDTDRRTLLHAFVKRPWVVSEAPKSTPCRRNR

SEQ ID NO: 997598 - protein, 66 aa, Homo sapiens
MRECISIHVGPGCVSEIGNACWELYCLGTRPIQTRMDRCQCDKTIGGGDESFKTFFSGGRALAKHV

SEQ ID NO: 997599 - protein, 169 aa, Homo sapiens
GELRRSRRIYCSPSDGLQQPPIPLLGELEPLAKSSPMSYSLRSDANGEIYCILRGKSATWWRLHSHSIYKKVIIQADLHVAPSSVLQTWSYYEEPLRKLRGSDDNDLDYIVVNGVVLRHGLVRSPSNTYIKLIRRPAPGLQSEEYWITYIDIANDEETLNEILNGVQTK

SEQ ID NO: 997600 - protein, 270 aa, Homo sapiens
TSGLPAPSVFLWGKSTALPPLPRWDDATPSCATPVALCAAHLCPWSTAGWPINHTSPGAGTAQGSDVEFSTHATPPAAEGQATALSCSTVLSDEEGPVVLPGPQGLHRVDLGHPVHTYSGKASCVTGIAYQLTYNLTLQGHWDLDDRRGHLGETSSAWHNAVHLLVHLLAPQHPQEPRGPSRGNHEAKGNMTETREPQLHMGPHGTKEPNVTGSSAKTIDNEEHRTMTESPQRGGPPQRTDGRPGTHRSKGERATAATEKEQRIEPGRPY

SEQ ID NO: 997601 - protein, 577 aa, Homo sapiens
IDVSFHFHSRGSRRAVTCAWTRSRARLDETTPDDQLLYHLLLHVPDDSFYMSWVLELLVLMLRTFVGFDETTHRAQFRVRMRLVDPRTLEKPTGAPVGTSMRKLSDLATLEYHRYVTSRCRCCITEVPECEVVTEIAGIGSEGPGQNVESGQVQPGFLFLGPLAKVKAQRQVNFKPDGSIEDKHTDFCPNKETPAERNKFDPARNSGTAQAALIRLQRGHPIREYQILAALASVVTITSVRLGYHEASGYHIGKTVVWSQRTLIPNDRNSEEANGRPPSLLGQGTITVNPRLKRNCVMHPQLYRYRLGSATLAHNKQFMAKAYPDFPPVACRPMLAIKAPCDDVSTNIQDHRNALTKAPFTWHARTAIGTFCPANFAVEPLRMAGFPVVPQEGGYTLHNAKHSHSPQGSSNLTHHHLNPTSDVTTYGTHNEQQASHSTVRQVKKRPHVQTQIAESSGHTDIFTRTYKTTTRTTTQPTQKATPNICLHTTHPKGNPARKATQYDTQRDNTLRRSTNTKRSHHASATAHPLNLRRTESRSQHHYYAQRTTTHQKEKQNAPPQTHITSKQLRHTAITPAT

SEQ ID NO: 997602 - protein, 151 aa, Homo sapiens
MRTGNQEEATILTEYQGTENNAKNTQKDTKHREQATQQYKTANGEQGSQEDEELRRLHSPLDASHEKLEGLSAIRTTRETPSTEEETPQPGRKQKRKGSTLIKTRRTRTAHTGDDRKKEERPRSNQETNIRAKHRGKKQRCEKESTKDRST

SEQ ID NO: 997603 - protein, 331 aa, Homo sapiens
MCTVAVQCCAPGCDCRWTLAWHRHPLNGNGATAFLIRKEAPEQENSRTMWTKGAASFNYIPVDAEHCHPIEHFSTSRPPQSGGSEYDGESRYESKGFSGPRGSAHFREDNITLTNLYEKPPGRRGGITERMKFLVLAAERLGLEDLQEASQVTESQVARELMYQIAGQGIQGTAGDSKLWQQPGEFEHASDRLGEHGTPGCQYAIFVSKWQEPDVGPWRVAAYARDDEATVVKKSLLYHMNAWNGNLEPKKRVRPWTVVIVTEKRFAPESKVQRGSDISKRTWRLGPRGEETGPEDDGHDEKHDEVRRRIEETYEQDDQGNGRASRRKMSG

SEQ ID NO: 997604 - protein, 98 aa, Homo sapiens
MAGEVQRPPKVWTEASTGRGIGSIRFKIAAGNTIGLGTRAVSLGSTLKNLLGFTKVRTAGNYTLGWGTGQQCGWTYVPRATSEHCDPVTQYRYIQAVT

SEQ ID NO: 997605 - protein, 201 aa, Homo sapiens
MLEIPSKKVMPRATLSPRGQYNDRTTSGAVTRNKNDRDGHDCKNRSHPPGPTTEEERVWQRRQPQRRRPREGNEPKHYRVDQQNLHGTLPSGLCGDKPLSNNCGNTTSCSTLPQVEAYYTTQHQAGVPAQHKKPTGHTTGTSHKGPRKEKRRDNNNPQEETSNKRPTWEPTEGRGHNQANERDSETKTITRGNTTNTRRSD

SEQ ID NO: 997606 - protein, 275 aa, Homo sapiens
AGPESGAGVQGPQDRAGVFPGPGEFGPVPPGGVQSPNKGFLGAATTSRDFPCPWIQAPTSASVARHPGALHLRGYHQFAGTAHLGRPGCYSPSRHASSVPRSSATEAGHVRTGPQSSTGSRAGGSREGRKKASRGQTMEEHKIDDWSKPRSQAAQVFPRRGSRNKGRSTQREGSRMKGKRGQGPKGATKGEERIVNRMGPKGQPDTGDTSAGQSMEDEHERKSKIPGTAPDRENVTHAPGRITKKCLRGQKRKKKEEATGEKGTRKPGKEGREEQ

SEQ ID NO: 997607 - protein, 238 aa, Homo sapiens
VTPDEPPAGAQSPETWLPTLPPRRCLVPVTMKTVLRRVSVYGGRGTVGSYPAWCLERNLAHLATRMARPWEAMVAASRPPMGRPKSNDGGGPVRLHQRGSEVLTADSQEAIDGPLPCHTISYTCRLVAACMVLSGAAAAGTEAGPQDHGQPPLQDALPRILRRRTPSSSPRPLARPSPTDYKPVPTGKQVLTPSQVGVHPRPRRLPLHNGDLDHFSNSDNCREVHLEKTARGGPGRGP

SEQ ID NO: 997608 - protein, 57 aa, Homo sapiens
MKGASKEILSTISSLVDDRIGSQRIGNLGQNVSKLAHGHYACMEDEAEKQRYKVMKN

SEQ ID NO: 997609 - protein, 119 aa, Homo sapiens
MVMANNVVQQLWGANAAEPYPVQPAVGLEEPVTQEKAKSIDKIEALSQEAMIYIKGCGEKTQNYLAENRTMTMELLMLRNALANQSDWCPASDPRRIPCKLSTEYQEAHGPYSIRPKKD

SEQ ID NO: 997610 - protein, 274 aa, Homo sapiens
MRRRDDYGQPMVKLHDHQHRGGPTAAPGGHPRKVSKRGQREPQSHESTRNADLGPHPGRSKGTDTTRACISVPRPQGKRAPFQLSGTIAELDGHSSRRKAPRTVEYKDQPPTTDRTPSQAKGTGKGEHRPGGAARSAGARRARAPRPRPQRRHERQTQTANNTTTGSSTPKTAASGGANKQTTTHERTSASDSTTAQAAPKRPRTQETKTRGEKPHRREDASGKGGGGAREARARKAGGTRGGTTRTREGETDGARDGEATPTEPDEKSGREGN

SEQ ID NO: 997611 - protein, 86 aa, Homo sapiens
GRRYHQAQRSWSCEEIRAVPPCLPCVPDTGRFCPREPFQQSRKTVVEFYEGSRRAETMPQPRIFNEAYRKLATEDGDPRIKKSWRY

SEQ ID NO: 997612 - protein, 114 aa, Homo sapiens
MVPRMERCQPPDWDTAKQGSAPDEDTAEMDGLIRGGLGSLDSDDHLRHGDSDRRDLDGLDCPKWWTQPCWVIEELYQKVWNLAVEDVDNVSSVEKPSFRQNGLGEGMSMRQCKG

SEQ ID NO: 997613 - protein, 279 aa, Homo sapiens
MTLLAPKGAPSIHPAHHLPIYRYYDHRIRSSCSTSRYCQLSYIVVTPTTNFNQTHMRGEHASVVPSRYLVMSRRQHVREAHYSQFFTFELRYVGVQRVSYAIRNHPGIWLLVPTSAGKLALGARPRGPSRSEGVALRVSADQSPIGLVEIPLLTLKASFLLLCRTFGLWAPMYLSRGSYEGSEPISSQYNLACLNPPGNRGEKRFIDGYVTRFRQSLSSSKQHKLELAPRVPYPYGARIRAAESFADRLEGGVPRCPLPKPFTGESPNAERAPPFPKRY

SEQ ID NO: 997614 - protein, 146 aa, Homo sapiens
AGARRFRERGVDDSLRSESRPWGPAMTWVEAECLDLSTVRSMNVSAGLMECIMGFIDRTDAYPDIYVLAVSPERTSYQSFRESVCESVYAQLPAMESIMRGLRLPYFQRTMVGLQTDPRIIRMYFYHPKHKESDRYAPYLDLRSVT

SEQ ID NO: 997615 - protein, 132 aa, Homo sapiens
MREGYRASPEDAKPCVADRVISSRYINEASCRDEWGRSPDAMKSCHGACEKKLNHGPFGVVHAPWVHAREQVAPISCDFLETHFLVGGSEVLVKKMGDHLTKPSYRLGWPRRLGWAEYLFERLTLEARVRAF

SEQ ID NO: 997616 - protein, 261 aa, Homo sapiens
GPLRPRPQRPRCDFLFALCPRRSSSFHLTQESSNCSVSDQRLGVGRTLGRPVVCAAMRVGSLRLRGGWLAVQPVWGPSRPTTPPGHSWTQRPGLCVVCLGGGAAASERLWLRSMRPMFTTAVISGRLGTSHVPELFSVREVSLLVEIFNLMVLLYVLSLFDRELTGVVKRWNMQKTLQTVGLDAWRVRNEPSVSRYIHPLPWARVAVKPPRYESVNPSVSSLMAVKPTLPENNQTVANPGFQPKYHVANPQLNEGEQRENP

SEQ ID NO: 997617 - protein, 82 aa, Homo sapiens
GLPTAGPWWGFALGTPNPGAGCQDGDADEFRELGTVEEKLSLVAICAKTEVKLPNSKASYLTVWFGRLVTLVLCVTYPLGLA

SEQ ID NO: 997618 - protein, 143 aa, Homo sapiens
AQAWPLFRRGRTAGAWRWRRDASYSGRRMETLPPDSRVSWTAEEDEADSGEPWENPIIRHITTRIDRETNSHEKSWHVGDGNDKNDDNREQMNEINQRTENTYPNSAIIHHTHIIFATYRIIPERHHGAESIPLEKYHHSLKG

SEQ ID NO: 997619 - protein, 166 aa, Homo sapiens
LKGPALYLAKPPSPGSGEAWDYEDEIRPHTPRCRVSRTTPKTRLCPKGTRLGGRGGGGGETSPRGVSAQPPTPRARGRGQDQPRDQRLYHYRRRSPGDLMIYRPAEVLTEAYPRETPERPEKPARDRHSSQTNMGLQGQRSQSAPLPNNVRTLDFSTGRRPRTQLW

SEQ ID NO: 997620 - protein, 178 aa, Homo sapiens
GGVWAAAVVGVPSRWRPRYFRSESGVPGRACTEGPGSCAHPAVRQGPSPQLPFPLSAGSTRAMLAVVLTRAARPYPGPASWHHGGPEACARNSRGLKGSEMQAVEAAEGVPVALSPDAMTGAPSAFPGNGRLQCSLKSEATQKNVPPCTDSFTHGTAHRTGRFQNLRKIDTLAQRADT

SEQ ID NO: 997621 - protein, 222 aa, Homo sapiens
APLASAFTIDIHKLVLSPSLVFHSGVYEPGLYVGDSVYAVRVLLKIEKKTPSSGHKQSGTGVTPSMSGHTLLCQYSEPNQMGPSSLLIPGSEFSLLIPWFSVSHCGYGLGSAVHDDPELMMAPALEYCPWVEASRLIHALSSLSLCPPQVVAQLSRQVSIKGTACVCACDAQHPGMCLACRRGRGHRSVPCWPMCTLYVPYCRACGRLQVRILPGVNTWMLW

SEQ ID NO: 997622 - protein, 274 aa, Homo sapiens
APDAKAAAVLVNLTVMGLPEERVLERQRGAGARRKLEPGVPGRWQLVSCLPEVSRSAHVPSLQLLPRAAPGAPVEEPREFWGRHLPRNLTWKTPLPWPIPSVQPFDVTNGKHSSSTWMKGATTNICYNVTGSNVHEKKLGDEVANTWEGNEPGETTQITYHQASGPSVSRISKCLRKQRIQNGDRSGIYMPMIPELVAAMLACARHQGRFAPQYVYAELLFRSLYVNGIFGFPASAFSFTTDCLLPVAESLGTLKELPDEGLPQVSRKRLPQYD

SEQ ID NO: 997623 - protein, 347 aa, Homo sapiens
GSLYSRRTTAVCPTPRPGVLLGGSHNPRGRGTSLLTIVPCHEEHVSKTRKSSRGSPRISRQDREVGVMNGLAYVWMRTQCAPDSVVVKGVAPTICDEEAIEIARAQGKAKVRARMRRQTHLALTRGQLYRALKGRSPEWSFGPKVLATVALNTVPGAMPIRRHGVGSAHDCVANILAYLVAKETEKLTCTGMFAQCQLAASVTETDRIGKRLWFSGRILWDRDMCFDERHRRTYFESCPKGRPGAEKDTLVDRGIVRSYSKGVALDRRLKKPTAFWDTSDEWSEHISDRFTHFPICNFPNAQETLKYHAFSLGIRDIETGNDGAENRAHFHSGDQKYEVVQPKENSR

SEQ ID NO: 997624 - protein, 69 aa, Homo sapiens
ARVGAQTVRRYVSVTAEYPRRTQPGSDQVRPSADSGYNGGIGASSLALDATQRQPLSLIPYVKMQRDTA

SEQ ID NO: 997625 - protein, 353 aa, Homo sapiens
DHPQPAPVTTHLWSRVGPRRCPEEAGAGSGGRGRLTEEEEAEPGQSVDLAGPGLTLALTPALAAGCLPMPAVEDSEATETSDEAGSALGPCSATILLEHNYALAVKPKPPWAQTLEEPRSQCPAAYGATQLSLNRLTILYDIFGNSGLELRGHRVTVGLTGTKRLLQQDQAGAWTGSDEDSLGTITQYNQAEPGRKNRIGVWAPRDWGPREQPDERSAAQQGLLSPNEGTTGRKDKYMDVCAVVGPGQLGRRVWNTFRGTKPGVACTRAPAARSHRGGLLKHAIRVHAGKVDWQKDERWLKSSKPRPPVTREGKEGREIWARDRESNEVGAPCMAIVIPHCVAGGKLGQMAIT

SEQ ID NO: 997626 - protein, 431 aa, Homo sapiens
DPAARVVRALWPGGVRLGLEAEEAAPAAATHAEPGRWLRWGCGGLAEPLWLQLVLVGCPRVLVMLPAAGPVGEPWGCTTLVRWHLRAHGPPRRALSRRRIIPCRRAALQGLSLLYHVQGLLSLLAAKVRERFTYEVPIAPLRLYTRLVEVEPLCRKGALRIDRYLLPRREGCPQSLCGPGTGKQRLARNEIDSLCHHQAALKGPSLGSRGARPLGKENHSAYLPKPNGMAVEATQGATGRLTRGSGNKVRGFIAQGRTEGPDTVGNWGWRPGEGAPKGPGDGDEYAKDGPDNKCAGQGTLGAWGGRTLRFYPPTRSDGTRETATRPERHRGRVPFIAHNHMSPGEGDKLREARAEGARGRTKKHLAAQGSTASAKVEQQRAAQKRGGRRTPRGTERWRKGTRIGRDATDDETRELRRTAMGKGGPLYRERR

SEQ ID NO: 997627 - protein, 131 aa, Homo sapiens
MAGPGRPTCVTVGTGKHCPGTKMCHCRTPGRSTGPTHAASQLRQSKSGYTDKGPIALELLDSGVAFNIRALKFVANAHRARRSFVYTYARFRIHRNMTGEQIVDHLPYDRPGEADAWACKWNVRHTLGGPV

SEQ ID NO: 997628 - protein, 311 aa, Homo sapiens
MTSSGPGPRFLLLWPLLLPPVASALRHVPAGPEGPGQPKKNAASDRHTWWPQVRNQRVYLAVNLQLMGKVLTITICAETPGEPLGQTREMSATGLDVATVGLQKPVVRANETQDEVSPEEGHNKETRHTGTNNNSKHAGTRKIMTTKHQRTSERQTNDQTHRRPNPGATEQEPPKKERDSDADKQEARRQAGRDNPQTQSANTTDGQEKNTNQRRTTRKRGERKPQKQARTTEETDEQHARKESKPTNKSGGGNNTEDKKGQHNKRPTKVVAANNDTVTQESQTASQTTKTAFTNPRSHNMDTTRNIGREN

SEQ ID NO: 997629 - protein, 106 aa, Homo sapiens
MAVAEAVLAAECGWVAGLDGWLAAFVQLKHEKGLYIAMARMLLAGCVADTAMHESLLILYPVSIKGDEGDWAWPYTMRARRKASSRPQSVDHQIRRNTTHEQRSIN

SEQ ID NO: 997630 - protein, 225 aa, Homo sapiens
ERTVSFFSLVCKSEFIFIKDTMNGGDHQKRDFGSGCNETTRIQSTQDRSRKTPCDSVDFRMYTTVSGALDETRRVESVLGSCLAATQGRGPGGAPTPIGGSLRGRDKILTGSDVERRASREKGMKTARMGARSLCRENASQVHVDTPLESVCERRTLFPLRKSFHSSPKRGLLQGRTRSSRTGPWACMGVPYSGAQSAQWRVNQHLRERKSSPPVVTSAFPSRKA

SEQ ID NO: 997631 - protein, 108 aa, Homo sapiens
GGPGLPPRPVRRDEIPMTVFMLGVRSGLVPSVSDIRPHQGYTRLSDRRSMLHGRSVAMEKKEKIIERTQTIRVLRATIEKELGKQKLYAQAVHIIWVEDLEYKEKVHC

SEQ ID NO: 997632 - protein, 90 aa, Homo sapiens
MGKVKVGVKRIGVVYERLVTRDCYLSSGNSGYWLASQWTPFIDHQSTWFYMIPYRFRARDGQYSYWRLVQGMRIRVSVVITVDKSPYTRS

SEQ ID NO: 997633 - protein, 176 aa, Homo sapiens
AEVAAISLLDISGRPQTPCEVPRSCRKENRKKLHPGTRSDRYVKMKRNKAESLRRHRADRVRLNDLKGHDHVMPSSWLWNAHHKDIQESISACPCWTLPGIVPGSNEPSSELVKCLHDVHTRSLRVAEGYVVIEMYFAYLSYSRRHRSDTLVERTLTQPRTIEECTKPSIAEGCRQ

SEQ ID NO: 997634 - protein, 151 aa, Homo sapiens
MSQVMNLCVEPEELTPRRRRGWESGLKDIPDPQMCGNGGYYRRGDTVHWFPIVWKISAPPQGCTLQLQERHESRVLAGQSLNRTATREPALERERPLGVNQERRGIPGSHNLVCAYAVPQPYDVGVGPPRPQKTPFWRATGPFGEDSFTNP

SEQ ID NO: 997635 - protein, 435 aa, Homo sapiens
GSLSSAAAQRAGPAAGAAGGSESPAAPGSIAERTGRDASRALWLLLSWFPCSMDGIGGCDVGMTHLDTDVVPSSKRAQKVGPSPKNWHRTLCVICAPCMARGIACSRECAVKLLGVTQLRYPVYGAPYCPPWEVPEEGGRGLSRAPWALATLSRGDCSVYPVEEAVYSPESRGQALGTRIVLPRHHVIACGPGPPGHRKHNGGLRDPNLKGPPGGFVGTHKAFPSINWPIALPDFVGTPNVAENPLGQQEGRRGMAEKRTAQPRKFALEWRLEGGFAPVPVLFQANEVGPHPGALVGGHFVEPRSNRALGFPIGRLEFLLKGFGYPGIGGRFRRCTLVDDGEDTALVCWERTPLGSAERPLDELPGTLGGPIKGNLRRVWGNKSGTRVGPQGPHRMGGKPCRNTCGSHGAFKYSGDKGYPGCSWEDLGRLRRSST

SEQ ID NO: 997636 - protein, 158 aa, Homo sapiens
MWGVGPVQGLGADRVISITPPPVEFLSLKDYAGYTFPKLGEFFIPGARVTSVKRGRMALISLHIRDTALYKICVSPSKSRNPVSTYQCDEISWSHSNFLTWGTPHTVCLDYAQRAPVWFVPPNNAVACALLWAPPPASCTEYKGCLEKLPLKGTSVSI

SEQ ID NO: 997637 - protein, 361 aa, Homo sapiens
MPAGGCQYNETKSGGMEADEFWPFSQVLELALSRSGGWITPASWLKPGLVGCSTNNFPQFLVGHQWIYKFAIGNPWLTSSTGGRNRDRWIFGTHGPNINAPGAVLAYLFVAGIIGGDNFLENAILAQGTIHGAPPIVWRERRGRKETRGLGASASPPVETIAGSQSGGRLARLDPQDIKRRRDSREGGPQRCLKAREGEVMSPGGKPTHSTQGGRLCCGAPTQEKAPQIRGQPPGVFSSAGPLQTPEKNTSYTRSVASPEKKEGGVEKRPRNDKGIFGDGGAVLDTTKLFPKKNILWSQHQKGGKTHKWAALPLVVFRAQGRKHHHLVAPIWEGCNSLSANFFPQCPFCFSIGTPEKFGAP

SEQ ID NO: 997638 - protein, 230 aa, Homo sapiens
MGTVQNVCACREHSSMGSLIVAETGGQLHIARAQSAACRCIEHDKEGYFPAEVGHRARTTQGLINPGPLFQRFAPNSSGCPRTPLLKKPVGSAEDGFPRTKSGSHSQACKRNNPNRLGPSSPIPTEGFHCRDSLGVGTSPRTGLGTWGDQKAPSGRSSSAHTQKEPLMLLHTHSLTNLGRIGPDGPFGSDLGARWFPLATQERTSLYGGNRARTNLSFALQPYASTWEPL

SEQ ID NO: 997639 - protein, 284 aa, Homo sapiens
EQPEEFCTMNLCGTLVNNSAKGLSSCCPENDLGHHGDDVQAGLLQMWHAQHTSSSLASGGWNSEMSSRPLQIFISVATSYNTVFIRHRARNDSRMASGRVSVSWLRLLVLPVIQGDCFQRAYSLGVWAEYEGAMRLYGHVSTLGWQAVRVVEFLQVAVGSDVLRTTFLVGSILDVTHRDYGVRIHERAILGDASVVPEPGEDVCSSECPLHNPKQSIDFLRVATARQLTPGKGLGLCVSQIHCGGGENGDAKAVSQPRASWLEKGPAQELCVGASLGVPPVQVN

SEQ ID NO: 997640 - protein, 135 aa, Homo sapiens
MARPLTILRKTIPARTVYPAPGRGPLSKRSLFSSSSLARISRKVMKRKVPPASAPERQHGRHVCPVAPWALYICPGPRPDAQGESWGFGDRRGLAASRRGHVTLRAMLDRPGPTATSVFVDGHPQIKGSPLSPIR

SEQ ID NO: 997641 - protein, 152 aa, Homo sapiens
MPQKYMSVRRRAKEEHTRGGAHRHIRQNDGKMRHTTTGTTLTRKTGPRSTRQSLDTNGQIKDMEETYKSTPYRTSHIRRANRKGHTNRTRKKQRSYTTTIRRSTKEGQQKTATRLGHRGKDNRGKTTAPTKRPKKIWERQGVYSRASSTRNR

SEQ ID NO: 997642 - protein, 240 aa, Homo sapiens
GASWAGGVVQRARRVQTGVQGPRGRLAAVLVSPALTRNLHREGKSAPDGWLSTAGDSPYRGLPSGVEREGVRVGEKHGKGGFRRWAVVEGGGGRADLAMTVEHGMSRAKKPFIGKNSIANYKMAEGHQDKSKVFATPVDKYPIHIPYGTWTPIVVTASGGPNWQSKDEKPKPEGEVGNPEVNGHGLGLKLTNAVKDSSLDRGVRQGTQKGAKFHNFNWQQDLLPSNWDMGLIQRRTQHTA

SEQ ID NO: 997643 - protein, 74 aa, Homo sapiens
AAPAEFSCPALTAAAPAVPVPRVPRVPREREWDPALGRTQCAAARDATQEMSHSRHTVPFQTHRCPVSSPVAKI

SEQ ID NO: 997644 - protein, 402 aa, Homo sapiens
MKPILAASRGISANGEGVLANVLVVATSQKDAPKDHMATPRILVGHESLLFGHYYLVVYRPWPCLSKDGCLVNFGQPSQANTHTTNKASSRSIERRINPSCERPEKRKVSQHGELITVGTSKGIAERTIHRGEQEDTTVICPRRPHIVPQGGIPSQRDYFMLRSPRAQAQPERCGELLPTRGHNVVWPPTHEGGKPQQHVVPPKLCCRTTCGGHQSTVVAPNEVLPQPINSEDAPPTVWLTTNVSANMQEDGSHNMSTPHKVSHQTHPATPYDKTPANMNRGRTSPAGKKETPTPLSRRHKTIAVDTPQHRRVRRTLAEKYHASGETEDSLRPHDETKKRTPPSRRKSVITPTEADARGNPRTREKNNHKKGEQTNTREPHRNNDDHHLNKRRRANPYTTAV

SEQ ID NO: 997645 - protein, 181 aa, Homo sapiens
GQCKPSGRWHRGLTMDAEYDVIVLGTGLTECILSGIMSVNGHEGAAHGPGTPTTVGESSSITRPWMELYKRLTVAGGAPLSRWAEEENLECRPDSQNSSWLNCGSMCTGCYLYHRGETSHNMDFNVLVRVGKLLSYKGGRKHLTNVAVPLTTEAYGFQICMVHVMRNWRYPEKYPGSNVAN

SEQ ID NO: 997646 - protein, 45 aa, Homo sapiens
MLVEEGRKKGEGSKRKRGGRHPPSIEENKQGREKTSTQRGHQHTR

SEQ ID NO: 997647 - protein, 335 aa, Homo sapiens
GSVSLRVLLVAGAGGVCGLRGEPSEDAPVLQEAEVRAPARCGPAPDRGHGVTNCPCMFRLLAGARGSGSCMNPADHRSTGDRRRGQLHITSYATKIHFSYVRAGTVWLECFDTPASGGALRIKRDHAEGLNEAGTYVSVRTEVYWTPKCILHGSIGRVKCHETDTYTAMETSGRTGEGNEPWHFGASEGQRHLVQGMKVRWKKGPEQERLSSAIARPKQGPGVPGQAPKETQVGPGATAERQDMPERRKCQFDIESRGRTFDVRPAPEDVTAKVTWSAISPQLTKRGIAGRLCFRRRKTIHPGEEFSGRADTRKDTDRSVENPGWRQPRSLVINH

SEQ ID NO: 997648 - protein, 265 aa, Homo sapiens
MSYSQDPDAREIVVTLAENPRLFEVDLFTSEGLFRCCLCSRCVLHTGIYEGPEKLRDTDKTRYMGKGVSQGVYEHIKIKLLAAMTWLRHTKTESSSEPREDGRKLTDRQHWTVNQSTLQSKVMAANAILGRCTLAVLTKLVPFEKGVPHVPDKHRCLGMTTSEVHPASPWLSHVINGRFSCWQQRWPCTEFMILPDRMQAKLHGKPCAEEQRYNIQLAAMSIKGENTLAKDAHQEAEGRTARCAPKHSWRINDGCNHVKPTLAQH

SEQ ID NO: 997649 - protein, 154 aa, Homo sapiens
MDVNWLELTRAKGPFTGNQKGTSGWPAVYKWQEATGMAIVKTGIMGTGIDMLNMYITITAKNQTIVPYVPWLKLGEKAQKGNPGMTVTGTDGELTTEEEPGLTKEQTTGKIHTTATQEQTSTSDREWRDKDWGANRTGHEQKMTTSEHGTETYK

SEQ ID NO: 997650 - protein, 233 aa, Homo sapiens
VRGAVHQSIGAVRPSLSPRRPGPLCACVSAPAPARACCKGRRAAASGGSLFPQKLLNAENLSKWYLRMTLKKHPWTGLMISKSLIMVPRGKSRTLQEMQTGGPVELTRTDGKDHLGNTGSWASPSIPARGIYSSESSRYKRINGGALGFTAWKGKQMEFPRIGVENRAYGRPGNFTRSLIKPLCRPNQEAPKRIPRTQKNSKVTGRKDLDDTEATPRYPYMNTHDGYGATIWE

SEQ ID NO: 997651 - protein, 230 aa, Homo sapiens
ETTSWARWSVPLSHLPTEDPTMERPYTFKEFLLRPRSHKSRVKGFLRLENGLYAKKMEVTDEEHTVTRGTDMEHGWEVVDSNDSASQHQEELSYLPPTASRVGQTQVGQLTPNYTIVNHNNRTTQWHRPSLMDVSSRVGQLTSDRLNQEAAHRRTSLPTGTSAKTPEARSPREGAGMSPSLWETISEEVNIKMEELFSGLDLAHTTGNSQDSQTMPQEAVTGTEPQGIRL

SEQ ID NO: 997652 - protein, 175 aa, Homo sapiens
RERTSLEFRYIFLFKFTKFFFKNQIQGLKKSLHFQPCLGVWVGELRIKLSKRVPYLPSPCKGDTAELKSAGPLPFSCPVPSLLQDSFKLRCIEKIINMSGQEIDVFARSVVKRREKAVRYIFRQYQDEREIFQKTVGCLMSPLLRKEYTSVKEPHQPICGRNPPPKGDVGRTGAH

SEQ ID NO: 997653 - protein, 53 aa, Homo sapiens
LPSLFGARPYSTSERMSNGPADGIDLGNTLLLCGCDPARTQVEIMANDQGTRT

SEQ ID NO: 997654 - protein, 253 aa, Homo sapiens
MISMGSKGLFFFVKYFPGLKFLFFFFVLSFEEHQTLVRIYSPPGRESCKGGTKIFVPHMGRHIALPGIHRHFSCLQSTSTESRWRIQQGTQCPPNSTGAKFSINRANQQSTNTERGVTTRGLQHTETGVLRRISIDTLERQPPRPTGTTPQRAVGELHRADGSQMPPRGIWWACDKVPPLQERHTPPPRLPVSDTTYTKEKGENWSEQQVKQINQLIISPRQQRQSRTRADRRKNNTATDPTSRRGQQQTSNT

SEQ ID NO: 997655 - protein, 106 aa, Homo sapiens
AECRVRVVSRAASTARFALRRPRPAALAMSRPPPPRVASVLGTMADGVRLHGLRPASAAGLCCAVSWSACTHPNLDTGLHVHATGHVLRPSWAGMGLGLCAVATAE

SEQ ID NO: 997656 - protein, 274 aa, Homo sapiens
MVRYSLDPEKHTKSCRINEVPISCVFTLKNTRENCCSAIKGMHILKSHEVSEKMSLYRNSVYHSDVTMVELAGVRRPGNGAGHTVGGSWNRVLNLCCTCLHETRESTAELKGLDVDPLVIEHIQVKQSQLRCDRPDLQSSWSDEPIHELSLTLEDDPYVKRNRLFLKSEEEVAQKKKIVPEETEETKDLIGTGEFKFQAIKQVTMVNQRQKDKKNKNKKKSATGQYIIVDRKSENKKKMIKTQVKQMKNKTESQHQNPAPGLCKNQTSKTREEN

SEQ ID NO: 997657 - protein, 495 aa, Homo sapiens
MHSTPMSQITDRLPVQWLGSNRATAMSNPNENIPHSHPILSTEKPKPYPFPTQIQQVAWLGIALEQPLQAHRYRLGEVPPPWELIRKQTPNPISDKQTRLSAEPTQSTAHEEERRKEHLKKYIMKVTSNHIDVTKESTPTKTLEDLEHWNTTHPNWMNARTHKTFKSTILSLVHNTTPTLTHRQNNTYKLLTHHKTPQETTHIHKSSQHSNTTPNIHQHHLLPPISPHFRNHTNHKNTPKQNSIIRTLYNKHTTQPITPPNIVRTQPINQDRYIPTLYTNTKYRKTKQTTDLIKIKYDHQQYHQSHLGSTNYLGWRQYDGVTPRRICDTTSRSTILTKSVGSAAAQTSWMHPPKHNYATPTLWEYRTPTDSILHNIKWTKQRSKRRLMRTTKANNNYTEETHTTAQIITPELTSKQKEVTKPQFGKIKSAESGQLVAQTIIEREDNQPARYYDLDTMHTTRIITPRYSTTPNRPTNKIQKDKILHNKIKSTLPNI

SEQ ID NO: 997658 - protein, 100 aa, Homo sapiens
MQKDEERTTQNGKEQSNAPEGGTPRRERSGSTARATDPGGKRGAKKEEEQPEEDEHSIVKNTKKGGQKMHAGGTARTYGSSTDYKKVHREPDEGAHMGHK

SEQ ID NO: 997659 - protein, 211 aa, Homo sapiens
PRQCLAPASEAARPRLRRHYRRGAALRRSPKLDGRRGPVASALEKKTKMQGGPTSLLLCAPMEFKNGYNLRRHEAIHTGAKAGRVPSGAMKMPTMVPLSLLSVPRAERSRRGSGERMAAVPGRLALPEFGLPVAVVDHDLPRGSGIRKETMPARCVARPSATSTTLNRHKLSHSDEKPYQCPVCQHALQRARTAMSYHVPLTIDRRLCTKP

SEQ ID NO: 997660 - protein, 133 aa, Homo sapiens
MGAPRSRIAQKPGGWVFMGACERHAGGPFWLRRNRSFWRLHPGFCSSGREGHPSGRRGPGRVWHLKGGGAWGPFARVAFLLRWWPPTPSSSGPGLAKSREHSSLSPLVVLWGIRETFEGTYRKKRSREKKQRH

SEQ ID NO: 997661 - protein, 381 aa, Homo sapiens
AALWTGEGKYSLRYVFISSVKTDYYSKLVPAEWGIAEKITENVEATLALGNRQRLEQFEELTEEDRKMWESLELPRDLLNAFDQNADSDMDNNNAELRWSQMDHEELSGTLEYKVILATVLSKKDKRHIYHLPLETQCNLLSNRMILAVPRSTHVSKPANAFTEVAVGYCSQGHSSIQQRRNTDAIITSFRTKLDVTLAPAAREHNPYVHAMSQTQSTSSVARSRLPCNKEANQGIKNRGAPHAFTQTFHEKQPCWYAPQTIMDKNEGSINTKHRHYHGGQHNSTGEVLSEREPGPIEEVKNVQNGCQNTAKGNKVGGKKVCLEDLCKKSFRKAERSSGINRVPGGFQSKVEKQDIIGARAHHVSDVMRIRPLLTRVHRSA

SEQ ID NO: 997662 - protein, 104 aa, Homo sapiens
DTLLQSAISHSPTPQRRPGVSIHPALLAPAVRGPHPWPLSILYRGHSCGPSRENPKSRTRAGEHRGVVRLKQGDTTYPGPASGMPLLREQRYGFKPRIAVSTRR

SEQ ID NO: 997663 - protein, 140 aa, Homo sapiens
MDTRRHSCTHATQKVYEKVLSAQARAANGGRSQSVDVHMALSSPGLPLIPQRRGAHKECPQCAVSAPSGKIAGPSGTAICARMSKPIWNPGSFCPRAESRPHITSTSKKLLGVVHSRRSSTGHLRSVPPFYHSLLSARFI

SEQ ID NO: 997664 - protein, 67 aa, Homo sapiens
MADFANLEKETGRSQVKQDGELFTTGGPYQERRHVNCAQGSMGVLPPERDKCIDVDPHLNDSYNGNA

SEQ ID NO: 997665 - protein, 191 aa, Homo sapiens
MSSEENKCVEQPSHQQRKVCEEGTRNTEGGAERQDRRRPLGPGPSSEWRLNRLDKGRRPEAEDNNPGRARSEHSEGRNKRDEGRRRSQEAEKTQERGSGGDSWTNGKWGPVDNLQNARGKKGGKRKRRNQQPNKTQNAGYAQVDEQSVESESTQQDEEEKDEEKSTRSDRRDIGERDGREGQQAEERAKEN

SEQ ID NO: 997666 - protein, 341 aa, Homo sapiens
TDIREELTMCTIGTSYAHRKDQLHQSLGIGDSMLCDSPLHGPSMAVVKTRARAKGVYAQMSSGPKVITSPRSRRPCNIDVQTNAMVGEERLKPARLREPALYVIYFEKQQGADVELQANRSCSRGVIVRFGIRKRFGLALYQWFPFGIDTLAAQMEHRGAQQSSSPVTNVAVEKSKPSRSYKETNAAHGLAGATGHTRPKIATRYGVSLYMAQTLSLKKRRSTPKYCNSQFWYAPVVTHRVTRLSRGYHRWWCAGCNGRSEEQTQRLCLLWNGGRALSTLGEPPPPETKELSVYGVLGRPEVHFLGGKLPSSLQFFTSSSCSVLLVTLQNEATSRDSVAIT

SEQ ID NO: 997667 - protein, 118 aa, Homo sapiens
MRLKETAIEDLQSSRTTVQELAEQFTHTEPMSARIYKTDPQVQNGTVFNKWYRNTNPHEKDVDTPPWGINSLVQDISTYLLAGHRPAHDTIRPHTLHNHYTADPNAAYSLHNDTTHIH

SEQ ID NO: 997668 - protein, 177 aa, Homo sapiens
VWPGSGVVRFSVVGPVATWVPFISLLPSLWHSSPHGDRGGCWIVERMAIRIYKISSVYPAGLMVQCTGMWPSVRSWPGYTAQSPSWLLSRFQKPVLGLGHLPMRALELLASRGLSHVPASVPKAGCRGSTARSTKGRGKNLSHVGHMTTSRGHQLTGPLVEDLLVSFHRSIDWDGTP

SEQ ID NO: 997669 - protein, 270 aa, Homo sapiens
SRRVTMMAAPSCGELADSLLVLDRHPSTPSADSVAGARRVRKHGGPSFAAESAEDRGVQRRGPGHGLGERARSAWATCDKARKRTKTRHIPHSTQPPKDAAVDENRGGTPRRSDQNGTQEPQKGHSAPVDARSTRAKAGSAEQRDKGQPHETRKDATKRSPEQRKQETRKGKTGRRGAHTEGADPEKNSSKPGNQRSTRTQEKTKQDDRGSKPTERTDPAGRAETEENTRDTAQTDGGENRGQAKHVAHARQRGHTAQNKQENSEREDNQ

SEQ ID NO: 997670 - protein, 101 aa, Homo sapiens
HYKGNPFPPSLLASIAFPQAPDPEFQNPSDHILLCSGGQNNCSLSLCPARHGPEDPHLRTTSSRACKLWPWTHPQSEGTDGPDHTNSTIICDQTFISMSIA

SEQ ID NO: 997671 - protein, 57 aa, Homo sapiens
MGRLPGTKWPRDPTTQPPSITYPNSNTKGTLEAPSRKSTHTGPPRGYPTAYGTLQGH

SEQ ID NO: 997672 - protein, 191 aa, Homo sapiens
ADTRAGGGRGRQGEDGGLERGGITMRMVMDDAHDEEAPQGSTTVRSLSAGRTIEARGGNRMEASYRVEAERRTTRDTGDLDQRSDTVAMDVLVRCHEESVIGAWRWPEGRATGREPCEDALCSAAGMASDEHGTPVSEAGKAGKAVSAWEGRDVAGMKDTADKNALTRVVQRVVHPGAYNANNRNGGICKD

SEQ ID NO: 997673 - protein, 137 aa, Homo sapiens
MGETWVLSPGQKKTRILSPISGHPGPLVGKCVRALEGAVTVLFHLIVVVPYLNKREPRPPFPKPKTQRTKHNPPQTPPARLYPGGRAQKQRPNATAQEETTVLHTGRRTRGHKRAIPRRPPHIDGPLYNGTPARHRT

SEQ ID NO: 997674 - protein, 322 aa, Homo sapiens
DLRVVETGFHLVLAGLVWDSWPIRQSTWPRALRQEVAGYLVVALRPPCNRGQKLYLYVFVLITATQHSTGWKRIGCSVSTCGCLSRKDVVLHRQFAPQHVESLVHAHYPFINLLFHRESTRQPVVYVTCNSSKNAWRHKTPAIKTLVTYLGRSLASPVSGAPGPETGDTKPGGRRGGQTKREALRGAPRESQCRKRIDDKGRSSYKQSRAGESDPAQYDRPAKKTGCAVTKDNVVSALCVATRVPVTICALQFDDYTSQPRHDVCAAQVFSAPGDLPYLASVGYIWMEKERSPGSAFVVCNAACQRNIRVGPNLSREILHAR

SEQ ID NO: 997675 - protein, 450 aa, Homo sapiens
GGNLPQWGTPGFWGTQWEKSGVWTVANRPTAVVTIILKGALRESQTRRPWRHAHRREPTIMHRQPHDKGHTSVPGHSRPSETRRVNKKNTQSRPVVHPTRCHRGGTNHPTRHVHRTLTSTARSRPQRGDGESSTPGETPMCSEETGRYTPGTVHRQRAHYSPRGAKPRRLQSTSLETAHRPYAHNGPQNPLGAFPAPDIEDEGATVNTHNRWEPPTVDGGRPHNQKEGNTHRAHTTTRGDNRSTRDQENIPRPPCTTVTASGKEQTCDGRTNLLTTHKQRGPQMNNNPRDKGKPNVHNGRTLETQTTLRGGPPQQFHHKKKSQLRHKTLKEETSHIDQPPRALGESASGRITHPTRRGEQAPWAQTTRHDAHEERELTSVTTDRVRRRTNACGAPAEGLTRRAIRPTRRRRCNRRYNRRGDLTMYRPNRSGDADPTKMEDEAATRDSRHN

SEQ ID NO: 997676 - protein, 279 aa, Homo sapiens
GDLAGLTCNSDVRSIPRYPLLVSTEIATWLEVHHVYCSQIHAREIFDSRRDPNVEVASRCSLKIGLLQSRAVPSWVHSTGIYGGPEELRDNDKTRLYGEGCLKTAVDVINQEESYWRLPWVRKKLNRQRKQEKDRANLMTSMMDWNHENYTLSYGSERAYLGGSPFARLHKLVPSEKGVTPVPSIADLGWATLNVILAKSRPYKVIKLRVCLNAARTTAGPLPGRYHDPYPGRVAAMTSAERTHCRHWEATGYTHKTCKTLFSPRDEPMGKGWQPMCRD

SEQ ID NO: 997677 - protein, 459 aa, Homo sapiens
FTSRSTFSTNYRVPGLLSMSGPVYGARVRARVTLRPASIQALGCSEFPRVSVSRIHQAISGAGIGVSRAWPVATGNTPGVCPDWEGTPRQSRIGRLTVKALRRPAHGPSYPVVHELMRCLADLENAEKAVEDAIESSWVPTLLRIGHGYPPVFHADLRRQFTFKRTQSEGNPERPPGVFLPPLPGANNCPCIRFPATNLTNCPQILCLALSQHLFTETSTVNFTHHRMPSAFGAQVTFVSERHTDPFPIEDSPAKHGSNSIRPPPQLFPPADVGLALRTETRMHFGRGLPSNGEETCHSFLSADKLNTKQRNDTRQCNRLQQQGPFTRGPHRNFGPMTFLGGFCIRGWARAEEMVPPREFHPLRNPSDAKGIPLGATSNSRRAPKSIGLRRPWVFRLKRHHPGRHGKAVREPHRYSWGFFHSRASLDGSKHTQDSVGSPPQHRSLARRVWQGPGSQTTT

SEQ ID NO: 997678 - protein, 389 aa, Homo sapiens
ERTSLEFLNGLFSYVRKVQIKPRVRASSSNRGAPYPPRVVGLSQVCPAGLGRVGRRRCRGRTGELTLVAHECPIAMPSVVKHDICAKGKGPQHNGCSDQNGSMKNRIWMKTTRARIELYTQKAPRHMNETKYRRRRGRPRDSGVYNPGKRHGTSGQPRTKSPQNGNRTAPIYIKPRFPQSDAIVLEGRQLEYCTANGGTNKFAEIMGTMETQSIHTARIYTFTRTESVHPKKRRVEPHQQQFEASNNVEQRYAGTVVDKKVTYRNTETSRRKLDPQAKKTTPEKNSSNRKKTPHTAQRIHHTTKSERTSRHKTQAPPKGNNHSENTTTPSWNTARLRGTKTDHTTPTQTSHYINPPTQLGTLPCQPNNTAHATGDESASLSNHIDRDDN

SEQ ID NO: 997679 - protein, 231 aa, Homo sapiens
TSCALWDIETGQQTVGFAGHSGDVMSLSLAPDGQSRLMSGACDASIKLWDVRDSDVPTEHSSAMNPTSMQWAFFPNGYAFTTGSDDATCRLFDLRAESGAPQCTPDDKDHRVAITYVAFSRSGRLLLAGYDDFRRANIWDAMKGDRCSESSLAYDKRVSCLGGHRRVAWLVSHGIPGNSFPQDLELTGPSPHGSQARRRPWPNAAQVQGQGTCGACAQVPAPFPGPRRPIG

SEQ ID NO: 997680 - protein, 183 aa, Homo sapiens
MARQSYYQRLGPRGSGTFISGQTSELGEFRFTAFATNQVQEDTAPKYGRYNVFWSSNPGHALDDRDGKESPKYLVSAIEPQGPPLNASSAGQGSLQVGRTEVQVGKGMGRFLDTAGDPEQFPFPETLGEESGSDQAGGNSSPDKTGRQSTVPRALEKPWLEGYKKSGYGEQTLSSVKGGRGHE

SEQ ID NO: 997681 - protein, 149 aa, Homo sapiens
PAHRAMPFRCASEVDEDLLLDLESGVPSDHVSMPQRLGGPSEVVRVRTLGEAVQCRMTVNPCVEPSGGQYKGEVSGGRWMNVVRRGRDACCVGLGGGAQTICAPICRVPLSSHSRSRPHMAEEQQLRKLGALRDGTNYNTVSRHQGWRP

SEQ ID NO: 997682 - protein, 113 aa, Homo sapiens
ERTSLEFFMFLKGLLLMKQIQKMYSQAQFVQFTSCGGNRQNDSVQDSSELTQERGLDFAARNSLSWSGTGAGATGLGTGAAGTGYSSLLPQVAWARSVLHIFHRIITFLPFKF

SEQ ID NO: 997683 - protein, 90 aa, Homo sapiens
GQHGPVRTRSVKKADRSLTQQQEWLATRLGNDFHTRQGAVCEEIAMDPPAKELRNKKTGYVTLVMHDSEFHVEGTANQVSPSMPARQERR

SEQ ID NO: 997684 - protein, 277 aa, Homo sapiens
GLEQSLEHAAVLPGPEPGLFSTQVFRAPRSAMSSGHPCCCWMIGRLTKVHFGLAICARSWCRLVLERVTAGAHGRRDCDRVVPGLRRTMSSMHGWRACAQRFHQTEYICRSARMHPQPCAELPDDTGCTGGLYVLVNNAGIAFKACVILTSLVIFKLEVTIKQNFFGYPRMCAQNYSLYSIETPRGGECVNVTLAIDDASDPLKAAGQSLQREGSCSEYHLLSEELVGLMNNVCWMDTIEAECNLKGRAGPSSRITGLTKIGVHRSVPGSSAKENLS

SEQ ID NO: 997685 - protein, 206 aa, Homo sapiens
MSAAAAARGLVPALLPPLGDRAAPSLSWPPRLCSRRPGLGQPGQPPQQTPRLRWQYSPSPSLDRRPPTRGRALPPHGVPGQEPEGEDMARRNCTVDADRAASQPWAAFTGEDQHGPHEPDGPLYQMHPTLERHGIESPQSSKGAQVHGICHDLVAVHLNTSCNFRASTCDLHCPSMKFHKEQRHYSNDGIAEAAESRAPNLGPIAS

SEQ ID NO: 997686 - protein, 369 aa, Homo sapiens
HRIFQRTTVTCTVWAVFLLLHLREHIHDTEIILRWTRTLTDISFQSNVLFAEGEGQTSRTAALRASIGGPVWNERWGALTRRSHTAGLPLNSVSEASRLEPAVPRAGGRCRGANLSGLQMLGGVHGETVRILPPAAQVAWLVARLLIRLWLKTRDSPVCQQVHRNGCSCMTLRLDRLPSQLRENPVPWLPLLNAKAVLLAVLSRVTPSSSTERLGANMADGWIPPTGLPGKALAEECSISMRTSEVAIGRYHEKGHKPSFWLPGNLQDADNCGKEPLVFTYCLSNKETRVRGKGSLDQALGRAFNPKASVKPSNGRLMTRGQTSAFRTGKVGNALVSSWIGGSCASCFDIGPMKPGWYESENELLFPEH

SEQ ID NO: 997687 - protein, 308 aa, Homo sapiens
MPDVLPNLPLIAIHPRIRLFPTLYQDYRGECNNECWLSLAEKCKFVYAQPYVGVLSKREMTSNESDVVEMPEMKVYHIVGRLPRSMRCSDLVVTSLRMIVMWTQKSPYQQTAGGGARWTPEAENKHKPLQEVKAGQKGGGGRAERRQPAEVGMEPTPELPAEVLMVEVEKRVHDGLPGHRSEGESPDCRDQCKTIRDIIGLNPSLQGVTCLQMMQAVQRVVGQPPLYLSDMGARAHRDWVPVKLQGVLEETNIPKAADTGLSLVKQGIGADAAAQRLGRMSSKIQETTVIPMRKEAHRRDCGKGKEPK

SEQ ID NO: 997688 - protein, 145 aa, Homo sapiens
LPWFTSFPARCRHREIYLHIMVPRPESESPVTPDLHTHLKYRQSMLRVANHGQSGCSSLAILMSNNHVLGDLSGTDGDNAYACYGVPGLVTEAMDVGGADCLLMRTPEVGPDPWSPDSSIYGNQLKREKAHETAYYVLVRNRGAQ

SEQ ID NO: 997689 - protein, 391 aa, Homo sapiens
ARSLTRCQVLVFMSARCANEAGHQPAVHEKTLQSVCRLSCPRASRRRMYRCLARWQCDRLAQQSDRKGADTADFWLGDKDVGMVTSWLTALIEWTAVTAVEIRRSLKVRSLTSELSVKREEVIDGGIPVERIVLYLVLVHRSGAVAGTPVFVAPLPFLAVCFYQGPPATRPLNYQAGEGFHELAEGAGAHGKDISVWSRETRTNCLYLWGLGQLDDLVCFSALWDGKPSMVRRRALKPTTGSLRGGPYVEVLDWRLAFVAPIRTCEYDVPKGTRMVYTPNGKPLGQTSDTNIPSGSIAGKLRPRGSFWLTIRGQFHRWNRFVGKMRLGGHRCRPYLKFHTQNRFPWNGSLYTMHAAFLAVPILVNLLRDKFEWGTPCLIITIRLYRERRTK

SEQ ID NO: 997690 - protein, 120 aa, Homo sapiens
PIQDLVGPARRSRSSLSRERRGTEKQHPGLSSQRSSGYSYNDKSLSALLSIGLTETPSQVVKPGFQFCSIITECFTVSSQCLHRSVLVNLAIHIQRNFGMTIRLVACPNLSITYWLVRRD

SEQ ID NO: 997691 - protein, 362 aa, Homo sapiens
GLTPVIKCQKPLVPSPEGYQVTYSTAYVLVEEKAGVLGKKSQILVGFGAPSQTPHDKTTGLQTLCVQSAQGLGLFKCLVRVDGFHVSLQRCPAGCMGNRQSSLLARKGDVQTNDARLLTAHEEKWDGSQALGLRVPEHEIEGGCLSRDEDVARCKQVDVAKTKPMEVSISGESTRRGVGASDIAQTMEIARVKGYKEGSYSRRPREKYTDSSFGSNVMEDAQAHKGLKGTPVIRYKGFHTGIGERNALARDQSLESLKDKRSDPPLGIATERPLNGSPITDVGTTPLDCGRQLGKQGFGMNIRKPQGIDKCRSPRTGAKTRDIGVTQQSDTSIGRNRTPRKRRRKKRNKEGLVKYHDIADQR

SEQ ID NO: 997692 - protein, 117 aa, Homo sapiens
MLSRIHKNREVTSRGLGDTKYVVSESQGTSASYVVPRKIVVVRVSYIHNCKGYTEIMNEIGRKGPDGVYDVAPRDEYGLPHRKGTKGDPAGPMKHVDINITIKGQENNEWQEEHQSV

SEQ ID NO: 997693 - protein, 85 aa, Homo sapiens
LTSTMAVWQEQVALRPGGKKWSQERKWLIHLSKKDWYDVKAPAMFKYKKYGKTLAHHETQGKQYIASVWSQAVCRWNVSLADLHE

SEQ ID NO: 997694 - protein, 84 aa, Homo sapiens
ICTEQECRMCVHAEDRRSDQAMQIGPCSLCEEKRRPNDHMGPAISDIAGAMSLVYQISEWKQCWERTLGHEIGSGAWFTLHQRH

SEQ ID NO: 997695 - protein, 292 aa, Homo sapiens
TYRRYGFLQAASAYSSRRVACSRHVTGHPAALTIQALTRGIAKVIGKSDPLLMSYPETAKGSDWVPTGCRGEGQGSFYQDDPTLASNCRWNPASHRRDRRTNDGGSSCSTTATVRGSQGQSINRAEPSPRKGRGVPCDMHLHVCRICAPCAKNGVAQSVATWLFRSHYLLRGRACLMERCTMAQHLPTSVTAVPFGPAIYALLQLRRSAVEGFGPLPVYSSCRHGVAPSLTFPGTSGTLAELSPEASTPCARFARRVAFLRALPKRAPRAPRGPKVRPAAWVLLFECTARSS

SEQ ID NO: 997696 - protein, 71 aa, Homo sapiens
SLLGRMAFRLQGCTGCYVPSSVAASTDNFDPAKAHAKAARDIQGVRRVRIRTCALSVYYEEDDSGHFHQIQ

SEQ ID NO: 997697 - protein, 280 aa, Homo sapiens
MGTNIECLILGYNSCSMNVQDLCFPLVPPRLCGQLKVSGSVFISSLISGAGPETLATSPMLCIHDLFWTIKGSIDANQRGTTRRETQRITPGSGHFRAVGGVRITQRLDHRESRLGSGDTQIFPTGSTDERLGHPKRRVPCVRRVHLEKGEEDKKTGTKTSEEDTERPDEVKGTEKSHGRQLKERRPREGAEDKKQTTDRKKEYEQEPTEENITARERNDHNKWDTNRRPLVTQLNERKGDTNDWDTKNNAQYEHEETPSNDPSKRERGQEPKLRVEEPT

SEQ ID NO: 997698 - protein, 390 aa, Homo sapiens
MAASGVLGRIAPRLLPSGSPEAGAQVRGHWWEKHNLHISQEEALIMAGSYGSTHSLSKLGGSGAASYIGEMSAHPLSGGLPAEKAEPWACWGPQMSGGVDKQVPGKRKPQSTRGPSAKALCKQTSSRVPLGPTVQIPEENMGGLLPRKRAEGCPPSSVLETQLSPTLFEEARFTMGGLERPKTLQGPARGRPTKIARGLLSQLQKMVQNGEAQWWAHVRKRGQCAPGGQEGPPPREHKQRDQSTQTHKGSRQHQTTRTAGGISKDYKQKKKHHTPHKREVESNTNAKRHPSPQNRGKEGQQRARKKTWEKKEERQLNEDERQKEGNQKRRSRRGKHGTGAKRTQPQSSRSKIETQQEEKNNQINKEGQNITVPPHREKLTNINRNAYPPT

SEQ ID NO: 997699 - protein, 262 aa, Homo sapiens
SPRVAERRLCERQVLLSWARGGGWSVSGLSLQPALSCLLPGARSVTTASTVRATYLALCTRWSVTQQGTCELHGRTFDSCLKYLGVPCTGALQMCWFAVNCEEQKGVDDPGGETGLDASESTFRTPVNKAVLRNGWRHGDLGNETRKIPEEGLETTDPGQLTELQPDVRRLEGTQMGHDIMHDDMLLAAMSWVRYIGGHKYVEWLGEKQEQRPKDLEILSFQEPKAWNVRSPGLTETRPGWKKTRTKPIKGESEGYNEEWGK

SEQ ID NO: 997700 - protein, 183 aa, Homo sapiens
LRAKADIRTTSCREELPTVGFVSAEELNTHVGRPAYGNQVFISGSPTELFCRSVKVFFCLLALHWSALPHSSWTQDKNLGLAGSGGANIAVTETGLKACPLLANIAVMSNEGGKKGEKICDPYTVKPDFRKIGDGKTVTALSGALWFLASPSFWAPYGLPRCQSVKTVVAESCLVNRGWSTVA

SEQ ID NO: 997701 - protein, 396 aa, Homo sapiens
MKPYNYCKGPSESRWAQKALKYVAMNSEPYRRDTRPSPAYAGPTQTVCGGLAPGVVHTQSLVDIKLSHIYLNTEEECAVTTTGEAPREENGGDSRLTVTQIKPRVANWKVTSKRGGPVDYKDFLYTSRGGPNCAQTINKWHDHGRVYKTPKLSNFFSGCGTFTGGQGHVGEKKWRAQHNGVGLSDEHIQRGSTAYEKPHREQHRLRPQMTRGQKKGGLHRPIHEKTQVSTREGAETIGEPKKEKGSVKENEPMQGYHNLGPKGHRNEPRLPPPHGCRTRTYNVRGRETPWGDSTKGKRACSTESERVNTTQIKNRVYVRRVPPRQRRGEHVARKQRNVSHGEEYWTTARTRRTNYGEGDGQPESAPANKQTSPADILFPVRTNRVRVHDQEDSETR

SEQ ID NO: 997702 - protein, 316 aa, Homo sapiens
GERTSLEFVGSIFSVDRKRINGGVLKGGQQHVEALMSAGPAIVSKGPRTGDVLDPKAIWDEPAFQPPVSSNSSALNWVKPHFLRAVWIFWAARKLELGPWAGPSITCASCVCSLVRMDMNNCGQVVTPVATDARGSFPKAHSQCLIGEPDQPQTQDNICGDADDVEGAGAEPRNMEAICGPQSFLTPVYRYGHQNSGRDLQGLSNEDSVLKIHLTPWWPKKRKMITSLRLFRGTEGPKCAKSGHSGTPRQKPQTLWKYGMVLTESPVKQRRRGGRAPGAKPATESEMTAPAGAVAREWPSAHRTPKAAKRAGKRRR

SEQ ID NO: 997703 - protein, 195 aa, Homo sapiens
WRSLFVACGWEGGSHVSPGAIESRPVLQRVSWWSASAVLESRLIVRQFPSKTPHRAAPRMHRQWSGCLGVTGGCDGVSPTVWASESSSGPRGQSRTLRLEINTDTVALIKFKHKSTKMEQPDSIWLQTGRTRRTLRVTCDLSTKGKDLATDYRNSGDGCAAQPAMSQSQRLKATDGAAGQQDHEALVKHFSKAKS

SEQ ID NO: 997704 - protein, 268 aa, Homo sapiens
MKLELDALLLQCTRRCRPSTRTVARRPRVRQAPGAPLSRVTWGPSSQCKVCRHQRHHNSKVQDWMPDDRDARLHQSGSSAAAHLEHSGRILAAPVPLIIHIYFIVSLTIVVSHHPIIVIPLPKVTNTWYPQGVVPGLTPPICILRSLDRSDDDDYAMLGDSGHKDNRDSDRPDCDRSEHPKTPPMPRSTHAEPKSQLARKRHDTQQRTRSRHSRSETQRPKRRRRLTHRTIQIMHTSENPTRVNNTQEETLNHRLASQSGKIKSWQQC

SEQ ID NO: 997705 - protein, 230 aa, Homo sapiens
QQAATYGGEQRSRRQEQRERRGEVGAGVLQQQVIAGFTAFGRNSEAWQSKAAELEMAVECDTALVIDTLDREGPMKLEVATALVGSDVAGGSEPVKAGAAPALENNHRSTTTTHRSFETTDTDRLQGKGQHMNQIDIPWTHAQPFGLQWDERMTKPKDEPQAKTSDTWAWVLRPSSSLDDAMGRSLKGTQMAPFGVIIVHNPLTLPRVLTFDFHHNMVHSNPISFVPHCV

SEQ ID NO: 997706 - protein, 95 aa, Homo sapiens
MGPRKKLNPGEIPCIERPKFNWAIPEDRDNESNIVGLGQYTIQDVGSPTSYILQRVVTQRQEDNYSNGLKFDQGETNVTHEVASATAECEPWGLL

SEQ ID NO: 997707 - protein, 213 aa, Homo sapiens
GLADGFQVPRRALFFLLQHPVRGHSWALLARMPEKPGRGHGAIRETSEGLGNSSLPQGIDSSFLLLIDVPDGHDRVLVSWVASFMFFSKTWSPFWGAEGSLGEEDRVWRAGTHSADELWACRDSVDLSSLLRIHRNGRGSGTHFLGECRTTLSSSRLKPKAGADTLRGGTEPWGSAQRGRDGTQSGAPGRKCGRANGIDRAYNVKRDLTGRNR

SEQ ID NO: 997708 - protein, 179 aa, Homo sapiens
MACARPTRYSVYSEKGAVHLGQHTVSDVYAVTGHIHTASVNSAHQQSVVASYCSTPTLAAQTDTSTSPMLSVHISRSSDSVLESMGYWTELVDRITQSSRWWDYTATRTRVLYGNMCRRRPNVKHQPKPGADGIRRVNTNQKRYAICSALAASDLPALVMSQQVIVLRKYLNFLLVVDG

SEQ ID NO: 997709 - protein, 265 aa, Homo sapiens
MPKALRGSHSGEREVTTRALKESRAAENCLMLSESVHLCLISTAGAPLGARSVIITPRETPRRDRTKSECESTEGAQYQQKRVRSLPSQLAKRDNSREEERHSEQRGGPRTHNPTHEGGKKQTPIHDPTRGEEHPQRKKAVHTPRRESRRTQKQKRRSTKQHPGSTDQQRENKHKQREGAPPMEQTRGEYHHPAGEANTPPQAANTRTYIAPPTTGGDIHSTPTNDRGYTPTAQTRPTHPHHRAEKLKTNTEQQQPHLIKDKRGA

SEQ ID NO: 997710 - protein, 119 aa, Homo sapiens
MARERRSVNLNELDDTAPLNTGPIHTIMMGPGNPLCLHGIQTTVAMKALGSEHGAAKQWLTKSAIPGTRPPLERRNDIKEDQRYGYTPRKRHGMEATRPVRGSPRETNGMAAHGEDYLK

SEQ ID NO: 997711 - protein, 165 aa, Homo sapiens
MWSSERAFEQIRTSGLQYCKTDQSCFVAPEALRHLRSSAGQSEGFLISEARCGLGKPDAQPIFRFQKLTHGHSAFGLSPTRLGISETLRTVHGQWNEEGKVPMASEQEQVKHNRKQEQTEKRGWYPTQNNTVLTHKGANMRHHPYIPTDRRTGTPMMEPDRDPTQ

SEQ ID NO: 997712 - protein, 396 aa, Homo sapiens
GVMSPEQFSDSHDMWSLVLPDLVKLQHACASVVDSVNDAFHYRHDPTPMPVIQPSPLPYPCDYHTALGMNITTLLPWTCSTTVPAGLPNWIDTTSNSAALGSGMCIACTLILLQPSQPTHAQIVLAVWLVRPLSGSGGLNMAERTKSHTHFLELETPYPGDTRQFITTWETQLPSIHHRAHYGLALDTTFQRGLRNYRQHHTFAPVHPVEQAEEPTGQFMTPPIKSFSQTPATQRLVGAGPAILTEITYVPFNAPRPHTEAKPRWMATPIYILHNHPEINLGAIPPALSGAQRPGDQHTTRVWGRVPHHTGAENTHWTDHAHAHDLLRGATSTTPRDQQRCPHKLTPPLAAQHPAQIHSVQSKRHVTCDTNYPHTRRHDNIAHHSTGTPTRAHITH

SEQ ID NO: 997713 - protein, 140 aa, Homo sapiens
SWVIRRGARVLSFLSRPRRPRLLCDYHVFVAPSLGFSFVRSGLALSPLISPRSRIRSLAPSLFVERPRCSRYTAVQVVLCEHSTIRPVWERAASISVHIDPLIGTKLNTVGLWTDLPRKLTSDIKHSKKPSYFSIIRYSV

SEQ ID NO: 997714 - protein, 234 aa, Homo sapiens
MTMRSVVPMVWTETIETWAFYSSYFTRWASCDCCPSNHDSALLIRLVYVRVNVGSQQRGSPGMYEYTIGERSMAIIDSTYVISYPIAYFAFGFLGDIAFSLGECRIAHVIQRKASYAHWLSARYRTYTLDRLATNVLLEWNEFELDGPIRLSRHDSRLATYTFVGARRAYIARGYKGVTRTICPSWTQIGKRCPDSYGQPYGNTKGGKWFDSPQDGLHVIPVDPLVRALVDAES

SEQ ID NO: 997715 - protein, 117 aa, Homo sapiens
MPTKNRIDARAPTLTRTRTGPLDETHSPPTTAFQEQAQPRKPPRDPQQIPGKSPTNENNNHDPQPAGPSSPGRNLNRPPKRNDPQYHKGTTENKTNNVRIATTTREPKDTSHPCCQY

SEQ ID NO: 997716 - protein, 195 aa, Homo sapiens
MTLYRGQCYGMAQLTTGGQPMEPPSGLKTLSDNWRRDHREAPGLKPFGHIHGLDGKGTPKQGIRGHHPNPSDDSWNTKRTPRTPQNALTQNYLGRAATTAPRTTPPGADTQDGPRPATLDRGSQNSNRRTSPSTHPQRPPAPPTNATAAKRKARAPLTSPPHCSHDNTTAGTSIAHEGHAPPTAPAHRPTRTQPR

SEQ ID NO: 997717 - protein, 144 aa, Homo sapiens
AGLQLCGWFGGASAERAGAGPGCNGQGWPSCAARGGRGGAERLACLGDAQGAGSRGPGRRLCGGGAVGSPGGPAGAPDAELAWAKATAAAGLGPTTLDSGLLAHGPMQTPAWGRKEGLAVAPSFPGKERESTERGTEGEAGRGD

SEQ ID NO: 997718 - protein, 77 aa, Homo sapiens
MVEHGPHAGLMCLVTPYIPFDNPRGTTWAFNYQQLVPYGTLLNDGLAMDELLPPSGTEGLHLPPLGKLSAKGHLWMP

SEQ ID NO: 997719 - protein, 152 aa, Homo sapiens
MQPKVKRGKNGSQSTGPGGKTLNRSTCIATCVLDLTLHPIGIIGAVGRKGLIERANPRMQLFVDTQKLFAKEEKETVANSNMWGTKTQDCDTIKVVRVRKEGNSAAERRTVDLASWRPVYGLDAWNIPEKGVHNPNNFVVDDSVESISEEKD

SEQ ID NO: 997720 - protein, 118 aa, Homo sapiens
MPHPPSCLCHSYSILHPGKEPLRLPASRHPEITIYRQTMISEAETHQPPRLTHLRTGFTVRHETPSGVRNDGHQRFRRVTRRAVVAASGLSFGVLTAVRGPCWFLRPREEPGRKHDKR

SEQ ID NO: 997721 - protein, 142 aa, Homo sapiens
MRSLYLAVVNAMPHRYRPGTVALRVDSSFIRQSIQMLLHSVKLPFQRLVTGDRAGFQIRPEVSGALASVRCRRLSRSVPGGSVRRYLTCVPSYAIAESTIYAQRHPVGSPDTGRESLSDRQSFMRAFVDKVLLTHTFGLQLP

SEQ ID NO: 997722 - protein, 399 aa, Homo sapiens
MESPRRKCKGAISTSLQSSPPGFKRFSHLSLLSSWDYRHLPSRSANFGIWSRDGVSPCWPGDLHSHSPHISQSAGITGISHKPPHPANMLHLNSGISFTAGLGGGEINTLQMHNLGDPCESIILIHNCGSKSLLSLSRVIPSILFRREVNSGVTVVCNTLNIFYTVLQGYAWDIKVAIQRRDWHYQLTEEGGFQGKLIDLKTHKSSVTDPAYRHKERPLPLNHSAGNFITADTYQVSIPYRIGGDIERHTVHTRVNIGRKNTQPFLKLSKQLLEREEHKQDNRYTQMNYTLENRKRDSTATRHQGVKNMERGPRTPVERHSDGTHATPRGAQRAQLARATKRCSAEKRGYESHARGANTNHEMTEKASRRIKTEHNEEQPNTTSDAGEVYTTPRTGKNT

SEQ ID NO: 997723 - protein, 260 aa, Homo sapiens
KKPKEPRVRMESAADGDSSAPVLVVGTYDSSNASDSEFSDFETSRDKSRQGPRRGKKVRKDARQLTWACKFLGSDLESEDDEELVEAFLRRRGECSPCSACLHRRRVDLPVPMFEDNLGPQSVQSGQVAGSMSARCPGGMLEAARVKGRDAEGECPGWARPGWLQREWRAQGYHRRPEGTSPGDRVGKRGRCKCAPGIPLGDGGPRSTWAPFGSRSEEQTEPTGQGADIEADQEGEVATYQKGEAIADQGKGLQVNQRAG

SEQ ID NO: 997724 - protein, 217 aa, Homo sapiens
MQFFTRVCGTEPARILRCFVNNIDDPCLHEYKTLSPRRNSPVSNLQGTVFLVTSPNTDCVNAAGANHWCWQLGAPTHTSATCGRAYSCPRILCGSYVPFVPRNAHQIRPPKLGRVRTKTVKNGGPGHHEKSLYRRLGKGSSTGNKRVCEEDRHISPEKSSGTRIAGYRTGILIKRHSRRGPVTEVSPLKLTERGERKGDDHYGPESTNYDPEILRET

SEQ ID NO: 997725 - protein, 52 aa, Homo sapiens
MPNTPYFGVPCVDAMGPNFGAWSLPLAPKHNNFEPGHSFPKVSPKGQRPFLS

SEQ ID NO: 997726 - protein, 184 aa, Homo sapiens
AEWVSGRLRNGGDARAAGATPDPSRTHLTPQQQHKEEMAADGWGSQWLSHHGRLGLVSLDSALLCPVHGTEQNGLIEIRCLQNDGPNPWIQIIYSDKFRDVYDYFRAVLQRDERSERAFKLTRDAIEFTLQPIIQSGQYPESSLEVTFTKDLHEELTYITAIIEEQPKNYPRIGIIGRVFSGNG

SEQ ID NO: 997727 - protein, 152 aa, Homo sapiens
MLAHLRSSNIVQLHWCYTYLSVHCNMQVTRGATGRLGMIRSGVVMRDYENGLVAGTIQDRCAYRIARSATQLDRRRCRGEYRIVQPERPVAFERFRAPLEQEYAMNALGRSTDLVFGLCVVTTRTVKAGECDATPVRSGPRVEALGRCTHWL

SEQ ID NO: 997728 - protein, 221 aa, Homo sapiens
MKGGRWVIIVPRSSLTSARGSRDLATRGNQRCAQDDLSEFITPIQNTASSYEIGSVLSSDSLHDRRHIIEHEWQVEDGLSRPVKAVVLRCRSRGGRAKYECCARSMGSLQGALCTSRGKHSKLSNLVGSARGTHVDMPVENSSWTKPSFSCKLLPGDKDFLGTQKEHLPRVCNPAKFHEQRCIAVELGIRLLLWHIGHFREEDGPFVWIEHPFGFPLGQPL

SEQ ID NO: 997729 - protein, 233 aa, Homo sapiens
AKLKVYFALSTMGPEGQTLARADEDKFYHLATETGSRSRSAFIAVIHASSRTIFRFLREMPVGLGWTCVLRQGDVLLWELSKVYACIQPYCVEWHLWFQVKSSPQVWCLSSEEHHKENVVGRPVRKELKPGKVDVVLNDGAPNSCGLAGSMMLSSQAPVLTLSGSTVWLVTFLARGGSFITKVNRSRDYQLCYGSFSSCSRVSRPPSPIALALESEEIYGVLQGFLALTRVDE

SEQ ID NO: 997730 - protein, 363 aa, Homo sapiens
MPQNFFATRGLGKKQSSPCLFFSRAGRPEAGGWNTFFRGSRLKLYLPKETVPLSPSVLAGFECAPEEPETSQAWCRKEEPFSEKATFLHQGTGAAAKWSECESVRKLGQGRKLYRLVAHSTGANLSDRCMGGDTRISKGSISTAERQLLYTSSRACSDQEGRKDRRKTKARGPYIKEASHVEQAGENAQSAWNAKNATQTQANLNKAPVILRTREEPPCDEPGEYTKESTENVVENPATPKIMEETRGRGQNLAPLEDLAQIDHPLLRGAPEDGPPDRREEYHELAPTNVAITSGPNAVPRGPRSVGRKRVGRITPRGRKKHSSHSKHMWKHTGDNKQRHPCQHHTRRVGNPINNRCYRTHLG

SEQ ID NO: 997731 - protein, 101 aa, Homo sapiens
MLTLQRDVWKVKHWSSVPHEYHICFANAIEHIGRRHHARAVVNGKASNKLIAKLVPKRHQPLSQEIHCGIALREGIELVVRMCTLRQSQLGPVMSSNTGVP

SEQ ID NO: 997732 - protein, 134 aa, Homo sapiens
SPGASPVFLGAPPGKKAPVPHKKGVWRALCGGETGGNRAQLTAAGTRGGKGNLTWERGELVCKHARRAGGQLVRGAGKIFSLHLFIVTLVEEWRVGFRGRGARGTTPVFSRHTTWGVNNTTVGGSRGLPVYSPA

SEQ ID NO: 997733 - protein, 137 aa, Homo sapiens
GLFGKTQEKPPKELVNEVVIEDKKRKMNTLLTRQHNGTTPTENERNNVTTDSVKDCCQERARQDVCIGSGQGDCSGQRKAVTQRCMHPKHTCNSVLMGMKNQLADLASGWFPDKKSNKEVMKAMQSLVKDSRDSGTP

SEQ ID NO: 997734 - protein, 301 aa, Homo sapiens
MDLSHLLGTLVVMKREAESDETNEPKVCERVDANASNRLLGTKSSELGMMARERHSFKHWCGRRWRHGSPIFESGWSWTFPLSDTMSLSSRGGRCMDCREELDFNPEAGSSAGSLFGLQRVGTWGGKRKAPEGSITTKGNGPKTPFTSTEWALTDPFGAQCSSGVQVPVMRGAPIKISTGPKGPTERSPLKVAVLCTTTGGFTQKCVHVSWNVLTGKRFRSNGIAPFTSRSDPNPGLRRSSAPWNVYHQQKRGKSIPLYTPLQKTGVTNDARWEPPVKKSPVENSTGNTTRLPFQGGPKSP

SEQ ID NO: 997735 - protein, 151 aa, Homo sapiens
MGGLLDTWAGGSGFPGHLRQTRVSGTVQIQIHRVSRELPPGHVKEGQQARNGSRDIYKQIGAAEPGIPKSHLTLPYGIPIQEESQATPWGNPREVNNRRSEWAVDRLGDEGRQRWGTCQYSQTLASAPEAQGVPSTVPRETQRADEKGKVA

SEQ ID NO: 997736 - protein, 225 aa, Homo sapiens
AGTAVALPARGGCCCCALVLGLNAGAVMDVATEEGKEVWDYVSGSAKDAYSVLGGSIDASNSLQELLRTAPGRVASGRSRRFYALDIGNFEEELGPLTRDLKTRKTSWLQAVSSYIVDNPVGTGLQLCEWYVRAFMGTAACAIARAFVTMIAFSRAQTVAVQLAHTRVPITTFRLLHLTRPVLSCRDQHEYARASGSSSVFIDGQSSRRRPIQGSNYYAGVWYAL

SEQ ID NO: 997737 - protein, 300 aa, Homo sapiens
MIAVYGGLAVDFVSVPVATLVGSPQRPTSSCSAFSLQAPQCCAQCALLRKGPFYSAVPQKEFARNSVRAHGTCGTEARVGDYEGQPVHPLTCVCVNAPTARTGEARGCVSTKSLPVLLLSVRPLFGDALPLCEQRSKSSPSVLVRAHLRQTRSGLSLVSEDTKPLNSALHSAELIQHHFIQRREDNDQEVDTNGNLLATRMRRRSFSIDGRPARNCLELTNSATRPQYIPQAVESWRSDKRRAPRQPPTESKTSDWQQPGSYVATAHNWGGSDTKTQLKKQRDPARIFIHSLNNQHVCAA

SEQ ID NO: 997738 - protein, 130 aa, Homo sapiens
MKHEPEAESEKPMHTKRKAKGRLPILPTAHYKGPLSFPREIFPVGGVKHPSVYTERRIHRLDYSQGRVRQHLASLLGMRNREVLMGDRPKTDRKPQFRSHKVSVSSDLLGLFGPQPEGQSALVKREVFAT

SEQ ID NO: 997739 - protein, 164 aa, Homo sapiens
MRRHHKNDRCMTTGALIREPHRSSSHIQQRDQQVHEPHTQGRTGLTGESTDGSQRPSRVHTGLYHYKKEPETRARTGGGWPHITPVPLTEAGRKSPRGGAKDTICAPGPSIHQQGDANAPPPGNNEGETNGRGDAHKRRPPRVSPRVEEQGHPKRKNIGKPTSC

SEQ ID NO: 997740 - protein, 313 aa, Homo sapiens
SGEKKFFWNPPNGKIFPGLNPFFLLEIGFFYGGPQVVVFSSPPLVFRGSRPVAHYLGGGVPYRTLSVPSFLRRHPARLRSSPRQEDLFAWVVHTTPLFWCPPHTNQLLPVMNNDSWVAPLSTLLGVRPTRPPQEVMSDVLSCVIQISAAHHAPWGEGAICVLYGSHDVRPAPRRKGCNPLCAHLFFITPFFSVCELPQCGGQEYEVTSFSGARGEWCPQERRRLPRNHDNVSVRPPYVTGGPPCVRDDGPCEGRSSLWRGGSPFFVSVVLPPQLCGGTPPFLLVRLLWPLCGSPHPVVVDLFSTIVVILPLCS

SEQ ID NO: 997741 - protein, 249 aa, Homo sapiens
EGVPYQRTGLEQKRGLWLKELSGLPSGPSAGSGPPPPCQQGPHPSAQAHTSVRCIKNDDHDYPASVTWCAAEYNHGERSINTMHHAEDVICSERMKETCSRRRIHMDELERGSREVVYHKTTAKVGLHDKRTQYILGERVKKALTKSKARTHPIRAPQRSRRIHDEQITEQQEGQDTDEDVDVTPVSGNHALWADREETQHAQTDVARKSNSTGAEQTQRIRHRAATNNMRLDRPPSTTPALGTTAKHD

SEQ ID NO: 997742 - protein, 312 aa, Homo sapiens
TNRLYYGQCVLADIDEDTEVTLSDSDSVCLRIEERCLLSMTVVPTFWMEARWAPFTKVRLQSWNGDVTREETEVPERADLPSSLPMFNTQRVTRDETTRQRERCPRAHGEARPRLERDSDSPVPAMNSQVREQRRKRKNPRALMHIDMMVRELGFEMKAQPSNRMTDGRQNWAQGKSSEHLRKDCSACRGRHATKCLGTSDAGIDTCYGNRPHHMYKPRLCSYTVTAPSREMKLQLIPQKHLDPPPTHSTLQTGTAQWIKQRTKPATNERHDTTMHKRANAPTYTHPRQPSQHRTTPASSLNPAPLHPTPQP

SEQ ID NO: 997743 - protein, 316 aa, Homo sapiens
VVAVRNDSGRHPASPAYRTGRFCPRTHSNQSRKTWWITMTVLGVQRHASPEAYYITGIIGQLGTAMLASHDREYPVEKKNEADEETFPARYAVGSTIEVLLVMLMKRDFYAPESGKEGIKMVEGGRWSCPYLTSPFENLCLRRFPVNPHDCIVCPRGIALGWAYEARPIASCVGRIRLWIRPPCCRGTCLLSELSRGGYPRGGDARKRPNVGPGVPVYWLMQSPSERFVPGSSLAHMSRFASFLSLGLPAIFTFPILRSILVRSTSDCAPSSVSNFTSFAHALRIVRGRASSTWHTPGLNGFQKFPELIRKALPER

SEQ ID NO: 997744 - protein, 272 aa, Homo sapiens
GVTFPRAGTWARALPRSRPAVTWRPILVGPWCRGPVGLGLTVPGVRVPCVARPVGGAWWAVPRLAPPLSAGAQSPFGLGELIVGSIDRLMCPDPIHLSHGTLQEDRPERDDAQGWLLLLVSLPPLEAMSSPGSTGNSSSFKAFPNCPCLRDDTLSKRPVPASGKAGEILSIQRARDFGAIEVMGTQDPGNMGNRSPGLGADKLVPKEDPQVYLPLKRLGGPMDCCRLQTCKSSRKTSRAPKGDGLACNPGGLLGSLSGILLRVTLWGTKVPS

SEQ ID NO: 997745 - protein, 283 aa, Homo sapiens
HTQQEYSGDEKPVDVVAPTFRTSCDYSKTIASGYLKDRGVLTSHLISVIDRLALAELVSRKASPSYSSYIVIVSLTPEIENGIVLVPFLMNCIHVCASFIALVLLIRSGELARFILVTTGSTKLDLAQHVTARYCVPNRTRVTVDSTFKRRNVEQVSDAALKGGTIANIRIVRKGGSLEKVTHYLPTVHPLAFSRPPPVIAQHNTVGKTPYQERIVEEGVVDTQGNPPSPKGSVLKFSATGKGPHCVLELAPSAKEPGGKPRIAPDDREVTQIVPRVPWNWVA

SEQ ID NO: 997746 - protein, 128 aa, Homo sapiens
KRCFFYNETNPKNCTVRLNLCSFTSLEETDRTTAFQDSSELNPKRGLDFAARGITLWMALGPGPPGWAQAQKATGFLFHLVPQAVPWQVRGAPHFLSELSPFFPFRILRKSPEALLSKGVPSLRAATK

SEQ ID NO: 997747 - protein, 236 aa, Homo sapiens
LRAAVLAYVAPCFPERRRRHHDGSRARVQALSSAGNLNHAPLVGESDHPDDSRQSDRSRGHSTKGGQSELQAWNRINSVLLIEATLDASTVPPMTVLVASGVRTPMCFPDLRVRGLLSGQDSFSSSGTIVQINSCQEVVLGRTYYVSQVELPTNTNVPRTRWVGPSGWHVILLCASAKKAPWHVNHVWDGTFEGIATDGPITKIGGKTPNSCHRGNSGEFSMCVYVDTKVRKRTLT

SEQ ID NO: 997748 - protein, 200 aa, Homo sapiens
MRPTTGSRENCDTRGTTQTTSGADTATETAGPNTTLGGTLNNIIRTQRGALTTPRRTTKPITSRREATHRRHQGKSSANGHQPPVGLSPTQNTIPVGGAAHQHSDASDRKGKQNTPKPPSDQQHHSGRTKPRSEGDTKTTHTVHAGHTATDGQTSNDNKDEDRAEERNRTRNTARPQTGNLSRKPASSIRAINARQIGRH

SEQ ID NO: 997749 - protein, 122 aa, Homo sapiens
AATLYMAMLGIGFLSLTSVPSEFDALGSSPPKGSGNIKQRYRLPESFSALQTSSTGFMCSNTSRTENRVWWQILLFLHYLALNGEENRNGAGPRCGVGMPIFTWGTRNTVMEQEGHRAGLTM

SEQ ID NO: 997750 - protein, 198 aa, Homo sapiens
MPEIAQAVDEMAGSSQLISRLNLPIDLTEEVMYLWLQKQASGNNWCFSSIPVIRASVYENSAKQRTRKANNRQQHTQFNNWCFQCCNKWQMNPYATAGICILATLGSSMVFSGPKPADSHKAMAHGCNAANVHGIPMHTGHTPLLMQDQSLNQVHHTAINWTEDIRGCESEPTEQRTIYTGTTYEITHDQRLPGHERT

SEQ ID NO: 997751 - protein, 280 aa, Homo sapiens
MSEARRDSTSSLQRKKPPWLKLDIYPSAVPLTAEEPSFLQPLRRQAFLRSVSMPARDKPHLFSTHMRLRTAGAATPDVITQTHPQGDRRLVRSEARTVTSTTEMAGKSIRHLQPAHTGKLKPQDSRELDLPRQDKRVSDRTESKPHSYVGPCQAGHAEDHRTTLDRVDCAIPMWQNDTCGRTECPKRAPSKDQGRCIPSLDTYIKTHRYRVSTPGSRAERQPKRRRFGEGPRELEAFPGAGYRPDSQRLNKGPIQVIGDIGTRYTTEEKGRYEQLKLPSI

SEQ ID NO: 997752 - protein, 194 aa, Homo sapiens
MPAGPELGLSQNLMLSPDGSTLTSKSRLDQELKADRRGMRLREQTLMVWRVKLQPGQDPHMAGRELLTLDEKDHGVLSKAHALVRRLVRIGGAVDAGTDEAWIHVLGLKQQRIAGERRLAEAMVFKAGLGQSPSTTAPRADPARDHIRVRKQVVNIPVLCIVPDWHTPRRHIDLSYSWQLITYTGRWPDPRPGG

SEQ ID NO: 997753 - protein, 154 aa, Homo sapiens
EEEGEEAELDGDLLEEEELEEAEEEDRSSLLLLSPPADTCLSDPCMIPVRVPGVCAAASLHGSDALGGWRLGWRLGGVLYVEGTMPSGMMAAMLSHALRTRTVVEAADVTPESGGAVQDLNPGERASNTHTSDVPVHTSFRDNVSTRSYGRQGL

SEQ ID NO: 997754 - protein, 126 aa, Homo sapiens
MWPHTYLGNNPKTYPPNTHPKGVASPPAAEPLTLCRPRQHPKQRRQNTPQVAQKPPKKNPPILGEKQTSHRTRVTRRDPPTQQPGQEEDIRQTENPGRDPEPDKQTHHPQSSRNQLCAPHTPPPAT

SEQ ID NO: 997755 - protein, 226 aa, Homo sapiens
WRRLAYMVLFERIRRMYPGPMGPSRLMGAALLVDCCLVLRSSSTATLVPGYVCENEPHIQLALHYVRGYLGRLWSSSPQRILKSYDGTRRVVKGDNDRIESIGQSGASRDAVHCGYQEHYQESRAPIHEETPDTYSSSLGGPSIRTDQRDNQTNNNTSDCEDKGLLERRTYADAPGTTLHIDNKSTRLETNRKRRGQERRNDHIQVQDIKRHEAKKRLLTGWTTES

SEQ ID NO: 997756 - protein, 206 aa, Homo sapiens
PAVPPHFCYLSQCSGRLNPNLYYCVDRCVSLLGTLRFGTRADHETVHNAQSSHFSTRAHLQSHPSRSMVTMNHTTIGSPELPHTVDLRALPPERASCNKQIRLIYNNAQLGRIRSRAASQLQMTLKHGCRAENPPTEAPTQTTRSQNCRDKRNLLRQPSPCALRRLLELTPTHNSQRFACTLSNNPQCTTCLAETTDPRANLPQTR

SEQ ID NO: 997757 - protein, 314 aa, Homo sapiens
WLPVNERDPLLRLQGHGAWRRQAALQGKNNLYICTFFWGPQVVGVHHTSLLRQLTATRVKASYSHLRQIICVARGYSWASWRDKKASILPPRQAQHQVPGLDSYLACCSLNTVAAILQLFARQYYQNACLVHGWDITPPLDPLKHLRGLSHYFLHSGAPLELSDTSTGAAWLLSPVERESFHHKNIVLVFVQLRQRPRAHQSRAPWVCALAIGRYSVCSIYRRLVFRPHLPGSPFRAAFPPGDPGLSCARCDPGTSSEQAARIFVNPREGTPKKQSGSRNLCGKTGSLRWNFRTKRFPVDRMITNKSCCPLQVI

SEQ ID NO: 997758 - protein, 298 aa, Homo sapiens
MEAAAQISSSIARTWSTDPEAIEAQYECRTTRVYREGGVLKVHPMSTRFTFRSGRQVPRSRGHACSAWGWEQRLHTHRRGAGQSTAFVLSTTAVSGRKEAKYRVSMDSGGAAVSLGLDAEGQVGVRTLQRLVLAMVAPNALVFDGWDISSLNLAEAMRRAKVLDWGLQEQLWPHIGGPAAPGLHGVHPRIHRGQPERSAGGQTSSRAPSCRTQPGSKNPAVNIPRTSGVHKPQGAWTHKSHTVAGRHGRKQPGKRTYMAAKSEIPRGTTTGTLGRKKHLACQTTQWKTTDTGQVCKAL

SEQ ID NO: 997759 - protein, 214 aa, Homo sapiens
MSRSLWRKVGSLVRPLWSGWPYAWRSWVGSVFGASCEGAGGRGRLHPTRCFHSGAPPGVREGPHHGLARRIVVLLFMFVGHLTRRVVQLFWCRVVPLQQCAGYRGCLNAPRSRIWCILRQLGLPLRRVRATMRVFVAIWAALHPVITLPRFGQRAVITRGEGDTNLSQQVRQQLFKPMRLDRLITGPQLHGRHRGHMPSLQPLLCRSYLSDHRH

SEQ ID NO: 997760 - protein, 169 aa, Homo sapiens
PGACDVVRSERGTASRWCECLAVDWARNEPGEIPSHEAPVPAHCEVPPFPPTEVAAAALSLEQRPWRRCPGGEAAHCVHRMYPPERRLERLHESLPWVGTGYSAAFVLDCKEAQYFAGHAVAEPVCYGESVLSLEPTKDDVPRTPFPSQIASQQMELSVCINQQCIPDA

SEQ ID NO: 997761 - protein, 286 aa, Homo sapiens
LEVKVWPGSLPQVSSNDRCRECTHAAGHSAAGSQSILVPVSSGSCQEQVLSLYVWSNGEIAGVSPLQPCREDNRELPESMPGSLSWQRIIKPGSYQARNRGALLAPCRVATPWVALNMVLMRALVFNGQRQGISPSCSMVQSQKRAAFLLNGSGGSRNALGPVSRRTPRAVGVGPHGDPRRRPCDGALSWALGASSPRATGDLRCGTPIRFLAIFDVFNDNQHGPSHNLTLGLATPTTLVPPLMRRHVATQGELETNAYTFRPRTCALSYHLLAPALSKCPSNFCP

SEQ ID NO: 997762 - protein, 161 aa, Homo sapiens
GNRYSHNQESRTIRDVTRIERFVCPLPNSGTGAVTMPCDASAVLREAWLGPLGGLRRAGLACVAGDLIRGQGDCFAGRAVLIAGQVLGCEGQDWSSAGVMAARLLERAVLSPVHRVQSPVACENLVPWQDVANERRRLYAQALLGRYPFVSFDMQGVQDRT

SEQ ID NO: 997763 - protein, 94 aa, Homo sapiens
ALMELMDKETKLVRLPHPCSKSPAPCKPQPYSGTQSPLNVRRWCRCCGGQWSGDRGDGVWRQAEGHWEGSMDRRPSSGVGYQEACGMSSDGLCS

SEQ ID NO: 997764 - protein, 113 aa, Homo sapiens
GPGCGGRRSAGSLRVSQAPRSAEFPHAAEPGRIGTEISRKIRYWRCKGKLQELGAYVDEELSDYIMVMVAQEGKVRSKGQRILCLISREQHNSDSAVMDYQWCIQIELALCYN

SEQ ID NO: 997765 - protein, 227 aa, Homo sapiens
KRHLLGEPPLVSSRVCADAALNVMAVGQFTAACGSPYIVSPVKETRAIEDRVFTVSYREGNATLVGLGSKSILVRVKEDTSYREIYMDYHVLWALQGRNIGSSLQHVADFDKTRTVVNWIKIGHECVKKKKKRNSGVHEKNKNPTVERQATPCSRLDDKHSIENSYCQHLYEKKTLNMAVGTTHTQRGDYIGKRTSPKEINTKRQKLTGHSKERQLVMLIMVVATLI

SEQ ID NO: 997766 - protein, 486 aa, Homo sapiens
TNGSKKTLITFNDGPLCFLAKCLGTRCFRGGTLLGPFWSFGEQALDFLGLGDFLGQKPSGVWDAFKLRGGRSYYGLRTYSSMQQHASSEQSKREASRERIPFRSRGVPLLGKKALLRRSVPFVKAFINSQYRRINTCTLNNFYGPYEEIYKEADSKHSGCTLMGTITPIISRDIYKLLCVGAPNSCGVTVAPNVVANEEVLTVDHHLAPKRHSSEQQLTISGQRAPLEAPETNTLCQRDVQTPRRGHRRDPVAPRWGNKGTKRDSGVSPPLHTLMKTEQRGPHTQQPQEKPPPEDDQGTTKKSHYTKQEVGAATHKVLIPAGAYVEGGPTQRETGNPYDGGHHTPRGRNNLHCTHNGEKGRPDETTNPLMGDGGPPKRQVVVPQQNAGVEDYPNRNTQRIRTPVERGDKLVTTKMVTGGSPRRRCYPRQKHEQGKRQRVGHTTADTPLRTKKRQTPNIMVGGCHPQRRWSIITEDVETNETTSITN

SEQ ID NO: 997767 - protein, 234 aa, Homo sapiens
DVKFFYFKNENGFIKGKKKSFLPGSLYASSTSNTSRKSRPVAGGDVCGKPGSGRRGTGAPARTVATGGHEGDTKWGEKAQSLRPGPASSGAQLSAQGPVSLKMVYWFTEILVTSSAWEGDTLYTPKGLYGSVKAYPNLECLSGDAWNYRTRAIREPKVLDEVTMVTLLDQPEQWQQETGSSAFSAYQKRDQTGHLASSQLTVSLNLGPPGKTVDKGGLMGKHTGGTDKDGSWEH

SEQ ID NO: 997768 - protein, 100 aa, Homo sapiens
MTTKEGVVYEDTLFGTPWERGMALGTLRVEPQGASEFPLIADNAWQEPIEFWATTPGGKDRLRANGLHSTGRHVENDILLIPLSLEGSDRKQTEHFIRGK

SEQ ID NO: 997769 - protein, 133 aa, Homo sapiens
MAIRGSRDVGTPNEAIGFPLVVRNVVGNIERPGHWPGDFLWLTVVSSPVTLPKYARFCEPHQRVGPNLGGARFRCVIARCGTAFVWPIEREETLCLTNGEVERHERLHTRNVESWAVKQDAFPKLALVCDTLR

SEQ ID NO: 997770 - protein, 207 aa, Homo sapiens
AAGSRVLPAMNAEGSRVDGVDPLRPHQPEGSQYLDGRERPGSEGETRPRKHALKNEITICDGWEQAPCTAGGAELSVRVPRLEHTMRYSLHMCRSAQRSTGEPMNAWRTPSGGVAPRVAANVSGYIHRVDGRHRTDRDQHWIRIGRIPSRGASAGLPSGIVSVAHRKGSAALGCSLVRSAPIRGATTAQSRRKGIGNTFRLATGCDS

SEQ ID NO: 997771 - protein, 131 aa, Homo sapiens
MKRAGMEAIAAQGITSGWHSIRQSQIFCAFPFPLLVYHFFATTHLDHCMHSTSVQGTSETWSNKGNSFQQAMSHPFVKLAPRGFGTKRPEGKHQGSARKRGLSQSLQGLRRAPFPFFVRVLHNRWGSSRPP

SEQ ID NO: 997772 - protein, 105 aa, Homo sapiens
MALKELAPGPSWRSINYQYPRGEPKGSKRRPSGIPQGRERAPEYSPRWGTCPNMEMYTINNTRGDNHPIWVRPQKEKVHTYPRKVGTQIKYDLERAGSNPHETPK

SEQ ID NO: 997773 - protein, 83 aa, Homo sapiens
MRCQGSTNEDRRPSRARRRTKEKVLYAKLRRTHRKLRAERELAEKYRDRAKERRDGVRHNVIMNDTPSLSVTQTNLYGAVGPT

SEQ ID NO: 997774 - protein, 374 aa, Homo sapiens
LKQALLGSARPSAIREEETRRRSHHHAWGILTGKASDAVVTIPIRAMLFDRTDSRDPFRGADRHAEKQGKERTSGGKRRLCGPWGPCMRTCQAVGAGPNFLDCALGLETFSSQGTSQDTERKIPGDRPAVWCWFDRRIEETASAAPWRLSNRKRIKTDVWNRMTRGLIQILQWLTFGRPLPLDYERIRSKGERSPPVVDQIAISRGSHTCACTKGLYTAGCNTVRAGYRNYVPRHIHLEHGPHKILAQTLSARVASVSLNGSRHRGEGPVGKPACCKKGDPDSEQAIVFFPHFIPCRTRKRMNTWRNKCTSRCNTLGIEDTLPTFENQRYRYHYQVWGMETRRRRFLAISTYELRQRLGTLNLPVTLPVGTFGV

SEQ ID NO: 997775 - protein, 99 aa, Homo sapiens
VCRQNTGVVKTIPLNSPKLVKDTDLTIQAYVVIGHDRCRRQGPPSTGRNRDSIRVARVHSTIERNPIARRVSQERRAVVTDGATAAPFKYGRGLYETKS

SEQ ID NO: 997776 - protein, 459 aa, Homo sapiens
GALARKLEDNPKSLKSGDAASWRLCLGKPMCVDELLPVPASRAASACARHEADWWPVVRHQELWNDRRAGCAPARSPMSAQKCAELLGNVKRWAPCVADLPVGGRPWASETPGGAGNGEQGGRGEKEREEERGKRRERGKEREKEKSGERRKKKEKEEETKEEQDEEERQNRKKQSASWEEERRESNKQKEKTWEREGGRGEEQQKELSKTNSSKRGRRERDNERKQRREAGREGRGGGGRRGRTEKTEEDKRERKKRRREETREEKATHGKRKEGTREERRRERERGKTGAEGGRGDERRKTKGREGTTGRRRRQQKKKKRGARNTRKTKEREGESRGAEGGTKQRQERAKDKKEGRKDKRGQGKKRKGGQEEKRGTKRGERGEEKRRGGQEQAERERERERKRARTGERRTRGRGTREERERRKGRKKRGGRGEKRRGEKERERKGGRGSGRRRRGE

SEQ ID NO: 997777 - protein, 148 aa, Homo sapiens
MSEGLAALGARGEPSFNDSYIGTQLFARVTVIMAPWSGLHLAVGNPYRFRRSQGADSLCVPNMGHADYRWLNVAKVLPIRLLTQTFGRTTVHTALCDSEVYRIGPSVLTGQHGAHPLGLQQAGQSVAVSHVANSALARERTMMTRGEH

SEQ ID NO: 997778 - protein, 107 aa, Homo sapiens
GPVRCRRHAGEGAGRADSGRWSPARALRRCRGCPLEWAEWEINENRRSSRIPQLPSTAALCVAGAWDCGLQVVSAWHCVTGAGQARHGELVLHYKSHCGPAGLCGEH

SEQ ID NO: 997779 - protein, 345 aa, Homo sapiens
AILSPMMGANRGAWHWKVYYQDKLSEPAGELRFEIGEGDEPVICRYGLGERPLRAHVHDQDEQFHRDTSSPRLCLWAVSGTRKVRKDSRTKDVLDGWNSMTLHRIKEFCDQSGAEREGPMGAELDTFDVTSREGVRKHVDTAMMLATQDDRGCDLGVTYRQVHRVQVQKSQACIHHESNKVTDSDESSENGKLLEILSLFLQHKWDVTKATQVNTPSTVSPVCGKLGGLSFNIVDTDMGAKVGWSTSLGKNALTKGALSIPWPGATLGKTAVAYHTDICCPNKYNPGKTNGGCNIPVMQERGAPIQYPWRQGCELKEAPRMSLKNRVPNVEPFLENPLATRGTRC

SEQ ID NO: 997780 - protein, 110 aa, Homo sapiens
MRVGFTTCNCVESRRMRLMVARLIFKSVRIVHTMYKAPTACICMFIKIAESSRLPRARVFVSSVAKILPSPCYRTHGAQDDKLDGPTVSAIDGPSPLGSTDIHRQTYRLV

SEQ ID NO: 997781 - protein, 227 aa, Homo sapiens
MSCPRNIGLNTDRCNFPGRLKTKANFHPSYTTRGYTTGQCSEICGAKPQFHAPSVPRIEFPPKQIFEIRARIYPIAPPSNPLKRPRNIRHHIKAGLESSPSKALRGPLETQSPGEPSLYHIVSINGNPAPSICRCLKEIGGPPAGENPRRRSHTRGTWGKGPGKSYLATEDARCTTQPPSSQTGHNAMVDCTHTQMFTNIDSMYTRGNNPSHTRPTVATIAELSHNP

SEQ ID NO: 997782 - protein, 220 aa, Homo sapiens
MLPEHNNQCQEDGGTTRSKGRLPESTLNCDDAIVDPGCPLLRHRPTQWRQAQHHDDQYETPRDIEQEHRVHTDRYRSPRICITQLHSMNRRYNNTNPQRQAKQTNKNEERSQQQRRATLNGMRNWVEISTRKDYVQLWKRPPENNNHIYRHYTIKRKQKQSYQARAKMIPGPPLNTRESRRQNTESSTRRPTPSQCAVAPPCSYSNQPVKSESIDTNNTR

SEQ ID NO: 997783 - protein, 371 aa, Homo sapiens
DERIKSRVCLHASEYEIPDIALSSFTQATDDSGICLCSAHQVATGQSSMQVDVDAVIVCLRCLRVRCVPYHTEYMRCTFPAFETPCYEERPWDEETLRKSALTSAYHVKRASRSWHAYRRRMVCQKNCTNSAVHISQSSRGKQDAGLVRFPWRRGRCRARPCGEGGTYRPVRWGVRGQEVTGNPTCWAPYVHGVPRTGPTKDPEDAHSNFSEDSDPNGDRLEAAIHSMLCVHEMTCMVNNISALHVAVSLSPRIVDTKLYLSAPYCLLLIKPRYRCPWNRCENCISGNKETGNWPRMGKPHGCLYCAKENPRNGVATVACPYARGTVVPIVVVRNQHEDFISGQQKKLAEGMEEANDNEITAGRSVYLGQG

SEQ ID NO: 997784 - protein, 282 aa, Homo sapiens
GNFKIPQKRFIIQVSLESRGAYRQDFWVASAGTRASKLLGLAATRVSYQQGPVIRDEDVFDLLLGSLIHIFLGNEATGAWESGLTDSINRGPRDHHPFTRTRLFTPANRLLAEKQNVASSSLYWYAWRGLNHLRGPPVHLDETLAAFGSGATVCRWSSGVRRPAQTAGGPCDGLVSERGLAGAPEGDWGAPGSCLLGCEESPLPPLPVLHEEDARRSVSRVLSGRFLSRKARVRGKHPVNLAKDAHLDHDECVTFTVVEKRPPVTKGLHGEEGPKPTVIRSY

SEQ ID NO: 997785 - protein, 73 aa, Homo sapiens
LDLNRRRSNSEDAGLIRSNQPERRGIYNIQTTDQQSKSTCERRCDGSDVLTADMCGFTVGRRDHRPLTFQIGN

SEQ ID NO: 997786 - protein, 100 aa, Homo sapiens
MSLRSLAVEALPTLRACVPVLVAPAWRRHAAHASHPPSPHLGRHAAIIPRTPVEGFLSRALRSPAVSLVDRAQSCALAPCCCGSLTYTAGAYRPFSVVFP

SEQ ID NO: 997787 - protein, 236 aa, Homo sapiens
MLGSELPELGEGRVRPRAHSRRPVTRAQDWRGGPGPLRQALCQGWLSHFTHTSHQKLQGPSSNNFQPGANVHFSVQNLILEKRDTRGNTRESRVEGFCELLSREDKEEQARETELSQTPKEKTQRSVMRNNREEKQTETVRVRRDPGCHNPRVLGTRSSQGLSGENRPVWSEAWEWSTKNRVIHTATDQRRSSVVAPPWLTEDQLGAILLAQRVCHEEGSREDVAPGEGGAPIAVV

SEQ ID NO: 997788 - protein, 46 aa, Homo sapiens
MRDQVDIIVFYSTHDILCTMVDTCGGPPQMKGPIKFCNPPEIPGYK

SEQ ID NO: 997789 - protein, 186 aa, Homo sapiens
REKVLYSGICVTRLAGVLDWEGDSKEQDQEGPQGQPMPPGTRPYDRRGCGRIDVLDGSRKCVVPVGPRVSGSVCIFLSLSSGIVQDQSLTACVRVALRVAVSARWVLRLLCQSWPESLGWSVWVHCANVSLYCGELLSYVPGVHLGYDVLFTHTRPSITMCGSNNVVTPQSIDSVAGDPHRQQGSP

SEQ ID NO: 997790 - protein, 66 aa, Homo sapiens
VRLLDEAAVSAAILRASAMPPKDDKKKKDAGKFGQEKTKTQVNKSPGAGPKRRSVAPRGKVRDKPQ

SEQ ID NO: 997791 - protein, 250 aa, Homo sapiens
PGGGFPGVGFGFFQIRKNLLGPLGVPPPPGPFSPNPLAFLLPNEQIPYFEGNHYLFKNDIRVVEASHTYPRDRNYKSTCLHIVLVGGWELPFDFVDPRCPLHTTLVNAGHFISRGRSPNIKTPFSMCGASSPASPSPLFVPILPHISAPRCRYEGIWSGSCFPHKGGEEPPGVKRWGRPGGAPVVAPRGMARHRGGDLRREGSIGERSAPRGAGGLPAAPANTWAAGHQRSTEATPQEKRRAPERLRGGR

SEQ ID NO: 997792 - protein, 250 aa, Homo sapiens
GTLNLFYWAWLLPKGSPGFWLGLMASRTWCVIVSQTPFCHPLSGGWWVFGIVFRMEVAAGPRLHQGLKVLAILSSRAAVGGRSQPSSFDLDCSAGPHYSGAWRVYLLPGSVPARDSGVQQDSRGAASILLGRRGPPPSLRRVPPSVAFRFSSVELQVDLQGPGLYVYSSVSVVYRSLQPETVWCPRGCSPQSVETSTGLAPLGSSRASSSYGGPGLSAMICGKVLRLGGHLPPRVTQELANLGLKAFNFL

SEQ ID NO: 997793 - protein, 131 aa, Homo sapiens
MGSQRRQQLCAGERQGPVRNPSYTRFVCNAVSCLEPTRKRDVKDQIDESIRDRYNLCMMSHGRHQEIQLARSCHTLRGHGGWPAPWETRRPIVVLSCPVVFDETAVPFPWDVHDSCRSEKPGDRLDLQRSY

SEQ ID NO: 997794 - protein, 128 aa, Homo sapiens
GERELVSSFVFFFILTNEKSVIGGGLLRQQRWSPEKNAALAVREGFRWKLQAATLDTSSEVVAVGCSRYQRRGEAEDTWVKLPHLLPMPIPLDFAFSISQEISGKLDYNNMAFIGVTQIDRDYQKQPS

SEQ ID NO: 997795 - protein, 285 aa, Homo sapiens
MERAGLSGHELPVRLAMKSHGIMKQMELDYGWRVRRLDERDTSKLGDRLWSDFFPSPPWSRRPGSAPSEALTRVQLLGFEYLETLRQTRGFPLVRRSHTNVRMNTHRFGTKSEVVQPKPYYSLQDAACSPMGHGPSSGPADNPQASIPGNAREPAFNGASTGNSEDRSLRYLSVERSVGPSPEWSGRWASLSPFRARDCACPPGEVTRRTNSARIRDTSQSGITKPQYVLCPEHCPLGIRPRSDITYHRCEGTQCVKRRERKTYYALQYISKASLSCACEDPEPT

SEQ ID NO: 997796 - protein, 118 aa, Homo sapiens
VLRRESSGFPASTVLGAEPGVSFLHPGRASIVRPSVTSSAAALGLPPRPRAGQHPGAARGNAPTSAPHHLVASMTTSRPTIGGAARTTIEDSEAADQPPDTTWSSNASYVYLSMSYYL

SEQ ID NO: 997797 - protein, 139 aa, Homo sapiens
MAWTFGHVYTAAGNLEEPQGMSIAFPKRKYRLGERRPPCVSQPKDLSETIRLRSHICNSWTLNVSTGPVETTMGYEHGPACATTRPVPPGEYWQSGVVRCDQGGTPIHIQPLWCNHPAGTPRAVRRELAWPYLVKTAAC

SEQ ID NO: 997798 - protein, 303 aa, Homo sapiens
ERFLNFMEKANDNQLPKNRNAKSHLISSASALFLKRSRALDLSTSTVSQESPCWVLPVCCPRGSTLKAGSGGTSPGQALLYAESTEAAGRHGKTPALWDDRELLKEDWRKPGENRWEKMVPPHCWWDKARVSSITSGHCRGMGAHKGLERIFPIKLEAGLALGSTFSAMGRSSEKKVEVGPCRTQYESRCGFTSHSHCGGVGVARADVTGTAGATAGYGMVYGQSSRGFPLRSRGQRTQVTAENYPPIKVNETTHTWNLPEPIQNLRMMKISGHSLEPGRIFKLARGYPSLGYHKRLTAFKAA

SEQ ID NO: 997799 - protein, 108 aa, Homo sapiens
MVLPRANYTLWEDAPKNGATPQHEQRRWFAPQKGLPPRAFTPPTPNQSPNGTAVKTPHDPRGPTTSAPPRNHAPIEPARIRARVETPHTYQAPPTGRRDTCLQTRAHT

SEQ ID NO: 997800 - protein, 96 aa, Homo sapiens
GGSDQNMGPRNWGSFPRAFGPAFQSSIGHLVANYDRPEDLVLRSTRVSNLVTSPKCTEGSGYPDPEVGLRTLPTWVQTRAQQQYWVQAMRALMGIH

SEQ ID NO: 997801 - protein, 113 aa, Homo sapiens
GSLGGMAVCARLCGVGPLARMSAPSQHAAVGTVLMTCGGRLPIPELRALRRMRIRGLCAGVRGAVLCLRAPRPRPRADRCWSWRSDACWWRSSSSACRGTGPYSNALAAGSCN

SEQ ID NO: 997802 - protein, 271 aa, Homo sapiens
RIGELRLPGVGPGGSPTVPGCGEAAPGPVLWQPANPGALRSPLRGSACQACLRWTRALKSEPLRRSQPKSCRPCPGRGGGRTEAGDWQQGAGRRKERRWIPGSMGDLDERETQVHWHGILKHERGDDLRLDGLLVHEKIRGRVSWVETQTGAKRGMSLGEGIAIWQKAVRKSSKAPNWEGDGGVRDGQASSVGNAPDNASDRDFAMGGHKHVCLPLTRANGEPVSPWTRRTPDCLERHDKAVQSSTIRAGHGGLLAIDATSGGVIGRLEPR

SEQ ID NO: 997803 - protein, 74 aa, Homo sapiens
EHVSHHPPDAANMLLSKKWLDMRPEIKITSKLRGKYLSIMPRSVPVHCNSMQLGTTTLGRTYHNCTQHYVGKCG

SEQ ID NO: 997804 - protein, 166 aa, Homo sapiens
MWFPCGHYSHQGVVLVLAQLIQELVANQSDSGQVKVHVGVVLPMLRGYVIDFLLQMSLIPRDLSPLYKISRESCGVRWGLVWLHDESSVAGKRAECTRGCLSDVPHLLAVYKEGVLCPYRVMEYSPYKRVVAWPDPVGLSENSAAEGDLTTRGEETFSSTRGISKR

SEQ ID NO: 997805 - protein, 228 aa, Homo sapiens
MSVPLCRLNLTPRSSPITHTRCPRVLDYAYLTEMLRRPHPLAASEDVSWESEASCLSLSEPMEMIRGLAMRHWKVGFRRSSGEKVWRGEEDRGKGRKGRQSIGPYTSGFPSSRDVSTDDSVEIGKQELHLRQVDPWEGSSSSHRLLDSRRRSVMRFLDRDVIVACYVASIEELASWGLSLLAIATSHVHSGKPMNKYERPGATESPEETSSGIPGVKLREYANTRQRS

SEQ ID NO: 997806 - protein, 448 aa, Homo sapiens
RLVVTCVRLWLLPERLLSGISERPFVAGASARIVIPAWIKAAGTGRDAGEQLAREAQAIPNRDLTTAHTLLHGLSTTGGESLDLDLERPSSECIRPLQCFFRLGRTEWRSIRLECRWWPEAPRKDQIAEVSLPRSKEVAREATATALAIEEVKCHSDWDVHPRPKNVGPDHAVGDLTRSRDAQTGRETYKAAYSCGMGSTLSGPGRPPPTDHRLRNGRRATRQRCDQYASPRGRLLPQDCIRPEGPTLSGDRNWRCGGYLNARKVPGFGMPRRGLAFELGTYALGRRPPAELVSLRPCRASESRLNGPGVPAGVGPLSPGPRVLPGLGQERPSAGGPEEHFAGPATLVSRFSLLCPWGPLAAGSWEKGTPKRGQRPLDKPEGLIGRNPRAYPPGVAFPTGRVRLEGPDGFLLAPWEAGCMNLGVSTGPTLAWPNWPDWVYFWALKTVI

SEQ ID NO: 997807 - protein, 392 aa, Homo sapiens
MCRSRETLYGKMGARIIYVSTAGSGVDASTHFVYLPHRGRTRKGETHPNKTDFATVQLVLFPVVWGPKYTEPTLAVLCLNTRHANAHADSKFMFGHRAGKESVTETRCAQRTSSMCECPVGSLHKRALLCCHSVESSIESLGHQGGPPRHNVTFYKEDSKSTECNSKVLTEKSFVLLPPNNKLCRRTQLFAPHRQGVDGENIYGLVRVCARVYQPRIRPVNTNYINQPARGTTCETFSLCRCNKTAVGGTTPFIKYNHTKNVGSFCTINPTKVWLSENRARPLHTNDISDMGRSGSVMRAEPTPLVVSLRQRHTRAVTNRQEKQQAGGASKGRRLAWLRPLDTRDNNFVPHITTHTRVVAGVLQHHRFGVHHIVSGHTPWGFMPPIKCGCWC

SEQ ID NO: 997808 - protein, 38 aa, Homo sapiens
MTRPPPPFVYNSEGERSQIIAQPHGGEHLPLNAQNRDI

SEQ ID NO: 997809 - protein, 179 aa, Homo sapiens
DSTQSTWRGSSVLRQGHICRLRGLWCPQYTLILWTRPAVGRAQLDAISEKVDVIAKRVLGLLDKIWYDFTSGYAEMDELRERYHDTVWKATKYRNVRNILRMVLSGQQQGPPVAEMMSALGPIGGYGKRIQNGGFQLGEDVSGMCDDRQFDPCEHVETDCTRGSEGGLGTDRERLLNGN

SEQ ID NO: 997810 - protein, 100 aa, Homo sapiens
GGARRHGKPVFLLNKLACQNAHPEELGTWNCPLKRDVNEAIRGWAIERPEIPTIIAAVARNVVPDMINVGGWVDQSHRIIVSRDARVGFVHVRLMEPRFI

SEQ ID NO: 997811 - protein, 387 aa, Homo sapiens
MPSGTWHGDPVGQMPMYPDFHMPSCAISGLSWLSAPRRRTYLGHVWASQSCVALNGQCTYVRWTCAVSREFAVFRLQAGSREWSECTIGPWRRAARSYYPRARFRARVHSLRPSRGNEAGRRTVPTALHTEPALRATFNAWKPMRLKRHAGVEPNEITRVRVLRGQANESSCGDSATSGRQTWTRREAPHKVGCPGTEPIEGGPKCTRDCKSCNYQIVKLRIALDKRGVLPRRSWLCLAGAHIYTHLSDWREANKLCPTVGTCSVLHVGFLHKFVNTPPLWGARGFSIVGYIVGVGIVGSQFDTVNAFPPWVISERRAEEKRSVARLPPFAPRPNASLLASQQWNIPVIRLQRISRVALSTRVIHVWRANTSLDSVGIVRNKIDVST

SEQ ID NO: 997812 - protein, 211 aa, Homo sapiens
MARGAGGSGALWGGGVRFLFTITGFWLPRSGAGPGEWAAIAQVGGGLGSGRIRVSELLLSVAQSILCEWGLRTLGGVQSFRVARDLPLNVTTQEHSCGRSVCRLQRPQSLAGESGPVVRGEELGGPSELLGLKLLIESAYSSVISETVSSSDSDASIGEMLQNSGGELPSTGGDREPSEACGSQGQGGRSREVLPWGGTLGTMTRGGSKSL

SEQ ID NO: 997813 - protein, 205 aa, Homo sapiens
GPVSASTVWNLLTPCSTAAWLLQHHLLRTREPLTFSARPHREPFWGHHLRLCPPPGPVPQTRGPWAQLGTDMVRGTGGGSGAEGAISPDRVSQVLGAERVKRRTGRGRGQKASPATSEVMEPGNRSLNPHKTKHHMECRVTGRAEVTASREGRGACAWDCGSSRGPWGLLRYTYAPVTGLKALGLPTQGLTKPEAKVPTPVTPTS

SEQ ID NO: 997814 - protein, 310 aa, Homo sapiens
MAVFIERLCSCIYEPTSTKTGWASSVTEDSLACLSKKSGNVILGSRPSPDSEPSMTGRLQWTREDTGPLHEGHSKILHAGERGRGCRGNATCNTSSMTNLRAEASCPSERGEESWPLIKKAQKEETLWDPEVQRLNRNTADALRRLVATHSDEGAERDVEEHSQGRDRYRVSMATRGMDEPGEPWKQTRKGETPVNPFSEKNWPVLTVENGPIWGTYTCGQLVGQTLEELLRSKGERTVRWGDHPRNQKGRRADEFLDHKLGERMGNLGESRDEIPIPARNTGHSGRGQRAKRKRVAVDSQKRPKRGPQG

SEQ ID NO: 997815 - protein, 141 aa, Homo sapiens
DKTSLAVMIRRHKTSSSRHANESTHGVELPAPRRGHPHSGLLREAAAVQWMTNSWIDEVLKTLGRCVASPVKQDGHRPQHSGGWLPGMMISFEALCIEPVSSLWQSCRCDDMRPMDVREARVQLNKAWRVEIPKKAPFCRK

SEQ ID NO: 997816 - protein, 169 aa, Homo sapiens
GIAGSEGPLSRHARELALPSRLSVGGVAGLESRGAESEPRASDLGAPRTCYSGAAAGAPDILSAHIPRAQTQRDHPRKKPGWTESHRVTACLKKPCATQSLSYLGGPPRLQTLSDARRPVAGKTPVKGGPCVRGPQSEANRRRTTSKHVEELGDWGPGPVDQDASPVTR

SEQ ID NO: 997817 - protein, 39 aa, Homo sapiens
MCAKKTSKNGPTKAKGATREGTHGKAPGARERRENPEDH

SEQ ID NO: 997818 - protein, 304 aa, Homo sapiens
VETLSRHQDYQLQRGATRLWASVSAEICNTHWDALPYGNQLVHSGSPRELWLSLTGKGLSSCCTRPPSIWYLPLPTFILVHEDKRLVDCAGYWMERKDYGMLDSKTGVGKHCAPLTRRTIDEMTKRGAAIGKGEQASAIACAARTPGRKEKIRSTSQGPVERPILVGASVGLSLGCLQRRTGAMLASIPPGKSKCRWKVVLCCQDVIGLSDPPQGSGMLARVTDEVSSLIAEKRSCRFIKGYQRLKFLGSCSLPKPFLVISECLRGKFPPNDVSCTATVSRLEFAPRTPIGTKSTLVWDHFAIH

SEQ ID NO: 997819 - protein, 75 aa, Homo sapiens
MGAKCNTQGGPQAYYDAFTANGKDIWRSTAMWPRFESGKRVHRINPVWVHIRGGRLYQPILRAKELNPWQCNRGT

SEQ ID NO: 997820 - protein, 202 aa, Homo sapiens
KLTLAIVIQRERGGPKSRNSWESLVYRSERNMRPPRRMSRGLHGQRGKITEDWIAHIDDRVTLVVEYGATHYYLPNNAYSLALYRVVTVHNSQGVVQRSVDVGTSYELVVPTVIPFHIGVSQRHCDPTIDVDELLEADPDGAIRETLILDANRTDSKLLAPIRKHSGPMATWFQKAIQNLGRHANRRRGGRHWSRALCKFGG

SEQ ID NO: 997821 - protein, 259 aa, Homo sapiens
SQIVTQMYDLIRAFLAKLCLWETHLTRNNLAHFPTLKLVSRNESDGLNYIPKIAELKTEFQKRLSDFKLYESELTLFSSPFSTKIDSVHRGAPEEVIDLQCNTVLKTKYDKVGIPEFYKYLWGSYPKYKHHCAKILSMFGSTYICEQLFSIMKLSNTQKYCSQFTGFPVGILYSTISNVMERQTPGRALWWRPAGALLDPNGHGARMTTLQLPRLASSGHGRSWLCSPHGWPLQPPLTLGFTGTSRSLGPNRLSWPPAS

SEQ ID NO: 997822 - protein, 196 aa, Homo sapiens
MCRRPRSGASDRCRFPALPLIDRLRPCPIIVAVYGKHKGPETLCIMDFPIAKGERQSPVDIDTHTAKYDPSLKPLSVSLMINASFPEDPQAMVMLSTWQLDDSQDKAVLKGVTPGWHLQICFTFHFHWGFTLMDYGSRAYSCATHTDTYSLHRNFTLVHLEHPKVMGAIMGDRLCMQPDETGAPYALLHSERLAVA

SEQ ID NO: 997823 - protein, 142 aa, Homo sapiens
MGGNSDLRLSLSNRLVVNVYGPISYVNTSWLWTQQLARHPAYSESLRDTRIPPKGLVPAAATLVRKRHSLMTHLWKEAALYREWNKPITYGPGLRALTRFLDLEPWSVAMITNVHLTSSCPFIRQHQLPKNPQSLHSHQCIP

SEQ ID NO: 997824 - protein, 107 aa, Homo sapiens
MASGDFCSPGEGMELLQQVCSKQLPPCNLSQEDLLQNPYLQQASPESLTALWMRRGLSLNPSKGARLRPWHSDVLTADSSTTIGLQRLQHSHHSSQFKHSLCGTHFM

SEQ ID NO: 997825 - protein, 177 aa, Homo sapiens
GSSAVPRVCRLVVQTVLGRTQIRGLYFQPSDRPPDLPLRLQASVAPVFSAISCFWDLPSSRCLWLASFLPTQSMSSQYSSRIIPLDVEAAVIAAWFKFVPAGLLHLPLSGLSIPTAMMCALEGVSQFYPLNLADGRSCEGYRDVLLEPIVENTALTCRAFSFHGHSIKPRLERMSGV

SEQ ID NO: 997826 - protein, 189 aa, Homo sapiens
MYFAESRLGLSCFNSAWTGTRRYVPPPLAGRPKTMALRSPLHRTLVTAPSVSRRRFQRTEQNSDDTPPPPHLVAQRMTTRVNPRSAAHRTYQPGHQEGCQDKPPEYKAREAYKRTSTKSTPDPNVVDIPRGDGGVKGRAQARKHTPQQNKTNNQQPQCREDGEPRPEENKNESRQKATKNGPKTTHTET

SEQ ID NO: 997827 - protein, 148 aa, Homo sapiens
LSPSSTVSASLQAAHPSHGAHPRLRGAPTTAGACECESVSDNCPQPDKHYQDTPPSITIAHAPSIHTNNDIIHRYNKITTSRNIINITLTPPNYYSYTTNHYLSEQPITIEQTDKSKRITILHTTTTTYDNSHSTTHTHQYATHVLRR

SEQ ID NO: 997828 - protein, 105 aa, Homo sapiens
MNLRECAKVPFQTVLVRKKLLQDIYNARSATYLEIARIMRWHLPGSVNVMDVSCGRAMLGYALADPSVGYSNKTKNVVAKCDAQRDHPMHMTPARQIDAGSKRMT

SEQ ID NO: 997829 - protein, 262 aa, Homo sapiens
MISNVIDKPKEDKREHKTSNNKTDKHTKQTTNDKQDRPQTNDAPHPNQAHTTHRHQSTPHENSTTQRRQKHKTSETTPNAIEKTNDKTAKHDNTNTNQMTHSSHRYSKQNRSTRHNQNEKHRPEQTHAHDKEQIIKQEDTYTDSHAEQRRIDRTNKTETKQEARDTYSRDTHEDRTNKHNTTSTTQYRYEGKRPEKENKNRNITTKRQRHRTHNKPKHTRHRHTKSINQRHTRRNDRQQQQEHTITPETTEHKQQHSPRKET

SEQ ID NO: 997830 - protein, 253 aa, Homo sapiens
CTELDTAVELCSLPVVLIAGSVFSPAAVWDLLRADEKTEGAQSRPSRCIGTYELEMKDVRPGDLLVSLVNRLYQKQWINFVALATGDKGFGYKNSKFRSVESNDFMIQGGDFTRADGTGPAQSIYGELLPLMRTSNVKHYGPGWVSMANAGKDTNWSQFFITTVKTAWLDGKHVVYGKVLEGMEVVRNGGRAPKDKTAENKPLNTHCDHSQNLRQDSECTQSPLPSQRSMAKGHHIYRGDRLCTDLVNPAHGL

SEQ ID NO: 997831 - protein, 171 aa, Homo sapiens
MNLTNRRARYPRGKAEAMPILEFHIDNRVNDLDVGSGHPEWCMPLLKVRLSQRLERSLRDSEIQTRDVIQDTVSYSHFKIPSPCYRNRGPTQDTFNGDPNRFEPQKACPFAPPRYHVASNSETLDTLITPTQRTTTSEIQRREKNQHKGNECDHNVEERETNKGEKEEKQK

SEQ ID NO: 997832 - protein, 83 aa, Homo sapiens
ARSQFTCSFRPPELKGSHIASVRQVAGTYRHYAAHAWLVCGIFVETGFWHVSQVTLELLDSNNLRTLASQGAGDCRHEPAGLA

SEQ ID NO: 997833 - protein, 116 aa, Homo sapiens
MTDFRVYTAQRQNSKPDRTELNYIQAILQDDLDGLYTREKLLNANHLYARLMLVLSAYHTARVRITRNILPCVTYTCHGRYECYTIAPIQCCQNGLVGDANEELWAPFTASNLVAP

SEQ ID NO: 997834 - protein, 258 aa, Homo sapiens
GNGVWLFWPRLDCKGIGLQLVETSTSGVQGNSLASASQVAVIYRACPTQAGATFGYFAGYDRGIPTVCAPGRVLKFLDLKSSGLAWASQGVAGLTGCDAIGTGAWHQVLYGPWSISGFLALGNPNCVRCLMLTSFETLLSTFFPTYVFHTCPAAKTWAPFAADTACPVSNLLRAQNVLIYTVDPSHLRLLRIFVDTPIPYWVNVLGFTFTFTFRGGIQPCKLPTALAALFVFDHTLLLEPVPPFGDWRYFRQQAPFWA

SEQ ID NO: 997835 - protein, 111 aa, Homo sapiens
TTVREVSRALSLSCATWRLLSEKLIAPVADTKRQEFQTIQDHCMWVLDKLRMACAISILGKSLADELALDWHVWEEIELKGEMIGLCQHGVAYFSSVAPIALCCRYNDYLV

SEQ ID NO: 997836 - protein, 423 aa, Homo sapiens
ETQDGGCGAGGRQRLQRGSRVLGGCSLADCYETSCRYRRFSSSRVCLVPNIPPIVFRPVTPGCTSSRVCCANRLHGTAEHTVVDNPECTPTYWHLSGDIRRWLVLTKYRFGEHALSYQAERNSLFKFMDSTISERRTVAFRWDIVASHVYMRHKIRRVSTFLPRPLICASKRERVLATFPLHFSAVCGRNGSAGGSNSLLEHCLSDNAKVGTQLEPPLVLLLLGGCVVRGITPVEHGSLVGQAAGELRFLWHYNLLRGLWTMPWGFVPGQRESHPWVCKSEGKYEQEAAALVDTHFGTRPGDKLETGRYTKEYSGQGPWAIRGNALVTNRRDRRGVRPLGNSHAMQGAQYSIDQFATDRKGKLDKFIHLVNYSLGSDITKVGLTGTIEPQGVVDGCLSPTPVGMNIGSPPTLRDNMSGINEHT

SEQ ID NO: 997837 - protein, 226 aa, Homo sapiens
KLQTLAGSCLCSATCNTIVSKLSNHVEPVKQKKNVGWDYRDERMTVTGPTVLRPLERVIQYFSVEQEIQSQRAIVVCECAHSSCVQLLLLVNAIAGAWWFAGKMHNSSICTSSNLTHNLFPDSMTATQLLVPSRRCKEDIVPYVYSVNCFSVRTSSLSLSLNLDTRINEARIYGHLYAISCYLEKINTVNRNAVCSFSLNSTSHCIQNCSLVLPFKMFRVDTLIEL

SEQ ID NO: 997838 - protein, 128 aa, Homo sapiens
GCPDAERKAEKVGNTIRFHPSRKPCRTRCRYVDDSRGSVGVPGEAVAEQAERLRRNVGGAQVKKVPRDGMCDLQQLKKETSYLCAYKNVMGAEKSLRGEIISSFDQKRRNQREEKTTLKMIREYRQNG

SEQ ID NO: 997839 - protein, 178 aa, Homo sapiens
MARQTILYPLCSRLAFPIPRSFPPVPVAHNLFPASTLRPKLRHALAPPSRPAPHPGAVTTPTEYLTRPSLPHIAEHRAIREARKQAQTVTRVVHTLLYLNSPKGALHELGAHTTATRTRVTGMSSNNEAGKPREPPPGSSPLDTTSNPQNGGHTTHGEQHNAHREAQRTTNQRWAYAN

SEQ ID NO: 997840 - protein, 363 aa, Homo sapiens
WNLAVRAVALRQTLPAPSWSLRNLAPDREPELEPGPAGLLSARAAVMLHALERLMPVLPMSRECCLPASALPCVCPAAPWRSMWAVALCVAAGRRAALDGACRFRRCSLLSPPARFAMTSGCAVWLLPQDPWNPMWMQPSPDVYPHNLHNWNGLYKGRGDIEGPWEAVIARHAGHSQCPGARPSTRHEHPGWKQLRGHHGTLPKPLGPRSHQAQKTPRARRPGFGGTPARDDDERSEHWSKPEACPVTDTGTAAGKGEKTPERERPPKEDQRRVRGGADAAALPRGSGENGKSRDQEIKREAGRRWETPIEGRFQTKGPGEAWQEADEWPPGTREVNAGNSPGERRHVKRKRETSSMREAEGV

SEQ ID NO: 997841 - protein, 507 aa, Homo sapiens
SAGYELCARLTDRSLSVVVHVETIRRVKLEFTLMEDPRANGIDRLSECVNQDQIIEHKSREESEVLRASKYISDFDCNQRSAPNRERPQIKIQETRTPPERLEENSTPRNQRTGPPGDDKQQAHHNNNTTAPPKPQRENRAKHQRQHDKKNKEGTTHERKDAKRENRRDPRADKRTNTRRPTDTTNAETTGHDNEAKDTDSDRRTHERLHSKHTDGADREQNSKTERGGARAERRRPEARRTTPNAARPGDTEARGDEGRSRGAHESTQRHQLQPEGDEVRERNHGGRKRAKRRDAKHTAGTGRDDTASTVRRGCQSVTAGKVLSRDQQEREPESGTSKRTRERYKRTDESEAVRNAAGNECTTDGRGGPRDEDSVAGYSASGREQDTRTGECDQEAKIRPRRREKARQRRRHERRSEREEDESLAQQRQEQNRRAREEPTDKKAEQHVGKYGRQAEEADRNGRQQGAQERYKRDQATRQARVGEKQESDDAEERAGQNTRRTQRAR

SEQ ID NO: 997842 - protein, 75 aa, Homo sapiens
AVEGRWLCYRHLREQMCSLTVGQLERGKRFEYSHILKLVHDGLGEPAPAESSQGPLVLSGEVPRNLGVQSQCGVR

SEQ ID NO: 997843 - protein, 244 aa, Homo sapiens
MASCAVLCPDSPSSFCATMSPLPLHVGHADLESATCGTSTCVAMNGSGAHYEFETINLNPMCLGSVEILLIARSPDERLRAVVKPLPINPDDLWCQGAWNALLLQWNNDVQRLGFMGSAWMRVRFVENHVGRNNGEWNRQPVSSGPNNIRREGTCNQAQSASRDPRRPLLDSFGPRDATLTTEPRRREAKLRAANSTSPANAKQKGRERISGRKARSPTLPIDAHYNPQGPKDPAASGEHTQKN

SEQ ID NO: 997844 - protein, 432 aa, Homo sapiens
MGKRGFHHRVSKKPRVANSAPFLTFHVLVKIGLSKTQDYRGVEVSLIMWTSIVLLRTFFQSLFVLQLCRLTRNVIRHRAQREKRLRGQHHNQKNAPCSEPFHKNISAWGLPFQSAVDAGHGSFEKPFIFLSVVRIRRFAIVCAFFSSVYIPVVGDTHHSRGGYSFLKARENFLDTRMGERHTLFSVAYTQPRNFFSQPEARVIFGQKFLGRGSPMLPLATRAFSHPSRLLAHGGKKPLSVVFCGGHRQRFLIRGGWKRRPPMRGKPPRGPESKVLRVRPPVGGGGKARQEALSSREGHTPQIRTYIVEEQLRAHSVVASDNPWSCENTKRGGAPLISPQRRPFRGALFPVYRNKADQERAGDTFIHSSVATPPSHERGVSPRGFKGAKMQKGARRSIWPPIIGAATKRNIYHYRGKRSPVFGPNSGKNKQYE

SEQ ID NO: 997845 - protein, 115 aa, Homo sapiens
SQAWNYLFIYLVRWSLALLPGLRCGGAVSAHCSPCLPGSGDSPASASQVAGTAGAHHHTRLIVVFFWYFYVETGFHCVGRGGLGILTSGGPPALASQSAGIAGVSRHAQPLFYSL

SEQ ID NO: 997846 - protein, 258 aa, Homo sapiens
PPMAETKLQLFVKASEDGESVGHCPSCPAALLWSCSSNGRTFHPHPRLDTRRSPDVLKDFAPGLQLPILLYDIATAKTDTLQIEDFLEETLGPSDFPMAGVLCYRESISTVGNRRFPQCSPRFIKNPVARARTKPCTSRLLRALARLDSVPARAPGARAGRGSLQLRESRRRFLDVRLVLTLADCSLPALSLHYQSDYGVLRTSCRLPIPRSCCGVRRNLDSAMQEKEFKYTCPHSAEIWGLRSACTPLQSPPRVCRQ

SEQ ID NO: 997847 - protein, 683 aa, Homo sapiens
RPLPTTYKRHLTPTTPLHVCALQLLVRYTPALYCLYATTNAPKTPPRPQQLKHHAHGLTNHTRNVLTTLRASNRYAGTLPPPYHPTRNLTPLTPPSTAHTTHTLLTCLQLRKTTPPTPRQPLGPQFIILLSWAPSPETKLPSTPPQHLNRHSTLLAPPWPCNRPSPTGTDTPWRPTTTIPFNIHPPSLPTLANNPYRAPRPPPPFPKRRKTLHSLTLPAPPLSLGTHTRANVFPHSLRSPDPPRYRATHLHAPPPPSLSVPPAPHLAPAPRSPASATSPAPPPSVWASPPPPPPPCPASGRAPLAWPAPSDPTWPPHLETETQHHPAAPHNYNPPPTRSTAERAPHDTNNPTPPGHRPRHANQRPTATDAPTPIYPPHTKQQRASPTNKTHPSPPTAKRHSCSPDDDTTTQRRGRHLPSSHHSKTADPPRRPPRPPAPASRARHLTTTHPTPPTASTTGNPTPLSPLHQQDQPPRADPPQKRIDAVDITPPPPTHTLVRTAYITLLLELTPAAPPPHIIDSLLSSSPNKSTQQLLRTKSTMVEAHITNYTSYTPYLSLPLSANHNHYIANYVNTYINPLTLHILCRNRTQHERRSPSLNPTTSPAHTHRAAARRRDEIHNSQHPRAETLNRDRKASSHRPPHPPPTHRGRPARTREHHLSLTPDLRQRHTAITPVAYLSHATS

SEQ ID NO: 997848 - protein, 317 aa, Homo sapiens
MPSGIGSEIHVDQVPCSPDLHMPLAAILVLAAWSLAETDRLVQPASQSAGLKDDIITVKPGQESVCFSEAVITWMSEARSGTVRRRDGPSSHRLLPAHIPSAPGEEAGMSRNPAEDPQCSESQALVRCTLTSLLMSMTLTQELSDWIHGSPDHRSTVYSCHHVNQVERGLITHARYRVDLAEENYKPWVPTGGLPMGSESCRTIQAKNGPLSHSVQFYPREAPPAHGYTPLPVGPNAKPIPYRFPRVTQGLHLGARTHGAKYTYGTLGSSCFHTVRIHREESLGHRLGLAGTQGDPVGSLGTAWNLHAKGTFKEQDF

SEQ ID NO: 997849 - protein, 245 aa, Homo sapiens
QNSPRHPAAPSRPGTGPPRRRPSRTLRGTMPALDTPVAAHRCARADGHWLAAVAAALAWAGSGSAGLLWAAACGLAAWGLRVVGPGGWSAGRSRCALVGGRGAVGAGALCGARHGWRPGGPGWLALPGSWSVAPVGGLVGCGGSVPVRCSRLRCVCAAVCVWSCVNARAVLLGYAHTRGLRGGMHMVGSRIVDAVAPYVVATVSNLVNVADRAATSHVRACVNRLPWQPVRHGRVKQESALLTAR

SEQ ID NO: 997850 - protein, 248 aa, Homo sapiens
MRSNDERDGRAALPRSADSSRGGPSMLHSELHHSIKRMIRHSSMTWADGMRSQAYADYIGFILTLNEGVKGKKLTFEYQSLLRPLRTLVALLNTLDRWIDETPPVDQPSRFGNKAYRTWYAKLDEEAENLVATVVPTHLAAAVPEVAVYLKESVGNSTRIDYGTGHEAASLLPLWSLQDWGAPGGLTKIAIVFKVFNSGTLKVMRETPGKASRMEAGGQPGVWGLGIDSKFLALHLGQVRECIDHQEL

SEQ ID NO: 997851 - protein, 105 aa, Homo sapiens
MVGFTMYSNVTVMHQGETGTSWNVLTYFPSSIIHLIGNDGVRGGVMSLWRSTTDGGVVRKTGCKTVIQQWCPVAGEGLLCALAWATVATPLMAAEGPYQGGTPWG

SEQ ID NO: 997852 - protein, 187 aa, Homo sapiens
ESQRARTRPMRGRPRDPSRPWRGARSLGRCRLGVPSRGGPRHLRPESRSAGSRLLRGSRYPVPSRAGRLGDRSRKVPLSAQCRVLAAHAGPTGDPRSPDRVPGRRSRTPVVARECLCSNSSGDYKGSECMAEGREGPGPEPRAMAGDIASRMSFISLTRRQAKDVHREDRHQMDAEMEFNCEMKWKG

SEQ ID NO: 997853 - protein, 254 aa, Homo sapiens
GGRSGDWRRRRERLNVGSVIERSGAPELASRGAPSSPSAASQPPVSWPRSPRGRAGRERPSAGRRRCLASRGTWPAGSRGRAAQNVKPKPSCKTGPSGPAAQSSSSPLTSPQGRTVTKGEHRARLRRSHGTQGYYRERRTAGESDIVSARRAREEKRAGNARKATGGGDTAMGRAGRARADEALSTLRAGAAQERDTHHVTRKDSGGSDPGSGPTGSAQGPPRRTNKAGGDSPQPPGGEGPGATEYGGPTTATW

SEQ ID NO: 997854 - protein, 114 aa, Homo sapiens
HERKTSGLVPPVMLSRRATSGEVLVCLCVAETTGAHVDCVLRGYAAFIAQTLSAWVPSAELLTRTAVYAVLCDPRVRRRTRVRTMSLEGLLKRTGGPYITVSLSGPGHRTCVSR

SEQ ID NO: 997855 - protein, 70 aa, Homo sapiens
SIDVDHSSCTRAHRGTLGSATCRVEESSVVLEQSNHVKKSMDYNRNILLAYCFFTPVKQKFGPCSVTSYC

SEQ ID NO: 997856 - protein, 124 aa, Homo sapiens
MAYPPVRKTLVRTMWSMIHCDNIALGIFTKMDYQTRMLHRGCVRDMYREKPGKIWVVFHVGVEEYMSGGHKTKRCDGLAVRRTGVTEKLCDKSLSSRAYTVATFSKQLDQLLCIDCYDQLIESR

SEQ ID NO: 997857 - protein, 364 aa, Homo sapiens
GVMSHRKLVRLPRRWVPRASCLVKRSSSAIRGDRRMSCTHRGTTQSRDRFQPSKAVFLRTTRAWTCTHNRCRGKLEQRRGIRRLNQEEESGETAGWNTCVTIDSASSQVRSGYSWVTMLGAHSSRINAHSVGGFPVYPFRYELDSVWAQNASEFMFDLNIANKDSDLLPVHNMHTHSATRTTPASQGNCKRDALCYSATCAHISLRPKGTPNAGQRHVAQSTVAGHRDPAPGRRAEGQKGEPDSRGTEGHTGTLGTRCHDLREPKEYVAHDYRRLRECNVIGSDGNARCSEREHGPSAEETYIPLAVDSDPRGKQAQKVAPHHPRYRWAQRNIRPEGVKHAVLRAHNRGREAPEQNRVLGGNRR

SEQ ID NO: 997858 - protein, 268 aa, Homo sapiens
AEKGCDAGVWLEEAAMDDEEETVPGSGKSDKTIMQLCHDRGISGEPGQSLTITLEEYKAQIGDKPEMRRRPRRTDRHTMTGGPTNDDPTEQDVAMLYPKRSTKVEHQKTIKDDTLTAACEEENNQHGLLTPMVQTGPSTTPTDNASPMSRNTGHHKVASLGTQDTVKDRTHASSQPVHREESRRHSTSEATKQVKEPEEGRDDRKTWRDARTSSRGVTEEGKPRHRTPRGTTQGPRVSEHPIRWAGGRQQPDLGAGDKTGKLSAATES

SEQ ID NO: 997859 - protein, 138 aa, Homo sapiens
MTQGGKTARLLTLKRLREEVVKVRKVDITVYLFQNDAWRNSEVTSDDQYLSPPVPVTTHLKKLKESYCQRQGVPMNSLRFLFEGQRIADNHTPKELGLEEQKMCIRQFIRNKRGVIQQFRYSFYFFSFSLNPFSISNK

SEQ ID NO: 997860 - protein, 253 aa, Homo sapiens
SIQSTQMTKDIYTYSGGIRGLDGVGSENEENNASQHDYKCVTLSIKVEGTGEVAKARPLPRALPFKRYAETKQLAIHKVTATPGTSTANAVGAQQHAARNTMPAAHLQRKQDHIGNEEGSVHKHTRRETARTNAPVGNERPDRQNTNLRTISTDKPANACEAPIYTSHTQPDDPRTTPTSRGIPQPTADAQQAGAATNRNREEPRTRQSEQQSQTPDLEQGQRHPGEQEASNDTQHRVGRKRHGHTSDTYKIA

SEQ ID NO: 997861 - protein, 57 aa, Homo sapiens
MSNRNSRARPSGYYHCTLTSWRHPINNRYHARRRHYFLIISPATDNTQPPLLIQANL

SEQ ID NO: 997862 - protein, 148 aa, Homo sapiens
MRAHENDRDNSGPHNNRSIHNGQKCLDLSRAGPFLASLTSSNELPKPADKKEMKTSLNTQARIRTSSLWEKCFENKREAIGPNPPVVTPSLAGTTDPDRNSTDLVKVVPISLAPIPHLAPPRVPIGARPHVALPGAQTRKDGTLAPTL

SEQ ID NO: 997863 - protein, 256 aa, Homo sapiens
VRGRPGASAGGRGLRPGRDPEREPAAGSWDSERDPERDPGARRGAMARRGPGWRRFCSLVLLAGAAQGLDSTSRRGQDLHTWPLRGRTGWLRWGRKNIPPDLNEYLYTSGSCQELGPGTHMSDGVVNVMTGINPGTAATVPPNNSRPPCWGPRPMHPSRLLAGIRIQRVKRNGKPVGPSTAPSRWSRGQGQPYNPELEEENGIGIPSCEHGRATVDHRTRREGKKEQATKSHGESHLDGGTMAAGRNKRPRSQGEK

SEQ ID NO: 997864 - protein, 248 aa, Homo sapiens
GRADRSVAVSYSPTMDVCSPTDIGVLRKRGSRSKATNVTISLLYSRLLFDQIIVNICSHQLAAKNNRQPYAVSELLQVIRLVLSLWAYWQQRSGSNSQSSRWCDSPCLARVLYGNMCRGGRMFAPIQNLAAVSRIVHVNTSQKRYAICTGLTSLRPYPALGHVYKVMVLQEVPELSFGMLNDHRLHTATSNDQGKLVYASLHKLTSLELISQNGLLPFSCELTHPGQTRQHHRENRNAVIQAPGAPWH

SEQ ID NO: 997865 - protein, 162 aa, Homo sapiens
LKRRVTRLAGGLSLNVPRRQKTLKESEKRGSPPWQSSRRSPSYGKVRKRNTATLPHVVPASWTGGDLSPRGQKERGRMKERRRGHINVTRCRVVPSMANQTNHGDVHVRHTKCVPTEGGPPRSPVCLTDMMLCVGVTERKHLGHSGSVSKTVGETLAFNSAR

SEQ ID NO: 997866 - protein, 43 aa, Homo sapiens
MGCQPDWRQRTLPGDEWRNHSSYWFQVQGPGATGERKSKTDRQ

SEQ ID NO: 997867 - protein, 96 aa, Homo sapiens
GEESIAPAARWMWAAKKVHDGEPSLDYVQTASQLVDRIWQFHCMPQMHTENAMSYRWWVSGRSINQICGLISRRDHVLIGVIQHRSQANSNGRMGY

SEQ ID NO: 997868 - protein, 169 aa, Homo sapiens
DKQFSGNLINRSRTSQRIVSLTVGAVSDWARGPVPRPIVAVSCLRKSWHSHTPIHSHDSIIQEERFCHSLYYILCSGTDKQDAEEYLKYAKHVIECSTYTSCHRAYTYLHTTVESLVDPITKSNCSQCKNPLIDGEIEPLKVSRSRCHRGTCCLRVLLRSAGYEGKCSD

SEQ ID NO: 997869 - protein, 96 aa, Homo sapiens
TSGYLIERKTLGARVQLMVSGHGHSMYPKRSWCLTYVPIGIYIDQVHVIVPRRVIRIRDIDANFSRYAVSREYLYVIYHKESTMRLVYSKLRPVYM

SEQ ID NO: 997870 - protein, 69 aa, Homo sapiens
EKAGGRHSDRRSGVYSERWLSARAFRGVGVYGGFPTVGVWTCFSRRCVSGLRANLSCGWLRHDRVYEHE

SEQ ID NO: 997871 - protein, 158 aa, Homo sapiens
MLVSPHGLLSSILMNLGRTQQNGRVHTIAIVWRGVQVAEGREGPVSCEGQTPSDPSFEDPETDHICVSSCSPSRSLPYSFAHSMSSMCPSALSWSRDVTGLFRDKEFCRETRCTGNSRNLYIHLAGEECSLGPVIGFVTIWFHARCTAKPNAWSHVVS

SEQ ID NO: 997872 - protein, 419 aa, Homo sapiens
GAARDEWRLGSTKGCKRKHLWSPWLLNACTNRGTSGSITRRLSRPEELPSCTGHENPLVHFRTTTTVTHRLHLSYRSTGFLPLRSNAWRAPTTRYICCELPPAPTFCGHHLTQALPPALTPTPACSPYTVRPYHVRCVLHSENLRSWHLPASTGGPKLGLALLSTLPECSSAQHLRADSTLTRSHASLCLAAPSPHGVSLGSLARASTPLLTSPLFGPSAPLSHCAPTRLPAAAAVAHHLSALRALARRSVTLRPSFRQRCRLVGERFPRLARLAATQPRRALPRDRFRLSARERGPTAFLSPHAYLDAHVSARTAVRLFSPVAWALSFRPPFLCLLILVMDPAELGAARAPGAFAERAHRGVPPLFGYVYRTLGGFARALGSIVGPVWALRRSMRHRLALVYAASPSSCAPQPPGVSA

SEQ ID NO: 997873 - protein, 73 aa, Homo sapiens
HGGSCLQSQHFGRPRRADHKVKIKTILAMDNVVKPCLYQKYKNYWVWWHAPVVPATREAAAGESFEPRKWRLQ

SEQ ID NO: 997874 - protein, 178 aa, Homo sapiens
GSLVGLESGEDRQLLGDVAAGHHQEGETGHWEGGPGVHVLQQGGLHGARYCWGAGPDEARAGPRDLVAVGVVPQVDIGCRVCVPLGASRPPEGRGFGLEPGYQRISRETVTSGQLEVGRTQGLEGRKGCGCVGRGSWTLEGHLAGTWEGGIGGARGKEAWKARASQFRAPRNAIAVVL

SEQ ID NO: 997875 - protein, 40 aa, Homo sapiens
MVLRVQEMRHAQTIGRNSDNLAKNGTTAAMGKKANQDTEK

SEQ ID NO: 997876 - protein, 30 aa, Homo sapiens
MERAYAHVSLLKHWLRGSRLRIGTFTTAQL

SEQ ID NO: 997877 - protein, 227 aa, Homo sapiens
GGGCGKRWRCRTIPGLIRVLSNVTSDHYCNSHICVITEHNLRQHSVMTLMPHGKGGRTSDQWGLLDHCVLRAHRDFPGAIMLVKQTMGQQWGHKSNHTLIGVDKTMTSMQPTDTTEREPRDRLFTKHGKNGGTATMTQSTRCRKSRTETKGEQATHDKWQGTNSEEHTLREPQVNVGATNSNMKQPMWPFVSKREWCSTALHNALSPPMDNMGLSTTLSHRNRNKTW

SEQ ID NO: 997878 - protein, 162 aa, Homo sapiens
ETFFAESRRGFLLQQCLDGTRRSFPTPAGTPIASPPSPLQRNPRTDPKDTRTHASRRPTQRTRRRTTNSPISRRAWRPLSTSQVRQNYHQDSEAAIKRQINLELYASYVYLSMSYYLDRDDVAYEETGQIPFFTNLHEERENAEKLMKMQKQRGGRTLTFRI

SEQ ID NO: 997879 - protein, 137 aa, Homo sapiens
GTRKWRPGLAGGCRGDGGSRSMEPELDGGDGRRGSRLELADPPTAHQSNILRTTHRTCGSDPRPLQDAHLAGSWGAWGVLGEQTGHLNQPGGHHIYTEGNNVEAEADRTASSRTVPHLTSNSEMLHSVPVMASHDAG

SEQ ID NO: 997880 - protein, 342 aa, Homo sapiens
ADKGAEEQSQLLSEEAGVAEMAKHAYGVFFNMIIYSNKSTHISICSTVNKQKLQQGGIQCQCINTKRQPELVAQEIFLYSLYPTELIVLCRMISQTHKPRVDNCTTPYADLAYKASKLSVIHTSQTTAMVLRLDCMHGARYNSLRRCSWHTRRFRHIRRLFRILIHLLRVIDHTLPIYQSYPTQQPQGRDLGDSNTEGSVGYTLTSPIKAKQKPPTTRPPQAPPTALPRTQSNMRTAQSPRDQARTQHPATTPTQAPIPTRQPVTTTAPSPKSNHHQAQDTTTGPTHQLHANSAAPTHHNPPTRHSPPLTNHGHTHTTWPPNTPHHNPRNRLPHNNTSSTRS

SEQ ID NO: 997881 - protein, 114 aa, Homo sapiens
KEVKRDEEPFAFLGSPGRVLLRHVHVRTPKKMKRIVLVDNNVMCARITSRYHPYLSEDPTEDSVERNIRIIVPLNSRENISDPISPFENQIRVTICLTSVKHVILQNVELDTSR

SEQ ID NO: 997882 - protein, 212 aa, Homo sapiens
MGMDPFRQFVCETLLELRDKAHIGDVPLLNFYAIRHFQQKLRAITVLVLYPFTLFSQTLKEFSECQRGEIRGFNYQLSVGTVTKDNQTVSNKYGHADLRHLVIYLQAKRGKAVTFHHEYGQQWRGSRKNELTDTTPMCSNRAKWGAKQQSNIIRQAPTEYTTTSGTSLGPSERHKDATEEKTIIDSTRPTWRDRGTTGRKLATTKRYRRGAQ

SEQ ID NO: 997883 - protein, 78 aa, Homo sapiens
DGHRSPVRTVPWLLLENVAFTQQQGHMGHTGPQGKPFHAFPFLFLPFKNDAKPGGLIPLVSLLFYSQNVVAFWGSGQF

SEQ ID NO: 997884 - protein, 305 aa, Homo sapiens
RYPSRRPGFLRRFSRCSPRTGLQITGFVSECASRGAGIHGAEEAGLGFRCTEQWVISGRELVIVGDGACGKTCQFIVFSKGPVSQRVYVSTSCLKTYVADIEVDGKQVEWALWDTSWCMNSIDGSPECRLSYPSILDVEYVMCQTSLTATDRYRHDIPENSGTAMNVELVEFARVCPFILVWGDQARIFEKWNESAQWGSVANDEIGKPVKTGRMAETCANTNRGIGGHGRVQLTPERIGGDEKALYATWATEDAGPATAYKLGHSSKGSGDALGLAKNHCLIGSKALNAGKYGKVPVISILRCL

SEQ ID NO: 997885 - protein, 93 aa, Homo sapiens
ALKVNDIAIFSFPRQEWVLLSSGHTEPGEGDTCRLLKVMPTSVVMRAKKIAQYRLPWSKSCTSMVSTQRLLTPGVILQAAGALVACSEPRDES

SEQ ID NO: 997886 - protein, 135 aa, Homo sapiens
GTGSFYFFLQDPFVDLAMWPSYLCLLTSKVTEAENVKKLTGTIEQRRMHAACRLDSCTMCSPGDTAKTPLKIIVPRHGLVTEKLHSTTKMPHGTLQAGICEYMSECIEYLRNTQWRDGLLRFEDGDRERLRAYAQ

SEQ ID NO: 997887 - protein, 132 aa, Homo sapiens
MVRRRRNRDTLAQKGPFVRVSLYRTNAQYVRTAQQYVAFQSNRAHNTPKSGGGVQIELTLYEKATIGDFARLRQSPLVRAATLAKSGEGAHPRSGLQGCDRRRMAKENSLAKSTLVKKRVPHQLCPNLVLGG

SEQ ID NO: 997888 - protein, 221 aa, Homo sapiens
MRLESLKNTLVELSTKSYREEGRLKVVTSPILLVHNIRSGTCMLLRLRRADQNSLPVGGLYAWDCSHSMRTVSLHTCSRVLAPTRNSVTENARLLNLNYLSSQSSSAHDAPYASDVATYTYLLVRRRRQYTQFYATAFSMGPKNIWPSSICTDNGVVTASMQRTYRTKNSANRYKLQLHHHSKSGPYLVTHIRQNYMLTYKLTHAITYSCGIKPALTFKHD

SEQ ID NO: 997889 - protein, 205 aa, Homo sapiens
MVARGGAPVREAARARAGAGWGSAVQCQRSARPGPALRPVAVLGLASPIPPAVAADMELLCCEGTRHARRAGPDPRLLGTSVVLQSLVRLEERYVPRASYFQCVQRESSRNMQKMLAYWMLEGCEEQRCEEEVFAPDMNYLDTLPVLRPPPGKGHVDKGPEVRVLDWLLGYQCWSEEPRPLDQAEKVCTSKTGPGLSTPRKVGGD

SEQ ID NO: 997890 - protein, 104 aa, Homo sapiens
MFPLWQIPNACWLIKASLKSCREKALFNTKCNNFQMYLTPMNSCRHNLFHKTHLVCGSAVGTSDTVFNGSVVLPVCHAVPIPLCQHESMHVESTQMCPKPAGTS

SEQ ID NO: 997891 - protein, 170 aa, Homo sapiens
MAAMGSSQAEIERVLCWGIPGYNSRKVTILELFYTSPKIELLEGDASLHSEGMRCEDIHARHYFSQELKKAHGGGATVPARVQLEVNRDASYGVSIGAFAGCSEPTSYKEGTQEEGTIKDMMTNTFVSPTQLHILRTRPSQVAEIGQRANRQAVTLRGKWGLWAGGDHKQ

SEQ ID NO: 997892 - protein, 117 aa, Homo sapiens
PPPPPSLLLRSAGPFSDCRGPLRAAAKTSHDTMRSRHHNAPAADGAHINHDKETEQSTHEKKRERQTTQEHKEDNRQPPIEQKQNREKHKTEENNSRGRRKKTKNNKTTKKEKKKEH

SEQ ID NO: 997893 - protein, 31 aa, Homo sapiens
MNRWDYRFQGYDQSHVCRDRGDDTCRPEDVF

SEQ ID NO: 997894 - protein, 105 aa, Homo sapiens
GKALILLNWEGKQNNPEAQEGQVDLNPPPRGFQPQPHTVALSWEFHSSFTRPGRRNTPDREKRKRRSQMCSLETPGGQLKRRDVSPPCLRTLDIGARERYRQDKQ

SEQ ID NO: 997895 - protein, 72 aa, Homo sapiens
CKLRMTAVCSVGGALECPGVPCGWGTCGGFLLLRFLADGILVAWGSLDDGLWARGACCCQLRDSAECKVPEG

SEQ ID NO: 997896 - protein, 126 aa, Homo sapiens
PDHAVLEMKANFTLPDVVETSWMRFCSFELQAGGSGQASEAVHTRKGRKAGPPPMKSAFDNTMVDGCAIPGDQREGWLRRASQEPNEKARTPMERAKHDETGIPIPAHKVTLPPHEGGPITFTHFP

SEQ ID NO: 997897 - protein, 163 aa, Homo sapiens
MQRLVCLVTQHVSPCRLPPAMPFKSMASGQSIYYLKCRTRYVLAAYRQATAVPTPSKAPPGRDHHPEALTHHTRTGRDSGPKRRHERSQTGRSPRSITNSFALNRIALWEGPNLRPPAPSRALTRVGTRASSGHTLAQHPNLLEGTANRYASCHITPTHKPLL

SEQ ID NO: 997898 - protein, 143 aa, Homo sapiens
MKAETKQAKVPRVKPTRATHSGQNPYSQRTQTHPWQTKGGPQVQPQNKGRRNNGTQATHGNTPTHTHPQQRRNEAKAAHTRTPQTHPNTHTIASSDPQTTHTHHNTPNPVYSANNTQHHPGPAHTHHRQRPHQRTTSSPHDRP

SEQ ID NO: 997899 - protein, 37 aa, Homo sapiens
MHTRRIYPQVGGPPDGADEKSKTSPTMRRGDTHTLGA

SEQ ID NO: 997900 - protein, 189 aa, Homo sapiens
AAWRGSRKRPEPQCAAWSGDSGTVSQSHSSCLGAVGRTRCAVRTVRAGPRPACCFACCLLRATACLPVCPVAGALGPRSDGPGLRCLGGPAYPEWTSSWACWTCFAATRPTVVSEGVPCIPRRRPPTIAAHLQQDRPAGGLREDGGGAAVARMAGAAVTKAEDRAWGTFLPGAFKKLLHNDETVPIGIF

SEQ ID NO: 997901 - protein, 105 aa, Homo sapiens
MWSPPRGFGLSKRCACTGKIAVMDASHGPREDEQGPAVYLDQLESTTACILEYKQSGESIDIITRVPWLCPGPHLAAPQRPALLASLIPECRMIGLRLYDGLFNG

SEQ ID NO: 997902 - protein, 87 aa, Homo sapiens
SGPSNPAGEPAQAPNFLETVDLQITLKNLLIPRKDKRFSGTVRLKSTPRPKFSVFVSWGTSSICDEAKAVVYPPLWTIEALKKLNKI

SEQ ID NO: 997903 - protein, 343 aa, Homo sapiens
ANAQPDAPSVTSLRASARTQEGGGRGTPLGVGGPGLTELWAPTQYVGRGEVDAVTVRRPEAQDDGPRKNGTLFTIAGAQWPSAFGVRQVPELGQGTKGAWPGPLHHGHSRPRQRVADRLVAFAREPNAPGALLAITIVETCVEVAGLERPDAPRHNITRQQWVPSLFKALEAVRLYRRALRPRYAPCVSIRGFTYSRLRLDSVSSGALASSLRVLLAFEKSFSLAAIGGACFGAHRRFPRAHRAALRHPLVAERAIPNAKLPPLPFDPQCRGGPLCQNPFPPYGPAGDGPNWAQGSPGVVTTLRSKPMPVAAIARAGERPLSRFCKGPWFPWSPAGLARGNPF

SEQ ID NO: 997904 - protein, 459 aa, Homo sapiens
CCESGCVVLAPCDVPERGSLMRRHCGAVAALGQTAGGVAAQCLVPEFCGCCTVPCALRCFGGPRTVTWVPASCTMLEHECFSDAWRNAVLAITCKLGTEGYTRRARDGTERTPRARAAAARQPRPSSVVPPRSCCYKGSISYSHVDDGRGIQGQPLNPHNHAILFPSILNSRSLGNWLPRSLRKHCPLRNVQLPWRASNESAPPGGLAPLADPLALFVALQSALGTSLDQPSREAFPPAVACKAIVTSEGFIDVMVVFGWRPPLLTFVRLAVNGRERPTFGSGRNTRLSTTHTRYSRNSPPLNHDERSLRCPHRNYPCGGRHPSCAPSTPCATCKGRDFGAHWRPSRFGRLTLTLSTLGDNSVLQRSTDELNHQHQYSTLYLNIYQLPGHLASNIITDTHSLPPIILTTTIQMLTNHPPTIIHFSPFIPYFRRPDPHITHHCNTTVSTCITNTLHHAHH

SEQ ID NO: 997905 - protein, 327 aa, Homo sapiens
MGRIARGSAGLAEARAESRYPARTHSPPQLPREEPQPCEHQVLCCDSGNHPPQRTLDVHPSSELTVDACGPMLERREETCAALRVFYFQNVLRKEVLPSMRKIVATWMLDGLLRNQKCEEEVFPLAMNYPGPLPVAGARDKEPLLQLLGATCMFVASKMKETIPLYGREACLSTPINSIRPEELLLNGSAPGEQASRGHLACNGPARFHLQALSLSDNAQRGGELNGIIRKHAQTFVCLCATECEGSFPKSGLHWLQASDACGCPHLQGPETLRDAPIKLSLFVINRVQTAFLLTELSQLYPGLPPGTGRCRMKAVWGQAWQARDMD

SEQ ID NO: 997906 - protein, 98 aa, Homo sapiens
GTNKTCLFDKNVSGKGGDNKGGRAKGCSVGRWDAGVYIAGTGPGGVRRLIRARMEPRGQNSRRWAVLGKTRSLVFPGVDKEEPQRPDVEIGGQLSSDI

SEQ ID NO: 997907 - protein, 390 aa, Homo sapiens
GPANGSCAQGAAGRRRALRQASPRVALASSMGPDVSSLGEAWLDTRSCRPDDRMRSLRLGLAESRGHSLGISESGYAAAREGKGSPVNGPGRAREEDIGDWQNERRTGESKHVREDIGTKAVAHVKDTPGKTGKSTDKQGANEHTHEGIGVAYTFTEGMRMSDTGVEQSRCSKRNLGSRPHDNASFDNHNGPTVPPSTNTHRASGHRPNSRWAYGLHVTDSAEENPRRANKRAGATAGEEAHKLWDRRQGRNGVGPPFQEEYSDMVTHFTTTTNVTKRATQVGHGHWASPGTRQLATRSRERCTPEQVIARGITHYLHKKNRRNTGGSPEKERSIQREGQQAFNKATCGKKGDTEQQEGYTHTRLSRQWNYEERETRHTHGNIRSCAQTG

SEQ ID NO: 997908 - protein, 212 aa, Homo sapiens
ETWRSRSPVCSCVRVGAETSPGQGSYQDGLRRPGFAEGPPAGRNPRRKKPQTDRRGGSAGSQPQACADGVRVSLPKSGALVMSRTGLPVCPWAAVSPVARSRGDQNPAASGAAWGLGVTCCMSVSIMGVCVCVCLCVCVCVRARACVRVCVPTTVSLLSLSLSLSLSLPSRSFRRPLSLSLSVCVCVRLGTRVPCAPDAEFRARRPLFWSAS

SEQ ID NO: 997909 - protein, 141 aa, Homo sapiens
MSLVSFAFRWLSVTSRVVNIVREDEFRALAKGYIMQGAEIEFRYSPMLSLYIDTLRTIASLHIARKYLNLIGIEVECLDYAFLRPGATHWNLASQRLGKERRKMREAKYGVACNNHGTLGNSNVYNSRKQRQLILWDVRVG

SEQ ID NO: 997910 - protein, 112 aa, Homo sapiens
MCAGDPPNSLYRFHVNFCVRHCEKASGFPLAHTGNCVLRAHATISYAVDKPASIISHPRNAHISRGGYSAYPVNALYNQVFWYLETSERPHPVQHAAQFNVMSYYVRAPKSR

SEQ ID NO: 997911 - protein, 150 aa, Homo sapiens
DQADLIDIYRTLQPKSTEYTFFSAPHCTYSKIDSIIGSKTLLSKCERTEIITDCLSDHSAIKLELRIRKLAQNCTTTWKLNNLLLNDYWVNNEMKAEIKMFFETNENKDITYQNLRDTFEAVCRGKFISLNAYKRKQERSKIDTLTSQKN

SEQ ID NO: 997912 - protein, 298 aa, Homo sapiens
MESTTMSHVGITQDELNMLASYFHSFHASVRFHEGWMQHTRVLPPPDDLAQDIRSSTTAISENYVCSNTLGVEKPGIVKTHYKESRFYKPLITCRQLHNSYTLQGGLLNLLACGYCNRSLEWANSRKTFTPSIPGLYLHIPHAIANCATRVSPGNSDLHTGFLALPLTTVPPSPPRPTWEEPNLGTKYPRAKLILVPGACNHYQGTRGNDFPNEFPHFTRSPTLGKRAIFCLSFGDKFGNPVRYTLTLTAFRSATTTALARTGYDSHCAKHKTNACGAQHCFALTTPHSHERFIHPTT

SEQ ID NO: 997913 - protein, 58 aa, Homo sapiens
METSVAEGQDQQCKHGAFQEEPYRLLASQDEASAKIAGLGKRPCGEPHPKEHELSLVI

SEQ ID NO: 997914 - protein, 106 aa, Homo sapiens
TVWLEGYCGNRCYLKMISMKVWTYLVLGTLLLVRYSVQTCIISMSYTRISVYNDRARCRVGGSRLVPPIPIIVERVLEFPVSKWRRVTLTVLKVIDSSIGESQART

SEQ ID NO: 997915 - protein, 101 aa, Homo sapiens
IPEADSIRAEMSRSVALAVLALISLSGLESFHAATPKYFRFTQRSSRTSRGTCEYAQNILRGMRVVVVMRVSHATPGASVRSVSLIVDTNVRSTNATYTSA

SEQ ID NO: 997916 - protein, 156 aa, Homo sapiens
MKPGKFQKEERVQGYDKLPFGKHYHPGVINITFFKSAIGAPYEKDTLLERCRLGNTTENTVAPRGIDLPTLPGVTGKTDSGADTRQTGGSNQKRPSVTGTDSEERTQAGVLSLAGVPVLRKCWSHTGGVSRQGLKNLTLGFRAHQAVWHAKACLKH

SEQ ID NO: 997917 - protein, 123 aa, Homo sapiens
MPLHSSLGEQSEIPSQLRNEDIYGYLTIVDVFILPGSTYCVSLYCVCPQGVVARKCPGPQSNALLTSRPPKVARNYMGKILSTAGPFGPCKSMLDIEPVRANWTYVYQFPGYFREAKEERGYT

SEQ ID NO: 997918 - protein, 111 aa, Homo sapiens
MTTGVGLIASGQCDVIVARWGEFDVQMSLFVNSRKLTQWMLDLHKARSMGQRLSFTLQIPEEFQAPELPTEHWSTPPVRHRPHQKTRRARNTRNRPRQDSKSTRPNRLDTQ

SEQ ID NO: 997919 - protein, 197 aa, Homo sapiens
MSERWQAVCDLSDSWHDGIDLHRTKMGTVHLLCTRKLYSQSDELQCLPSVDARIELPFAELRLRSKVMSLMPENARYSVRSNSGEVIRGVTMMDSVQSFINLFMDFVIFKADDGKIVYASLSQKSSMHHMWEQEPTDGENHLLSNNVLRICTLDNIHKAAQGIVLKHGQQWMSFKEWLSLNPGGFITSLASPGGMLA

SEQ ID NO: 997920 - protein, 340 aa, Homo sapiens
MAWLANAPDISRTYSKSVTLKPSAQTTSTTHAQHGNFSLLEQLQFARGLIHNGIDQSPHNDRTAEGNQPNDRTSNFPTSVYRILESFSSGRRTGQPACTSWETDDTGNSTFVMPSLKARPFPHNVDPNSRGLPVTTQHGLVDDTCKTRECGKSDHAATTVLRNTPQLGVAIRQRQHVVDFPHLPLGHFLFTLAVFLSRRATLTNLSGTGTYQPSRTMHQRETRVSYNQKCGQRMAYGKHPVTYEWDNNGPGGTFRRTRHDGKLRNLPTALSGTDRLLDGRQQTSHGPAAGATTGRTNSGAPDRGYEDPDTQADSQASRNTETPTWQRTNCIDPHNTFGHR

SEQ ID NO: 997921 - protein, 194 aa, Homo sapiens
ELGGGHLRRPDCRSYVVRLAVGFSSDEHVVNRTANNGSEDRENFDKGSKLIRKTEHDDRRGISIWPFQKYTEYERRRKVKDSGETRYTVGPSDARSNYATATFPSISIAPFVYFFYLSSIQTACYTVLFNDCTPGAVWTSNSFTEMIMVAFGTGISAFPESGNLKSDKSGMRSRLPRGPLVRISLVPTLIASGL

SEQ ID NO: 997922 - protein, 194 aa, Homo sapiens
HISEQLIIKAADGVLTIVHVELRSISMIGLRMISRVYSYLMCSRSFRTIVIEWAQVDQTKKRTWKRLSRVCACMLDVLYSSSCNSLLRGRVGTYTSVGLLHYCKNEPSPQLPLSMHTVLHRWEQFPAKATLVTCSNQPVAWSWTRQHKPKLFITRGTILTLASRGLASAHRGRQFNLVAPGVEAPMRNILGMKF

SEQ ID NO: 997923 - protein, 305 aa, Homo sapiens
MITTTALQPGMHRTKNPVSFAQNFFSTSSTIFYTFRVHVFIVPKRARPMSSKNENQSKKTHQKASQCHRSALEAIVDSEGLSHAKEMRKPDGQSYTIILYAVLLLLLGAAILYNAAAAADDYTIIADYCCCSYTYYLREIMIPPPLQKRTRRETITNTQHAHPGQYNMQATTIGNSTYSERYAQHTIPAMRPDRRPGERMHPEEEEDAHKYLGYHQGIPSRRQPPTTNRRDSTTKAHEHSTHGTQHSPSAQHNGNTRDEVRESTDSSRTSTPTTGEDSNKRRTRKRTPVKRRQHDAPRHSNGIAH

SEQ ID NO: 997924 - protein, 81 aa, Homo sapiens
MVGYEPASPSYSATAEATGIAGPWEADGSQVSRDRTTATSSQDNTSNDIPISNHTTPPQPQHAPTTHHTQATPQNTQQQQN

SEQ ID NO: 997925 - protein, 369 aa, Homo sapiens
DVLRRESSEDTMLQQCYGLEPGARIPSPGRPPIARPPITSSRAPADCPKAPAAASSASARTRRQRTTLPELAGMTDASTVAGAPGRYQPGHQRPAINAPDQPGRPLRPSLRYTGSHVLKRTPRPATDVVLRTATSAQHSFSITNVNEVRRAHHDCRTTRTATGLGRRKPQTPRGQPHTHHHRDTTKRNRSPGKQTTGPGQDMTPAPQRSAHALANWPTGARRLAPSKTHLRTQNTNWARDSQGSNTNPGTPLGPHTTAGPNRQHQYTRPEPPPQATGQHRHPSEAQAGNTSHPTTPGHNLQANPAQRNDDATTSPENQTDAENTTTRQNPSNSTGQHNCGNRDTRNVLGLGAARHTTIESRETMPATHP

SEQ ID NO: 997926 - protein, 92 aa, Homo sapiens
MDRMPDDCGSPRFYNSYNDTDSVWLNFEQVTTGLQGYVHKMLAGSFTESEEMMSHRADINYTGGQDQKNKIKGWSLNRVKYTEAICEAGDEG

SEQ ID NO: 997927 - protein, 146 aa, Homo sapiens
MTQDALVIICGLLALMYLGIYSLHYFQDVPDLYLQEQSIREPTRLTNESSIYHSNKSSNLRVGLDIRYDSYKLRSGNLNDIWEIAIQFAKKTDRGINIDNNLITIGYINYCIENLQLGSHKVISIPKDYKIDSKWLVVLFVGLLNN

SEQ ID NO: 997928 - protein, 259 aa, Homo sapiens
MRRVLQEAHNGGLCTCVWGHDWFLLILCEALQFFVALPAEFQGGWRVLTWLLNLTRRLLCKNAALLHRGCRGMRCIGVENTWDSGAPNLSSIGSLALCCNPTFYMSCGWSEKFREKALDSGKWPKDGHPTGLARTHHTRSRTANISRPSCAGATAEGATYVRPPQKISEIHRKSQIAQFFPPGGLIHLITSLCFENAQDLGDYASGTQGGIPGYLWAIVAEEAISFALKAHHGVGKTSRESPRGEPCFFGKPEPFKTLQ

SEQ ID NO: 997929 - protein, 211 aa, Homo sapiens
MLVCCWLLEQFLGILDLKCPARGLVAHVPPEKLLDGSRPWLEGLVCFPGRARMLLCSPAGLISLMSYDGVSERQHVIHLLLPGELASPMHALVSWVRVPVDRSADCGECPSVAWHPLLVLRWGVGPMSVVGDEVQTWEPGPSGSSMVHAIVRDFPPVVSRDCSTLCTQIKSSEIIADSSILNHKIGEENIHSIKENRNLPKPRIMNALKVK

SEQ ID NO: 997930 - protein, 113 aa, Homo sapiens
VQLTDFENSAYVVFVVLLTRVILSYKLDFLIPLSKVDENMKVVTGKRCCLAGNVLFQERYLQRWQLRRAWHALWQGPEHALELAAIGVHPHDAIYYHHHMGQEGVLSWTDPKF

SEQ ID NO: 997931 - protein, 130 aa, Homo sapiens
MEQILPLAQSDRTGGQRVTGRGQSLEACKSSTGPLPTEWTTLAIRPHESTGPGQSLVGEKDQNLISCQIKHPEGCGQRMLGDIAVAFSKEINPFTCFNLANFFSWQATFPTDMGVESPEDLNSPIDGARR

SEQ ID NO: 997932 - protein, 82 aa, Homo sapiens
APVAGVWGKWLRLRGGEKEKERLGGGQGVGWWYQRQREVGSVLDLWDHGRSLIIGHFIEDAGDCRGNHRVVNRLERKTRSGS

SEQ ID NO: 997933 - protein, 95 aa, Homo sapiens
VVAHARNPSTWEAEAGGSQGQEIKTILANTVKHPPLLKNTKKLAGHGGVHLESQLLGRLRQENGVNLGGGACSEPRSCHCTPAWKTEQDSISKKK

SEQ ID NO: 997934 - protein, 113 aa, Homo sapiens
GEMGCLTLCRPRVGNGMGQQISGVTGEGSTFRGSRPFLLGSPSQSSWETTGPSGTAQPGLILREYSTGKEDGVFTPLGVTPEIWGLRSTGTIMDPGPLLELSHTMWLGINQAL

SEQ ID NO: 997935 - protein, 116 aa, Homo sapiens
RRACEDEGAEPMGYSAEVYYDEGYPGMIDNGRRSASLEGRGRTSVCEMVVAERWRQWSRVPRTAQNDGIRGGHNEFIHSGEHEAKACGSKYQRIGCGRSGLVAESKADGIGRVRGP

SEQ ID NO: 997936 - protein, 238 aa, Homo sapiens
WLMPVIPVLWGAGVGGSAGSGDRDRPERHGEAPSLLKHKKLAGRGVCTPVVPATWEAEAGESLEPWRWRLHESQDHATALQPGDRARLCLKKNRPNLEQRLLSSWAQVNIALIVNSTDRHLCECSAMKAELYEHRNQHIHLALSKYISSTYYVPGPVLNKCMITSTEQGTSFTLKRSHTGTLKAKLSNNNNTTGLVTVGHSTCTVYCTCPGSSSKACRCLFITVTLHETSSTKRAIGD

SEQ ID NO: 997937 - protein, 106 aa, Homo sapiens
MQIFVENPYAARSSPLRWSPVTTIENVKAKIQDKARHSPRPARGSSLQATASLAQMAVLLSALQTIREGVDPVHLVLRLSRWVCRIFDEVALEPERSISRGLWTPM

SEQ ID NO: 997938 - protein, 263 aa, Homo sapiens
DSFNWYCGATRLLLTELARRWAYWIGESRGRLVLTGRHDRRAASAGAALLGELPVLLLVLLCLPACGVTVASPRCNLMPASFGKAYKFSRGYCNNYKCEESFVKNSWREGLSGSAFKGSQWSDLEEFCNRSCEVPNKAKFCILKQLISLRIIFPVGTVWTMSAVQVTEENLLSHKITAFRITMVHSSRTLYTPKSWPNREKSEWSDGCTRGLLFGAPISFLMYHRYQLFWSTLVWLSRQFCQGVTRCECREIIGPATQMPGHT

SEQ ID NO: 997939 - protein, 184 aa, Homo sapiens
EPVSVGCRANFPASMQTPCGQTAALPPLGPRRQWARSPPATRLLAACCCCVAPGGGARGSGDPDDPGQPQDAGVPRRLLQQAGARCFTSSTSGPVAQGATVLAEVQEGRAWINPKRGMYSSRGLHHRALNPESLLQEGEGRLGKMFCSSVSKKSETQTNINVTCTRLIENKKKTTQRITCFTSK

SEQ ID NO: 997940 - protein, 193 aa, Homo sapiens
MGGHTTRGNFPFGGKPFLRNTVGEGKRGSCAGRTLNQMLNNRTRVDTWNTTRVRRPTSQRGHPGCGHSGHENWARNEGEAKRLRNLVDRNIPAAGGESLRHNRAARAQGEPPKPPGCKTGRTSPGPKLWGKRPETLGTLGAFNDTTEKNRPTRSDSEAGVKSAYHKNKRSSTTVTEDIPDENRQRVHLGRRPQ

SEQ ID NO: 997941 - protein, 128 aa, Homo sapiens
MIKDFPLGDNVRLYHGPNFGVRHHKKQVLEQVAAPEKRIVCRWGGNPTIALMKPLLVVTINGHWEGSLREGALRGDRIATFDIVEPTNIEWAPYRGTTHLPRKKGVGVGIKGKLLHPGKVCKGYTGCR

SEQ ID NO: 997942 - protein, 148 aa, Homo sapiens
LTPRPAHPREAKHANSSKTEKRTARKKSSTTCTTTDTYRETQKGNDERARTQQGTAQLQYTPTYNTHLNTPHRQTTRRSLKHETNRRQITTDSTQKKEHAGPISKLTPDEQTTNKRRPNLSSSLQYATTPESARRSDASDRSVSGGRE

SEQ ID NO: 997943 - protein, 78 aa, Homo sapiens
MFGPPWDLNSTSRRVKRNTFPGDSRFGTRFITSSLHYICAPGGSEGNGKHGPKGEKQHGTWASAGGYTQLEPFYTKTQ

SEQ ID NO: 997944 - protein, 156 aa, Homo sapiens
MRVRGQMKCEGRFSAPEEAETLRTTYGANVERLAQRVRTDTAFFSGTHENVYPGFERRNGWLLGFPTCILPCCHNMGSPAEPHFREMPMGTPDKRKAPYRCLRRIVVQSPLRCHLVVEHATHRRHLLSKAHLVRQGSFKTQKTFRKSSRNATPLEH

SEQ ID NO: 997945 - protein, 101 aa, Homo sapiens
RSPFKDPEVRFVLGNGCDHVVRYSPRYVSAHGRVLVDARIGYCVQFTVSLRGVKDKTGCSLYGYHVEMSEVERDRCRSLRVESIVCVKGLKKALMKKHIAD

SEQ ID NO: 997946 - protein, 114 aa, Homo sapiens
AVSPDRRAHPQRSTWKKSLTAKKEELLNAMVENMGNREDPIPQDSFEGVDEDEWDQPETTYTSTQLCCHFHSANITVILKLEDTSSGTRTPVTPDTPAITRWELTNSSGRSGKL

SEQ ID NO: 997947 - protein, 132 aa, Homo sapiens
DRLYRSLADIEYQIPLVRIVEDDFCTINNITSFRQLQAWIIVIHSCNTTGKGSKGALGTLTRAMGDRTFDFAVSALENAYFSSPRDYHSSLMGTLIAFGLFIYSTVCLVFDDRGKALYEQAPVSSLRVLHVA

SEQ ID NO: 997948 - protein, 106 aa, Homo sapiens
MKELSSILSVSHCIVSHLRRGMPVHLDSFPCIAPEAVKYQFPFFCFFWETWVPRPLCCARGLWSCAVVGGVLPESQLWRNPLANLSRGVFQSHFLCVCTSGPFPPV

SEQ ID NO: 997949 - protein, 105 aa, Homo sapiens
MKLEDSNFYKDIPSVRRVSHKWTFPELLTPSPTLVTLFFSETVSSTYTKWPTFQFMAVYVAKLGTILPTLTHRPSATHGTSCLLLGPFDDTRHYTSLLTAQDVHY

SEQ ID NO: 997950 - protein, 376 aa, Homo sapiens
HNIAACCSLCNTVVVRDPQGISSMGGMAEIVVQTQTMSVSMFTGSWQLYTPAHSSISSRSLLVSSPPSTPTYRTQPDQAPHYPSLPALPHTLPYSPTTHPAPTPPTAPPLPTHPLLPAPPYPRLPTPPLLPPPYPPPPPTPPPTPPPPYPSPASTPNPQPLTTTPSAPHLPTLNNILPNHYPLPPPKPQPTTPHNTSTRTHHHTTPPTHRTRTPPQALDQTPYPTPPTHLPHKPPPPPSFTTNLHTTHLHNTTHPPPTNSSQPIPSQTLPPPPLIHHPIHHPPHLEPTLHHSLYRPLSPPQPFTTQTYLPPYPPCVPPTATTERRQPTAGGRISPQNALTHLLLRAPTHSAPPQTSAPSRAPPPPPPLDREPLTPP

SEQ ID NO: 997951 - protein, 123 aa, Homo sapiens
MSRRKPMMMENRLLNHWSSKQLRVETETVGRFLSSSRPAIFHQKGLPQGGEAFGKAVSFRRAKETLCPNNAGAPPLGFKITDSFSFKRYVRYAPRERKATLALVTAENFLKAWVRLSTVYRLN

SEQ ID NO: 997952 - protein, 86 aa, Homo sapiens
MIFPFFGLNRTTHRGTLTQIPASNFGQLTFLFQDSTDPNILGPTFGFRYNPRPQFSSNSQKYSPPFTSRFSHRGSVKGPFFLHFKF

SEQ ID NO: 997953 - protein, 122 aa, Homo sapiens
MKFAQTDASNRQRTERLSMIPAKHYHKAYYRPTVSRTVNSNWRGWHAHSAVNFYVPAEAKLDVLSLRIRGINGVTPKGSKGVARFFAFRQHLSMEPFAEAQPRASINIAEDLVRANIFAIGG

SEQ ID NO: 997954 - protein, 268 aa, Homo sapiens
MSAHFPLLSRPAHARALFNVVRRNTRVGSSLAPCNPPLVKHLRPFDNGGMLRTATLRRALTYSNKGVPLTVVETRPDVLYPINTPAQETRNTALAHHTESFPSTGCADAFGRNVRTLGTPCRKRFLSGTAKQQNFTQSGFARTSGLGAHNTRLAHNVPPQATTANPGETITRSGQLIINPAYNSRRTRNRSPLGARTHGLTCNQAIPRTTLTLLLSINRTPIADGGVTKHAFITPPSSKTHSLSREYGAAPLSRPQENHSASGELHAT

SEQ ID NO: 997955 - protein, 138 aa, Homo sapiens
MLFPMEQVRLPCPELDLGDFPERRQPVPSPLRSFPRLRPYAATRRICTLPFACPAPCDFPCLRLLRPPPRLAPALFNPQEVSMYPHPSGRTMATCGTCGISTANTTGKPSIVQISRHPVVAFHVRGSSLHQRYLLAHH

SEQ ID NO: 997956 - protein, 38 aa, Homo sapiens
MSPATTFFQLAHASITSPLPLHTCDPSPNTTRRPLRPL

SEQ ID NO: 997957 - protein, 126 aa, Homo sapiens
MRTTAPILLYPVYCVTRGPTDGQPFDRNLDVCNPLACRRWSRSCKHTQAFPCPRPVITDGSLLLPFGASFLRDLVLYRVHLRGRVFYVYPWVPHGLWSPRLIGFVPSRPFLISISLPRSLAFAFYA

SEQ ID NO: 997958 - protein, 66 aa, Homo sapiens
PGTTGVRHQAQLISGVFGATDGAFTNSLAQYGLRSLASPCSKHTSGSQKLLGYCSACSHHALDSLL

SEQ ID NO: 997959 - protein, 113 aa, Homo sapiens
AVRRSRVSVSCFNSVCDGTDPGHSLYQTHRAVHPHISYVRVVNIRVHHLRRRCSWLSWDLASTRTVWIGSFLAKNPNPMKATPEITVRNLMSSRNVEWSRPVTSTPGGELQLH

SEQ ID NO: 997960 - protein, 152 aa, Homo sapiens
MHSPALVRRTTASGSVQGLASRVDDAPRVRLPLHRGASPGTRSVTGEHGSEGFRMMVDEAQSKMRHRSSPVSTPVEHGYRQPRLVTITGENLGYSQLFLHNVSVALLASTEGMQSPGGVADPARGTRTCIPHKKVTRTRLDEKNDDPGIHWF

SEQ ID NO: 997961 - protein, 164 aa, Homo sapiens
IAILKLRDMRARVCRRYRWPVSSCSARTLFIIWARRRLIRSRDSLKEFSVMTLPYIQGNINGIVEIYLGIANGVGVPIHSDDWEVVTLLGENLCRTSNRHNLVGGHLEDIRALSSYWDSALIYIHLVPQTCTFSPLNWPPRWSNCLDLGLQPHWWSIGPSQPNR

SEQ ID NO: 997962 - protein, 274 aa, Homo sapiens
DVTVVYKSLVWRSLTHRRDAQARLGERGITDLPYLQRIMPTMKSSYARHRFPFRGRHNKCGAPMTDARQIRRLSYSEATGLSVLVVGETNTYECGKRLDSLSGQHHGGVNKPLTVFEKRLAWHSIFTRRRSVEACRSSTRIGWTLHQMTDVDGSESIAIGATVMDDTAMSGRSWLQCLPHICRKAIMSDQRSEDISMRSRRVLKRSNRCPCLCHQWSCYGVPSRTSLNKCYPCGRHGYICIHLSLVTLDFAAQVSCNFTRELWRGHEYGVGRKT

SEQ ID NO: 997963 - protein, 411 aa, Homo sapiens
MAHPSAEQGSGTRRHDPILTVLHLSRAESGAPGLHVQARGHSSEARTHLGMSAGSCDHPGKSCDPQCVRGAFRLTEYHLYRRTTNQTSWVYTRLQEPGNECASSPSPSITWSTVQGRYHCQYYSHNHSSEYSDPLELVVDEEPPGKTDTISASAQDPVRDPLAEGNCDPHSVSSQVGTSERGYQLLVYTGTRRTDRNSRGKILKLPLAPLHTSECVTLGAQYDLQIGAPEAAPNISTRGVRSKGRTIDFTDYRNFFHVIHVGTNTPTVESTLAGLARLPLGVLALQDTPRHLLNRTRHEDPLRVGPPCGASKPALKPPPKAGVLSVELSRATTKHRIADEQDIQRVCDGENLDNLPITSDQHGDLRQNPRAGAISCMDQRGRRTRAPDMYAHLHSELTKTVKKSKEDSNSD

SEQ ID NO: 997964 - protein, 104 aa, Homo sapiens
MRAGREVGCPEAPARVTGPRRSSRAAWSCAGCVGCPGPTGADWRLPVGRHVRGRRLLALLTHRVRLVVQVAGWRFGPPSDLGQSAGGPGACCAHPAQHSMREKT

SEQ ID NO: 997965 - protein, 307 aa, Homo sapiens
MATTSTTGSTLLQPLSNAVQLPIDPAQCMIITQHDHYFGLRNFTDGHVPRRTEELTSSQRRIRLLRHAKLTGTYRSHNCNFMGILEAHFALTKDYITSIRRQIIPYHTIWCNLAHAETQYERTEPSPNTAARPEALTSVGCPCTFHLNHLYTHYLCELQPLLAAIFKLTSFVANNSIIYSWKYPPPYRPATDPNILTFCIGRYALMPMTYCLHASRHSDAYCANHWQTLTVRTVNLCKLATLPTRLRAVSTRLLQAVLPCTRAERSPPSLLASQSAVEVHAPPYGPTIQVPSLRPLHERIPGHMLSV

SEQ ID NO: 997966 - protein, 226 aa, Homo sapiens
LVPGVCARGPPCRDHERATTGACTRQMLQALTDTVNRLRISSIQATTAVGSEHPTVMLQRRRDHGVSHLLSTSMRYKCQDRPGESRTMYRYCASPMVLMSASSILYAVWAEAGFLAEAELLITVTEGLMLLNFVTVAPEYPESIVFQPSVASLRHPWAMGLAGPLDEDLASTARSTSTKVQSTVVYCLLGDGELSEGSVWEAMAFASIYKLYNLVAILDINRLGQS

SEQ ID NO: 997967 - protein, 314 aa, Homo sapiens
MCSRLADSNVPLFATIGISSPLGGIPEGAWVATDPTEWDIIALCTGVPLHSFCITPFLRGGRNFSRWKGVFPRKFTAYATRRFPQVCEKRTLFHVLNHLCRKPMIQGNLRYTSSFPRTLEHQFPVFTRVGTPQLSPFKSQQRADTFVRMSECLENIRTNMVRRDTLEMVSWRTTLCLAHHSQLERALFTHLLSNTVFPLVHPTQYDARVPYTKNPTPHSSAGMIYTASRVRNNRRRYPSNLRGKHTLARRLTALQSADTVASTVHMPMRAIHRRSLWLANRFSQFPAAVNKHESRRLCNDSNPTYRGQSVRRGT

SEQ ID NO: 997968 - protein, 227 aa, Homo sapiens
VQTPSLCSSRGPEPCRCDTKERVQLLQKFTRSDEIAIRAAIGSSQRNVLDSVLGLQWISVRNGRMEPRCIEHLTYIGLTLFPSYSMSTQEAVFSIVPIAVAKGVVGKQSGDGVLLLCEIGAKVHASSIAILFPGECRRIAAYPIDTPNVGREYMDVLEEYPFEIEYGSSSESRSYLGSDSWNRYGLVRSHLCARGRGRPRYTGDQSTPICSLVHAMKCHTEVVRVEL

SEQ ID NO: 997969 - protein, 112 aa, Homo sapiens
GGLERGGGNQKRLVAAACVPNPLRAALATTRVHGVVSERSGPADCSDAWAQLPSALGRHQGVPARPISSKSDTMEAHAQGSLETEPSAKEQTEDAVASADFSSDALWRRKRT

SEQ ID NO: 997970 - protein, 142 aa, Homo sapiens
MLVTSALKCCMCATPITNFNLRNASQNVSPFRGPKQVEYLNAGRSTDHSPRELLAWENHYKRPLCGTHHKGPLGASHLFYRHDKSFCATKTFYAARGAPARARIHVLRTPEGLRDLQRRTLPCGPHYKRGVGISNHPLVTPI

SEQ ID NO: 997971 - protein, 308 aa, Homo sapiens
AWGTPEVGWGAEWCDRRRSLMRRFRAPRSVYCACSPLMTGGPGSHFTAVSASVYACHFNCTCAPRGPRLCARACCRWAAARSTTVLIAVSTHTRASCAEALVCAPGSPAAFSSYPALQRRVGSTALVLHVPMRLAETLSPLAVRLSGCAVACLSVCHDVPLWTACPGRLLCPAHRRDVLSIMGTDGQLPPGSPWATCAPTAGMEALRVIARTGTPHNPCRQTPCTAMTPNSGRDPSPWIGPWLAARGPRILVWRHGPPDRNGLGSRPWWTLIWHTVWRGPLFEGRLSRLAGHLGVLPPGWWPPFVEIP

SEQ ID NO: 997972 - protein, 355 aa, Homo sapiens
MACPREEAMLSCIDVVAKAFVEASDEKKLRAEEIEADSKRPEIPAFEQSLARVPFTCGLVIEMLKTTDRRRHAAVIETWSSPTGCDNDEERGWQGLCTTCKKNTTTCVVVAQFVRLTCENPIRGPPGLFKHLSFAAATSSDVNCKKAVSHNTTSGTENPKARTGPLTNDTCQAPWHGMQGMRNDSHAGTDTDYQDSNDKKVPGQSTYRCPFAQHPQNDALIPSCGHEARPHPRWDDPRMNRDGTGWPRKLDMGPRDGFDSSRVPVKTKCGGTDADDPTSSEMTKGKTATKGSPDVGKPNEGWPRKTHRGLAPGGLEWALAHPGRVTSLGHALAQGYITEWVKKRLKLARNYQDES

SEQ ID NO: 997973 - protein, 162 aa, Homo sapiens
MFVPLNRRHAGSPIVTNTHTLFTVQDIGLKVHNLDGKDPGLTFIAHQVETQISWTSSSPYQNVELTDTKLCGGPTRHVGLGCLLHIENDQAIGPLIGTFDFYPWLRPLEAPHTLGLHLPKIPERLPLSFYRHKRKANPIPRNTTIIGCRKSRATSLMFQKPD

SEQ ID NO: 997974 - protein, 121 aa, Homo sapiens
MEGALDLGGLIGRWVCDTSTVLCFSSRCGRSLSLHSLLDSVGLWREEPGEGLGPGHEVPFSSLESQLRSLNSVPHFCVISGSMSRCWWAQEPVCNEGATRALDPAACEPWVPCRIHSRKHL

SEQ ID NO: 997975 - protein, 325 aa, Homo sapiens
RRGQHRTCMKMDVGSKEVLMESPARTTSADSLGVRNWHFPCLPSAIVKRPFRNQWTVVSGSVIYVDDCREPVLHVVSKMEAKNTYRYMVLEMSIGAPEAPVKAGARGEPSWLPILLSSLIGSTGRSRWYDLIQVAADRSTSPSPWRPAGYMDEDSSRGGIAQILRLSLEKVHDFQMVLLCVGQVARCHNGLKRGTGQRGGEECRCQTTASPEGGNPSAYTWKQWTVDDSTLSAGRRVARGYQHAKGTAVRVKQGSRGKKPQGVQGRRTRDKRGPLDSAPARRAHEGWVQGTTPGEEQGPGGMGGWSEKDGRRAEVAAQGRGSPDH

SEQ ID NO: 997976 - protein, 97 aa, Homo sapiens
TGVCENLTPKSQNSGKRKMISYQHVSSSDNVDAVQRPRILLASLTHTNSAGWQSINKRSQSKILRREDMLRLGHKGVLQRYALVSLDYKPGRELEVG

SEQ ID NO: 997977 - protein, 196 aa, Homo sapiens
CRRVRPVPVCRTMESYHKPDQQKLQALIRSYGQTVLRISLSSYGAPLQAGSVHIPTSCLHARAEIMAVLFFHTMRYKSQDPRNPHNDRVVLSKGPLQTSRSSTRVWAEAGFLADGLELLNRDWKITPPHFGLGTRSRNKAFTDGGHVAPWATGLGASLEGEAYTGKYFDKASYRVYCLLGDGELSEGSVWEGMVLR

SEQ ID NO: 997978 - protein, 135 aa, Homo sapiens
FGVSAPCGTEILAGVVITGIIDTMKVTHSDWLSRLPLGVFLLAYLVDLAFYDLVRPGVRSASWFRTRCMLVDSCGGHPQGSESRTMAGNLDQTSGSSRQSLRLKYLAHDPDLQVSMIGIDGSVVDVACWTKYINA

SEQ ID NO: 997979 - protein, 321 aa, Homo sapiens
RDRRALSSPPLSRRRQPNAPRLIRVRHAAPGVCCVLAVVVPGCAPTAPCRMDGPSVLLLRNNAGFAEASGWPTRYPCFVEFVCLLACGPPARGLWPLAVLLIGRMGTAERPERFLRIQEVSGQKGVGKRAQLANADWSLNPCGSTADNRAVDGEAELRQHIQRIAYQGGKLRKEPDQGAFLSPPTWGHSLLTNGVGPTDGKSAEYAPIPLIAYGLGGEKSANRGTPVAVGKTQAHLGVFATRVGQKPLPRERSPFWSRRKHPKGMKALGALVPIPGPYHFLKGEPVVQRFRDLPLTRRARVVPWPRGPKHTCGPLQTGAIT

SEQ ID NO: 997980 - protein, 99 aa, Homo sapiens
CWSAVAGSWFSGSMVHCCLDLPGPEEYPASQVAGDRGCAAARCSGYCFSVSVEYRGLPYVAAELVLALLDLTVMLPEYGPPKCEGIVGREPSTTQALSH

SEQ ID NO: 997981 - protein, 144 aa, Homo sapiens
AAAVPRRADSPGHVPEILGNPGRAPGTAAGTSGPVAVPGRSASACPGEEGSTLCAKASTSVSWHVMESAVDGTASVSWWRSASYPMAVVTVPFSTSPATRPPGQRRSFRGPVRARYSHGRYLIEQGLVVKATVRNLTIQLAYMY

SEQ ID NO: 997982 - protein, 241 aa, Homo sapiens
MATTGGRAPNAKVWVHDCDFNGCNPGDKDNGRVNVTDQDENTERTDVEATDRATGGDTTHPVSGQGHPHKPLDTPNNGTRHNRLELPGRAADKSTHHKQFAHGDTITSSRCTNPRCSTHYATEDIKQHIAGIDTTCGGIYAAKRGTPQTPMQQIVCALDERVNMRKKNTTGYKETANTQSLITGATLVQECDTHMKMSDASYQYATQSTPNGTADNPTALFTEVYVVAERCMRSTLKHNTK

SEQ ID NO: 997983 - protein, 280 aa, Homo sapiens
FYIVFVGIGTFKYHKSGVGPHLSLPGPVGPSPIFCLMYCARGTAAVGLCRDARRACLAPEMSLCERKRASSQATHKSPCEQEKSGESPRQSQQAITEGRVWDERERGERPDDRRKQRTVLSAVDRRRPTIVVVVLCTKCRPLFYTLVVVVVDHNGTLVVLITRSGLQEGVLLNHMKQQLPPVGHYFKKEGITHSRVLLKRGELIAGGSQKHLLADEVKKSGRKGEMQQKDTRCDPFIMVLYAPNPAGEFDGALFIPSPLGTNRRYTPTEKKGAKNKKDTK

SEQ ID NO: 997984 - protein, 98 aa, Homo sapiens
RDLASESDVDKAVWWCAMIRGNDPDNSVDASSDRILYQEAEEFLGTDSCLGKSYTSEILDSCKRTPSMWLIWLASSGPHVDRSPSQSFLPKDDEMETR

SEQ ID NO: 997985 - protein, 95 aa, Homo sapiens
MACSLMTCAGVRSGWALGLTMCVQALLWPLKGNTETRSDVQLPYYLTRNWERICYSSGLRFSHSSKHVANRNPAVKRTQRGHSWENDHYQPFKAT

SEQ ID NO: 997986 - protein, 154 aa, Homo sapiens
NIPEVDPSPVLMGVDRGTSLGQPLARCSAVSGSVARSSPRCDFVLLTFLRDSGLWTRGLYLRRTIFIPESPVSQSSVVGSMVLYTLVAKNLSLVRQSDAICVSRSHFVCGTSLCDNNDRRKAFTTNTCSCVAIDFIVDWYQQDRTQSFVGKVEC

SEQ ID NO: 997987 - protein, 70 aa, Homo sapiens
AKRKRRGGFAVQAKKPIKKRNMMRSRQLSGTPQAEEVDGRREGPDPRPRLRGKSGINRGTGFVTLFFQRK

SEQ ID NO: 997988 - protein, 112 aa, Homo sapiens
VAAGIARGPVFGQGYTSSCSSPARTTSWQASFLEDCNVIPGEIGAQLKLLPMNASDTGSYRPSSVEQVSRERKGKGKWRVLQAVERGLEVKGARETVFFGLGKLLEIGVKTV

SEQ ID NO: 997989 - protein, 292 aa, Homo sapiens
DERPCERVWGYKVVMSASSGSGLITDYVLICVADSNPVQEPLAGLSVTIWELTTLLLSWYVTRSYHGYRSKHANMLLVLLNTAGATVCELTIEVRHSISVPPLNVVKDPHNCRTTYAWCVTFSLAPLARGLGGGQNGVVGNAFGVIEHWDTPCGVGFTSGGFPHGANFHIPLMPYGGAIHSGSFHGLVVESGNVGNRKLIATKNARNSMYPRCKSFSGVRYAFVCHFGYLQVVRGLHGHRFAFGKLAPGKAFQGLEYSTRRGIPKTFPSRMCYLGGHLTTVAVEAATTGSCE

SEQ ID NO: 997990 - protein, 308 aa, Homo sapiens
SFPASLEKLGNVATPRQPLCMWTFEQGLGAWTLWKGCALQPATLPTVPCSPSLVHHHPPRPARGPRRRAPHPAPPTPTPDTSPPPPTAPSALPTSRLPQPCRPHPTTRAPAPPRPPTTHPPAPPPPAPPPSPAAPPAHPAPPLLHRPPAHLPRALPTPPTHLPPPPTYPPTAPPPPSAPPATPTRPGPPPPNGAPPRPRTTPRPTPRQPPLPPPLSTPLPRPLPHLAPHHPPPPPPPTPPHPRHTPRPHTAHAPHHDPPQPPRTPPLPTAPPRPTPHPSPPHAHPPHLHPSPPHHPRPPHRAPPPPPR

SEQ ID NO: 997991 - protein, 302 aa, Homo sapiens
KERRMAAGTAVGAWCAGPQSVGGSSRCSKHHSPDWRRHWLLKCTRVCPQETTPAGWNGNLEHRPDRSLEGPVIPSGGGPMGQMWLVSIHQRSPSSFRPVRGSRMTGFFRCQATATTEWQQADRSPNYLSSVSTSIPGDSHEICRISGLLTLTGLVVHQLQRGETMLSSAGQSLSLDRALFTPGHFGTGERPHLVTLHRATREAIIVELGTPGPTDDHTVTEPRGHPLPATRCQRIMGNPSTLGVKTPPCTPEGTEQQIPPASHKALIVHACKHFPRQPIGTCFPHEHNLVRHLYEHQLQRQF

SEQ ID NO: 997992 - protein, 215 aa, Homo sapiens
MRDQLHLAPKPPYHTTPTKCGRPAATPSTSSSTHEPAEDLRPHRTRHGPQPPQKAPRVLHNPTQHHRPHTPSRIRKPTPTPRPIDTTRRRGTTRSGTQQPKGGPHTRTHAGQNGEKRARTNEYNRGPQPAHDEPGPANHNRDTPPRTTPPPHRARKHTIHPRHYVTQHNTTERAKPETGVNHTHNRIRAPPTQANTKRPKAPRATRPLTPRKHQP

SEQ ID NO: 997993 - protein, 374 aa, Homo sapiens
MPVARAVGPGSLRTLQRSPSRSVPRGSSGMPLVEDPVVEVRDLPVQFMTPIMLTTAGLRGMTAVSVCMHQCPRRVTFEFMLRVDHVARGYDDWADSIRDSRIRKRYVAVALDSSGVNDGLVNGESMSVSVPGQSANLVRAVLVRSEKQVPEHSDMVLEACPLGIVKHEIGRGGYGNPEVAYYDKEFWLCLDRYRTDVVRKGNRDAPYVEVPLDRKIASDLGFLRFQLKYKKRAPVRHDTFGFDGHFGLRECEPFKRYTQAPTIGRRRFGSERPGGRALSEFAEKCGELAVDRGRFSRVGTKRIRRICWTRPLGTKTKEGFARMGRLPGADSDEEDFAVVMTLWGKFRRPWHTGYMPQFGEHENFPMCYGFVSPG

SEQ ID NO: 997994 - protein, 105 aa, Homo sapiens
MVESVPSVRDDGTDGALLLWSWILACVPGLHWNVFSEDAATGPGAIESVTMQELSSAYYPISRCHANHMIARRRPGVAGREYLLVSVSAWQHLVAEREDLLTVVA

SEQ ID NO: 997995 - protein, 133 aa, Homo sapiens
VDVSCFNSAWTEPGRSFPSPARTPIVQTLRHSLRPAPSALPHLYGGALGAAGILARPQLGQPVRPPVRCNLALCVVLVMDLTPRVRTILNCAELKTAYRRHGTFMTDPKHDSSPGVTCVAGLDSRPYPIALYS

SEQ ID NO: 997996 - protein, 217 aa, Homo sapiens
MYTLVVRGNPVRQRGVWCCNIVLAEKFGSRGIVYSAYIGWVEQRLMRLWQEMVFQCETGVLVYIIREKWGGVLQNLVDELFLTTDFVSNADTSRNIYREALTRERVLIGEKHNSVGAARCMKIKAQVSRTKNLGGCSAPEEERKGAQTTGPSVATARAGPRGKRGLRNESGDYCRRFGVQTRGVYGEHTIRVSPYVSFWHSAELVASNNSRRTRCVL

SEQ ID NO: 997997 - protein, 184 aa, Homo sapiens
SENGAERRAVSPADMESELTTRSAMISNGPEEEHPSCDALPHSTCVSALSSPSHDYVKSADGFALSETDPAMTGTWAVMTSTRMVTLAYVCDLCETLGHGYRIARTSPRSYVVINVANSRIVCAVFFHMDTIGGLLTPFRGPSREFLRGVRVYCHGDAPGQMNDGVRRSKYTGKHVKEWLTGWK

SEQ ID NO: 997998 - protein, 316 aa, Homo sapiens
MSSDEFRLVSTSSRDRLVSLLDGPKKHQCMSTSAHSRVGIPESKTQDSRCLLGRKLVWSHRIFRRCRRLLVLHFVSYASSPGTDRVSVGSLTGYPCVPRAQLKGSRDRACLEVWGERHVTHDVEAHVSGYYVAMNYLDTTSDAREKDTRLFVQGVIGVFIELEDRSTGDSPIWNIAEVDRCYACDRQDWVGPRAGERMTERPQAWLKRMRTTNLSTYLSLLARGPVPAGWFRTKLVRHILANSLERCIVVSARETNSCDFLDYPWERWSRKWLPSVMVCKIVVPQTGWHQVPPFLSFNGLQNESLGLVWGRRDLHL

SEQ ID NO: 997999 - protein, 221 aa, Homo sapiens
MGQEGIPYCGRLKAQMQGEAFASALEVQPIGRYGYLSSAKRGDDRWTIQFVVTLHPILTNCTLLLCAPGGGHHRYLLDREGRSRKPPKGANSAEYSMTREIIGLKSVSKHAAANVTRLGYRRTAAEVPLVTHFLGLVTTLSNAVNWALPVERGIYPKSWWRQSDREGVSVPPAHDQSLRSGEPATWLGTAVTGLRSLNDPQREAAVTKRSTINGQKRGRNP

SEQ ID NO: 998000 - protein, 371 aa, Homo sapiens
MGSGTCSSEMTAMESCDYHLIEALQASETVVYAPSYALSFLLVCNTCCMTTRRNTSTYSFELVHLVSAPPSERPGRNPFNSKKRTICTFSLRGNQILRWGEWSRDGFVPHRTSGTRRRQGCMRIGARKTCGRTQTTWWDKSLPRETGKTLVLSEGTPVGKEIRPKIDIPYCKSRTSLIMTLRNGESGGVSDSKTAIKYMVLQREVCYHGDREHHAGGDLFLKSIGNGTSEGQLYSRRNTRSLASHRHIELEPTVRHQKVSAVSQQRVENLIPIAHETRCYRPACYALVVSHEQAAEQRFPEAKNVRARGIRAHMCGTVSNSWLRFRAGRNSLCSSWALPSDKKYRGVWQTHNLRNFAVWGESAPPTCVLFW

SEQ ID NO: 998001 - protein, 139 aa, Homo sapiens
MVGVNGVWSYWARGQSWSAFILWYEWIKLPSMTPVIDLNYSGLYMFRDMIPPMANSMETSEADESVKLVSQWKSSFTIFHEAEITSKHQVGLMLALSYLDGVSHWTSFYRPCEEGLGHHVCTACDADKGVHPFVLTPPS

SEQ ID NO: 998002 - protein, 219 aa, Homo sapiens
MRAVKPRCYGDETRVLRRRSDLLPGIPAKQGYVPHQWGHAMMERRQWGTTNGLPGDPWFAPLAQSQSVDNKRGEHPWGQPFPVQYVCMGPLRSIPKVPKARRTSTREWLEIFPRGQTYYVQFYKSFRVPFVGGLPEEFDSENWEREQDLVVPQGTQNQVYPAHRANLKAPGHLAEGDQFKGRKAFAWCSNRGDWPGGALVPRREAEGGHRRLLDHGGEH

SEQ ID NO: 998003 - protein, 121 aa, Homo sapiens
MTSGVGPAGGRGVAAECKADARRGGDADRIWLPSSWGPGVGRYTEPPLGWRLVGLVRAPMDFAVSDFAWRVGGKNKGGYVETGQYRSEKELIAKTAKKWFPNGETLWVVKETIFSFKTVVV

SEQ ID NO: 998004 - protein, 134 aa, Homo sapiens
MLSVDLMTGVWHEEEVIVVTVSAQRPDVLLPFYEYLATGRDSVGASQRDPRPTVLGDVAAVVQSSRVRKAWAGPTTKCHLPDGGGDLSSLVVRIKDPLIASDEMENLKRVPHLEGALGYGYRCALTCAAHTPVE

SEQ ID NO: 998005 - protein, 264 aa, Homo sapiens
MSRRIKREYWAYCPWFEAVGTVTYRHTTCYENKKLYLSLSESGLTSEYREEGNQRQPYDIPTEGKGARSSSRMWMISSVQILHTVRGTRMDYLLRGASREILRKRDDRYIAVGHLSRAETDGQLQHHFDMHSDWNELGRPLEEPTPWPMNGMGKALGSEEAFVAIFGFRGDTLVARAEGKIVGPFNRGPNQCGKEATYKRDLPEVRSKTHLIGGTISRYAPKGVIVAVSGATFLAKAVVSTRGERGNGKSPMVAITNAYVAVVS

SEQ ID NO: 998006 - protein, 206 aa, Homo sapiens
MGNIRGVVVSTADCGGAIASQTYFVTVSDPAVPPAGGTRVCGGISWGEWTAIVRAEALGTRGGSKVVRRCPRERRSSLPCKDEDVLAPGSPLALFRLIHLGLAQSVHEYLECVLAREHLRGSTGSCTVLLSSGAVPGVAHAGPVCSRAGCPLEEDLAPVPYVQRVTSTRRKDESRSTRLMSSIPLDAQSYWKSPCMVAPQSDSCVS

SEQ ID NO: 998007 - protein, 138 aa, Homo sapiens
MLSPSGPSASARLGAPQRESPGVLDGAVRVCWRPGVRRAGGRAQGCKRQHRKADPDRISVKSSARAVALNEHLAMGNLHSQDIDPKVVEIVTVPAWSPILPPNIGTLNSPQLKEWEETLVVNPRSPPVVQKYLVEIGY

SEQ ID NO: 998008 - protein, 336 aa, Homo sapiens
ALPWSAQRGGSQNVTSVLRYPGKLGQWPGRAETSDADARRLYNTSSSCAQQVATHVSAGDKMPPDVGESGYEVDLDAGRMLELSPVHSDLKILRHYRVDSRPTNGMPDVLVDLCDLPGGTTSGAVRLRDYWLLRPAWRLHGLGLDAGASRVDRSRVPSQKAYRAESDYPWIVLYGSCTDSMRIARILVESQEPFLGEAMSSHARIGGCSTSRHLSHASETLLVVKGAMRDSVRDLVVPWHSPCLLKDIADREVNESSNAKSPRKTRCASDVKSPRRGPPRSQVEGGACHALGPSVRPVPFFRVKRRKTSVRRGPCARAVGISCPPWAGERRTGLGP

SEQ ID NO: 998009 - protein, 110 aa, Homo sapiens
IIRALAASRSRLPAAPLLARRFRSPSPRGSRSDSDQQPVAGKGDRGGGGQGKRGCSGGSRKMSGEDEDNWSKAIAEDLVVTSVYTMGGDIAQQGTSVLGGAHLRSGVSVA

SEQ ID NO: 998010 - protein, 244 aa, Homo sapiens
MWLEILLTSVLGFAIYWFISRDKRGNFATVKMGEWGPGTRSAAREDRQRSALSRWKRQMRRSTDLHQKDRVSSVLTPSLWRDSLLPHSGVQAPTYLKNSHLLAGGMNLTWKKQVEILNQIPSSFKTKHGMGWTVHLHPREAPPSVEPEDIPRRPLLMVHGWHRLFLQSCYKIMPLLTDPKNHGLSDEHVEEVDLPFHPGYGFSEASSNEGVQLEWTPTGIFYKADAAAGLPGILQCKGGGPGGT

SEQ ID NO: 998011 - protein, 318 aa, Homo sapiens
ETLGGIKLRGMVYRSSLCIENSCIAAHDQRGRYGTLFTMDRVLTRPMGTVMDVLKGDNRLSMAGSCIQLCKDLTGDPQPWKESTNSLMLPRNEEPFRALHSIENGSETLGRCRRNLPNRVRESTTVGDEILVSGRHSGPWCGYSLSQGDEAGSHAWKNNVVSVNKEPVAEPDIMGSIMAWSIVISHVYVTVSSTSRTSGQEGMNLAELCDLRSSDKASAVTRASQEVCSNYAPGLSKRYEETDDCIETGKAPTGRGNATNGLRISPTQCARHELPPEDWCVTVVPEKYHRISRPEECTNGPSDQDVKNGRGVPMRGND

SEQ ID NO: 998012 - protein, 461 aa, Homo sapiens
DPLNMGRVRTKNREEGGPEFIISSKYYTRRWATTSHTNNAAWCEEIAIDPSNELRSKIAGYVDSRSDECELQEKAQLEMVFSSLEAARRMEHEEQEETKLIVTEQVSMPCDQEQMRSDSKITLTLKGKMPASLSDLTARSVANLSRVTVSRVSRMCGMCNCVQYTGSCGVQHCDCGQLCVSWYAVWLLSITHDRQSCGITPEGRKSTIDKNRRAARGYHLKVPAELSRSAKRNGGLYNSVAIGVHIQCEMCGAHSHDSLVSAELFETIVCPVEVSRKTPVGSPPNSLLHLESIRPTVIYRQERPRPHVKKGHSPWQTQLEHDVELVPPPRADTYPWGIHCRGVTTQPKTRRRTPAKIGAKGQRHRTENARRRVTKRQHRSEGVMETTAEGSNTPPEERAAQETDTRAPNEGPNRLDMADRASKRSSRDARPTVDIGTKTEQNTHAHEKRKALNPGNKRKTQ

SEQ ID NO: 998013 - protein, 129 aa, Homo sapiens
MRSKDTRAVCVGENPKDEARTPTWRGAVVGTPKHGCKYLGRPYQEMCPFASVESNRLNGTVLALGIAPRITKLNGSNVELKTGAPTEIIRRQGSTQGEDRGEKAREESTPARVAPIVGSRMLPRFTHEA

SEQ ID NO: 998014 - protein, 259 aa, Homo sapiens
MMDPDMRRSPVSHRPIPGRCEVQSRDPDKLDRLHSPRSTGSWMSEGRGQSFEDDDGMVREKRRVRLGETVHVYRRSRVCDRRTKRDLAPRRATVGHQNDLAWEWLSIATSGSEPWATRHEVASHPVNAIVDSSQNNNWVRSGDLDVRHDTELGLSHKRIEQPRGKEPVIWELIPLARVNMEEATLSHCEDYCAGRIQMRLRIGKYSSYPEKTGGKQGICFNPYGGTVEYGKGSALWPASERERRREFCPRYESAKYACV

SEQ ID NO: 998015 - protein, 281 aa, Homo sapiens
MLVLAKDQRILSDVVVPVDYRYCGMVLPVDMGNDELSKNEDSTACGVTRETSWLHGIKRRTAERTMGTRMDIRTWRGTMRASGWDQWRSEHIGSGPSRKRTLGSSRGSSVSEGKRAAAVGAGIQSGTNRMQGQKAPIATDTLPLVVPPIASYRREGGASDADFVADSPWPEGDPGFHAYATCGRRNPSGSLFWTDHNGRGFHYRRRMQTWWSNWNPWVHWLPAAWEPLQHGVLYSPLGSQKGCALRIRQKIERIKGASYASVANKGLGLKFRGKGMGGDKI

SEQ ID NO: 998016 - protein, 148 aa, Homo sapiens
MEDTPLVISKQKTEVVCGVPNQVVCTAFSSHILVVVTQFGKMGTLDLPGAQTGVAHVTSRQALVRRADKNVLLGQDEPLIHGLVLREPGSVLCLKKLETETVLRRPWTVKDKSMEGLKALREVIRDVPGAGDRGRAGRRRSVASARDT

SEQ ID NO: 998017 - protein, 203 aa, Homo sapiens
MVVLGSGDAKVSQGSYVWGTSTAWGRKDRERVLRIYQLGCQHSPLDDGKSAINAGDAVKTKGISQLYHREHSSYKMTVTVCAWWIADALKGGCRRRDEAERTNVCMDPGSLCEVPYPCEDRDYNFAGGPRIFQSSMNGCSFIEYDPRMNAGAVTLYDMIPMVQTYTCPITTRGTVPQSSGLSYPSMCGFVGKERGNSWSYIHS

SEQ ID NO: 998018 - protein, 282 aa, Homo sapiens
APTACDPGERLRQMTRERGRALLRPDLRRDLGPVPCCAAPPSVRARASQGPRVSMRSRSADLRWSPAHAGRVCAGSCLAAGRVGMPLRREVAVPRRCRAHLDPGQQRSSWAWWAPTAAFWTKYMNHLTVHNREVLYELIEKRGPGTPLITVSNHQSCMDEPHLWGILKLRHIWNLKLMRWTPASLQTSASPRSYIPLSSGLGKCVPVCRGAEFSTQSNEGKGVSDTGRHMPRLLRKPEAEQTTMALYRNGGSTTQATTHNKGPQNTYDTPSGRANPYESARL

SEQ ID NO: 998019 - protein, 124 aa, Homo sapiens
GRGFLASTVLGRNPVLVPQPVRDGHSQPSVSSSPCASDCRWANRPSQAPGGRCSHKLRARTPHRTPIARPAHDDRDPPRQDAPELRPELRVPSSTRQNQPLEHLTLSLRFYTCSSGRNVTWTSR

SEQ ID NO: 998020 - protein, 173 aa, Homo sapiens
MWGACNVTVHDSLGTIGTHSETVPEIGGEHGKKQCSSYVYGTSEAGRQLHWAHMLGGTCGAWTSREFPSGSSYENAQVLQNPIDTPVRVIQDSMIQIVRTTSDSEELSTDSSVACRRLLGTSKLDLKGTRHMQLIATGGKETPSIALFDTEGTGRPARGFQMELHRWASFRRY

SEQ ID NO: 998021 - protein, 245 aa, Homo sapiens
SQGGCLDLFWKKTKNNVFQKNTQVWRGRHSQCGGSQGCGHPGLEASLGRPALMRIWQLRGPHKSGPANLEGDGEWVDSSWDVRWHTWALWGPPRLRWCPQGTGRRETVGWGSHHAGGPRGVYSPAVKSPPGEMIAQVHDTERDTPARALAPMGGGTGGKTSERGGREGRTCTISARPTDTRAHRRRPPHSAQRRQTGGNTKREQRQPAGSHQAPRGTQPEARHQQENNQTEYESAARPPTILNAI

SEQ ID NO: 998022 - protein, 259 aa, Homo sapiens
GEGLDREKVSLRVFGEESRVGPGLWLLSDMPLSRCAARTRLVPREVSSKHLEPEPEEEIYVPEDYDDDPVDYEVQTRLEGATQLSWYKVFDPSCGLPYYWNADHRPCYPGSPQHDPNLRGYQIVPKKSLDSQLHADAVTEKFGTGTLDKSDRGHDEVRNLQLMRNYTWVPRPKSRPGPATSLTGHRERWLLTKDRTDERRAETGNGDRGKRRARGELRSTTEKERQQENGGPSKYDRRRDRRIHYPQQEHGKGSKAQKD

SEQ ID NO: 998023 - protein, 126 aa, Homo sapiens
ASFPARLCFPAQEPQAVGSHGAQSEWHGLEAPLPQGLAAARGPRGSTSRPVMIRRRKCPVKPRRAVSNPQHLRRVPVRPIVRWPLRFRYHTKVRRRAAAIRPEGAQRWTCIHKKVARTIGHVCGSE

SEQ ID NO: 998024 - protein, 40 aa, Homo sapiens
MAMISNWGQPNGKKYPLGRRISNYLDTPGVVRSHWNPRLN

SEQ ID NO: 998025 - protein, 74 aa, Homo sapiens
AGVVKTSPNSQRWERNKTHINIVVYWTRSIRASPPLRGHLIYKSRWLSTKEPLKQLEKEAAEMGRRASFKYAWV

SEQ ID NO: 998026 - protein, 133 aa, Homo sapiens
MVQPHELWQLITGITGLDGSIAVLSSCWRRGYEVHGIVRRIQSQFNTGSRLRHLYKNRPGSTLKERMRLHYGDLTDRYLPCGRSVNASKGPTEIYTSLGSPESTSNIYFEATLRYTCRTLHGVGHSTHFSAAS

SEQ ID NO: 998027 - protein, 142 aa, Homo sapiens
GSVVAVRLDPLPQGLWTGAVVSEHLSWPGSVTVPVGGLISRMHVYWSHSHDMGLLPVVVLSLSFVPGCKQRKGDWFVVLSDVGDMCDSLPETIQRIHESSATAVFVSDRASSCHRLSRGRLAITNNVFNPRLPGVLNHMAET

SEQ ID NO: 998028 - protein, 238 aa, Homo sapiens
VCRRSTSALTLGPKPQCLARAPLERDGTSECANSSTMCCVHLEDTRLGQLQRCASAADDRCTGVSPGRRSSSTSFLPWTSLQLVSLQNLSRTRHCQGRRTGMYRDQTQTHLRCHEVHTASRDAPEHRASGVIQPERAHMPIQGRTITPDRDSRMRLTLRANNRWSMQHRRNRAHGGAADKRRSAKIWLQHDTNMPEHERRIGDQARLDTIPQARPKEDIKRSEKHNEDNNMARRHAGE

SEQ ID NO: 998029 - protein, 69 aa, Homo sapiens
MALETGHPVTLTTKRTRSNARQVDETEGHKCHKPVPRRCNQLTGPKPNSTGIMRAIPGPQKSRKAEPAE

SEQ ID NO: 998030 - protein, 229 aa, Homo sapiens
MTSITSSLLLCSKSRRRRQRIRTPGTILPKQEPLPSAEAIDTDEFIIAPNVVLHVMYAKVPKSRVGTWQSLYLREADMADQPDIGPNIVRKGLVNQTLRKIPHNDKDITHHYKVATQIQDKNENGTQTINTECLKTTVDKTSTQSNRRIHHHVDPTGDIEHHTAQRPWAAKRPADGHPATTTRKQTHHQAAKRTAPAQTHNETSGPNHQGGVDHNAQLHTQGHSKQRPH

SEQ ID NO: 998031 - protein, 315 aa, Homo sapiens
MSIFTFMGANVMRLDDTYSFQVINKTVKMVIPAAFQSDSGDSIEVSRNVEEIVVKHHQCICRMRCHTSRSTGACPSLINYVDTLGAENIPLDFFLILLFQNSSVTENMCWRRAIWRTMDASLRKHDTEFGLSVCCESERPASDTQLDEYPPVLNYKAGRGTKKKTLPKDSDQFNTRVNSQEEDCYQVPNRRDIDTSEQLRHLQIRSVLLQCSPDSLSYQINFFLNTNGKSRRKWVGTCKIQQTGTLQHAGPASPETRERHAAILIPSRPTKAHQTPNCKPGNRPHKQRPAREQPLRAHPATLQRKANHDNVVQIK

SEQ ID NO: 998032 - protein, 276 aa, Homo sapiens
RVLPAEYRCRENYPIQSQQWERKKSHINIVVIGHVDSGQGSNIDSLAHLQSIQCALAIAEEPLRKFEKEAAEMLERAPSSMPGSWIELKAERERGITILILSLLANFETSKYYVTIIDAQDTENFSQNTLTYHGIILRLSCAVLIVAAGVGEFEAGISKNGADPESMPFWAYTLGVTTEISVGVSKMDSTEPTLQPEEDMTEHRKAKSARYITNDLAINPDDTKRYVPNVWLELVKQCVEHKVISMPWVQGNGKVTQVGTGKGQEEATAGGGLGWI

SEQ ID NO: 998033 - protein, 364 aa, Homo sapiens
MAEAWLSMWRHGMNPGTYFFVRGDIATRRCVSRIGLMNDGSPRSCHLLGYVPSERHPRRCSQWCVLVAAVVGIASEPYMNGLASGMKSGSCDSDTAEGCIVHTVVLEPRLNGGLLYRIVGPLQKIAMGHGCADRRVRGSFFDHTQRISTMGMPPQGIAPNTKVKIVVNNEVFVHRVGKRQGNNKYTMSNAEGPGVNVDKPRAQQGVSRNNIGGELGHVLVRIGTTYEGTQERQFFSRLVCAWDRAEQDSTKIVPLGKAGMRKPDMKQESIESRMGVPSSLGGMNCSHAESQGAKRAHKRAEAAWAHSGNVGGKCRRLTLAYMETPKVDHVATPPKVAIAIMEMCKCDSTVTYGGTMNASKHSAG

SEQ ID NO: 998034 - protein, 108 aa, Homo sapiens
MESQDRQSVRVSYARPRASWCLRMNRVTVPPTCSHCAVVIRTGVPDLVAGKILATTELFHIGSDGVTADVAPRGEALTSSIACRGGCAAHLKAPEDASSSTNAVTVNT

SEQ ID NO: 998035 - protein, 71 aa, Homo sapiens
QAQPSLEMQKDAGEFVDLYVPRTCSANNRIIGANGRKLLHPDEQSPMLIRSQCMLHRGQLKTLCISAGTYT

SEQ ID NO: 998036 - protein, 376 aa, Homo sapiens
QNTIDVLDERRLQLGLASGGSLVAPELWGTACGFRGGFSEGILEAGVAAVVGCRVGLCLRQLAYCRPAGYGRGLSCHRVWAWFESQDMKIHVPVRVDLSLLPAILCESGGSLDFFLARPVSQRMRYCERYTAQCEKAIPWCRPACTMSHRDILLCRIRGERNKWATCSDPSGCSQIASLWEHVLAALNHIGLGKPSQYPEVHEDFFPFRSRPVAGKKSLTEGVGNQRNPGKGPAEYLVSPLFRDKCWTQEALVLQGFFRLAWVNMPLKYTLDSPPRVSHLVGTQVRSRFNPLMVPLRSKMPLTSICTGGVGINSGFVNVGVNQTSFASPRGGSLYTLSRTTPWWYKNTYTGHKMEDRKPVIGKLAQDFLLKGTPLR

SEQ ID NO: 998037 - protein, 132 aa, Homo sapiens
MRESHGKNGIDEIERQAGWLQHWENGHPFIDHSLGVLGVQREQRAAVEVSVSVIDHLRSWQIHEHPDKLLVMTTPSDCTAETANDFNRKNHESTGHISVHDMVTAAVSPLAYTMAVGRKFERRVISEQWCRM

SEQ ID NO: 998038 - protein, 218 aa, Homo sapiens
FGLLAASQPQAVPPYASEKPELQGPWKRNTMSPEATLQSCCVSACRGQGYPSGLRLKCSRILVTTVVCHMLSAEFLLSERLELRMIQSCQSAASAHVNPVDRASLREHCTRYAYEATYRREAPVACMPSRVNVHVRAVGPHRRCTTRAEAYFSLHMRRPVGHLQSPQLQEHAESGGRGETTDVESPLRQGRGLLSRGITIHRAQGGPACASPRNRQGG

SEQ ID NO: 998039 - protein, 271 aa, Homo sapiens
GRIRHPRVINGDKCCHSIAETGRRPAEERIYFAALTERTLKKPKTAKPRSSITKATWESNYFGVPLTTVVTPEKPIPICIERCIEYIEATGLSTDTASTGSAGTSLEMDESAETVGSRATILDLAEKDFTVNTVAGADEELVASELSLSALGPDISMQIDLVEAHKIKRTGAEVACPLRRYQEKIAKGKPTEVFKYVISHLKPGQPQEQGESHGPDENHLHLLLAHIDEDLIDSSQDDTHSTRANYQTISEDSLIPGRATLHSFYNRTINR

SEQ ID NO: 998040 - protein, 311 aa, Homo sapiens
MPITVPLPHAKSLCAKVYGRSVPMIPPSGYLWLIYVYQDIIEEVSHGAVVGPHWCVVGWCSRDIAPCGGEVRLVAVSVLDVLSERRTCRLYYLPFTVLCITGENTAVEGVHSSRFEVTPLSNPVGHYPEETSGVASDNAVDGRMPQLRMSGICESVRTRSTLACSMRNRCQGTVSVVLVLIRRYFHQTIPKAIQEDSLPHWWLVRQRDPIVALVSKWNYRPERLLQYHRQMDGAQVTPFSFTLGMASGSPLRLAVGFVGFPLTGDIDFRWKICPPNSLNVGESLWPRETENNTGWNDESENSDLLWRIRID

SEQ ID NO: 998041 - protein, 217 aa, Homo sapiens
MEDSENKGREMQRVGSRQMSENRGKCHAKCWTRRSARWDDAPTDLLRHKTMHLQDSVIPGWQALPFLGHTWLRHPWSQCLGTGCIGHVLAARCVLLWNPVPFPSWPRLSTLPSSAAFSPYLPGEPGLGHESASGARAQRDQENPLAWKVWCTLTQGRTREEEAQELGPAAPGAVPCTPGRAKGHGMAGHPDTGLGRPERHREGTRWATAHMDVTGIP

SEQ ID NO: 998042 - protein, 188 aa, Homo sapiens
MTSYSTWHRDIQITLTFVPGSSSVILSSTLIVYGETRLQLGVIVTDRQFSGEKATVNRKRQTLTHLSLSPPLGVCEGYLIRAVSETDCYGENRQIPLGDICETAVIPIQCSVVNTNTASYARRIETVRDFVPMSEKRLPQMLAHDIIWYRRLASRVHLTWIRADNGTHFVKFRREQTDTTDNLPWQIW

SEQ ID NO: 998043 - protein, 331 aa, Homo sapiens
AFEERAGTVLPGDRAGASVLQNLDGMMMTLLLFVVACVLIHERRTGQVRGGTMTVSDEGRVQRTVSNTQGKLTIRQLEDILNMLVTRGLHNRVHLTLSKIKNADTIRCVKVLLVVMPEPYEPQSPNGTVKQNDANLRPISQERYVELPGMNDTCLDMGKSSPKGTVVAKVDRTPMHSRSPSLGYRNVSYKGPLPIVQDPIAASVDQLVHRFSLAEQTASIQLAHRRKFGLVPREAPLRLLGPRPLGLLAKRKGIPRVKPSWQGLTAPPFSFTRWPFGGVRNTLGAGNPDQLSGSFAAVALTGREHLEPRGPRATGNAAKPSLTFVGVWFPH

SEQ ID NO: 998044 - protein, 368 aa, Homo sapiens
AQLLQVLAGGRFCAVLEGGYHLAVTGESAVHDSTCTLLVVTRSHSLSGPNGAMSEVPLESIQSCPCLPRVPSLEEPPAAEMCPASSRCSPEHADVPTRGVPPPLHACGVSYVCRGAAASLAAVASTSVDPRPVPLVHRDLPRGTRNRRAMPLSTAPDYFTVGIVATRDRSVPTGQASSPLDGEEENHAMSLGAKWPTTERFALEAPRERAQALPSDQPLWDMHSLGNPSFKALRWHLTTWGNFGGAQRGFERRTWLGALLNQYNVAKAFLDVSPYNGPLPTGHNMPYAHLVGEHCFGALGSYPGAKRRMCSFGNPTHIERQGPPYQVSGPCPCIDRSEGPPIEVQHMRTWVKTRCAAFPSQETAFRDH

SEQ ID NO: 998045 - protein, 159 aa, Homo sapiens
MAPRKWRCRLFHCVAAVSLTVTDSLDFVKIITILVTATAVQRGGTLGYSLLEVSSLWPSSSKTVNLPVDHISLILVCGLASRPVLYRLNVEGDALGAGFLQNYVDRTESRSTEPELIQVKSELPLDPLPVPTEEGNPLLKHYRGSAGDARVASDKESVM

SEQ ID NO: 998046 - protein, 377 aa, Homo sapiens
MHVASGNCDREPLPPGLGRSRSTQQTGLALLRGPQTAAPHTWNDLAACHIMRGAPRRLRVLVPMALPVHGALGLPFWLVRSAHTCCNPHGLRTSATLPSLCSIDTAHENPGMVQPFSMSMPQPGMHVEFRTEREQSAVLHHESPKVTICVAPCQKPRQPGLNHVLDKSGMGLAGTPQAPTAFTQGDLEASPRSSQACLLDLHQSLHTSICDQAMTFPSCAREQGTGPRSLKGFPREGVTIIPIPGVDEQREGMQTVYPEPMQAPMPFPFQARAHERRLGTPKRRHSANSTQDPNQGLDDTHQTNAKGGTALGKGPRDPQSGAGTPPSTQGPTIDPGAAQLRRREKEHTHQRQKKQAKPKSNVPQWAHPVGPHRRDNQ

SEQ ID NO: 998047 - protein, 90 aa, Homo sapiens
MARKQCDKHEGCYGAPEPYKPVDESHDNHEKTPNGDESFSACLCANTPLHLVVRVVARRASAISYQSRRRCAISQEKEEDYAHNKTLGRQ

SEQ ID NO: 998048 - protein, 90 aa, Homo sapiens
MSFWWAISKDKSLSSEYISLLTFPGDNPGKALEHGKRSVGNQSSHRLGRIPERTYPPPGLERSETRGRPPPGLNAEPGGPTAARPGHSLV

SEQ ID NO: 998049 - protein, 141 aa, Homo sapiens
VCLLKILMSTWVRRAARCYRYSKNKPYPKSRFCQRLCLMPMIRIFWTWGGCMAKQWHEFPAFVAYMGVEMNMTQRVRLKPWRLTEFVLNKYSGKEVVVNGMASIVRRDELHPRSTVTPTFNKHVVLVLGLDQRSKSRSVRE

SEQ ID NO: 998050 - protein, 262 aa, Homo sapiens
PFQGSGCVIAILGNVLSVAHLARGEPLTITAISAAGARWSRGPSSSSVPRAHGAMPDRPRNLSSRSSVDEYMIVNFGSAKYYALCGFGEVLSRGFDYKLLWFPCDMTLKCQYARWSPYESTQGICNRYSQFILTMTDGVPWSMGIWTGAHELSPWANSPCTRTLQSFRLCYGESFTTGCAHRQLFAVCHHGEVTVICGLRHELVCRPSPSGQVDRNVSWVEHVLPVGYLIGKASITVSELSEPLKQGNCPTIFRSASSRPPQ

SEQ ID NO: 998051 - protein, 333 aa, Homo sapiens
MADIQTERAYQKHGEPSFNNKKRVLLGETGKGEASRGTYQEHLVVGLQRQPLRRLFEGTYELKEMPLLGGNVSIRGRILSGCGDLDEDAEDALSSAETICHYILQVQPRSRSATRTCLVQLSPCFRDVQIGDICRQCGDVPASVARQLRFNVLNGHQGCRHQEAVPEVLRLDIGPGPSRMAIKLFCSIPQIKQNDHNDKTRRASQSRVSRNMGSRALVAHGVNYLAQGPPRVSGDNPKGPKSRGYRANMEGPAMKVGEKRRYTRAVKEMQENERPPTGNMEQFDKKLGDVTGVSPNKDCKTQRGHGGQNQKTPGTCFNPCQSDRAEVKNRNAI

SEQ ID NO: 998052 - protein, 270 aa, Homo sapiens
MDLLVHHEGPTGPFLLLLLRRGLASEVVPIVRSVWFLGAEESDDGDVDGETVGVESCAKRGQSHGESRGGKANKAKSEVKSDPKKYTTSQEQKAKNQPIDPTNEHKTAIEYPAHDHQNKQIEASLPPNSKQNSSPVCCEIDLPVAVVWLQVMTASRRPLLSCWLLGVSPAWLVPGRIAPSLLTAFCLSTIGSFVVFCTALRAAPPNVALLAVVDSQDNAHLAADMSPAHMNPTRPHHLPVTRCAFREAHAPAPNERLLNQAYSPLQRTSH

SEQ ID NO: 998053 - protein, 80 aa, Homo sapiens
MYPAPKGDTPYIQVNVITMGPSPSGSEGDPSSQGKVLPGLAARGTSGGLPRRLSGATAAYGLLCISLEYCLCGVAFYGCG

SEQ ID NO: 998054 - protein, 189 aa, Homo sapiens
AAVPHRPALLNRAYMTPASRPSSSKATICLPTSSILLTNNGHSVKLNLHLGHAHPGPPVSLQCHADCTCTGRNPNDPDGHEHTVSVTEVRPTRLHIVHYNSDLYPDARHWQTTSQKDLDCTGCIYIEMGSIYNPSYDRSSVTFNMRVQQARKHTSRDSTLKSCFRRGPHEYYRYREYLSTTNFKRHMEL

SEQ ID NO: 998055 - protein, 263 aa, Homo sapiens
MWKTQPLVGHSNENTVCPPNWVCLPPKAKGLEPPIFHHTRKWKRAFGQTTVVLALFVFENETERGFSRGVSHVNDLKRHSHHTIFPRKETPAIRGTGSELSGSINGTNTLEYDPPQQKCLVAPLSGVGFYHLFSGATKDAVGIVHTYRNNRWSFFPNHGELCVRARKTTPDGLWLFSTKTAVLVMRNIRPCFRENRVPPPQYLSAAARVYESRQYYRDWVVHEQNVSHPKRTQRVCRGVAPTRCFFPPFLCATTEVGVIKPPL

SEQ ID NO: 998056 - protein, 117 aa, Homo sapiens
MCLSQLRPDHDHPAGPDPGSLFTIPGHRRGSGPEIFSFDPLPEPEACPAGRPHRLLGVGYPENAQSTGLEVASTRRTFGPRCPAQGRCPKCPGRENPENPQRNPRDTGPYPSFVRWP

SEQ ID NO: 998057 - protein, 169 aa, Homo sapiens
AVRRFLLLGRRVLGWRQKEWLQSCPEHMRKIVVRQASEYDDRDQRDFYDADETWPCGQSASRPTGRTGAQCESLRVTMAEELSRGSIPMKDRPCAVKRLKRRREDAVRGGTRVVRTHRLEACDRSRRLTRCWEGCDDTPRGAAGWNDGKLGESRPRLKDQFTYRPGNGP

SEQ ID NO: 998058 - protein, 209 aa, Homo sapiens
MGQVPSRAIIEPTVMGHFALCPPMGSRRTSSRLHLFCECGPTERRASKVERKPTELVEVDHTLYYEPRIRCHWRPRSRVRVLSQYFGNQYAGDRLRQGGLRSSNPCREVIARDKGPSLEKVWLAEVLNIRQWRGMCGRPITFNANFVATIRNGKDMAPPPLRIGSHSGIHSRVLAPVCVGWDSGKRMPGTKQRKDKWDSQVGFREEKQR

SEQ ID NO: 998059 - protein, 260 aa, Homo sapiens
KHRLAALEPGAAEPGRGSAVSASGPPGGATAELLPTCCPRHLDGRPQQANGPRPERHPWAPRTRPHTTLGRSLAWRLSPTPTRRAGAADRKAAPGDAPYPGYPWRALLLLLLAAGCISDRMTGKRVMQPTRSLAGIQPVRAGRERGRDDPEGEHLQGGHRRNAANRQIKDFRSLGGRSPGTGPNPFRSSLKPGLNLPTKRAWVANGTLTTGTPWTPPWRADGIGAENRRGPRQTERQPREATYRGSKRRERQRFGPGRRK

SEQ ID NO: 998060 - protein, 347 aa, Homo sapiens
GPGGVAVCQRLPCLIPWVQNDEGFVRRRCWARKCKLVTSGPWLEVPPIALRDVSSSLESPGAEGSGHSIALWAVSDKGDVHVPDLGSVGASNLRDSSWTARWHRTKPLSTIQSPRGPAYQDVGRWQGDRLRTFYTGIRVPRRQNRPVTAWYHIRNPPRQRLKQVSAGTDRQEYALDENGNLETIAKGYTPQLTRRDSSREHRVQQKCAEEVRGPLDQRLACNRNKRAGEGKKPWARRGTSGDKRKPRDSSTKKHNTGTKKGENADITRARLATLTIRTGPKANQWTPREPKTATSKEPEVHQHEQDHDPRKCRDNTAQDNYHNERSHDEGTKRNNTGARGRQERPNE

SEQ ID NO: 998061 - protein, 76 aa, Homo sapiens
MDTQAQWFNTGRSQEELRKFTPVLTRQTKLPCWARCICHFNPKGHVYPTKETGLEGNPCISDRDATGALLIPEVVA

SEQ ID NO: 998062 - protein, 105 aa, Homo sapiens
MTPKIDGSLMRGSSVGICCGSRAGRPGIYLSEGQERRYGPVSLVELEQGGDQNGGSVLALACPVAPSPEALAEWIKQVWNWTSASHRSLDTNTNHKTLVIVSSRG

SEQ ID NO: 998063 - protein, 163 aa, Homo sapiens
MHEGGLVRRHVTPHSWADRSLQGISCMRRYDYASELEITKIYEYLVDTRWSPESTPPGGIGHTRRAKLTTIGRMHAGETEPKEWYIPSSKAFLVQGYGSESPFRGTIVNMLCPEPRHTEGSVRISLGFSKQVDSPEDIQRMCPRLATPLTVGVAHMWAQLKVD

SEQ ID NO: 998064 - protein, 417 aa, Homo sapiens
CERGNLNLYPCTFTVGDSTKVYYDSGCARYHAGDQVPPGLGANPDLHIRDNAKGANPLRFFRPNCTWRQRVHRPLPRRIDGSRHFLCVSAEAERMALSNGEASAETASARNDAYYVHGYAGLTGRAERALRPLGLHYAGLVISPPTHGKLNTWRGKVLAQIYCALDPNAQGKQEGTPIGRPWKGGLSRRVSQRARGAEKNHFARHDLGDLDAIGVEKQKEKYAHLTLSMESPQERKGAHHVWEPRWMSSGDGVQWQGTVGHGMGHPLVNDQGGPVEMARGEPTARGNISTPQKGYASRAASRYFAANPLPNLNSKIRGKVCLGDLVPWESSTVGNTMDRGHVHAMLGTSFGELVLTNTSLGPCGHHKNLERTRADHWHATGREVNRQERLQVAKEDGTTCRNVPPGELIDLRIGKGE

SEQ ID NO: 998065 - protein, 218 aa, Homo sapiens
GITAAFLQKTDRLRLSKNQRPARAKVTEHVRGTRPKAPRTYPSNSNSARSGLPCDARSKDEYHGTAMLEYHSLNARIVTMWAMREVERCRVTYVMYYEMSYGLNSSRCTIQAEIVEKRLNGIMCRRSCPTSPDEHQQQVLGAIERAKQVTVPELNSIIRQHAPMSILAVSELAWPWPCPLVPPLPVGLAACLRCRRFSARLAVSISTCPRLGSQAQLS

SEQ ID NO: 998066 - protein, 144 aa, Homo sapiens
MARGSGAEKVWLRTGVRCQIEVDTTVLHCDASDVKRAVQPTLGCDDTQENSSGCVGELDTAIAVIAMRRMVCRSLAMRAVLSKKLGGALDVHLIQREIGERLEDSRKVSTRKDPAGNCAGFSDMVKLRIDHEGALGVRLVESYQ

SEQ ID NO: 998067 - protein, 354 aa, Homo sapiens
MTQSKGSNRDYGRQRRGGKAPIGEDTSPQTPRYPGNGAPRTIEQGLTPERATIYGRANHPGEERVVHATSNTAGNNTNPKHTRRGAHTPRETTVGTATNDHTRDHQEIIVPDSTVIPTKKRENKHDIAQENTQRAQGGKPHNHTRHREEPTYTETTPRVKELGEHHAHQRGKLDVDTSAHPYNRYSGGDSTKRRRHWGHKRYTQHNMDRRETTTDEVDQPHTRRNTTNKPHAHAREYSAPHRHKRRLDPNQHEETKTEEQKKTNSEAKQKQGEARILEIARPDGDRREESNTDNTRHNKRNTANNTRSEKQINQTISDANRYRTRLTHTTQPRGARRQSDKTKYGEEHDRSRTH

SEQ ID NO: 998068 - protein, 66 aa, Homo sapiens
VIAVHRSMPQHLRSPPDAADGEYLCHAAFTYAYHDKETNSIGMHICDSNKSPLSLIIDSLNDSRTD

SEQ ID NO: 998069 - protein, 219 aa, Homo sapiens
MVIVGLNKELSTAEGAGEQKVYAVRYEEENEILEVMRNVESELSIVRDFSGPLKLLKQRQLLHADMRARLKQKVKSFGQKGYRVRSWLLCKNSDRTNHTLGRKRSRRSRTGFAVSRTIPQNDPSAREGNLMIPVNDLHADRYSKPGIGHEPHPLPDAPPEQGGLHPPNIPISATDNEHSGSERPRHNPPLEPQAQQHKNTTTRTAATPNSTRTPPRTQR

SEQ ID NO: 998070 - protein, 106 aa, Homo sapiens
MDLSLGPDSGSTERGTNVPRLKLATDFTLTCGGQPERIVPTIFIRNSVMMKRAPCHEVGLTALLLFDTLWVLQRKRFESVREYLRPLVLPPTTDAWLIFHLGGATP

SEQ ID NO: 998071 - protein, 329 aa, Homo sapiens
MFEPPILLPILYRVGQAQEQGGSQGQFRSMSLREEQHRQVSTNGSGAELVVPACTLPRSSLKLKSRGTLRYGPGRSVCLSTQKVGHTSQLVRHILHIARGLLLARNYRDASCPSANTRNVASQNSGIRTMAGTYYDLLLLNGPIWYMFTAISHSGFGSSTTEHRQTICVHGPSFPKALPTPLLNVFHALASQGVAANLTPGKTGAACTYPHGPCCPYWHPSTCNPPVLPCIRTYGHSLPKSLRNRLDSHYSGSPRKDFNPVCWFPIPADNPGTNSTCRTYSTPMGHHAEASARVPFPPGYTEHPPPIGKAGYGYLPLNLSGKAGGLSAQ

SEQ ID NO: 998072 - protein, 125 aa, Homo sapiens
MGGAGARGLRRGCERAERVENIGIHGTIRFPSETQVSGVKLLVCCSLLIPVSFRGARDAHQGRADCFWAGWHECGMQGNAGLMLILQVATLTNGRESEALCWSLDANVEDVVGTTGLLAASACTK

SEQ ID NO: 998073 - protein, 110 aa, Homo sapiens
MFTGKKSCLTEASMVMDLSLGDKTVFQWSKNGRTSELERYTLIVNDYAMVDSASSVSGGWLSTEENATNQIRKTSYAQRPTRSAKIRKKHDGRVMTREVPEQMHLTRSGQ

SEQ ID NO: 998074 - protein, 261 aa, Homo sapiens
ACPPAAWNPLTAWECDLLLGGWPCRPTSLISGGLLGSDQPLPGQAHRSWLLGLSWAKWALRQPHCAWAVALPTGRSHGPALLLRAAGSGAAAARCLASAEPVRVCSHPLCPRGCCLCRPTWTAHSGAAAGDNFIQAWGPWLPHMTGLVDLTLSRNAITRIGARALGPESLRFPPLTATGVEWHRSLRGPVICDLISGTAGRWPSYEIPEELETDCLQNSECLAVALLLTPYLTYYEHAQAFALVIPGLLTLPRSAVLWLGA

SEQ ID NO: 998075 - protein, 259 aa, Homo sapiens
SLVAQIFFWGGSEKTGGKGPFSLPFLSNTRKEPSQRGDMKRSPKKACGGLKRDLVRRANTLCGAVRFSCGPLQRRCWGTGGQPSWAHTGRAIFWVLPKESPGWGEPPRYEILRARALHIYFQRSRGKNFAPTMWGGFIHTPRVLDLQAPPESVICAAPQIVVGASHPPKNGRCVSTTSVFRGPPTGGCCFSHHQGGEHVVLSHGVDTQRVCGETSSRRPVSPYFFSQKKNLLLKRGGLVRAPLERVVVDTGYTSSPEED

SEQ ID NO: 998076 - protein, 266 aa, Homo sapiens
MCVRVHLFRDCRASGRADSSRLFGYAGNLQESFSPWILRAVFSACDVGGGAAITITLRLASEAYTRRYISEELAQQLEKVVKWHHSDMHDRPECNGKDRCHGPRFARVISLVVNRCAMARVTRMVVMGNRVMTIRHRSRIDNLWANFVSAQFLVLELGDVSCIGGFTRNPEEVPNGVDIPVNHGPNYRRWPNVERGHTKCGLRARRYRIHLTRKDSRFGGNAVRGRLWFDEATVIRQWTTLNWINTKWRPQSNKKKPEKNISVRQS

SEQ ID NO: 998077 - protein, 187 aa, Homo sapiens
APPRPSRGPSRASQHVHPTSATPDIHLAAQPASRAAAPEVRSELLLAPAAWQQQLSTASAPRRALRGRALCLWGPWWSVRQSRAACTDVIHDACLGARLTGWTTRPPSLQRVRQEEERADQDPQTMKFASFIDKVQFAGAARTSMVEIQVDSCVAGVEKSVQETVRHPQIMLVSAQDWLGPSGVSSE

SEQ ID NO: 998078 - protein, 121 aa, Homo sapiens
RKLANTEELQFYLTGIFHDWTIINPPPIVLPRLISRPDQWVNPQYWVVSALTRRKVGHPPNKKATRRLCRSTQRAAANKSGPPTNNRGTDRPPETIGDRRRSQPSEAHANKAAVAPTQQSS

SEQ ID NO: 998079 - protein, 102 aa, Homo sapiens
MHAVHPRLHLVSLLAGVRPGRPCLIGPDGITAAGVAVCSAVGAHTCGNRPVTWRDFSRRKGNWLTACDGPDESCINSSEAVSGYSQSMVNVTYVMRFGSFYL

SEQ ID NO: 998080 - protein, 151 aa, Homo sapiens
MSNVRVSYESPNSVRKLFIVQGGAVETTDESLRSHLLSNGERSRTVWYREIQTPMRSRGFGLVTYATCGGGGCSYELQWSSQGWMEELLEPNRRCLQRRFLRRPGAQLNCDTSRYLSGGIDRRKDDVYMIHRDYRGLIFVDSYGRERIEVN

SEQ ID NO: 998081 - protein, 41 aa, Homo sapiens
MAPGAAGNREYKQRTYTNTQANNNETPNRTTTFTNNNTNND

SEQ ID NO: 998082 - protein, 210 aa, Homo sapiens
GERERENSASESSDTELPEKERGGEPKGPEDSGAGGTGCGGCDDPAKKKKQLAATYALHKPAVARATGPSEDVPDDMREEIACGPTHRAARAGLVQNREPSGVKRERNQQLDLCKGGYVPQFSGYAAYETCTPRYSYKMGRRAWRQRRLTRAYFSIHDRCVQSMSRPSHSHDMRQMGQGVLDATRAQKSKLTVSSSAVRGCRTDPLPTGY

SEQ ID NO: 998083 - protein, 400 aa, Homo sapiens
GWSGLPSELAAGLYAGSSPPRSLSPRFLRRGVGWREGHLVHNLASICLLERIEMKLDGVVSIYVTEHCEEPCPPHPYASLERTSYLRDVGKKTIGIVTELKIAHVYNIVIHENLHMLNVRHELSVDGRESESLRMRVDTGCSTEYCVCESANYESFQDANGLRHDLVCNTIVRANDALRLIRRANLGIRRHLQHKHRYQSLDVPVTQACRPKQSSCTSETIGSNAAATSLTGTPEKEPPVMASGMHVGSRGDVRGQYRPGEWAHRTGVTGTKRSWALGTNVGSLFARGTPGRVPRQAGTPRTHRTDNILDRARAKQEGSWDAGTLAQAAPKEAGARVAWRANRTGKDPKKVTCLGEGDRAGGPGMRPTDGGTKEQPGLREGDIEKEVPGTWQTIGPCVEK

SEQ ID NO: 998084 - protein, 70 aa, Homo sapiens
MDFLVNPVALLVRPCWALLPHWKYSGARRKVNAGGGACKCTIYSCTLYPGSYVASILADVVGSPVLSKNT

SEQ ID NO: 998085 - protein, 134 aa, Homo sapiens
TVLRRGSQCPSARGPASGVGPALGRTRRRPDAREEPLPPRPFRPSRRSPRGRSNHELTLAIPRPQVATHQLHQVVVPVGGAAYPPPTRCHHRAGYVGTYAGQFNQDYLSGMAATCLGPFGGANMTNLYPGAPWG

SEQ ID NO: 998086 - protein, 201 aa, Homo sapiens
LVSAALSAAAGCGGLSGLAVRLSRSAAAEARYGAFCKGLTRTLLTFFDLACAAAAVNFPYFYIVASVMLNVRLQVRIEGAPAAAAGEGPAEGAPVSPPAPRPVYAGMKESWSRVWGARSAGAGSEPLDSRPTPDKGTDVPSPEPALRSQTRGPWIAADNALNWAPAHTGYQKLPGAQDEPVASLLAKEGETRMREVLPAAT

SEQ ID NO: 998087 - protein, 324 aa, Homo sapiens
MQRYLGVDPSVSCLGARCGNLLSVSCEIMRVSADCISADGFLSLDCPVMPAVSDPGGSEQTAGPQVPSDSVRRYVEATVGSPCIRDYTEKLNIVDVAYRGELAHSNDVYPTCWQTDESKFMLADDLADIVSFRIYTAGSYWDTVFRIGGGLFPQIGVAGMLVTFVVARRVVKQRAFTARKRRVAEGLLIGVHRAHSGVNLDLGAEVSISPKTGSPTGFNACVSPVPAYPEGCAVTQRVESWWTWHAPLLLSGTRRYPTRLSRARLPRKGKSWGCDTKESWLNSTTMVGHPCAKMTASDERPSVWHSEPGATSSYPSTLAMLMEF

SEQ ID NO: 998088 - protein, 208 aa, Homo sapiens
DSGGVYLYALFIKSSGHAYTTSTARRQFVSAQCVCSNRPLHECYCTNESSNAIQLRTNVFRAILLCFGDPVQQRVIRLDLAFRSLARNRELLVDSPESLSVTIVHTQHSSQGAVRPITAERSDLWLALGTGSPITNTLFICVAFYCRPAQWIVGSGNVAQTMYLCQSNFVPDGAYAGCAPTERSSLNECETMQGCALVRRILFPKELY

SEQ ID NO: 998089 - protein, 271 aa, Homo sapiens
MLSLHDPSRVLCGCGRWPSENHGSPRVGRASHVGVTPPWYLRIHEPSPVLQSQSAWFRTSAEELVHAELVEVLEPEGRIVPSEFNRFSNPWSLCVQHDRSVGLSTMLNFETPLGHECGAERAPKTHSLSGKLARAEKQAQKCGSLSGRRHGNVGPWCEGMLQGLENFHVTSLTGRKSGCPARTFPLRLVPRDNAAIRLVRSSAWITVATVERLQSKTLHGSHLGTTLAGCVPGRPLGNILKEGQYWLLGQFRRQPWGRPPFQESACIVAPG

SEQ ID NO: 998090 - protein, 220 aa, Homo sapiens
MRRSDYNVAADVEFYYYGESEIVHHLGYHVMLLPCSIVREVSRTSSLVPPDPEAIRHDIQLSLTPSYEGERVCGDGYHALSSRDHMAVVGFILSVTPVNLLGTILVGPSCSVYTFVAACEAVGPFRTDPYRVKGSSGISSTYRSRIEPLLRDTDICLGKLTRKVPRMQPNRFKEAVSLPVGHLCAKIGVGGVPLPHWALSTLCIAGYLYRGTPLRFSTPR

SEQ ID NO: 998091 - protein, 151 aa, Homo sapiens
ERAGTRVPLTEACKDLQNWRHDEDSAAVIVGLLLTWESGQVLAGPDVSQHKKLQGHMSQSRASQGHVYIQAHIPNMLVAPMRLHKLRQSTAPRPSGTHKTNTAQTGRTSHALHSQSKSPFRPEHKALQGTGNRHTRPEQLPPVRALARNPK

SEQ ID NO: 998092 - protein, 321 aa, Homo sapiens
MNNSWLPDVDGQALRGRSCTGALTQETLRSYFSQYGRQSSAFVFIHAHSIKTSQPSLRRAYRGLVKNFNRHANTVIGARVLGPARPGPRVSMARETIGTRQAQCRQPPEWALQAWQQKHRARNAQRHGQTDGDTQGRRLTPGSQVESYTHNVDGSVMGTFARTSRGVVGLTDHWTTYTRATVTLSNTNELFQETSGGPTWARGYTVQVEIPRFSNVAPGSEPGHWNGGTTRGKESYAVGETTIMCRFCNPFVVRSKRHNRETHDKFPKHCGGATPMVGPFVFHKHHHLARHFLAAQAGEHASFHELGCDTPQYRPTGVGDD

SEQ ID NO: 998093 - protein, 146 aa, Homo sapiens
MLVGLYLDSCSHPGSEIPLVVDQVILRESSLVTDSVCAACKSKSPVSSAGYLSFEGKTGTNASTYFHGWNRDHKITPHGTNLEHFIVLKYARNAKVRCNTFILATTYILKELTCVGFEDLRSPRSVRGLRGIERIPGGQVCVPKTV

SEQ ID NO: 998094 - protein, 197 aa, Homo sapiens
MAGMTDSSGDYIDSSWSCVSVGERTRGRVVTSAGSRGDVDTSGWWCSLKIRGDRVNGKPGHGQTDAHLRGKQNEARGMPARHQIGQLEQGTGTPWPERHDTLTYGRPKRYQETQYKSIRGLDTKHTGSRQRCSTSRWHSFSPKTAHFLPRGLIGLDNLDRNIQSKESRDNTQNEEDLLTPLASGGILEERKGERKKE

SEQ ID NO: 998095 - protein, 125 aa, Homo sapiens
IICSEPDTCINESAEEGAGSVSWRPEHRKAKTLTDNRLTSKREDKGTSGPKENTHNREPRKTEGDEHTTNARMHNRSIHIIRVKKRHGRDEEKKRPGPKGESNTKKDQQTKKNNEPKEHDQDNKK

SEQ ID NO: 998096 - protein, 215 aa, Homo sapiens
GWLGLAALPGSRRRSPAPLPPLSPAPLAPGTAEAAEPWAIVPGVEQKNYYVCVPLGLIWKLYSDIFWDLVWIVHPARFPTGNVDYYMESSRRYPDHLALPWGCRPTPPAERRNGQRSPAASRHHPDSPDAEDRVKRIPEVPTHGLYTYPRLGSHRTGPREAPQTVAGLKHTLHQGATKSTKPHAAQAHAQSPSPRPKNHASRIAQRTIAPGNRPR

SEQ ID NO: 998097 - protein, 247 aa, Homo sapiens
MWPARPNFVSPFWPEEVRTYGPQVDKALPLYAWDNRPIQNPPLTSLEGVPTLGASSVPSPDYPFGGPLKGKSLASICSWRRWDSIRKWTVAVNSALQGRSRVVHCPSVCRKTTVEGDNHFGALETGASTFLEGAQEFSLSMEPLNEGVSRLEPAPNRPLENGRTSGLFTSTKEVFALNFKRKGFQLWTPSLSGFKREPRREQKRGPSPAWAGWGAPRGLPKSLVGLSKRVWAVFKFTECTQDLKRRK

SEQ ID NO: 998098 - protein, 367 aa, Homo sapiens
FGCPASTVLGRKPALVPEPGLAAHSQPSDHLFSRSARMVPMGPAPAASEVAVACQSAVDGRPFHLALPLTRAMQQLHLRLVTPLLYALRDGKHGQRIDDAREIISLGTLRNPYSSHNSFYYLLVREWLNLSLNFCETLTWIGTCFGVTWRLESYCDPDKGSSVGYLCNRRQVAFNMHGGQKGGEEQSGLWGVDITALNLQHGRWAQRNTARKPGEVVWGHSEYISYYRVFPVATVFEPERPILRCDPLRHTKWGIRWRDPHLPKRSPSYICERKVDGTIRRADITRLTICSADTGPFAPFALDAYPTKFRGETSMVANPLRYSKAEFFGLATNRLGLEGNTTSKGRFSQFFEGIGQNGFYEVIAKTY

SEQ ID NO: 998099 - protein, 285 aa, Homo sapiens
MERQEMAELVIDNGSGMCKGGVTVGTTLPEPGSSFQASGGLQYHRWAVDRLGVGLGIGLLLSRADEGLEEAGVGNRWTLEMYSPIRAIGAIVIRILGTDECDAEYIMAISQRFLTKLKTADCWPPGRVGEPRSGVSETLKGHSPMDSPLKGTQPRKEDKQWSVQEFMIYWRDPLCVNLPLAGHYLALPVWGPLSRKARGARAISPVPLAGAPLWGPTRANLKGSTIGFQLGVAFPGAKKPGEVFQTTLFQPGVGPLRVAVNPCRGAALYLAPLCLGPMQASISLV

SEQ ID NO: 998100 - protein, 264 aa, Homo sapiens
VRSRVTARGALGVRHGARLRALLCGAAACGFAAGAGCGVPGGKPILCPRRTTAHWAPGKPSLSLHGQDDLSARRPPRTRRNPLHSIIQASTESVQGSTFQNHESQGRDKRKLWATFVWPRSLVPQEQDEVVKYRGSLISNNCRGPNCPLVKKNSLGRVQQKNCWAIRSLWNRWGPTERPNLCGPREDKLLANTISPTFLCHKWKPQKFGPGKKNRGHPQFQTHFPRGINLGDTPAALTTRERTAGLFQTLGGTICPGSGAQQPS

SEQ ID NO: 998101 - protein, 38 aa, Homo sapiens
MPNKFTEPLVDDLTDHIISTLFPTFRHKIQRAVNSGYK

SEQ ID NO: 998102 - protein, 72 aa, Homo sapiens
MARKSKGQDPEGNVENGGQRRASRKEFLRKVGREFDPMRCRLAPHWEEQFPSGGLGQAFAPGPMVPTGRFPA

SEQ ID NO: 998103 - protein, 102 aa, Homo sapiens
GYKSGQNILNYVQRSDLCSPRDPFSPIVLVLGRQSCGLSLQQWGEGGYPFPRGRETPVVVWPLPINKKCVESSSVAKLCASGHSSQGEPAFKRLQGCLSRVG

SEQ ID NO: 998104 - protein, 31 aa, Homo sapiens
MNSARDPYGRFCPRWPRGPTQGLQGLVENQH

SEQ ID NO: 998105 - protein, 229 aa, Homo sapiens
LRMRGIEKRDGDMCFLWIRFVVALYSLLSYVLEPGRHDRPGRSGLSHDIQLSRRHWMKQGDRLEIDDYWYDRVFQGINRRNLSGLNDLAAKLLLVSDAAESILYALTTWPGSLHSVLYVIMQVQGSSSTGSVGRNGARSSVSATDDPIWRSGQKSAMGSTSRDYQLRKWPVVDAQDASSVPSSIGAGKLGVVASCKGNMTRRPGKAWETATQTCPVNKGTARKLWRNGL

SEQ ID NO: 998106 - protein, 96 aa, Homo sapiens
PANSTRYVTCATRCRHCMSWVRLAYRGILSISVLWESSLVGSPIGSLFTTSNLCLRSMSWTAYTSVCIDSTSVTEAELSVGGKPHTLGYDAMCYCR

SEQ ID NO: 998107 - protein, 190 aa, Homo sapiens
GKAEASGSAELRSWTTSLSLLNNDITIELGGHGWSACNPSLLGRLRQENALNPGDRGGSELRVARRCSSSPGEQMQDCLKNSISRAGRETSTCSLRHHFCSQPMGHVCGAADTESHRCPWWAWAAWKSPLGNVKEAVKVAIDARISAHWLCLCLSECNMKLGEAIQEKIQEKAVKREDLCIVSKSWATFL

SEQ ID NO: 998108 - protein, 133 aa, Homo sapiens
EETSNYFSTFIRLLAGLQPSPMCAVLRDRTQEHPGRVIVCRDDPGIHTSGLTCRIPPTCHWISLLVPQACQTQAERDISEIISNGFYRRNHRKVGVNEARIIAHADRNIAERSLLFDENSAEQLGSANSCRID

SEQ ID NO: 998109 - protein, 342 aa, Homo sapiens
AKASAAAGHIVTDELATKLSLAWLQMEGRGAAGETPEQPGLNCGSGGVRRGAPDCGGRVLLGMQRTARLERQACLLAAAEPQAMGIWRSPKSPQTDDVFKPLNQFKGVLQEADQGHGEDVQGSMMPGLGTASSTLDGAEDLIDGETLGPLRSNWDLDRTLIKEGGGGTLTAKLRLTGKYPSVDLPKRAGRSGGAFQEGTGEGLCGCLAPGVFLRIRRVLPVKGWSRGVQRRHSFEGQGPSGADFTRCSQYPGISGRERGWISAGCTRKSRGTGKQGGTRKSDAAGEGKGSRRATAGEKRSGPFPTGEAIADVTKPLVKDTAQWAVIGRARRHERVASVDPPQ

SEQ ID NO: 998110 - protein, 114 aa, Homo sapiens
MVLGWSPARRLWWGSLGAAQRARCARYWPRSQSCTSRLVGRTVGRACGSPSRPPRGSGPMPHASSTACWLGVAARCGLRARPRAMPPVTGTSSLCLLSRRGRSQWFSSIPEMSN

SEQ ID NO: 998111 - protein, 350 aa, Homo sapiens
PISGSVIQVADSTLHVAQGFGPLWNQVGSGGSKIVRASGIMEDATQNGETASTDRSYSRIMCLSASGAAVGMEDVIRDEGSRIERDDDTFAQQFIERFTLAEDHQSSHMRTEKRLEAHCRLLLRGPNHSGVPGGDDPFIGEQVAQLGVAVRSSIRTIVTPGKVEYSNLEFDAHHGGIAYRFTLRVWRDGNAAPPGQLDLALERPGTEIPVDNGCAPFGGTYGRFHQWGCYSRQFPGSMSIGPRSANGYKPQYSLVGTVDRTPEFVYKTALGIALQRTRTPVFGPRWLRFVKGNRLFHLTTSEARENTRRQRRHTNGLDDAVEIAPRYNTGFEQVFGKQRERNKHIGRQHP

SEQ ID NO: 998112 - protein, 274 aa, Homo sapiens
MGDETIGKKLPAIYEVVHDSMQMHRLVDTAGQPSKDSLHSSYVTYEGTDMHAESRIKEGDLVTLINKDWDRRRAGGNRELNGENAGVYPEEHSRKLVSTGNSETRQGTQYRKNAHRHHESDYLIQSKTKEDTGEQMKERTHEPVKPEEYPCVEAERTENVTPKQRENTDRRLEDGRTKKKKKPKTELETINKQGTIQIYHGRYNGRKEKGPRRRRDKKAKMASSRQGRLRGHDWHPQRERAGKENAGQGYLDGRRQPIGMTKSQQDSDRNRTTS

SEQ ID NO: 998113 - protein, 228 aa, Homo sapiens
MLTIQLSSESLAQVVSLLATLMQFHRRTSLQWASSPWFNGLTDLQARQDTRNMSAPDSNAPTVDVTLGSPHSLSKGSRAEYFTSMRISQVTTFCWSTLLYKGSEKQLDRKYNMTSLARTSLNRNHASLSSPAKGTSRLTLCSSQPSPARLPAARDPFDAPGRFHGLAAIASRHALPTGTSNPCESNRTYGTPGPRYSTNGQSKAKTPQTTAPRALHYPAGGTTQRHRH

SEQ ID NO: 998114 - protein, 173 aa, Homo sapiens
MRRSEKSNLYPLDRRTLPAPRMFRIALFGSTPQNLTDAIHPQSWLPARRERYLECVVQTLRHRSVTAVLSSYAARVRNGDTDRGHNIFKTRLCGPSTSHLYAQSNGWIVLTLPLSSMSSLSGGPSGAVRAMTLCLDAPWGTTPLKGLLCGALFGTMSACLVGHLIPGATADMP

SEQ ID NO: 998115 - protein, 126 aa, Homo sapiens
MSFGLRSGGDGRKCTVKCPVPPICTCTSYRGPYVKLPILHTVFTQLRDGEIPRKRNKRFLATMDENGCGAYPGAAQFEPFSQFLLHLRCTVTMLARDNYFPQGLICFLSKHLFPYTPSYADGQLYS

SEQ ID NO: 998116 - protein, 281 aa, Homo sapiens
RQIADSAEYLDALIGTDGPISCAHVPGRVHRWHNTRYCWAEKGGGLYACDRHPTDFSGSTILLEHEAVKYLAFPSARRMNTKLFSEASYQFRAPQARDLHGRTRAEVCLAPYKNQVEGNARSGPSQGVWTDDPIRSLATKTEKADWWFLLALKVVASEAYKTSMPILGAPGITKSGWRRSQAVTCHTWTEKRNRRHAKVSKQPRRERHTSVSEGVTEKRVRSQNGSEPDKLTKVPHETVRRRTRRMSVDREARINELVKYPPLPLCLAFTSDGLTLEMFGE

SEQ ID NO: 998117 - protein, 322 aa, Homo sapiens
MCLIRTLYQLIPEQYDPQPEKQQWPRPVTLALKRSNRPYTYAHIGPNWVVNQSSETPRVGPLGDNPRWWPPGRENGPYGPGGSGIGEQQTLGGPDMAHITGGSPGSATHPGRKTIHKPDTHRKRDHSTTREGRPPRGDQTTPPGSKGGLKPVGRAGPVQDIGGHVTESETTAPVVERGHRQMRARDIRKERGKRDFGPAVTKGGDGKIARQGTQHLPGSRDTRGVYPQTRGHRKPEHKATTRTSYTSRAEYNQKGAHRGHTSPTTDEEPQSPEESTHTGDTTRMQERYPLPGTKQPSNGGDYGANPNPHTQRPSPPRTTLPP

SEQ ID NO: 998118 - protein, 69 aa, Homo sapiens
VAVRSLRGSWRADVLARIRDPQAVAVAVPAALGPSRRDAVVTPSRSRPSAPFSAPMTQYAQGLIVISLR

SEQ ID NO: 998119 - protein, 55 aa, Homo sapiens
MSSLFPRKSLEKFLGPSNYLRTSGKPVVSDSPTEDYIIFSFVVQTQHINIFFPQM

SEQ ID NO: 998120 - protein, 120 aa, Homo sapiens
VEAISGLHSTGVSMVNHASLGRGLRTRLCAGIMVRSEEAGPGWCPRSTGCCACAWLIAREYSGGVDGTLHSVTGRDAMGTLERAGSVYGRDGRPWEQDRPLRPYYHLGAAYWLFCCVIMC

SEQ ID NO: 998121 - protein, 313 aa, Homo sapiens
QQNASISSLCLDSAIVNVKVETSSTCPEPLCTATLLDSEKRRGRTCPSRVSYGEQEGLRVEWTANSLYLSTHADTCYSRQYMREYELTANHNIRYESSKRASLGEERASRLFRVRGTLGWLTLIKTLVVTVQGVEYSVPRVYYAGPRVVCVPCTVYDWVPSWRDQLRKLTWVPAFENRMALPLELKNQRCRIGNVTKGTAYRALPLAWVSELGIAPQGGLAIDREGPHPSPLGNWAESYPVDVAKPLSLTGESGRPRVVGGNQGNLPALVFGLSVIWVGNHVVAQFALGGPTEKRESDTLLPVHGGGSLELVG

SEQ ID NO: 998122 - protein, 291 aa, Homo sapiens
MWDLGTTSLVVLPDVSHSHRIGEGSPSEGLGSGFGPRNVYPRLAAIDGRLGLSYGCQPCCAWLIGDVCHGTWPVGAWRQSAHRICSARLLYSADLGCEVLPREGLQVIGLDNEEVGPRKGASDSDWELRENGLAAWITQGLGGLTSVVSVRLTTSSYDDMGFCGELKKNLSFILDSPDYSRGPVRLQLRYYGVPSIGSGSFLSDIETTTPSDGILNHIERTFAGGEKQSCKGLPQGDTRVRRSAPQEAGPRWVDSTQAVALLSPDCGLLVLLVVPIATRASRYKGLPNPPG

SEQ ID NO: 998123 - protein, 195 aa, Homo sapiens
AAAAPAAASSSASCSRRLGRALNFLFYLALVAAAAFSGWCVHHVLEEVQQVRRSHQDFSRQREELGQALQGVEQKVQSLQATFGTFESILRSSQHKQDLTEKAVKQGGEWRSSRDPPTVLAGNLQEWRIPQNDLSRWGSMVVEGTPRERGLSRSPGNNGGRERLTGASPKSHQRTNIAIFTEVQKRSQKEINDMK

SEQ ID NO: 998124 - protein, 265 aa, Homo sapiens
SHPSGGRIKVFNLSTMCPSCTLTMASWQAETPPMRLAVSKSTATKPLSAIWVGEGTNKDRHRVLRVGAEPAVLRTPSCSRICASSCDWRHDSSRLRHRGLVHMVVALQGVESYALEGCSLANLLRASRLTMIAPSRPINRNSDDNPIDHSCCMRETSFKAMDDGVAGIPEWSDERGISSRIAKPRNGRSRRVFGGENEFVENLAGAPLTEATASGIVWFMVDPSADRRWWHREPSLADVPSTGVAERARTGQWECRATPSEVKLG

SEQ ID NO: 998125 - protein, 198 aa, Homo sapiens
MRDIRENFHLTVMHLLCPGRVVQSHMTLYHDYAAYLIIALSEGVPQALTVDVLGRGAECLVTIGVVRSVAHDSCSTQETEDALRWTAGTRASIMSELQGEMSRSLPMDSWSIMIARAMLALSRKTAEQEEDRSWHHGTPGSEDPVQEIYRENQIHKERSKKGDNQTNKTKVKICSILERGGFVGATLRLQSPTVHSRR

SEQ ID NO: 998126 - protein, 187 aa, Homo sapiens
MVDDTSHGGFVGIRRAIRCDKPPSEGPARDPLRENLYCVVWMPSVQVELKLATEWAVLLSYKATFWASKNCLQENESGPCNARGSLLEGTRGTTVNARELSQGNARAWHGSERSSKPVDTKGNLRKDPSQMVQLRPHPQDCAPVFPSCRPEVKASTRDWDDPSVKPGWPTVVPEEGLRTEAPSDDAL

SEQ ID NO: 998127 - protein, 178 aa, Homo sapiens
MRPEGGIAYSCATCVLFTCEERSCEAGNEKVRREKLRTAAPGSGKALTFMAVEEDSSARAGLSPRLGVHRRQVESSAQSSCGMSSSECCWVVRSVNAGAVCPPGGLVATLRRDLGGFGWLASSSLSSVTTLAALELATAYRTRAIIDTLRAGNAGKLKPKRWSLGKTLACPFAFGLGA

SEQ ID NO: 998128 - protein, 226 aa, Homo sapiens
GENYADTSGRCAAGVERARAVPKPSNRPTRPRLAHPHAREHSQPCTTELELGVVMGKRCRAVPEAAAMDYVGGYATVPGYDRPGRAGRVQEEGAAWTLAKSFTASCPVSAFVPKEKIPDPHKLKLWLKVNGELRQEGETSIHDVDHIPYIISYVSKTHNLGRRRYYHGLGRLKGVGPVKENDEIEAGNTRAGQYDMLKVEKPEYLSYFVNNFRDKNGTQDKKQATA

SEQ ID NO: 998129 - protein, 148 aa, Homo sapiens
MKLRQLRERPPMQARIPEGLNQTLEQSRVGARSGLTRATQTPTAMPTIWDQLGGVVLMDHFERTHLLSSIILPGMTTEMLGYSKTGIGGHHGPHGIQGVRRVDHQPQQEHKRKRETLTRWGVSATLSPRHNVNLPSSQLLCRPKKREA

SEQ ID NO: 998130 - protein, 160 aa, Homo sapiens
MVDCPWSAPWTCVTSGSWPPGAVAVEVFQAIGGGELLAGRNVVFFRLVPAQAQGRICRREARGGSTREAKGENSARGKPGEDREGSQGRISERKVQEEDSRGEPGEDREEKPGAELGLGKRRRRGFSFTRNGHRVGGLDSPPEAGGQGGVLSGSDTQARD

SEQ ID NO: 998131 - protein, 129 aa, Homo sapiens
MEAYEDGVEMLFRTGAQVSLHSHKATSSHGLGEPCSHRRHGGTLLFAFRRSARSSEQPRGANNLSAKEHRRALPCHIMWPEAIAQFNCRTPGRGTGRFRSCSPGAAPSSAKQPGEKEHPQLPQPRERDN

SEQ ID NO: 998132 - protein, 341 aa, Homo sapiens
SGTPPPRLGPLRPTLRFATNATYRRLPLGRPLWSGELALERANDVLRNRKGVPKRASLGKVRGPLRGAKPGLPQWGPTPTPLMGWPPYGPRPPHLQTPKDKNIGLYPLTPRNRREGNWREREEGSMPFGRAPLEAHAYLARHVLWPREAKQRHGSKGATRKTRCVKRVHKGELCGSLPFGGESLSVVNWRLNLTHGKGGPPAVVAPRSKTGWQGRQPTIAPRFDAWPIFWYPNELVHYRPRNSMPTPHQLEDPARHKCRLSCARHKRPRWGVGGRELYTHRAIVSPPKGTACPQLIPERTLTATLTAVSPGRVPQHPRPSLPHYPRKVRYDLKSEEVPPAM

SEQ ID NO: 998133 - protein, 159 aa, Homo sapiens
AQVNEDLVSLPHQLPEASEPPRSPSEKRKKTFVGEPQRLGSETCLPQHIREATAAPHGKRKRKKKKRPEDTAASALQEGQTQRLAWEPHVQEGGPMAQLPCLSDGRIDGTLAYHGELATQVSTVLRTATTRASTQTESRKEQKILEQKAACSMPHFGSA

SEQ ID NO: 998134 - protein, 76 aa, Homo sapiens
MGFSTLATSTTEVPGAEMERSEHTAFTCVHVAGRLTSRTAGPAIAAHSHRPTPAGAYRGRFRLEKHSHSPLAYAVL

SEQ ID NO: 998135 - protein, 195 aa, Homo sapiens
DEKASRKERKVILLLEVSSLICLLIVGKGILASLRLLPLLVPTGGGDTGLRRKKKKLLEDWRGAKMKVEEEDGRRQTERRTDRSGSALEDDAARTRYGLNAVLPTRARTTRTTGGIRRCGSLLNQVWGLGAPLLGTGRCRVRGSPSPSHFFTSAPCIWALHHELAPSSFSPSLSHFRLSTTLRPSTLTLSIVPTS

SEQ ID NO: 998136 - protein, 322 aa, Homo sapiens
EGVKIPGRRTACCRKALKRQGEAQGAAGSAGGRSVRPAVVEKMQQRQDRRRQNLRRKKAARAERRLLRARKKGLLLPQDLERAGLVLSLSTPGAAVFRPRRLQDTALSPDAGSVPGSPQTFGLSIVRGTQLVTLLEFEAPRSQIPCDERREFQRHPLNDRIRDLQTPAESGEGELGALSTAFPWAVKASAEGSAEVRGGGTVRVGSQLPVPHCQSFAGAIGTEDGGRLNAGPRCTASVQPEITSEQAIEARSASSGTPWTLRSTGEAQSRTMVHHWGRTPWLIPALLAYSLLGSHSFLFPSASGAAVLLSKNLYRREQYFPL

SEQ ID NO: 998137 - protein, 143 aa, Homo sapiens
HPFPIPSGILLCHFTVVPFTRSQYFHGVPGPSFLGFSFVWRMLCDCRRHAWDPTAPLARFRNHLSHYAMSNNSTYAGMSLWRLSLMFQYLKKFSAQMVIDEETSGSMDTSYSPMMLLHSWLDHGPCTARRSIDEPFVEHHGHR

SEQ ID NO: 998138 - protein, 211 aa, Homo sapiens
PSIVHPIRPNVSQSFLSVCVPLATMVFCFCDIINLVCSVLADCSVYPIMGMDLFMKCLPSLVSSAVLFLVWTLALRLLYSVHFSHSLGFPVSLLSVLSYSSRGLFLIGLVPFGSVRIRSFRFALHTAYPCSDSDSAGLATQGLTVCCAFVPSSCSAATPVRGFGCDSGLGSLGRLGCGPPRRQPPPWSLGNRCIITSENEISLQSLCTIGS

SEQ ID NO: 998139 - protein, 219 aa, Homo sapiens
MTLGFLKNKAIPEDSKKTDVSRDAGLCSCEWISSPFVTQRGRGPLVLTWTSLLPPDARPRTRRRLNMHYSHGKRLYANGKSTGPTSIFSSRHTRIAEYAHCSSNEERRNADANSRNLMLMDVQLPRLLLLQSSPRVPASLRIASRYINPVRIKKDPEGKKEHWRRDATPCPRSPARSRPSNFPASALNSLKPGLGRAVAAESGLEREATCHRQPQQSRI

SEQ ID NO: 998140 - protein, 164 aa, Homo sapiens
GEAAQMPGVTVKDVYQHGVRQKLLAAFHQKSHGNAESPRMGGYRASQAQSTKSVAPYRWRYIGSYHRDAASTDVGHLVARGGSSGVCAAHERNESMGDVHEKRRHAQTIFIRGSKSVARSGPQSRGGAEIWLEKDHMMAAVNLQPERSKTILTTNRLHGGSCHN

SEQ ID NO: 998141 - protein, 201 aa, Homo sapiens
ARDLNNVGTEVPSVPARAWSGGSGPRGFWSLHAPVLGPCLCGHCRLPPLIVSQRLTLVPGCVHALPCFALKSSGSARPFAPCLALLTAQGDAGLEPRQVPGLSPARHRNQLFSLTMKADAESGLWAELRSVPVSNFALRRGSSGPLLSCREVAVPREAISLGQLAGGRNGEAEPAGQEGARPPPTPSCHRSPPSLAPHIAS

SEQ ID NO: 998142 - protein, 69 aa, Homo sapiens
ALFLTLSSYPAEVYQLGPFLRKRAVLTLYLLHCHRRYNVGLEYGCTCLADGAPICMLDRSHRNIDLLSY

SEQ ID NO: 998143 - protein, 133 aa, Homo sapiens
MKLGRAIPPKCWDPPTLLLSARGPQFLGRVAPLNCHFMDCSGSNYSPRKEPVISRVYLKDEDRWGTTAEDISDLTFMSSASPLLGLRKEIGGSYEEEAIFFTHPFLFGTATPGLRLGPWGSATGIHKPPQPSQ

SEQ ID NO: 998144 - protein, 254 aa, Homo sapiens
GADSEKSTVVEGGEVRFNGKGENKIRKPRTIYSSLQLQALNPDGSSYTQYLALPADGRSIAASLGTQHRLTVNDLVPKQRVSKFKKLIERRLGLLLEGSALANSVGPLSAGILHTDAAPAWNPNSSSGKRLHARKSLGSLYPQLHIVVPFYRTKKAMLATPNYVRLPARLLRVSPDPGPSRHPGPSIPSGKDGPRGKKEQWRRDALHLLGAPRGPAQQLPGIRALACTWPRAEQSSAENGLGGKPLPPIQPQQQ

SEQ ID NO: 998145 - protein, 109 aa, Homo sapiens
MPYNVIGPHVHCGGRVLRLLSTISSPEPSTSRSPAQVAWPCGWPTLSGAPEVSPHSDSCPFQQLQRAVSLWGGEPQGLFLHTCSPSESGYVEPKCPWNQRSGPTSCVVQ

SEQ ID NO: 998146 - protein, 72 aa, Homo sapiens
MSHENPVWIAQLRELEGGERTRQRYWKGVHGQTEMDLHFGELCGRLDSLGLRLLFYREISEVDFPEIRRRGG

SEQ ID NO: 998147 - protein, 251 aa, Homo sapiens
RALEASAAQRRLKIKKYKPDVARFQTWRTKPIIRWRTLSLCSAELQEFNWNKLDITGKATSTTGSGEKHKDAGFWKTTISTLRDQELAQLHKLDTGSERSRRSLNYILSTNSYLSSRLSTYSNSHQQYVHNSITYLKIKRISNTPSHSLDNRCQANNQAQLVIILNITWKTSSKPHNPHQKCYKARKSERTGTSHYGFGYTDATNLAKQKLTATTQFKHLFLIGQKTYIGSTPTFTPHDQDYLMRHRSAGQ

SEQ ID NO: 998148 - protein, 259 aa, Homo sapiens
MVEQVLMRHCVLTVPWIGGVGLTAVTLVRKAYDHGSVAQYEESILTRVEHPEGNAQRPGESLHALIERSALARGVFWTDPEDSEPEHWIEFENTLKLLALMISLSASMHGFINCIIIAFDIGAGHTMTQSYYDQNITRLSAAHLEDTEQPIQTHSSVCNDRTYLDFKRPWATDDRGLQEDEPDKGVHPQLPGQWPRDSADRVYRPVADRPFKPYRPTPLGIAVATTPIWARLPEEFLTQNELDSNGSVNLAPGLAAGTP

SEQ ID NO: 998149 - protein, 321 aa, Homo sapiens
MEKLIFDITTLSANLLTQYHALKLPPEAGTCQHIQPSYLQLTTAAYNLNHTTQLTHAPQRETPYCQPTSLASSMQAFTTTSLALANLPSTPSQQRKDTPESTHAATNLCPHSTLSSATPQQALHHPPIYFSLRREPGLGALGLAFTHGSNPHLPHSFQHLISIYPGAYPFPDTRKPVGNVNTHNKKNNHPPNFPYANLTLPHNNPPHIIPPRPISQPPHEENHNPNATPHLDPPLFTCTKRHIIPPLDTHAHHQRFIPHKHEPTIPPPTANRQPPTPGPVENFPHTPRANDNTPSLSEPTTQTHPTQTPPHKTQLWTLARQ

SEQ ID NO: 998150 - protein, 74 aa, Homo sapiens
AVAVLCCGEGEKALCIALAVVGLLLTPESPAVTDAGEPPEDASHQSDHVLQQCRSTQTFKLSWTLRCIREEGEV

SEQ ID NO: 998151 - protein, 111 aa, Homo sapiens
MSGRGKGGKGCGVMGVSYAVIARFSAITSRASLQTSYPAALLVAAVSSEFLCLIYEETRWCYSKVFLDNVIRDAVTLHMSTAITAKTVYSNGIVVYALKRLGTLLFTRFGG

SEQ ID NO: 998152 - protein, 125 aa, Homo sapiens
MQGLEEDTWQTITGQTCTTDYFKKSGTAFHHKVHAKIPEPESTDKYTKSPEKLESLKTCLAGIYAEIVPTSMFLHEDAWVRPPNYIPFNKHKDSEEALTLPRVTLWGEIIGMLLRSGSLQENHFH

SEQ ID NO: 998153 - protein, 167 aa, Homo sapiens
MHCLGRAGKTAEGKGAIFHVGEPHETVKTLATGHVSQSGPGSETWPWGTRVGVMTTCRTQGISQDVQYCPPQEFVVVEPSYGDGKGCRVIQIPGGIQGYTGRNTPEIRVGVNLLEFARWSLIVDTKREEGIDLTRDSGIVLVTRVHLGWVDDIKVDLNPRAMEIRMR

SEQ ID NO: 998154 - protein, 63 aa, Homo sapiens
MGPQPEKVKHNRAYLEKKAHEKGHSSPVDTAPQGERLFRTERGKAQPIGKKPCEIYEGASWKP

SEQ ID NO: 998155 - protein, 237 aa, Homo sapiens
MTMEIATTLFGVKQFMDFADDTDAIYSIIAIPKFKRSGAQQFFKSHFVATTTLQSTFSTRSLGNTNSPMATTTNVQPYGEHRKKNAQDIVLGGGGLKLPSKPLGLHWCWHHGPPKTIRSRFGPHFGDNLCSTSLAWVPRPKSMVTLGGTLQLVSVTPRGLALSVEFTKKTPLVVQTAFARLPFKTTWHFWQTRVYLCVSVEPLVTVEPSIFRGGWPPYTFGNKMPFVCSTEPYGHQM

SEQ ID NO: 998156 - protein, 285 aa, Homo sapiens
ARQVLGRSDGGCAVTTSGFALQYPERVVIYLYRGSRIYSRGTAAHALLRYLHTNFAQAVPRLSSRLYDVNEQEAIYSTASRQSRIVQKRIELGTQTAEFPEQKVECMAIHSQACTRRAVTSPLRVTLVNGHPCGETCRHRTHTCSPGRDKTYLATVPTPSLQSATDIHADLNNTTRIAPETSYHQALRSSVITTGNLRTLGTQLHCYLDALPRTIAFKGQYVTQRNASRATIRTPIHLGPGRLAASFGPVLPHAGPNQALCHTAIEHGLGGGPKPDPSSHTQWGT

SEQ ID NO: 998157 - protein, 534 aa, Homo sapiens
MPLTHPAAPLEKEPGSRCPVLARLAAAPRRALNAFNTTLGSNSPLLTLGHHTEEAKQDQPDLLAHLSTPPTYLALTESLALELLNKRTVTTSLAPRGQLAAHAHASGLSPFRTSAPPTGHSTLHLSQPPTTPRPLHLGPSLDTPRHAFGSPLPCGPTKRNYVLPFWERNGALGTFTTSPRHNGRMAPWPLRPHIAHLTSATQHTPRTQLNLIMFPPLPLGTPALGATPDVPPPFPSTVAVNTRPPVQTHCAYERTTAGTPPNVTTPAGAHEPGGFLTYTPTDRAFVPPWGPPNYLRLHPHPPHQCRLGTHPKQDTSTKGRTPPTALLPLSPGGSYPHPPRLTTHPNGTILRPTLQPIHNPNLYNTPHAPPTQHSSTIFQLPPFPYFYTLVQHPPSFLAPTHPHTTLPSPSPPTSTTSTRPSTHSPRATHLSRAKQVLPVAPPFLSHNHLSPYALCTRPRLITPHQLYTVIQHPCGDLTSHPREASMGTCIIIGGHARPSHLLVGRPSLTTLSLATRTHTIAPAPSQCVIPITSN

SEQ ID NO: 998158 - protein, 133 aa, Homo sapiens
DRPAVVCGSASGAHRRLERPDAPDVGCDGRVKQLGAYAWVAVNVFWLHEINAVLIGTVVISEKLVEIVEERELRVALLTKDEECLGVDLQECVLCRRGESVVEGSYVERKWCYNVATSGEGVRATLVQHLPPL

SEQ ID NO: 998159 - protein, 79 aa, Homo sapiens
RIASKPLLAACAAPSLHAVPPQIDHLLSMQRIDNVYRKRRVKENARSNRERDGITWKPDTGGEDGDESPQKLGNGLIAL

SEQ ID NO: 998160 - protein, 191 aa, Homo sapiens
MASQRHLSSEPLSRKKLYLSILISLQISLIITFTATELISFTILLRKHTYAQLGYHQPMRQQQKPERRHILAMTTALVGFPFPNHRTELPRRKTLGLTKHSITESSMAQELSKSGPTTDLTSLHKKFHSQDNHLQESSENAPKTKVESRIGWITQEAGGRKTYRQQEENGQQAARKQDLRPQDERKRNTGT

SEQ ID NO: 998161 - protein, 376 aa, Homo sapiens
GGGCSSGRAARACDPAPQPASRPRVRPGPGGGWLPKMEASTARHDMLLRRTHGGSTGTGRNEETKTGRISTRRNESTTGGRTATNRGQKPGQTDQSGNKRHQHTTHAPQGPDATRHTESSTGIDAIEPKRSHSQQQDEDMPRQTQTAMQEPEKMQERSTNDTASQTGTRRSPYASKTMGANNAQKNGKKPHAQDITANGQQSAQYNTPKTHPQSHQPGETDNTTQTQHPCERHTSARKRSTQHTRRTTTNETHDHDKANAQNQTVNTMRRRNPNQTYRNTSMANTREAPTRKRRTTTKNHGPTQRTDETNHEAAHEIQEPRTHDRHTDNQQTKAHQPRQQRDKTKDRHETRTPHAQRTNRDPTQQNTPQSTTLNTA

SEQ ID NO: 998162 - protein, 109 aa, Homo sapiens
MPSDSVTSAIASNMYNHEATWTFYPEPRLYNMVASMLSLHPRSIISMHLQRYVKYVFAQMGHKATSRTDILFSQDVVVQQNFYPVSKALGYPHSVSRRYMSQERQVRSQ

SEQ ID NO: 998163 - protein, 282 aa, Homo sapiens
MALTKLDSKAHRYRPSRGTDGNDKTSMTGKEAITRHTSPWQTVARPTRRRGNEDSERHRHRSGHHVRNRARTSVHAQRNKCHRPVVTRGNLHTAPELGHESTIVSSETCVRGRRNEPQGRNKAPTRQQKPGDSAAAQRERRRTQRNNKREATDKAVRERAEARERKSGGEAREKREKNARTDMKRDEHTGERDRETKQTGRRQRRRRAGGKRRRRGQRAEEGKDSRTTTDKRERDRGGWGAAGAKASKRDKQTEGTAPGQAERKDQQDEKGRRRKHAPRKER

SEQ ID NO: 998164 - protein, 270 aa, Homo sapiens
MARKLIHLRDPRRAIRYQIIRDLQVLHECNSPYIVGFYGAFYSDEWSIMHLRMGHSMVVAGVPGPTVLKLGQEDSRSVDPGGKVSIGGSPCVLGSTLLSRSSHESCHPEDVMALQPIRRCNRLAGEDQAVGDLRGESASLSRAPWADLRSLARRVSLQSPPRSWLPRVTTIYLVLHGRYTPGMPMAPVSWLELAVGPGTPSPLSRRRKSWKAIFVPCPVRQTGATNGEPHSDLASCRGPPLAPPSAVTGWIARLPCASLNSWDYIVNEPL

SEQ ID NO: 998165 - protein, 136 aa, Homo sapiens
MSSCNYVAIGKGWGVMESWKGTTTHFGDADTVCRGTKKKALVIEEMRTHKKITFGKGVSWCLDMTCDRTLGLGINWACSHDERGHNGMLIRRKGFYNAREGINFARQFVGVETEDKGQGERDVDNLNDDRKTTLWS

SEQ ID NO: 998166 - protein, 102 aa, Homo sapiens
MARGPLWRRQPRAYWRTGVARPRTMPPCETAEESKEPAEADITELCRDMFSKMDTYLTWGTVTGTSEETIKLLENMNKVTSLKYLEVKDIAINISRKLRGSY

SEQ ID NO: 998167 - protein, 114 aa, Homo sapiens
GNTSRAPTVVPRNCGRAVKPPVFSGHILKPPLCFSHVPYCESSMATYMWLLGARSLPFWPLGFRLHMPTAWSGELTARLVCIASNWSWILATDVATDAGGSMTSGRTSTVVPIQ

SEQ ID NO: 998168 - protein, 208 aa, Homo sapiens
MAEWNGGGSSRDMVVVATREPELWNEDWRPFKRQYLTSKEQFHQFLEAKGQEKTCRETEVGDPVCAMSLAEPDGKRIRLEDGQTADVVTTEEAAEPVGMHLQTQKRARGRKQGSGPTVKPSVTYDNEQAVSLPNPGVWLLSVSSVHRCPLSASYVGRYLDDQAGRPGPPAALLFETFDRCPYGVTCRFAGAQLKAEGQNLVQEELAAA

SEQ ID NO: 998169 - protein, 175 aa, Homo sapiens
LFPVWSLETTCENGTKKKKKKKQKTTVLRARARGPLSEKHFLKTHIALWARRGRPTGGKDDNVWPHKGGFPKGNTGVREGNIARVRGISSTTIHKKNSARGGGATKRGAAFLLYKQNLSKGSGGAVSLRGAPTYPGGIISIHPNTEEELSHQETKTCSRLDLSNSFRRAPASLAG

SEQ ID NO: 998170 - protein, 130 aa, Homo sapiens
MVNPTVFFDIAVDCVSPWIRVSFELFADKVPNTAENFRALSTGEKGIWLLGLPAFTELLPGFMFMAGDFTTPIMRDWWQLSIYCGRTSLNDENFILKHNCVLVIVGPLATLHEIQINKMCSQGVISSLSA

SEQ ID NO: 998171 - protein, 71 aa, Homo sapiens
GETKRLTTGGQTGTPRQKVVDPFAKKDWYDVNSTCYVPILDILAPTLRSTQRPKASKDSHLMVSRVDARLK

SEQ ID NO: 998172 - protein, 134 aa, Homo sapiens
MNTNGTWNAMECRRLMERNNVNPVSPEGRMAYPRGLEGTAQIFASFGGRKGQRPEKRILFFSKNPRAFLPSGPGFRCWPRANSHREKVNQTDARKGGFSPQNYGKWGPPRLGSPFLGNKRLAFGFPKVKYPVRP

SEQ ID NO: 998173 - protein, 68 aa, Homo sapiens
DSIIRRLMKMNRGIKGAFQECKLMRFEIHCWGLDEIPVLGQEYTEKTRDLLSMLFSMCDLMSKKIASD

SEQ ID NO: 998174 - protein, 30 aa, Homo sapiens
MGPLSFGRFACKSYNMRPWAPKVASWGPPL

SEQ ID NO: 998175 - protein, 98 aa, Homo sapiens
DYENSNPVPENPKFFRCHSYHTRIPKDKVDAIDIADRAHTPKMLVDTLPVLINHPEAPRRRSIYILLEYSCPRAANSLSQTPQVIRQLEFFLTLEGRP

SEQ ID NO: 998176 - protein, 245 aa, Homo sapiens
MKDDIAALVVAQAAPCECCKAGFVGATYAPPGPIFPSHLWGCSQARKGVMVGWVRQDSYVGYEARARRGILTLKVPHSDVTASVDQPGVPTVARKIWTTTCFYILSMRVVPEVSTPMSADRGRPMNAQGPSRGEDELMIMFETFNTLSLCTLLSRLCYPLYASGPLPLAIVMELRLNGDHPHCCPVLRGVMPLPHVHACVWTLAWPGTLDLMYPRDRILTDARGYLLRAPYGRCREKFVAVTIKR

SEQ ID NO: 998177 - protein, 534 aa, Homo sapiens
SQQTLPACNELPGGRRSSHALPTKCRSLPTLRRNCYSGLAGCCEPAGRKRGCSHDRRTTSQSMTGVAPSSVLNVPSDSLRPRSLMSTQLKCRRVSNGRRWDEAAGVLPSLNEVAHGRVAWYLTRTSRPSNARSFALAQVTPEWSDWWCSRSLGSRWLGSYDQAGLKPRQGAHRFASSFSTSNTQSDHGSQRVDARGLDMEREKPKAKEWSHEVCKGLGSMPRVTSQPWRFDLPESWPEGGPSERVAPVEVEHRRATVVEGHEEAVFLEGIKSTSLKTAWDGRDVEVRLYARVHWRRRGDLEVNPPGYTLLSPSIHSRGASNEYIGRPQGSPQNGVLQFTRSPNESAPNSVNTPELFNEGLPCKQAWGGPLREPPFTQAHFLDKHKDPFNEGVVPALRNLPDNQGFVPPQMTPFLDRETKVPHPEREEALVGQGDLGWRANTGVEHDWPPERAFWRLCKLDGQSRRGHKRCRSRFPLWLARLDTISWRLLNIHGDLFKHFSQRHYGGPRDRGFGKAYIEKSPPEWEPEKGFVPYE

SEQ ID NO: 998178 - protein, 211 aa, Homo sapiens
MRFPATIMLSCLLLGRARYMHVSGELLIFMQVRVLLSVNIRGIDKYPIVVSTYLVDLFCNESRPTHGDSSRTSVYNYTAGPIVTLSKGEQSFHCLECCWLECVASVGLDCGGLERRFPPLSSTSHKESWLITRRGSRSSPCRRVVNHDLWLVRRNRCLDCCSRVLENKTVGIRHFEGTITVHRCNIKGHGPSETARRYSRSIGRYRFRDKP

SEQ ID NO: 998179 - protein, 179 aa, Homo sapiens
GEDRVAAGGTGVSFTSPSSCCSCCPNASVPQWRVSARSLDAQRSGPCESPYRSSTRLPSLPAGLRPVSCRGAGWKQTWRRGPNVVFSSESILAGRCRIGKLATDDDSFSKIEEYEVTVVRVENLGLLKNEYVGCQWAVGILSNLGTWYSLLRFTGTNWYIRLIWGTHCDGLTTSECWMV

SEQ ID NO: 998180 - protein, 266 aa, Homo sapiens
GGAWCDVTRLIMGQAKSVATYHTSVSPLCLPKAFLGLTLSDPKARRTGLSSAPIPIAQRDKLSRPSHGLRIYRVVLGPLCTLNSWCLLLPYSRVYNSMNGARWDLKREDGQPPGPHGSVTDVTPVFLGAQRMAYSSDGQRSLPQVPPTYLDDSGLIAPPTKSYDFGHNGEHFGAYVVFNDCVGGLWARGGEPRCQELSVTWHLYLLVQTRCLLIAGFLMFAWGLLLVIHARAWTAPERARHASPWLPCGRSLPRSQTVRSPSRYPS

SEQ ID NO: 998181 - protein, 38 aa, Homo sapiens
MADKPPFVGKRTTGGYYTLKTRLNTAPFRGGFTHFFPR

SEQ ID NO: 998182 - protein, 106 aa, Homo sapiens
MAAVQSSFGSASEGDRGKRETVGRGRGRGTNHFYSQSNLAANRKAGLWDVENLGFLKSPACKTVVVIRLSTLFMETTEQLCNRIGYTCLLGRPNATEQPFIKEDQN

SEQ ID NO: 998183 - protein, 94 aa, Homo sapiens
MGSQAMIMFGAFTPLINCERLLSFQSGQSKLIFNAQRRNSTWDNLDTRNNGIGVRVTTRLARMNGACLGTQAVVDARGSPHRWCGVSSAGSDSG

SEQ ID NO: 998184 - protein, 134 aa, Homo sapiens
MSAPAPKEGFQEGCDQGAARRMGEKRKRSRKESYSVYVYKVLQYRFTPNNGHLIQGHGHHEFLRKLTSSNASEARLPDWPTTTERSTITSRRSRPRGASAASRRSGQARSVRRSQGLSPSNTKLQVKLCAEVLQ

SEQ ID NO: 998185 - protein, 226 aa, Homo sapiens
MVARLVWPNTKLRMTPVQRGGPGGALCGPGYGEPAGGFRGGFGSGILVAGVAAVDGGRGRGRGARGGKAEDKEWMPVTKLCRLAKDMKIKSLLRRSIIFSLPIKESEIIDFLPEGPLSRMRVKKIMPGAEADPCRHSCNQVQGIMYAIGDYKWTTRIMGVKCFQWSVGQPDNPDRSHQSMAKALHKSTCSQRLLGEQGSGKAPRIVPLTSVTWPMRDLLLVTPYIP

SEQ ID NO: 998186 - protein, 57 aa, Homo sapiens
MVDERMRKEGRVARMPFLIHTRDVQAQTAFMDGLDLTRLFLQRLCVRNTLQAVTDQM

SEQ ID NO: 998187 - protein, 136 aa, Homo sapiens
MGVLACLTSCTNFSISFFSSLLGRGMWFPLTLDNSRLRQLSVVAYRLTRSEQATGLSVNQLILMYCCEQRSVEILTEHDPSSCVDHVISQPSSVHEHLMFRSTPVSSPQQHSVVERSQSLSWIALQGVHDSRNTAH

SEQ ID NO: 998188 - protein, 272 aa, Homo sapiens
MAQAGCGAGAGARWRRLHGVSVWRSRPSGAVRFVTHEVKSLSLSCGLLVSGPGSQLHVLSARAAVCHGRAWGCTLVTLSDGTTAYVQRAVKGDERFLKWQVIQLRGWDHRIHSPRCTVQQMKLSPLSDGHACCMLDDGSSGLHTPQHPEKAMTPGALEAVQLEDGSTCYIHHPVAVPSESTILAVQTEVGLEDLAAEDDEGFSADAVVALEQSASKVLHDIQIPRNVKGQQVGDRAFRLWVPGVWAYLTAPFISYRWLNELYRLASIPNVIP

SEQ ID NO: 998189 - protein, 281 aa, Homo sapiens
TILPACGATLTCTCYVPQECNIPGTSLHSPGRGHRLYPSLQLNVLGRRIGGAEGVLLMMFVIPVHEIAHRLACPLVQEAEMTLCLPLIFQSSLAWIVSSKDDTLELLSSSSSYHRSSPVFTSQWSYLALVPEGRLPDIPFSIQYSPRSQSATCLLMKQPSAFLCACLITLMATPRHSTVTVENSIASPRFGLGDRHRETQRSQAYSKRITDGTPRLKQAQRPAGKLLPLDGSVAREQGKESEAKRAESELRPDSVLAFPGAVSPFAYPSEVFLCREETRVA

SEQ ID NO: 998190 - protein, 616 aa, Homo sapiens
SFPLLQELAGVKTHALSNAQNYLTRRTNTPTRPKQQACTACAGTRPEHKAANPFNTPEHNAPKHRGDRPTTLSRPAKTPCLPFSFHGTRKTLAPTRLNFPRDFLAPLDYFSPRHTRRPQMAYPHGKGTRLNPSHVPGLLITPSPRRGLWQHTRHHITRPKGARQQRRSSLSGPKSLWPFKPKTTPPQRSSWRPGDLRNPQTQQPRRPRRPSTPPGGAPCGPLNKQFPLFPAPNNNHAGPPTKGATFNVLNFPPLRGFVNHGNLGAWPPHFRATLPYDPIAPFWQRSPYIRRPLHHSHIAIARPLFQGASQTVSTPGLGNGNTTNPFRVQETGPPKGPQLFATPPTSSGGGKAPKVSYPFGKLSRHFPPFSYPPLAGYPRAPYILNRAAPGPYYRGNGGEGFGAYHTSSPPFGATPSPIRALSCSAPSPVAVRRALSYPFSNPLSCASANSTPGASNTPPISRLARVSPRVSRNTHITHRTVVSFSPPLPHYDAALKPPDLNKTRNSISSRPHVINDTHALLPTASSTTIYCEGPPHTHRFLTHQIPPPNTTKHTLITSNTPLQNSLRKGPPNNTLLGLHRPHDYTIFLHPPHNTCQPHTHTFSIHHFSSSLGQTSV

SEQ ID NO: 998191 - protein, 67 aa, Homo sapiens
HRRSQINISLPNRGTEDKQTLTLTELAALNYHATATGQLQLTQRHDYRATLAAHFWPLSLHGYASTH

SEQ ID NO: 998192 - protein, 226 aa, Homo sapiens
MPSIFCAHSGHGMVLRLYASYQEYSSPWTCVRSNVTLDLIRVFGFDIVILYGYASVIGLDRKVANVRHDISRKHEEDPFNITIEPCTCMCSYRPLSSVVPHDLSEDPQAALHGLVYKRITGDHSTVVTNASKDHERVATLEMFTYQAFTAALKATYDIPCEGGRIFYVALLRGCCAEGNLWVGPLSQGGQHVWFPPRSSEWCHGVLLFGEPCCPARVPVRVGPCTG

SEQ ID NO: 998193 - protein, 258 aa, Homo sapiens
VAHDGAPHPSSPSNPPLCRLRSFCRFPGACSAVASLIGSGPWLPSSLLTRRHACRQTPGRHRHTGHDRNKGAKGTRQIKRPCSIQNELHYFNISAHACAREAHAHMRFSLPENGHALLPASSQRNGQLIPHKRYKAYQHPYTLAHTAPITLAGKAEPQRCNLWLTKLTGANATFKKLYPRNFSGNPEETQTPPTRSTHLVNHNPTETKPNPQLTQNQAAQSAPHHFGRNGRHTGTPRQLYTQKRLSGKDLEMRIYNPQ

SEQ ID NO: 998194 - protein, 249 aa, Homo sapiens
MVLPATAAPWWGFALGTPILERMPRTVDADGSSEQQLRYRLEELMLLALFVLKLGELSETQGILPISWFGVVVSLVFVCYLPFVLVLDLSLGAHLSPPQGQVPEHVLVFASSTGKVSLMTHCYECKTVMVILALMAERAQSWLHLLSPCQSGRGPVQCLSSPQVPPGSIRVKSRVDTLWLQTKGCCSSHIVWGSVQSPGSYLCDLTTPGALSAALLHLKPFDSSALTKKMTLGGEGAPPSRAFSQELVL

SEQ ID NO: 998195 - protein, 133 aa, Homo sapiens
MAQKSRVANKLHVRRQNVHESARDSTRVATITPSWQSFAMPTNCAEMSLVGASIPEVSLGPKHIGGSRSHCFMALSHPCIDLSHLNGSVPLRMFRNTIAGKVYFEQIKVLFNGIHSMPNLALRLTNRTQNFAF

SEQ ID NO: 998196 - protein, 259 aa, Homo sapiens
PLHSPVHGRHAVGDIEAEDGAWCAGSPPRCCVRPSAVTSWMVVTQFAEDWATLVSLDAQHAVAYVTVETKPVSLATKHVRSGCSDSSLLYPLVFSRKHTCGSVIVSSLIAWTSRSMVLLCQSASETGQVRTGWRLECALDGEVLILECCQACWSYLGTRSTWPCSYHDAIDSPVDPPHSTQLTVARCLPLRSPVGRCVTFVHQSPCEPRTMITSCLQARSLSSGYLAIHLCMIGPGGPGPGRQSRTGSHQDLKSSALWF

SEQ ID NO: 998197 - protein, 225 aa, Homo sapiens
IEAEDGGGVAGSPPRWLCTAFSSLHPGGGDPVWEDGHLVSWSPAEWPVTSASLCSPTKVLLGQDEPLIHVFAKNLVAFVSQGTRETDAVLLAVAVKDKSMEGLKAPEEKVIRVCQVKVNPGGIQPRAAQQDYVNTQIHPIRRLKSLPPSPHGGRNYGTSLGARRKDSCLRQTLTLVSKIIVRIDGEDGTRHQRSRDMVLTSSESLLLCENWRNESPGVESRPPGV

SEQ ID NO: 998198 - protein, 108 aa, Homo sapiens
MPGTIISVISRDGVSPCWPGWFRTPDPPRLSLPKCWDYRREPLCPARHHDRASTPCLDPKHFYTENPKVTSQFHPLVHNPPGNNNHVTLHLWIYLFWIFHVNGNHIIW

SEQ ID NO: 998199 - protein, 305 aa, Homo sapiens
SFPSCKMAGATTVEQAEHTQQQQANPQAQARLHARWHRCKTGSTSTAQNSPKKGHSRHCSLQPVYLVQRQIGQVIRRTRMSFAAKAPCTKQDSTTDRLTSQALQKHTSNGSKVSRHTCLRKPSWVDDKASGEYHGVDYNFSTNAVASLSLPAQTVPSTSMLQTTGKTTLQITHDEQTLRAQTLATGNHSAYITHMDGHKGATRRGLYLTARWHSGHSTLVDWDTLVPHIDSTYYDSNHNTDSEVQSPTCNPKKSQSSRHGHHNPDTQSYMKGNIPRKTEDCGKPPDNDRTGGTHVQNKNRNKMTH

SEQ ID NO: 998200 - protein, 315 aa, Homo sapiens
VSSLKSKAFQYEFRGSRKEEINLTLVGSSAYCKTTDVLTIKTDQVPFKAGSNYDSCSVSTNSVIPMQSRKYCKHMGNDTVSIDSSTMASSHHHEATHSIHLATAHIILGAHTLRPSNCNKRGCKHTHIHGTHTQSQSHRQTSDVGYLTRQNLQQPVTKQSACSVSVSYKHMHGKAHRVAQHCHHVYIEDNETGTSREKARNVIEKLVETQMGQVEVGQATEQQRSRRKYATNSLNKSYALTLTRSRGKTQESIATNIRRTEHSAKQDARHKRESTAKDTENRERDKHTRGQNTARMNREQDHVQKHNTTQERLTK

SEQ ID NO: 998201 - protein, 139 aa, Homo sapiens
MCTLSYGPKPNGQRFAKGPKLGWAKRGTEDAELNEFSDTKFNLFAGAIGAPSWGRPCSREQVCFLNFSSVCARLPTLCGPSPRELKVPVRGGIPITREYFPLGEPIFFYSPFVRWAPLPGKGPPKKWRPFIPFYLSLSR

SEQ ID NO: 998202 - protein, 108 aa, Homo sapiens
MNANTQPHLDIHTTTRHPAMTPNAPTGTSNHKTHRHTPAKETNNDRPTTDPVTNQDKHPTRQHAKPNTAHTASTYNATQGDLELIETDHRPTRHREPDQTEAGDRHNN

SEQ ID NO: 998203 - protein, 159 aa, Homo sapiens
DEMKNTSDLPDTGSHVDAAYGQIRSRVGPPPVSPTDVSAMNKRLKSALLLDRLKRRIWLYVEQMHDNNGIELPPDMFLLAYNTCACFAWTADVTAGSLGMVPSYLMQLLITIRVARKSGEEKCVTKLAVRERDGLQVQSKSLFHTKHIGRWNRSVLAQR

SEQ ID NO: 998204 - protein, 99 aa, Homo sapiens
RCHGGCAEEDHVALMGWAVCNTPHEAGKAILYTKHSCMFLRKSLTNAAIISTQYTEPDSQMRSWLMVKGNPDVQTQISTAPTSRRSIQHRGDSSGCNMN

SEQ ID NO: 998205 - protein, 107 aa, Homo sapiens
MLRLRQPTGRFLVCSYWFGLPPMGIQGVGSATCRYRVPDTRLCAPVMRNCRFCRARSFSAPQRPVRDVHRRRTSSPLFSFDSRCLLCCAPICVAKGLVTASIRRSFS

SEQ ID NO: 998206 - protein, 404 aa, Homo sapiens
TFERLLVSMCQAIVMRTRDINHQMAQAQHAQRHLSKLVQGSTQGTAGIIAFNHDPCHKQAFLQLELTHGRLILGMANRRLVPSQCAARAVFPGIMSAKMVCKHHTCQCATANRCHAIHLARSRLSLMLMQQVPGHQHALPPWLQARRAPLRTLRLDHCYQLTTSMFRLHTALSTDIWDNKWLARLTHSSAQIHQKDILLDYCADQNGRDTSHKQLKHEPRKQTIKTSATQQTQTPRPKRDDHTTHTTHTQQPPTTTDQRATTTPNQKKNTEDQDKTAKHTGARGDTTRTTRTEARGTSTRDTDHRQTANNPQCIKDNKRPIRSEDRPQQQNEITQAHTTQDHERHTTTPNATTRKRQEETAKTHRKDEAKEQGDKHEARGKPETRSNRTKGENRVTRRNRTRDQ

SEQ ID NO: 998207 - protein, 68 aa, Homo sapiens
HRGRSELISVSLFRAVAVPMVRVHFSGPSDRLPGRSERLRMIPHVSRDERSSDAGQWPLLTEKCGIMT

SEQ ID NO: 998208 - protein, 130 aa, Homo sapiens
SPPGRREAMRGRPAPCVHRPAPSRIPIRTLPSPYHHDAHGTSFLVSHSYYHYISHLLLWLLKKRSYYECKGSHELASQHHERCTSMPDETTFIHWTLSSLDTRPTVMAIDEEPAMNNQTIGIFQERTRDT

SEQ ID NO: 998209 - protein, 96 aa, Homo sapiens
MRLRQHAYEHSPGSSLRVHQCRWAHGGVCMAACSAWRPIRRCNGIDIVESNGQLDSSELAEQRAERTKACNTALVARSSPRDTPRNTPGVPQRVSP

SEQ ID NO: 998210 - protein, 112 aa, Homo sapiens
MGSSLSRRAYTIESLTPADWTYYHWTDMTHSAHSWFTWGAIGTKIVNIELMFDGGVPLRGKAVAKCMGTLVGYIDKSLYILYDLRIKDDLEANSRNGGGIHGKRGWMGQLTC

SEQ ID NO: 998211 - protein, 79 aa, Homo sapiens
AQADNCAPNLILEADQNLQSSKSLVECTPLLADCYSWLCCLPSVLFCLPVPEVAFAVGGCMACWAKEVCMDSSLILKSD

SEQ ID NO: 998212 - protein, 138 aa, Homo sapiens
MYPAKIEVPPITMYLSFPPWRILYVTSRYSQLDTPTQSGKPLDLPYLVLGHGSFPGCPCPTCWLARRLFPYLRTQQFRSPKWSWEEDKSGSKRALQDKDITSPTSIRNPRGHLVCGGELNHGLPGLFSCLVRFGVGRP

SEQ ID NO: 998213 - protein, 217 aa, Homo sapiens
LFWTVFARKPRVQKCGELEGSSALPLTILTLQPWRTWTYAISRRKRSMLLRGAICPCLSHQTRRGMSPDKRERNPRRVSLGRTRHASIRKSRNFTRISAPRYIMAIDLVRTSHASLHRPHREARTSSNCCHSRASIKATMRTSREDITIETFIISREAPDKRGYLRLQAMWWVASRGTYPVFSYPSWGRTQQAILTLFVSFDIFLERTSLVGPRSSR

SEQ ID NO: 998214 - protein, 338 aa, Homo sapiens
AWGTDGSAQYLDVTEDTLAAVWDLSGLETEMIVIIARAYAAVGRFGVLCQLDVATVRSTHRDKDQLVYTPRSNHSTLLSCVVERAVRRAHPGATPHVLCYSSSTSVFVRGFTRAAAPKMLTGRHVSVALYTDVCVATIRTLIPGSVAQSMQHDAGGRGSVVGVSRDTSQVEEREWWRVGGFAIDSLVLRRSLLSGAGGIYRYYLRLCHACAAVPETTANMAVTRFRLLVGWLRFARTPFLQGKWTVVLLIDVPPIRSTISRSGIWRVFEVETSPASAGRGTPLDEQLKLTGIRNSGGLARAGSNQVGFGVPQQPERRISLPLELASNTLWLNTEYHVR

SEQ ID NO: 998215 - protein, 145 aa, Homo sapiens
MGSSGLDPVCVLTEALWASCSWTRMCRYEWPTGLSGETRTVRSVPALGLLVVTSVMRDHDSSNRGCRMCERRDPLRVFQVTELAHDAIDDRLGTWRIRDRLSFGSLLSNFSAAYHHVVIGLEDHPWSRDAKGAWVPYLVPMPLQC

SEQ ID NO: 998216 - protein, 60 aa, Homo sapiens
MLLDQFVEIVAWTSSPVLATGSHDSRTKGLHIPVWPKGGHRNNVNPFTCYPSDKRFRDVS

SEQ ID NO: 998217 - protein, 349 aa, Homo sapiens
MRLLHRTDNYDCAGASTSTVCESLIEVNLRRAYPVPSSVISASRDSFSVRRVGWSLAWSPWQRAVVAVRAVAQAIRVVVVCLELSGCSRGYEPVCAFVLGVVSMCNRGVDSRRRSAWHVSNARSGSSLVVAEGSDVGAPVSCEWLSRLCARNVDWAGQSSGSRGPCGPSVAAFPRVDLSSSLVGVYSTCDGVHGYGGPEGLGPWVSVPLRKCGSRSVFSVSTFQVWSYAHKGPTLTNGKLSGWQPVYRPDIGFVHLLTWLQSRKVRRPNLNPRIFPKGQWMRGARFGRERCFTTWGDHHVGFPWLKAFVHSRIRIRSFLSDCGVAIKEELAIREIPSSDKFALTVVNHR

SEQ ID NO: 998218 - protein, 157 aa, Homo sapiens
MCTESVRVLIESTEWVNIMGRAPTTLVHVVHSLACCEGPRSNKEFVGPRAHGTLTPVVLELRGSVTRRRRRTCNRCLMRGAKWVLVEFPANGANRKAHGGNDCPLGKTPPPWAMHQKPRKGEKGPAIGPRDGTSGGSIGGPPGVVSPLCFPFPVGGL

SEQ ID NO: 998219 - protein, 72 aa, Homo sapiens
LCWLTGEKSSTKILTYIEHGQWRSSLRGYATCTSMDSDRSLPLATICMSCRAHSTEMPSDATAHGELWGFTG

SEQ ID NO: 998220 - protein, 79 aa, Homo sapiens
MNALSSKLISQPKAFFAKMVVDAVMMRDDLRELRHDLDSRRYRVEPLEDSQLVAGVAFKNDLLFAGVLKVRSHESTTIP

SEQ ID NO: 998221 - protein, 178 aa, Homo sapiens
MAHSVVAWSNCGLLAWAGSIRRTISRELAVNMSGTFGGANMPNLYPVGPWGWQHTECPHVRLWADPPSALAICSFPYGMYPPPREETDAVQECPHYPAIPRGPLCQGHAQWQAARIRSAQGGPSLGQPSSDLTLVKGSSAHSLGQEGKPSSRRYPRIPEGRDCKTPVVAPLARWKAGD

SEQ ID NO: 998222 - protein, 312 aa, Homo sapiens
MAAVQEAEQGPDRRTWMACQVRSADVQVRVNHAIGQHQRKETPWPKGITQASRTHRPIAAPNRLAVSLNRLLAVEQIFIILGHHADMSIRQRAQAPQASGGPRREPPRIDQTRKAGILAKGHRFMIRACVASSDARDTFDRAFKRHVGTLLWTARSCVLADLVAIGRERQTGVRTEHFAELDIPESVQQNGSIYIHVYFTKSGFHAQDPRQKALLPPVCHSPRLSRDDQTNTSADDFRKPRTLLTGETEADPEMIKRAEDYGAVGRVESPIGTPRSPSNIVDDHTPWGEEGSVPPPLDHYVKFDGRERGLLS

SEQ ID NO: 998223 - protein, 72 aa, Homo sapiens
GSCCPGSTSGSCCAVCRLSVSVPYHCRCQITSDFGWLIPKVMRIYDTQVRKWTREASPHASRLQKPLLNWLT

SEQ ID NO: 998224 - protein, 68 aa, Homo sapiens
AVRSLRLVASADVILHRFMCDVYCREHAVYASQLVESGRQLALHTFYAFEECRMKDWTRDPLHDWLLS

SEQ ID NO: 998225 - protein, 44 aa, Homo sapiens
SEPPEHKCREYYPYEPKWERKDDYISPLLVIWTTVDSGKCQPLA

SEQ ID NO: 998226 - protein, 144 aa, Homo sapiens
GEPGLNEHKNEQDMAKATPCVLQGGRRKNSGHRSTYSIARYIFPDSHCEGTYSTEDDLIGVTKVALVSGAVRLTETSLRENGRCFRDYLSTTTRYTWKEYLVGRDKLEERRGLGSELGRTGEQPSRRVGSLLIIEDYPSRMPRE

SEQ ID NO: 998227 - protein, 286 aa, Homo sapiens
AVGWAGYAQSLLADAGVRLPAWLAAAPGEGGGFNLPAALIVLVLTALLMRDNRQAAGANAVLVALKVAIILGFLGIGAAHVRPELWQPLVPANEGTFGAFGWSGVFRGAGVVFFAYVGFETVSTAAGETRDPQRDAPVGLIGSLVVTAVLYVAVAAVLTGLVPYRDLDVADPIARAMAATGLTGFSVAIKLGALIVLTTAALTALYGQARIFYAMARDLMLPDVFARIGATSRTPFVAQGLIGALSPRLVAALVPIDVLGELVSNRTLFAFTWSARRADPARTELK

SEQ ID NO: 998228 - protein, 78 aa, Homo sapiens
AIAYVRTVYYYHVSDPIGYDEMSSTGIPCAASPFDHCLVSTMVPECTAGEKFCCARVCTVVDDTSSIGYKQGFNCLQQ

SEQ ID NO: 998229 - protein, 128 aa, Homo sapiens
EREREREREREREREREREREREREREREERARETRARSRGGPPRCCYVSSCLCCVVVEQTRYVFFLLCSIISALLLVSVLVCVCVCVVGVCCSLLFLSQVLYHVMSSILGGESSSSLVGGGVLLLAS

SEQ ID NO: 998230 - protein, 339 aa, Homo sapiens
GTHRSSRPRGQRTGPPSAAEPARSPFVPSLRLGMQDWLDRGLGSQCRHWREVPYNLCHIPWGLVHSLPDPQEASQHACRSFACIAGGLPGLENEDRPEDDVLRPECVQGPACSVWISERLGGSEASGCQSLLRMSENAHTGDGSDLFGQRDAFVPSLKDRRVEPNHKNINLVEFGLVYSKTSELNHCAGVGLTAGDLSQMIKYFKKQKRLIPERTRMEVLCAAVQRRGAHAFTPGVMHRDIKPANVFITATGVVKLGEPWVWGGFFKSGDHRSPLPSGGTPYYIVTRRGSMRTVQLQSSDILGPLRLACCTKMGRPSRRSFYGHKNGISFSLVAKKSSL

SEQ ID NO: 998231 - protein, 182 aa, Homo sapiens
MSILSRAPECCKRGAPDSVHAAVNCSLARNVTASCELPVRDHSNHGQQRRSIVLKELHSCTYASALSHRYATYNASRSLVPHPVLMERPGRYAAVAQLTWHDYSGWDACIGKYSLLFAINFAQISVVGVRPGRKLIPWHTHVGSSIPIANQSGLALMCNLSVVPACALAFLESSWWANRHWE

SEQ ID NO: 998232 - protein, 218 aa, Homo sapiens
SSGDLSGGCESYLVNLSLNDQRWLQWGFRPGYPGSSAWGHAPWPLLPSVSPTSTLPHYPYMPCSLHPTMSFHLTPSGGGSASSQHSEGSLEQWVDNGVMRGAGRTGTRREERAPESKSRTVADESESLQLEGADFGGVGEASGTSDEGGPPPSRGSELGECAPNLRDQARSPSLWTAHHGMALTPCKVQDWWSLIATNIQASKSLQHAAHNRENCEHL

SEQ ID NO: 998233 - protein, 70 aa, Homo sapiens
MTVLRFSSSPDQGEEPRDTHPWALALTGKGPGGLYTGGRSTNTRGADPSLRETDGGSTFTAGPEVRVGQD

SEQ ID NO: 998234 - protein, 74 aa, Homo sapiens
VAIRQRCQVRLAAPLVAGYALIPVQPQGLPGYSYTHGVPIEDAHDGWYEMNGQLSLGACTLPPVGKLHTKATFD

SEQ ID NO: 998235 - protein, 128 aa, Homo sapiens
MAPARLSRSFAGNLRALLLEPSNSWGNERGAPFGVFGTGPVGAGRLPAGRDGPMAHCLGSRLYYPWQQLRAFLAIGVAPSKGNGAKLKSLVPPRYRKLQRSCVPMAKGGNLRPFFSQDRISNEPLLPL

SEQ ID NO: 998236 - protein, 169 aa, Homo sapiens
RTLAFNVPGRRLWLWAWLDSMVELWAWREWGTADCLLLPTMCLCCLACACFRAVSGLPCGRDGWTQDWHEWLIAVAVWYYQTRDGDQGLYINLFSVSQWGFRGQGYLEYSRRMILPMRLAKSPMDIWSKCVHERLRSICERHASSINGSGYHFTVPSWHPCSKEFAECA

SEQ ID NO: 998237 - protein, 255 aa, Homo sapiens
MPFEVCLWRLSRDGVVADGLGGLCVDSGYCAGPLVSPAPVRLGEAPWECDDARSYECCALRRANSGQDVGIVRVEYAGKQRSAYPALLLFDQPLELVPLTNFDSPGVTYVIDQSTRTQGNWPLGWGEFTRARARKEDGPSELRQWGYSSPRVASRRAIYIVLVPPRGGWIPARRKVFHYPSLVPPLEWAQTCNAWKRPLMPKRVKTNGKSKPKIQPIPQVNTLEGRRAPKLWWGPVKACKKSRIENFAGQGKRPF

SEQ ID NO: 998238 - protein, 115 aa, Homo sapiens
MWLSVRRVLNRDYSCPSVEVHCRDPYRKRRLKIARKNSTCNRVGMIKSRGEKSFPGFTKERTGTKNPTNLVLGEWGEFSTHSKNGTGKDLEPRPRGRGQGKTERTGRRDSGFCPA

SEQ ID NO: 998239 - protein, 140 aa, Homo sapiens
WLPAAFMVACTNHSQPAPGQGPRTRGQGGQGATFAGHMPHTRGHPAAVPSIPQVTEQPGPQAVTVPEGPTGAVGPKRGLRATLFGPCRIVILVNLISANNFRKIEDILTLQIVYSRGFLQNFVSLRPEFPTARKQYSLPP

SEQ ID NO: 998240 - protein, 151 aa, Homo sapiens
MSGLISTGLRVLPFVDAHHAAHQSRGRMIYVPRGAVFTNSPGFSRGGGPPFWALRQGAFKQGKCVLSGRKAPVLSRRRCGAHCVSELCISGVPRMRHIVSEQSVVSEVSPARGISGAPLAEGLRFLLSRDLILLVGPIHSVSGGAREQERR

SEQ ID NO: 998241 - protein, 177 aa, Homo sapiens
MASNMCRSVFPSSTRMDSLVCNVKLDYYAQSFRRTYPGHSTQIEKALISTPYIQINKFAEGIAKGMNLRDGNSQGLGGRGNKERLRCTSGAPVAPDQRVVLHERRRLFLWSVEWVEKTPEHGLTRYIGVQVVRLPSFLTYAPMELSVRGYIIRNFGGKSKVSRKGGHRLNVKGATSV

SEQ ID NO: 998242 - protein, 151 aa, Homo sapiens
MNSWLWVKTLSALETLLVCVWARTQNSRVLRGRVKAHLSRRRGKLAGTLRVRSPPREVGVIYSASAEPKSFSASLFCEERGALLSKLCAPKFAGASRGGNSVWRFMRGVSHVGGGFSPSLHSARAAPPEGVFPHRGCVSPPHKRPHTQSVV

SEQ ID NO: 998243 - protein, 492 aa, Homo sapiens
RELVSSFLCFFFVGNEKLTFFLWGGAGRCPALENFVAAVFLGCRTCWVTLCRVETRMVLAARGRGTRPLVIDVADLAFPHDSGGDGVLRHVVLLWGPPFSRARIDPLGAICLCAEMIGPAGAIAPEWAPLVGSCLDSCGFHLPRLHRWGAFSYALSTVVADSLFPAFETRGAFFMCVSARWLVCAPLEILRRLPCGGGVLFCCERAPRHADVSSFWCDGPTPGWGSTISLTVWPSVLSLPPREEWAPPLCFCVVFVGNRDKCVSGPVALCGRVRWPTRLLRRLRVEMCSPGAKVCCATCLVGQGVSAVGELLHRRGWAVFAGQRHEEIALTAGKHEGREEDSPAKQRPLPGGREGGAPTQKEEARREDENIPRGVASHHPIKSEREETIRRGKAVGGHPTEPLERSPPQRRGSLFLPTSVVVPRRGEEERNAPPPRVSGGGTNQPPRELPLCEVSCGTTRLVWLTNTPTFARRAARLDYPPSGKCVHQNPLP

SEQ ID NO: 998244 - protein, 232 aa, Homo sapiens
MEEPQAGDAARFSCPPNFTAKPPASESPRFSLRSADGSRYGAVAYSGPCRLCPMNASTGRHVPLSGSQNRQGQIGRQAAPLIEVLSSCPQAGRSDPAGPLNRRQEVDSPVPQPPMGQPVEALLASPNPLVRVELLCHAPVPRKSPSHRSLLAEASVLCLCGGKPPVTGPRSALPNLLSLREEEEEEMQVTEAPVTQEAVNGHGGPVQVDMALGSAEMDVRKKTKKRDQQSER

SEQ ID NO: 998245 - protein, 148 aa, Homo sapiens
MDGPLLGLYWGLAVARDVLSHSVCPGGTFSSIREILSSDPSCGSRGASFRRVQPLLRSPRFAPRMDSGRWHGIVSMGKGRNGSPVLMWFFLDRVESPTIGTYLQGRWECCARPRLCCFVAHSILRSICCRRIVEILLGPYTKSKVDSN

SEQ ID NO: 998246 - protein, 87 aa, Homo sapiens
VRPSALSSTPYHVNNLSPLYKCVGGFMVNCPLKDYYEGGRQRARVSYSQLSRGRCYAEIKRLLSRRVLAVLNRLLTEPLSSTKGHTR

SEQ ID NO: 998247 - protein, 109 aa, Homo sapiens
MRRTDIGRRLMPNALYVKTRSRHRQPFRGDFWQQGYLEWIVKTNVKDALSHTFPLQDRMTRDRKVNLPIKEYEDLNAWRPHVESESIQNRCRFANEIICSPNKPAIGTS

SEQ ID NO: 998248 - protein, 144 aa, Homo sapiens
MYADFRHRPENLVVLVPNAGNRHEGMMKRIDLYRCERKRRKTTRMERRRVRSELTIRTSKASLGLPKVAVPKRIVSFQPQERCGLRRELCLGPLLWGRIEVYIPTEAKILERYRSLLSVSREDRLITRVPNVPTKTGFRTNDSR

SEQ ID NO: 998249 - protein, 178 aa, Homo sapiens
MVEDIINLEPGELKKGSLLSRTLIKDNFQLKSSQYNGPHQDPLTRLLWYRADGKLALRPVLPSISMKSSQLILVNMASFPEELAWIRSLQSTWQSGPIVYHPTGRVPTLGKLASLSEASISSSANITCTACSYQGYNENTWHMNLNPRSGRDANSGTHSPINQRAQRNAGECGQREHR

SEQ ID NO: 998250 - protein, 120 aa, Homo sapiens
GTRAIMEQVKYSERTIHRYCISAHLGAERKLHKMRQLFVRGVPLGGIIADLRLPPPDVHRRAVTHDDTEAVSLYKATALPAGTVRHGHSHILPSDSGPVEWLSEYTLSAGRIGLYSSYLL

SEQ ID NO: 998251 - protein, 271 aa, Homo sapiens
MRFAWGPGPGVIRRDRVLGLMSLRGLGYAVHVYVVSRSESQGTVAADQQSLLRRLQPMLRANSGGPLRITPKALTAHGRPACELCTICELKHARGKSRDSPSSRKPMRVVEWSVPPLKRLKREEVPPGPVGPCPTIPASKGGFPENYPPIRDFPYPVAHSFFVAWFFPADPSTQSWPFKPVQIFPEARGNQPARALGEGRGPQGTVEPMVPPPDVGKAPLENPLKVKAQELEIGQGGGPRVPLAPFNTKEFGQKPMGVSTCASYPQGRGEI

SEQ ID NO: 998252 - protein, 285 aa, Homo sapiens
MTELVIYFAQATSWLGEVAVCSSRRSSQRLAVVPDSMRVTAAALLVQHARKHDSPSTKKYKGIVLTALSAFPDEQGVLSFWRCYPCQTSFASFPISQPSTSSFTGYVLGMIFAAGAWIEASTSVLCRYLCWVMLASGGAAGAISLCFVYPAWTFAREPAWLADRGKVRHESASSGGLGDCLVKITKSDGIRGLYQGFSVSVQASIIYRAGYFGVVQIRARACSPNPKNTHIVVKLVIAQTRDRPWPGVGVLTLRHGAAGLMNSVPGRKELTPVHGPRRLLGEIFE

SEQ ID NO: 998253 - protein, 68 aa, Homo sapiens
RMIMVGPAADDVRMVESLLRHTSVTRPEATGHDANFDCDGSQSGCLFMSVTCDVTSSARNDGPVDSSA

SEQ ID NO: 998254 - protein, 174 aa, Homo sapiens
MLITTCERTSSHISKYSRIYFCQTSLLMLRSREILERVPVVLPQEWPRSQSSRLRRGDDRARMHSSMWMPLICQRLQAGRLYQILDPPRSSISQLGSPCTQLAMNVLNGSPRSHYLADSILSSQICLPDSYRKVGCRTPSADLFHYDSMNAVNWGMREYKIYPYELLLVTTRGR

SEQ ID NO: 998255 - protein, 70 aa, Homo sapiens
DHAACAVSMHTSSTNMTYTTVMKRLIISALRIKKACLITSVVVASTAQTHAVIHVIRCWLVEHCARDNAS

SEQ ID NO: 998256 - protein, 182 aa, Homo sapiens
SWKMAASVVCLGRYRRGTCASCCARRSGGPMLRTHSSWWMYWQIFVSVAAPEFCCRRSQRLRRAWTIVAAAVAFRMHVLFVPELSQLRGEVVGVDALVPDRCLMNENMNKCVCAKAYMCLWDATPWASSIRDNETRHSAPLTMWRHWDAHRCVAYDAMRAEATSCALAPYVGTRANRLAMQC

SEQ ID NO: 998257 - protein, 232 aa, Homo sapiens
GRSGPSAVQSARGSGSSDRLLVRGVQPADRLLWFVTSPGRTAYSSPDMKDLSVPRAAMACPFVACGAELKHRLNVLISLLCNQIEESGTALAERSVSDPGTNYMQSILSSDVDDRLLWELSVSSLAHTSCSHRTRGSTGRVFSITSRGSRIVWFVALPVGHFYLRDLEVFPVPDFHVCAHVMAAACWCNAVSPCLGVAGVLRESVDLACLARLLAGFVVTMTCARALVPSES

SEQ ID NO: 998258 - protein, 88 aa, Homo sapiens
PCLQCVLIREIDKADGMFWSSVEPGDHQLFFLHVPLYRCDERSLVTSHHKTVYIGIESHVVTGRRLYISRRDAVVDLELTNIPCLMLR

SEQ ID NO: 998259 - protein, 239 aa, Homo sapiens
PGVIPSCAVVSLGAAFSESPYRLLSYLSACRHPMDSIRCPHGTCSPPEAPELIFSVSATQRAAQKNFIHFKVDTCMNNAAPVHLQATVSYRGMVQRMSCTELQARGNDITQAVHFKVNTGHFCNCPVTANRLPLGAYDNNKHQVVFKGTTVWLQGQLPSSRGQHLKSASWADRLQSTARLTAHEEACDNSSTYHPGKNQRTENPGQVRSTRDTHHEQNVTTIDWIADKIDDDDINQPTD

SEQ ID NO: 998260 - protein, 185 aa, Homo sapiens
MTSVSKIIHHIQRQEFNPEGSSSFSDTLEAIEPPLQPSFDTENLAEQSPYDSKVIERGIVDSITGSAGFMEAQACTGGIITPQDTGQKLSLQDSSTPRDVIEQDMGTRLKPAQKAFIGYRGCAQGKKQDVSQQRQCTEHMATVCRLDSEYHGDSRYLTGGPRRPRQVHGREHKHQTEDTPDKRVT

SEQ ID NO: 998261 - protein, 149 aa, Homo sapiens
MELGVQVPEMTFVVTGSQGTLEFSVNAVHCSTRFRNGVPGQEVIASGYLRPPFIPVSSACPLFVQHVNISNHNHPGGFISTSTNCCNVFTKGKLQLWANLMNDYSMAYLNRLNRTGGLKRLVDRRHRNVPMSRRRRTKRHDQESIIGPV

SEQ ID NO: 998262 - protein, 77 aa, Homo sapiens
SLLAYSDPWNSPVGNQLDPIQREPVCSALNSAILETHNLPKQPPLALAMGQATQCLGLMARSGIGSCAFATVEDYLH

SEQ ID NO: 998263 - protein, 197 aa, Homo sapiens
MTFYALTQVTLVRWTQTQEEKHTRQRTALQEPDNNEHLTAAFDTTLTTRQTTERQLDLSLQLTHACATAEPFGASSTVTHTQAAMYLNDFSQTHLLTRDSTQAKTQPLTRFSELTVADTTWTTRDTRDPPLKNILQRAFYNLLLTDCMIPRSTTKAWRTFRDVFARRTWRETPGVMQANFEAYDYEDILTTMVTGRN

SEQ ID NO: 998264 - protein, 111 aa, Homo sapiens
MKVRIGQNTAEVERIVCVLVYTSACEVTSGNASACSTRRHCEISLMDMRSPFLTLQSYSNTLHEHNVPLVKEFGKKVYLTGDRELAKVMQTTFKPTKVLNITDEQASYTTR

SEQ ID NO: 998265 - protein, 104 aa, Homo sapiens
MIVQAMVDNTLLQNKGQLTFDTHALVQDLETHGFDKTQAEHDCISVNCFIKCQPGYYSITEMVTQAQQEIPVQQLDGSYWMLQEHDMVILGEKVNSAISAEHER

SEQ ID NO: 998266 - protein, 80 aa, Homo sapiens
MVDLIKLGQKEVQWQWPNARSEQLLGKAHGTASIMERPRRVVERQEAHNAETDTILEGSVPLLKRTMFTEHLYAWLTLRN

SEQ ID NO: 998267 - protein, 139 aa, Homo sapiens
MILKDKVKTPTWLSQLATGIYGIPSVINSDNYRVFPWLGESLNPGSPRCSESFIPGSFGTHQGQGVDIYWRDYYTCPLTKTIKLWCMQKHLVDLVCITQVGLNADCTLLTQQTLNTPTSLHLGSLLKLRMIMALYTSHS

SEQ ID NO: 998268 - protein, 132 aa, Homo sapiens
MCYSKTRSYMSGTCDINQPVQFHFDKVCLISRGVLLTDIGRCLLHFTGAYQILPMRGVVLINYPDNTHQKCVWNLGNHNVDKHDKNLSISDVLWDLPLLISRILLNLLLIEPVPGVLVKFHAGSLYLWCNKT

SEQ ID NO: 998269 - protein, 135 aa, Homo sapiens
MNHNTILSKSHYSSLTNHNGYKPIKLWEYEPLSLLTSQSVTRSAPLCTIQAMSSSHMTYIIYAPISNQYNRNALPQLQHIAFSSMSLNLYSIISMLVEVPLNPNLQLQQNLSILLQCTHMMMPKYQFYRTNSLTL

SEQ ID NO: 998270 - protein, 392 aa, Homo sapiens
SKIREEYPDRIMKHRFSVSAIRPKVSRRLGGASLYNANRLRQVLATSSLRKHTDLMTYRAFDKRQSSSYDRIVLSEIRVEMLDSLAPLGYGDLEAIAVCSAYRVMCGVTFVSWRLPQDQARLLYRCGELRCGLLVAVSPGLALRSMSRSFAPLLYSSPGIDSSEVTGSAGARSAELRTPARWFGWPEEHWMRCACRTSAPIGTPNLKRSGAIVVSRGRVNGSMGMRRLVIDADIGFDIVPRTKNRIQTFLVESGIAPKLSVVKNRVVRSWLNSSPAYGGAKKSCPRTTLPIWGQSKRTGPIPQEKPDPKGRPHLPGKQRFPRGTDGYPSRHKGAVVPGPTWVKPRGAQGHVVTEKVVGSTRNEPRMAPTCEKVTRGEVPEENHCESPKECVT

SEQ ID NO: 998271 - protein, 110 aa, Homo sapiens
MTNTITRTVDTFARWSGWTSRTKNSLPSLITRDVFKSLDSGRTLVGLRLESNAMQRYPNLVHCMRSVCTRRSRFSKLFTPGRAKNQGTGHFLPYWEPMNFPLESQNGHLG

SEQ ID NO: 998272 - protein, 82 aa, Homo sapiens
DHYAQDRDAQSRCGGPLGTIRLVLPSGRIPWGRVASVDFGILSTTGENASGGNTRKRSQSNVSRVEMLAGQLPVIIFYGGGF

SEQ ID NO: 998273 - protein, 127 aa, Homo sapiens
MRKVSMKLEVIIPERYPFEASSESDFAHMPIYHAKHLILRGKALCAAMLLKIAKATEVLGRPSLKASQTVLSLYSAAQCREPSPDDPLMADQYPSEVSDMDNARPVLKECRDQWDRESMQGQADAKG

SEQ ID NO: 998274 - protein, 182 aa, Homo sapiens
MGLWTVAQLRGGNPRRELYCAQARQNAQSGTHWYTRCGKFPSVPFPATSLANRFCATQQGGFGTLAENEPTFAPRLRVPTVEKIEARLNNGATCGHFTHLWDKRVCLLMFSNSGVGWAQRICIISTRQRGAVFPNKVSFPKRQLVPSTPTVLKTNGVGTRTFHKPQLFVFRKFRKRRKTGYL

SEQ ID NO: 998275 - protein, 184 aa, Homo sapiens
MPSIKLQSSELDDDYFDTLTVEHWPNNSVTYLRPMMDRFGNWLTERTMTDPKLPPTTMCNASNYYNKGPFTLVHPEQQGMTRPSILEDDDEQEHTQRNSMHIRCYGTKEFREQLTKGTTFICNSFWTGETHFRTSRGYAWMSTLHRRVGQVCIKRDKVHGGAFSKEPFHVLQHTVNIRHIVDYG

SEQ ID NO: 998276 - protein, 172 aa, Homo sapiens
MRIENVSISVSVAHLSWTRSVTVRPQRLQGVQICANLKCHKEDFETLKRNPRKVRWTKAFRKQLVTELTVDNSFDIVKKRRNEPIKYQRRSYGDKTIDAMKEVEEIKQKRQAKFIMNRLKQKIKSYRKCRISKTVKQKIHLIRAPLAGLGETVGRESGTAVTSRMWTWKMRP

SEQ ID NO: 998277 - protein, 167 aa, Homo sapiens
MAKLGYPVLQEGRIRATVQRDSKGNRHDRGTFGIADGKMADKCKYSSTAKNTQRRSKEWTQEQYQQEYVTQTEDHKDTGQELGSHKHDMRETEDQQKGPYPAQENTQQKRITRTGNTCAKDRRGKATHGEWKPRSALKKKCHIYGKLLKRRQSTQACPRVKTVHQVD

SEQ ID NO: 998278 - protein, 69 aa, Homo sapiens
GITSSQELDVCEVGVTRGFNMRIEKCNCCLRVQSILLYKIMHVQYRLTISKGVQDFARSNMSVEKRSIE

SEQ ID NO: 998279 - protein, 146 aa, Homo sapiens
MVKKRKRSREESYVCVRVQVCLKAGPIPTTVQSSSKAMGIMNSLLNEIFERIAGEASRLAHYNKRSDITSRQIQTAVQPAAFPESWTKHAVYGGQPKAVTKYTSIHSKHFQGGDNKFKTIFFQTVVNCWDNCYHLANKQMKNGVDP

SEQ ID NO: 998280 - protein, 76 aa, Homo sapiens
VVSPRRACKLAVLSRLAELLEWLRREPAAAAAVTCENGGRPWIDNPGELITNDRRNHEVTPYWNHRQVNVPSSIDC

SEQ ID NO: 998281 - protein, 396 aa, Homo sapiens
GAAGLRAGAAEHFFDLVPPRPVRPAGVSAWARVGGSRRLPPADGASLVALVLARASSRQCIQCIRSPHQTPEHASSPQRLPPEAAGMQATKRQASTERHRSYQTSRERTCEVDPPECGPPDLPSTSDPGTHQPITAGNAVDSEHKEGVTSLNGCEWKAIHIRRPTVPKIGKGPGMDPPLRRAKGLYLAHIDACESPATGLLYNRGHLPEDYTGTRIGTITMGIAYRENNSGPKVLGRTTLVIATRDGTTPLVPRRGKSRGKRITPTLRSGALAINIPAPYHGNAPMAQPTNQGSAMGTEEHSVTTHIDYSEKPKTNSNLRDRAVGQIRIGNTIQIRNGDGYEGKKDGKPQYPSQQLGESNGYIPPPQWNGGNVPTTGRHNSGRPWDTMWVQATDPT

SEQ ID NO: 998282 - protein, 105 aa, Homo sapiens
MTDRRPTIAECAINYHSRNSRGPPFNAPQINLASIYSTPYVIPCTNVIDNVWTRRSTREHSERKHLAHHHVVMSAKVFDLQAARRTTDSSTTCIEQLASNTSTQR

SEQ ID NO: 998283 - protein, 283 aa, Homo sapiens
MDDIFTQCREGNAVAVRLWLDNTENDLNQGDDHGFLPLALGLAWEGRSADGLRCRSCMGARTQCNETVGIDKPQLTLLGSQVNGNNRAYLYRQLLQYTGTDIICSAMNMGIVAPCAECLSNMRAKHQRGKKDPGVHTLEGPYGQRTRVTQRIGEDCLLGTQAKRHPVKQTHSSRRRRSAETDWGHRILRPVLPVHGHSISWKGGPTHAHRAPEHGTLEPDSLGRSTLQTQPSHFPGRKPPSEKITSETSLMRKGRLAQGQGTLVRARCLKGSANWDVHRHDAR

SEQ ID NO: 998284 - protein, 470 aa, Homo sapiens
LNAGCILDAVCLSANGPYRRPETLVCLFRDFPCASRNLTSYSAVSCANSGHGALSSRMDLDAAREYYTFSDLTAAILAPNDCISFQMKLDETPGLSKMVVCIHGIVGSRAGCTIWIPYESWRSGKNGAVSWQRPIHVNNWVQTCRARLPLQIDLILKLSESNVLRFDLLGVRQKGLGPTIDKRTLWESHISQGKVKRLLLLPDVLRASCTQCCIPQYCLGCDILDTPKAVFATPGGILIGKTPFLLNTLLAVEPLALRLTVGDAKIGRMESGPYLLGPLMYTSVAVDRIIKEVHRLHVEKGKSVDAYNYRDTPTWEMGRPKDHILSNRSTPDRREVDSDTTHRGKPLGKGPQADWDGTGKVSNANRSGYDHTAHENHKRSHAGPINNTRGGQGEQPTENPAIRKHTNRRHRQTRTGKEPVKAQREAPHYTTMEEHDAARCRRERSLTRRNLSRTTAAMEQQHVADHQHGP

SEQ ID NO: 998285 - protein, 296 aa, Homo sapiens
GAARSLGPGCCPAAGPGAVRAVLLAAPCELHGCPWAAGEAWTRGAVTGTPVQPRLPLRMPKGCAGVTTGVVPLCCRAATTECRKACRGLPTSLGSLHPLCCGAPSTVRWAPDVWDTEATLGPGSACLTPGWPTGCTCVVLTTPHCLTLPQVLWSRRLPNLPGREDTCTCDVCCPVGDRAPSIRARFMLPNLYPGGVSGSQAALSLGLYGISLVTAHVTLEPLALAQPALIAQGAGPLCAPFLAGTSWGTLSPYSNWTSAWAPTIVKRLMLHLVHRLPPSPVFLPADIGTRNRCRVP

SEQ ID NO: 998286 - protein, 326 aa, Homo sapiens
RLKPIFRARRLKNHTSKHCAKAGNVFAASTARSKQDAGPLSSMQAILQPGQEHQASRKGQVIQFYTLWDIFLQFSEENNGEAIAHSYPRAQIQYSDILTQKKHPERTTITTNTVIGRQHISTPLERKAFLAKPQPVRYGKAEDDQKRGYKLANSCLLTADDTPQYRHTRGDQTSITCEEENKRKDKNNTPHGGRKHRKRSITEKKPTPKERGQPKRRTQNGRRKHTKTEGIYHTPESDDRETHNNDPPERGKQKTEKTNRSTNNTPTQHKKKQNRKKQQQEKQTTRERDKTEQKKKPELDGRQTNNKIHTTTTQKHSQETTKETKA

SEQ ID NO: 998287 - protein, 253 aa, Homo sapiens
KVQAEIGDVSDYSQIMLVSVYTIQHFVCYTSILQIANSTFASSMYLHISGLQRPFLPAMHEAKPMAILSLWLRQLDMSSVPYLTGLLFKQVSQLLDFIKTLTDELACLTNPWSQNNMSVSYISNTLASSKIQVQVSGPTLEPEARGKQADAMADSDLSQHSCIITTIVLIALIKQHWEQDPFLSVILADITTEQISVTAVNGQINGKYNHCHSRNISHLKCHLNTCIITQGIKARMSQSLQLDGPKKPFTNGL

SEQ ID NO: 998288 - protein, 208 aa, Homo sapiens
AGGSRRQQQRWRHEHAAAASGTGRGRPGSGDWARGPPTSETHKLVVVGGGGLGKSALTNPVHPVLLRVLTTNPNMEDSLQRSICSRAMAFPGRAVNILGHRSGPGQSSGAHCRSSEYHCVTVHGGSLLECPAHYTRTGQEVSHVRLRPQLHFDGEAIPCEALKGVPGRTGRFTPADGWLGHRGDTQRVPREFRGVSSIKPHIGSFPPA

SEQ ID NO: 998289 - protein, 300 aa, Homo sapiens
GASSGNLVGSPSTLWKLGSCALHNKSCCFSLLVSTPPLRAVTLTVKVCGFTPEISETMNPPRGMNNSGRATFKNCNIHYEGLRIPPEVSETMNAPEGMNSSGRATSKSCNITVKVCGFTPESQQDQKTHQTGRTLVDTSEHLKEQTLDNTIFKNLYTSARGSCGFILEVSRPRTTGRKHIQTHMGDPDGTIAYRKAEMAAIKLQMGLRMESHMSSSNQFLSEDPLDWPAGPIHGLEKNPSGRDDQLSGRGPCIWPRHSREDSSSWASGKSQEHNEADQLDGTWDNYRTGILGKAQTGRTN

SEQ ID NO: 998290 - protein, 158 aa, Homo sapiens
MTSQVLLGGHWDWTIWGTSPAGNLSWSRSLGSKRGKKVCHYPSWLTGQKQRPGTCQMALGKQVECAAERGDTPGGDKTVTLGPKELRDKGPQQARDIQPRPGALRRAGRIGETGDSRPPPQGAQRNGLKPVPKRRTMAKHAMPNDNRRPARRPGQVHG

SEQ ID NO: 998291 - protein, 127 aa, Homo sapiens
MDLCTSYCTGAMICVSLASPVKFSHYFTHASRHDMFVQEGNWRLYRTTKSRNRSGVKTRGHRPEPNTLCSPEARSGLVIHVRSRTVRCHWGRRMAGERTIIPLDLSVQPPKVGHFPRTMVTELTGTD

SEQ ID NO: 998292 - protein, 103 aa, Homo sapiens
GSAFGDALRLSEHGPASLQNVYCTRNPVQAQCWRVITLHPQVLMASVKAYTNFELLSRECCESVDNSHREDQNSVCNEVTDCTTTCVATTVSTCTRDRDIAFA

SEQ ID NO: 998293 - protein, 71 aa, Homo sapiens
KLGGGHCAVPYFARIRAPRLRLVSFAQMHVMTRIPEYVLSIDLHVNLRYTFANLEQNDLGGRHNVVHKVLI

SEQ ID NO: 998294 - protein, 78 aa, Homo sapiens
RAVGELLGWLVSARGLERLANRAIMSHQIKLYYFGTNTYDEEFEVNQTCTMLPKERYAIVWIPRNRHLMSVNLNVRKS

SEQ ID NO: 998295 - protein, 66 aa, Homo sapiens
CPPVAFMFILDPAKQVGFHERVQSPSIELRVLLCRYQCCVNSFAQADSECYDVLATREDVRRDLEP

SEQ ID NO: 998296 - protein, 219 aa, Homo sapiens
SFLRRLVMASPVPSSVGLIGGHSCFLEEDLWMIVDALEFVNPINKRARRVKPLSVLELNYESGSSMMVNYLGSLTKGVRMRSLDYLRFIAYVVCMVRFGVRWGKFQLDIFGRTSGVSEMLFQLGIKAMINELVEILRQCLTAFLNPCGRKFFTLSRCAEYWEAWGYGGCVTMAFIWHYCSFGTRGIFLITRNQLGKPVSFQKTFETRVDIMALEDSIGG

SEQ ID NO: 998297 - protein, 46 aa, Homo sapiens
MRDVFADSYSRDTWRTEIQSLTLRTLGNNSTFRTLWSHADNLLTSS

SEQ ID NO: 998298 - protein, 143 aa, Homo sapiens
QLISARSEELEAPVDSSHAYRIKSNPLDMSVLISNANERAQKLFQIPIATCQEIDWTRAMGLFTSRANSKGPQLVHIYTDALFNQIRCPTVLIISCHNSQLGLTRKVPAASRVEQVCMTLTTHLTEGPAVSRQLPCKVQHALR

SEQ ID NO: 998299 - protein, 263 aa, Homo sapiens
HVHAAAKALLAMASSGLKTAGNSFCSEVPCLAAQYHRINQSGPVNSSVLTSVQSGDRYSSIRTSAHVTDSKLADRPSHCAELTRLPRCHNITLAVSPVYFVLSHASGQNGTPNTSFAPSAPIHYSTNCGIKRNNFNSEHVMQHYTILLLSCVYTYILLRVPFFPPFFFIPHIPALNWPSKSAPLGLLHRPLSKRSFPMCLAMAIPEGDKPNFDPSPPPTQHLFRLHNIFAHTYPKHFPTHTVNFPNPPHTTLLSHITPNAPLT

SEQ ID NO: 998300 - protein, 103 aa, Homo sapiens
GGGLVAREARSQTMRPAMSAMPRRVPRCDAGGLVRVRAGLGFGLPAGSLEAGPGTMRVDAAAEAEAPARLSPPASALSPGEARRTGCLEGGGPVPENWEFLFT

SEQ ID NO: 998301 - protein, 205 aa, Homo sapiens
GPARLRLEALAPCESGRGGSAALVRRALGVGGSLLVLSRRVDPLPRSALLGDMRAAPGPAVHGRGDASAYVAPGPPLINAERSARGLVHIPHDSPENYRLDPAVPVNPCVAFPRDPMPLRPQEAPAATHARVDRARAWGVGVATAGPKALGREALRERRCRCRKSSFGFYQAVPRLATRCGCLEDMPASEAFPLGRGAGPPQPTR

SEQ ID NO: 998302 - protein, 59 aa, Homo sapiens
MRTGSHMWYGTVASLYPSIEEHQQLLLPRVGRIDCSFESNVGIALGNEGSALCAQIFVA

SEQ ID NO: 998303 - protein, 117 aa, Homo sapiens
MYSFNRVLVEPFGDAPASFFGSRNSYGPFRHLVRVQYTSIWPSLKFPLERRYLVNIFSIPRVDGLSPPSLLIHISRNTTKKSGPKKGTLLIPPRDTKTFDTHRFPGDLITGNRRTKI

SEQ ID NO: 998304 - protein, 108 aa, Homo sapiens
MVDFVPVSRVLVLECLQAEAEEADLVCYMRSTGQLTVFASGWMVSFTSIIYREEGHFMDVDWLNLLVFGSSDCMTRCGIIGLVVFAWSYRVNMVAICFMVTGLAIQLA

SEQ ID NO: 998305 - protein, 166 aa, Homo sapiens
MWVKENDSSSQTLSVSCDDCRIQGDRSDTLHGLDHESYRMQVCYRVNRNPVDKKSLTKGRHCSTHWANRAHFKSNAVGVIGLTLENGLSRSTRGYQPLVSIFLWWKGLGDASKVTHVELSSGCPKDYMSTFIITEHCINEWYSQVHATCASSMYESAGSVVRMKFR

SEQ ID NO: 998306 - protein, 72 aa, Homo sapiens
TYETADICPMDAVINNVDCGDIPSTVEQNNRCLRGLNPSDSRTRYTTVHRHKDPRTEAHEHSPLPELQASAS

SEQ ID NO: 998307 - protein, 206 aa, Homo sapiens
MFGDRYDYSLQTTKTLETLYLLFGAVSEESYVDMLISLLIRAELGQSQATVRRYQSLQSTTLVVTSPLSLCNYIFFIYVIALSVNRTAIGNSELVPAKYIGATRIWQLFPTLNQHKAFLDICNLTYSSITSLTPLVRSVTSCDVTLESSVHKGLEIELLTHILACEHVAIITTSQHSCEWPSSKKPKTQFITHFNNLKQGVVLHIH

SEQ ID NO: 998308 - protein, 246 aa, Homo sapiens
MALGLVEDDATYFEAGRGDNEEEEEPLCIAVVKVGGTTFILNFVNEEHMVKAIEGVTRGRALRVTCVYSLTARTRKRTEEVKAGTIGVCGRVNRRSPRGEPRLWAPTGVARGGGPVGGNQALWDTCARSRTEGHDGRGQWEKARGGGFLDTPKIGQRAGRLKGREWVNGNPATTEMGYILRRTDNRGGALKDRGGTPGGGGPHCLNLRGGGTEGRATAATGVTHLYVGGSSSAPENWKQRALRTEG

SEQ ID NO: 998309 - protein, 74 aa, Homo sapiens
ASAAVMSSGASSDLPWSALAEHAQVGALAVETDPWSLTADKKSVSDSTCMQNACEGCPDWLSVQRGTGNPFRET

SEQ ID NO: 998310 - protein, 317 aa, Homo sapiens
MPSRSESAVTVVPLSDFQATEARTLCVNEKKMSYSYILEENRVIGGKSTTGYPSTKYWRTQKPLGERTLTMVDNSGGMMRTDHMIGDAMLATAKLVSPWVPPHGATPVKGTFPHVVGDTPGWPQEVGLTLQGGPAPHRTDLGHFLYHCGVAEPSTGYKDECSRNEIGFDNTNSNGLPIIQMIVSSTFHVSKDTTKRASHAMMYGALHSPPDRIAPGVRPPATNGENYPRRYPTHGTVVQVGQNNIVAPPTGKVDTKVCDKVNGIGNGRARNLYARRVMRPPPQFMGAMRKTTPLLYPTGRGARENSSDTPIPDRRQT

SEQ ID NO: 998311 - protein, 212 aa, Homo sapiens
MRIDDSVISVLGPIYPGTTALSVRPPTIARCSDCCKSIMSSKKLYQKKRNPRNVRWTKSIPESRVVKSLQWKFIVTFDTKGRNEAYQIPVDELWNKTIDADERELARNHTRSAKAKFNNEADCRKIKSLRKGSGYHTEVKAKIIHLYPETPSCMAKGKPTLRHDEHMVPAVTHEDCWALGRCSLKNLCNHFLLCTFEKCPLGYLGTVTLFIF

SEQ ID NO: 998312 - protein, 253 aa, Homo sapiens
ALRDSLSRELPWKPPGSWNEKALEVYDLIRTIRGPMKMPNTLARTGTWSRTQSCGMFTEITDRTEYLVIYQVQRQQVPHLLFGRLYIGRLCFPAATHTFQKMFLPNFTEQSTLATLLPLLSQGTPQHQTRSAQQHSTYTAVDLDLTTMKHKLRHDFANLRTTAPKSYKRVQHFGLGNPQVLRWIPLLESPLGTFGIKDLVHITVEAPNTCGRGYKYGYVALCSTVAYQKRYSLTATFNHGHEYTYKWFQTIYQ

SEQ ID NO: 998313 - protein, 237 aa, Homo sapiens
GPATCRIRRRTPCDVVLYSHVFWLLAADLGHGTRQSRGPFATLQIFSPTFTNGGTILGNGFAHDFGKWSASVEYLALELTEVSQSIRGDEPPNCYKIKQTTNQPSGIAGAFPIEENMVLPPCTQQNFIGRAKRPLQRHLLHISPIVPNYTSTGPLDHPYRGRDHNLSLATICMCCLPKFRLVIHNTAARHSPFIPTANAYTWFTTPQHKFPNAAAGDTICGSCNNDNTRDTRDSSLS

SEQ ID NO: 998314 - protein, 222 aa, Homo sapiens
MTGKELIWKSNISVVGSMLREKVDSGRRDTYCRIRLTPMKTSIGSLRYQECAIIYVNNILHDALFALMTRLRERVYSIGATITSAKVMLRGVVAAYMRLRSSGIRYSHAPKIGIAILYIQYIAHTLNTGYGTFVGPTNSPLVTDHASKAFTPHNGTRKGWPQGRPNPFQRTSQDIISWQSRNIDDETLLRAGMRIPPKPLVHSTTPFMPAKRRLPFKTNTTM

SEQ ID NO: 998315 - protein, 75 aa, Homo sapiens
RRWAEPTMAADEKRPKLSKSLLRMKFIAHTGTGLSNTKRTNYTEEDENIISAMSTGTWICRSFKEKESLHNRKTQ

SEQ ID NO: 998316 - protein, 197 aa, Homo sapiens
SEDPGASTQTWSMNTVYVWCHSPAKCHDTVVDALQMPPSASAPAGRKYRGDLIGIDNERSLGNVVQNFYEDDKMSYGDLKNMVSDNDEWGHQLGAVCQEQVNDDLRNAGVNMVRGDHRGARYLQCPSFCPRGRSGAGGQSGEVTWELDSVARMLNTKQSVECHRNMSGGRGNAWNNGWYMTVDAVDRGPDVRMKEGE

SEQ ID NO: 998317 - protein, 407 aa, Homo sapiens
KLISQGEAADTARSSKETAPEAGPFVDRECHSGLRCGASCGPGKSPDPTLGQNHRADVDLIHSLAAHLSHVGTNSQKHSADGRGGLHDCASGAPLERVWPWGRDERTPGTLPRASRAGWGIRGASEYVLWVVAHGVRGIHRKGELLVSTPFQFGMVPAWASKLEKFLLLTRTISCFDETQTATRLNARGLAPHRSAFESLQNLMVRTETCSRLDSLPVRTDHREYALALPRYHTPASLGAANAKPAGSEGRSAPRRITSAERSKTTHLGAHVSGSRPKPLHPRHPHTDTTPPRGTCSHRHHNTYGRTPRPHSTLRPPRDKAKQRNVARGQGPIRPPTALRPASRPHRTFTALAKRDNTFQGAYHNTARGGAPAIKPQGAAFVPHTGAHCAPPATHRLEPRHRRRSAG

SEQ ID NO: 998318 - protein, 78 aa, Homo sapiens
VAATAPRQVGHPEATGSSLLDKQATGRRMAAKLSRTLWEDKVWAFLVRPDTQAPKGVLYRPYSLFRVSDQQKWSIPGD

SEQ ID NO: 998319 - protein, 71 aa, Homo sapiens
VPGGSRGLRPRRAVDCQQQWRLCSVSRFLVRRNGPRDLKLKKPLVCTLPSGMTCVCSGGGVLHSVIHTGGN

SEQ ID NO: 998320 - protein, 192 aa, Homo sapiens
VDDLEALRNESGGLSVRLKCRILRMPLGGLRLCPLAELHVVHDLSRYLSHLLQGPDSMPKMWMWQLHGRVRLVYLSTPIHGLHRQCIYSTCDSAIGLPVFSSRGSAFLAAYLESFVSVDATIPWRAALTPSWSTWGLVTELLLDYVHGACLAVNAAECRAFVHCQLYSFAGVSYVNYHDVGICKAVAMLWTL

SEQ ID NO: 998321 - protein, 111 aa, Homo sapiens
MHVSFSRGFLSGLLVQGHLRDPFWVGVLNEITCRYVESVHGFVPVPTWQMRLVTMECHASHGMGTLSYLCKAALGFENYDSGISFSTHRIFTLYLRTRGHLQLILMITIAS

SEQ ID NO: 998322 - protein, 168 aa, Homo sapiens
ESELVLMCGCAVCCAGACMHAVWVAVAGLCGSCVPGGCAVLPSFVALWCLVGDVPGDVVCPCVCVWHGGLLCKLVPGSLEVKRCDALMGCIACFGMPLMPWDSPGCPDRDGMHWPLEPLMHHPLREWLPGSPLGAIESYRRRAPPGKAQANGTWDRGSVEALVGTFGG

SEQ ID NO: 998323 - protein, 152 aa, Homo sapiens
MSMECQRWKAVNTRAYQAYDSVHDQERTGKAKQEIRRQPCEGQTAEKHPIKSTTHEKGIGDNQRASRKDYPKGGDEQTSREAHRENEATQNTRVPTREQDTRGQESRVTADQNYQHTGQYRENNKRRDGRNRKRLLKTHKEPGENNERAELS

SEQ ID NO: 998324 - protein, 356 aa, Homo sapiens
DPAWRSPTVCVVATWLLCDVTLYSRGTSCYLNAPFLSFRMRVLMHMLPIFLGPARRVGYCFIALIIPDSLVVPCTGTRRYRTLRLPRTLYRPSHVNQPLDEESSDSYLNRMMKELSAANGWHHSLIAAQAILANVMMRLRENSTLFNRTQGEFKKLVASMVKAGMNARLLLSSCDNSRGQARQKKGPKEVLNGKRYSLKRMAKKTQDGWAVSGGLFCPSGQYNDRSQACQALRWGVERPPPRSVPLETTLAQWAAGDAKKKLDSARAPYLCGSCQLAPGGILKPGHGGGPPKSSCLYIPMVTDTSELPQELKATGEGFHSNVKGLGLTTPLEAYTTIGLAGVSGAQKDWAVCGGDV

SEQ ID NO: 998325 - protein, 183 aa, Homo sapiens
PWCQCAQTRASPVLARLPHSFDSPCLRSPTDSPACSSSFPQPRTADHGWTAPSDERNTGPEAGVGNNAGTLVPAHLPVRSVTPSDHLQGRARMVSYRVRRLAAKSEDTSRGRPLGTELLRTRMPRPHGNANAQRQTPTMNTYGEGEAKEAHHTSWRGKRNTKDWEHRSQPLGTACTGKVGKAR

SEQ ID NO: 998326 - protein, 94 aa, Homo sapiens
VAVCCVRLGPALLLDDLLLLGPLLSLLSLCPCAAACSACGWHAIGVCPRVSAGLVWLAVALLARVSWCALLLAFYIVLKSTGDGLSRQRDGTEH

SEQ ID NO: 998327 - protein, 254 aa, Homo sapiens
MALEIFGSNLQEHETMNVGYSHAFASSSIVGNIVQNQPHVLIVHYSIDLPTETQDDIESENHDLQGHIYRTDVMHVTCIVMLPWMLCVELLRQDMGTSSKDSGVRTREKTLTALLDFNNNCAVLKKQLTFDRWWLTQQHGELSQTWTRPSPVKQGPRQPKKSWQRNNMERKGGNDSQTQHLSKIKQAHQYADANETPPGKTTDKAKQGMTKRKQRRDMTHTALTTQPNGRVDSDQEVGNSEREHEARPKRTLAK

SEQ ID NO: 998328 - protein, 99 aa, Homo sapiens
TELSVLGVQMSLSGLGTADGVGGPWRDGPARMLCCLRCCRDRRGLARVPSRRRCPAVQLDTQHHGNQMLLSVTRMEEEYVEQEVSLASRTLYIKNKSYL

SEQ ID NO: 998329 - protein, 181 aa, Homo sapiens
CCARAPCPLRWTAAGVRRRLNAEGAEGALLAACKQATAKWRRPWLDTRRLDHQCRRTLNDAYGTPQQISSRSDCEQTPQHGGGRAGAVSPLTKIRVQRQILPLFFKLEGIYVLDTKIPVTFELPAERLTLRKERSKVDSFPPVPLGNARIGVKLPFIEGVLTWHILVMTILHGATRNNQGA

SEQ ID NO: 998330 - protein, 438 aa, Homo sapiens
DYQMATKIYSILDPVRKPGTTYYADIAIRMYAGSCAWKSCSLKSISGCRRVNVTHSDKRLANSRTDYDTSLGISSGQWTDVYADQRWDFAHGFNAVEPPGKYYLSDYVQNQVIPRRDARGDLRLATSESAESPTRGSTNINVCHRVTLPSGTNPSCSWILDCWLATTKTLNDSNLVLLHNDHPWARIGHKDIDRSSFTCINKHLAPVTRKPVSRTPLEAIQISHLSNPKLGYTKSWANEAQKQYVEAGVCHNNVDMYLAHSTILLAYHMVLGIPNNRSTTILSAMCERQPTTRYGDGTGTNAEKITTKRRKYRRRQQNRENGPAERKHARGKRPPAQPARDKPPTKGNTRVASIRITCGRGDHTKDTRRNINAAEENNLKKRSYATQERSKAHSTQEQHKRTDDAHRREHCQHKKRVTPLNQKRAWAHTRAEVRKRRR

SEQ ID NO: 998331 - protein, 345 aa, Homo sapiens
MDLEEVEIARLSQTLEASNAIHGRNKEPGQLADMLLTMGVATRGDSYKCAMAINTKFRPMWAAQTQFQNGPGPGGDYMWPPPMGLNLGEQLGQPRDNRWCLHNADCATGCGPQRYSSRCRMETDQSGDNVGTYTRHTWGQCPGPREWKAIGVCTPTYTGPGEEQGQMEGTTPLCQSIISYCETRMPLAHCNVGPWRTRSVRVAGHTRGGQQTPWGDTTVDTHSGRWSWRYDDRNTGTLRIPTRTDEHCPTDTLKRGGYRHSQPGRIGEAHRDATYKLSTGTPTVNTHEAFVRIGKRREWILNEAEMRSAQRYKRTGHTEHQQGAVVTICGNKPPYGSTTEAIANT

SEQ ID NO: 998332 - protein, 195 aa, Homo sapiens
ERVGNVRLRQRAVFVCASALNTSRHSTSEGACCSNRHSTAFFIHDSVPQLPHTLTKGRQRTETVAKVSMGLFMGGKTGQGPWDTRYNRPGNKKQKALNARGEEGITSGMCSHFGKEFRKEVTIPVGTKKKWDLMVQGLLEVDANGERDKGGTELFNFKDLECVHKKDQGLSCNLGIVHLTLGGAQLGTPEKSGAV

SEQ ID NO: 998333 - protein, 349 aa, Homo sapiens
MESPPVWMAMPVEARCLRVWDCILPTTRSTDKHLAAVHISQDVYKDWWLWVHVRCWSEWQTGVSQVPGMVVTSCSRYNVTTERKICRECDHEASSERSFLGTNCGVFNCPWMVSVTGMYRWVGHTRFGVGEPSDTWIGTPRMGTGMRRDLSRLVPRVDGDPLERQFPKGQILKRPGGNGPRGIGHWPHQGGFQTCAPIGKGVRARWLRRGQQRIWNRDRDAVGFKNRLREQDVGAVLKISLVERFPERRIAFAIFVWRIWGVSHGKNSAPHWWWCVSDTNAPSQRKINCTPRCRGLRLWGPRAQANRGSPTKKSSPAGEFVIKTVRVSTNQRRSDGKPVGQVVNQNVRP

SEQ ID NO: 998334 - protein, 43 aa, Homo sapiens
MDSTSDSPLWAPRKTPTEVSIFQKNQSASWINPMGRHITISLP

SEQ ID NO: 998335 - protein, 111 aa, Homo sapiens
FISSGITWHTYGKHNIWQRLIQNVKDKKHAECTCIRNWSYLGVPMCSHNLQARANPLQHKASVLQKKLFSSLGGHHFIKDIMEDAIDNRLDSYKNGHIVPSVQQYGMVQEL

SEQ ID NO: 998336 - protein, 80 aa, Homo sapiens
VRSDRSKMATVEPDTIPTPKSPDYRKRRERISNQGGCQTQNHYIEYIPYRNRWALWLFNRMIKRKTLDIRKSCRAVSPMF

SEQ ID NO: 998337 - protein, 73 aa, Homo sapiens
DSRRVGDSRDEDSKVGRCSEVLAFSFTCSSVIGTRCALVARRWEEFMNESAEKLESPDPMNGDVWFRAKYRHC

SEQ ID NO: 998338 - protein, 446 aa, Homo sapiens
MDKADSDRWHIAGWESPGSDTGKPGIDNVKHVWKCQRRERITDVGMEVGKAHPCAPCVVGWTTFHHRKVFSAHPRGTEAAEHKKRHSVYTKVKPPYKKQQNEGDRIKHQKKTKNDVRMEKQITTISEKQRSKRPKKENKQRKDETKEDQEKKQSKRHMDEHGTENREIGDHNNISQYNVADREKQRRYQDKRTGQPRDHPIRDNITADTRPHPKTVTQTDNDKTMRGRTREGERHDKGNNDHRKSHTTLRDVGTKRMNNETRREQQQTTEQSETITTHHKKGRTHTKRDRRRQEKNKLYERELEQKKRRKKTTTQREDDEGRDIAAVMHTNPHRQTAHNTRGRPTNNPSTNNNNRDHTTRRKRHNHIKDRASMKSRKERRKNTKNKEQTQSGVRQPTEERAKSRPHHPTQTTTTSEADKQKVTRKKQTKVGEKNKQQHGARKSDHE

SEQ ID NO: 998339 - protein, 268 aa, Homo sapiens
ESWKRSSEAGTGSFAAIFLSNQTGDGRREANQGLHRQVETHERIKDTLYSIAWFFSHPIEQTRFLDSYFPLDQGGWVTKISTNMIASSNKRNLLGRHSYWGATVIMLITRPSMDELLEGNRHGQWHHGQNTKVWSHKPKTFSRRNQRNTNNLYPIYGKKKVGHTGNTIGTQMCAIGPFKNAGAHQHLAHEKDLDPTDSGGFHNDNVLATQLEGFQYDGLLDRPLHGTRPKVGNKGCPLPKQHTRWKETEIQNVGTTTESFTSLIGHTW

SEQ ID NO: 998340 - protein, 141 aa, Homo sapiens
MKSRKKEEAKVIKLEKKQTIEKKKFKKMRAGRVEAMRVRTNWKYIQHRETARSRGARKSKSNRRTEQKHRRQKDNRQTAPENRQQIQNEQLDNKSNTPEAKRRNTTHKHTDRRSRRHKIGTKITRQTAPENNDNTKEPQKT

SEQ ID NO: 998341 - protein, 101 aa, Homo sapiens
MPHPTRIHSGQTRRQPPQPTPHSGKRNWNAQGQTAHRGPTDTQDTKEQQSITNPTNRKHQPRHGNTQAPGNPRAYATRGRQAEYDRYQYKTPNTPYYTHPR

SEQ ID NO: 998342 - protein, 145 aa, Homo sapiens
ESEVRRLYTDARLTLSQWIVQNTLFWSVVILVLQWGSYWIIQVAENLDEACTLGQSSYDPDSQCLRSKRIVFQEFTTDYSGSYRNESESGSLRRRISKDMNIDQQTVMQGEGSAEVTSERLTGLVRQAWADEVDEHRRKREVTSV

SEQ ID NO: 998343 - protein, 214 aa, Homo sapiens
EPEEEGGCLVVVTERSPVHRMAGHRLVLVLGDLAHPTPVQQLGQLNSKKPPWLPGKKFQATISSWQPGKTFGHAKRRQFHGRILQRTLGRGVEWFQYCGGRRGRTSGVEENSGNFSSQESRDTRVGLNSGLGKPRFSNKQLWALGNSPMWGSQFQEVYILPNWGGTHLWGTTSSFNDAPGFGKGRAKFLELWDTILPLSSASGVEAKQHNAKHA

SEQ ID NO: 998344 - protein, 378 aa, Homo sapiens
ASFRADSAHASMVNVPKNPAGTFCQHVWQAPKPITLTQYTKGKGFSVRPGTSGRYDRHAEWLWWGKIKAEFILETRLKNKKEDGAKGILSAVEPQSARNLRRMLVIKRCKHFGNWGQAAFKDSSTRCQVASQYPKGGQSFELICKHDENICAGSQCPKKRNKKKEEARKPEGNTCDSGRTANAHKRQKTKEEYPESAEVERPKPPPRENESRENTEGDTRRLGYHTEADNRTCTKEKHKRALVSTTPKTQTIGKQDATRGGSNTKRAEASGQQQNTQTEYDHQRREHQKRGRKKQQKEKRKARKEMRQTTRRNTNKHYKRPPRRGGGPETRNADRAEPPQHKIETEAQNTTMRKQQRREHERQERTRKRNDTATSRNS

SEQ ID NO: 998345 - protein, 154 aa, Homo sapiens
MPDAPLRIRLPLRLHYLRLKPGTSHNPRIKQFYRVKCSYCTALVPSVETMFTSRENQRLGNSITKGFKVDTHGFWSVPSTCGWPPGRLGTPRVDQSHPQYTGGEWIGQWSAIYVGVDHFELIGTHCGRVVIREREKNVGEVGDIEGGEEKELFN

SEQ ID NO: 998346 - protein, 150 aa, Homo sapiens
MNHVTVADGVNLSLNAVPECDMLEENHVQPRKPRRGRLILQSRRGVPSMGGMTLKSDTCNSTMLPKVYARGFQLPICGVRNTQHGVTRDKFNTLGNMTKWLQEQCYVSDLSYIYPNILAPLTKQVPHRAQATTFWGHYFPEHTQTGIQSC

SEQ ID NO: 998347 - protein, 105 aa, Homo sapiens
MGDREQLLQRARLCLSRRSATTNIGPPPIEGRDQSLGTHLNEGNSLLRDFPRLDSMAKLAGETTSPSGRATSRMKKQEKATEDPSGPLALPSPTPSSPILPCHNH

SEQ ID NO: 998348 - protein, 322 aa, Homo sapiens
IVQHIFNSPMATSTPYGFANNERFRTTGWGGGKLLTTRPGNKVPFDPCVSESVHAMDDRVVVYTQFNIQKRLRNCLCTVSVTLVMGELPQFGCQVLLCTTTANSLPTSWLDLNQLAHYMLKPFPAYKSPHGSCNVHSISKRIVMHRHWTHDQWHILYTHGHTTKLQYLVTRNTKIKHIIHVIGTNNSPLTENQSCQARARRTREYQCDLITYPSNIQEARTEEWTMGIKYRTHKKGPNDHRHVGAKTGMKNRPRQIPTYTQVPKKPTNLGSSSGGPKDRPRTSATAKPSRERTRRAHKTQRHRSNQSERRTRCNAENRSTGH

SEQ ID NO: 998349 - protein, 41 aa, Homo sapiens
GEGAGSPSPTSASPHRVCAFLATEHKDQAPAARGGHIRVPS

SEQ ID NO: 998350 - protein, 157 aa, Homo sapiens
MNTYSVWCGAEGAHDARHEAAAVAPKYTVFPLTGRTPGRPSEHGALGDFLHTNIYKNTRRGEGEHPRDACLRVDKHSRKGASCRERGSLYRRGGLSISTDRVRSPNRRERRSLIYTSKYLARPESPLGETLRCPKDTCRVANYLVDRIHSHRPKDMR

SEQ ID NO: 998351 - protein, 121 aa, Homo sapiens
DRQYHATRYTTNEELIWTVLAVKVCTHCASEEAIENMAHRDGRLVCIIHIADVVLTRIHLSRYNKFYTRISLEIFSSLVGMLIVADSDFGIYPGIMGSGKEDYIAKMYSFREVETEAYCVK

SEQ ID NO: 998352 - protein, 92 aa, Homo sapiens
EKPAENGSDGGLGRVGVVVAGLIWAYRLVIVRLHMLPIKQRAHAYYGESEKLCQIGKRNRQEKIKGFYRESNSAMADYWVIILWTSLKPMRI

SEQ ID NO: 998353 - protein, 267 aa, Homo sapiens
MRDMSQSSGPTQFEARLTLCSLRELKHVDSWVTRSHYATLLMRADLEMEYLGVVSDCAERLFWTYPNCNTLVRDNLTAKSSLRKDVTEDSQGMAWRVERKNAMYGLVYTGQYFGCPATEGQRNARGGMDNPPIAMCGNSWDGTAQKSNGVSGANHGCTTCLKLCTGNDSQSTDDFQWGWGLGAEVVGESTAFGHARPDRRQRHTRVDACAGQQQRNVLTTVQWARADISNQGMCDLWPDTRMHSVWNESLALSDQGRFLRKRHVGRV

SEQ ID NO: 998354 - protein, 200 aa, Homo sapiens
MLRLVYAVWDSTWEKVNEQMFGDYQLLKTQVNIFLEIPPGYDGLEYSHVMPTTVKTPLKAIRYAPTRLLAVQKRLVGAFVDIRGSNRVGLVWVTPRWPKRIWKGTGNYWVMERRVVWESGEERNVQEKLGEVVIRIEGLCKKGGDGMAFPRDFNLGVCWDHVPTLEEFRVLCKGGQKKEVLGRATWQVEFKGPLRGIIKE

SEQ ID NO: 998355 - protein, 95 aa, Homo sapiens
ALGWPAGAGSVESSAVAVCEPVCAAICGPDILKDSRQWLKTGDNENDGLPWRAKSVIKLSIFGRLQFAEGHNVSTRNEIKQWIEGLGNLFAQHNA

SEQ ID NO: 998356 - protein, 217 aa, Homo sapiens
DCCKMAAPSDGFKPRERGGGEQAQDWDALPPKRTRLRGRKQMIWMACSAYCGACDGASLETVKVGKTYELRQIRVTKHRSLVLLTEWTGTRVGSAGLDISRAEFADADGVVHREGELACYRFISITQKNVLIEVNPQTRIPRTFDRFCGLMVQLLHKLSVRAADGPQKLLKVIKNPVSDHFPAGCMKVGTSFSIPVVSDVRELVPSSDPMYVVGAFG

SEQ ID NO: 998357 - protein, 119 aa, Homo sapiens
GKSVDVSSQIIKALGLVARSVLSYHQSETFRRKPSHRQKQYGTRPRSIPRDKKPTTREYNRTKEASQESNPHDFSHSRSYGHSKHQDRNEENNKNNQRPKEQKGDQLTHKQKLIKTEDT

SEQ ID NO: 998358 - protein, 185 aa, Homo sapiens
NLNTTFFDRRAEEETRSSIPTTYSDFAVTLKFIFLSYQASEIIVPYELTDSGNKGEPLGYVGDGLERMISIGFLGFSRVSTPVYLRVGIDVDARAYVALRYRESSLSLIRRLSIICLTRTKLRRKQYEMICVQCSEHLGFILLGTVGGLTGIGLANSSLDIEVHEHVLRCSVTFHYVLSNDGAVM

SEQ ID NO: 998359 - protein, 75 aa, Homo sapiens
GATEGLSTGSRRVWLAKMNQMMRKMKKSSSIKREEVDENMVENRERLNELRRELRLIELWSGEDHVDRHLIVRRG

SEQ ID NO: 998360 - protein, 98 aa, Homo sapiens
FSGLYRWRCGLVSACKVLSVLFSALPGPKLVRAGSGALRGADAGTMVHLTTLLCKAYRGGRLTIRLALGGCTNRPFYRIVVLTTKCPRMAVRRAAGLL

SEQ ID NO: 998361 - protein, 72 aa, Homo sapiens
ERTTGTHKNGRQWRDVSAPQYSCDREKKVLEVKLVGAGQVVDIDAGDFSPSGIICERFREGYYGVVKQVHHW

SEQ ID NO: 998362 - protein, 93 aa, Homo sapiens
LLSAPSPLPPLLLRLFLPPPGSARIQPNPNPGEPFLLFPFSRHTASDKVIRAGPKNIIPSPSHTSIACPYQNLKSFDPFADAPKGDDNSRRGH

SEQ ID NO: 998363 - protein, 109 aa, Homo sapiens
MPRYAQLVMWPLLASGKSTLLVPQLVQHCEALNLVLSKVVNLASRQQNISNNPCWVTSGKLIEGGLMYMEDDSRDDYGPKGREWVHCALGDICANNFGTCAWRNGSVAM

SEQ ID NO: 998364 - protein, 464 aa, Homo sapiens
MISKQLDENRVIVPVDDRRYYNISTYDMRSSAGNDNHVGHSPVDYEIPRHNGDWLMFTMGDDCSALPQEMAPYITYYALIRLYFTCTHPLRITEPCATVTQRQSATRGKIFHRESSTRRASARVRANASHMRIRIRVAYGHLCYEVNAVRTVCTELEKRAIPLFAKGGLLSRLRILRMKIAFIPLQLGPSYTKNLPLFPTRNTLIAFPSRTKILQSSLHGQNGLKVATGGFSTANKASQIVGVLQTLWLNEYERSVARFGSTPLSAMVPAFECPKVSNPMYIPLYSGDPVATVARLVPLKKCKLGWHSEVDIPHSPQFIDGRGKNTLQTRLPGGRCQAVAQTSKHKVFFHTGCFLTNKEITKCFDVKKKNGISTYEWVATYMAYWQPHMGHGTCPKYTVTDFHQETQFQLKQREKFPRPFHRQESRKVRTPTGTHYHLRVRAERGQRERTFGDGYKQQGAPGDG

SEQ ID NO: 998365 - protein, 117 aa, Homo sapiens
MACLFLSSQVASYFTSCGPLFLNLWLNSLSLTYVASKIVGQLHYLSTSLFAIVMGYVLLGLNDEYLSTRSIHTITDNYAKNQQQKKYQEEGIPALRDNFYSEVNKCSFLQPKNFTQK

SEQ ID NO: 998366 - protein, 362 aa, Homo sapiens
FYTSGVCRQNTGVVTRLPPRKPKWDRQRSHIKHSSCIGHVDSGRSRTNTGPSDAIQLPVVVRAIEKPFEKILRSEAARCMRAQGALYFKVIAVAIYGIKVGRVLKQSQTVASVHPFDYHPLIVNMYGRPSKVLMLTYASRCRPVSTVVNIIPQNDASKLVTIPGAEFGCLSPDVVRMAGKLGLKVRKAWDNRPKRNLGKKPLTQVIGAPLIVTKPLLEGGCKPRVRLRTGMDWNQKLEFSQLGCSGPKHWARTRRVLTQDTRSQRKRSAHFVPFSAKFGGKWNTRNQQEDRLDAKKIWEWGPGAPALLGDTKERQPGAHEGHRGLLQTVRPRTVDCATVCQDVDGRTVMYFERVSGDNVKCL

SEQ ID NO: 998367 - protein, 161 aa, Homo sapiens
SSAFGDALSSQRMAQLILQNSLLFTKSCASIMGWRCDQQSYNPPRSAYGSVKAYTSFDARRGHCFAPIETAIKSERCGMSVTIVQEFIRPNAGKLGHDARGHNMPSQPNPGRKWTQTKMCNRLHSIRPWTVLGLNHCAKPVSDTASSDSGPSLKELPLAHD

SEQ ID NO: 998368 - protein, 481 aa, Homo sapiens
SVVSTQSGYYGREKQTCSILFKDAFTFAQHNHMHSTSTHTTSHSGKLNIQAAKPGSQASKTNTVQHSKHAAQWTIVYAQHTSIGIACFAKSFPECIFSMHLGTLVSSTAFHHQSLFPRTSMGCTHHTQWASATSVPAGQPTQQGGIKFFICKQHIIGSKGKGLLARQKPQQECQQSNRVKSFNEFPKANTEKVAFEGKVNVSKRQARLGHHMKANLAEEKKSHSANRTPDKGNIPRYNPKMWTTLPTTTRSGFRHFLPTGGHHHGHTPGRHNFTTALAPPRTPVGGSSGVHTGATTQLPKSLRQGGHTETARTPIWALRLHCATAHPLAISNSTWELGTHKWRRQTRGDPLVHPHRNATRHGTGNTTDHKAPRHNPLGQFPTIANLGNNTHRPHNTWRGHCDREPTASDHYGFQTAPQLLSQLDHSAGQQYGRSRYTPARSSGHKGEEPLNTNGDTNRGNYRGTTSTHTRISTPLVTTQQG

SEQ ID NO: 998369 - protein, 201 aa, Homo sapiens
MFSINPLENLEGVHQAVVLPWVVFMIRRKRHWHSFPDPGLLLQKSRRLNPQKWQRDWNHFLLRFTDSALCVLRAMKPSKHLTKRNQNSRTGTSDQAGRPEHSTQSPQAWRTRGPVNISVIKSRITLGPTENPSGRGNSPANAFGPILVTSKQSKGITLVTFTGQGKTTKEDNNISFNPFVAALEPRIDCRRVNWTLLSQCG

SEQ ID NO: 998370 - protein, 397 aa, Homo sapiens
ERPPSGCGCGAASGHHLRWPAQRTPCCTGLLCALATWGGPRNPRLCPMKRVFGVWGQLSSPQPWDILVVCAPMPDNNAHTHNWHASHPTYTTYGEHHSKARKGEHTDKRRMQRETRGKQEDEREQSEQRQQKRQTRAGEEKTGEDDQRGKGSERDEKKKAEEERQREGGGTGGRRRKRKAEEKKERREKANKTQKERATGEESEKERKKTEAARASERRSRTEEASTKNGEKTRDRGRGREEERGREDKRSRQHNKNGSKAKGRRGRQRRRSPEETRGRGERPGHRKEGDSAAREGRGGTRERQTRRGRGNRAKEGRQGEKRRKERTEKRRKTERRSQGGAQTKRKKKRKQEHRARGHTHERNTNKDGETGHKRRRTERERRNERGKREDTAEETKR

SEQ ID NO: 998371 - protein, 67 aa, Homo sapiens
TESSALVADEGIPSAREVLDLVVFWLRVTPAWREVFCEKPKDYTVTNRNRIQATVSEELYYRYFVSL

SEQ ID NO: 998372 - protein, 195 aa, Homo sapiens
MPVAPMKGCSHINIVAVLWEVTPPGGVTQKTEVGILDSFRLRNCLVSKPCVSSSIHQAQGGRYSAKGVHPPVGAHCTSPYPHTYYMVLSCSSGRRGTRPGPVDFTHGRGISATTVHKLCVYERCNTWAKLLVAPRGREGRSRTNTDKQPLASLWRWRHSRHPRKNGATQPAKSSVEGTGGHAGGTAEQKVDTQET

SEQ ID NO: 998373 - protein, 294 aa, Homo sapiens
MELYKPSPEQFNGLCSGCKAFLHWYTGEGMDEMEFTEAESNMNDLCVRVPVVPGCHSPSDGGLSSTEEADGVTVGYEALQSLGYMQGSSVNSYISLPSLVPVGLFHCVHLACIPCRIIHDCTDTQTNIKGNFANSQKQETATRGVHIKSIQKSGGACAHPGESTPWTQQTSAERDEEVHRRGEMTDNSGYTRADHQRQNNHSATKEKNKDTRRPFNTTQKRRPTVGDQYGTIAEENTTREIATGGQKRENEKHRKVRAQKRKHKMRRRRRGNEREEEKEGKRQAEQSDTNHEKQ

SEQ ID NO: 998374 - protein, 74 aa, Homo sapiens
LVRDIINGYVPSIKHYICFNFDIADYSDILRSNTSLDLDRLTCTEKYCHVVSSTVHFETFSGVPYYFFCVNACV

SEQ ID NO: 998375 - protein, 253 aa, Homo sapiens
MHRLKVIYSVYYYQAVCDSSSHIVTLTYYRQKRQNHFWITSGIGHEAMHYHIWATTKGFHCVMKQAPRYTYTAVGGYDRLEDKEGNIDNIPYTNQNGVAYSPDADVHKLSLADFGQEFRDKSKQYKWSHGNATEASERPHEGNTKEDLSTARRAGPDSGAMTTTRTTLQPEEIGTTPGTRERTGVGKTDEKGPERDSRGAQDKPRREERRDNPKYTRHQTKKSPTANTKEHKNKRGKKKEQPSTSAIQKAEIV

SEQ ID NO: 998376 - protein, 399 aa, Homo sapiens
MRQLLHVGGSELLKQLDESLGVAIIGALGERSRTCVVNERSNTPKRSHGAYGSSSTIIATVLSEGGMPASLILLEAHTKGAHRNESVEPTSRAVYQQQAFSMGTKGCPSVNVVQTRLVSLCVAIPHARHTCNAHESTLIRAIYFCESANADMVCTCAFGPFTGLRKREGKLLTDTLGGCFWHVLFTAIFAADPMDILRWRITGIWSSFQEIYRHELRLDIGPTYAVGLHTFKETQVALNKQDQRARNLRPTSMAIYNSPRPHTRKGAANSWGSLADQRLTRGPGIGGKGRERGLVRSTKDGRQTWHERVTRNQCDKWKTLCKKGEQGGEGTEGEEGQGRGPPTPRRTPFGTRHGGSVQRAIINWEPDRNGMAPTTQSRTIGGPAKAVDNLERIMPATCH

SEQ ID NO: 998377 - protein, 212 aa, Homo sapiens
AYRRDVFVLMSHRQVFRMSDMVPSQYLIECSLAGISVAMVAYDDFPLLGDPSSWDTHITVLLWWDIIVLGNVVTVVAGNVKSPYFAVCCIVVVAVKPLINSLDTDELAMVVAVMFVPLPICRLAVRKRDPETRFKKTLVVKRNVQSSFIRSRETSYRSLRISHSIARILLICDLCTLLVTQSCVHVGQSIDGIVVKNTLTLESLELTSNAFK

SEQ ID NO: 998378 - protein, 120 aa, Homo sapiens
MIDRAPLASGTGKFPINFGLCKSWNGQLRHFSVRTQEALITFSIARARLLFWRIFCDYTALVKRVPTQFLCWFSPPIRHWDSGFVCGRRLDGYSLKSCERIANYLSETGVVLICGAEVGR

SEQ ID NO: 998379 - protein, 107 aa, Homo sapiens
MIILPEKVGSMSGRLQSQRTWEADWQANHLNPGWREVAIESDSHHCKLHVVGNRCEHSVSKKKRKETGINKYRLLYLFPWVSNAAMDNFLEAFQDFKVGYIPKEKYL

SEQ ID NO: 998380 - protein, 120 aa, Homo sapiens
MYFSYGYMGQKIRVQFLALHPLITLHWCMEDLLDKKPLDFSETSGHYRSTRRDTTGAREEWWISPEYGAIINSKQCVPGILERTEKNRYYTQRPCPTSTKPRGTILGGHIINGVRGGNVQ

SEQ ID NO: 998381 - protein, 168 aa, Homo sapiens
ESERRWRTVVVEVSSCGGLRAVGAPGPGAGVSLIFVPVWPVWDVPRVCGSPGGAGGLRERAWSLRICDACGELVLLEAPGGRKAGCAGLMGCSVPWPPVSAPGGASMGHLGVTVFGELRRHAHVDVEGSRGSWIRIGYGPAGLNPVELQLDGTPLGHGDVLYSTSFEV

SEQ ID NO: 998382 - protein, 125 aa, Homo sapiens
GTCSASRSTRRYFPFIEELITFHDHALIIIFLICFLVLYALFLNTHNKTNNTNISDAQEIENRRELSCPAIIALGPAIALPSLRILYDNESEGQGIRSPYHRRSMGQQGYCTYEYTDYGGLIFNS

SEQ ID NO: 998383 - protein, 369 aa, Homo sapiens
MPPPLRDQTALCLRACCEHSDSRPVRQRVLWGICPQVAKLMAWLSWDCRLRLSHRLRLPPPPPQPGGGPGPDNHVSEDYWDGRLLAEPGGTTGGRRGLNSLGRRTRAPEDAGPREFWRVGLVACHPRTDSTQGKSELSEQIQNGTAVGPQVTTSRSVEPEVHLEQKEQSVMTPMHARNKRTLDLKHSGGRDGPCGGEQDATPVEDNVAPAKATSLHWLPMCGENYLQRSRMKRGESQRFRRFVDTQRQYADDQMRHHSERIGGDYEMDAKKGEPRGARPTQERDPHRHMTALPRAPQGVERAQYQAARDAHNQQQPRRAKPEERTREGKYKGSKRCGTQRKKSTKQQGKRGRLEGGRHPQEEDRDEHQN

SEQ ID NO: 998384 - protein, 35 aa, Homo sapiens
MRYPDIGEPTPKKASEDRPVVNGATERYERRASKL

SEQ ID NO: 998385 - protein, 143 aa, Homo sapiens
MRKINQLKANEAIPSGYMMRPYDRMLETIQEEEIDPCRIYYFERLVTFGSPLGTFNPDRTLRLFTQRIGGLHTSCGSNPIYFGTSRNEGCTQIKPKGGPPQKVWTTVLGGILPHFKKRQPGPRNERRLRRISENVEFNYEHER

SEQ ID NO: 998386 - protein, 98 aa, Homo sapiens
MRGNACIHEGSKTKYTPPACKQLKRSKPREQRQNGAHRRKPRIIQKDYEPREQQQRPRHPNVRCPKTSLRQVNVIPPPKSHVGDLGKRHRGPHTPGRQ

SEQ ID NO: 998387 - protein, 310 aa, Homo sapiens
MPLHSSLGNRVRLRLKTEKTKTRENKKKTLEALPEDSRMSSRAYSTWSRAILTGGQAIPNDIVAGYPRTTHTANPKILLTLRGTSICATLTPDFELRRLSRRAQFPPCTHNNSDRGFLDTSVVPMCSPRHNVDDGVIFSPPCDAYIPHTLSHCYTIDVTPLRTPVTKPLGGMRRTHRWSPPYTPNIISTSRRNGSLSERPDAVAVEEIPPQWGHQLYKTAATFRKATILCVVISRKNLYMVEEKKKDGMFYEHHLGDVRTKRARCEKTYISERRSINTWRIRHHEGGHRRRRLYWEMPPEGHKTSSAVNA

SEQ ID NO: 998388 - protein, 125 aa, Homo sapiens
SCPKQPEVICENGFAIHVDPENPTKSCGDRDEVPIFVFTLRNYCVKLSQAYQRDMHIRKATKDLKDVTLQKQCVPFPTLQLVEVGSVCAGPSLDGGWTLGSVGHKEVRNFLVHMLEQRRDVSAES

SEQ ID NO: 998389 - protein, 254 aa, Homo sapiens
MSDTGGNIGVSLREHPAGAPSTTTGLENFSTPITKQRRRRDQPRRRSCEQNFPTAASSWKAPHTREPLTTTVRAPSAQTALHKLLQNYTSDPAHTGGSPNQYPYPRHPTSTKLLTYAYITHSTTSRNPNNHQSKHNTPSNHPNHHSTNTTSTSYPNHTNHHNASTQTPHNTIPSTHYKPPYYTSPPLQILPSLHKPLITNTAHPSHYVHTHHHTYHSTHLSILNHSHLPHQTHLTVSHTPSTQPTTIISTLHHD

SEQ ID NO: 998390 - protein, 112 aa, Homo sapiens
MVKTISVLGVTIGPQILQKGPGIYGNCLGTLFTSTWGFLTINGSGSGLLTFEYIKLPQVFVKEAFKVCGTWDFTTRIRSPFLTGLIFCQTHWGNLLNEVKSSGLLKHRVPTL

SEQ ID NO: 998391 - protein, 128 aa, Homo sapiens
MAARHTKAPSVFAQSCSLTPRILSINTAHNFRKRPRAPARGVTEWRLRRQQRRVGHQPRRTHWRGTQSKDTASERSNPPQEIKRRAEDFRERMSVAPHTPAEELAEGNASRTRTTGRRLPTNASNQEI

SEQ ID NO: 998392 - protein, 130 aa, Homo sapiens
IQLWDPELLTQRGGPAEPVTHLCMCVSGSGSLLMACASSWMLWRACLPAVCPPVPQSCKPAACWKSCPRSWAVIIRLASCLQGAMAEGNGADPWYPRIQPQNLKNSNRPLSQNVGQLQKSLKLPKYPIGN

SEQ ID NO: 998393 - protein, 106 aa, Homo sapiens
MHSVGVSRLGILHTLDGSEHGAHQVYGSRVSHPNRLNFSGLLDATIAVRDVPVRVGPNVSSLLQLIAGICQGYLQHQLDGCFEDSLHRQASLHNASNGRCAAFLFT

SEQ ID NO: 998394 - protein, 292 aa, Homo sapiens
MGQAMLPDNDRYLRSIGTTLCNFPWEYFISASLSGHRKYWMCEAILFAEVNGQTFVVLGSWYHKGGLLGHTVTVLAYPVRRQLVAEAMAGKARVRTVTGGMTVTLARATVSYNTYTLGCESQIVEPGGKNATVLKRFWQREMYGRPLLTCDYRLFNGTFMIRDVTVTQHVYLLLLPNCSGAGKLPPRNTVQRCYSRENTFTNSGHNSELFNFLRSGDTRGTLSQVRATADKGRWTVQGHQHRDDDTRINHKGGLSLPDNRATTFAKGPSNQAVQASPLDPSRTRHRRIRDNA

SEQ ID NO: 998395 - protein, 263 aa, Homo sapiens
MRLICRNIRGYSENEPLGPLAMSHIFGRPKMISDAIPELEGLHATRKGEDFREGPLEGEAAVTGGTDFLEFMNGSHVQLAKDRVQSKLRILIRSGGSITGIDIIHAFQIVGGSVGSINKQPYPWNSLKNKRTEPTGTHKPQHVGGGSRPGGPPGTQTCYTRTRSTVSVHERSPTDGDQRDSMGPTNGAEPQGNNTSRGQDTTQQGEGKPTPQDKTNAAARGPPRRAVDDKKYRHRERNERAKHEGVNTTTGGSNRASHEPFKK

SEQ ID NO: 998396 - protein, 70 aa, Homo sapiens
PFHLAPLQNGSRMRRVASKNTGPFCHLTEDENPEEYTINIHKRILRVWLSRKALQPSGNVKRAFWDNSCQ

SEQ ID NO: 998397 - protein, 319 aa, Homo sapiens
GGGAEAAAGVEPAVRPPPCGLGLLACAPGFSWGVMSWERVWAELLRTVSPELILDHEVASLPCFPGQEPRCRPEPTEVFTVGPKTFSWTPFPADLWGPGRSYRLLTGQEGTWNPPDRSLAQPPRHLIPAVAPKGGSSSQSVEGDGALSKLTHVPEGVRPQSFNGMCHDFEVTLARHRVSCHPQESRPRKGSNGQIDPYTCPTQSQLCRPPSHQKIREPSSQAHTVENLEQLAQNPGIFKATLAYFLQFACIHSKLPAVVTDFPLVMEPRINHHFEVKKGHTCNRGRYGKQEEYRDINIGHNKVRAERYAYGGKEQTRVT

SEQ ID NO: 998398 - protein, 71 aa, Homo sapiens
TLTKGRGPTLRNADGFCSWRIAAAGLAVVGWRPWSQAGFQCMFRAADHEALACECIPDYYVACIQHWITSI

SEQ ID NO: 998399 - protein, 78 aa, Homo sapiens
EGGYTYRMNIEIQPREAEDKRRHADTTQHATKTASTEPEKDRNKHHNKEDTTKHKKTQNNTHKNNKNNQQEQKTKKNT

SEQ ID NO: 998400 - protein, 132 aa, Homo sapiens
GKWSVRWCPGLHHGACRTFIDISEDSIIGCLSFVLILKSKEELHHLHEENSERVALHCEIVSSYIHWKPGDVCLNREALDVMHVEPVLTEQEWVVPYLVWIRGKPMDRGDSKAFEICKDRYVPLGWSKIVRL

SEQ ID NO: 998401 - protein, 137 aa, Homo sapiens
MGPPNSRGLATWSPSFDKKRPWPFLARANLRARRFPSVSQHVLHPWTWGFPPPQLGPCFGTLVLPREHRACFLARALGVLTPPKCRAGTRRSRRYNSGDPGVPVRLCATLTSRPLRLSPFLNARGLGARIGAYPCVS

SEQ ID NO: 998402 - protein, 109 aa, Homo sapiens
NPGGGGCSEHRSCHCTPAWATKRDFVSKKKKKNTYDIGDSFGSGFSQNFFWRVSNALILGLQAFGFGKPPCPESLHIWLGSSTCSPRAEEQKSTPLFGGEGGNGERYYL

SEQ ID NO: 998403 - protein, 49 aa, Homo sapiens
LSKSIRFGGAGPGRLSEHGAIPSLPEEILVHDVSRLGYRSSMTERPEER

SEQ ID NO: 998404 - protein, 277 aa, Homo sapiens
MAAHFSSDHAASLQFNEAGPSSEGLCTESRRRIGRGLAVIHLPHMRTSQTCDHDVSVCVQGSVEGWEPDDDPIEEHKKAFVRICLSLSVKKQYEELTLGAMFETGQRKSQEQNCKGNQQIRKKEFAGHCERKCAVPSEQLGWPWIAGLWAGACLGPSSGCNQFTGVYSLVPPEIPWWAPLAMSLGKGDPAFSNLGCIKCALGGGICKVGQQQVASCLLQRAMTEMRKQAGLTTHSSHHSTKRGTQKGHNRNTRDLPTVANGRRRKKGEGPRGNTRKN

SEQ ID NO: 998405 - protein, 180 aa, Homo sapiens
MLLGLLARGAVQAREAPQQKMLQQVPENINFPAEEEKILEFGTDIECVFTECLNAIQNIEPKIYPSMTGPSFVQRGSALTMDHNTLRGYLTDISYRDMRHQKGGFMVDEKIWTGIAMGFLCEYRNGSRHLGNQQDHEDVGQNVGDYQSINNQCLSKLVMRYFCWSGTKLQQDIPSEDFES

SEQ ID NO: 998406 - protein, 105 aa, Homo sapiens
MEDFGVSTRFTVNSHYGQTRDPRRQLDPQKHCGHTYYTLMGRLVSPNGTSTIQTQGQMGRRIEQSPPPGRRRSGDIPKGRPRPTLAPHSDTQQQYTAGEGHVPTQ

SEQ ID NO: 998407 - protein, 228 aa, Homo sapiens
SSGINAECPLRPGSAYITSTSLAMSGTVTGHRMSCSCRLRLLIPSHICSECISIHDWQAWMYRVGNACWELYMPGTRYPSPMARCQVHKHHWGQADDIHSTTILQRARALESTVPRAVYVRPWKPQSSDERSALDTYTPASYTLRQLITGKRTDACNNYAPRSTYTQMDKGALLENVAVGTDLRQQTGRHQMTHEIIQGHSRTNKSIARAGNVGTCGYKPCAWAHCER

SEQ ID NO: 998408 - protein, 336 aa, Homo sapiens
GWNVTRKDGHASGTDADLRALDCDPTTNCPTDKSLGARAYSEDVYNDWWYRYCILFGRVETGVLKPGMVVSLSVQSKVTHGMENLSDNATMKLGSEALPGDNCGLQMSKNVSVKDVSCVANCCMVDSRIMNRAMERESGFYSSGDVSVKCLKCWLMLASRCEYWFPGQGTMSVGRRSILQDLSASYEEYSKGSRTGELVAEQNTLGRAGECPSHHGQNGNNDTGVTWEDKERRGRQMVLGTEKGSDKGLRRDHRVLPYIPPGTAPKLLERPRYWGTKPGPSRNQVRERYNWRPSRPASQGYVHKDTRSHTACTGVARGEKNRCTQRENRQQRRWRD

SEQ ID NO: 998409 - protein, 276 aa, Homo sapiens
MATRPDHLAPNEQQRVNPGGPAQGPAYCQQPLDTDGTPWRMDPLTGNDFQPSGAELRAENQAGTQTGTTVGHNRPSRVNTHIWQGNRRTGANRRTPGPFHRGSATPEGLSATKLACNRGVPMTGRPITPKQTSARGPSKCNTEQTRHTVATGPSGQQRHGGAAGRTPDGTADQLGPRRTLANRDSPAVGQQRQRGITTEADSERDRHTDQPSVAPTLDTSRSHRAEQWDTHRWVDQPREKPPTQKRDTTSLENHQERNEEPKHTGARTQGRPTEPP

SEQ ID NO: 998410 - protein, 123 aa, Homo sapiens
MHERSWLLGITVAEASWLSGGYLLRVRIIKVVKGSQMFNSIRGPSYTRPRQDKTQQASTSQHEFNIGVDRNQLGQVHYASCANYWPRDNKSEETDTDTQRHARPARAARTGRQQRTQSSRHQG

SEQ ID NO: 998411 - protein, 405 aa, Homo sapiens
PVTRQYGNGSAGAQEDKVNMVMTGFHREIMDHDIAAMDIIREEKTHRRKPEAFVNKSQNERFMRDHIRRESINTSEGGPNSRRLSRSTKVNSTPEPGRTTTETRKPTRRKREGEETGNEHGRSGKRENSAKGRQREDKKGAERRARRGGGRGEGRSDSAEGERRTERAEGRAGGGERRGERRAGGRAEARGQERGAGPEPRRGGDAAAAATGKNKKRERADTTEGRRKKKEKDEEKEGAGHRQSAKGREPEEKRDREARRTRPEEGDDAARRNEPTRERRQQTRGRAGTGDRRKRQTEERAEQTASERAEKRQKEDKDREAQQEQQRDKRRRRGEERQTRAADDERGAEGRDKKRESRTTSKTRRSDKRQRASRCRDRRPSEREEAQDEGRRREEERTQKTRAAS

SEQ ID NO: 998412 - protein, 71 aa, Homo sapiens
SAKLALMCYLRKAVEDKHAGVLFQFYGKNRVNPRYQQKAVPVKVFPSRKTSAVHNSCLSRLSSSRIYSPDK

SEQ ID NO: 998413 - protein, 361 aa, Homo sapiens
SHNKKRPNNLVIRSYVMTHPCAWHHALHIRSLQQFMSSLHTAPFKHTVTHVLQGNKHPMLDHLRRRMHFSMVNQQAFIEATNKVYLHSIIFSRPRQYHNIRAGWIQSMFVHFSCTAMGTDVTLKLIKLLCEEIWLQNTTDELEEMGPSLDLVLRRTHLASDDLDKIIYEKCQKLSSQQQDETIKPSDTSGIQVTGTDSICQKQDPNAQRTTTRKTLTRGVDKTSRTRPAQGTKQEGTHGRTQQSTTTDPRTNTLRLGRHNTKPKHNTHKTQQHHVDDSRSERTNGRQRAAHETRRPTNENRDSEHSPHKLTRRRTQAEKKAEREQRQRQDTRGEKRTAAGRQRAAAKSRKETRQRERPDEV

SEQ ID NO: 998414 - protein, 163 aa, Homo sapiens
GKGPVFLLREAPGGRTCVRAQAPSHSHFPFTAVPAVVAKSEYVLLGPPSMGLRTRWNQHRQNMWKKDVWIPDRILRCKMAKRGVLNKFKILQMLQELSSSYGSKMPERQFCIERMSKLLTIMIQPYMKNAKWNTCRQGKNSEKLEFLQRQGYRSFQRRHVGRV

SEQ ID NO: 998415 - protein, 66 aa, Homo sapiens
MLGTTYDALIPMELNDKHIWSDKNLLLRLQCAYECEQDTRDYAEEQNHAPPMKKTCVGNQPRITYM

SEQ ID NO: 998416 - protein, 196 aa, Homo sapiens
MLSASMVDEQECNARVNLLVRMLRDDPHSYALDVAGAPRRSQEHETATTCNPTNTLDLDNPSISRPSRETTIHTGPELGPRSRIQRMASLRYHGHQETRQHKGHRVQETANPQHTRAALNPLDPGQQRKQTQPLENFKATISQDPHSRDKQPAYDIPDQGTENMTKRADSDKTAELSNAQSHTTKQETSGSTNNKH

SEQ ID NO: 998417 - protein, 494 aa, Homo sapiens
MPVIPPLWAGCRQQICLQVRQFGSTSIGSTMDAQPHLVTQQSTKHNISGASVVHSLEVLSSLQAELEAQAAHRLAHSRAGSRVHQLQPTQIRHELPQELDQTAEAPQVIQTKRTNDTHTTNRTQHNIAYGARQPEAPRKRQSDELQATHNTRHETAAPERNNTEKARTKKNKRVTTQQSKRVNTNKKTQTPRVTKNHQLRAERGINTDQPTEKTKDNTPTGRRTTHPRRDKLLTRTTHQARRQMQKEKNKRRRTTKAKKGPHKHQEPTSAESTDNKGDKRVKKNTRQNNKTATRDDGWYRTTDTLTKEKKKTPTQKKKEKTTDKQKQEMKKKEKNHQQNRKIEKKKREKEKEERTKNKKEERRKKEKQIRKIKREKEEKKKKKNDSQEEKKEDQRKEETQRNDNKTDNYNRATERATSKQEPKKGRAREENRNTNRTDDTEKTARGKKKDQQHRREARRATHAERTTEQEAKTEQQKRAKQSQKQTKRHHEQKQ

SEQ ID NO: 998418 - protein, 123 aa, Homo sapiens
MVIQCIVLAVFLLASSKQIQNETNRDRSYGILMKPEIHRILKNQALLHANEENRKWTERNMYLTTSRPATGYPLPPQIFNESQYRGDYDAFFEAENNNAVYAFLGLTAPPGSKEAEVQAKQQA

SEQ ID NO: 998419 - protein, 123 aa, Homo sapiens
MTTAGRPHIDRQESGKMTPRAAHTGERAAAGKKEDAHRQAETHTQNTTSDQLEWKSITTVTTEQHKQLQKNTQTTNNNHPRTSTTDKTQAHTKDARPEPTTNDETHTDRTNVRNITTQRSTEH

SEQ ID NO: 998420 - protein, 106 aa, Homo sapiens
DSSEMHANVLLESGGSDTGIMVIGDSLWMIHGQSSSCSYVGIYKPHYKTTARSRGITEMFLSNHFPECYVTWSVVIPWIIIKTGVAKRICQIIQNSCFPNADPQLA

SEQ ID NO: 998421 - protein, 135 aa, Homo sapiens
MEGHSQGNAGHILNNPQKATESTRIGTPTKGRYIIPKEHQGHVSQEDTKVPHKKTTRGTREKEKPHEHYYKPQGGHIQIREYMTEGHNGHKGTGPSAKEHQEEAKHGKPEEQPIKEANDKWTNTQNDQEQHRERD

SEQ ID NO: 998422 - protein, 132 aa, Homo sapiens
MGETHRHQTVFYHSVANLVLCGPNLKLKRTTGSITVLRTAITPLVIVTVDTVQQTRCTWNHFAPNNNKGPLGVMGVPYTKVPPNHLNLPALYGARGPKQLTGFTLLSAPQPYAFYTVRTLEDDTDKRGPAVL

SEQ ID NO: 998423 - protein, 181 aa, Homo sapiens
SPSGESELRGMCGRVSEIGSACKPWLTNCTASSQHCQNSNSKLLPLILHQSMVHGNLFTNQRQSGHTVMQHPPWGHESQQQAAVNRAHAFTCKSDARWVMGDNLTIPEIFLTECMARKNERHENSEEEIQQKHSVCLIKDGNGSYSVLAETSTCDDKTLAEEVNQMKASLMNMIRASSIID

SEQ ID NO: 998424 - protein, 109 aa, Homo sapiens
MCNRPVAGCVVRLTCMGQPLRRWSVLWVGEQYLVASYVRSGGLIANSFTWPRRTEVPQFVRDSPGSKLYEILLMVAENGAKKAIMGGVGNKKYRRLCGHVIRVPGMDGP

SEQ ID NO: 998425 - protein, 188 aa, Homo sapiens
MSLESSFGSLGYGGTLEISGKYMVRLATGSSRRNLEISRTPTRFRKQCPPGNVRRERTLRDTCLGTILMLEKSGLKGGHWQAAGQEQWVRYPKGNRHLVGAPQCEGAKCPRIRSPNRKGKEDVSVGSDTRVGISWDLVVRGKSGAIGRGGVPICLCGHHHTFLDIDFDNRKHFRKVFTDRTIPLSLAW

SEQ ID NO: 998426 - protein, 67 aa, Homo sapiens
MCDFLQRRVETHGAARAKATAVHESTYSRTEMFLDGSLDFGICLTARRFLQGRLEYDIVSCSSLAVI

SEQ ID NO: 998427 - protein, 193 aa, Homo sapiens
MADIQTERAYQQAADQSFQEIEKGVLLGETGMEKLPRYYNEHLRLALYSDYPREAIDGHLILRMKCPFIWLMCPLRGAGSSLRVVTIDEVCHDGTMCHPTEIYSDTTISGKYKRIRRSATKNMSVALMSTLLHGYCLRSGDYQSTSWDELPGPSDATTSCAIERASQVSKGCALREARSMKVLSAGSSVPLHH

SEQ ID NO: 998428 - protein, 138 aa, Homo sapiens
MLRKLHEACLNIKQKVGRRSFRSRYQENQTVMTGRAGLSAMAVCSYIRKKMCLQSLLELHKLSTERNEPHWCDFIETHYLHEQVKAQGNWGDQRDQICAKMGSARILALADLSLLTGTPWDDSATDRLRLGLISHSVG

SEQ ID NO: 998429 - protein, 81 aa, Homo sapiens
KPNLDTPSSTPPEEETPVLVPNTYSEFVSVTLKFIVLILPGFGIISHDDNLNVTPDYQEPIWIHRYGLSYDIKVGFLGLIV

SEQ ID NO: 998430 - protein, 265 aa, Homo sapiens
QKLATTHFCSHASVPSTCKAEQCLINCLVHSESPWVNDVDASANLVIHIHMRATRTGKPHALHETKITRGRSLDGAHFIWARLTRTMCSPTLLTPQHYSIVDAPPAPLEMGWYNTERHIGVTPIHAVGSIKREQHTRAVYHRTDKKKRAAMAENSLSPKHSIIKKQTRIPPWRRREQPPKRHRTVLRIKHNKNNTTQTKQRRAIHQIMKPATQYHTKEGDHIQTTNDKKRTLVSKYEQQQAAAAEYDTLQTIYLTCATPRPPSGD

SEQ ID NO: 998431 - protein, 138 aa, Homo sapiens
MDDDTTKRNIDKGKGSKRKTTVETGNEQEQSEQTEDSRHEQNNVKSDGKQKTGKTWRHNMRQQVEYRTKRKPTTKRKTKREKTRLGTGIENATAMETGHTNSNRKVARERGTGKEIRKEQVKDKRTSKKKNEKKKNKE

SEQ ID NO: 998432 - protein, 204 aa, Homo sapiens
MRKSRQRVVESGETTEERIREEQKQERRRRFTHNKEEEKAREEENTGESVCERQNKNLHKRRERLIRDEKQQKHERKLKYKQEGNEIPKRTGRRSKRIRTTVMKRNPRAHGVADTEQRQKTDNETQKERRKRKEKKTKKKKRKKKKDREQSTKKEGKKKESKKEKRTRRRKKNKTEEERRKKATKKETKPKHKKKKRNKKKEKK

SEQ ID NO: 998433 - protein, 103 aa, Homo sapiens
GVQRSGEELVASAGSRRFELQLKGNWQLRGVVCNDRLGKKVRVKCNTDDTIGDLKKLIAAQTGTRWNKIVLKKWYTIFKDHVSLGATMTIPTECGTEPGSFYQ

SEQ ID NO: 998434 - protein, 213 aa, Homo sapiens
MQWLEGLNEDVTNISPGRMYMRTYGEAKEVPHMLRMERESDMGFENGRPLVRCNLYGKVKNSLLELKSENVYGESREDTFIVKLNSCGVVLHAKRFTTGALCDPLPFIYLVPSVTFLRTKPHGELHTLGFCNAYNNGPYESKPSWRNTFGDHIDNLPFRGPFKETVGNNFNFWMVRGLRNRVNLWYYILCAGNMWYVMLPLRHNCGGIIPAAR

SEQ ID NO: 998435 - protein, 155 aa, Homo sapiens
MLAILVARISCHVAELQTRTTYVPDANIAPTLSSNSGEVILGVDMMDSVTELHNLCHGLLIFKSDDWKNKLIFQSKPDIQYAPHLEQEPTYSERIFSKHNVLVLQMMSIHERTGHFLKHGERDGVFKDASLLTLGGFLTTTLCPSRMIGYRLLDL

SEQ ID NO: 998436 - protein, 82 aa, Homo sapiens
GPLLTERWTELRPLVYKRSCFSSITSSESGRSSLYAEKKFDPMGLTEPWFEPIACSVLRLDDKYSRHRNRASRKRFKVLDDL

SEQ ID NO: 998437 - protein, 69 aa, Homo sapiens
RPQPVKAGDAIATLCKSVRYLKKLQGISALLGGHMHRTKDNGPDVTLKGLLSTKHTPEKPERLKAKPEA

SEQ ID NO: 998438 - protein, 348 aa, Homo sapiens
MDVGQGQHMSGYAIQAVEDVPINLVERDAQAPAADSTPYVKIRTSFIAYMPHTHIPLKHTMRILRQMRSALGSSTLFEKFLNEGDKHTCGHGALFPRKTTRNANHAFGDYSPHTGRKEPPQSGGRPTAIRTLRFGTCIGYTKTVGHHIPHNSTMGGNRRVREWLYVGKRHPGTPFQETPPTEKNNDIAPTGEQHISTKKGAGTGRKGGTHTRDYVCAEQEHRPRTWSKPTKTEERCSPHTKKERRKPDRTKGTVAKKTTPPGRYCKTNPPHTNTRHRRKLTVGVGYTYRRTTRALVMDEKQKITTSNEEGGKLRSSDCTATHSQHDDQSIAVSKHRKKHRRSSDERRI

SEQ ID NO: 998439 - protein, 155 aa, Homo sapiens
MTGDSYSFPSNSQSPSFPFLLHTFCHITGSVHECQTNQHAHASWHYPLSALIADMFNTAFRTVQLEQVPNWHSLWTRHKHPKAINDTLMTERHDCKFPDPWFDPHPLHDVLFNRNCTASTHTLSDSSVHGLCIGTYAFNHIQPSRCDPERLPAID

SEQ ID NO: 998440 - protein, 166 aa, Homo sapiens
ELQVVGDKVGKVAVAVHCAFELQGHSEMVARAVRRRAAETRHIPVGRRSQLGATIALQSTSQACGMSVKTGWRTDAAWLVALALRPALALQIGGSYRVSHVVLASKQFTSRGQAVDPTVWTGAVPHPGDGGGFGAHLGGARWPGGLLAVSPGEVDHREDGLRDCRS

SEQ ID NO: 998441 - protein, 105 aa, Homo sapiens
MYTNLGIRNGRGMGKTKRGNFYVPAETQICAFVIRNQRVSNWTLKAQKGSKRGVRQLLSAFRQILQVEPFVEAQQGLRLTMLRICRAILFAMGVTPKSGKSGKLN

SEQ ID NO: 998442 - protein, 31 aa, Homo sapiens
MNGGGSPSYKTEGELSTRREPAWNIYQYLAA

SEQ ID NO: 998443 - protein, 68 aa, Homo sapiens
MPKETPVYIMNLDPKEAKEIGNRAQKLGYQSQTPMGLPWTLCQKNLTGLDSKNRSGSLDRLGPKENLN

SEQ ID NO: 998444 - protein, 107 aa, Homo sapiens
MEGPHTVLVSRRPITRVGSRSALFERSMVRSIECDIVKDYAFVHMERAEERGEALRGLDNKRRVQRWDVCGLKFRAAVVPENTPLRGTPSPGRSRHLCVSSLRNRGP

SEQ ID NO: 998445 - protein, 187 aa, Homo sapiens
MPPSLAHIRRTRIQYNLDKERTESKPPNSWFQANPQWLSSDAKNTHNQSIQHETLVGSAQGSSRNMRLCWNPCFFGARRAAPWEVQVVTLAPLCRVMSAQRERHSCVDVFTTGCWGVPLSTPISLQLVAPRGGLHAETVFFVRPTLPSEGGSSRGAPYEARSLFRTRRGSPRDEGCGYSRYSARRRV

SEQ ID NO: 998446 - protein, 166 aa, Homo sapiens
MESFKSVWHSLVIPYTRHQAFLLLQESQKGGLALPLRLTYHEIVPSCPMPLQFGRAPNCLGRGTIPGKLGIYLDQAIGLFRRGNLPQGGRLFFLTYLHFPRRQRKSPLTGEPPVGLNSKKTGFRGITWGHLDTHLALCTQLGFSEHIYHHGAFFPTPTATPNATSF

SEQ ID NO: 998447 - protein, 180 aa, Homo sapiens
MVFRSGVPMLTDGSIYSRFDLHGKGRSLVPIIACGKKACELTNWECLDTFGTGPWGNRHDNFESTGTTTRGLDQGILQHEVRRADPENGVFTTLGCLTHLPRLGDTVVVATEGELFLGRGFHIRAMDAKLFTIWVLVLFTHFQGPQDVGAHLANTYGYEPGYYGQQGPYVVNPNVGARFD

SEQ ID NO: 998448 - protein, 137 aa, Homo sapiens
MGDVEKGRKIFYYEVFPDATTVEKGGKHKTGPLSPWSLVGWNDRSRLRWILLYYSTPNIGTYRSFIWWSRTITGCEYFWSNPIVSTPGNNNMILVVVHCDSTGKHTGARRTNQRYLQKISLTYMHVINLANMRSDVH

SEQ ID NO: 998449 - protein, 67 aa, Homo sapiens
DRDAREKSIAFQKKMNTDERKHGDIVHDGVRRHICTDTFHIALPSYCHFILGCTTLCTDATESGIRV

SEQ ID NO: 998450 - protein, 152 aa, Homo sapiens
VRRLEIVYPKSVELACAGGGVPVGFPPVRLPGHRGSDICPVGGISTPTFGGSVYDTIKVEVARQSVGGGRITGVLTPGAERAGLRDMKEKVEAVSRGRHPVHQPCVLWQGGQVCTREGPPVQVCPGKLGGTFFVPPKIQGAAGYSPKNSGVA

SEQ ID NO: 998451 - protein, 111 aa, Homo sapiens
VLFYIPVLADQCHEPILRRPGGGPIESDTGRWAVSARICLMVSPCCASVSSSGGARLLHDRVRVGSGGFARSMGGMLIEWCSWCGQTTHCCALHGSATIETPSPGGLLVCS

SEQ ID NO: 998452 - protein, 319 aa, Homo sapiens
HLKMTHRRGQRSNKAGRNKTQDRQKGEQKTQEATTTKRRDKTKTEQKDREKKKNKEQRKKDTTAEQQKKKKRRDSGRSKSKGRERKGAGEGKARGETEKQAERAEREGRRESEEKRQPQKTKNEKKKKRKEEEKAKRGREETKIGQRQKRTEERRRERREAGEGRERREERTEERREEGRDKGGEKRRTKHGKGREGKEKRKEEKKTRSTPHEDEDGQKMQKEGSTKRQRSRKKPEDRRTAKEERKRKKGKRRTRGQHKQKKRKERSTHKRNAGKSETKKRTAQTNQKERGKRKQQTTRENEGTTTKKTNRKHKEHQDV

SEQ ID NO: 998453 - protein, 145 aa, Homo sapiens
MEEAIRPGRDLSAKKKNSGERKPKTEGQEQDNQEREQNKRKERKHGRRPPEGPHRANKRNGPRRHEGRTKTKRGGRNTEGQKERIKKERTHEEKKKEEAEEKKVTTERKPENKMVPADTCEQGGSRRQERHRRKNDNWTAKNEEE

SEQ ID NO: 998454 - protein, 47 aa, Homo sapiens
MSDEKTTLVDVGTVVLGFSLPIIKKRRGETTGVFGNILEEGSTTNDR

SEQ ID NO: 998455 - protein, 96 aa, Homo sapiens
MRHNKVRVGEFLLFTYYIKKERRAGGQKPGEKRVSLSKHNFSQENVRVSRERGLNNQRGGTSLFLQTAGESSSQEGEEFLAEYISNILTPRYLWGV

SEQ ID NO: 998456 - protein, 226 aa, Homo sapiens
VKGSHGGVHIRTTVRAMGKGTRRTIRYSKVTTMAIRSSRRLQDLRQLASEFIVEITRTQIVPDDASETSRSTIVSIDRDYVHISICCGMSGDTDHLVHSFIRIYMHGHEMIMAQGIMESHVMVDNDILMDCVGWRSGDVVVACTHGYRPPVHSLKNVVYLQNNLGKCAFTWVVVRYRGEKPWLVSKGRVLFVPLEEIANKNTCNQRSTNPVANERVYVNLNFIAKS

SEQ ID NO: 998457 - protein, 79 aa, Homo sapiens
MCQCYVSETCDMSYLIRETVESQLTDLLTEFTVTRALSGTLGGGREREETETEEDNKGVKERDTARDKERQVYRGDKQN

SEQ ID NO: 998458 - protein, 152 aa, Homo sapiens
AAIVPAPRVSVGASTAGAVGWGRRKPLSGAGREGSAEESPGAAPLARHAPHSRHQGGGERTPGKKTPGAPGGPPGATMGGYTQAREGHPQGLSRRARGAPRGLEQAPRGRRHTRGGASYNEENNTNGDREKGPPRTHHGGRPRPNTPWGARE

SEQ ID NO: 998459 - protein, 119 aa, Homo sapiens
DQVQACGRACFYQSRGFPLVRYAYNLPRVKDCNCTVCVHRSPPVNRIDELFYESGTLVLIFHLGKRLLCIDCLVSLRRKAVVAGYISPYQSFFQEEQGALEIINSWGERDMRMVRSRVY

SEQ ID NO: 998460 - protein, 81 aa, Homo sapiens
YLISALASEVSVMLGESVRAPKMLKLLVLIRLSLIRLMRISLMDDAECSSSLMVTYVQPKGTRITLMGLGAERKIRQSWCH

SEQ ID NO: 998461 - protein, 135 aa, Homo sapiens
GITSSQAWRRVVGSHAGSTVRIARSVDCLVSGPYLSWYTAMMFVRNDVLRLFMILQIYMSYHILKKKLQVLAKFRWTKSEFRKDTLVESCTVDNSFEFERRRSEPIKIPARASGSKYVLSAMKRVEERSRQKRRS

SEQ ID NO: 998462 - protein, 149 aa, Homo sapiens
THKSISSPIAPSPLHGRLGDISDWPYLEADHRRTAIIVRTLSSSSGRRTARRDTEPYCRRFSEYGSAQWIFIDHLNSEPARTKSYPLIVNINYSGTEKNALCDYQYGIGADASEYSSCAFLGLDPVMHDRMIFTGRELKTYDSYDAIVS

SEQ ID NO: 998463 - protein, 73 aa, Homo sapiens
MASFTDFPYCHGYILDKLRQNPFHYHIHRRKSTFFPQTFSAIRKPRRFSDYPDGTTHEHPIICRLIHCFYANI

SEQ ID NO: 998464 - protein, 142 aa, Homo sapiens
ASVATGAEKVVTPSEVARVESLTFSQQPQGHFFPQSQHLPLRSAPRIPNSWYRGCGGWRDALVAGLTRMWIHNTRGSVVAGYGSHLEDGVWHWDTTRTSTWLSVSTRPPCGDKRWEMQGIVGNGRARDSRKRRSLPEEYMAG

SEQ ID NO: 998465 - protein, 77 aa, Homo sapiens
MPPIRIIITSQDCLATHVAVPALGLETDADARTSKANHFHRYSDRGYTTVNALKSVEHTTSFMPIVLELIPKIFEVG

SEQ ID NO: 998466 - protein, 72 aa, Homo sapiens
NPEKKSRTLTDEEPKAKIHNLNYYSVAFMGKQSGDTTPKYLLMPSNKQHMYIGTVTGLVLAIEIVGTGYQYK

SEQ ID NO: 998467 - protein, 373 aa, Homo sapiens
MPPSLSPAQVAPQPLPLAMEARPPQQPQGLGAARPGQAALEGIGGGHEHAGTEEARRRKPDETYVPKVGSRPKRPDVSLTHKIAKNETQGTEMGHCQLGPARKGRMHCQVQQVTPKRTQRQVGISVAITDTPRIAHRQAGGEGRDNGIKWVYNGEAQTKMGIAKEGVQAPHVLRNAKSHTTEYNGQTNQFKDGDEKKTQIHNGNTAGPKQETDAKDVPQDRDVTQTDSDGVHKHDEEETTKEQSHDTTESNTADQGRQPELKHKADGATKMTSRTVLSQRRGTPSKSSTEQRHPRVVMRGQCSSAPPPQSGETGWRLATGSRGKAERRKNRETPATAGEKEHNTQDSTKEKVRVPEKQVGPSDRPNDGSRHSI

SEQ ID NO: 998468 - protein, 226 aa, Homo sapiens
MTLGINMIYLHTSKRPTEPAFDLAEGESELVSGFNIEYAARPAFALFFIAEYTNDNSSDKHPQRTTIVPEEQHMTHSARELYTSTIMVTKTLRYYTSRVSYDTSKQTYPRIHATSQLIQPPMNKTFRTQVNPESLTLLVTMVSSSPSYKSPGIHPVKTEGEKTHNRREEKHTMTESKQARNTQKRTPQHNKNKGTRDTKKNTNKENRGKAHNKQSKTTGQGQNTKA

SEQ ID NO: 998469 - protein, 106 aa, Homo sapiens
MVFRRLLWSVGRVVLCLLWNLMPETSGRDGNDVIDHEQGFGRMDLALNVSETGHAFSSACMSLISSSSFRTVPTRDYVRHSRGYEGYDIYIQYMVQTTRVRPMQRI

SEQ ID NO: 998470 - protein, 149 aa, Homo sapiens
MWSTHLDHSYSRRLKPDGGSPTPGIAILLTHMLETKLFGGNVGSQILMVEYKPQYSDGHPNGTHQELHVYQHISQMNSKGTIVINVCVTVMTCLDGHLFVLAVGVVSGSNPLWTGLAYDRAHLKTVVAQYPRTKSFGPRIHSVLSIYHR

SEQ ID NO: 998471 - protein, 96 aa, Homo sapiens
MSPREKNYQRVVGQITLRARFVPMYNFRPCGGKQNELPGRLRHGTIPAETVRAYTCENRRETGPGLDLAYAANYQTIRESRLTEAGLGSVQTICTT

SEQ ID NO: 998472 - protein, 75 aa, Homo sapiens
HDIGAWHSHLIITYCSLAGTERFCNTIQIAQFSMVHYVASIERGSSKLMLDDSEVTAAVPVEAGRSRLMQVAPFA

SEQ ID NO: 998473 - protein, 153 aa, Homo sapiens
MKLRARRPLRELVHLGDSRGFSPELAVAVDDIFPSSLPLKATINISSYSLHQTTHNITIKKSQNVLWTWTLRVHTHKVGTLNPSRARELSKESVNCCEVMRGKRVDTTSVVSSREIKALRVKTFKRASVEIFDQIINKDSELLIRSENPKGKC

SEQ ID NO: 998474 - protein, 131 aa, Homo sapiens
DLDVNIDPIPFYESAGAMFLRRRTMLFSHADRHLQRNDSLNNCAQPRMLLMPNLYRISTRNQSTMCLRCEWPMHSQSTNSVGGFIDHGAYHINDSWARCTCRRCESVWLITYGVPLDAGRPMSIKLIRIVA

SEQ ID NO: 998475 - protein, 275 aa, Homo sapiens
MESRSNCPSHTDAGDDAYSGVPILQVIAQKVATRKYVRTRPGQKGRHSIQNGQPQRWGQERLTARRQGKKSQRIGPSNLWTSDVSNRLYMSSNHKQQQSDETHTERDRPQTHCLCERPCHCASPHRGGRRTSGADTHRPRRGPARGAPPQERKQMKHPHIGTNLRTVANQGRSKKTSGGETEDPQIHTEPRKLNITTAPTRQKRNNKHTPGGCEAEPSGTSTLIEEAKQHRRRHERMYQARGKKKRLSRQYKTNTTRRLPAEKKRRPQNAKVKRP

SEQ ID NO: 998476 - protein, 155 aa, Homo sapiens
IGRQSICLSVLSLSPMKDERVQDIMRYTDDSVIPVNTEQAPYSSRDQIAAQVSAMIYSFAYTCRRSWIDLVPIEWNTPFSDYGVNCVGPKVASSQEMRKDCNNTVHQDLCQVLLSDLLKRGHPRTGSKIDHIVRETGLVLSLTWRYLPLVVGIHR

SEQ ID NO: 998477 - protein, 149 aa, Homo sapiens
MTKLLVILYTNKDNAPVGLNRRVPESNSKMEVHEVHLESYQAVSPSRARISTLRPRSCNLTIYIILTTTEFLLLNLNSRQQDTYYYLSTMKQANMTNTLNSIHTSLSHEEAMTTDKTDLFAQMGHYEEFTKNNSLIIPTIIASINLLKL

SEQ ID NO: 998478 - protein, 158 aa, Homo sapiens
AVQVVSSIRCSHNIGCRKPGIGGTPPEDLSLYTYHGDRRTSHAKRHSLASLGSQTQLRELVRPHVLWILKSNKPVTDFVLGETAFLQVLGAMPGTPALAIWPATQARSSNWGRPLRILVVASVPWYLSFPPRSFLVLIMGKFPDRSIASFFCLGIVSY

SEQ ID NO: 998479 - protein, 285 aa, Homo sapiens
PFPLAGSAEAARCLELLVKRGESQHGRSSRALAAFLKKSGKLKVPEWVDTVKSWASEQTSCAPYDENWFYTRSCFHSSGTCNLTEVALGLAPGHKIYGGRQRNGVMPKPLQPRLQEVWPGGSSQALEGLNKVEQGPEIGVRKLIDLRDKEIWDRNRLDTVCSCQHRSIENKPCWVNKVASIRNKSIKDRRELRHMRCERTLGHWKKTSQERPYGEGRLAGDYEKVRLPVQTCGETPQGYPKKTNATGEDRIRELPSTLPTKTKKKRRPEGQHHAEVGLENGIPPQ

SEQ ID NO: 998480 - protein, 211 aa, Homo sapiens
MTLNSGALIVRIPCANWNSSRSRNPFDAYYTYQTRDETTPHQLLRDHKLHAIGRSHSTSTIQLELRQRIVEHRRTGHYYSSDTITAHALIQNTAPSTTGNNSYFIYPQTIIFHSQELFPEATFTISMPMPHTTHKLERAHGTHKQGIKPDYNPTRKSTRHYNTIQYFNSTLTDVYNSHLTLHAIDHNYDKTNTKTQKYIPERRDLIYNIYT

SEQ ID NO: 998481 - protein, 302 aa, Homo sapiens
SPGVLVEVTSSLNPAWLSLTHRRDAQRKTGLTWKSNYFLKIIQTIAYDYPIMFHCVEQTMWRSKSRMHARSGMSLSQGKAVGADGAKNTMMRKVIRGHLGKQTSSVSTVLPPYPGGLCSVPLCFSSEDLSEIADMVGGRARGAILPRAVLAGLSAPLCRRCGPVPRRRPGLACPRSSNPRFPGLNRFSSIISSGFTVVKSCRWMSHGLNQEVETKWEPAKPRLLNMLKISPFSFWAGHSSRCSTNGSIYTLKCLISHEETSASRFLEGVRMLPVVLSCQIGYPECCISYPIPFVHGVLRVLA

SEQ ID NO: 998482 - protein, 128 aa, Homo sapiens
GRPRARLCSGWTAAERGEKESDRWGACSGGSDCCCRMGAGRLGAPMVRHWKVVPREPLVLCLAWGMQAGLGGAPEGRSAVSHVRRRGDAARRWPAVGASGVGTRRESTEGSGQRDPMLESPCQRVDNA

SEQ ID NO: 998483 - protein, 130 aa, Homo sapiens
MTADTSTILACSEEDSTINIGAIILSTCRLETNKSYRLITHYQGVRSYVKPDIATTRTGNANMQIDSCLHVAACSSVKDFSLLLWLPGRLCLDWRICELDKSQSSRTNRYLPRINATYDMLDYDFHAMIT

SEQ ID NO: 998484 - protein, 70 aa, Homo sapiens
QQTISDDDGRADCAVVDAVSLGYRDLSGCRRIDYNRRRGVRLSMGAQEFNAGRQWLEASSSTNYSSDLSA

SEQ ID NO: 998485 - protein, 168 aa, Homo sapiens
MLSCLDSARYCCYPHPDVVGYPWYTHEDLYAWASSSEAEFRNYAETVVERKSNSENLINWVILDAPTYTHSKNRIHKSDRKEGIEPPKAVSANPMPHDFGKKKDREDKKSVWGPVGPGELIKHDRSAPTKKGQRGQSSRGTGQTSGDARRKRGGGPGMTNQRRKGIDG

SEQ ID NO: 998486 - protein, 104 aa, Homo sapiens
MLLVRESNADAPCVVTQCKVQWVWSTLRNCGEAEWTVFYHPWVFVGQTPPFFNPRFLLWHNGGAKGYVVDGIKHKTMCRCHTAESMRSGIVSLRRKHYARPLYH

SEQ ID NO: 998487 - protein, 81 aa, Homo sapiens
ELVRVYESELSSVVCVAFSRNIACILSCYLLGLYPQHELARRHNSSRHSRYTQCCYINKFDRKHACMAIVIIKQDGGMQIV

SEQ ID NO: 998488 - protein, 77 aa, Homo sapiens
MRARLALEWYIRLRNTWPVSQRLTDWCNIAFKCLITLRMACGPRLLSVARRFLAKCAFKVPLVYITRLSSTQAPDYY

SEQ ID NO: 998489 - protein, 339 aa, Homo sapiens
MQEYALSFSCFRQDAGIKFQLKDGEELYHCSCASEALYANSEKPYTTNANESLRPYTQIHLRIKCRPFRYHLNLVLCLDCSKPGSEKEETPVGADMIMDDESAKVKTLLKDNRLLWNLDSEMVGNGSRSWELALQVAERSRLDLDQDSSNTIRRIHCTLDQLLTEDKLPRYSTSNISECAPRSSRCRRAIVLQLACIQGTAPLMWLGRTDPKFPQRPPIFFLWEAQSPCGGIPKASQTWHDRFSKPMMTPTREREIGARSDAHNTRTVSSEDGIRRGTRKKIIVGRTTADGDAREGPRRKTTRTRLSAKEVQTEENIPVHSRGEGRTEHTVKSAHGKIR

SEQ ID NO: 998490 - protein, 174 aa, Homo sapiens
MTQCSATRSTINVYFPLSENELLHLFMIIDPSVIISSFICHILPPVCPFLKNSLKNTNLIVTSRDRLSEISTTVMNYLCTLPSSLVLIALPSLRILYITDEVNDPSLTIKSIGHQWYCTYEYTDYGGLIFNSYILPPLFLEPGDLRLLDVDNRVVLPIEAPIRIIITSQDVLHS

SEQ ID NO: 998491 - protein, 288 aa, Homo sapiens
MRGHLIEHDVSQKRYSEPRRGSLGLHAVWNAVTWPGYLSVKALQCSSLRKRISHDQTLIQDSTIDFTCVITYGIGIDIRISAGTSDRDRYPRVNEEEGKCMVWIASVPIRQMTTITRCEGESRRICSWHSFDNVPLSDETPPGVDIEPTWSFCLEISRSSRINIRCEHCELNLMEAHPGVMRPSLDSMDSHFTTREFNLHTQKANLSASQRKRGKKSRLVDKGTLPAQDVNRRGTWTDVQVPMCPLSAHPQDMFARLPSIVAPKMRAPHFDSGDASAESRRRSVEPRE

SEQ ID NO: 998492 - protein, 131 aa, Homo sapiens
MTPEKGCRTMESLKGGDGAFWRHSKPDLEERGFRLRPLKIKLTRTCTARRYKVGHQAAKSGLAGQPDVQNGGNTRRENRGDLDSRRRKTTTHPLKERSPGSGHTLQRRASGLKTRRRRPGRQNKKSNDKRD

SEQ ID NO: 998493 - protein, 185 aa, Homo sapiens
YTISAAHVAVQVLEDGRRVSYVILVTEYRYELLSQLKMSRSADNEGASGYEYAHYGERSLVSAYNVRHCHSIQGEALEQGVRLQIINTLQQAPLRAMEVAPHKKVVRKPCKKGQHISIQKWGPATDGPSKIDSQTKGKAKHDSIFIAFKRYDRQQKHDGTDIHQDMKLTEAFKQGSSLLKGFSKA

SEQ ID NO: 998494 - protein, 107 aa, Homo sapiens
MCLSPVGSPAYPDISFFRSTLPLASSIFIHGSLRNAKGPPPSYSAAVPAHDETGGQHLSHAEFVLDIYRFNFLKSHLRLAGEGVCGSRPCGSIEVAVTGSGASQGLY

SEQ ID NO: 998495 - protein, 198 aa, Homo sapiens
MSIFKTERRSDVFFTRELALKHGYSWSCMVRDYTNARYRSIDYLQPQMNTENCSLREKGRRCSGTDCVYVQQEVWLSRGQCTQLYAVNKCGHQRSRVPLPRHESLRYKLLRRVLLCGRDCYGVLRFITGEWGQRLRRRGRLVKLRGQRAKSMKYVDGLMIHSGDPVNYYVDTVVRHVLLQQGVLGITVKINAAVDPYW

SEQ ID NO: 998496 - protein, 252 aa, Homo sapiens
MPWLVVPNEASEAVWSAPKLWMLDKLTGVFAPRPSPPDPHIVRECLPLDRFYLRNRLRYARDRRRSREDCMQRFIKIDGKVRADITYSCLGFMDVTRPLTRTGENCRLIYDTLGFALLYIVLHLEEARYKFVQSEKDLCGHDNGNSLIWCPSIDARIAFDSPSPLIKVNDSIQIDLETGKITDFIKYDGGNLCMVTGGDNWEELVDHKRERHPGSFDVVHVKDANGQQFATRLAKIAVIGKGKTWVFSSRRK

SEQ ID NO: 998497 - protein, 89 aa, Homo sapiens
PGVIPSCAVVLWSSVLLISWSAILSYLGACRQPDGRFDGHGHEPPEAPELSFRLVNYKAELEVLIDSYTVGTKSSDNTDAPDDLQERSV

SEQ ID NO: 998498 - protein, 110 aa, Homo sapiens
MPWTWSTPLIYTRNRTLLEWGTRLPVGDLNRTFWINPEISKVAFPQGFPTLDKNIGRGKGCWPPVLGRGRERLGPGGSNPNSKGPWICLQRGRTAKNENNFSFPDGHEIG

SEQ ID NO: 998499 - protein, 122 aa, Homo sapiens
MWTERSSGGVVQKTGKAVEYLHVYNPSKGTYTGRDVPVYKRMVGRTSPDATDYGMNHWRCNNHSASDYGGNCVIECDGSNDYRYGPFVLRALMTGHEYVTNAHLNYVIAAPEVRGINGSDLR

SEQ ID NO: 998500 - protein, 197 aa, Homo sapiens
SASYSVSKPSSDEQGWAPFPVNAESGGTLASSPEFPPIHFITIAFLVVLFKVLGPIQSIAILLNHRQVTTEKPAAFRTSFNNSPVSEERPAKAGRVNSSPREKRQEFILLFGVVAVTYEPHAPENLYGALVLNTRPSVGRFQWTLSTFCSSTLLWAHLLGTEKFLEVVQQLSLNHQPDLLVNYLAFGAQTKCAPSNL

SEQ ID NO: 998501 - protein, 101 aa, Homo sapiens
EVSMMAVAEVVDRETQLNGLYEVKEAGSAPYPLRRSSWEHSRSVFLVFIMNNVKHTNGQHGTEIYIIHQRCGKFMNASLDPKLRKGKPGMTRIREEQKNSA

SEQ ID NO: 998502 - protein, 325 aa, Homo sapiens
ECVTNLVLLACWGRVTGKPVSDPDRTSRVLIAVDHVCSEVRIHSIRCVTSDWMLQELAVEMPCMERLHSCTGNIEHHCAGMDQGMPYVTIGPIGGQCRMISLYNTLTSDVDRRAWTMHCEPLGRVDSRRALRSTTVTLSVSFCTWTPDRPSVLPPTETVCINRSREGCLPSRSYDSEGQQHTLAKGDHLTLLLEPEIRKLVLTSAPVFRAFVEFTTAVVRGNWFWGSPSRAHGHVLSVDYGQKSKAGVLHLPKTQGFHKLVGGGTYLKSDSLSNKSQAMGACLIGCLPGVERKEGHSMEGLVEKPRYSERPSLTNLTGLLAEGSP

SEQ ID NO: 998503 - protein, 170 aa, Homo sapiens
MARGPKKSSEAVWQLQSHWMLDKLTGVLCSSFHPSGPHKVDEVSPPHHCPDVNGLNVCPDRKMKYTKIGMQRFIRIDGKVRTDIAYPAGFMDVISIDKTGENFRLIYEDRRVAFAVHRIDNLKEAQGTSCDKVRKIFVGAKGIPHLVTRWLPGPVRYPDPLINVNDTIRD

SEQ ID NO: 998504 - protein, 79 aa, Homo sapiens
DYRPCGTRGRITLERLMGHKRSLRIQHDAMFSIDMDVVWDSSARSTHNGPRGTEHRGQVAVERESTEMDMYSECQFDCS

SEQ ID NO: 998505 - protein, 102 aa, Homo sapiens
MRLRIISGWGQTVESENPTVLSEYMLRHYYQSKAEATNTQLIQLDLSKEQVTLGINTRKSYSRVHDQRIGFTILDSWISDIPNGAAAIDRFVCSSDLKSYVI

SEQ ID NO: 998506 - protein, 129 aa, Homo sapiens
SCHVNYLMLYFPQCTTEACSGHRKPMVPHAIFNHLVVSQYQKWSLLHNNASNIQPSITDIFISQHRTLHNSLPSVKPLDYKSVWLPRWLASVHNVSDPLLSLLRLIATLLAHHSVLPPSPWLVPKLRNS

SEQ ID NO: 998507 - protein, 102 aa, Homo sapiens
MRIYKKGDIVDITAMGTVQYGMPHKCYHGNNWKESTDVTQSCCWYCCKQDMFKGKILAKRINVRIRAQLSTLRAEIASCKRVIGTMIMKQKEANKMKGTWVQ

SEQ ID NO: 998508 - protein, 103 aa, Homo sapiens
MVRGPKNHLKRVASSYKHWMLRLNSDQSRVLAASYQYTIRSLIYSIEKESCIRPSIQYISLEMKTELESYSILYEADSKRYKKHCKLYAGRVADINKNRDECA

SEQ ID NO: 998509 - protein, 107 aa, Homo sapiens
MAGVRIILWMCRMYPRHRLGYFTLRTYGDSGLYLRYSAIARTLVCYRVVLSPKFVVAKKYVRNVGQLFCCFNMCGSLGPSFKGAVNCSIAEENFRANNMGQSLGESE

SEQ ID NO: 998510 - protein, 200 aa, Homo sapiens
GRVMTQRVSVVTFLGASRRPLFLAFKVITSPRRTPRVFRGAEAGGPTVVEEGRCVTALAGPVWRVVGGRGAVARSVPGGWVARELARRSRQSCPPPPLALYAVCSPGRGRRRSQLPGVQPTPRCDVVMGRRLRRVQQDSRQSKSREDRRSWATGLWGKSSLTIRFVEGQCVGSVDPYHRMTLLACWSRSKMDKKYHSCNL

SEQ ID NO: 998511 - protein, 146 aa, Homo sapiens
MTNDRIITEQVIKKMPSNILGECYMSPLIHIKLVCIARRFRKREHSFEGRNQRSKTSAELQCGTLREHGQSARGVVARSTWSARPNKVHLVLLRVRPSLRLRSCGKREALSLYEKRRTLFSLTDNWLWLIVLLLRETLNVKTTLGY

SEQ ID NO: 998512 - protein, 116 aa, Homo sapiens
DTRVQHAYRKVYSVRGPSIRGHGMMFVRQRWQWCADYANSKVSYMNFKREAQSSLKGGGPKQFRKAAGKELTVDEVQFEFDERRIEPIKYQRELWNKSIDAMKRVEGNLNDEARKC

SEQ ID NO: 998513 - protein, 103 aa, Homo sapiens
MAVGTLYTYPERLEGHCKALYRLSQYQRGSGPLCSPAPLLNVPILWPKANSSSPMNISSSREISVHGQRSPAIGGLMMDSGDVLRSERPIAVRMVSECRTLRG

SEQ ID NO: 998514 - protein, 113 aa, Homo sapiens
MAAAAPQPFFRTQNNRSRMFPGLVDPLYILHLSSGSYSEYKKKQQDVLLVVLEAKQNRMLKKEDYCRPMNENRKWMTRKCSLKIVDQATGWTSRATLRFSMKASDRGDYDAFV

SEQ ID NO: 998515 - protein, 234 aa, Homo sapiens
AFPAAVDSRGVRRLGCVQVFNFELRNPTVHGRWNGISCVERVMRRYILASHRGSEVTALIHEWPITWNAAKLAKALDKRPSAHLSVLAFAAVMSPMYVYSMVEGLCAEHTYQPKSRLLTPDETMENGRPLYTPTEMRETPYVVSPVALCVRCCGLCAWSSQAADVSRRAISNMHLTKYVRRWSHHDSYPTYSLVLFVHHSEKFTCMTLTCRNMKGRLKFLSDADLLAGRLCAHV

SEQ ID NO: 998516 - protein, 132 aa, Homo sapiens
GLFFGKMADYDLTTRIAALFGSAIYSFRFLNFSLVDRRYIIDEEEIHYNGKLWTFFSDDHSTGSTYAMDVYEKSLLFLMILPHAWRDDNRTTVVGTTEYLQAMKRVDPHCEGLFEDAYENLLEKMRVQAEGW

SEQ ID NO: 998517 - protein, 93 aa, Homo sapiens
YLRCCGFFSFSEGSERPPEFSSPLATSVTIVLVPSPASGTCPVYPLKCGLCSLHCPNQFIETLMIPQEIIHTRTWRASRSTSLVNCVPEELLR

SEQ ID NO: 998518 - protein, 67 aa, Homo sapiens
RTLCCDWCGACGPCSDTRARGPVIPPRPCPTDGPGIWGVGAVRSSVDDWIRLVALRLLYTFAEKTLV

SEQ ID NO: 998519 - protein, 233 aa, Homo sapiens
FLSLWVCRQTHSVSVEIPTRYHTPKMGYGKDSYQAVVVDWTQYDSRACPTRLTWRIVTYKVRVASYRAEPLCTKVLNNREVMPCSNWSIMVPPLRPVNAVWLPFGIKTLHKDWYALVNRLVKSSQCGLTHRYVGHKFLVWNPCLQAGVLLNHYYELEWALSTCNHPRKYHFNRIDIDWDFNRGESTSCKSLASCCLGFPGLLFLPDWMHRMKLYRRLGHASQFTLGAGLLLVV

SEQ ID NO: 998520 - protein, 115 aa, Homo sapiens
DIIDDRKRRRSVDRKKKGYVSGLERSQKSSKGGSSRDTERIERIRMPGPTERGLYQRVVDQAKDLQEVKESENQTRIETKGVNGRMPGISSAIAFAAEDVWIKTGLPFLVKRMLP

SEQ ID NO: 998521 - protein, 104 aa, Homo sapiens
MRIEKGYVCAGAIYPGHGMMFVRKCWDGGHDLGNSMMNRNILIREATSPSSIKCKVDGKRQLPGKRVVQELAVDNAFELEKSYKMNLIKYTAMEGMEIKRVLMR

SEQ ID NO: 998522 - protein, 75 aa, Homo sapiens
ENLEAAITYRPKPGPARRSRKYRHSRSNQSAYAVMCVVTCCVIEKAINGRRKCSSKRGSVCTPSSSYSPAQSVST

SEQ ID NO: 998523 - protein, 152 aa, Homo sapiens
MARMAEKSWLDFYVPAEPKIGVGHQSQRYQWSEPKRFEEVCAAFFDLRRNLQWEPYVKLNKASINMLRIVEPYMAWGYPNLKSVRCTSLTSVVYGKINNEANSFDRYRLDVRDLLVDTASSAWRIRFMRSILSGQPLRERRIIPVALQMVFS

SEQ ID NO: 998524 - protein, 112 aa, Homo sapiens
MPLYEGLGERRGRRLAVRDLTWERPLPSVDLLEKLVQRCTKFLVGYTKSWDCLMPVESLYQYNYSIQQRNYVAYLKEFIRQYYILSAVYSVNPQMTAESVSYRIGIMSFVTS

SEQ ID NO: 998525 - protein, 85 aa, Homo sapiens
PLAAILRPRVCAPNLRWSTRDPLSTNPSPPRGPYSLRQDEHETINEPGINSAETCKAQVRIVWERNCVAERSKVVHRCSHRQDDK

SEQ ID NO: 998526 - protein, 129 aa, Homo sapiens
MSQETSAHQVRIFTLLSGCASKPINEFTAKKTKVERGNTVDVNEERESAACGNDISLVLSPPIMGFVCLSTKLEYYLFRQTSLLGGGVDTMASRHYQWLVSQRERKSSLQCAGGAPPTIDMITDGGGSK

SEQ ID NO: 998527 - protein, 154 aa, Homo sapiens
MMLSLSYLLHQHIALQTDIHDICTHHVPSLYILEIGISPQLCSMRVGVVDHDLAILVITLKHIPNRGIPTRFDEVVICTYYYAQFHYNRSPSLDKTKTSLIGTMAFRPLAGIGEIGTCVLGAIFRDRGRFNKVYLRFVARNGGVIDYSIHKTKH

SEQ ID NO: 998528 - protein, 71 aa, Homo sapiens
DRTLTHTVRETMGPDVEQMLTVCSCVRKCRGDIHSGSFPSRMGISAPSRWLRKNDTSLEWNTVVAVVDLAI

SEQ ID NO: 998529 - protein, 468 aa, Homo sapiens
VLVRVNRERRLPDCGGRRGAARNATPSQGSPTKIHATKSTTGRNWTDNTKQNQQAHTHRHIQKAEDKSTHPFFSTREHKKATKTDDKREHKQNTKKPPPQETTTDHSKTTHTKKRPEKKTSDGTTTDSERTDTSSTNQNKEMSKHTQKKQKKKQRENEPKDKTRETDVADTNREQTSRADEESRETTNKDAPQRRKTKGERERYKTRAANTGATQTTRAEQETAPPATTKKVRQGPRADNRKPNAADEEQTGSHAPTKKEQKPTTHCADTKTKTHRERNEDKPLTGGAHHKQEQSDNKNNRRRYDKAEWREKATRKPKKTEKKSTDTDRNGGANRKNNQQEDSQRINKKRNTNTTRRERREHTTHKDNERRTSRERNNETGEEKRDTQHRKKKDTRANSDNTHNKAMKQNRKSNTIADDEGREKQQHHTRPHRPPADRKTDAEGTQQRTGKKRKSKSTRQNENNETHE

SEQ ID NO: 998530 - protein, 244 aa, Homo sapiens
DSRCILRRRRSRHDDCSLDKGGDAFCFGLLELSASHSFCAARLCMSSSRRSFHEEPAYFLTHGNCCSSLPILDPDLPQSSFLHEEARLKSLLFYAQNCPKMMEVGAKPAPQGICPLQQYTTNRSKKPLRPVKKDKTAKAKANRLLMDPSRVQMAHSFRLGTPCCHKPGTASKCPFLAAQMTQNEGSSVFCKASLELQEDVQEMNAVRKEVAETSAGPGVVSVKNRWRGFQWTVKNFQDHFAKAR

SEQ ID NO: 998531 - protein, 265 aa, Homo sapiens
MSVISQFLCRITCRRGALTKERSPRCFSQTFSEVCVEECAHDDACERPWSDYDETSEPFDLTVAHICGTKCPVIEQRETIEYIASNLAPIEGAEQMTDTFNGVPNGLSPIEGSPIWPFVPLPCSGGIALEVDGRTLHGLSELADCSSNENWVDDVGKHYLGAELSKRAFDRTEMGLRQLKAAKFAETGYSLALSELEGNYALIAVKQTGKLSTAEIHGHVPPGTCMARSDEFRDALNERLEDTNGRTHCTQRIADRMEERMSVSD

SEQ ID NO: 998532 - protein, 69 aa, Homo sapiens
WRPGTRSSSEEVNSSSSRLRSKMASESKLLVAEPYGINHENGKSQVRLPEAEPGNEFVDGKAQYYIDVY

SEQ ID NO: 998533 - protein, 105 aa, Homo sapiens
AFTLTFQTGSVSSSSDESAHFPQKSLYVMRSAILSKMKLGVSIAKTSSCARLIDSVLIEDCWSIGSPRVETARRVAILMLPSYILPSIQTLDQRNITLQITQDFS

SEQ ID NO: 998534 - protein, 114 aa, Homo sapiens
MPGPPLCAGASWWSTTVFASCYRPSNKPLMVIHSALHGKQLLGLSMVYALDPVFPWCIQSHMILVLIEYSNHGVSPCKTVFETSESSTPHACLMYAIFLRILCLSYYAPGKCLD

SEQ ID NO: 998535 - protein, 142 aa, Homo sapiens
MIQVVTDLLSRKELLATQTVSRLAPQGIRISGDRVNLTQSLRRANTKDTFLRAGANPWLIASNWNPKDIWDPASPGFSKPWKIAFYLTFVPPISNMDAMAFEQFDPMIMRFGYLPCGAPSDYGKEIWKYARRGENREGKGEI

SEQ ID NO: 998536 - protein, 200 aa, Homo sapiens
MVNVLALAIDRREVSECKRYSLLVALSHLLCSLKGRVSNLYSFVGAKELEFFTNEDMGFKWLGGVHPGGELSATVGAVFYPRGRFAGVESDSPLCAQLYEHIFCPSFVRVVLPGDLHSHSLSVGGANCPSYIKGPRRMRVGSPRGVVLFAQRRTIVRAGGRNPGCESQPSERVWRQYEPRDTSRRHICSCGERIAVIGYI

SEQ ID NO: 998537 - protein, 98 aa, Homo sapiens
YLAQAARPESLRVYLDPAPLVVETRAPPRDAGLPSLLSWILDTKLIRKHGTVAYQKSISTGPAPMIDKRYTIFVDECQSITSRGQCLLLKTMNIRNER

SEQ ID NO: 998538 - protein, 105 aa, Homo sapiens
MSYSSCDKHKSILSKNGRDPGEARSDITAHRVCLMLMDSPLNRAGFAYRFISITQKNVPELKVNPQYPIFLMKAVDRPVRWPSMVQCFYIIAQMLRAADWPPEGF

SEQ ID NO: 998539 - protein, 231 aa, Homo sapiens
MDDPVLRPGPLVQHGLPGIQWLDMDSHFVSARCLQAGIQGERDMDVAVEAVTIVETPPMDGGGHSWAYVDISPSEGLRELSKNLVFAEHPIDVMKCKNGVSIYNFGVNIKGINGSLPHVAAQKSRWDEDWSDDAIPWTIGTFERAMTNVRSLESLPEFYVAHYNRMDAAHDVAVWRPERNVPLPLLVLFQGEADRQLVWREGMLDGGAQCRGLGARLRYRVESPVGWGAKV

SEQ ID NO: 998540 - protein, 148 aa, Homo sapiens
GGIDFTRITEMDARREASTSGLPYPHYPLKGSDPSRKIKCIEPFLEQDNYNRINPWKTSLLDSVGMELEPKWVRKHVLENYTQEIASVPSRKSQDLEGRIVVATKEKRFLKKFRIGRGNTLLTLYVRPARIGGTMWGLGELAHTGCRT

SEQ ID NO: 998541 - protein, 113 aa, Homo sapiens
MRCELRRCRCGNNMSIPACRCIVTRRPDRPAAAGRVFLAWKWEILGHGMAHEALSRVSRSSHIKISSARMRLFEACSHIIYERGYAFMVVILLGLHQIHREDESGIRQVSRKI

SEQ ID NO: 998542 - protein, 90 aa, Homo sapiens
VNVSCTIDVSVCIVCWVYYNSGRGLLEGVRCLCHCIRRGVVRCSAVEVVGDYSDGVSWFWTTMIAVGRGMYRILDSRVGGESELLGGRER

SEQ ID NO: 998543 - protein, 105 aa, Homo sapiens
GSSSPDMVFTCAVFCYMLALLLHCRAHLLRAFGTLGTHSDEAVNDLITKNSVYDQCRYPESALYSQTYLIHALSSVSCVFVQHDLAYTGSQYSPSWHIIFEKVYE

SEQ ID NO: 998544 - protein, 108 aa, Homo sapiens
YSALPERRQVWCCPLISQAPGLQYYVVVSCYVNEAETHQVYERCDYIAQTVGHRNDEPIAEVDCNSGRLIINTRATVHDGHSKVVRTDEIQMALSICIAGTWIVGCDG

SEQ ID NO: 998545 - protein, 105 aa, Homo sapiens
MRIVDLIHDGINTEDEVCQMLLIYESSDILGMLSLNSFRSEDCELFPGADSGLSSSWSAAGRLVTNVCCEMTSCFMGDALSRKRCQVTWYFGQLIQHLKPLSGYL

SEQ ID NO: 998546 - protein, 98 aa, Homo sapiens
INPLAQAVIYSTIFAGTLITAAKLVLILYLSGLEINSAELFMLRFYTKRKVNTASIAQREAGQSSSLPPERKQPRSPYILLIAILVSDTYTCSGRMKP

SEQ ID NO: 998547 - protein, 35 aa, Homo sapiens
MLLTHLKPRQLEPVVSTHGEHIDQGKGESGPFKAG

SEQ ID NO: 998548 - protein, 163 aa, Homo sapiens
FNGMESHTRKDGTFASVNQRHALTALDVHSYHQARPNDKPVLSPWLVQDDPTMMCGGYLVHGVPCEGVDGNDVGDSSENLDGCDRPFCDQVYTFYNTGMIKIMFEYCYHGKAFELKLLLWGSIVGVRMLKKIVVDVRWICFGLWAIVVLGDHAKDETYTYWIC

SEQ ID NO: 998549 - protein, 116 aa, Homo sapiens
MSQRTPYIRKTCVTLRLLHGTPKDDYDDVMMGRLCSRHSLCEELSFMHKEGCTCQHRSVWVHPDGSLAVLMPVGGICSNRTPSDNFRWSPSRPLNMSLSVMLRASCVTSHGQGKLL

SEQ ID NO: 998550 - protein, 90 aa, Homo sapiens
SFPSCKMAGEKVENPDATEKKPARPSKVDAVLCMVTYTGQPSNSLKSTPKKGEAPICSATLSLSEDICVRVFLDLPMYSIKAYVPRGSTS

SEQ ID NO: 998551 - protein, 220 aa, Homo sapiens
PKEEVEEEAALERASSELAGVAERELREPSPAARRRASALRPPQNRSPGQGSSVTLVRHGQIRSSVEGRRGLAAAAEADRRREERRQADARESRGGNVEGPVAVRSPAADVAPLEGASRAWAAVVHGGEAQIGIRGASCITHVSLALTNNTNRRQFRSIPINGPLTLEGPSHYRGNALTVDAHHRLVEAFPRRSKPLHFVVQCLTLTLPTIFNKPYELGH

SEQ ID NO: 998552 - protein, 74 aa, Homo sapiens
EFLTVDAKVTAGVLYLWLSDGGPLVLSYEYVARLFLYWYTWYQGTRKIHWSHRGIIEVPLQTILLYTGKTRDRC

SEQ ID NO: 998553 - protein, 98 aa, Homo sapiens
GVVEWMVWQYGWWSQAIRLMLTSTRADYLSVKSHIQSAIDVNEDSEQVHERAAKRLTRRLCDQREVADNTVLACSKAGDHSLVVDTEEYAEIKTSETI

SEQ ID NO: 998554 - protein, 69 aa, Homo sapiens
LPEVDSLSRRVLTPCVSLLLRSLSLSDDATLSEPGRVGYKRADWQRKALTCLARGLSWIAAVVGDSHSR

SEQ ID NO: 998555 - protein, 148 aa, Homo sapiens
MSNEARLRGVQVSLYNSCLRHDQDLLQKLNRMQHCLGKADRLDRLCIENQFTSKAPVEEALLYAKFRYLNAGLVARVHFSPIQPVVAGGYRSNTFALCEILNQFIKDGEDGAFWMEVVSLPVCEVTSHVRGRLNGWFTALQAELYEAV

SEQ ID NO: 998556 - protein, 382 aa, Homo sapiens
MGSRLLLYNGAKMPILGLGTGEIYRPWAMVYVRPVKVAALICLGYAHYYQTCCPVLYSELMNEVAGVTCRGRQSQGVRMAEKTMSGDFLHVRYRTMADAMQRYTICMRRCSWLTTGARSRKRAYPGRAFEVWHCKPWYPSCLMSTVPGHALCDMRWGTGKFFPQIRIGCAGPMVGLPHVATSLSTFSWHQQLMMGSNGNRSLGRGSKRAWSKKTNLGKTRYIITGTPFIPRVGKLSTCQYTKPKWVVQRLITVPGLVSGQKFGRRSSHNGSSTFKGKKSLDSRSNLVPMFAKERQYAGMTTGAKGGVPYRGFGHGDKGPLRANRALTEPISGFRGERGSPEEFKGRVRKSQSPRVKTYNGPGSQGTRVPTRHERKIGGENRT

SEQ ID NO: 998557 - protein, 266 aa, Homo sapiens
RKAMYNEEVLTPLNAEGLTRKRRREVLGNCLSSTHVWLVDNELACHPEVRLHNCLDTIAVDYYRCLECMCRRTSCMSHGTKEDRFPDQRNGEATHLTIGAGWCIPRAVNPVSWTAVAATWVRVLPRGVQMNGAGVVSMYMTETGLGGHYCNYVDRVALMDHSKSDVCPSSRMESSSEEDLQVHGASVQIHRIGWTHVRRLGEKSSRKACVNLTAIRGQETTRKRHVARIGRGIHQGRGLMESFDKPYQDDETTDGYTAKSKAAKRN

SEQ ID NO: 998558 - protein, 119 aa, Homo sapiens
MRKVRVSTERCMIMFVLDSTEVAVAIFSIAVRDKSTSHVISKIMVNTRHDTLATTLLLPYYKLREFSGIDVYASCMISLWSIAMPGLRIEVNVVVAYVLLAMSGHLGTSDVAHSSGYES

SEQ ID NO: 998559 - protein, 460 aa, Homo sapiens
LYRRDLMAVTVSPEQFSSSQIMALPRAILPSESRRQSRPSMSDRLTGSVHLNGMTQFTRPVPELIHSTYLGNTNVLGMYIYNLMTVQRRPGRRSNGMNKQGSVVDVLLTHLVENTNTSVWFVAHMWDIGGKSPHREPYRTVHRADHVCLSHQLQVGLDIGKRKRLFPLLNANLWATIQIINRTRIGDLLTQCSTLATEQVGGRHSEGDGDIKEKHKTRVRNRDLTGQANVTQEQVTFDSLRSHSPVASNLDPQSNPKGMAGPVAFHFPCLTSRQRKRRTPHHLDFGMDSRKGEIQGKAQTLVGAPESTSLWHFREHTTRSAVILHAHEDGRYTPMVGQPQQGLVYGRAQGTWKALESETSPLRGAETQKGGHNRGLHNQGRGATTQGSECGKQTTQRKALEPRRTQEAHQPDWAPYSNEEGRSPTTYQRDIGQLPCTPGDTPATLVGEPTAGQPGQREHH

SEQ ID NO: 998560 - protein, 111 aa, Homo sapiens
SSPGKYDPTRQNFSYVTGLDCSETVEYSQVNVDEMICVLWNLLNMKWYRSEEILMYPPIVRSSGIPWARWRNNLRHIFAITEDYEDRGNPSKIFDDKLCKYSSICTIGWIS

SEQ ID NO: 998561 - protein, 107 aa, Homo sapiens
MTTYSDCVLLDSGIMKRIGLDLTVDWVSCANASKLLGWYFHVFLNPKVQSCRMSLGPLMKLLLYAFPSTRQDIVPGGERLAAAGWKLADRVKTIAWGACRPRDVRNE

SEQ ID NO: 998562 - protein, 156 aa, Homo sapiens
ARRPRQEPCADSSSRTVPVGEVTWSPRRRGPRALSHVIELAARERPVGPERGAVCLVRLEDLVHGHLQESSASLTGQGDRPMRLGRGQHRLRAPPRYSTRKQAHWFENVNAGEIPADQEGQKRWAFDIVARGSRKRYKQSARDTSRFLGAKVGRQG

SEQ ID NO: 998563 - protein, 70 aa, Homo sapiens
GAAMSLWVDKYRPCSLGRLDYHKEQAGQMRNLVQCGDFPHLYSVRTIRCWNKRQELCVFYVNFMVLEWEN

SEQ ID NO: 998564 - protein, 158 aa, Homo sapiens
MDNLSSEEIHSRELTRLLMRSRGKVRGESCAFSPLSLRMQESETITMPGMNRKEAKHKPSIEEGLDQDKYTRPQRDGDDFNRTQQMLCAFVFVPTVYTNKELFDVWQELIRTTLGEMRGENSPCNVVSKQACPADIMVSFHANQANREQPVVDTFIHA

SEQ ID NO: 998565 - protein, 106 aa, Homo sapiens
MIPSFTGLTHYDVPYGPMSESPHQVRVNSYLTEKYVLNGHRSVASVVIMSDLYELHLLQIRLVHMNRANETLTAIALDTKSHYGGIINTYTLRYVLTYNGPERQNA

SEQ ID NO: 998566 - protein, 49 aa, Homo sapiens
MPKAELGILGKLLWGTRPLFSLELDTYYKSARVYNVCEATPGSGAFILG

SEQ ID NO: 998567 - protein, 72 aa, Homo sapiens
SSHMLSGGGKVGVVHLVFDVNYNGCGHNYCLTAPLSWNRRMEYSYQDRYIEDRGVTLPLPFSVSELVTLFQR

SEQ ID NO: 998568 - protein, 75 aa, Homo sapiens
DEHMSAMVHQIATASSVVYSARGRRRWINVRNDASCLGRYAVPKSCREGETRAMLTGRTEHLLGTDCCGTLCIYL

SEQ ID NO: 998569 - protein, 131 aa, Homo sapiens
SWESIKLYLIWSEAAQCVGSSSINVSFEWGYRYTGPLGRSWKGQIFAVLGLNLCLILVELPARIVTHETEHVEQPNFQSPHLRSPGKGRVHNLCKHGEDGAEDIECPRKVCTLGLWANFIQMAWFLISDNL

SEQ ID NO: 998570 - protein, 110 aa, Homo sapiens
ENALGAYIAELEPAVSCCPAEWKRVLFVYVSLAYGAARLSTREALEITTCLRERPECRWCVDSSHFRANQHAFIYLAVELYPSLTPLHRVLKYGLSLLVTTDLELYLIPK

SEQ ID NO: 998571 - protein, 122 aa, Homo sapiens
MGGIMQWPKLTRAGEHLTYKEEVADRENYCGPTVRVSACHRCDTIEVWPFDDYAEGRVYLDGATYHLWIDRTVAALRVVHSVNHATGKDSIIWSACVERMTEPVCSDPSGGVRLKPMLHIDP

SEQ ID NO: 998572 - protein, 104 aa, Homo sapiens
MDGCTTMTVSVGELQLTLCLTWDCFIVLTCTHVDLPQLEHWDETEPMGKASEGERKTDHMSPRLLTDRLKRGSSRRMTHGQLEWQRYEGLGNGWRKREVPFMVR

SEQ ID NO: 998573 - protein, 181 aa, Homo sapiens
MSNRRCDPGTTVIGAFAPQIHAMMGSVLFGKGQASVAKLWRVIFFLVDLSRISNHGKCGALARLSSLGVLKNVGNAMSQFDETSLVNRGDDALKPLGELLNALRVTSLSAKDCRLGPRIPRDSIERVFRCTRMPIRRASIVFAGLTQGWIELDQILFLLDYKKVRVKGKSEPLVPLDPWRL

SEQ ID NO: 998574 - protein, 83 aa, Homo sapiens
KLLVQYLIRTVDSVLPVFSNGSEHVAFIKRYSSFPSSEDTVAIFSIPRYHVGLNHVWYPWISSSLLEIPLLRERCNSEMKDDS

SEQ ID NO: 998575 - protein, 73 aa, Homo sapiens
DFLSSSASVRWRLHCVVLHAYRKVLISVRRSHSILVARHDVRPQIDCQVFRFRKSKMSIKSFKNEALIRSAKV

SEQ ID NO: 998576 - protein, 134 aa, Homo sapiens
FRCRAQLPGWRSSLPSVRSVVASPTPSHQYPLHSRTGSRSPWALPSRDGNAVSADRLGMCLPLGRPSSNETAGVHRASAEGSGVSAGTRLRCQSIASLADVGRMGATLRRILSQERVRHVRLAYAVFARYEVKS

SEQ ID NO: 998577 - protein, 30 aa, Homo sapiens
MNSLMHPILAPSNPQEFAPVAFPIYGRPRT

SEQ ID NO: 998578 - protein, 105 aa, Homo sapiens
MPYESATDVVSLYENIGAFLSGGTGDFVRQAILELNSRISVIEVVLEKRRVNLPHTIVDRDESDGRISKRSTSAIYGLPLVGSCRAVRASSRGSLVQNGVTNFAL

SEQ ID NO: 998579 - protein, 144 aa, Homo sapiens
MLTPHMGQPQTQGMLHLGLGYQRRLHSDARETVLPPSCLTQEHLSTVMKLFTSSYRGELNACEHSETMMIFTSQRLSPYTDDKERSDINLALVPLMLTEASFIQMGIPNIGALQGHAYHRVPTIKPEMKKKNRVALQNGPGRGI

SEQ ID NO: 998580 - protein, 137 aa, Homo sapiens
RLNVGQPCILPRNAFEFDLLIFYLGNLHFYISEIGLLGYVLFFFFLEMGCLGSLTQAGMLQYVAILGPLATSASGARVILLPQPSNVRWGLRALLATAPGLILGVLSKDGVWLCGPGGLLNFLTSGDSTLPRPSQRC

SEQ ID NO: 998581 - protein, 205 aa, Homo sapiens
MGSTKKPGIGNFPSEDWSMNPNNIEFLPTPGKNLSTERGGMNRNGVPGWGVPLERPALGGDRPRATTKVGQLGTPSHSPLRTTFNLPPLNAKIPFAKTLRGGPPAYFRKPPLKFKQTPPPVSYNPPPFLKTRSPHYTTPITLRSYNHNNRQHSSHTHYDFYLRRQQHHEMTTSPTKIQKYTIWLDTTTHIHDIRRQTTDDIDQHT

SEQ ID NO: 998582 - protein, 93 aa, Homo sapiens
VPGVYSVLRGVFSGASRSYISLVRPFSPTYTCVPVTTIGKIRMVGMDMSPPGGPMNYLFGCELEADEAYSLKGGLFDENRAPGIILNVTGSEY

SEQ ID NO: 998583 - protein, 95 aa, Homo sapiens
NCEAGKPSVDKSQIGSVVLNLVKTDIGDILDLLSQRDHIFNTLLVFGHEIMDVLAGRDRILVHGYLPSSNFSCIRRNVTKTRKSRNEMCDDLIKC

SEQ ID NO: 998584 - protein, 85 aa, Homo sapiens
FSPNAVNMVFMWLRRLAGVAYVSFGPSVPEKSVVDCQMIIRSEQGLRSMDLALKEETGHALQVACNSLIASSSIRISDHAKVCPD

SEQ ID NO: 998585 - protein, 104 aa, Homo sapiens
MSAGRSKTKLYNFNSFTTKREGNMYCVQLATAEIRIGVAIANEFTWRQSVLEVNFPLYKSLGHNGHVFDPYYAPPSYHVLERHKKEQFTCKHTFVRIQLTLKHL

SEQ ID NO: 998586 - protein, 108 aa, Homo sapiens
MDHFLQRSSQYGIITSIGYHLNCRVLTKMDFLFGGHPTAQKEFEDTSLGDRPAPNLRNHIWGDKSPDVPVKQYPVRKYTLVSGGVRPQLNGSPRGLAIGVCFKRNRKM

SEQ ID NO: 998587 - protein, 86 aa, Homo sapiens
ARVADGNDVVKVMELVVDGPGGGRTNVMTRGITRKTQNICNLTCTKQKQLLVRMNDEDTVEGPRCLSSLNLHTCVNNRQRLQCALC

SEQ ID NO: 998588 - protein, 145 aa, Homo sapiens
ALFPVWNHGGCTKTNDRRRFLLCQRTLKNTAKEFRSSCMIKRLRTKFALKRCSRKGKVGSLSMIKQSTITMEYEQMYRTEIRMARTGRKAGNFYVPAESKIGVCHRNQRYQWSDAQQVLKGVAAFFAFCRNLRMGTFVKLKQGFD

SEQ ID NO: 998589 - protein, 75 aa, Homo sapiens
DDASMLPMDHGDWGYIMTDPVTFNVGGRLLYRTSSHHIVRSVDPNSRHALCECVTCYMECEVSSRNHVLRRNSIQ

SEQ ID NO: 998590 - protein, 78 aa, Homo sapiens
NSVVATAQTKLRSYSCASLCYFLRQTMCDISPSMAEESMKVADEVDRLNEGLDDCGDEIIQLPSNETIEQEKQAGDSY

SEQ ID NO: 998591 - protein, 110 aa, Homo sapiens
MIECRPYQIAERESNGTLKLIRRADCIGVCLKRKYSLTRRRRKLNFVTGPVICMDGLTGSLTAKRYKGIIIDSSISTFIPSLFVPPFLCWARCENRCFVEERMIGIRYAY

SEQ ID NO: 998592 - protein, 125 aa, Homo sapiens
GDRSSSGARCVYLLGRSASGIRSGPVVGVVRPLVRPRRQAELSLLSPAAASAGLGPPALCTGEFRSDAAVPVPAATCHRADCIVRHLRLRSCRGHVVRELRPRVRAAGQSPQLIFLSKWYDNLAR

SEQ ID NO: 998593 - protein, 121 aa, Homo sapiens
SENRCIEVIIYSTVYPPTMTYYPWRIECFAYLFSIIYLFPMGSVRAYEPQEKNFDYEAYRQILDENVPVVRTGCRICARMNARGNVYMPCLCLCPPEYLVYQKTGALLFYKVCDLSAASKS

SEQ ID NO: 998594 - protein, 69 aa, Homo sapiens
LSPVVHVDLCPTALPGAYRDHVYDSIARAVIHKLERLSPIIILLDDGILSHDPRSSLLRCHRESRGQIR

SEQ ID NO: 998595 - protein, 170 aa, Homo sapiens
TVNVYAAGNSDPGNIMARLSRTVLERCTPGRTVRMKECQPVHRAVRDQLDSAGMVVEESRKIISQSEEVCSPPGVSGGSHFTPSDGGSFIVAAMFADMVSVPMTIRKRSRDVGQEYGPGYANSRSELFGYTWVDPRGVSGRAFDIARWRKDQLEDGHGYEWVSHQVMCSA

SEQ ID NO: 998596 - protein, 116 aa, Homo sapiens
MFEAPPGSRAPIRQEGCRRQVKDLESYVGLLGYYGFQADVNLARAMDFVPTSLWCMLTLRSEGCDNPTLMRSATLANGLCTVTSMSYRYVKMRRRRQERYQLARKGPKIIADTLGR

SEQ ID NO: 998597 - protein, 117 aa, Homo sapiens
MSTADALDDENTFKYYLDRYSISGYMGKDDGGGRMMTGFVVVIRYDRNLKSCAQDRMRGGFYVVEGGDLFHENKPSRKNITYLAIELLRKYCMGDRAVQFEILSDQSVNLVLVSFHG

SEQ ID NO: 998598 - protein, 230 aa, Homo sapiens
MQREYRSSTCRCNCSITDVGGCTYNDGRRMKDEAEMNALMSWNIDHWPIAGRAAIAEDNRVERMKVSLPCAVRMIAEVVLEWVQDARENSNGTDDIGCLPSCHVREKLSAGKEPNYSSWDNLGMGRVERYTFWGRISQNGRGQGGIREIFYIGMGLLKEVAARILCLETGQKRTCSPNQLNTGERKWAIGMLHNRPKILGKSQLLGSKLKERITLWRSGSGHQELWDGNI

SEQ ID NO: 998599 - protein, 213 aa, Homo sapiens
MPASGVSYMTRFALSFLIGRTPVPLPRCRRRIRLPLPAGRLGPCIWNRLEQLSMNSASTSSLSYSAHPDESEYRLGTVSPNAIVFSIVYSACKATLHRMYMSYRGDKCERKERSVYEPLTLKGGPPILAGDMHFEGRCESRVSYWEMYDNYAQSRLKGFRKRTRWTQTILDTGNKLFLIPEVRRLIDRTRRVRCTIVWYHDANYEKAPERRSL

SEQ ID NO: 998600 - protein, 205 aa, Homo sapiens
MDDDRMQEAEPATGKTGKLHAACTTDDCRYTTEARKNRTRDDIDQHNKQDTRIHIKRNQRDRHENHNTNTSNITRVHHINRPMRPTISEDTQKGHRTDTKRRTKGTSTGKNKTTGSIVTTAPAPQRTQNQKCRKNKDKHPRGKTTNTRETAKRYEPKGTPEHRAAATQEEQTQQNRNKQNKSKRRQSTTYERLKKTTMEKRTTEH

SEQ ID NO: 998601 - protein, 124 aa, Homo sapiens
MPMKLEEVEACYLRLQKQVFGKCQDQLNYEFPQHVAGDSLDRSPYTISAMSVGQRNPPRALKRTLRVCQSSDSWFNFSSADFKYVTEHKVMKFFRNKTLHFHYTVKMFSLAFLEVPNFCHLISA

SEQ ID NO: 998602 - protein, 413 aa, Homo sapiens
IRAAADRRRAAAASAAEEDSAARAPPATHDRRVHRHRPRASGQELPPKEKKKKKKKQETKKRRKKKKEEKKKKKDSSERATQAAKTDKRRQGAEEEEQGETRTEHEKERKNSKQEDSPQRRGNNTAEQWRSREEAQPRRPREKEKRNTKEREEEKEITNKKPEKRERRDSRRARQTRRRARKARTETTSKSRRGTPKKRRDERNNKNNKETQRQKQHRTPERDQPNSETDKARNKQGEETKKRTTQEKRKRSAKKSEEDKKQTKKTKRKTKRRKNKDRKKRRRKTRKRGATARTETEKRKKNREEARRREKGTRNDAPREINKTSTRQKEKTKKKRDQQQKREEKARKTNDNREPEKRRRDVEEREERTQRRKRERDRARQRDKTTKPGRSAKSIQVRSRTKERARIDTTVRH

SEQ ID NO: 998603 - protein, 94 aa, Homo sapiens
MVTQSLIVEIPRVDTEERHLLGQMKSLEVGAPASEGLKRQRRVPVWNSHVVLRHLIGRIGFCNVHILGGTPWCPQVTNTYGGSTQVRFERHNPR

SEQ ID NO: 998604 - protein, 107 aa, Homo sapiens
SLIAWRLCAGVNLRGFSHMRFANCLSSRLRVDLDLIARDSSGNGCLRCQHSGTCRRLLARISLGKNTHYMLELDRKLLRERDAADSSAIKLVVVNQNDIPGDNRMLA

SEQ ID NO: 998605 - protein, 102 aa, Homo sapiens
MYCLASRAINRDFGTLSIIGVVGADLAERKVQDRKLPRVAMDKTVPHSPVYKECAWPTNLDVNDRDRLEKLWAWTESVVTIWCRGRHISRMKEILIFTPLRH

SEQ ID NO: 998606 - protein, 258 aa, Homo sapiens
GFPGGKMVARMRKCAARDPVGHVDPMPIGPSRRLFQSMFSVKANRLLYVLYGVRAATRFDKAPIPAGLSKRTLFVLECAPITAQRRRLSRLLSDLWPRSSHVGVCREIVGDPWLSMPYRASTDGSQKISSIRISQYSRRFPGIDHSCGCSLGSREGWGVLEARLRWAPAMVPPPLLVSNSRSHPPCCNVVAFTKWISDYDKNSVVADPEDLRVEVDTFMEAFDQKIAEEEAKAKEEEGGPLTREGWVKVTRRGGRPVF

SEQ ID NO: 998607 - protein, 69 aa, Homo sapiens
GSLSEELAEVAGSFKMRLLLTSPSGRRLQMVRRRRPRPIWCWRVPGEMIKDAGPADGARWIKVPELVSS

SEQ ID NO: 998608 - protein, 257 aa, Homo sapiens
MADIQTELCRYRDKACLTDLSNTNEDGSCWVDTVGRRSSRGYLQEHRSGASETRLREAIDGHPTSCTRGQCPVSLVECVHSEERILIMDVVTSDASMRVGPSCQSGPVALILQRYNRSREDTNTSYQSKDGPAEETSSSSDTTRVPRMCSRVNEFSRTLGCTNSVCHVAETNVAQVLLEAKEHCGRPFDTVSVLEGQAQQGDALGQPERKRQVSRREGNLDRLGEPIQWPPTSPGNKFCNIDTGKLLRTNSLKQQHA

SEQ ID NO: 998609 - protein, 184 aa, Homo sapiens
MTYDNCRIAYAGVMLRAGVQLTRHAALGASWGETVDLTRCDVRLLTPADDYGTPSLAVSVGMNRHAESGPGSPGTLTAVTPDTRTREASENSGTRSRAWLAVALGAGGAVLLLLWGGVGVLRPPRRVPSPRRFSPESSTSSRCGGKTPAVVYIEILDRPFLGPEVPISNGSDSWWCDGSLSHAL

SEQ ID NO: 998610 - protein, 71 aa, Homo sapiens
DFLSSLGFVWWGYTRVQYAYRKVSSLFEAHLSCTLAMMFRPLKDCLTVLFPEYFRNNLIDVQLYNTYQDIR

SEQ ID NO: 998611 - protein, 132 aa, Homo sapiens
MILEGAYQGVPVSAVSCPCDRDMCARPYSRVLEKLYCELQSDSRLKLGCTVTCSYILTERGAVSSVTVSSWGPSPSTLVLSGFIYLCGECHPNGCLRIQINPENKAVSKVISTERALADFLFCQHPSCTLLS

SEQ ID NO: 998612 - protein, 147 aa, Homo sapiens
MLGEEREMSDAGGSARSKPCSAGFVIGGSHMPERKTSVAEQWMVQVALVEHPSSWNYLLAWASIGVRVPLVQVSGTEKMVGDDDRGPGILPPPLSDLNICGPGFGASFMTILLIIMTSVGRPGPAIDQEASLRPGSSCRELYAMYSI

SEQ ID NO: 998613 - protein, 113 aa, Homo sapiens
MTEKVGRRWRSIYNYGSLRTTELDSALRYMYWRIYGDLRDAHKILEKGISYSVAGASQENIKREGGAGGCRAHSRAGTTTSLTAAVECTFDEGDTSANISPEDLTRRFAKVSI

SEQ ID NO: 998614 - protein, 108 aa, Homo sapiens
MFSATAKIVKSNGEKPDDVRVRSSYSGSVWMLEDETRTLERVNACKGAEYLRAAVMESRELGGGWGKLSDIHLCPVASIEIFLDENPKIRGSTRNWRKMFSGNAMYVS

SEQ ID NO: 998615 - protein, 87 aa, Homo sapiens
QCVIIVHGRNQEATPIIMGDVLYISLVVAEYDISYVVPCLYVLRYTTVEDDIELKRRHSSQGDGVDLGSHIVYALLQFFVHGKFSMA

SEQ ID NO: 998616 - protein, 66 aa, Homo sapiens
VECGLLAVGVPRCTMGREIVGTEALERSAQLSLLENIPFNIKNVPESYHRQLRTYVIVDVLRVNNE

SEQ ID NO: 998617 - protein, 133 aa, Homo sapiens
MRDECYQDSCEIVSDTCEEGMSDEEGLRYPYYGIAGEYTHYKVVGHTAIDRISQKGTLAPRKWVPEEVVWRRVSLRRDWSTHGILVEEAAYALDSRSNHMGVYDSKSIAIDAVGEVKSPTIIYGNPPWVRSKY

SEQ ID NO: 998618 - protein, 265 aa, Homo sapiens
MILKKVLAADLSWNLPGDHLAEDPTEVLNLFGERRHLMGPGGRKFRLLGKGSLRQGQGMRFGQVREAPQRNFVASHHVGTSPKDSWVPNRYSRKELRGDLFRKRKTRLFGKSKEKRCGWVTSGHTVTPITHYAPRCCVRAVRAMGRPFFERISSCSCKQTLSCKWVRAARSPKKCFFRHRVAAIGAGAHTGEKPGWRTRDVCVSVRSHIADPGKNEERPAGRGTIAESAQSERETPQREGLQRGSKQRGISCQRAGFKGSGQVID

SEQ ID NO: 998619 - protein, 158 aa, Homo sapiens
MTCMGTFEYHPHGYRIMYPQPVTLDLYAYPTWQWKLLMGIILRGYAIVDLRGLRRYEPWTNCYLNGASVKPLDTETQVITQGPMVARNSEAHAIFRWEPTVLPWLLIRCICGREIPFRLWGVLTVGKPMVDVGSSLDGGGDSSSAFSLGCGGGEDEVN

SEQ ID NO: 998620 - protein, 321 aa, Homo sapiens
SFCCTKCIGKSVVISTLFTLSSPRVDFISRNHLLVLILWEQLILSRLLQRLLQSRQICRLFLVILVLYVYFHQYLQITVLAQKIVNALCHLVRVGIIFTQLLSLFDHLGKEVLGGGEARGQGMTMPVYMRDTPPFIRGVSDTDESVPLETHPQVSRWGIYRNIALVAQAPQSECYRRGPLIAHALRILANIVGAQGAGFLQRKLGDAWKSHRVAMGHLPKRRLRTLPQGVGEAPLQCPRAPTSSPSLTGRPTPRGPMLKQRLPLTVALLSRGLSSTHVCRENPVYASTNTVPNDIFVAPKVVTIDRGSIHFPLTNKALSAP

SEQ ID NO: 998621 - protein, 31 aa, Homo sapiens
MGSVTLNKAQQAPPKGPTKESTKDSRPPGPQ

SEQ ID NO: 998622 - protein, 156 aa, Homo sapiens
MPSFRDIAIHSARSTPSNDLLHDLHTGQRASRANYTHPSAKRRKEYKARAQTHNVPRPGKPRTQRRCDHRWGTRGTSQASSRHKATPRVKRKDLINGAHGFNDARSRNHEEPQPAQKENEPEHLGECTDSAHTDSGDTGPKGGNKPGAGRKPKEVQ

SEQ ID NO: 998623 - protein, 113 aa, Homo sapiens
LSRRVCSKKTTGLVGLAVCNTPHEEAEEYGTQRFWMFLRKSFKMQHIESIQNRLQMMKLAVVKAEPDVKKVRRASFEGGQLEEVILQAEDMNYIWARQNEGMATMGAISGRAS

SEQ ID NO: 998624 - protein, 201 aa, Homo sapiens
MAALVLTHAAYPVTDTVRTCHREDQSTPSWPHRAAHMNGNLDRWWNTDCFGTSARYMVAPAQLTGDGTRGHRYHRHGTLSIGPFQEGHHTTWTEPTRRKSLDCPLAYDRQDAKRQLQPKTRDRETKNTQKAIQEGNVQGAAQARPQGDSVAPRNTVNSPQARGPQGQYTEKPGVKHKPQHGNSPTKRSGHQHDNQGEATQA

SEQ ID NO: 998625 - protein, 561 aa, Homo sapiens
TAWPRRAAWRSAAQPQLCLPCPALCCTPPACAACALSCLRAPRTPPSHPPHYAPPHLRPDTHCACTQPAHQRTCAPAPLRTGPKTPPASNSTHLLHAYSTSLCARNPLTPSTGPNACNQTPSPLNTANTQATYKTPLGTLKPRPLGAEPPLLRHGNYTLQLKNHYSKTPRRLCKTPASLNTNNQATLSYTWRTPSRLPPHAPLLARPTKLSPQGRPKQRPPPTWGKPHPQPATRNLTQNTLTTPPTAPRGLPSPHQPHNNNPPLTPLGTPAGNPWNLQSLPYPHTPCTRLTTNNTHGNFPGFSKSPFHSTAPLSPPKSTWNLPNKPCDRCQLRNRLYQQRPTTLGPSSPTHPNFKPHAASKDALNPSPHLTFPHRNPLPPHKQQPNLMDPTLPPPRHPLPSHRARTSHTHSPSPRRSPHLTFPWPPEPPPPFMATTFPWLLQPANTPPPGPTRTRKPPPLGAPPPTQHTPLPHHTATNTPRNPPLGPPSTPSRTLYAPKHGDHPGTLATPLPTWPPQQHAHKHTLSNTHHPPPHTNRHHHAPLKPPRPGLPKDPLAHASQH

SEQ ID NO: 998626 - protein, 177 aa, Homo sapiens
MTAIILSPHQPLSHSARASYIHNSGQNESKPITFTLSIITSLWEDQNEYLRGLLTFRPECNWGVSITLRFNPRLQLAFRQRIISSLRETSRGGIVAEIRYCNVGTHFLRLVHVPRIAMDPPHVDDSILVTIYSGTDTFGPIPFDSWGTPSTCWGAFRTKTKDWQKSPGDRFLETPSP

SEQ ID NO: 998627 - protein, 140 aa, Homo sapiens
MISVKRNTHEEVGHGSYTIEFGSVSSMIIYGIDFVICYDESSYMDIGKVCLVYRRHGLVHYVICVLETKHFRLASFQDNVKLKSYSVYFAEVEAIWKVLIFGVRLLTKCIESYRKFTLEFLSSLWFMGAILCHVASMGFD

SEQ ID NO: 998628 - protein, 710 aa, Homo sapiens
LDGQHGTVPRLSPAATPCSSYNLPNAPLTTNHFPGTTTAHHCSLASLYSPLSSFNLHHSPIPQVHLSLPPLWAHAPTYTTQLPGHLPPSTRTPPTSPHPRNVSHSSHPPLHAPTFPHNDKTPCASGQPGLTHVGLGGQLGIKAKAITLTTNKPPYAGTHPKHTHVRAHTRRPRSAPPPGHTTQRRPTTPLSNTHAKQRPRDLYTLTTHSRWRHCRAHPLPQHASSTDPSLNTATPPLRHHSSKNTAVEGARATRHTRAWADTPLYLAASSTTNRRSYKNALITTNRGDPNRTTPTPVAAGTPTRPIPQNTPHANAPHTTRGPPLNRTLLARAYKHTTKRTVSSRPKAFLNHHHTPPPPTQTRHLDEPNTRTLAYTQTTHDTRTHKLSLGSATTTTPPPNTKHTQQTTTANPLRRAQTITYQAPPGGTTPTFYYHETRPPTTTITTPTPDQNAPDWRRATPPKQLPHSSKQDTYIFRTRTTLTPSPPRTLQQTITYRGAETKINNNTNRPPNYGGCGSTYPTTHQVPPDTNHTTSRGGRTETTTKQLTNTEDTVTRRYNKRHGHSCVRHATTPTMLASLPLHHHYIYPTSPYLFINNDNNHADYSPHHERTSNTHQVSSRPSTTRTTNQTHPPSRPNQPPRQDAEINITLSTRTTDTTQQSIDNNTTTSTIRATPTSLHQPQPQLTRTTQQHPAHKQYTPPDLRVCAQPHT

SEQ ID NO: 998629 - protein, 101 aa, Homo sapiens
MAKDAEVRKQVHGDVDGTLYLQHDDTSQQSNTVGCTFDALEGIACNLAMEMRSINDFDRSKQYFTTFGRRLTFAYVRVRMEEIGDFLIDFKGMNKLGWCWV

SEQ ID NO: 998630 - protein, 190 aa, Homo sapiens
MPLLPYPHLVIESPTPVKSSHSHCKAQASLSRSVQGVVGTQLVDQEPCIMTIRSYLGDAVAVSVGIAVCTESSMLWDIGQVMIYENSREELKELTNCATEGSGYYRAVKKDGDAKGLELSEPRAISHQQDRNEVMDVLVKLRDLENPKGANVVGNHRRNNEGVCTTGYATMTTLTGAQHAMQIGGTTVRR

SEQ ID NO: 998631 - protein, 106 aa, Homo sapiens
MLFDKPDGQSDMERNCRVHTFHKGNQSLADFFEKSCPCEARHERRFLLPFGGWVDIWTDVNILIPWLLVFEGVVAKEGWGIRMGPKCCQLIIGCGTKVSLIHAGVE

SEQ ID NO: 998632 - protein, 126 aa, Homo sapiens
ETGVGAEQRRPGLLMLAGAWACENCAGARRGLMVSHGQGRLGPPEPISPVQRLAALRRAGQGKPRRVDRIGGNDLGTPGKGSRGLEGMVGMELSGAKCHTLGRGMKRSWEQIPTDLTPGWSLVKFD

SEQ ID NO: 998633 - protein, 105 aa, Homo sapiens
MSIIILGLRSGPRHTDTLPSSVAKGRSAGWASKVAGCRPTQTDTLKAVKHPKIGHTECPGRLVTEAPKTKKIADFNAHRGTIHFKPSGKSRSVKIHEKTATQPKK

SEQ ID NO: 998634 - protein, 71 aa, Homo sapiens
VYSCGQFMFLETIAFESLVKVGSVTTKNSSIRDLLNEWVAAIGRRYSKITVVAVLSTNVYTVLLSIMFTAM

SEQ ID NO: 998635 - protein, 83 aa, Homo sapiens
AEVLVSGPCSRVDSSLLQREQAVVPEAPWKESNLRELCGSHCQCRKKNNARIRRMKEGERGRAGYIDEIRWSKSGMENEKNEE

SEQ ID NO: 998636 - protein, 90 aa, Homo sapiens
QKIYRDYKDEDGFVYMYTTASQVDIGMSGVMQSPMDGKTRLEDETPAILSYPCRARNVCSRQYSVMMLAEGMVSLLCIQRQECEKQGCLG

SEQ ID NO: 998637 - protein, 198 aa, Homo sapiens
MQSARDRQVKTAATRHAQTRTDKVTPNKTRTRTHITREQATDHTTNGQRGNKSEYDSERGHHERTKRKGIGPTTPRAQGEHTQKRATREDTSKSATGKAPKNETDTEAKTDPPRQRDKGRKTENDTARQQRAKGQAQKAQRRYHPQTAQRNQRIEQTRKRTTEHKQNETAPRTGSNEEARGATSRRRSKRIRIQQTRD

SEQ ID NO: 998638 - protein, 102 aa, Homo sapiens
DEPKVSIINALMKEFSWSPAHCVLRLRRSPDRNISGIDRDVRVQALCALGLRPLDITTWIQLPEAHGSVTHQEARRTGAYVIESARIITLRRKINGVELRSA

SEQ ID NO: 998639 - protein, 66 aa, Homo sapiens
GMTAVVFVTRKNRQVCANPEKKWVREYINIFGDELGWQGPWNLNLHKFACFCFDHGHSLGGFPSLS

SEQ ID NO: 998640 - protein, 87 aa, Homo sapiens
NAVEVTGTELSYPARNLVTTPCWLQEWCVSGSLSSRVGTPDFIRRISACCEEFHHEESIGCEQASRSLPPTSLLLVFGFFLLLYTNF

SEQ ID NO: 998641 - protein, 116 aa, Homo sapiens
MCCRCGVLERVPGAWPEAGGVLVGLLIQVVPAGGGRVVQVIRGRVGPCARLGLAMRLLGPSKCLIPSVQRDKTGFLVEKRCWGHRLGSPSNRFPIESLHSCSIGQAILISHSFPYY

SEQ ID NO: 998642 - protein, 97 aa, Homo sapiens
MGFHRVGQDWSSNCVTVHGSARLGLPQSGWDYRRRANIAQVKTVSYNGDDGGRVVIPGLIFQAYGIDSGGVTERQEHLPMTCIPTYLQVPLPSHMIQ

SEQ ID NO: 998643 - protein, 179 aa, Homo sapiens
EVTRAASQDGGGGGSRIGRGGVPGCLRWAPRRLAAGQARYLRSVGRAVAASARSRGWAVRWQRRRGMLLRGPVPLPSQLSGWRRARAPGSRGHGAEGAQMCVCSGIPGVGKSEYRVAGLWKTVLIRESLIQEEGQSCYEQECAVRKNEAREVPNLGYRWTRTIRGLGPMYYRGSVQLYR

SEQ ID NO: 998644 - protein, 83 aa, Homo sapiens
RGAPAREVDNFARSWFAVYCVTYRDYPPMRALALVWVVRLKAKVGYHGIYAGVGHRGTVRDYPDFIPSVDAEAIQKAMQRNRR

SEQ ID NO: 998645 - protein, 117 aa, Homo sapiens
RKSFLNLRLGRAGPGIRVKCDHVVSLAVFPIERSPVVLMLDIVCLEIPLPHIIIKQAAGRPNRERRAVNATLTRCESSGRGLIYTWESLFSNQGDCPKRETSRDILKIYQAPRPPWK

SEQ ID NO: 998646 - protein, 178 aa, Homo sapiens
MQTVTAAVDGAFGGQFRLPEDAACYMVGVYESAKWMICGPRQRGPSASVAIAEEEEDDIGLKIHCSRSFQSLLLVTNDHQSSGRVSWHWIAWSQLLGEPVEDPGLQRGPRACIVSWSRESQHVTPGKSDGYGGGGQVLRRKAGQQPVGPLHLSSGTLEAFPAAESVKLLPQQNYIVLD

SEQ ID NO: 998647 - protein, 106 aa, Homo sapiens
MTMTENARWAWWWSTRWVREKRRGLLGMQDDGDGVLCQGAYPGMCECRWSGDFKVGPIMKHNSWAHEEEVAQVVAMVDPGDIVVEVRTSTSLNPANRIIPFREQTS

SEQ ID NO: 998648 - protein, 128 aa, Homo sapiens
MESHSVTQAVLQGRNLGSLEPPPLGFKVILLGLSLPSSWGLQGTGHRAGLILVFLVKTGFHHLGQAGSQTPDLVIRLPRPPKGVGINQGYEPPHPAPFGDSGGVPQFGRREDLPSKWQWVGPMKNMLG

SEQ ID NO: 998649 - protein, 71 aa, Homo sapiens
VISARCDLRLPGSGDSLPQPPELLVIAGARHHARLIFVFLVQMGFRHLGQAGLELLDLMTRLSRLPKVLGL

SEQ ID NO: 998650 - protein, 220 aa, Homo sapiens
AFLSVDGAERSIVKVSAYTAGRQCRSQSLLKERRTDEEALHWRVELGNNGGEPEEPFGANGEIARGSGVVNEEIAIDLSAPGAVAVGHDDATGGRMVACSLVTCIGRKPQVGCEEIVEPKSRSWCCQEVTMLYTTQGDATCKLVEEEYILIAWRCEEEVTTGEEHQSVDEDCIFGDKVSGEKVRIVELGNIMNWDLSARWANERKGGVMAFMVDLCGLTQ

SEQ ID NO: 998651 - protein, 33 aa, Homo sapiens
MWVEGQEKPPETNTTYSLPQTGGAHKKGSVRRK

SEQ ID NO: 998652 - protein, 116 aa, Homo sapiens
MWVSTLPVLINPLGQPVDLLYASLQAALDHSAKLAVMLLPEYGLEIKMLAFMPGSNQQNKPRATAELPSSIPSRKADASIILSDSYPLRTSILYRTMNHNQYYHIKYSVINNHTWL

SEQ ID NO: 998653 - protein, 144 aa, Homo sapiens
MLWNVTGSPREHPNVTRAHRESDFTNFKLFLRVRLDISVGFTSPTGLRPTAMRSARNGSCPYFVFGALGFHRRLNLCYHLVTLPGKFHRLASSDARYLLVPSLDPVRPLVQIGSRPNKPRPGFSALLLAPFSELRPLTLCICVY

SEQ ID NO: 998654 - protein, 168 aa, Homo sapiens
MVISHRWYLWWHWVTRLGEKHRRCRHNFWASLFSGHGNIFSVATNITEGTKVWGRQNPGVFTFAGIAPQTETLCRLISCYQAACVGSFNQSSWPGYTAQKETEGERETGGPFPLMGTALTSNTHRAEFCATADSPAGAHPNAGRFKRQPQINPKLELQTRRRKEAKRA

SEQ ID NO: 998655 - protein, 102 aa, Homo sapiens
MLAAKPCVFHRSGRGMMLCLAWCQRVQLFGHEQLDDLSAYYFVSSSIFIGMAGSVVRAALLMRQPFRLGIEGSEYVLIPSSAVEVELLTSPQVHVIFWITQQ

SEQ ID NO: 998656 - protein, 119 aa, Homo sapiens
DKAKNNQWNTREKTLLDHGEASATNVIGNKYACSFAYHSEEHGEQMNRYQHLMGTWCEEEVSNRLLSNKGVPYDVRCLKCSTLGCNLVSKTQGFGNSVAQQEDTFMNFASKDNSLYNSG

SEQ ID NO: 998657 - protein, 224 aa, Homo sapiens
ADLGGATEPRGDTVLGPRAGSAGANGTRVRPGVPSSYGLGGSAGLRLRVFASSHGVRSCWQILVPGCCASVVLGRVVILWLRACRMCAGDRLPWTTNNRDWLQTTWDRGCEMSCVVQEHRGTIASCKSVRTRVLASEHRWWQAGCVVLTCDAPVAAWRVRLRASSVTLGGPRRLHQLAWPGARARRVWALKGRGALPVVRACWRSWPLCWYATMVARRVSRPGC

SEQ ID NO: 998658 - protein, 89 aa, Homo sapiens
QAANGAETMASRGSTVPYRDVAPGPRCRAMLKWTEADAESRDAVPLARMMLISRVLMEQAVGDDAMTIGLYVPWLCNAVQGPCAPSNML

SEQ ID NO: 998659 - protein, 123 aa, Homo sapiens
GLCARPAGPGLAARAVPSPARSIRSLRAGSCALPLRCWMTWGLVSASAKTGGHRADRGLGGCGAPCNGCMAPAGVRDLPAAAAGGPAVRPPEQGVTSRWLGHALLGLRRCQWIHSKMFRLVES

SEQ ID NO: 998660 - protein, 207 aa, Homo sapiens
GRRAPDPGFIRGEAGTRARSRRPRCPGGANLKVPRLIRVRHAAPRSAVPGLGTSLVRGLRRARGGGPLSWMLAGQSTFAECAWGPQGTCWWRAMPLVGGTERFWSLSMPKASWEAERAEGAGDQCWPRCGRQGGSLSVAQGVRRVRISIIKFFRTGGPRGNAPSGSITCVPEEADDVRERGGRGGKGRVATTGLTGQCAEALGKSSE

SEQ ID NO: 998661 - protein, 370 aa, Homo sapiens
ARASRIASRPVAPPGPAVRGPGTPARRIFCTVRFARRPSSQRLDCSPSRSSDKSSKKRKAHTATKAFRRHKPARKGSVTRFNQLNPVKPNPHRKNNSTQQHKLQRGHIYNAKREYAERKKNGDTSEHGAQIGPPIRPVLTQEHQKDFLVNHTRVRNNFCAVTQPQKKGRTKKKNQLREKKKPPETKTRAQKEKDQRKTQQNNTNKEERKTKKQREKRQKTQTEKNNNNTHSEEEDEREQSRRKQSSNKKPKTANTTQKQHKETTDKHRQTKARQTQYTKQANREERKSSKQQNRKGEKRERRQKDKNKRKTQKERKNDRREGERRKTRRRHKQKDEKNRRGKNKQTDRTNKTKKNEKEKTKRKTKSDKKR

SEQ ID NO: 998662 - protein, 143 aa, Homo sapiens
MAGRTSRVVVEGKCPGLRRLHARESPQSEKPFVPLCAKKGSRHPGRNPRLRLPPVVRRPNPLGALTGFDARVRIPKRSNCETQSEPNQGWRCRAESLSVGHIPGAPAACRLLLPTEALNGSPIAKIALVHRTRPLGAPVYLVS

SEQ ID NO: 998663 - protein, 129 aa, Homo sapiens
MAIKRLKPGAIEYMYRRREQMKDIDNQACILAHGLILAMTLLHYMKLHVGIKSFGKDEPGAKTLRRIQIDAILVNSYQQALPSMEAQHKKWKGLYYALRRANAQLNAGASWMDSCVGFGTVRVSDRRMT

SEQ ID NO: 998664 - protein, 252 aa, Homo sapiens
GGGTRRGGVGRERAPGTTSRLKVFQRPEVVSRGCGRIRLWRLPRSATTWRLKICYRREWPIRCPPVRPHQQPGTLISPRYGWCGRVHRPEGSRGLGLPAPNPWTTHSREYPMDSCGRGEARDEGDGARSSSQQPVVRGYGPWQVGGKLRLTRLHEDASSRPSRLGPQCCHSSRVSGTPRRCRGTVVHSARFTVCSPPRQQAGLGAGPMVGVAGWSGPGTDQQGACGLLEGAEWGTCCVGYPAGSVWGAHRQC

SEQ ID NO: 998665 - protein, 183 aa, Homo sapiens
LVRGVNGVVRQGERKSVTSAELFLSPKPFVGRREMMRFVKGYTAFYDMGVHCCGRGLVCIVVALESHNAMDHSERMALSGHIVRQCHQADEASINSYKSCSVELKQTIILAHNCSGSDMSGHGSLEIKEPSRRYYLGLSCVKKPKECGVVLGVPVNREDWESRTLVYEQAGSYEVTARSVRKW

SEQ ID NO: 998666 - protein, 98 aa, Homo sapiens
TVSAGLPRCDGDLPEPLARSIAVPFRALPLSCDPLHLGIMFRKFDARQKTVSETCIHVGEHFSILMGIEESMCIDATFQVLNAMVLINIYALRKILSK

SEQ ID NO: 998667 - protein, 131 aa, Homo sapiens
MQKRPARLDERCMLYTLQSTSIACESSENGVEVPGGGGSQRAEVSLPLNSILCQSQRDSVSNFALLLGSKIREGNTPRVIHEMDALLVQGAPVDSSVIRVASAPVAAGRCYPVRCRGTMVVPPARRRGWVS

SEQ ID NO: 998668 - protein, 307 aa, Homo sapiens
TAVRAAVPPASAPARKQRAARGPAHPQAAPGSSSRAMFQACERPQEWAMEGPRDGLKKERLLDERYDSVLDSMKDEEYEQMVKELAGDPARAAGGAARLGALEAAAHRGRGLVPALWPSSMNAKALTMAVIRQVKGDLAFLFQNNCSRIQSTVVVDHQPARNGWRPLPGKLVGDPGAPRLSRKYPLELACDAGLAWAKRGKILNPVLDQPRNSNPFLKGYQLRVGTRCSNTLSFYQWLPGASGGAKGSNELQTRNAQQNPVNAPSWPYTPQVSMRKYSTCWHPRRKRCAADITNTNLTRGIVPNTAH

SEQ ID NO: 998669 - protein, 293 aa, Homo sapiens
GVSSCFRSGGHIRTDDVRTAHHPIPPTSQPVAWRLPSPSVHPAYVAPVSLSVSLLASDPGPVLCSRGGFWDFTLDDGPFMMNDEEASGRCHLRRPETRILSYPPYSDHVYYSAATCHHAGMVQCIRHMGLKSVPKEISPDTTLLDLQNIRHSPELRKDDLQGSPGTSYALVLVNNKISKMHEKAFRTTCGSCEKLYISKNHRGGDPGQDYTSSLVELRHSRQPAIRKVPKGVVQRAPEHELHRDGAGTTCENSGFRTWSLSMCLKLNYAAHLSRARLTGIRGRLPETWNDLQP

SEQ ID NO: 998670 - protein, 75 aa, Homo sapiens
PLNSSLVREDDGLRPGVIEFRYAVYQLCLATNLQNGRGAIDLVRYLRCLLDLEGHYHRTCTWIMTSYHLRGDHAS

SEQ ID NO: 998671 - protein, 84 aa, Homo sapiens
MCDTGHLHMPDGTFKAGYPFRWNKSKKGKRTKLENSAGIQSKGVAQRPPPQGETIDERTGVYTTSARGCTNTDRNTAVCGNTQK

SEQ ID NO: 998672 - protein, 289 aa, Homo sapiens
MPSILNEDPGTLRASIVTPQATARISQCHRNASPGGRGTLLGESAFNTRDQLRLRYASEATFGNSWYEALAFKEEPRASWPKLVIALINIVETLEIELETDHGVELHASEYQNTGGMSPASFDVVRLRGYLTHHGFLEHEGGNRFTQKACACSIGVNVLKNSFTPRTGSLYASQNFLKLVWEVVTMVEPRDALLTQAPTLGTEACLCNSTLSPLNSVTFHGPILDHPGSFKRAFYVPLRQKDEVAIIAESNAEEGVPDVNQWYKALAWIHEGNTTNSKRNRSTQTCDRG

SEQ ID NO: 998673 - protein, 208 aa, Homo sapiens
MATILIFRIPPNCIDCTYLCIATMQAELTYTRGQSRAVNRRYKLAKIRAITANLSIRPPSYQAHGRDERRQWRIGHTDLPKYDTYQFRIHTVADYFQNRANRATKSMSNTSLWKRYESMGSNEAPRIRECKRRHQQELGTMDRGVLCPQTREDSPIMVGQVQLAHKTVCLYGKQDHRGRGHHTIQLSTKERNFAHCLQNNGPHPNIGG

SEQ ID NO: 998674 - protein, 111 aa, Homo sapiens
KLSEELSGGRLKPKPIDVQVITHHMQRYAVWFGGSMLASTPEFYQVCHTKKDYEEIGPSICRHNPVFGVMSYTLGLHYVIGVRGGGDRRLQSYLITCIEIWMGWYMSDLKT

SEQ ID NO: 998675 - protein, 324 aa, Homo sapiens
MIAHGSRCRVERSDRPRYRGWHEYTYHCMDFIARSVSIRHRPAHDELLRRRDLIAQPKECAVDCSSRILSSRDGRSKIQESMRNSEDKTRGVRPQTGKCLTSWVNVTDDSDDPCRVRTSPPRVQRVNNGKPSCTTWSYRKELGHIDVTGVCITAYGQAWLTHDDNGWTCEVLLKHLRETDNRARRHKPKTTRTAGQHIAKSSRRTDTVSTVGDRIGHKSGGRTQPERPRHRNIIHETNDDGVKRGHIGARETAKWTLYSPVHHRRGKPRTITDHHNPKWATKATQGRTQVEKKRRSTTPRDGGGETTKLDATHGCRNQVVERDT

SEQ ID NO: 998676 - protein, 117 aa, Homo sapiens
SLRPGPRFHNVPQQIVKKRPLDLHPARSSMARLRADANTENTDAKPVRQREGSIRTASRSFIEPHERHTDTSRKNTYDDTTVNSELLVTAVHNDHDNSHQTLDMWRYGLCHVFYTNR

SEQ ID NO: 998677 - protein, 462 aa, Homo sapiens
PPASRTRGCVRQPSSGLGQRQRIARLSPRRPSDYPRNQDHDSDRPPSADPDAGLGRGPQTHGLRVERRTLHGNQTTHNETTPDIRRAAKSRPTEHTQTKPHRKALSHREGKDRRCVDRETTKQVKHHKPNPHRSEHPNTPVNQTRRSATIPREEANATGDVKHMPGQRRHREEDDPGDHHRARGRPRDSDAHTAGDMDANAPVNTSEPRRHTAPQSAPAERKTAYEKNDTRTQWTPHQHKQREYLTDTAIGARRRAHTQEPEADGEQQHNEEIATTSRDTHTPSETNKKPIGAQRDQAVETTEHIREQSLTTGPESTKYHEEPDPQAGNMPHANTRRMRKRNANRSNSNHVRHHIRATSQTEPRGGTTPNRKREPNIDAHRGTPEQERNHRRHQQEAEFGETRQQRWASADQAKPTLREHQRRSKIDQMARDHKKEGTTHTTGERPRVAVTRGVGGVEERYR

SEQ ID NO: 998678 - protein, 309 aa, Homo sapiens
MEGVEEKKKDGSCLCHETPYDTQRDTELSQTLKINAPETRTFAQTRCFEHGNGRTRLSTDKKQTALLTQELSGTMYTNLKIRTGRGLAQTTAWQTIYVPLHDTQNLAILSIRHSGRVSTGRAAQHGFVKCVSAKRSIALSLKHLHMDTICDSSRTGISIYTMLKDLYEPLLYALGGTQQNLNRSGKRDTHSYNALDLWATTQYRSRTTSLDQTHRRISNMQSESPWVNITGNQLLHGGTIDSDEEYKLRDRANQHNKRRDTIKITLMGPHTNSMTQRHRDSGTCKTHTHTTRTGTKGDTKTGSKRRNRR

SEQ ID NO: 998679 - protein, 457 aa, Homo sapiens
FSQLLAQLNLSPLGAVPKKKTKKKQTKTYFGARALRALQKTFLNTFRLGRAAGPQLGKGRPWAIEWFTNRGETPGQREHKSGYGKFSPRSNIKHNAAGRGKTPRERGFMSTKLSTRVERYSEEEPTRQGRPLITTARRRLRTERGPTRKSYKELTSPTEPRGGKNEKTGKKGTNRKQRKEREKKTRASKKTREKKHDKETKREQANQNKTETNRSNSRNKQTRTEEKEREQKHTTREEEETERNEDREDRGEEKKEEQKKKRKEEQKDKRTTEQEQNGEDKKKVQNKMKIRDRGRDRTRTLNKQDKRQSKENIQHKETETKRARRESRKERREEERRKEKNEEKKRTRTQRAREERARARDRQRQERTERRREKKQRSERRKQRKIAGRQQREKHETKERRRENKTEREKKRKTEKKQQRNREYEREKKTVREKSQRRKRKRQEGYKKAQESREERE

SEQ ID NO: 998680 - protein, 157 aa, Homo sapiens
MKLFPVEEASVQRFPHKEPRKEKKGREIAFNIHMRYTANRWGLVSRNPVGRPNIHTVHQTHGAPGAYGEPPRVESVVAVVQYGMGIHCMCGIKGSSTRLQLRTPRNCNDKTRSVEGPQTEPYSLEKSGSVFHNRLLNYAWNFRCPRYTHGLAIHACQ

SEQ ID NO: 998681 - protein, 118 aa, Homo sapiens
AAIMDRQVHESVVLENAGDYVVVTDNNCYQSESYFANYLLQLEMATLCFVIEEPDLVSYSPRISLFSLNRVVIFPECLFDVLDHIKASGIESSIAGMLAIVSSIYAVVELSAGHRWKT

SEQ ID NO: 998682 - protein, 264 aa, Homo sapiens
SLLVNPRPVMRRTEDCDAGMLSARVMTMEAWEGSTGIRFEAANANRIPRPIAYLSSICTAWHTGHQGTHRSSITTRASTDVAHVECNWLKAGPVPLVTLRRNFAKRSGIRGELTSAHIGVKQVDIALPIDEEINHLDTGPNHGTRNTAYNTRVKTMKHRVLRDSPTYEDQRLSIHADKTAAPYAPHMTLNGLPQTDGTTVTSQLNVVGGTQTHWGASPDHTHRFPPIGTTPDWSRTDIHMSNQSQNFPRPSGPRLRAPSHTNSS

SEQ ID NO: 998683 - protein, 46 aa, Homo sapiens
MHTRQPVQFDTPSSFPSWKEVEEILPFILDVTLPKKLVRSGLPHGR

SEQ ID NO: 998684 - protein, 55 aa, Homo sapiens
MSNIVPPRYGSQTTNLPIYLSNTIISTTDTSPAARSHQRPCTRRAHPAGLSTTTC

SEQ ID NO: 998685 - protein, 183 aa, Homo sapiens
ALSRDRLVSACILLHRTEVLNYSSFPVALVSCQTLIESVSIDAAESFEYYAIENAYWSTEWSAWLDSFELKEVRRRLSSLVPEIISVGATERDERYTRSWTRHGIDLLYTMALLFRTSTSVIIRGAYPFSTIELRTVVMRGKNPRQKDEYQFTVFECDIAFMAVHRVRGTFFCRTAYLENDMG

SEQ ID NO: 998686 - protein, 202 aa, Homo sapiens
MGPRVSRADAVLVVASDSDGVSTMHRFVGRTDTSPIPHEGIHCDAMQRTSLPICPTGPVTMHATHNVNVGRHDVHGCMDVPRRNTRMTHNGVRHYHTSVDPQGTCREQNKNTKGYTDIVQHDLLPTGVRSHDCMGLDSTRSTQRTLTLIDQKWNPYQREWDPRAEITRVKCWAKHMGAMVTVAMEPLGYAQGSSEEPFLGTH

SEQ ID NO: 998687 - protein, 117 aa, Homo sapiens
MLKRGFGLLGFLSGLLCPSSFCPEQVAVSTPQSSFCMPCRLLYRQRAESPEVSINEPALGTNSGGGRPRGNQRCEADDNYQTTRQFRTESDIASNIDLRCLNSQLDKYWYSRGHTNS

SEQ ID NO: 998688 - protein, 376 aa, Homo sapiens
GAPAAGQAGLTSTSCLCWALTGDVHALVSRRTLAASLSLHLSLPPAAMAAGCARWLCGWGPQAAMAAGAGAGSAPRWLRALSDAAERGASCARLGGAPANSAAGVSLGRARRCELYLDLAGSSGSQLWMAPNSITLLGLAVNVVTTLVLNLLLSHGPPEEATILGHDLPLCTWELRSTFNPGHLDCYSTGDNQQPQQGNKALGTQLSVGTLIVTHWGVDSSFPARHITLGTAEESIPNWPASPVRQHLTTLHMDDTPPVHSFHYGAMVRTIQTMRATSGQRTLKGSQTRGHCIARTTGHNRWPLARTGNNTHNSSCDAGNQAQRRDRSAGTSGTGTTPNAGRTTHGEIPYIRQARLNRGQRAPPRHIGPHQTRTPR

SEQ ID NO: 998689 - protein, 309 aa, Homo sapiens
MPGREQAWMPACGQWDPVTYCKCAGGTWLTHLGSHESSALLLARKHARPACGQDSRSSTRHQGHTTTAMAPSRQSCEATHTNDHRQSATEQGQHLRDHARTGPCGAATVNGSGLHLTIAIAHRKQLQRSQPCHALGGLHCPSYTPAGTSRATACTRCDRDSPSDPPSAASRTTPALTAHPHTAVPARHIINEHKALSPPFQRLRALSRTARHITGPEVALAQAITLPSGTGLGGANEPGKYPRQGPPPGNAPDSAPAQPRSPDTALGELAGRHPSPWAPSHQLQPATAPPTQHTPPTHPRAPHPEAAHP

SEQ ID NO: 998690 - protein, 171 aa, Homo sapiens
MFIAPRELVGLSQTSDSRARKTGHCDPRAHEIQLVRIFLHFFPLLPSTRTRILHAQGGLFATGIGGAKLFQKGQILRHVPHGRPSAVNQRFIVSPTRQSFVRRLLCNRGLTSVIRTPSRAATPPVKENILDSSGLPLAVPQTRSRAHLFTISGTWCPPSLHAASLCFLTSV

SEQ ID NO: 998691 - protein, 109 aa, Homo sapiens
MPVNFRNLGNPDAGQHSLCRLTELHRHHALAHSIVHKPFELIRIRNSTTPSSQAFSGPHALYSPAIFPANFVSNARSREPPLKRVSGSFAALCPVGPNPARLQSPTCTP

SEQ ID NO: 998692 - protein, 76 aa, Homo sapiens
EALRQPAQGVSAECGRESESLSDNRENKVSSVIIVNDDRVLNDNIISDERYQIAISVDIGIIAVSDFKFLNVICCM

SEQ ID NO: 998693 - protein, 109 aa, Homo sapiens
RLDAHMTTYRDLHEATHSSLSEEHIQPSRLFHKVPLSPLLFIEEFTPLMYIASKEHTFVPKAHAHRMGLARYDCTEMSPGERMDWTMEYLTALIHRCIKPPVLKATIRR

SEQ ID NO: 998694 - protein, 46 aa, Homo sapiens
MTANSLYISNASVRHNMSNSIEERTTTYNGGAKKRTGKTTDEKTND

SEQ ID NO: 998695 - protein, 69 aa, Homo sapiens
LKAGAVRERRLSVDGALISVLEQYQIYVMMPEEYNTKPRSDKATRFNFLAKSSVYPYSYAQMSNTYIGV

SEQ ID NO: 998696 - protein, 76 aa, Homo sapiens
MALKCNRSSAQGSLPCCSNLAPTNAQHSAGLRFLFLDCPKKEHVGPSRGFREDPIVLDGRVGALVGPEPLWLLGAP

SEQ ID NO: 998697 - protein, 120 aa, Homo sapiens
MVAGLAEGASASPKVGHFARSGGASRTLGRTCTEWPVLSLEITVRIGSVKQKDSCYMNKRGKTTRYVPLDTRALHITLNYRDSNDVTGNRATCIALRRKISYRGYHVIRISLWAVKPGNS

SEQ ID NO: 998698 - protein, 343 aa, Homo sapiens
MTTTDSWPDISDTMQKAAEHGREETDSQDTEVSTARLGEDTLRTRQRGTRANEDGLEKKLDDIHSIARQVNTKTCITSGETLRTEARIPVGPSTGANGNGPLQAGLDVEVQGIVERLINCHRTPKEQKTGKTVEARTTKRTKGIAKNAKREKAHRMGEYMGYRRQGGQQGTASDVETHDGKSEQRHSMGPEATLHHRRRVRRARKAHTGTARFTRGHARHVSHQKRSGDTVMAQRRAVATTQGTTESSKEKQRAKEVSGCRRRGEPGKVSRWGHTKVRYQQLGGTTGWNPRENTGDERARPPDSAQSDSVTRAAQRRGTIVTDPMRGKPHRQRAAHYQRERTR

SEQ ID NO: 998699 - protein, 88 aa, Homo sapiens
NSYDTAEERQTLVLLCINISIINNNKDRTSIEHIYCRLILNKQRGQLDKIAKEDKYEEKTKDNKREQTQTTKNIHTTKKDKNRRTREN

SEQ ID NO: 998700 - protein, 85 aa, Homo sapiens
LYRAGFDGVMSHRKFSDSRRHGSRRLILPRKAQTAGNDGKGEELPLRMTRPSRSTLTAFLGSTIGWLCTHSCGERRRWLGDSQRL

SEQ ID NO: 998701 - protein, 147 aa, Homo sapiens
MVQLFRHLSTITVGTSKHTWIQWHNGAHRVDLWATVRLIQLRSRFPQQVIFPASTLVKQEIVGRLLSQGGASNTSACRRHRTWKYGGSVQRLHYLPAPNNQLLSAYVNHLNRKSAPTFMDQPISPPELVVHTPFPSGPLNQRRHILG

SEQ ID NO: 998702 - protein, 210 aa, Homo sapiens
MRTSGASASGPALPLDPPDKPVRNPLTRPSQRKLLPHKTRRGGATYCTGTSTNNPEPMDRDSSPNRSVTRYLCPFWGTTFTQHSAGQRNHCITSCKPASSHLPSLGYSTAWEIRVYRELRLHSHHSQTYPEPTEIAPLQRLSLATQTRDTHQTSRTLQNLPSCKPALAYIGAPDATEDTFRSPNRAGSAGCRPSVRPTGAPSKATPSDTA

SEQ ID NO: 998703 - protein, 305 aa, Homo sapiens
LPSHLALGSCLASRKQLHRGGEPRRISQLQSNSNTEDSAVATMGSVNSRGHKAEAQAGDDGPGTRAGQDHSSFTSCKGHQLLETLPTVGFNAGASDSSWDTLSLTSLANRCEGQAPASEPSLERTIWTGTDLPRATLTGTATDEARLPELKPAELTEVLNDPNMAWRPLLGAGHKAGGTCCHFRLLTASRHQADVYEKNTTDQHARELRGHDEPLTRRHGACRRHLQYRLLQPSLHILAKPSNAALDKGGTSPPGSARTSRQHRRTKTHGTQDRSAARSARRQSPTHGEKPSGTAGDKLDDDRHT

SEQ ID NO: 998704 - protein, 292 aa, Homo sapiens
LFFLPTCEEGFLSSPSPSGMIVGSPGGLPSPCRNCVGQLNLMFLFEIAQIIEQDFFCERVVKTGHNYQLVYDLSIVDRSVVTHPEFFIVHSISQAECFCNLLSQCILRSTVPRSGCLCSVYSLNRPYWCHSEQMKVQDTLCVGHGDTPELGHSTWAPWIEVTPKTPRSYGRERATDAATRTWSFTGGAFRGQYSRNGTLEILLGNTKTSERTQYRHLRLYLSYLSNRRSYAGSSICRATTRSHVAGYEVALGVAPVDIDRSRHTDRDDISTRRKGPVHSRPSGKERLAAHVE

SEQ ID NO: 998705 - protein, 137 aa, Homo sapiens
MRFPKCLEFTKRELRRIVLANLGTVPFNWQRDGSLGSPCETGALITCCVVLCAYLIRIEGFSLNTKIVQGQSHGPRNPLVEELATGRSGATEPLDVSLRFRSSRRNAGNCSISGPSKCACQFPWLDRIQTSSDQLGR

SEQ ID NO: 998706 - protein, 120 aa, Homo sapiens
MCLVNRARLVSLSPRITLFSLTRVVNPKAFSTAKDRHGSDESHVALLHLQIYAALNKCGALMKGYGDPLNLKIRGSKLAGNARVIDMSPRVGLLPQEVESLVSYTSVGLMLPKQKPFESK

SEQ ID NO: 998707 - protein, 270 aa, Homo sapiens
MTSLPLRILSSILITLTLSRINALSQLHSHPLPNRLNLYTHSPFTSHQASYPLLSFSLNAHFTYITLPPPPLLYPPLSLPSTWYRSLLYNQKFPGSSLHLPAPLLPTSPFTLPPCAPNRAHLTPGHPPRSRPPKGAHSHARPQPAASPATSFHPQPNRCQHNPIPAPLSPSAASPNTPPTISIPLQHLFTPPIPIHKNSTPLDPNYPPTHPLPKNTHPQIPPLRPITTPPPPATTPQPPPPQTPPPRTQPATTTQHPFPSPPQPPRAPPH

SEQ ID NO: 998708 - protein, 111 aa, Homo sapiens
PDVIPSCADVLCESADCLYIITILLFLFLSKCAVTDEALNGIIRWSIGAVTHPVSAPSNYSIILCEAKRTDRRVYQLVDVVGAIIDVDTRRCHPCVVLLDESRVIVLQGAS

SEQ ID NO: 998709 - protein, 284 aa, Homo sapiens
LLTICMSSFEKFFGHEIYFVPMCEPPCPAQDTKSSVQKPQAFLYTNNKQTESQIMSELPFTIASKRIKYPGIQLTRDVKDLFKENYKPLLKEIKEDTNKWKNIPCSWVGRINIVKMAIPPKVIYRFNAIPIKLPMTFFTGTWRRTTLKLHSGDQKKRKRKNNKKTRGGGRKGPREKSFSRHPRVGARGAHTYGQGNTWPQDGCLHGEETAGHRNKVVAEKLPTPENEKREAGGWKTHEQGAKRETNPGREDHEEGEVKGGTLIKRRGDPQGAGAGSITNRPGTA

SEQ ID NO: 998710 - protein, 257 aa, Homo sapiens
MGLGVRGWGRPLTDCGHRPDAAREDHPGILGEPRSSGGHEVTPTLQDPTWHPCAYGGQHHCGGFLSASPLGGRRSAQLLSATETSALAWWCWAPEVLSTAEPSEQVFGIDALTHASPTTSAMSRANDIWLLRLIGSAVLGPAGGGMLRHAREKGQDPTAAGTRQPGWLLEADVSDSRGGIAAMELMAGQRSELLVPGTSGERAPGNRGTMTLTHGSGTRKWGDRPTERGLLAPADIRRCPLVSTGNRSTMDFVHIIG

SEQ ID NO: 998711 - protein, 71 aa, Homo sapiens
MTGHAETKQLTEMLPSILNQLVRTSLTSLRRLAVALHKQSVDGKAPLLLDEDDDDESSMILWRTFDERSRM

SEQ ID NO: 998712 - protein, 81 aa, Homo sapiens
GAVVCCINPVSAPLRNCSVYVSLQGCCCVEQASETDSHVSHVDSVHVMADNFNPSMQLADIPETSNDNNWLYYVRRIGVTS

SEQ ID NO: 998713 - protein, 302 aa, Homo sapiens
MARGPKKHLKRVAAPKHWMLDKLTGVFAPRPSTGPPQVERVSPPHHFPEEQTLKFALTGDEVKKEFALQRFIEIDGQVRTGLLTYPGGIFMGLSIKHLAKDGEKNFPVLDLIEHPKGFGFCWYHSVIYTTLKGGAQGYTGLVAKVEDKESFGAGHQKGNSPSFWVELPLNGPGTNSWLTPRIALPFNRLTLYTQFQDLDFKNDLGKGFTWISINSSTTGVNLVYIGDLVQVLKPQEEFACEFTIQQSRHLVDPLTVVHGEKMPNGKQALATRTFPTCGDLAKGNQTMDFSSPKDRVIRLHHC

SEQ ID NO: 998714 - protein, 44 aa, Homo sapiens
MPLFETKKLNSAGNFHFESAQQLEVWHTKPCSRIGAKKDFESTV

SEQ ID NO: 998715 - protein, 147 aa, Homo sapiens
MPEMPEDMEQEEVNIPKEEGSGYWCHVGFLAELYTKNFSRNNWHCQLGCGFRTEQGPKFEPGSICWDSELPGSSTIHSMNFFKAPMLIVPFVQAEEKDPDVRQKNHASMLAFFKLTLWHCLLGHIYAKRESHALLCFGNAFSSIVTL

SEQ ID NO: 998716 - protein, 122 aa, Homo sapiens
MASVVPVKDKKLLEVKLGELPSWILMRDFSPSGIFGAFQRGYYRYYNKVTFHVDRKGEHLGGLTMVAGHATVLFSLLLFPLTKHLNATTGFRKITNLKREHTSWKPPRDPNDPFEPRKPPFP

SEQ ID NO: 998717 - protein, 204 aa, Homo sapiens
GSGWTAAEEARRNPTLGGLLGAGSDCCCGWEGAGSAAPMERHGRAFRTSVSSAWEQAAGGPPKGPGGKEPNWRRPGEQGAVRLPAGGASGLRGQHEGRRIRTGGLLNRRGPTFGSSPAKARFKKPLEGKKAGAAFSSQCVMGHLRLFRLRQPSWGPTAWVINFLGAPINEPFHLGLNRTETTRKTVCDNGPFNTKPISGTGLPV

SEQ ID NO: 998718 - protein, 126 aa, Homo sapiens
LVRKRVCRQNTGVVKTTPKSQTWERQRSTHINIVVIGHVDFGQVPPLTGHLIYPMRVGHRTKKNHLNTHILKQRKGFGLETWGTHGAPFQRYWPWGFYGITTWNRLGAVGNGWVIQSNLDIIPTLW

SEQ ID NO: 998719 - protein, 178 aa, Homo sapiens
MRLEMFDKLPQRKCLMTQLDHRMLLSRCNNDDYVFVCRLLHCPLPGLQEDKARLTEGCSFSGGMQHLRSTLSQDEWETSLNKHILQKQRQAEELIHTKKKFWAAGWIPPSGRSALHRTDPVCVVARRGAHNEESIKQAGLQQVIPKGKNFGAPNHTGSREFPTKYKKPLRSNTEGFDT

SEQ ID NO: 998720 - protein, 161 aa, Homo sapiens
MSLATQLEHIVGDGCAVTATHVARTYGERHEPILLVTRYAPYLWSTDRRTTVLRDGHQQNNEAWTRHAHQRSGAHSSRPTVHAHGQDKQQEAEALTNRHDKATRRGKITHQNKDKKLIKSTRHRGTARATQLTIPQHNQHAKTRCATNLTTSRDTTDGEDC

SEQ ID NO: 998721 - protein, 283 aa, Homo sapiens
VTRDGCLLPDVTVEMPLIPCSGLVACCGSVCVTTHVADPEGGCLRRACKLEREQCPPSLVEPGDLMHGNCWGHLPGMSVGVMPSSLEAAKLTLGVRKCSPFVFPSREDLGSEVLSCLATHDDVARRDAIRQVVGNTDCEAQGHGNGRTVCLCTTSALTPLAAHLALRSPGRPDKNDGEKPPLVVVLSAPDPGCINSSRHQRMTTPFCDYMELPISPERCPYSEHTHQHRPRKWHLTTEDTTFRKLPPATWAYTTEFYRHFYPATAKRPFHTTNSPITFYYCTL

SEQ ID NO: 998722 - protein, 273 aa, Homo sapiens
GLNDHRMTGCRVHDASLPSGRAGAWGLPLPPATCHVRADRAEDEKPLVLEMLEGRLCKDTGKTRGPPLPCTLACLALLLLAAGKPAVCAFVLVFLRPGPPPAGVPWLWPTVNAGAYGPDVGSLASGGWPGEAPGWPCGAPVTCVRVLALAPGHNMQGDGARVSRLSVSRWHRRRGSGHGGCWPSLEARASGLGWGHWGDPRDPATWSHVADEPDLAGGMGERGELTFRKRDMERLTRHVPTQPSIVYCRAPMTSVVHYGHPDLTARQILTSAT

SEQ ID NO: 998723 - protein, 183 aa, Homo sapiens
MLSWILPRKEECNDHGLRNTQTCQPLRLSGLCLALMGAIDSRYIHYLVVQLIAIWSLRDDPNSAIPDNNRYIMSIFGRRNRRQHAVNNNKQHQQQPAADNEQQHAASSTQQQQQQAAAAAASGREQLTARHKQSIVPQTRPHTRGKPQRPSNHQSSSELHKHYSQLAPLLENQLSTVIHFTTK

SEQ ID NO: 998724 - protein, 478 aa, Homo sapiens
GQRPLFGLPSRSRDVGRTAVDQGFADIRGESQLCERSIAGASQPSLVFVSVLRCCLPPQMSIALLPGRGTSLLDIAFQSFVLCGTLRAFVQLVITSRMARAPQFACEHVACQVRNRVRRDVVAFPRIRGETLALPMGRLSLVAYSHPLVMSRERRRVVRAPSQTRVVCPGLSFPPVYRPSVVLRSLRYGAMYIAWESRSLPPTRPMTGGVSPWHLVLIPCLMTPGSGGFDQFRFGPIWYSLSDVSGFPRGEASREERGSTQVFPLLPILVSLKHKLKCTPRLRKEGAGVTPAPKQGLGIPWSLFRGKTLAQTNIIPLAPVKTLLWRPPPGAVRIARSPWTRRTLPSSLEAQPGGPCFVASHKAYFTDVPPLIEEFSMRGVCFHLGPHTCVSVVAPLCRPWGPCLFLPLGELRRASIPGLLLLPVRAATLVPSPGAFAPERARRGRPGGPSFPCVHPFHRNWGVYRKGARHLALRAVSP

SEQ ID NO: 998725 - protein, 98 aa, Homo sapiens
LYDGGARVERVGPRGSGKRQELRESLHSRLKAICAVAVLYGIDARRLVESSDSRNGKQDMNERCLGVHKRCATGECNEIVRCSTRGSCMGVHTQTVVA

SEQ ID NO: 998726 - protein, 138 aa, Homo sapiens
VWSVFRCPDTDGQSQDYLNAEEHSTMTAENLDSDIVSVAASCPASSADLDATTLQLLIRERVCSKLTLAMISSMDYYSSQWLFEGTIGGVVIYSGLMGISLYNTAAQHDLTKFENRLLVLYVDQHKHTIAYVRAHISG

SEQ ID NO: 998727 - protein, 269 aa, Homo sapiens
MGTQEVEKVQAPGPVKEIGPWFTVRQKAPVSQFVVAAAEVPYGNRLEFFPIHGVEFQNKSLTVTSGASPERTSDLVKDYTDLEVTGASTQARGEGKQQVSVALISSSIRVAMLEDKMGSASSWQGKPPKKINTESSRLESRSPEKCVLVNLSKVGEYRSEHAILDREKGAHRRLSKDHTTELLRMCTCGMSEGLSAVFGIRSYPLTNLAMTGCKAKTEKPMMLKVHCTFLKIGVAMLKGSHLPRAKRIGPCQVQTFSRGASHGYNDQKA

SEQ ID NO: 998728 - protein, 101 aa, Homo sapiens
PAHDPYQGARLSPPNDLRRYSHVICTSDRLDKRSLILEPTNQSHRNHYTKEWLRCNDERSTVPDGPSHITTLSQDKAFVVRCIIPYFSYLSKFCLLRRGFV

SEQ ID NO: 998729 - protein, 240 aa, Homo sapiens
MVSGREQREERRRPERRQDEEGEGRGGERRGGRSTGPGGGTRARGGEQQQQRGRGDEGVENEGRNGRNVKRGRTRRSGDVRMGKMREEYERGEKKNREGRREEMKRGGMKRKEEHRRTTPERRADRRQEAKDGERRPGARKREERETREGQERTTKQRNGARESQTTGREERQRERRGENRDEEEGRREKDQYANEERRRGERRRRKDKQRMSKREEIKGGKRQKKGEETGTRDTKGEEK

SEQ ID NO: 998730 - protein, 110 aa, Homo sapiens
EERDGGALEAECPLAVPKDADALLTMRTPGGSRTVLMISAISSETELSHRVVMDERAYTNWYIDAYHCMALIGVLHFQLVHTSVERISTKLVGMHPCVVLLYARGRSLYL

SEQ ID NO: 998731 - protein, 120 aa, Homo sapiens
DAHEDSLFWSHLDTVVLTEITLLKRTSYFSELIFFLAGISAQCALDNQYADHSVCVSRLEIACSCKIGKRIDCIPYSPYQYLQAPYMDIRSDWLMIATLRDALPMISSRVLEITLLRALQ

SEQ ID NO: 998732 - protein, 297 aa, Homo sapiens
KAEAKNVLVLSDPGLRGFRILGLLSSVGLAVLHEVSIRAWSPDGPRQRSQSCSCPKGHVDPCVCLQEPQAGRGDVMSVAKVLGLNRHSVQSLGDLRRREDLVLVVIPMDFAPEPVGARLYLRAPVDVSDIETGGPEFRVPLVIPARGCLQERLGFVEPLAILSASGWGSFAPGNPDSPPAARGSRFRLIVLRWCPGRAFQPLIDVNCVLPSRLSPIGFSRDPPSWLCDFRRQRLGGFQLEAHGIRSSACVVTALVIRMLIPFTSRVGVKRALERNSGNLVSAVRASFYWRSPIGCGP

SEQ ID NO: 998733 - protein, 109 aa, Homo sapiens
MRTLRVAPEYHGQMNTHALRMRSDHSDASMLYEKKSFLIKVFDTQMCMFLEQGTTVMWEAFRCLVWYTCRGQQLERTLQQAGHALHEGNFVGRCHCRLMKHILRPEIYL

SEQ ID NO: 998734 - protein, 80 aa, Homo sapiens
MTIDGYPRITIYARIEQRGRFKFPNLIDHPREGYLWIRKHSPQGPLQGSRYEKPPNKRFKSPMLVLNEGIDPPSITIEWN

SEQ ID NO: 998735 - protein, 109 aa, Homo sapiens
INPLAQATSSTLPSLQAHRHHTGLSIALGFFCILEVGPRDTRTSDYAFESPKVLEPIKKYNPRDDHHDRHAESKVYFPYTGICEIALSINPFISSISFVQTRWTSSGDR

SEQ ID NO: 998736 - protein, 178 aa, Homo sapiens
MRAAGDESSEPLIAECVYIPFPGQDIGAGNVKGGNVSPRHVCGRDTPSDDHFDKISSKRLDGIMTSRHERSDRVKDDSGNRSCLKHVGYWVGPNHAENCGHLNEVVSNFKRELTVTLTWLKVAPRHGLTQMAVRGTGPLQVYVTNDDVETLQYEDVLDDDEPSSVSCYADLALLVHAL

SEQ ID NO: 998737 - protein, 75 aa, Homo sapiens
GMVGECRCRCVGRFVLEAVFVYHHPIRRYSSYHNVRCGHPQMRIDSRLEHWSSNDSSLGPPIHVSLAGLLEHTGP

SEQ ID NO: 998738 - protein, 194 aa, Homo sapiens
EVLLRAYRDVRCRVLSEDVLHRWLNKLGSQDILGSDEVAAWEFSTEIEIERSGAEADSSYANNVLTDRASYARALRVYRKCLVQMKVRHYRSEGVQDQYKSLSGLPNGVKTRKGGGGRLVTNCRRHPIGMSMMGICCGIPVEKPTPRAFTGPLPTELVRFALEHQSRGLKLHRKGRFPIKELWAIKSLRNERPF

SEQ ID NO: 998739 - protein, 142 aa, Homo sapiens
MVVVEVGFLPGMKQIGNVAALRLELFIDLLGFLMSIQDMGLLLANVCSLGYELIAEAEYPQGGVGYDINCGVRLLRTDLGSTVMSSLCQEQTLPKLLFDHIPVELGVIMVCIPYEMPKTWRTPWEMGGWTGPSETGMPGLND

SEQ ID NO: 998740 - protein, 114 aa, Homo sapiens
MRLCVLLSPGCLQNWWYWYCSCWASGDLVFSNPVWWSPLLPVNVTSGSHNLIVRCTMYALSEALPWGPCGLQWSRMCLSRMFVVATLLVTANDDPSIGRARTGLSIVVVMVIDP

SEQ ID NO: 998741 - protein, 89 aa, Homo sapiens
MGAFESVFHSAVERTEVARGLRDTVVSKEAPRERGALRPGQKRILPVNKRPPGSIEDPPEKLGVSVKETLGFSTRCEGGPESSSRGVVD

SEQ ID NO: 998742 - protein, 102 aa, Homo sapiens
MTAQSFHHRLAEEWSYQYTLVACLGTDSAAVGGRYDFWIDCFTVTLTQWDVSCYNWCSAHHRVMYVSVMVCRELCVRSGEYESNPRAFELQASMVKIALVGE

SEQ ID NO: 998743 - protein, 149 aa, Homo sapiens
MVSRCSRSVQVSSSLLYVPCSRGPPVCGPVYLTGIGEIHEARDARTSLVEPSKMVTIWIIYGDVAEELLFWRQCAYAWYILPLADICMRNADVHDNYERDLVFLGHCCALHAMTLYHVVSEQRNKKPWNIEREYADALVQTPQVGVHVA

SEQ ID NO: 998744 - protein, 135 aa, Homo sapiens
MQEVGVGLYPRYLLCYNRQTVTPTVRLCTMGPTSYCEQSETSRVGEELTICYLDMLMTSEERRKQLRDQYCLELDCFRCQTQDKDADMLTGDEQVWTEVQESLNPIEELKAHLARGSRVVAMCQAIIRSNSERVT

SEQ ID NO: 998745 - protein, 69 aa, Homo sapiens
ISILVDSRNGGHRVSAPEPLEGCRKDYIWVVSRDSCSCVVTCTPVEPRYSSHRRELSSVEARYILSRGR

SEQ ID NO: 998746 - protein, 253 aa, Homo sapiens
MTEPWLSLPGPTRGSTTPPIYAHYKQQHPPARTAPLTYLVPKGIACLHSAITGKDTLAGQGSSYKTTKAHAPANLRQHEPPERLPATLMATTPTLTAPTGHAPHPPNAHHPAQRATTTNALANRPERTAPTLHSAPSSGPTRVDGPTFERFTPSTATPPVSRHGRHERYHAFVLTGADHGSRNEPNSKRQSQLATPHKERPETKTERPNPSTTYRGHEHLKQRTQAANSRRPKCKTAGHRTTDSKQQRGNHTN

SEQ ID NO: 998747 - protein, 100 aa, Homo sapiens
MEMVGVTSLPGPSGLLTGTTFANGSLSIACCPVPQAVTVRAPSGCKGLILEIALKSGLARKSTCFRARRFPIGNRAEVDELSSDLGARTQDYNKPPKCLR

SEQ ID NO: 998748 - protein, 242 aa, Homo sapiens
MAPSRKFFVGGNWKMNGRKQSLGELIGTLKGQGAGRHRGGLCFLPTAYIDFGPGYASRRLPRIAVAAAKLLKSDYGACTGEISPGMITDCGSNVGGPGALTARRHVFMGMSVLMLIGHESAPMLWYRDSEYIACIGEQAICNEGNCRSREKVVCRARRKVVADSVIGLEQLSYLAFEACVWPIGTCPVLLTRQQAQEVHEKLRGWLKSSVSEVRGSEHPFHLLQGWDWATARNWHPADVTGY

SEQ ID NO: 998749 - protein, 43 aa, Homo sapiens
APLAWTTISGSSMSLALHHPIQLMVVSPDWAFAHWINKSQTKN

SEQ ID NO: 998750 - protein, 141 aa, Homo sapiens
MIALIASPVLVQTRSEIPSHNEVDLVGQEIALYPFSLVSDPVLVDTISRINSKIFSVEINSITITEFITYKVYLDLLIGQGVYCKNKPQGIIILLKPATTSSAPILYPTYWFVLVGEHKREGLVFTCLEVSLRGLNLGCPK

SEQ ID NO: 998751 - protein, 75 aa, Homo sapiens
DPSCLAMLEVSPVKRHEDGDPQLDHVKQFSQLVVVRHRATSHGPIDEYKTPGCIPTLTALAPSVVLCERSTPYRG

SEQ ID NO: 998752 - protein, 109 aa, Homo sapiens
PRSHINVVCLRAAIIHNDYSDLCRCMINVQPAHPQFAWYAKDGLNPEVCTFNPNASDGEILHSFHALIGISGYYYLLANARRRSLTYRYYKRLRRTVSIAPEKSVNIKV

SEQ ID NO: 998753 - protein, 163 aa, Homo sapiens
ESGPYHGLDKTHKSVKIAPGAVVCVESEIRGDVIYRTSDSDPPYRQELLSEARANELMGEGKLLEEQVGLIDRICLTQILSLLTPKIQNQNYDHCTNNVFDMWVVIPNAMEVWEYNNVIDSRERICRHDRNVTVCRARWLQSLAACVQPTSIHLNASVPDEYG

SEQ ID NO: 998754 - protein, 134 aa, Homo sapiens
MRTSRYGTGLFIVAVTEKKIIYGCKVDDKGIQRLLYIQRRPIAHSAEQRSEHALRSGSKLAIWITLELQKQSVEHSMVFRSSEACQPVNKRQSIMEERIPLMRVIRQNPSKYIPWEHKMICVGNLSKRGRKGQT

SEQ ID NO: 998755 - protein, 106 aa, Homo sapiens
MSRIVKSYAPPEPKSAMIHLGERAKSVSKRRISLFRKEEEIRKTTWLSLNSPLWTLGMNICAHSPAWYLSLSSSLGATEGECVSLPSLLKAQSSAGSANALGQQVE

SEQ ID NO: 998756 - protein, 68 aa, Homo sapiens
TGVIPSCAVVSLEQRAFISVRPSLLPKCVPPTRWKIRWIMDMSPLRSRNIFLGCELQADKYYHFKVDN

SEQ ID NO: 998757 - protein, 117 aa, Homo sapiens
MGGTGKILPQSRTSKNRRRGGRRTTGERSITAHKPYSARERRKKLQERTQQTAGKTTATKEREIANREEKHDQNIERKVNKGRTNQRDETDTREQNEGGKRTRTKEGEADAQHDKHN

SEQ ID NO: 998758 - protein, 242 aa, Homo sapiens
AGQPEAARAQVQAGPKKRCCRRCMPTVCSCHCARGGTALTSTRAHWTDRNLCQDCVSIRWSLRRTRPVSVWCTTGPPRKNTVQSTSHASCRWVTVSGHKTRSSGLTCNGRDSLGATDVRMIRGLNCVQGWGNFKAVAFYRYQRANRLGAPNLSIVDLFTQDWTSNARSVLDWDKERCPPAGWSHRKKTVMNWAIAGFRRSPDTDLVSDPFAFSGSPTDLQAPIFFPQYEPEEKPIQIVQGAN

SEQ ID NO: 998759 - protein, 68 aa, Homo sapiens
LLKHSFVVLISILHEYYDSDGAICLISLTQNPRSFDYVVLRIYHQVTHNRCEATLELLDTHTSQMSSF

SEQ ID NO: 998760 - protein, 364 aa, Homo sapiens
VAGPGELVLAEFQVMLALSPRRTLPARCGSRKDSEILEGQPGKEGVEYGAVLLPSPGARSRVTIGADPGVTLVRDAPLGTRQDSCDSVDSTGCYRRIGPSGYYGLHALNPFHRYLPFNRPAMVVQSRTRKQGPRNNRSWGGNHPLVRTIHGKWAVSINELRQRLAFETGQAPYETPPVRTGRQGRGSLADDNTTWHVEMDSYRPDCPQGYVVNEKPVPPNRNVARVLGDLPEDEIGAVYTVKPWGYSLFTVEQKWYDNAKHTDQVFLVMHPGVGDNAKELTCAMKDSSKVLGRLPEKFLPRKCTQTQRRCVATATYTVSRAIVKDRSRVETLGRGPRRGHDAGLGKSAVVWKPAHNGAAIAGCS

SEQ ID NO: 998761 - protein, 130 aa, Homo sapiens
MHVPFLIWPYQIRIYVILKSVYMLDFSEDKKRPRVSDHSFKLAWKQDFYILLTGSLGKPGSLSRVVLSWCHSFLGLGKGSRKKGDLHSVIKSCSTGLCGSIGQGHSWRRTFHHFNLAHERRYWQTSLTFI

SEQ ID NO: 998762 - protein, 187 aa, Homo sapiens
IEKWELCLERVTQSRKGVNVTPERMLTPGYTEKTSEMGQVSRQANLQDTACVGADRRSSETRKIRCIRVGVHGSVRLERRAVPYCKTSCKLPTGRKVVPNKIPKSNRTRRPVWYKQGDASKTKGSGIERLHVGDEQKTVREVRIKDVDSGFFRTKESLNMEQDELRKNVENLLDMGAEGWNARRKAA

SEQ ID NO: 998763 - protein, 104 aa, Homo sapiens
MGLWGGRPAPCGVHNGHELYTGQALHQGREERSNDAVGCPSQKDVVRCERRCTLWGAPLQTRGAAGLKHAPREKKSPRGAPMVWNNKEGGSVKIKRAHSRGEDA

SEQ ID NO: 998764 - protein, 240 aa, Homo sapiens
MASQRHLSSEPRINEEKNSSLSILISLQISLIITFTATERNHMCISSFENHTYPHLGYHHPMRQPARTPERRHIRSVCYTLVGSLPLLIALSCDTQQEALGSLNHATTQVSLRQELSKLLRPSKLNMTERYTIAFIERYLFTDSTYDSLEPMSKAPSVETKYLPQYSVKLGGYGIHTPHKCILKAPEQTPHSLTPSLGTIPLWRAFMHNKLPSGLANKTEAYNSGQCSNIVDRAGTITPT

SEQ ID NO: 998765 - protein, 69 aa, Homo sapiens
LSPGVLVEVTVVFKPCVGIPDAPPLMPREDRAILEVHIILRLRSVQLVDDVSENVVSCAEHDKCAAPKL

SEQ ID NO: 998766 - protein, 88 aa, Homo sapiens
MVTGQKKKQLKKEKNESFGNHKNTEKTRGSFPKPRKRLLKNPKGGFALLHDNWLTAKVDPSRVYERDCKSFHQRGLRNLSFSEETTDL

SEQ ID NO: 998767 - protein, 112 aa, Homo sapiens
ETRHVFSSITLNEQGDRVYTLKKFDPMVDKTKGNPLAFQGPPNSLPPGFFPQELTKITFLDHRNTIKKRFKVLMTQQTAPPVLLEGGFPFKNLDCHFLPVLGLTPPSGKDFR

SEQ ID NO: 998768 - protein, 99 aa, Homo sapiens
MRTGMRRIGMAILKRHGDIGTCRFGRSTPFTCDECHENPCALIGNYASIVRTAQLLVLLPSSATAIAGASFVLYWYSLFVIPLLPDVKVSRFPNLTISS

SEQ ID NO: 998769 - protein, 141 aa, Homo sapiens
RLTSVRGGSCGGVLRSSAGRAEGCVSGPDCDCTGVCVRAWEAMVSAALGAPVGGGAGGWASPRQRHGDLWFASAPWGPRLWTRECGLGALGAPNRGSACPGGRVRWGGPASSAALGPCLIRERTPERRLPLPWAHVPCAEQ

SEQ ID NO: 998770 - protein, 73 aa, Homo sapiens
MKHPIICRLIHFSNSENINNFHDFEKPFASKAKSPNSRRTLHKPGVTIWMPPTLHTFEEPVYIKSRQKRKEIT

SEQ ID NO: 998771 - protein, 108 aa, Homo sapiens
MQKLLRGSRPWTGKKFFVGAKRRPITCPNKREKVNKEFKEMNEHGLYLQNYYSEWKGGRKNTNGISIKTIPRFHIGCLLKTEVLLQNIKRGIKSCLSTNEKRRRTVLD

SEQ ID NO: 998772 - protein, 140 aa, Homo sapiens
MTLFRNTSQQELTNTNISDAREIETAELSCPASYLVLIVLPRSRTHPLHNSSEVNEPSLIHQNQLAANGTEPYEYTDYGGLSLQLLSYFPGLFLEPGRSLLTSCELLTRVRCMYSPLEGPRFRHNSYITQTSCSHELSPH

SEQ ID NO: 998773 - protein, 340 aa, Homo sapiens
RSLYASSTVGAARRNHVDKSEPMDHGSVILVRILGHDVGALESIRQENERTGRLTDAVLTQLPRWMFCDWSIDIGMLIENEEMISNDCRIGMILTVYGTTVTGPSDWTVSRIFDKNVRARGSRKKNGLGKLTGACLLPVSHKVSITSDTVKPSRRTAIAWRKRSRSARLRSDTSAVNCTPLVDARLTTHFRRLTGLVFNVGPEESTNSHRELGARATNTKNVRERKGIKGDIPTEATSTAKKNVTPPPTRRTTPPLSGPYPERRGNRQRDGLHNRARLAITAPRRTEKALLCQHLHAQRNGLTNVTADNNLLFLGRPIERRHHQEGRMDALRMAETAPQR

SEQ ID NO: 998774 - protein, 220 aa, Homo sapiens
MFSDYAYELRSIPLIPKNERPYNLIIEYRYFITCSKLLILASSQLFSSVFIQDMPQTIYIGIIPYAIRPTSEINPQSMQLESSISIFFITQVTSINLTSHFPHDIYARKYISAVGRRKRSLISGQHKYNPPIRTMEAGSHDGMRSSNRNSRACVSNPDITIIILAPIKIGIGNRDDPKGWLAKSEHTQWSSQFDVFAKKHTNIVINNLQYTMDVWWATSE

SEQ ID NO: 998775 - protein, 172 aa, Homo sapiens
MAPVWCLHGCRQAGSDHCTPIVLHLPIVQGIRWCYTMKSSMSDMGRVGVAARGGRVRGLSPHRPVCELLGTPRWKVSILCEHASNACQGALPSHSLALRRFTHVGVPLQRQLELSESWGFQVEAFKAWRGSPLGGRGGGRGVGVGMGFPPIEALEGKEAIAPNFILGRRLSG

SEQ ID NO: 998776 - protein, 185 aa, Homo sapiens
AGVSRSFEGLVSGCILGHLWYPDCAIMCVAVNGCAVDLGTLLRGYKCRLQDMLNEEALGGRSFAINQYHDPEGLWQDFPIAGVVGVRLECWKAWYRLEGRAAGRRDTYDITLRTIEVEAGTRRMRRIVRRVSLRGSQWSDIRYSLNDCWLMVGVEEPHVALKETAGKIQWKTILGSHAFKDNGRA

SEQ ID NO: 998777 - protein, 217 aa, Homo sapiens
MVAETSEELMCTEGTAKASSISCILRLKALNAGDTAEVYYTGADIGLEFVVSLVCRSWMFRRRGCGGERVPRSDIHSKIHHMRWLCNGSPHVFAPLSLVEQELWYHMLGRFEYSSLYILAGAHWWPSTSRLHHKEKYVPMFLLWRLSLEFNSCAIGCGKVCLVEVIQSASLLCGITLWYAVDVMVGKTLYISVGRENIPMRPREASEKREMAWCVGK

SEQ ID NO: 998778 - protein, 75 aa, Homo sapiens
GVESRSSPHGRPAGAPVSPRKRKSLMLLGLFMSVENTPMRPGFNIVWFIRDRCCGWTLGRFLFTIVELEDHVMLE

SEQ ID NO: 998779 - protein, 186 aa, Homo sapiens
MDMDMSPLMSPVTIFSGFETNSADNDYQLLRWIDSTARMSTQLSGRTVSLGAGAKDEWRIVEAEAMNYGTASPISVSLATLTMSVQPTVSLGGFEITPPVVFKVEVVVHVACCILVDSHFSSLWRKDAQVQKDEEDEGCGNSLSMYLGIGTVLALEVVVKVPGPNSKTLAADEDDDDDDAEADDAS

SEQ ID NO: 998780 - protein, 136 aa, Homo sapiens
PHRPAWHLSADASGLRQDLAWAPGAPIPVSVCVQLCGTGLGSPLECQGSPEHAFLKSRASECVAVCLFDLPIAPIFIPPPVSDPRGRQLARECGRAPSDVLPVTSGSLISLVSVGIEPPGYCGRGGLTGEDWGDVM

SEQ ID NO: 998781 - protein, 43 aa, Homo sapiens
MALLRDADREDLKGDIMLLCWTKNPMEMVQEVWTESLREKQVC

SEQ ID NO: 998782 - protein, 150 aa, Homo sapiens
MEFSEHLERIIAFGWLWKDMLIQVPNPNTFGISAAMWGSYLRPGFDTEHCRRRPQFRKLGLSFPRIVLGAISRYEIVDESTDAMCSSLKQLLLVPLPNLLYQAIESRGYAIMSPSSRYYCLEILKADFQLNPKRKPYNGEAQLNIRTTFR

SEQ ID NO: 998783 - protein, 267 aa, Homo sapiens
MWHGRKTECQKCTRARGVPKGVSYPMGGRHVPANRERNITSLRATTQGGKRKQHWGTLLQRTSATHINAGGVTKLLVHTPGTLGSGLTTKNPLATLPTDLFGTRLTRRSVQHIIMGDQPTNGPITRHRQTDARQTHPMAKLRHLAHTRNPETIVYGTLTKTRKHEDQAKQSRQRAPPQTCAHGPGPPDTQPGTQPQPTAPTRANPPYNTPATVGTPGNPKRYNGNTHPDTNRHTKAKTDRQSAGQQKEQREKRQLNTHATTMNPHAQ

SEQ ID NO: 998784 - protein, 228 aa, Homo sapiens
KNSPHQGAGLQVRASEGPMVEEQGPGETGTRFPKPVRMHVPSNPKTMVLGRCIELRWCRDAGAWRVQALRCVIVKILVKRHLLTTGRIGVGESAESTQVQSVAGGTSGKPVVWIVGSGAVLWSQTFVSLGCALVLSWTLIVLSPASDDGVRRWYVCDLGVCLYPGGQAGYTAAGLILLSVSTVRMICFIIEDEILRLKWLLLGPQVDCIEEIDHGHGQSLHFVKSSQA

SEQ ID NO: 998785 - protein, 119 aa, Homo sapiens
GPGDWLTYSSQTLTGSWLWMEVQGGPSLGIETVLLIVIFTRCSCHGSLCGCKRYRVAFTNEAEADAWTQYSQRGVDGLFLNDEDDRLLVSPYDRTESMKETSGGKSSGELPSVRLEGGF

SEQ ID NO: 998786 - protein, 103 aa, Homo sapiens
MAFEEGLSLCWEPNLPWGLGVLCDNGVWVGLGLAKWRQKKKTGSPEKLPLKLGLGARRGHAVRNFKTLKFTKPLLGGAINTCVCEIATFPNFQNWNLVFKRGS

SEQ ID NO: 998787 - protein, 167 aa, Homo sapiens
MHDIRCSKSESTEFLIRAAYRGVKSIIAMRKALGYTSLLIPISNACKLTKWPGLEYSTFFYNSQYSKQQQVSQASRNEELLQHYYSVVTNPVAGLVAQIQLLVSTGQTNQMIADELPDEPGTISYSRRKRSVRWERSKTLLAQEEHYLLEEALANKGPVLGPQNKSG

SEQ ID NO: 998788 - protein, 121 aa, Homo sapiens
DVIIIPSGPGAMVSAEMTMWSAPEGDVEHDSADNVERHSLTQIKNGGGSRDIARISCEENVLRMSEEMDTRCNGGEELATLGTTDVREQTCDERELDRIMVPRRRTVLVIENRPVSTICLV

SEQ ID NO: 998789 - protein, 102 aa, Homo sapiens
MACTFCGLRATWLALLLTDALIFFAIGTLYASDERKTDYKTPIDQCTTLNPLVLPEYLIHAFFCVMFLVQQSGFTLGLNMPLLAYHIGRYMSETSDEWFQDS

SEQ ID NO: 998790 - protein, 155 aa, Homo sapiens
GPSEPAVGCAPRQPAPRMAAAGARPVELGFAESAAGVATAQRAVPHARWAVRAGMAWARAGLPGPQAPGPASMCGPPLSIPAATAVCAGCPWTPGRLRNRLHLSIFWLPGDARRWHVPGLAEVHQGTSTLTPGEKQPIAYNLQLLQAHTYLERTR

SEQ ID NO: 998791 - protein, 106 aa, Homo sapiens
MAFDTGVHRYCDYLEKLLVLSQEFDLSPLYHSSLGSYPHSYGRRLVSHPKQGTHAPAYHPPEKVHTRVIGRSRNHRRYSGVLSSTLETASSMCVEMHHSRPAKHDN

SEQ ID NO: 998792 - protein, 124 aa, Homo sapiens
NSVVATAQTRIRSLLVRLALAVFLRKHVLTNSPIWLRIEKVQDTCLITDSNEQRTLMRKTPAAFHNECDLNRRSIGRRYQISECVRRQNMLLVQFHKAVVFIDFTSLIAVLTLCKDAKTVGIIV

SEQ ID NO: 998793 - protein, 68 aa, Homo sapiens
FVPGRCALTDTHGHTSHRMRSGFSVKKMCDKDYSVPIRVDRNVHMKGASAYLLVNALSRKRSYDVIEH

SEQ ID NO: 998794 - protein, 136 aa, Homo sapiens
MVEPPFEEIVSGQNPPTLNHVERTFKAKWIDSGTAHSHPSVAYRVWFLPPRELYIYIVVHPTYLIQVSAPQYLAHGKTGSNITYRRQSGAVELTATYQTDPPHTFYIGTIHHRMEEQERMAEFSVTSLTDSLQTNR

SEQ ID NO: 998795 - protein, 93 aa, Homo sapiens
VVGTCRGGRCSESRCHRVREGPTDVTGWVLCPGDATGCAGPVGPGGARARGWCFPRARPCETCVFARLPGAQAWTRDGGWSLGLHKRGKLTWS

SEQ ID NO: 998796 - protein, 105 aa, Homo sapiens
MIMKGCKSKGENDSHNVAIAIVDLTIAVVGKLAKGRIKLGLVEPIGTWLGYMGRIISHRDYRRISLWGENYSIERSNAEGKEEVAMFFSADHIAMEGDACGLFSL

SEQ ID NO: 998797 - protein, 107 aa, Homo sapiens
STGSFPSNSAKMIICKVKTIAISKSFPPPKSSQCLHVDVFLFCIKFTVRISSHRRYFTILSRCKDSSSLRISTYLYCNEFSLVIKSIVLIFENVVLAFDKAKFQLIN

SEQ ID NO: 998798 - protein, 70 aa, Homo sapiens
HQSPTSRRDVNYGVIIRTFTPMAPVQYSIMLPLLYYIGRGLYYGSFLLRQKPENIRHYPPCIATYSNEPS

SEQ ID NO: 998799 - protein, 270 aa, Homo sapiens
HTLGVSLSCRHVRTHPVCSSVGPLGWRRHDPQLHGSALPRAESGTPGPIMQAGPRPQTHTSGLSNGVMLSQVWEPHVTHRGVQGTPGGFGSYRCITEESPRNRGTDMNPSGAIEQGQILLSRSSDMRSYAVEYPNGGAYRMTMYGWSIEGAVIPLELVIDQEATVKANSFAGPGRVALGVDAQRKRSRGNLPSSEVRGLANWSPVVLAESRMRDSPIPILESGEYTKHRSSMKHKAGTSPMSSCDLSALGGRYRCYKSQGFFAYLQVKPE

SEQ ID NO: 998800 - protein, 270 aa, Homo sapiens
MERRAEDQQMNGRLEAVGAAGAEARTGADRVAGATGPMKLPCVEGLQASGRRTRYTTREYCQARTVSDPLRRSLWTPYVHDPEGTQAFDSSIPCSNTSKGVHWGSNHRRRAWQTLTINHLAYAQRAHQSVMGRLSTHRFETWTGISRRAWHKKTRVSGKVTRQCTRFRNVQEWPYTIFCSFSKPPLEHRVRGDPGTGGGTHVIAQEAQEFGENNARCVHENEEVDAAEAFHEHLCKPWGACRHALGVLGAILGPIQTLDIRAPPERIGPT

SEQ ID NO: 998801 - protein, 130 aa, Homo sapiens
MEEYWVQSPVGVGGEEFRCQSPNKALECSRGMNIENKKRERRMRDYRFVKTYEIEIFESEIMGDKGVEHVVWVRNCNVSVVSWRCMYESLKHHIGIGRGGHCVEDIYRRRLEAPGPHEKVGQMGFHGKKR

SEQ ID NO: 998802 - protein, 167 aa, Homo sapiens
GERAGRGGGGGVELVVLFGGAGLAYAPGACGDCLDPVSDRPAWLDASRRLTEPQAMGPLSQDVEPGDATTLVCRRACGGDEAEDPGGPRLGECVSAHARHARKNRARARTGTNISLATCRTPGERFEKIVVRGCDMTEWCTHGLGRCEVRRGSMSSFVPRGCYWLEQ

SEQ ID NO: 998803 - protein, 88 aa, Homo sapiens
MRLYGEVINRTLTIHDRREKCGHLKSLVNAILLEADEDGEIKWVSWEDDDTFGERIRKVGSGKQRAMTEVRERRDPRIGGRIGKFRGI

SEQ ID NO: 998804 - protein, 244 aa, Homo sapiens
RLDKSYRYFNNINRLAKEFPLAHRQLEDDKVTVWCSNDYLALSKNPQVLDAMRKTIDKYGAGAGGTRNIAGHNIPTMRLEAELAALHKKEGALVFSSCYVANDAVISLLGQKVKDLVIFSDELNHASMIVGIKHANRPKHIFRHNDLAQLEEMLQMYPKSTPKLIAFESVYSMAGSVADINKICDLAEKYGALTFLDEVHAVGLYGPHGAGVAEHCDFEATVLQVSPIHHKVTTVDSEPVMDPC

SEQ ID NO: 998805 - protein, 166 aa, Homo sapiens
MSVVIGTWDGRLVACIVPCGGLPQVLAQGAPALVPLGPEKRISCSRASKNTTSCERGGVVGELFRCRWAWQEAIRVATKWRRCGKSRWYRGALSDGLRALLVGQPRMVGKWLVQPGGGFYPVECRLQCVALAVPVVRPCLLLALPLGGQCAGLASGGNPALGVGRP

SEQ ID NO: 998806 - protein, 96 aa, Homo sapiens
LRHAPSPLPRGEGPIEINGGLIKYINTVVSCLVFVLGIIGNSTRSENYLEEQVQCRNGPNICDRQLGSGRPCAHQSLSIPIKCLASVLVRGLASWS

SEQ ID NO: 998807 - protein, 242 aa, Homo sapiens
MRVMAPRTLILLLSGALALSETEYRGISITRRVPARTAESPGFIDQLGYVDDTQSRAGYDRRRARVPPEGSRMAPWDGSRMGAESIAEDRETSDTYKAPGTDLTDVETYGTICVALLQPRAEAGVFTSYQRMYWLAEPGGPDWALSSRGYNQFAYTGKDYFGLNEDLKLLDRRGTRRLRITQAHSGKAALLEAAAADEATWRARAVAVVRRYPGEREKTLQRAEHTKTTREHQTVSDHEAPI

SEQ ID NO: 998808 - protein, 42 aa, Homo sapiens
MPFVWEEARIGYGEAERQRRHTHCGMGISKREYHVLTTRRRH

SEQ ID NO: 998809 - protein, 114 aa, Homo sapiens
MREHDEEKQRGAQNRRGFPQEEKDTPRGDREKQQRAVRGLAHKQREKKRRRRGGGNNTQAAVSLESKDDRKEGRHLGRTRNKHGGGTYQRAGRGPQQREAPQHKVTPGARGGGG

SEQ ID NO: 998810 - protein, 92 aa, Homo sapiens
RYLSATWRELDISPACRAMSCQQSVTPPHPGSLNGLQTCVDVANDILANLLQCRCTSIGGLTPLASVPTCVPTFGADGLGDCSLDGNPPDSH

SEQ ID NO: 998811 - protein, 104 aa, Homo sapiens
MAQKSQVVPRGSYPCTKLTLDLSNHPPNSRGVGQSLSKHFEFYHRKGRETFWIACPAGTAFGPLIVPSKGITLEEGYVGFRGLRGPRRFQSPWLGFASSIIAFK

SEQ ID NO: 998812 - protein, 103 aa, Homo sapiens
MRSLNWNSSQPGELHRSMLRLLELVTALAPVVLHGYRPLVQMGEVQKELEPVTDLVQPGTHYLGLLLHSIPIVRLVQPLCAGCPVRRETVLQPFCMSHELLKL

SEQ ID NO: 998813 - protein, 132 aa, Homo sapiens
MRSLRLYTVFRSWRTKGHPASGHAQGQTQCSVCSRPPTEEAPSPIKASTSVVCSGDFYPGAVTVAVEGQIGMPVKAESGRPPNPSKVEQQQSTRAARYLSLEGRAVEVPWEGYSCRVTHEGEHRGEDSGPYG

SEQ ID NO: 998814 - protein, 295 aa, Homo sapiens
MHLSSSWHMIQVHKETGTLPSSRFYNHDQSTEILVEVPLACESHVEKYRYVCRCPFYEEFRLTQVMIIKNSMYREIGKKTESFEEVRPDPEFVHLTTWTQTMQRRYQCQHRIGHYRFRYYGTPLVAGTLTCACNGKLLFVSAGSVILGVDACERLFPVTCRFSTTVPIRVRLSTRPGASGEALLCRQQPKLGDTPWSNFSFGSCVTSMSSGDLPGGYECGTKEGDPYLVVLPQVMPLETCGSPDSHSSQDYTNAELDSGMVRCRTGSSEGQPLGPFLVRHHWRRQIGMNKESSGN

SEQ ID NO: 998815 - protein, 46 aa, Homo sapiens
MRRRLGHERTERCTSLLTNPYRHGIDTPGLRLGERERYPIRHSSGT

SEQ ID NO: 998816 - protein, 234 aa, Homo sapiens
MITPLHSSLGDRDPVSKKKSEKKIWAWAQGFTPYNPKHLGRPRWGGSLEARSSTTSLGQYTGGPHGYNFYLSLCFFLLGLLGLQYFFQISKLVKLLGWARGGITRVNPSTLGTRQGGAYSQRSGNRDHPGYIVGETPVLGIKGPNNFTGGATGGAPWWVPGNPEQVEPGKGPGPGEAEHLKVGPEIRRTWGPPAGVWTERKLRSQEHQTPTEQRKPCAGRWRPLEKRLKPHSLA

SEQ ID NO: 998817 - protein, 113 aa, Homo sapiens
ESLWRPWGASIAELVSSLLEEWLIAVQLTECPEGAEAACVRQIQIAIDWSRNGWQLRAAYYSCGRKSGNRCERSDLFDRRMRSAGRPGLPVIGAGSKNTEAGGSVIHPLRVCT

SEQ ID NO: 998818 - protein, 74 aa, Homo sapiens
KAVVMRRTETGDVFKASASRRILLGGHAERADEDKQTADGYGLKLLVSREVNASMRRDLPRIQDEKTDSNEEAS

SEQ ID NO: 998819 - protein, 184 aa, Homo sapiens
MLLCVWVAKVHLCHVPNSLFPHKSFKVINEATVTWPVNSQASRSPIQFQFSSMMHAVTGNDNLNMESTCGLLWSIFGDPIVDGRSVKEFSPQRILSYRIDIIRFCELDNRAGENRNPSQAVCIQPTDSSRCADPWRRRVELTALYEQNVKADSGFILRAHVSFCACGSNEVRGLDQLCIQQLLS

SEQ ID NO: 998820 - protein, 123 aa, Homo sapiens
MLSTSGDVEALSRVKTLVLQHIGSHVHSERDLLIRNPPSSRFYLGLGGYKHTKTAKRLGMYTLHAQAQAPVSFSDPSSERSTLTKYACWRHWLLCTLVDLAHLSKHQWDNLIETFKSGSARYL

SEQ ID NO: 998821 - protein, 190 aa, Homo sapiens
TLCCAGWGGSGSRGWRAGRRGPADVGGHTSGLVMNPRVSAFSDGVVVRVQQSAFMTFQVDARYAVVCGFEAGDSWKLAPGGVDPSLLMQGRGADQSGPELVLRCGFESLPRTTCDRIDSAQTQFSSLQNRHKNNHLFRVAAGIPFVPFISAGHMGRHEAEKRLPVKEAYKQDPELATLQEDGPEANRARN

SEQ ID NO: 998822 - protein, 69 aa, Homo sapiens
YSVVATVQTRFRSYSCASFREPLAPWAQLLLPSLLLRYSGRFIIPSRCYLDESAMRPKFRCPELGFSSR

SEQ ID NO: 998823 - protein, 84 aa, Homo sapiens
RLITIMSIITIMDISTLGAVSFAENQQARSTKCSYSSCSSRPASTHRKATRVSIGRVTRENRDMPASEDLTRIYRREALSNRDV

SEQ ID NO: 998824 - protein, 132 aa, Homo sapiens
MARAYGQIRMFQKAAVDKGMLHQSLANTVKTPSLLRNTEKISRAWWRVPVVPATPEAEAGEWCEPRRRELVSRSRMNLLPAVELQILVLHNTRIKNNTEVKTWWSSVALREMPIARVPHMRVLSIEKNHVEK

SEQ ID NO: 998825 - protein, 184 aa, Homo sapiens
GAEGVHKGAGPMRVDSLKRPRVPGPRQRRPGQIVDPSCSLVGRSRVVVGEMPVRPSGGARRYCGSAGWECGLQRTVRSCLPFRHVCRFALRIAGSAVTHRFFHLSSCVVLCVGLLGTELVVSISGSHARDWDRSGNVGVCRADEISAPVQRSISVKRIVAYHRVDFVLVARLDVSLDGHLVMQT

SEQ ID NO: 998826 - protein, 77 aa, Homo sapiens
MCVVLVCQKAVTLQRHAALYLDARKVERFLAPYGRQDLHLRIFDPSPEDIARADNIFTATERNRIDYVSSASVSTTP

SEQ ID NO: 998827 - protein, 125 aa, Homo sapiens
IPEADSIRAEMSRSVALAVLARDSLFLRLEGYPRRYIRKIQVYSLSSTQEELARVKISLELHMCLESHPSDIEVDLRERMAEQTVEKVEQFRRCLISKDVVVVYSSCTTLKFTAHREDQMSMPAV

SEQ ID NO: 998828 - protein, 94 aa, Homo sapiens
GERLRRSAEESVDLRGSQYSRPELFSRLKRRDDLWMLKYARELKERDIEKRDLSGSGKSNIQGLLWMQDVCNIDSSGIVVKRCQEDEYSRILAL

SEQ ID NO: 998829 - protein, 119 aa, Homo sapiens
MQGDAHVRRRDPYPRKREMLWRGRSHRTVQRMPNGWVNFLYYHVKVFSFTLGCWDFLLMRVRRRLARGTVRLDRARCRAVGLMESAVGMERDRGGIRARNLYIILLELNEKTTNGGSSS

SEQ ID NO: 998830 - protein, 209 aa, Homo sapiens
MHFVYIIPLFFLGDGVLLCCPAWSTVVRSQFTAKLHLPGSCHSPASASASRAAGITGTSHHTWLIFGMVLVETGFHRFSQDGPQSPDFVIRPPWPPKNAGITGVSHRAWPFFFFFSREDGSLALCPPGLGCGMGLCDSRARLETSCLPGAQGSSPGLKPPGLAGVSGAPSIGPWVNRGSQGGDGVSPVVVQAGRDSRPRGLPTLAPNVW

SEQ ID NO: 998831 - protein, 272 aa, Homo sapiens
MTEDAPSQLGNCHVLGGEHEAMDYQYCKTKIRQDRTKAGYVSRVEPQGTFRERKRGGSLYGGHKFDRIHIGRGYPCAGMGHPGKGVIGLRGYPLKVGTRKGRRTHLFLQQGKHPRGKEESSLGKPVCDVVTKGFHKRVADRSYKTTHPTMGPKRLGKAQLIVTKRARPAHGFSPIINLVSGVQKGSGEDKGKSLANEIVKGEGVINEDGGLTVVVEGEEKMVHTVWFLIRFKWVKMPGLGYLGLFVVDDNGKREVSPCKWSKEILEDQKAND

SEQ ID NO: 998832 - protein, 148 aa, Homo sapiens
MELLGPNAGGALLVWPMWQDVGMYPLRLVAVQRHGQSQTTSGMGYPSAIEHGSDALVPEELFRRKKGAIRYEGPREIRVADYHSVAVNVPLSRRNTTSCQEGLKGPAQLWEAADAMDPLFRLNYSDGITGARVSVGRIEVGRTRTARR

SEQ ID NO: 998833 - protein, 198 aa, Homo sapiens
QFGGPVGSVSCVSTVLGTETDPGYSLPASDRPPISSPHCIAFRDHSFSGPSPVFWWTMPSTVYYAGCSILPCQPNHETSQEFVMKLFHPNVVGSSINQPGQFVPAVPPNAYLSSGPSNYRALMIVGIVDRTMTPYFLFATKPWSEGVKAPKGPINAVLLNECKHNPVGWSARDLSYASVHQVKPMTESSDVGAMIHRL

SEQ ID NO: 998834 - protein, 229 aa, Homo sapiens
MRPRVPPDAPVRVLPAKWSGLEQNSGDVFGHAVQERLSAMRTFSSDARVTQWDSTFVRPMRAPQVPVTCDCGEISGGGGFSGCSPYAIRAVLPKALSVKAGVRQNGGPVYLQIELAGHSTDERNDQYGPRRLAAYGETLDPPGGFPNYRRTWLARNAISPKGKRPRAWTLLTGRRSKTHGDGGNGRLGAMNQNADGGAVYSAIEQPATAHRNNASLARLCTGCYHTVVT

SEQ ID NO: 998835 - protein, 121 aa, Homo sapiens
MGRGHLYTGHDNSSGLFTGKSLVDAQNELYELLSKVTKFTLEDGIQSTEEDPYNIVRHSSCFSCILLGLGDNKAGLKEPTAGLLPRVDPQIVLHRHVLPNGGVPASNYPGIQQHRPVIIRR

SEQ ID NO: 998836 - protein, 130 aa, Homo sapiens
MGEPLQLVYVTNQEATERLAHNPVARYIVSGCKTCGPGLGRLPSSGLPGSVRHTERAKELPSALGTEEPCASLDPRADSGSLKITKAPSGTAGPCGESKRESHTWEGPVRWTGLRKIPGERENETLQRKG

SEQ ID NO: 998837 - protein, 284 aa, Homo sapiens
MHKVSDMHLLKMYGHSSATGTPDYKRVSYKHCTDALARLDSSLSLDANTNTCTSNTRKHLTTNRDIQEPPEINNQLERANCFLALHTLNRCTLHQALKSQLLHKLATGDYTTNSRKRRFSSTQQQHYPPRNGLDFSPTHAFGTTSPLDRHAGQQTSAGSISPNTAPKVYQPAIFYLRTDTQPETHWRTNELLHLARKPAQQRPATHPHLSPHHNAITHHGLGTTPAPPHAGHHQPATNLTPRRHTARHPHHNATPPTHALPAHTLPNRPPPPPSPPTATATPTP

SEQ ID NO: 998838 - protein, 105 aa, Homo sapiens
MAHGMALSQVNILSPTGFENPANRSKVNCLVNLLPLCHAPRITHGGRSDVLSYSACDIAHPHRYSPGRAVKYRPATPLLASPLAYNTHNTRRTLGNCYDVVTFGL

SEQ ID NO: 998839 - protein, 96 aa, Homo sapiens
PRLDWMANSALYLRGTACAIFVHCDLSSWLYRNNSKADMNPIDSSPGDMYALQEAHTAIEMSFSASSDAKGRSILPPVDNQRKNGSSVTLEEPKEF

SEQ ID NO: 998840 - protein, 265 aa, Homo sapiens
MIYVKVLSRYRNYTRKDKYKSDIYDAVVDISFGRAYCVKGGLETALGIGKCWSRLEVERVRNPTLMCSQSLGLQLSSSVGIVSDDSWNPLQFVRIADAIRASSGKCDLRGVCLLSDATIRPFDHELIHILCNNIIILSRDGVSLFRPGMECSGVISGRVANLRLHGYRAHSPCLSLPRWLGFAGACKACWAWYSDPIENGVSAEIGQGRSRNILDPQRESVRPRPPQGGWGLQGGEPTMLGAYHIISYRKPIIQNLEVKPQKSGP

SEQ ID NO: 998841 - protein, 120 aa, Homo sapiens
DVLRRESSGFPAFNRCLDGTRRSFPEPGRPPHSQPSGHRLSADTLRTGPRSPDRRSQTTAAADRSTSPAGLSIKYSRHDGPEVLTLRQGAAQKLPTRDFIERRSNEYGQTQYLGSSNAHH

SEQ ID NO: 998842 - protein, 127 aa, Homo sapiens
GNGVSPLVCPGLEYRGMIWAHVSLVPSVGSSDSPVPLPPKLRGRYNGHPLTIAHCLIFGDFEVKDRDFHYSVAPGCGSSKASCDLQNDSYQPLGPYREQVPWRQSRGVLAPNVVPPSRGEVPPNSFS

SEQ ID NO: 998843 - protein, 120 aa, Homo sapiens
VGSSLLCVSQTEFLFIQGYAILFLFYFLSFVFLLIFFVTKRDILVLQATHRAGDFTGDVTDPLQPQWSVISAISGGRKIHKISLSDYLRVLSTKRETWGAYAHRAHFGRSNTGVLRGAQK

SEQ ID NO: 998844 - protein, 119 aa, Homo sapiens
ERCCDESSSGCPASPVAWTEHRRSFPIPAAAIASPSVSVVHRHSIGTCPKGLHAWLLQRRSQLDRAGADSPSSLIVCTSLCTDAKSHTSAGCGPRNLIQREATSRKSPALKSRRVIHIA

SEQ ID NO: 998845 - protein, 74 aa, Homo sapiens
RRWCEEAPPSCGLLGLRCRLATSLDVGKCVEAGLLRPCFVFTFDHISGHDAGEYQTWEEFSRCCQRSFTSRGTL

SEQ ID NO: 998846 - protein, 152 aa, Homo sapiens
MGSIILLYALVFHCRSLETWKYTSGTNPALDVVKAAVCSIHIRRIYKVCVYMSDICVRNAATSKNIIARTICDSYTSPICKMMVTASMLLLLICAFSVEAMASLTLLTREKKYHEEECVYYAGARSVINQWTNNLVKNSEDIVSWRRVNVQT

SEQ ID NO: 998847 - protein, 102 aa, Homo sapiens
MFPHEIGVRTRCSTVVLSSVDVTELINVVGLYDPSIGSPPGIKLAILYPLKALFYCIMSTQYNLAWKLVVYVNLQWRETPKLGLRSYLEYIDAHRSLTELRQ

SEQ ID NO: 998848 - protein, 119 aa, Homo sapiens
PDQTLEDERDMEMNWGRNESQEDQRGTDRTATVSVRTIQRSDANDPENHETVNTMNERSCKRRDTGAIPEAVRTGTSNAPRSDLTRVTVGTQETEAQRGDSVLSGNVQCMEKITLEYRD

SEQ ID NO: 998849 - protein, 108 aa, Homo sapiens
MVAGLLYRQLRRAWVHYLNCLTDPRNVVALSYDYIWYLSVAVVGIEVLPHLDSSVACRFELQGASWLMVAKSRESVCSNRAPIEQEVMCQLETDEELISLDLPLFSLI

SEQ ID NO: 998850 - protein, 148 aa, Homo sapiens
DPRRRRRRLPAAAASAAEEDSCRPAHRQLTPLPAESHLPHGLGPAARMLPSRMPHTTNTKQSQNHNTPKRNTNTTTNTKTRHTQHVSSTYTHKHKPPHQRPLYRTYSIYIVFTLTSLHLFISLKVNITTFSTTTYSFLTLPLHIPSYL

SEQ ID NO: 998851 - protein, 215 aa, Homo sapiens
MLTKDECFLGYTGPGMCSLVYSASFRIAPRAECLLVVPLCRFAQLARPLQEVRPSWSFAFWGVLGTDCCANGIFAAVDNKLLLVPGNKAHLYYPEVQSDGKTVQRKSFVQRPFYCHVISLSEYIEHIDHRCLSPRAVMWSTLREKRFWKADLCNTVRQEITIVERAYLALGIDTVVEETFFKEPAVALLRKLRYPPQGGGHGLPLQGTCNQYWLV

SEQ ID NO: 998852 - protein, 113 aa, Homo sapiens
MTPIRKTNPPNKINIKSRHCIESPANPFQNLRMMKVRLSPWRLLILQMHHRMIPEHMHIHRQRRVNLPFDQSPRSSRDVKMAESSVYLPPADGAVNIRNSCASSYTYGRWCYI

SEQ ID NO: 998853 - protein, 96 aa, Homo sapiens
GCFAESNRGNACCNSAWTESGVSVCRQQPSDRDASILVGPVLVTHRIIRYNFGESGLRMACQSGQSRSHCTVNIATQRQPEAVGPQSLLALPVGVM

SEQ ID NO: 998854 - protein, 106 aa, Homo sapiens
MIPHSSHVSTRRSLRLRHNLAASASRISGVTMAHAIMRQSNLLEMNLDNKKTGVSRMALPIMVLGVYRGCNANYGLSYGKLVYLNSLYSWYNLMRTYGCLRRGPSA

SEQ ID NO: 998855 - protein, 78 aa, Homo sapiens
ERGDRDLNGLLSSLVQMGLSAPTISGLQDELSHLQELLRKWTPRISPEDHSKKRDPHTILNPTEIAGILKGRAEGDLG

SEQ ID NO: 998856 - protein, 109 aa, Homo sapiens
MGMLHEGSFKLRTLIHTMGGRRHGIVPYYQIDTSPRPIDRSIRNEAPRASSAFPACNCSFSCKFETTHFFIFYSPFLSKSFSRPALKRQNTTCWLNEHRKHTDNGGTKE

SEQ ID NO: 998857 - protein, 192 aa, Homo sapiens
YLSTILLGDDLALSYRNSDTLIIEDMIALWNILGHCTSCCMCVLVDPNKKYRACVLTRDRCMSCEVSTMAVLVCGPFHMGPSQSRRGAMVPEDGGPSCSSQIVLATLVRHVVQPNLPCNQRRWNTKGPQERGHLQRISREGTQGPDTHLTKPTTCECALTLGLSPGIARRRAPKEQTGNSWRKASEGEERFT

SEQ ID NO: 998858 - protein, 159 aa, Homo sapiens
MRSEPIQIPGSPNAISPCLARLRLTDGPLQPRKSYANKPGSLIEPALKPCEGSLASPSSVRLEYAARPGFLGDTGVGTKGPTSVPLVNGHLQARSLTTSDYDIIVRHYSYTGKLNISADKEKLAFKLTSVVFILIWLLYHPGEHLGLADHLENQEIPSN

SEQ ID NO: 998859 - protein, 136 aa, Homo sapiens
IIFSIDYLSYLGCPQRNITVLVTKAFRYFYEEESIVQGASGPHVCSPSHLEMLRAGGSRGREVETHHWPTTGETPIIIHKNRKRYSQWRGAWVPCSPQHIQAQARWQDEWVLTWNGGDCREPRIGSHLPSLKTLGR

SEQ ID NO: 998860 - protein, 279 aa, Homo sapiens
ISTIITTITIIITVITTITIITTITIITTTITTIIITIITTITTIITIIITTIITIITSITIITTTITTIIITIITSITTIITIIITTITIINTIISTTVTITTVIIIYPTEGHYNAVMALNTWNGKMVRNFHHFGLRRTLCTTDADIQRRAPIKAQVTPSQTKTIERTNTLPITGTKTECMTRGQRETADARKTLLDANINTLLKTSPYMNVPAKNSIEDDQRLYHGQKQKIGSPRRHCSDDKPSLQKTQEWLGPSSGQTPGPTDRQATAVTRRAEDN

SEQ ID NO: 998861 - protein, 114 aa, Homo sapiens
SGGSGETLERAGKRPNINCGRDSVSGSLSQLETTLGTGSQVRLLVPLPTLTCVERWCGHKARQWFRGDLTRREVGVLASDAPLRRQGCIWFHLPPVCHILYIEHCTIISTQEDA

SEQ ID NO: 998862 - protein, 132 aa, Homo sapiens
MRYRKAVMNVPIGSTDHNRCQCSSPLRPCLPSMTPQSSAQPATRPSVQGCCMELVVLDFATSWSPARKGQTRTPIPDDEALATENESHGHILEHGTEADYDGPILPDEPKSYITTSLVDACFDYRIHEKAAI

SEQ ID NO: 998863 - protein, 128 aa, Homo sapiens
MVLTPPPVLHPLAQQAKEPGLGSIIWLSLERTRCHGRYISRGNIHIYAAQRTEAMGGSHYLALGEPFDGSAAVRNSCTGARALQGVTQTPPTQGNDTVHRPGQSSVYVTWKRSRRHYFSCAEGLDRIA

SEQ ID NO: 998864 - protein, 318 aa, Homo sapiens
MARATHTHQYRTCNHLHEIEHREEYKTPTRSEEQQDTHETELQDNNATIRTRSCTQPTTRVDREMNSTKINTQQQQETRPREHQKSDKFSTRSSWRTVNDSTARDQLNITLNTTLRTHRTITTPDTKATKHRWDQQDDDNTHSRMTDDTQLKNDDDNNVQIQQQTEKPNRGGDHYTTTRAPIAQHSSSTAERCTKQRKIRYERLSSLTRPLAYSSTSYSKTPELANDREQKMKDSRKQRQDKPMEAETQDETDRYDKSPHNSDTRETARYIEVVDSNETARHIEHSARRPSVDSNNERGSHSHRTRETHTSTDDRDNT

SEQ ID NO: 998865 - protein, 50 aa, Homo sapiens
MGSPTHKGVSKRESAWILKISAPAAGTHQPHQETSTDTHGTPHNKQPHKQ

SEQ ID NO: 998866 - protein, 115 aa, Homo sapiens
EEHLLCSRRCVGLGDAGVHSNQLKYCCTESVTLEPSLVKINLDALLNSPPQYIPPIRRHASDRESKVVCKVYDPVCDVYRCTACLVVTMFHYGSYIIIQSWRLLVLACGVFPWIF

SEQ ID NO: 998867 - protein, 278 aa, Homo sapiens
MTPKYAIINPPYYKIKLNQLTQSNHPRPQSKQSLSMTEELSGVTCLGQPCLVSFSKSTTRVLNSIDLMLTNSTEYSRRTSPLCHPSRATIYYESSDNCMCIECNTRTSHYDRPYATAFTISLLFIAASFRTNIQEPQRHNSSLALTLSPTLTQHPDTPLEYMIPSLTLAYLTTPHQVPSLRAILDHLTRMRCPKTNFHSPLHEEPNTCITHLITKRSEHNILRAQSPNLPSFASNMNLIRVSTVAHVPCTGKRRHRYKEKGIHGSTQTSQFAHNAEVP

SEQ ID NO: 998868 - protein, 314 aa, Homo sapiens
GPWAGTAHCSMLPKKAQHRHKPLPGTGPCCLRRIGYGSHDHLPPPAPDAIYPLEGSAIGHQPQSPTAPHAAVRRHCTDTPQDGQTVPYPEAACEAAGTLLAVLLPWSVSTTGGPSPVILDPAGPELTCEARSSLKLIKTIDPTESSNAGTYRVAYQSRQLHERTLCLFKESRITQGPSFQIVKGLKYDAGGGDIGELTQRQTELRLDDCGVPTQPHMKQTLSCTLKHWVVPGSSTTRCQYSEVIDPASSENRHEHTGSMSLPYREAKQTETRRAEEEGDDRSDAEMKDRSERCQEENVSPKTRGKESKRARRQC

SEQ ID NO: 998869 - protein, 66 aa, Homo sapiens
APQIPDTMEENSESLVHSFPVVTMRICAWRLESIDTDVVWGPNPSGYVCMIDQARCVTEKVHGKVR

SEQ ID NO: 998870 - protein, 135 aa, Homo sapiens
ISTRTRNLSASRLQDDSRCLNLLSKRITSQRQQQQTDEVYNSKDKVIREQKKDHGLAQEKVHGQLRSDRDRHQEHSQKCLSSTERKFHCIERTDLQRFNSKQVWDTIKVELHDKQGHARTSTQMKTVRQKSIVST

SEQ ID NO: 998871 - protein, 243 aa, Homo sapiens
YFFLSSACGAHKFAALSYCCYPSSRIQPDTMGFGDLKSPAGHPGAHTITWLDKSYIRGVCAIIKQMWQYLKPCPAPPNCRPCVMPYVGYTHHQRYITKYGRSIFAQRVTKHILTKLDLAEHVTNYNPATTTRHSKSQEHREKTTNIETKHKYDTAAHKTTHTATETQRENTRKRANSKRGTTHRSNKTENSTNRNLTKRNMQIITSQKYKQQQPPLMQHKDTKKEPSDKHHDSNGETTNDHEE

SEQ ID NO: 998872 - protein, 411 aa, Homo sapiens
SPLRDGTALQGTHSILLLISFHLDIQGMCLPYGVPISLLPRHWPHRPPYYLHPIRTTHMTPHGIAVFISLMTHGDEEISIQRTNPNKDIECNTQRDDRDDDDTDPFQNSLDIIDEIRENHLMKGISIKGSNETRNATRRQYHHNIWESLEEHHKETYKDLVTKETTEEVGHSEIAANTTRHNKRPKRSKGELKQHKQKAVCGPDMKAHKHDSTPKKPHRAIKEERHETITKHTSTPRAKSQDTEQSHSGHYLEARTKETLEGPKKNETETGETNKKHSMETPHNQPQPNDAQLPERHKDAHREMNTLTHEPRTAGPNPHQNPPHSTEPPGHRRTPTSTQKHEQSTKPSGTTGAQTTTTPEPTTHTQNTRRHSHERTQTQRTPETSPQTQHTQTSNTAPPAPKNNNTEHPPT

SEQ ID NO: 998873 - protein, 70 aa, Homo sapiens
SYQILLLVITYTTNRPQPSTPPSSTRTEEETPFYTTNYSDFYRITHEVHMLILPGLRNTLPYCKLTTPEE

SEQ ID NO: 998874 - protein, 148 aa, Homo sapiens
SSEMAPEADPECRITTHSVSSRMSTPMASILYELMTGELPYSLSSTTEIRSSSWWARGYASPDLSKLYKNCPKAMKRLVADCVKKVKDERPHYNHPDPCLPLSCSNNSLPKIKPERITETIHDIGQTTHEDIHACTHDHVPEAACLSS

SEQ ID NO: 998875 - protein, 145 aa, Homo sapiens
NEGGSLEPATADDKKLQFSFNESEGVNNISGIDEVDIMYTNQGTVIHFNNPKVQASLAAEHFHHYMCHAETKQLTDMLPSILNQLGADSLTSSSETGRSPAQNNPVDGKAPLATGEDDDDEVPDLVRTTTEASKNEATGLSQLLR

SEQ ID NO: 998876 - protein, 177 aa, Homo sapiens
DLDCSEKPSFDIVPHPTSLTRRQIDPDERLLRRRGLRQLYRQRSLNSRLIFINPLHRITGDAPPCQTQTVDTRLRNHHQGLKGEEGSCGKRQKMEETPLLTGKLNGGNREKQAGSTNAESDESKQANARVRGGKQGSEAQKHRPHALSPRAKGTHRSMQDDRLSIRGKRRSRKHKRY

SEQ ID NO: 998877 - protein, 282 aa, Homo sapiens
MSVERLWASCCLWVGALKSVLAEAHVSVRRSIMQFSSCSKVTLVDGQNDKRTHTQTEQLLWRNSKPRKIYTDAFVETNFGKQGPKRMEGILALNPLTLTHALATWKQRPLGGLSELSTDNTPAWLPGNELSLYTRIPLDPRTGKGPTNVGNTIHPFFGPGTLFKRGNRLCLSTEPWELPFGPSDGLPPQLSEGPHLPSRSGPIFMQARYNLGNGSWTCTSSNGGSSQLNRPLCRDITFVGRKPAWFGLEKGQTFGRRLHTDTHFGQLGTSVKRVYAFSCYAL

SEQ ID NO: 998878 - protein, 164 aa, Homo sapiens
RRGEHNTCRKMDVGSKEVLMERPAELLRSSPGPILAYPDMNQYHLKTHFLSIGWWWMVLIDRGDCGSPDLMGLHMSQNNTAQNWGTRETEAIRGEPGQAHSKSARAREIEQHMEYTHGKQYTDRAHREHKRAADEITQNACMHRTNATSPETPARPHQANSPKT

SEQ ID NO: 998879 - protein, 296 aa, Homo sapiens
ETFFAESRRGYMLQQCLDGTRRSFQHPGNGPNTIDRPYQKLYTENTRNWTTKDPDTNDPETRTDKRRRPDRTIYHKYDDKKDRRYNIDRTRPEDNKTEKQEGGNKRRDQPGENINDINTDTPDERMTTKKQRTDTEVGKTPTTRKTTNKPQQTEAERGNKNTKNTQNKARRNQNERRDKHKDERENKSKTRHRRRQEARGKERTRQGITRHTTVANTRQIRGKTRNMAKEKDGQRNRATKSKEYGGARKTQTKQREREEPREEGRPKKARKHEATTQAQTQRHKKTTEDTATERGT

SEQ ID NO: 998880 - protein, 124 aa, Homo sapiens
GRTSSVLNIQYGTFMRSLTEMYRNDVSSISERQISYLRPVLCKMYQKLDKFRNGRGMAKQKAGNFICTCRNPKLAVIVITNQRYQLDVTPKRLRTGVATLLSAFVKTLHMETFVTAQRRLRLPC

SEQ ID NO: 998881 - protein, 267 aa, Homo sapiens
METQESQRSHSVASVLGDTSGDDLWLECKPIPGLLRDSKQFLPSIAASRRAASRQGMNAGNPRYTPMATWATVVRRYTGLGAYEDHPWRLTKDRIRRQGRIGRIHQEVATGEIEHERLQTWGKQPPGRYHKENTTENSETKSRESNKGMRPHGHREGKPGRNWTETQSTKDRKACRRNSRKTGRTTSTIQTDTEEDQQRDREKPHRYQRGRRGQNREEEREGEEEHERKEEAGRAQDEEARKEKQEGTERAAEDQEKTRSERARATG

SEQ ID NO: 998882 - protein, 309 aa, Homo sapiens
MRPRHLAPSAALPATRQNGLQGHNPRTRSSCPARSTYHGLHMITPQNELTVALVEQRAQLDDPNIGQTRRTTQIPSPNTYIVKQLMEAPKRFQANPHVHHTGLHPIPRSLQHANKRHGQSQIRTPRGTNEHRSKQYMGHNHPYTRTQPRPPWAHEQPATNKAAPTHHTGRIHFHTHPTRAQHTRQRAHKAPHKRRALPPPGRIRPNHTPRTAHSHHTGHTTIAFSNTTTPPPNLHSLSRPTTTITPLHPHSKNATCAYTSPHTPYPPAHTTSISQENISPTPRYNTWDTTTNNIPTTAQHSPLHTHRTL

SEQ ID NO: 998883 - protein, 109 aa, Homo sapiens
PPRGKEVGSVRSCYGAEFPGRAGRAEAVAAMKAGATSMWASCCGLLNEVMGTGAVRGQQSAFAGATGPFRFTPNPEFSTYPPAATEGPNIVCKACGLSFSVFRKKHVCL

SEQ ID NO: 998884 - protein, 447 aa, Homo sapiens
MRYQATREKEMAAYEAAGDSHPQTRGTACIQDVQSPALPGHSRSLLLVDRAVPGVPWHIIAPAILSMTPMQAPEHHFPRDIMSPLMIHLVSGRKDENTHSVNTLASAPLPEPPMGHTSSCDTRNVIRPRGNTHSLHWNRTLVHNTDGAPHVTELHTLHFRPDRLTQLTNMDERHNVTLDPILKTRDALTCQPGEEYPPFHTHRRPRLASQLETSPLANGVSTTAFIVKRKMQYQISIVNEIGGYRTKMNIPGYVSPHCSHKWQPSSNTIRRHNHSTRNTRATPGTKRTFPIPTNTTPKRVYRPMCRTRDHATRRPTHAQPLNRSQRRCAHLRKKRTTHSTHHGLTLLTDLTVDSADRPTLSENNKRRTPTHLVRVNSQLKQRQRHNIEKKARNVKVPTTTNSKQPGNESPAAPQETVPPTTMNDIRQHSGTQEQYHHLGDNTTQRTI

SEQ ID NO: 998885 - protein, 148 aa, Homo sapiens
MGCGDEKGAYWCQSCSIRMIDHKIESILTAWRDPVVEESQEEKDYMEETVMSPSSRDIQVCGQVKTLSSDDNSGEDFGPLVLQLMVEGLIDGRNGDSESGGCMSDDRVMIATWVLESGIVIPESRCMSAETSNDIVLHMKLRSMVEQR

SEQ ID NO: 998886 - protein, 233 aa, Homo sapiens
TVSVGTRSTEISAWLYVHLGYLQHASAFHLLARPRPSAPSNVHPCLFSTIHARADLLDSRRDIPTLVDGLIIIHPQQTGLLHRDWLVPQTAGLSTPWAHLTCTGHLRRSRETPNVTTRNFASFLRAHTDADGPITAKGLGSGRPKQVTTYTNTQSGRPLDRIGASTGPNGKEALATSRVPPSGNPHSDRTPRTPEQHIDCDCDNLDIYWRRGNEEEKFVSKKDIVESKKSFIT

SEQ ID NO: 998887 - protein, 108 aa, Homo sapiens
MTYLKYDAVVVSGSKLTSLNCLDNDWQMRKSDKTVRPVKEEEFEKHSCVIEIIGSGKWLLFRCMQNFATMLMYETFVSRKVNQTEMRGWMTIDSRAQQDEYDGGIVSM

SEQ ID NO: 998888 - protein, 123 aa, Homo sapiens
VRFLASGEGARWPLAKCIGWPDIVGMQMVKNQGRVSADGHTKHSLGTDLWAKEIRSKRLREVPYELVHWFHDFGAYYRLQVQRKQQYLMFDYPRDHEYNRQKFRGRAPRTGVTREGHCSVAKI

SEQ ID NO: 998889 - protein, 215 aa, Homo sapiens
MDCKNNRRVRIRTVTGLEQTTLGANSTGGTRPQNTPPASTWTQWTTWWTSQEQRTVPQQTTTRIEKKPQRAGTPNEQMHQTRQDDRKKKRARRTQKTRDKKIGTNSKSVDTNQESTRTTKEHGKDTKARGEHRRRKRWTPYTKGERRTKAKDQESRTTDAKKDHTQGRRTRAQKNETHQTYPETNNTSQNVTHRRKNTHRGPKQPAPTNGHHPRH

SEQ ID NO: 998890 - protein, 69 aa, Homo sapiens
NWSFVFLILSTVSSRWCRPASLLSVVPGTPLTFYALRRVSFPFSRPVLVTQAMDMLAFPLHRCFLLSLP

SEQ ID NO: 998891 - protein, 74 aa, Homo sapiens
CPLAAILRPRVCAPNSQVVHPRPLEHQTLVPPQRSPYSASEQDDTRTQVMNQEKLAQTAGTKCALVGTGNVLAE

SEQ ID NO: 998892 - protein, 311 aa, Homo sapiens
MSFTFRLHPAVLWKGREWTLSGHFLAWGTGTVVRTLLGLVRKAVIATSQLISRPWGAFFIVPWGLLFGGRASNYGRALPCDELPRPWGFIRVLIGGVFEFWDSWEPGEVVGQTSDALVMVGRYDSRSRHGGGPLLPVNRLGPEWARFFPRFDPGARWDLLKKVGRLNRPIGIFEKSRRGDMKGVVHLHTTLDWTVGRLGISPDYPLGTSERPVRLLVQKWLAPGFRPTLNVPPNSQYAEFTITVGHLNGHYRSCLGNTTIPLVAQLILWGPIELENPRGGRHWVTQNWDDTSIGPGWGAIWAKRNPGISRN

SEQ ID NO: 998893 - protein, 60 aa, Homo sapiens
MVPPVRVNFARVAVYAIDGGVRHYFRTHRAVPTRRPGVARDHGCLEAPPGSTHTGSDESH

SEQ ID NO: 998894 - protein, 258 aa, Homo sapiens
MGNREVCAGCASRTVQEPYERPGGQSGLHVLVCPNQRLLRFWSAGHCGTRRYSRRSDSRMMKSVEHKILILVSSEKDGCMEKEHNSCRPLFVPVAQAEDDNTTMIGSSRSFDTMWAIDYPSIMGLEVQSMFSQSGSWLISRCYVEDKPGGDVLLRDYLHTAVRDDSCLVLEMENAKSGHSGIVVPGRFLPSMWTWQSRSELPHLLDIPILERRDELPLESSGTLGTVHYRLAVIGSFSHFPQEGVNSEDVRNDSHFCQ

SEQ ID NO: 998895 - protein, 128 aa, Homo sapiens
MSGERIGIDVGVSKPIPRIAKALMFVNVPLMDGIHKVWVSKQLHNSMTEEEAYRCPLIYNDVGCAHENNLYWLKGLFETNYKRVMSTLKRADIIYTIRVGLSICDFAQTVTSRKSPAWDPYVYVLMVL

SEQ ID NO: 998896 - protein, 84 aa, Homo sapiens
DRLLGGGLEQSADMHGKAVFTASTYRAAIELHHSLWDWDTLRDIPHPRGMGALVWPLIWVGPFEQLGVTQCDSLDVVPSMLRSK

SEQ ID NO: 998897 - protein, 123 aa, Homo sapiens
MTLLSSWVTEQDPVKKKKKKDLAWILETKSPSFKQRFWKNLVGPMWGPIHNYLSRSVQSVLPSPILLGPWNTTPIILPEEFRRAQQSFTRPFHVGGVPERLPRGPSSWLQTGSLPGRTSAGAS

SEQ ID NO: 998898 - protein, 201 aa, Homo sapiens
ESKCRLCGALCFTLKALPSRGSRAAKRRCSASTIKFAMLAGGRVCGSRSSALHALISRAYNYPSTVVTQDMSRKITCSSSNEKLSSKAAAQPLHGTTAYPRKFRSGLSMCVALIFARLVIIRQRQSDRKALEKVRKQIRVHHSYIPHLVSWVLADPSHTRESDNWTDFALLALRSPRGRKSPYLHPSSFFQIINRAEITTT

SEQ ID NO: 998899 - protein, 84 aa, Homo sapiens
VETRAWGRRRQLVSEAARAQGDPVCSTMSEEEAAQIPRSSVWEQDQQVRAAPPMEQGQKVCGTVPSRSVSGQVSRPTPLLAGKT

SEQ ID NO: 998900 - protein, 168 aa, Homo sapiens
MHCTEIRDTSPSPTEFQPERIFPAAMHKGAIHMPTALLCMAPGTWIGPTVCCDGNDLTILPCILRHFRIGIHPQQKSTGPKTARRYSAPAYRAICVRLTHAQRTSTSRLHRAGPNPTHAPTNKTPPPPPRPTSQHTTPNQPHDPVTPPRTREPRDTAPQTRNDARTRK

SEQ ID NO: 998901 - protein, 156 aa, Homo sapiens
MGGEPGRGRRRWKWTPGDRGQRKFTGWGPTRSRELRSLHNKNKQNRQTKDKHIWCATTSRAPEKKSCTEHTRRNGGQAAPHGRGGREDTGAKECANQERKPWGNKTTGREEFPTKNIKTRRGKNRKRLCDKNHKVGSEGDQTGSFNKGRPHREAGN

SEQ ID NO: 998902 - protein, 242 aa, Homo sapiens
MVTKKSKPSYHVPSPYATIGDTLLLMCFMAHMSYFLSKEQDRGNFEIQLMRSLLLIAATIHDVDHPGRTKSFRCKAGSELAILYDEHCWCWRADTCGLDLPAEPLEMIKCKYMSESMERKDYRTLRRGIIDLVLARESDEALGAMSTTFVNSINKILGNNQQENGGNWINNAGKSSNDYAGGVRENLDLNRKNVDYSCCCVQYLATLRVVHRRGLCAISEEIFFSANDADEQAGFTGGDASV

SEQ ID NO: 998903 - protein, 110 aa, Homo sapiens
MGVRGPKNKTTNSKRENTCVCARETCTRENRIANDTTGSVDAGANQRIGTCDTPWHKKTEAEPKNPRDQMTIRKGGTGHKRTPAGEPEDKWTNPQGDTEAYRGHNKGPKA

SEQ ID NO: 998904 - protein, 255 aa, Homo sapiens
MALALGFLSVAEHSLPSDWEGGQIPVCERTVATGWPMQRNDTTPGARCIGQAGFIYADIGPLRNEVGASEGSGFLRKIPWTNTCRIVAYQLAPEKIWKDNECFPREEVTKTHCTGIRMGLIIVYHSSTYHENVHSRGDTNRAPLVPKIRWGGRTVGHCSACDCVVNSLHGDQPKDPYRCVALFDVTTDWRRKPCGGLVLFVLLDEAQEQLSRKVWRDSRARRFTYRISFSCSMHLQANLHLKVQGLIQSVTHLGI

SEQ ID NO: 998905 - protein, 83 aa, Homo sapiens
ELARHDGAWPVVPASREAEAGESLVAQDAEVAVSRDRAIVISSLGKEELKLHAQKEKNKQRKVMGFIAMGSMQNTKYFEEGNF

SEQ ID NO: 998906 - protein, 229 aa, Homo sapiens
MISDHPNLSTRSPRNWLSSAVSAYTDQLAHQSSSTNIFVLPSEHRIQPWQCSPWGHKAGHYTMKSEGLNLESHRSIPEAQIHRTAFLGTPPVPSNLGTTGMLAWLSTGQLACSSAEGLKLVDKFAGRMCTQLFHSEAFTVDFGDTEEAKKQIKRLRGEGYSRAHMWMGSKELDRGRQGFALVNYIFFKGHGRDPFARHDTEEEDFHVDQVTTVKVPMMKRQACSTIQHG

SEQ ID NO: 998907 - protein, 145 aa, Homo sapiens
MTRSIIAHESSIRYLHGNIYPYDQQMLKLYQMKVDPVLKHRARSLCKETVHIHDLTWEKMSRHCPHKEELKQRPGFDFMYTSDGYTSNDLSLPVKLRWGLGTWMALRFKTEHLIGSVRLPDKLASIIAEGFGLCLLLAQPNLGCD

SEQ ID NO: 998908 - protein, 66 aa, Homo sapiens
NNQSVGSYLIDPRSPRPTRRIYLQVISTLFPPSTMTLTQHSHRYFIYCNQAQIINLTIEDYMDFRF

SEQ ID NO: 998909 - protein, 68 aa, Homo sapiens
VACPVGSDEYEQKFGERWSSRAEVASRCCEALIGQRMRGDHDSDRCWRSPHELVCVVLLMCEVMLVRC

SEQ ID NO: 998910 - protein, 142 aa, Homo sapiens
MTQIESGSVVHRFRRFGSDSRWTSGLCHAGDMASLMPMFASRANLYVGLVRIVLRRNTNDKSVESYLTRCNPSIFRDFYIQSSCRLGAYLLPWENQTICSITIVVRWNIPACSTAGRRYGGNQAKLGACMLQKYQYGIRDTR

SEQ ID NO: 998911 - protein, 82 aa, Homo sapiens
GANRRKDSKEHKQEKHNTQNKHKHKSKQETTNTEKKTKQQKNHTQNTRRDNKQTATETRQRRTETERRTHLNRDTTRQNNTD

SEQ ID NO: 998912 - protein, 388 aa, Homo sapiens
MVSDHGIDDYMRDGSRRRDMKSRMYVPRSRKEREKGEREEEREKTEAKEEKKGREKKKEGKRRKERRREREGEGGKREEGGQKKERRGEKREEEEHQIKKETQGETRKKKKKGETTDKRRKTGEEEKKKEEEKNERTEAGEEEKTKEREKEPGGKEKDRKKKNKEKERSNRKRTKKEENTDERETRQADQENRTQKKKQQRDKRDEQQERKTDEATKQETTDKESKEGEKRKRQRRRKERRAERTENRHQQEEPEQEEDKRDREEQKPKRRSAATEEKTNRQERSTDREAREKQGDAETDMKNGTEQEKKGKDNEKTNKKGEESRNKEQRRTQKEENRVKEGTENTKEKESREKQQEEKKKKKKEEQERKAKNKRRKGKRTRREERKK

SEQ ID NO: 998913 - protein, 53 aa, Homo sapiens
MWVWEPGLVSTGGEQQRHVIKSSDKTIMLMFVTSRAKMLVDTVMRSVPRTICQ

SEQ ID NO: 998914 - protein, 301 aa, Homo sapiens
GYCEYGGVKGEAGIMPPPGGYGPIDYKRKLAVVEELSGYSMLAIGIGTLIYGSLEHNEVEPCSAGAYNIEALTMVSQSRCCTRVTVQKPDRRTFALMLRESLEEEAIVMKDVPDGKVGESVVPQKPVGAPTYESGSCTWAAQPQRRLIHARPRRSMWYTVGPCALRSIVASPDPVPQWWSGINMLLQEPRGQAPEETIIMEGTFLHVNIPYHRERVLKKKGEGEARDTREGEQAKHWAQNGGATPKRERSGRRGAERQGNDQPAADDTRRRAGSTPTGVGGAKPREREGPEEKHTGARRKQ

SEQ ID NO: 998915 - protein, 309 aa, Homo sapiens
SSLALAQPWLVVPTERLKRGGSSNGIGCWDKLDQVWYASVVRSDAVPYNGEKRVSSLDHFLMREQTVSMRLTVRLRRNRNDFALSRGCHLTQSDWRTAPDSWYISAEPCRGSVMGSAHQTLEQRAGGDLPVCSSDTEGSAYASLQSVINNTWERSANAYQVRRKELSNRSCVGTKIGNSFIWCSLGCPGPIRYPDPLITVNDTIQIDLRDCSTLLNFITVRLLVNLLYGDWRCSSRNDLVVITNRERLPGDPYERGVTCTDAKATGLHSTFQHFCYGKATTTDSLPGERYPPTIVREDKNCGNKHGALV

SEQ ID NO: 998916 - protein, 257 aa, Homo sapiens
AESCKRRRARRVKSRLGTAPEGTGSVGHQSVWIPSPRAWGSHGSRFAFESDLHSLLQLDAPIPNATLLRRWAAARARGRAWRPRTPSTPMTGSANRISTSAGRGHPVPKSVVKSSFQGVQEHLLSNTLVRVSGYIARHSADAVPYWMVASIRSVSNGEAKPEKQPEAHQRRKHQKAVGFGTLNGLSKYEEAQDPSAQVEKTTKMAPEGLSEADLTSTSYEAKKGTPGIQREELALHFLSAGQNRILGLRRENPKMTY

SEQ ID NO: 998917 - protein, 296 aa, Homo sapiens
MACSCGLRFAWVVFGPCGGAGLPGCACPGSAVQRAARGSSPLRTTSGQWPVSSKVWALSRTAGQWIAGSAPGAIAWGGRGVAGLGPWALAFRDGRVAQVDLGKLGTQRTRLIPVGYFTGWHYPTTSLWAPNTKESQRRGYTKCNYIKWQGVVSSPSRGPNRTLGTLPVGDHNPGKTIGMRASCLPYPPGKVHWQGPNRGTLGRPGPEKQDGDGGFHKENRGTPPESENDSASGRNGRPTWPEAQRGRTARGSTRPIACTHQERRQIPPKDKAGGGIGNRRGLGPKQTRESHLGRRL

SEQ ID NO: 998918 - protein, 102 aa, Homo sapiens
MAMPGWGPGSWPGTRLTFDVEAVGIVEKRVMLCHSHPTLTAFSYSCLLPMVFRTRGLLFALRLRKGNLCLAVDEHMMLTGCERIEGGVTHIISSRHKTMVTR

SEQ ID NO: 998919 - protein, 291 aa, Homo sapiens
GRRTPVAGIFSSFLDVLSVLMSLMCLGLDRGAGVPVWIPQTDVRVTVLARRGGLVGYMEARGARRQTRTAVIQVGAWEDKYADCGWSEAHAMESLPRVLQLMEGHASKLAIWMLVRPEPAGANVYSWRVDRVWHRGVCSVLDKVPGAAVRGGPAGSWTVIQAARNDAVGISRYLNQEGRFKVATQKLQVRHPVNEKNMTAAWYDLSMTRQVSESIVERLKDKIEGDALGDSGVQTRASVHSSLAGATIGRTRDDESGGKTDKKNKLKDQNLRFQVQLAKTAIPVMVVAGSS

SEQ ID NO: 998920 - protein, 124 aa, Homo sapiens
MKGHAICTSDFVDSNSGEYEMQQEHRRSTLSVTSISKKDRTQIYRDTLAFWQLESSMPLLWFPLMEDRWTFRAYLIDTCADTDVFLSLNCFHDGAWETPLEGTLCLLRSIPVSPEIKSLEFWRV

SEQ ID NO: 998921 - protein, 170 aa, Homo sapiens
ELCLDLLVRRAVRSQLKERGLSVANPSDVLLECSDFSGSGITPNKLTRQSRAVGHRRRYLETELAEHGGLMTVQLLEFQSSHRRSRTRTLDKSDINRRQHGCDLPRRPYRLEATWRLIAGSTMYAWKSSTYGPNHGRPRVRPYPHYVCWRTGTTMPLTRRHLTHGQLGPS

SEQ ID NO: 998922 - protein, 142 aa, Homo sapiens
IPPSELVGVNLSVDDKPTDLTCQVSRLGVFRYPYEYSTTQLEGFQSNNKDTVITSNVQGKSDEIGILSGGATQSSHWTRCIHARSFEGTGHPSRNVQRELLYKCGPEEHPHSAGSLGYRVNELEEKPEKYWQRDEIHRILPR

SEQ ID NO: 998923 - protein, 107 aa, Homo sapiens
MTAVGGPILFNVHVLIHKRAWFAGRTIEFSAHVVAFHRQVSQGKAAHGQFGVVYPQGVEQQRYFSTLGSKGSSGYCNELVPTVTAQLRHGAFYKGRTSSGSTTKAAR

SEQ ID NO: 998924 - protein, 118 aa, Homo sapiens
MDPFRQLKPPNQNYFERLIRFDCRHLRSNVISGVYRILRESLLATVDALHAVHVSPNRGDSIPYVRVTRNVYRVRPQNRSSDICIRSHIRLRAQCQLIESCWIDAKSYEQPEWGDASQ

SEQ ID NO: 998925 - protein, 112 aa, Homo sapiens
VLQSGPLSLHGKVPDRKAERQERTILMRKPIAVARSLLSDHMCPVGMILPPSDLAPWWVSADDGDEIDMHRLHGIVGSARTRRVLLYSNRTHLKLSEQSVSGRTPGLTLRGR

SEQ ID NO: 998926 - protein, 155 aa, Homo sapiens
MEAWASSASAAGVSVADVAAAGAVGCRSVLAVAALRRLAAGRHRVLPRTSVSEQQLLEVEDLSLSLLQGGGLGPLSMAPDLPDLDPECRELLLDFANSSAEADRVSGAQTPGPCASVRPGTPLLPTGRQHDGQDQPRPGEYFRESELCQKSLTGR

SEQ ID NO: 998927 - protein, 79 aa, Homo sapiens
GHSSALAPGELPGLTMERKVLVAPEALKEKDQGQEGHSPREILKSLATEGSAPHSESDLPRMQDRGDSGDLMMMSEEES

SEQ ID NO: 998928 - protein, 145 aa, Homo sapiens
MRIRVRLHTVYEGHDIGMTVFYGLELDIEMHSALISIEERMSSNIFMDMSVSLLFALDVIIVHTLSNERLIDSALAGADISYLVQFYRYSDVLVYASRAHSVDLFLIAQKDESRLISQIDAPSDRLLWRDVVLGGFLQSSLTVLA

SEQ ID NO: 998929 - protein, 185 aa, Homo sapiens
AVRRSRGSVSLLQGVSGRKQSPGTLVPALRYALRFALSRLAISGEPYFSGQSCRSFVETLRRHAPVVGLDIPSLARTNAMQLPSISRNSCATRRWRSCRHSSAGYNLCNLSGLPDSYHSSLRLSIFDRDRCGSGRREPLSSAKWPRRSAEGYERLLKMRKQRGGRLSSRTSGSQLTDDVVVEAQI

SEQ ID NO: 998930 - protein, 272 aa, Homo sapiens
GPRLLCTPDFGDTDMQCEPLKSAVATGFKASQQDDSMQGPVLHGEGCWPTSTHSRPGPTQMAVCELGPCSCTRQPHRTTTGTTWLISSPSQGTLTTQPPIRRLTRVWRGPTSHPLGDPKGGLGEPRQAPAQGQTRATGEGAGQGDARGRTHQRDPRHNRVVNHHHEETGTHTNTTDAKDNNDTEGSKGQGQEGTHRERTPYDTGAWRDSGTDNALTSHIMRRWHPTRHGQSPDSRPCVNRNGFRSYTPKRSTSNIRESVNTYTTKTAIHHGM

SEQ ID NO: 998931 - protein, 319 aa, Homo sapiens
LINRRSRVDPTLEAYFVTKVAPIYCFCTALRTSYPAAIVAYSSFLPLVIASNTSALHSSHGCQQHTSYSRLAQAHVITIIGSSTAITLCTLHHFSITPVVNHSSDSMLPHHSWVQTHRSIMASVHIRHYTVLTLSITATPYHLSTFSTITSNSLLVRTGFHNIYTSPLRFGSVIGSFLLTFHLTPSFKVGRRPPTPLCLPLFYSMAPNHNHVFPKFYVSCPNGTCYLQMTRKPKGKTTPLHTWLRTFTAILLLGELNVEQYHLCYDYHRLDVLRAGTPFCCHHFTARINTVYIVGAIVSQWKLIHDRARPPKGRLKSAR

SEQ ID NO: 998932 - protein, 133 aa, Homo sapiens
MFREPDSDDAYTTLVTGLRATEWSTFTHGSHCHNLRSCCLSTKSSVTILNLYVTTALDLGRPHQEAPSREAPRLQLPKEQRFNLKKRPYMTLIPSPLFYIQNPWIESWEPHSSKDSHLRGRGPPGGTPYTCDG

SEQ ID NO: 998933 - protein, 284 aa, Homo sapiens
AEHSAPADDTFARSLFAVYSNTSLPQRALDECDLSSMATVGYHGIYLELDTEEQEEIIQTLSPSVDAEAVQKASPRNWNLMTKMLSQHSDLERSNCTSGKSWMRSTDIINARDSGKRTLETMNLTAVDRLWTNFAAVSCVDPELTFHPSKSPDCITQAYPQHPMQAGAGDTNHAQIALDSDPSYTYPREPTQGPPCRAHYSSSKGLIKYTSHRKHAALCRALTIHVSRKHPFSALQLFPATTASMLWTLMGPRTAPKKEHIDQRSWHTVRIAAILAAQNHKHAP

SEQ ID NO: 998934 - protein, 210 aa, Homo sapiens
MTRSLFKGNFGVQTILSTIGYDNIIQHLNNWPQELQSSLTDFLTQNRAAHSTREVWHKICSTSLGRTAVWTRLQYSMSLEAGPLHQSSQQPSTTMCAHMSHSACHKRYKQERAPVTDWQRTLTRYKRQKTYNRLYTHRGLIPGLLSHYTPPGRFTTFTQPMALPRQKLIDSQKHCPGNNRTRRRTPRPFSPGSALTGGLRAGAPRNSPFC

SEQ ID NO: 998935 - protein, 599 aa, Homo sapiens
AAYLHITHTLKACKLTAYLTANPRLTLVLSIITTLHCIGTHTALLDYCTNTVETLTRLRHSFAARALRAHIALRVTTSHSHVALTSYYVTACQLRYTPLQGTLMSIYTRTQQRLGGCHISHTDSRHTAESHTHSMLAGTALDITRKLPTALPPSMRLHSNRRTPLDRGQLLIYLHYGHSLHGPLTVRNTDFHTITYFNPRPLPPHAYTPTTAPHLAPHTTDHAATTTTRLLPHPHTDHPTTPLFPPKPGLTPPRGPIYIRLDTQATSLHAHTRLPHSPHVNASPTRRRYSTPFPQARQLRNLPLIDIPLDTLAGLPQTTHSYSRRAHRRALTDTLNNGQIFQHYPHVLAPLRRHLPGNLPFATLAQAPHHPFLNTHHNRRHGCHPQDAQTPQRIWLHPHTSNPRDAQRAHPTHTQRPNVNTRTGPPLEQSETDSHDEGATPTARERITHHVGVTPTRLQHTTHKHRLFGTHSYPPLSTRTDLSGNQTIQAPHTSRPTTLLYERYIHIFHKATHPLSETSHSLTYDNKISPINSLHTTTNNNNQINKTHEHNSLTTTLNQLPFALNTPPQPIFTLHLTHLVQSIHHTIYILTLLCNILIY

SEQ ID NO: 998936 - protein, 265 aa, Homo sapiens
MHQIAHVTEQQDTTEHSNGNRTPCNFSSNTDSHIDTTHTSHRQVPGPPAPLPPYLQPLNRTHALDGRRRWLPHAPVIPSHPGATAAVHALLPWQVRRLPARPRTGPTIGCTPLVSYFTPSTPLTPGMSGGHCCAWRFPRLTRKRSVKPRDTSACTPRKVTTALAAAAFNTQFVPRTWPFPEHCVPTKGRQENFPLERTTDYAAKPWTEPSSTDRMVLASYTVSHATNSDTDKLPGYATQEKSPATTEPVLNNKCPHTVVTHRHLQ

SEQ ID NO: 998937 - protein, 113 aa, Homo sapiens
SSSECQITVNNVKIVILLFHQNNISHLAIVFYKAQSQEVQGVPIQVSQRKTPVRVFSVMFRDPYKFSNSRAFWYDALTFFVAFIQRIMPLASTFSTRLYNSRDSQMPLFPPQS

SEQ ID NO: 998938 - protein, 153 aa, Homo sapiens
MSTLSAEAALANQRELDTHPQHSLGTHNANQEHALSRTSVGDNTPPGRYQVNPEDNNATLRAEKRARKQTTTDTYGHETANSRGNHHFYGNSYCLRTTQCNTLFTPQHANHTTTSHLHTSSSPPPLTHTVSSGQGHNSDHKPHTTRSSRATTT

SEQ ID NO: 998939 - protein, 74 aa, Homo sapiens
AGRRSRGICLWLQQMLGRNRSGDSLPASDAPVRFPSVRHCETAGEHLRRTISVLLGTLLMHRCEVVSVLLANQA

SEQ ID NO: 998940 - protein, 207 aa, Homo sapiens
MRAPQLFTCPEWMIQLADQKQEFNKVGSKIGRRSVSRSISQSSTDRYSSGASYTDSSDDETSARDSSKRTLREAGDFCVKNIKRAECGEETIEIGGDKKCCIDGLRKRAQGEKAFVVEPKSWVDHTCMSELCAYGTLWVLLGGQCRWGWLQTSIPLFTEGGCLSSRKWVSVVGLEGRVRTLNLGGVSTQLCGLWRGCEPTLDLGLIG

SEQ ID NO: 998941 - protein, 84 aa, Homo sapiens
MPLRHHRLDKDHLLMKLSSKKLVKLSGAPSNAGKPARGALGPTASPGSNRPHRLHPLPPRQHPRPPNLAARPPQAPHQQHTGHN

SEQ ID NO: 998942 - protein, 71 aa, Homo sapiens
KLPKAVVCGVLHMYGNLNMDHDWFPRDIVVWTSVRVLTQYKTVWPLDLTCVGKNLKDVSLIEVYINRNDIE

SEQ ID NO: 998943 - protein, 238 aa, Homo sapiens
MIAHHVPQAITGCVWMLTRGKRVDWSQIEDLKQRKVMVAKSWPGSESNRTDASTHTWDTGVCVDGTGLEVMGGLQRNQAGCRSVDRVNHLEQRLVKVNWEKAFNNNTIKWGRDPGDYISDNHTPWSNFRPHPERSAQWCPTWSHLLTERQKAHVGDVRSHQCNGKRSDHVAAQGRTREGDTRGIQTKGVRESDPHIMTYARGGVNSRGPRDRHTKEAREESNRGASQSGTTGEGGNKS

SEQ ID NO: 998944 - protein, 238 aa, Homo sapiens
DWPRDGPAARGCSLGRQLEAEADEEADPPASDAADTQAIEPQCIVQQVPAPSRMQMPQGNPLHAVPYPAESWLARDTVQVELIPETKGLFLEACGVMRFQPALQVLGYTDGTIDFRGSSQEMLRAQVPHTVWWPALANQEQCWELTGEFIEARRKSPEALPSNCVDADNPLFSEDGGSSRLFLSFQRARMLKEASPQEVRNSASGGPKFLELVSLVPRAMEFIPGLTSRAHVCHNACK

SEQ ID NO: 998945 - protein, 404 aa, Homo sapiens
RPALVAWRVNLVYTGSVPCRSLFSPDSRLLCFGLKQLQELLTKNFKSQDQKEAKGAVQWHFSSNRSAHQQHRQVHLAPICLAAPDRTSEPRLWANSFLPKPCITAKHPQESVIISKGDQQLVLLCQDQIPKLGTSDLNRASGQHQLDEPSKTVTDEPTRSGQTGAACLVRHQRENKTSRIFLVTGRMGNNGPFCMGDSRTVVVQGHNPMVTQNYSRDQTRWVHTGSWSTGNNRLEGKALAKTAVTNRDDFNRRGWRTALRRHWASRTTGREHPVGGQKMIFATAIDEQPTTILAPRGPQHTAPQDTMGTKGEGPQPEAGHKPDRQAARASVAGNTRRARTRPRVDREAAHKDNTAQSKQQATEELKTHGRRRQHTQKESKTTQPSKPRAQTAPRHQERHTRRQP

SEQ ID NO: 998946 - protein, 138 aa, Homo sapiens
MALMMYRASTFWNYTIRSFQDKAGTSRSVPTGECKVSRNCGMKTMVHLFYYVISTARYMNEIQQIHVNGMFMNGGGVKSRVSPLSMIMTLYRWKTGKEDYDCMHVKKLCNSDMMLLHGIRTSVVAADREDYVHVVYTK

SEQ ID NO: 998947 - protein, 93 aa, Homo sapiens
AEEGFTQVTRKGGRGQKKRQAEQLSAAGEGGDAGRMDTEEARPAKRPVFPPLCGDGLLSGKRTEISPVKIHTIERKLDEDIYSYWEHWDFRYA

SEQ ID NO: 998948 - protein, 83 aa, Homo sapiens
MVSGVKVWSGDQRLEIIRGVDCTYLVFESYSRLSDDAEKSGSGSVVVIWVNRFYPQKKGKVRGKVDKPCKLGKSPGECRWSKD

SEQ ID NO: 998949 - protein, 270 aa, Homo sapiens
DKTRRLRLTPLFRKGHRHANICIHDTFVTKTVSLDMETLVTLSRSKIWQIHLNMQGLVKEILFFLSSILRTADRTNHRLCPTFLRLMKGNVTRLAPYEAQLKGYGNDTVRERFISHNGQVTAAQRSCSHYLHMNAISTAIPRTNWSSSVDIRGIDTCCYKDLRVQTFSIVIQTTSHLLSDHELTESWTALVPHQPRRTENSDSTLPGRFQCANMRYSVEMAVPCGNDRTCKTSKYPRYSFSQITCQISQPCLKVTQGTCTKSGTDTPRRC

SEQ ID NO: 998950 - protein, 399 aa, Homo sapiens
PRHKPILVPDAAGAALGPSEVSDHGHLLRPYGPSHDLAVVVRSCDSSTQSSQKTAPGAVPERSSNIIPTVEATCMVIYFGSESTSEVLELTSYYSTTLTVTQYHLNKPKQQLNTTINIQKQKNQTKTQQKQNKENITNIDQHNPKQKNNYTNIKTQTIRTQHTHNNRQTTNELEQRAKHGDRRRSERGERVHRRGQNRRSTQAYSDWRPSHSSGNEMTKTRAENKGATERRAAPRRSDDPQTTNKEKGSAGDETRTTAASVRRRNETQQQHDDEKTLKDEKRRLSAQNSQRRPDDTQTRPTTVDRTAKTEPEQTRADAHEHTDATGRGDGHPAGASGGALRREGKAAATRGCHRRGHTARSGRRRARRRRHDERSAPHSQALIQLIPNYPHNSILLVCH

SEQ ID NO: 998951 - protein, 118 aa, Homo sapiens
VSDPKEWQKIPSLREARLILACEVEETQMKKNKEPEKAARGTMSEKYVELMRKGSQGLYTSRENIQYAEIRPVIACGHQQQGLHGIQHPSTKTLLHKQLLLTGNKLFWDLLCENQLMC

SEQ ID NO: 998952 - protein, 140 aa, Homo sapiens
NKRKSSGFAFDPSVNYSKVYSRYRPQYGYWVIGLQNTCEYNAFEDSSSSDPKVLTLFMAVPPCRIGVFLDYEAGIVSFFNVTNHGALIYKFSGCRFSRPAYPYFNPWNWLVPIELVLPTNFLIFSISLHHISLLYIALCR

SEQ ID NO: 998953 - protein, 71 aa, Homo sapiens
VIGDGLETSKVRGIEDVMKVMESFLAVLALGGSRSVEVSWWFNSCTMEMGEKERSNETCHELVIEYTGLYS

SEQ ID NO: 998954 - protein, 207 aa, Homo sapiens
TLVLVYITLVRKSRLLSPLQPTVGTRRLDRVVSQVPSKASSHFVTKHIQATEKITDNNDAVTVEEIYYSDYTTALAARNQKAKSIHTQVKHVRHSSFPGTESSPVVITQEFKQSGEGSNGVTSKVCDTITKVLTEPGRMYYVKECEGDTETVCNMSHMHRNRTESTIINTVTKRVSWSNTEMSQYYVEPRSSNLQPGASLAGLALPC

SEQ ID NO: 998955 - protein, 75 aa, Homo sapiens
NWGRTMAEKTQKSVKIAPGSKSVCVAKCKSAGSMYTHRHLRTSCIPPLKRKQFICGKPGLNQCIRRKETTYTAQN

SEQ ID NO: 998956 - protein, 142 aa, Homo sapiens
AGVHRGRLGVPCGAVHLKAYVCVGGGGSCIDQWMIVGYSCSCVSIIEAQEYRGDGYWRSIIVRKPEDQTETVSELKHRVSLMPGFYHRVHMDLRSGVLTNEACLLCASTSRIPWGQLCGYTGLEQNGLENEYPTRKVTGVFI

SEQ ID NO: 998957 - protein, 258 aa, Homo sapiens
MHTISLSNPLHQHHPHTYRIHTHAPRPPAHPQPQAHPGPHRCSHEPPANQSGEPPANTHTAPPAPCLTPSFPQPPHTTPPTHPSHPHTPLIMPNLHTPLTPHSTSLHSLHDTPHNNTIQLPHPHSPHSTHPPLDHIPCILFKHHHTTLSLSQHQLCTTKTHTHITPKTNIIQPTHLTIINPPTYPPTPHPHPLSPLTNPHTLMLPLSPQASHFLPHPPPPPHTTPQPTSTPHYITLSTTPTPPHPHPPLHLHSPNYPT

SEQ ID NO: 998958 - protein, 237 aa, Homo sapiens
LSEAGNAAIEVFEMLWSLECGGSLGEAPERMLTRPHIVYALFLSLCAAPCLEYVTFGALTERTDKEVDLYRPRTRSLLYTSSGLCRRRGSAPERACPGNVHPPIIAMPGEPYLTRVDDEGENSGQNRSGVTHLPITFQECLCSYTEQVRVGQSLSDEKVLHAQRTKRLYGNGILCCKAPKVKFTLDNCDTTLGALGLDALSLSAIFNSSANPFGVILWQRTHTRGNWAAKWRTYSGS

SEQ ID NO: 998959 - protein, 84 aa, Homo sapiens
TVTATVAGGWVPETWRSRSPVCSCVRVGAETSPGQGSYQDGSGGRDSRRVHQQEETPGGRNLRQIAGEAARDPNLRRARTVCGV

SEQ ID NO: 998960 - protein, 95 aa, Homo sapiens
MTGSWGSLQAKGLGGLHEVSKRKALGTMCVTLCEISVFHQYSRGFPLRMSLGLGMGLTAERAIRSLVANKITVYFPNGHVLDLVDDSTIVIRQGN

SEQ ID NO: 998961 - protein, 118 aa, Homo sapiens
EREDEHSICMKMDVGSNKVLMESPGGTSPQISLWADRVIACWAQSQLEYSHSFIGGRCVVVLNRLLVDPCAHVLASLVVSEMEQEKIERRIESHENDRSDEVDATGKPKTTALGPLED

SEQ ID NO: 998962 - protein, 118 aa, Homo sapiens
LELLTSGDPPASASQSSRITGLSHCARPIYLFLRQDLALSPRLECSGVVLAHCGLRLPGSSDPPASASQVTGTIGLCHHAWLVFCVFSRDRVSLCCPGWSRTPELKPSAQPRAIHNSG

SEQ ID NO: 998963 - protein, 344 aa, Homo sapiens
MAWGAPAHLKRLEGGASIVDPGEGRKCGEWTPFLVPHVARPNAVGHTTAGERSTILKNTEKDTEQAKREKQGFTNTVDSTEKAPWEKNIHNAQPLFFDILHYPGSGYLTHLYMGAVRIPRWCYFVRETLYTLYKISFSTNPLYTPLFGAVNSSPTEISVPQKGFFVITLSGGARDTCNPKGENTVSTKAHPRGGAQFFSPEVIPPGGLDNSSLQRGEHLHPSQPGAVYTRYRTHFPSFNTAGGGPGGYNTGVRYLNPAGGRKYHTHGPPFGGEQPPQEEHSGVGKPTPGGGPAPQTELLNKYPQPCLGGPTRGVVVKNPPVGCSLTRKQQCSQKKYKSGRGDIV

SEQ ID NO: 998964 - protein, 130 aa, Homo sapiens
EAEEYVREGSVELAPGEQTCWAEQKLSSDETASDSLERNDDAVSMKVYKHEALITKKPNALEESGEGTGSQNAIFNVIVSGNHNNMLSQFTAQKKEIHSVATWSQSTVDVIQRDPVVHLTDACDENLHLC

SEQ ID NO: 998965 - protein, 231 aa, Homo sapiens
MIKRKKKKRRTVSRFDPDSFKRAKLRVQFGSPSGGFFKDFPIPDVTLKRNISLNSLDFLAIGDTSHWLGTGGGHTPKFLPTGLVSLPGGAWQGPLGNVCVWPLCRAGAPSAVMEPVLEDLYWIQKLYAYTRTPVLLVNFNQLLASSTVEAWTAGPSLAMDWSGIRNMVHSRFTQGPLPRGGDSFEDPNSGSKGLSPLGLQNFGSTQKFLPFYLKTFHKHTTQNLVGLPQNS

SEQ ID NO: 998966 - protein, 30 aa, Homo sapiens
MRLSDSDSGPNQALENAGNFHKHPFPPNAP

SEQ ID NO: 998967 - protein, 64 aa, Homo sapiens
MVPELSQCIDQPLGGPSLSEAKYGHLPQNVRSLKYWKLVVAWYLDLSTFLEVLCQRIAVKGFSS

SEQ ID NO: 998968 - protein, 146 aa, Homo sapiens
TLSYDPITAAIQIRILSFTMTVLLTKRMITQTSITPYIVFPVSAYQVQGPSWMQAQHIFYSILVAVYNIPQWSTTIVTTSPHLMSQPCCVLDRMYSICPLGSTESISCLERQVMQREPILPTVMSLYADRQRFLLRRQVVNSRWLV

SEQ ID NO: 998969 - protein, 172 aa, Homo sapiens
MTSDLRLHSEEHSCALVQSSVSLSTDTPFWAIQTIIRCSSGQNLSKGMYVADVETGRMRQTQALADQFEDKTTSVLERLKICVLLSSTTLTGPLQRQLAKLCLSELGCTSSGPSDIGEELEMWEDVVILCMNRAGQHGKAEEILRQELEKERGGLVNTGCLEMSSETILGMT

SEQ ID NO: 998970 - protein, 210 aa, Homo sapiens
MECGQERGPEWRARRNYLQLAPRGRLWQVSHAFSRGANLENGAFCIRVWVVGWSVIDRWLIVVERLGSMEIFLALSPVEHLLENGYHEMMSIWGCRKARKVWTPVVSTWLPSLRTLVDTIRRHKLGPSEAVWDLSQAMLSDSRVPEANRPWLSCMVLSIDTIRIAKKKHSPRGHVKGLFKYEERFDQRFSRGIELFMYEANGAAGRLTCR

SEQ ID NO: 998971 - protein, 157 aa, Homo sapiens
MTYDIIEIPDRKLDKNYQNLLDYSVIAYMTSQFQSMRTTYRCGLDIRQEYLDYCASSTNTTLRQSWTTPIHYKSSINQIVIVGNLLVTDKSSNGHIAEFSLQLISAIVNFTYQKNECCKTNSSADGPCSSEQYQNIDGLSISESVHRPSYGSEGLLS

SEQ ID NO: 998972 - protein, 146 aa, Homo sapiens
NPFHLVLRVGQALQFESPNSLRALSVPGPCEGLGIRDEIPAMKAPTGLTSKRVGTTPGLAGEASELRLYEEKPEGGAQDASPEDVTPKSNLIPQIHTVIFVESGAVWDRWISELPVGTKMLRAWFESVCMTGREGQHSPRQGAQTD

SEQ ID NO: 998973 - protein, 230 aa, Homo sapiens
MSILIFNNFISCTSCNIKHNPCPVILLKRHLEFNYSKGRLAHVHLTFLWHLASSKHISAPPSAADSESWACCTPYFFPDLRTCVSCKNIIMNQSGCLIMSTRSRCAHNLSSPYVGPVVIRCLRQKESCVYTGQKVQVLGVLPGLHSQYCLLTLVHTHPGTLNNKNRSGHTTLTSGGWTYPDYRLSRHENPSMWFTTREQHQWSSGLTTTLPVQQLDYNGYWHLKPYSLPH

SEQ ID NO: 998974 - protein, 308 aa, Homo sapiens
MSPRQFKLTQHKTLGHTGFTYATFTICRTRVNPFDDHGFNNGSERFLTHTVRYAGDFHHYYYSLDNAPHSLSSNQHTMTGIPHTPRTRAGRFQSTGALLCESSPVGTAIARIDTLASSLSYHVTLSFNRRHFITYTTELDKKHISGNTNLTIMARPLGPTRHTSPTPHPLAPLPPTLPHPLRNPLGHPSPVAHHAATSITAAQAAGTTHITPTLPTQRTSRATPPYPTRLLLTPLYPSTTTHTTHSIPPSPHTPSHPVFCTPTSPHHQNSHSQPPSQHTPTSIPRYTHVSQPLHNHTTSPIHHPPHSQ

SEQ ID NO: 998975 - protein, 207 aa, Homo sapiens
GWCLLSSLSQCAELSAVAICQPCCTGHTCCATPCAGNCSCFGLRPMPWLDLQPRWSPGGHFRCPWPKRNKRGRNPGNGPKGATRQNGAQNTHHGTVEPIWFPKPINRTLYVCLVPDAWCDTSAQRTPLCWVGSEPKQNNTASVGPSSGITAGDPPTRKAANPKRAGQFTNTTEGKKNAYTQRTKRHTPHGETLPRKAAPAVYASGAR

SEQ ID NO: 998976 - protein, 105 aa, Homo sapiens
ERQEQRQTEREQRKKNRHRKHNRTEQNRTATDNDKQTHTQTKKERKRTERNATTLPSGKRPVPCGCWAQFLRQFVNAFPVSPFALRTQFFGTPFEWFLTNRCFPC

SEQ ID NO: 998977 - protein, 220 aa, Homo sapiens
DPQWLRMGPARTHDNGATTPMVLPCLHTTEMCVQIACLSVTCFSCAFLHCVALPKVRRWKLTKAFPLVALSPVQVEHPQETTSDRLLRKALAMPWGWKNPPARRTHMVSVQRKARQVDWPQQSWWPPPCPHSKHRFIPPRSQRTPDFIQLGQFPSFSPFGTSDDAQKRSGWYGGKRCRRYRVNPRCPAIYGHTGGKTFPDGMGKKLGGNAPDLGIKSVGT

SEQ ID NO: 998978 - protein, 362 aa, Homo sapiens
VAETGLPSLSDTKLADPGFSWAHSEATHGSGSKSLVLAPSACPGYLLGCCGMESTPYPMWQRQSLCATTKLPRLRTAILRTPDQVPPTARPASATRHWLTTQDMHLQGQPCANQLAPTKAGQRMAPQRHPNGLTRQAYDTWIGPTGQATPVLVLKELLVPTVDTLVTYGFIHKCDQPTRESNPPVRAQRNNDGGTPNEAHTTGSAFTTTSKMRRPPYHEQSPIMGPHQVTQPKTQPLRGRRGAAECKKQTNNNRAGNVTSKGPAVNTPTPANHRRSWSWARMIYHPTDETNAPKEPDPPATPPVYHRIPYTHKPKPVAPRIRGPLGPPPPDACCHHTSDTRKGSTAHMTYPFVTSARPTLPN

SEQ ID NO: 998979 - protein, 240 aa, Homo sapiens
MTKKRKPVVKKIVTPCIFLGVAEGCVRTSRSQGEHVRRVQIEKKRFQKRDVTMGNERLVRPTKIGQHQATKARLIKGGSFSSDTGSQREAGWTVYQKFGERGRRVVTTEISVLSNSWDYRHMVKLPLEPFRGRLTQTFAPFVRQSIGEKPSRGQVNYKSEGDTYVGELHQGWVGPDTLVITSGFHVRLFVSRKCVEITLWWALVYTRKAVLLSHTNTGYRWGLGTVLSTSCSHSSYFDAT

SEQ ID NO: 998980 - protein, 71 aa, Homo sapiens
MPHSSRRPWTSPGKLKGPCTHSKQGHCRSNHVERDHTEQKQTRDIDSRQTHRTRGGTNQRGTTTPGNTQVE

SEQ ID NO: 998981 - protein, 314 aa, Homo sapiens
MWAAELLLLLAGGPQANVDGLLKDHCRWGCRALLEEMRPCAGGCPNGTKMHFKASSPPGPRLSTEGSVWTSDPDNACEKKRPFSFLRQEPWPCAAVAQSISEKEINAGFPDLVAEAKPSLCQLGCRSWYVHEPPWDNHGSSLGQRDPDGTIGTLGAKYHLTAPWVTIPESRATNERWVAPAMCTKCRAYEDNVGTTLTGRSDPGRPKQTHPVTSWEPLLTSVPAFFHSGECTTQHQVKTPQCIGSGTEAEAKSRNSQKNQFGQAVQTPNMGKGSLCRCVSRQCLTAQREKPPVVSKEFARCGHPSSRWIRWEIH

SEQ ID NO: 998982 - protein, 385 aa, Homo sapiens
MHKNCPVVANPELFLKPRSQDWRFLAVSYNLGESNSKPGTYQRQKHSELLQHFNAPLTRCGNTAKKQETDRRADVAPTQSDRADSRERAASAEGRERGQRAAKGDEATHEAQATESTAGEAQRNAARPQAEESGERGRTQAHNTQGEQQRDEANAETNKRESEQKSKRTTREDKHEQNTRRKKSRETKRDEQDSKHESRRDAPGREDETKATDQIETRERTHERSIGKSEKRKETRRSKRGEETERETAQDKDSERERKQDNTEEEKERKSETRQRKRNREKKETTGNRKERELKDGREKERTNTRERQRGEKRRREQRKNDNEESNSDAERAERTEARRRRNEEDEETEEEKGQKEKTNRGADTKQERERGEEARERDAKEKRQ

SEQ ID NO: 998983 - protein, 279 aa, Homo sapiens
MTLSPLLLFLPLLLLLLAVPTAGWCMAVPYCKALDFSWELGHHVNYARQAIYTCWGPLNEVQVHLLVTCDPLPMKHLCGWLPSLPDPEELFPNDGCWVMADSSDVTLVPYGNAHGTKDVSRAGGSSTCQHGPNQELQHSPKVDGLRAALNLTMQLAFPDHSLACHEWSDLHEKSATYCLQRLQPQGCRKELIMGVVHWADRGMLLTPRQGPQRTRWSPATDRRMCLGVTAKRGPPLGTIRPTLLTWDDNRNKGKQPDDGRHQQVTTRHGSRDAANSGTH

SEQ ID NO: 998984 - protein, 87 aa, Homo sapiens
MSTCEAVRSIQKRSKSDRLREVERRRRSERWVEWGSGEEEEKREKKIGKENSDKGERGKDQDRKEGKSGERRRKRECKEERKKREIN

SEQ ID NO: 998985 - protein, 148 aa, Homo sapiens
ARQRTIVKESACFAFNMLPLNLTCRKSCLMCHSTTNIRGIPTRRGLVCSQDSSADHAFKLCKQPACKAGQNCKASGKDGLFRKLLTHICEWMASFESLMGINTLNDSVPKSHFYISLSWVLLKNVSIGAVPPNLFFISSEGVNRRIMV

SEQ ID NO: 998986 - protein, 86 aa, Homo sapiens
IRNEGIANAMTVSRVSRDFCCSPVHDLAVPGDDEVVTITQRCPSASESTLLRSSDARLSLITWFAVCDNAYVIQVAIMHAGIYDAE

SEQ ID NO: 998987 - protein, 222 aa, Homo sapiens
TAVRAAVPPAAPQRWKQLLHALWPMLHPACKLPCMLVLRHVPWLADAAPRSWANGGPPLDGLTEWSGYLDDRALKAGLGLHEKTDGVRAMNGQSELQENPGLRARQEGCPLRDREAPGRGTRGSPEATGDSVPCQLGPIHSHEQHTTCILDPWANADSRPRVEHGDAPCALRSTLSKERTPCEPSTYQFRLWLVESHKTSATTHTLLEDATSVGRLALGESP

SEQ ID NO: 998988 - protein, 303 aa, Homo sapiens
GLSELEMQLLRSSNAAELEAEAAGEVPSDVTRPTYARTTSSTPDRLLSTKNNYYLGLTGQAKDQKVVVRPFRPSLPSQPFRPVREATGLDMEPEQNRKTRDQDERHRNTDTQDKTQQEEHQTTQKSQYQIVRNPPGSHRAHPRRNMSGRGNHRPDRGRIANDITNAAQRVGEDEAQNHKGGDICQERNREIALYASVRRGSPRLPASPQEGTPMALSAAPPYVYVGDEEKDRHGWLDAAHFTTHEGTEPPRSKPTSGPTQRSQNEAKLVGAYLSTGKLIEDDAGHYSRTTPIERRRQVGLRDH

SEQ ID NO: 998989 - protein, 274 aa, Homo sapiens
RRSSPRVVGVSCFNSAWTEPGARSPPPVWLPIAMTSVTSSHAPSDVTQWPHPPDCIQLPDASHTNRRPGRTSSIRSADHERPRTTLDRCARNYHQDSRGRHTTAKIKPGATTPPTVYLSTVLLHYEPQMTVDSLKENFAKTTYTLTHISIEREGTHCLQTPTTEKLAATQTTVDTHSSLPRLIPGKRTQNRGGTEPGATRTATCTAANAEGGASDPSRDRHKPAKITGPANAGTNAAPHTQAAHNEPQQTQPPKKTDAIHLPITPITLEMRRAR

SEQ ID NO: 998990 - protein, 249 aa, Homo sapiens
VPIGDGPENWTFFSVVVVFETGSLSVTRLECSGTISAHCSLCLPGSGDSPASASLVAGTTGAHHHAQLNFVFLVKTGVSPCWPGWSRSLGLVIHPLDSPKCWDYRRGAMRRLRIGHFQSVALRGWWQQHQGQFSGEGSRSRDERWRWGGLGSGVSDGNADGISRGQWDDTDWQWRAKCGGHSLGTPQPFGEVQVGGSLEGQESSQLGNMEDPHLYDKNFNIAGLWAVRCPHGQETEVQNVLTRIGLGGC

SEQ ID NO: 998991 - protein, 376 aa, Homo sapiens
GGGAVRPGRVCGVDLTDARAGAGLVAMELLALGALCGLLWPGGGLPTVHEQWENLWLASVPPGGSGLDLQHAGTGTPWDTPYTGSLSMSLVAGLSLGRAGLPTIPNVEALRPPHVNTDNQLPHLHSGPRGQANGDQKKGRSKRTEQHREDKRHKGTHDETRQDQQDKIKDRETRNENRTTASHTKARNTQRRTSSSRKHRTNREELRKTQTTDTPTMNHKKVENRSAIVTAAQQAEPGGNRQTEQMTNNARPTCAGLHHTLGQVTTEARLAPVGREHTIENTAETRATRDAEAPGHPQTKTVEDGEHHQTTSQQTHRTQNNTGPGRQTASAEELKRKNAQQTQQQEGAHHETTARQREHANNEPPNHADYEEGRNS

SEQ ID NO: 998992 - protein, 117 aa, Homo sapiens
LCGAVLVLARPTPAARARERRRVAGVGRVLCVALRLRRGAGGRNVGAAGAFLSYPNCGNNGLTGGRWIEGAERGSELHRGIMTSAAVQEHPRRNRMILVWVTFPSDEEDIINSADED

SEQ ID NO: 998993 - protein, 299 aa, Homo sapiens
AFPSSSYKMGKSFANFMCKKDFHPASENPNHPTHKYGWQQLSKIIIMHQAQHTPQKQLHASQYLQSNKESSCIIALLHGQHERVTAMAFNFHVMQAPTKAAQQHSKHESSNRKDTPARSSTRITNLAMAAQGSPHAATNHAETLTMNSQQTQPSWSFTVRQCAGAITMSTNGGPCQPQIENVLCGSFWNQCKFGSTDGSGPSMHPGANSGDETPVGMHWKRQCHWRRNLTAHASNHQEVHVGQVTAADSKDSSKVASPARRPHNNQNTKKQTFSGELSIRRDEAHNTNRQPRKTASGRR

SEQ ID NO: 998994 - protein, 115 aa, Homo sapiens
MACAQADGAHYSGKNLHPAEAEGPGDGTWNSYMPLLVIWDPTIKDSGLERIQIGTKCRPKGPTTVTRGPRTKYQEHRPLKRKAKTIRTGEHLRETSINTTEQQKKKDKNDKKQRD

SEQ ID NO: 998995 - protein, 124 aa, Homo sapiens
MPLFWIKGYEAPWCAGKQDCSRMDGGVKHRRYRPTKNYLSYLTAPRIILAFETDVTENMNSKDTVLSRQSNLTSAQYETTTELPDPLLLVNNHLTLLALAPAMCKQFYGPVRALTTDQNCRIWN

SEQ ID NO: 998996 - protein, 149 aa, Homo sapiens
MTGGIPRHPQTKEKSRSSNERQNKESNQQPTMKQKKNTHQTGTKTTKNKTTSKNDTCKKEMTRNQRNKERRNIHKKERERRKKTGQHNHQKDINKGDETKTSYSHQTTMIENNRKKKRKGNSKQQNTTRRIETDKTQKQNEATTHHDKQ

SEQ ID NO: 998997 - protein, 114 aa, Homo sapiens
MWAQTRGHILIRAHVQIINRVGHIYNTCGPTRGKSCLDEIGVAQRGTCGRGATYERPLSPKRAHCSQPQVAAEQDHMSKGAPPRKHHATPAQTSTKRTSGTTRRPRRNRQPTYN

SEQ ID NO: 998998 - protein, 233 aa, Homo sapiens
GGKKDMGHEQNQGAALATRCNQFCRHVIAIIHVSRSRVSLLTHNVAEDDLAKIIDIHCNTKCTGRVMRGPQVVETSPERTYIDADKTVSVLGLFPQTHSGWPQPCALKFVLDVGITEHRREIASLPDCKFADHKKSLAELGMTPGTIRRPNTLNGDKFPGRPRRRFHIRLKLVQRLTAPLAVLGNAPTNSCARVFGHAQSYLPQTQWLAQAGNCGRRIPYPSHPCANSDLRRP

SEQ ID NO: 998999 - protein, 368 aa, Homo sapiens
DVLRRESSGFPASTVLGRNPALVPHPGRPAIARPSVTVFTAPVVTAQGPPAHAPDAASDTGRLTHAIILKSHANERTGVTTSAGLRQKLPPRTQKAAINAQTPTWELYRHPYVYHVPCLTIMTGDRCGFEELCKYFLHNSHEEREHAEKLMKREEPRGGPNLPSGYHRTPECDGLARDGLNANWSCALTCGTKMVNQVHYWNWKNWAMKNIEPIVLIHGDNYMNEQVKHQDWVTVNQLAASMGKRTNLECAEHDLGKATLGRHSKGKQQTGLITKTAGETGGNKADETGTRTIQKCAQQQRRPGENNLQTTGTRTEKRKKYAPHTDKATQRKREARKKKLKNEKARTKQERGNAQPTPCTENEKTPQR

SEQ ID NO: 999000 - protein, 83 aa, Homo sapiens
MGGRTHRECATKIGGAAAATNSRGTSVTNSSGVRHTILRRTSPPAGVGNKPRQKKNKQTNTVGGGRDEARNTTVTAAQTQTTV

SEQ ID NO: 999001 - protein, 152 aa, Homo sapiens
RASYEHNVKFAVSSQYCYTIDTMARETDTSNRRIACVAVTSSRLLALRTITIFNHTLRASRTQHVTVLSKLKYDNWMCRRELIHMVVLSKLCESNVKLRCFKLIQCTVLEIALSYCSNLKSYYKRIKDDESFHFRAKSYYVNEKIQLWDNYH

SEQ ID NO: 999002 - protein, 103 aa, Homo sapiens
GSVAAADCGYRVREDSALFSSVPWRLRKPRSVVRIASEVYDELMMAYSGARSTGEGRQVEVGVLPTWTTIVDAEITRMIGWRGRSDIIYGEELRSELSIVLGP

SEQ ID NO: 999003 - protein, 77 aa, Homo sapiens
GPNLNTTSSNPPEEETPFYTNTYSDYRYPEVYILYPTRLRNTLPYVTYYSGKKRTIWIHRYGHELMISLGIPQGFIV

SEQ ID NO: 999004 - protein, 395 aa, Homo sapiens
MQSKANKHQHRVSKKDMHGQGSSMHSSLSNGDVTKIGISTNDTIWKQQKGTYTGRPTEISSTRIRKGCKLAVHSISLIGKGCTFKNQVFRQVNQIYKQSFRYRDRNIKTSKVCGNEADIFLIKTEEARHFDTRGRQVMHLSKRDAIGKTFHPWAPDPAWPRTTVWPDSQFSKHTAPFSAYTAVDLYYPNTTGDQALENNNGGTHRIFNIGEAAWRKEALATSHKCRRPGQETQQKETMRHTALGETDRTVGYQPTPPSLTAGTPGLDKRNNSDTLPREQNTPLAERTPIIQTTWHTKHTTSTIKSVITATCNRSNGHIRIQYTHEETPTIRTNRPAHENTKQHHRYTTTHTTRPPSPQGRHTPGNHTNSQSTPTQAGPTTRHDQKTHTQKTKNTR

SEQ ID NO: 999005 - protein, 170 aa, Homo sapiens
MTANALNNEYSDRRTYKAKINNNRTLLHNTPSHYAHRKWTTMQKQSDKKRPHEGNKRKTKRANARRNENKRCHDRHEVRAAHSGTPTTEDMPQRVAAKRSTTAQTTRAEQKPKIREQRAKNAEDTKERKNTANNAKIKESNKNNTAKQHTESSIRATQTQGQHKGTKTAE

SEQ ID NO: 999006 - protein, 261 aa, Homo sapiens
MALITGHPLCTGGQSYPPMHWGPAPSGSIPIPQGFQRKMSPSNMRSHRPTATAGLQQDHNRLHKLATQTGVGYAGTRTQSKISNTPRRGLAHACGRETTNRHQAYTGATRDPTTQQHYRATPPWEHTLQTHPANNRAPGHPSRQPGNRKRTRVATPYQQCKQHTTNNRAYSHADEQQENAHQPLPAPHQRHTERKTTYGQPNNTPTRHHATGPTRHAKPTDQGSRSKERETQQKSQPPGADTPTAQRRETLGITRDTRQPQ

SEQ ID NO: 999007 - protein, 283 aa, Homo sapiens
MACVWMSMVRETACLYQCASNGPGPGRSRVVACRKGNDTGLCNGHPKKNGHLRVHRDTRTTSRLIRAIDCGRAVRLGLEFHWRSEAICRDVVSGDGNVVLNCTQSRAMTLRGNGAGAEPLHNGSSISYLIYLLLASNEITAEYLKRLTCIALVYHHSEPDMVESPMLPHVSIWLLSPDWTLVVKAMSLQTGGNGAMRLLELNETRTQIGCRDTRNMEAGHSGHQSKQQESGRSTRAHKDRGKQQKRRGKAKTQRCTDARMRLPYTSENVIKMGGRMRRRRNLQ

SEQ ID NO: 999008 - protein, 178 aa, Homo sapiens
MTTDNDWTLGLTPDKLTDDNEYDLTNPTDCLMEKCSEELYMECTTCNGTALAQSHLGATCTKREYGHSTPAPGKMAAHEGQRTTTLKTHGKSRTPRKRIKEDHEEQQRKTTNSNKKPPRSNTDQTRTHTAKQQPEQHEPKHHTKSKQRNKSRTNQRGKKAKRKRQNNTHRTNSDATNT

SEQ ID NO: 999009 - protein, 296 aa, Homo sapiens
QWLTPVIPALGKPRVGRSLRSGARDQPGNMVTPYLYEKYKNQPLYTRWPQKLRRKLLTILKPKQGSEGQDGRVERGPQAQTKEDPRITSLHGGQDMRSGGQCNVSSRAPPGETKLLTTMHHQSFLLTTESPMNEAPGQNKQRTCGSLVNVKSQQGTKARTLYDTACGQQVTPLMRAGWKRRHDVRMVLINQCSGMLPNKIGIISRDTRGEYKNMIRITLQQKIYTLGRTLKNRTPGEPEKRTRKRVKNANQGHTEGDHVNRLMVHKTRKTRQRYKGRNHTKRRDGGQHDANHKQNG

SEQ ID NO: 999010 - protein, 345 aa, Homo sapiens
TQSQTHSPGGHTELFLNKSQHGSSAGHYTGISSTRQSKRSSHHQTYAPTRRKKEKKQKKKKKKKRKKNERRKRTRKKKRKEKKKERRRRDETHEEERETRREEEEKKERRTNKTEEAEEKRETKRDRSTGDGRKRRREREEEAERGGEEEEGRRREEGRRGRNREGGERREEEGGGEGGERRRRRREKEKGQGRAREEGKENRDKKRIRERERDRRERKEKKERGAEEREKGGTQERKEGTDQRKGQRSNEIQQIKTAKNNEQATETTQRARARQKKEREHERREERQRGDRQKEEKENDRQAGQEERTEKSDRKAARKDKRERNRERSRTDQKATQRKHDEPAN

SEQ ID NO: 999011 - protein, 201 aa, Homo sapiens
MGRIPQNDSLENMEEKQKDVYMIRGDESATRAQQEDTHETRSTMRNDSTFLTTNIKTKEANKNNTKENQTKRNKQTSTTVSTQTSYKKSKQTQRKHTKTQNTQKNTKKGEEQEEPTRKKNKTTEKKEQKRSTPKEDNNTHKTRTQKEEINRRNINTKTIENKTKDKEETTQRKDNKQYKQNSKNNMTETKKVQAEDRHRKR

SEQ ID NO: 999012 - protein, 124 aa, Homo sapiens
GAPARDRRIRLTRHWILKPKHDPESGIFCVWRGYCILSSHRMGTGGTNNSTDLIADQRADTLYRYRDSELIQSDRRRGTTSQTYRADSVISWLEHIVFQNLLQRLQINIFILYLAPYRLCQDRE

SEQ ID NO: 999013 - protein, 534 aa, Homo sapiens
MEPITTPHQTTSAAPTPAPHRATPSTMPRPTNAPHPASTPTYAPHTRALAHPPQSATTPKPHTHPPTPPHPPPPHAPRTPPQATNDPTPLAREHQAPRDTATPRPAGQTPATRPPPRTHSSPAPPPPITLHRHTGTDPPPPQQPRPTRNHHSARAHMHTPRSHRDPPHATTEPPPQATPPPPPPTLPHQNAHRPPAPLTPPDTHAPPHTPPHTAPHTKTPHTTATPTATTREPTATRPTARHNSPAQHTPSPHTTPPHPHTTHPPSPPPTPTTQPPPALTTPPPQQRTNHPTPPPDDHTPPPPPLTPPPTRHTRPPHTPPTHHAAPHPPPTPRPRPPPTHQQPTTTTTPTRHTQNDATTTPTPTHHPHHTHATTHRHTPTRRPPHDVHQRTSHRQTAPQQPYTTQRTHATHQTTLSHRQPTIAPEHNHSTYRHPGPSQTAYPPPTDAHSHPTARRSRNAHPQDTARTRTTETTHEDEAPTTTTTYNDWRTRAATQTDRRHTRQQHHRHVTDTTRDSLNNKTTATTSRPPRRTIN

SEQ ID NO: 999014 - protein, 684 aa, Homo sapiens
YFSLGIKYVFNWYISDGWQAMPFIQPWWSHNLFTSTDEQSPPSAIIITAQFISLETANNRTFPASSKLVGILVPMQTSLTQFTWPMPALGTHNHRHVYSPKAFGSNSHPFSPQTGWTNRFIKAAIQPFGNPRTFKGNFFNFPSQPHLSTTVVSIRCRKLCEGPEAASYTTYLNNVNFIKGNTLTLTFVTAPGALVKRRPQFHGTMAPKSHFGAGKHGGGWYHNVDPTLGIIIVTIDPGTYLTPSSQETATAQPDKHPPQSSYSRPSNFSPNALLPHSRLTRWNIPTGAYTAAYTFLQLKDVTYLTGQHKHSPQAPVTNAHAIRDGHLLGYVPPRYMTPFSRTPVSETPKNGGHNIGGGPHKYMDYTTIGGDMGHSSHRGIMLWGYKHRAHRLVHNEYGTFLIRKQKCHLPAHLQQDFSTSHNGARNHTGAEEHHEGNQQLTRQGQSPQLETTEPTKRDADTTGGTPPGLRENTPQPGTITTQIRHAHQLTRPHQTHVRASRGTTQHHNEYDNTETHRAYGPHRPPHSRPTTNTDETTALTTPHDDKQASRDKRPTPITPHRTASINDSQTPMTPRNDSDTNGSPMTHDTVQHSQSRRERQINAAQQQKTLMPQPRNSRTANTNHPNTMTHRPHTREKNRGPPTARTTQRTTTTQAHDEQTSDTTHHKATTLRRAHTHCTQGDKQ

SEQ ID NO: 999015 - protein, 124 aa, Homo sapiens
KKSYSNDKRYLVTGLCAKMERRKLIVAICLMTLDRLVVHASTLPAVTLELHETYQTKLCSKYSSIGASIQNACMSQFSGFTYMCISQTIAKSQSDKQRGEAFVNSDLNMNDFGNIDAFLGVDMT

SEQ ID NO: 999016 - protein, 41 aa, Homo sapiens
MTNNSSLQRSDGSILIVTLLAKSFCNNRIVQRGTKVIVIPR

SEQ ID NO: 999017 - protein, 248 aa, Homo sapiens
GKLYLVGNNYFYDWDVGSIYTYSNLYALNNLVQRSVAGIPRACHNLTRTRPNSALQQASIDEAQFNKGVLVTVFSGHSYTRWRPSADYGHAQHMMAYPFRNQITKGTHDKNNVHGPRRRQSTTTGTANGTKQTLGATTQLSGAFKTIPHFPGLTPTPSCCFLPRNEYRQRQKTRVLRQHSRENNHKGVAKWPLGEIPRLYPTDSPDTGIGEVARSRRGTWIVSRSERVVGSVNRNATDLVRTDTCGNT

SEQ ID NO: 999018 - protein, 162 aa, Homo sapiens
MDASGVRDHAGAKVTETPSLRRLTKIRRMSLVHCMKYKDNTKKAERGRRIGLATPEKGARRRKPVTSAPYDSREWSTEKQTLSQNNKMSLGQADKAWGINPWRVERGDMARPEMATSGPRDTAYKITHRGWGTRYRLEGSESDQGRGTIGSTAATKRLKKRG

SEQ ID NO: 999019 - protein, 452 aa, Homo sapiens
VAGRTVRQTESGVAAGVRSHGVNDYYQTLGLDRGASDEEIKLGLPHASALRLPTTAQEPMEARAPDGHTVSTAPLAWRDLTETGAHRRKPGRQSAERIPHRHLTNAGQSAMGPSQREEELRPHMVCGQGTRGGRGSRLHRKLGVQPPSRLYTDARITHTISPHLWETKPRLVQLGPIVVRSGPTNSVYKYHQGSGEHEPNLSPLLCSEPRPKLISLLRESANGATNTTRARQLRNHSGANNSGTPKFVQAVEQHPTQDINTVQLDSQSPHRTYNLRERQTLESSHRQGRYNNTANHKRASATHSIHNGEPNRTTPAGDNLQVGPTNYTSTRRHSEVNRVRKQQADKEVQGAGAVSAPTPTQLLDYATQIERKAVSSDVNVIYVRPAVLGSAAQSPLLHYETSNGERLCETRHESDTTLICEHPDYAAHPKTVNDGGSNMSTPGNGDKQQKLQ

SEQ ID NO: 999020 - protein, 292 aa, Homo sapiens
MKSQSEVQKEEIEEASANARKRKYSPSLPLRTNRITDTRVARKANAQPVNGKREKSERRRMSHTKMLTKEYGRPKAVPNIARSSYFPKNVTAKRRIGQNYNHVKRRKPGRRIYELQQDGENIWHSDGGNRQRMKDPAQKGDITRSDQMDPLGERINCHHEQKPIHIHQCPVMPLTGTMIDGNTRWKPRRASHPGAAGNGNETTVQRKTETSTWTINNRCTGTVAAKSHKEVSNKQRPGRKNLTGHRRRRELSASRTDHGETENTRRPDSNPARDRQPTQGEKPEATTNTAAN

SEQ ID NO: 999021 - protein, 230 aa, Homo sapiens
MRIIEREAEDAGAERCTSLQPDNRADRLKQNTKKQKKNKNKFGRPASEKLNPSWGRGQVRNGAGVPGTPGDRGVPKKKAGGPGGCRKHPRGGVRRDHSGTYHKGGPKEEHQINKFTAGSEEYYIDRQPQSANRRSSASDNERANVDGRKQDSEPAERRRARRREQRQAQTQTERQKAERQNSNTKAERHHKEARTEEKTTKQKSKHSTDTRKAELETETQEGGTTESGRT

SEQ ID NO: 999022 - protein, 302 aa, Homo sapiens
RSACTKRQGSMTGEAEQKKRTEEGEDERRRTRRPTELRKDRERTDDGRPILARPYSTGPDRPDHERTTERHRHLTTTDRTTEERQEKDTDTHPPPLTHTEPHDTSNPPDTDHDTPDRHTPNTPGNRTATTRPVTAERPPTSHATARAHRPTPDPWRHPRPDPTGTTSTPGNPTLHAHARQTRNGDPAPLQWPQQPGHARIRPQPGPHDSPTNQHATTHIRTHSPATPPAHPAPQIRKPTHGHANYPGPEPVTPRTGKTRQAMTPPGRHPHTRRTVMHRPAGTRIGHRNLPRAARTPPPRDAP

SEQ ID NO: 999023 - protein, 141 aa, Homo sapiens
LQHACTRELTYKGEIVYVLKLYFSVQNTSHSCLINHHLTNHVSSDIGYFNILSRELNNSIIKANHAPPNEPPHGYSISLNTRYLLLRLLAPKGSHDKHLTLNKGYFQTYPLLEKSQAPSPGCNTTAHYGLVYIPVNETLSA

SEQ ID NO: 999024 - protein, 236 aa, Homo sapiens
MSKAINQWTTRGRTQDMVPRRRIRSPQRKTPIDYETTPTDRNPTGSQEQPPEAPGTHATIPTVTKRVDLHTASRSLSCGTGPTCRWCAATGSSTLGQYRVTPSGDDYSRSLGTPGGYRQAEWCIDSCSYSKGVCCERGTTNRTPHRGTSTGPLADRRDTNNSRDTNDDQYSGRKALLCADPYTAAVPTQHKKHNTRSRGLATRLKTDVARRSKDDPRRVRLRIQGQTVVTHNTDQQ

SEQ ID NO: 999025 - protein, 278 aa, Homo sapiens
MDLLWILRSLWVLLLWGAVPCLKTPWNDHQVPYGPRGNWRASISLVPALPQLVGRESPGRVRGETKGAPWSIIGASGNTRQEWGPGVSQEIQVNSCSVCTGWPQEACRVSLLEPRAANIGAAWIPSVAYLAGAGPHLQICRRGWYTEGASGLAGCVHMRQDWIHAEYLVRSLGSSLRKAASVENLESLKFLAWRSEEFATEFTLPGVTWGAAGVELGTTFDGNTELSPNYCDLSDITRGGQIMYQREHWGKIRTRVTEGDSLRLQRGQALTTYDVDTI

SEQ ID NO: 999026 - protein, 229 aa, Homo sapiens
MVYGTLLLLLSRATWSLIARPMVWGSTRPLNDFHMFVMPVSVRGEARRIQSHVGLLWIGAHQGLCCILIDEGPRDPEEMARSPWSGPARHREANGKGEYNHAIWGNPGEGTSEKSPYVELVVDQEVFHGYRRFHELRNELQTVHNIIISRKVRKGLAVVLQSNTLAHDWEYAWGTLDTTTGSGAPRTEGWPVSATRRGYSTIIDFTDAESDWGLSGSLNSSQELWEIGP

SEQ ID NO: 999027 - protein, 188 aa, Homo sapiens
MHTAHLHATSEDWTHHPLHAHIGLDHFTLTPRTPLRTLGPTLLAEFTHNCTRTDSATLGLDQLADMQHSTNVKQLGQTGTGTALTGLHQHSLRSWHHLGPLKIETGKHGHCKRRATLQLPKLGNIAIGSLEHICPLAGWATTEALDTLDSDQLGLAGPWENIGIGKHLKAIGAIARTVNHFGNIGLDP

SEQ ID NO: 999028 - protein, 173 aa, Homo sapiens
MVVTPGEARSLQWSRESRPWNSKPGATEARTPVSKKRAEQCRQGNVRSRYCLYPFWFSHKARKCLQGPGATQDPKCRYISTDWFTNTLVLGRTSLGWEHPGGFTPNSVVTPRWDNGGPTVKNKPGAQAPAKTQRKEAQRNRDEESRGLHSRLKQEDTRKAIGPRGATWGQDNP

SEQ ID NO: 999029 - protein, 199 aa, Homo sapiens
MVVHAYNNYNYLGELRQESCLNPGGGGSSEPRSRHCTQAWATEKHDLSFKKLIIYPLYLRYCPLLSLSAYQYSCLTEPVTTLILINYTHFSFTSGNFSIFSLDPLDSENVNQNDEQSRSVRPRLEYRETHLSDSSTDVKTSMGLQRQIPPMAFGRPRNKDYPLQKTITPINQNSISWAHTTSNTDERHKHARITQATRR

SEQ ID NO: 999030 - protein, 69 aa, Homo sapiens
DERVVIGGQPVMMPSTVGGSMAYATGVCPECKNAGCGLCPGEDELSWMIINERCQLVDRLTSALPVVEP

SEQ ID NO: 999031 - protein, 183 aa, Homo sapiens
RTVRRSCVCGSGLRKCVNSGQYPVTLSYAIAVVMHYSDCDFSCICKKSGERSILRRSDMTYSRIAWSRRRVISGYVSILEYPQRSRYDLRFSQSPDTDRGGSRSTAVVNLYLQASYTYLSHGLLFRHSDDVALEGVAILTRDTGRGDSREGYRASPARSPKQRDGRRSHSKRNHRSQLQDEVG

SEQ ID NO: 999032 - protein, 113 aa, Homo sapiens
PQCSAAERLGARGDAAGGPVLRQCVLATWSCVRARGCRAVRMSGLGGRPRKAEGDAAHLRGEPSDRRCASKDSGGPVLQVRPASDEIELKNRDTELVPFRHSCAYEDPPRCHE

SEQ ID NO: 999033 - protein, 135 aa, Homo sapiens
MRLPTRLLRLRVTRFLTPVPFSNYAFNELFYTTNTTYSKRPFTAHRTVPPIWNAATNWLAQPRHTNGAKLPNTHQRGPSSLPLFNTLQSKPSILVNPVGTGGRLGHTGNFANKAPLSPFSHIWRLPLTHKHQWVN

SEQ ID NO: 999034 - protein, 108 aa, Homo sapiens
MGTLIPTDDFSFLLDQLFAFPLYSGGVPTSSSSHTLRGHPWGTPLLGTSDPAGLRLLPSGPRGGKRTPHLFCTQAKPGVFVSLCGFPLKVLGGATPPPANGGAHLPGS

SEQ ID NO: 999035 - protein, 146 aa, Homo sapiens
MCERLKRVTTNKCIAKTSATRYVDTLHEKHHDDNNKEHIHNKATQDYMRTGEHTGRQRDTTRELSPHKQIGGRAKKNGEGTPQNEEAHDSIRQTRRGTKTSRETPPGQRDKQNNEALNTAKMRWKHSPVAHTNREPTPHDAHRRTQ

SEQ ID NO: 999036 - protein, 260 aa, Homo sapiens
MSPCLFHDSLLFFFGFFFWFLCEEREFWPLCSPEAVEVYMGHDSRPHAKPSAFPRFQSNFSVPTASPDSGDYRALLPPVPGIVWIWFFLSRKGGFSRYSQAWSRTPQPRGCSTVACGLPKVRGITGYSATSAGQSPFLESQKGTQESSSKGTRTPITYRASAALRRHNSLNVLLKQHPTLYTHAAPTPDHLHPCDLTPLPPCLKAEHAVTTLNLDRSTDPGSPDSSPGYHTTRGTLPNARPAAHHPTTTPTAHKPHRPRT

SEQ ID NO: 999037 - protein, 438 aa, Homo sapiens
GKSCVTLSENAVLRRPWTLHQEMATAASSLLPAHTEPPTLPDRPRLLTTWPLHAASRLPLTPSFPPLPSPGPCESPAALPDYLSFCLTSPDRADAGSLPLRNPVRPTTRPARPVPDPPRGALGYSARPGLDRRPPPLPLPPPIVRVCHPRGRTFRLFPGAVPAAPPAVGPWPAVSHFSCGPPGACLPCLLRSSSTSSCLAGMPRTRGCSRPSRSALPPAPARPRPGRPPPRPLLHRRAPPRLPAPPPAASPRRRSAACAAGPSGAAAVAVVRPSASARPRPAALAALRLSSSAPRRVALLVCVVVSSPLSPASVSRLPPLALRAPRCPASRLPLPFCPPSTTPRLTPSPSALGVVRPPRRRSVPPPSSPSRPLRSAGRRSSRAPSVRACRRPRPPPSSARAVVVVSSVCRSPPSVPGRSVRSLLLPPPARRAPSVLSR

SEQ ID NO: 999038 - protein, 183 aa, Homo sapiens
MKAHITQALIWLSQRQEGTNACSRSSGSLAQTIAIKGRSHTDEVDPLRLYHHAPFLRFLSQLTHPCCPASARVLPEVSLARQPHRKGTMARHCIIPKHCWPYAFVPVQDKPRHKRKGRNSKVTLLRKLCTKRQPLPIWDAPSEKAKAQWAIFRNPGPSAEGEINLMAPRYFNGTANRGNVPEH

SEQ ID NO: 999039 - protein, 67 aa, Homo sapiens
GTSSGGAVLPVEIRGGREDSFGCRPRMLCNGVEEYDNPTISHEEIQVCSSTMPRIIDEDVISERSFS

SEQ ID NO: 999040 - protein, 113 aa, Homo sapiens
MTLGTSTAPSESKAFSAGLGHSIELTGMGPIWGLLSSRRPETDAWFASCCLCSALCLHGSSRLPFLGVKVPSFADCEWCPLCLLGEPPPGPGLLLHMMTWGCLGQAPEEDWNG

SEQ ID NO: 999041 - protein, 131 aa, Homo sapiens
GISILLTDRNLKTTFFDPAGGGDPISIPTAYSDFSVHPEVYMLILPGYVSNLPIFVTDYSVRHKRYHCRNTLGNGLESMHSQIGFQEVYRCERKHDSLQVGIRRRHTSHISAIRVHISASRIPNVRQQYYS

SEQ ID NO: 999042 - protein, 173 aa, Homo sapiens
MGVVGVLGPKLVRLGHLFSSGWVGMWAHHEFSHVGDLAKALLGIPPNPEEVLPFCLPEWVSPPFNPFRHSHLLLPVAPLLTLSHSGWDLDKIPIFPGPPSGTRGVAPGAVAVALGEHLWRPRTGLLVGPGIYLLPSLYILTVQRFSAGSSRPTPPVLHTYLGVPSWFPRGFGG

SEQ ID NO: 999043 - protein, 182 aa, Homo sapiens
MGAGPPVGAAQQGPQTPANTKVEGSVGGERRATSGRAATEAKHRLRKTREGADSTEESTGIGERERANHNREVESKDLARESDTEEEATQAENQDAGLTQTGEADHTDERQETETDKVEGPPRQMRPDGESTQRTAPLTTHEQAGRNQSESETTTAQARAKEESRRDDATPKRETHNDTHKQ

SEQ ID NO: 999044 - protein, 289 aa, Homo sapiens
MPGMGSQGQSVQFHVHMTVARCRAVPKTGDGIIDFIGQVHKTKEQFGQDAAYHGCYCSAGVAPHRGVTSRLSIVLERMRYEGVVNMSQTVKTLRTQRPAMVQTRVTSISCSYLCGPRKYLWHAFDHYATYLTVPSPPHRPTAVGLRRGPSSSEPERTIGTVLLRRCCTLAEAIVPTGITASQGTSPYQSESLQNIPWSKLGWPQPGMAPDGPSVHQSHLGARFKLSVALRILMLLLMGWEIGGKSFRSHFLNLGFTPEGIVGHFPLIVPSRELRIFSKGHSKGWRLYTV

SEQ ID NO: 999045 - protein, 76 aa, Homo sapiens
GAFLKLTAFGPRCLVSVALVCARRRSLSFWPGGYPAYSKDSGLLTSSSREWNSQISVTLLLCRGFQSSPDIEVDVY

SEQ ID NO: 999046 - protein, 381 aa, Homo sapiens
MSCACLYHIVISSSHMHRLNMGRCFDASSRECIIRAVGPVLTVRLSKVLTGHSSCRPLCNALKLTDDTLMDGKLHRGTAEVKATHTRKGPHKQQLEASSSKGACANNGGISRISLIDTSSKKLIERYDLMIYVVEPMCSSPITPCTKRNHVKRNELDLQEASGKQRKEEVKFFPPTSKITTGYDTFLPPSRKDPQVKRPMLRFDLLPGAAIILGLPHNDEKAIPRHHKEQVNLRRYNKARRPEKMGQGILTRSQTVSTSRHNVCTPPYYPTGGGNMCKFGVERPNTVPVGVKRNKGGLAIGPKVLTNGRYIEGGRPKHGQPWGNTTTVGHNGKHGKRNSDEDTLNRKTRKRKFENANMMDIRNVRKFATGIAGNSYRNVAP

SEQ ID NO: 999047 - protein, 259 aa, Homo sapiens
MSLISPLVGPSPYIFAPGASLFYNKRGGEHYYRPLVRTTHGNRGDPSPKRKIFHALPAANNTRGRIFHEEAEGGPRLGGVVHYLTKRERTHNIMGGLLTHRRLVDQAPKPRVGHHCFTSFNNYMKLSRPDLVVHALLCYLHQIISAYIVSPPRCISPHRTEAPQLFQPRPPRPFTHNPQALRRNATQDDSLGLNSTGLGARLQYNALFMTTTTQGRAGRPTVQQLLSTDGHTNEEGGTTHYVSYATRHERGAYTYCFTE

SEQ ID NO: 999048 - protein, 385 aa, Homo sapiens
QTGETEPWRVSEDFVSYSIRQKGTRMIRDRMIHRSTSQGSIKIPMCTDATDYTPTTSRSSHSNFHRTDQGINIYRKPTIYKQNADYGRTRASPQNDIIQVNPRFPSKTKAPEHQRDNQTIETDHMAWYPPIIYAVSRDLHMKTTRSSGKKKGKMMRTLTEDSRAEYKTSSTKRSPTLTGLGPEEPSTRSRWSTREPGKGQNRNARRKRNYPYKTEQNTSTHLQTATSPLTNEAQGENTGPGNHRQYEHEQQAKEADQREERTQTTNKPARQMTAEQGTKKGNDPDREDTKTTPRKDPVGTTKRRKEDKRKKDDTKARTKAQKSGNTKKETKTTEHSRKHEKIENKGGQKKLRSDKQRKVDRSDKKKKKKQQKQNDDSYDKHEEKQ

SEQ ID NO: 999049 - protein, 72 aa, Homo sapiens
DEFDGPAALSLAATVCGRRQIRENLFQLSEDEHFADFLLRIVKPHLVGSTMLRYNFSAYLVTCPRPPIFDEV

SEQ ID NO: 999050 - protein, 121 aa, Homo sapiens
MALGKSLISLVLLPIHTHAHMHVLWVPIHHIHTHSRDISFIFTSYRDESLENSCCLTYPAKHQSYLLGIQKVSPDPASEAADLNSSTSHWAPGSIPFLLPILHVGPLLQPFAVAYIRPVAL

SEQ ID NO: 999051 - protein, 102 aa, Homo sapiens
NPGGGACSEPRSHHCTPAWATKQDSVSKKKKKIGLGHWCWHCCRVSSQPLREAEAEEFALNPGVRRFAVGPRFIATCTSSSVDDRVETSCLKKQKKFSFLTM

SEQ ID NO: 999052 - protein, 468 aa, Homo sapiens
MSNCYAQIRAQSPDTDVEQRTLPPYGTARRPKIDIHTQKQHRTHRNYRDGRNATKTKPVGETARQPSHHGYTTRTHIEPSTEHNPTTLRGSQPQIGSRGQTPIETNQRHRQGHRGHTNHHRHRAKALGQYQTITREAPPQAADTQPTSGLENTVIGSSLGAAELVRGFPSVYTTGNREHHPCVATAPTKVLYGHQQWITKTRTTVMSSKENLVGDHKASRGNSEHLTEECKNSPGVDDDVVSCDKTTRPSVRSAVSVSQHNRRAPANSKEEAEQTQHRLVYTTDRKTTNDEQSDARQGRTLVRGRTECRQLVAKNRKPTLADMRAASPASEHARAAARRHDVLEQHERSYLSTKEDRDTEYERERKAEREEQTEQGTENSGAESESRGVGRLVHAQRGEQGATASEQGEQVVDKQRTTAQQGRITARQQTDRQEDEGAEKEVVEQTRRSRTGREERTGRGEKPNDVQH

SEQ ID NO: 999053 - protein, 179 aa, Homo sapiens
IISRGKIIDGVRFVIMHEYTKLKQGREDFRVPHNDLTYQTCTPRFRMLFPDDVPELVYPVDARMALLRWGQVVHNTRIDAPLGLYPPVDPSHQGFILPDPMDYSAPTPMVSILDNGGNVIFIDGYCANEDNSSSEAARFKLGYANGTDFLKETVGRKPVLENVRERHYGVYLTGISLVA

SEQ ID NO: 999054 - protein, 102 aa, Homo sapiens
MPCTWGSELGTTIQVYAQGLSHSATLQDTTHAKTNDNSDANCTEGTKGNGTSTRDTRRTLAGTTCNTPLRPKPWTTRPIEPKEKIGQEHTICIHSITHPTPK

SEQ ID NO: 999055 - protein, 109 aa, Homo sapiens
SGQQGRPSQIKEHVRLSRTAQSLMARHVQLRFLLIRWQQHPLIKHRMTAEMQIFYWPNYGLPYHVPQAHATDKSPSEQHSVQRQARRIRPLTETTTLNQTRELSACYVH

SEQ ID NO: 999056 - protein, 461 aa, Homo sapiens
VGVAAANREGTWNRLVFPGCCCPSVPWPGDACCQFWSPPGPCCGPDIPSSGVHLALRVTCHYWRLTRPTYGCGPACRVCLSYVPARDLKRPATNTLVSPAYDPRCIRRVVFDPRDRAGRLCTPCSIACVNDDNPLCTLAKQRLEPPSKVVKGSGRNPHGAVNNTYRTLCCSSPSCRNCNTASEHAQRIAFSAPRRNSETVNAFEPPVGLKRTICVSANHFLCRIIPRLCNHLVSQPAAKKTDQPMRSHNAQPMTALSHNKSYETSSPTQKETWCHAAPGLLNRQPRFVAFDHEKHLTVSIPTPRRSSDHDKRKGVYIYTDPVSPTHTRHPHIITHATKQTLHHHYFYQPSSGNPSNLRSPMTTTSSQNFLSSHNHHTPVSLLYPSPTHLRSNSYHTPPYLSAYYSPTPPPYVASHRLAGRDNYQPRPPTTTTTCTKYSRRFTAPHYYKWTRFATHHPTLSS

SEQ ID NO: 999057 - protein, 68 aa, Homo sapiens
GVGGLKVALNSCSPGSSPLSAEYVGLYGAGWLWYGEVSCAIGVHETCCDLPLSGGGTVCHTFTQGQDD

SEQ ID NO: 999058 - protein, 128 aa, Homo sapiens
CVQESEMHMHLAAKMDVGACKRWSLMDEHLPVTYILTCITLCVPAFWQFHCLPQGCTLTTALSKSCCVVCVVLCTINTCHVGMISCVNATCLNCVSSNTLMTQEHDNCARIGLHCAELECHFWVCMHR

SEQ ID NO: 999059 - protein, 207 aa, Homo sapiens
MVHLSSFRLPRKGTMDINTLAALTPGSKHMEEQLDTEDCLDKDYIPPNRDADVELQAPLTQPELHTLPGLSYEVHKDSTPITKRGRPCPPGRLWAPRAYNRQPGNHTGKNQPRRNTKQVQPKNPVGRTKAPKVAQMPSHNCSQHRTTGTQGGHKAQQWGNAVARSTVNNTESWSLQEKTTVATKNKETHSARTVEQGDRGATQKPGA

SEQ ID NO: 999060 - protein, 614 aa, Homo sapiens
GRPLQASPAARGFMLAVGPGWQRCRHTPASIQFLFSFCTQHQQHSITTLTLNTHIISSTSVFTQRIICVSADSQYLSHSHIFHISVSQHSLQQPHHIMHKAPSSTAAQRMQCTWHTQHYTQGLSSTTPSELGQSLGSNAQAFRNPIVHVPHTHNGPSLTHMQHNICKPAQKGHYTMQACAPATIFQVTTDSGTRVAKVGLFLQGISTHECKGVATFHTTQACSHKVRSKVYHITSFWIQVGCNPPQTMPILLGDGWHDIPLLYEHTTARNFTTNRQDDGGFALLQTARQPVVGDNTSTYIGTRTDGGGMDNSLAALQVISAHTQPYTAAPHPAHSLTSEKNASPRNPAQNQPGATHQHLLTPPGAQPSDAQDAIWPQHTTRPRPTDHTHPHGQSVYADTTRRTQHTLVHTTHTRHKRHAEATGADTGTNTAQLTERQGQQQSTPPHRTKTSHTTHTIAEHPHNTRHSRSTTALEPSGGAQAGHDTHKPHRHANTTRRSYRAHNRVTTATHTPPPVPPKRTRYGTHSIVHNNRHDQSHKHADYSTLGTPQPYNKYLEKVGRHKRPQTHTHTDSAQTINADRPQPNEETETHNDTRRKRRHSSQQRRSRAAPQRHR

SEQ ID NO: 999061 - protein, 293 aa, Homo sapiens
MLGRLPQLYHNLPDPCIPHYYQYTKHIPSHLPALGPLTYHTTYTTLRDSSLHSKQDYKNIHGTYRDDSATHRWTTFPTKKRHITLPNTILAHFPPIRTPQSSTRGTEPYPHNTPYHIEFPDPEAPHQNAKHKPTSTDQRTHTHTQNRPQEADDKDTKDITQTNTLRTKNTQWTRRHKYLPLQKHTYSTHKHPKQTKTSASSNTTTSYPPAHRPKHRKQTSDTPNTTPNSQHPGEVHKQPKKPSKHTETTRAQRPRTTHDQLTTNANQDKNNARSRSNTQRNQARKERQNTVTP

SEQ ID NO: 999062 - protein, 250 aa, Homo sapiens
GVSLNSPAALEDDILMAFLRLLGARPTPQQPMIQGTMQDWYLTLGHHTYLIDSRGSNIPSHWHNSRSINLPNCIQGTTCTPTPQSVIDRPFTGTNETGYDIRIAETRTTANHKFGQIGTPPHTHTHKVIIEIAPKLYWAFGHSPDIFGISNMALCMDHNKIRWHSIATHAILVAPVISIRARGLAKLALRIKGREMTAETRGSPQKRIKASIQNKGRQALGTPNRHHGLYRFNHPKDKSDRRLGTFSHTI

SEQ ID NO: 999063 - protein, 106 aa, Homo sapiens
MKHQRVIVRWIASRSIGNMLQRLSAFHVLLLDKLRSTEKQKKLLYFTAFLKHNFRVSIKEENTEMRVEDDRKNEKWGDKDEEYSDRIMHMEELERGRDNSTKNCDL

SEQ ID NO: 999064 - protein, 393 aa, Homo sapiens
MPYIHNHGLGSHITRYQIPMGPYTERKPVEKTNTYQRTIIPWVGYQFEPYRTGPDQLGPCSNTYTLLNSQFPHSTDTDTAIIIPEVGYCNRHYTKLSLGQTHRLNIGPFAKQHYGTQKCGKQGPLQIRIPVCGDQTHYIPITYLAREIIESGQVSCETHSPKRDIPYQSKRPCPHLTQVSNIVSASPRESARRTGETHSGGDWTAHEQQQITTSRHSTVLRNITTRDYQTDTYTQDKTKTSNTRQTRLTRQDTALGGIIKTTTRVRDGTTTHRCKDMNTTDTDTAPNTGTKQRAITRRTAPAPEGVTEQCPPGTTVATTQARHHRSTHRHETRTHRGRRTTTRRREKKYTDAPSRSSAATTHTTKSKRSSIKRQNEKQQGERELDKEREQTVK

SEQ ID NO: 999065 - protein, 141 aa, Homo sapiens
MRASISKLLPLADGKNKKKREEEREREERERREEEEREEREKKEREKKERKEREKRKGEQKRGERQKRQNRGGEKRGEGKATVGRRGEREERGRERELEKRGRRAARGRREPRGGRGEGRGRERRRKERAETRAEEERKRE

SEQ ID NO: 999066 - protein, 206 aa, Homo sapiens
MNKRDTKEQHKDRHTPEGKPTEGTPQRSKSEEERDQQPPMEKQGGQTSRPRTHPTQSTPTNHGHNREEQHRGRATDCPTPKRHSAPAETTTHHGDSRTTVATRGRGEREKRRATNPHLNENKESRRQPHTGGTRGRPIGEQARRSHEEDTNGERPPEERVDKQIERHTMTHTPMRQKERTATEPMIAQEITDPTHHRTQNPRPSEL

SEQ ID NO: 999067 - protein, 352 aa, Homo sapiens
MTWRKWSPPNAHNSNTGPGTLANCQRTLAPAHEQESMEMQTYHTMISKGTNDNTIIMVDTKNHSHCTKQRTPERTIAARNRNTTRTRHPIYGTRSRERYRCNAPGKQIEAKPRDKRNIKAPRIGTYIVREYLTQARVRNEDTRHRITHTPCPHNNEYPKRNHRGGPWSAAMHTHRLGDHRVDDFIVRKPHAIEHPRRTQKALDRGPAEEKVGNPGTDDHTWAEGSQQKNKEQGRQETGLPGLGQIRAKKPREYGTRATPTGAIATGTSQRNTRNRARGDNGVPAQTLRHKIEIENRRRERGKKREEAEETEDHARKDEAKSKRKKKARKRRTPPRSNGRKRRSRQRTEADSE

SEQ ID NO: 999068 - protein, 133 aa, Homo sapiens
SSTQQGFVAMPGTQLQFTSTTNLTQCKHIHFGRVTTTATQKILQSHACFINVIPWFEVVGYMLSTEISCINEFRMMFGYLFWHWLFHSTCVATSTQPKRQRQCKPESLAFHHHFRINTVCCNFLYSHKGMSPE

SEQ ID NO: 999069 - protein, 525 aa, Homo sapiens
GLNHAYCHTGINTGTAICQAADITRANAFIQHSAQAGHMQPPPSLPSGTWPCKCTSTKAAGAGPRSHGACATFSQLIPRQPIMIISEQSTQRILHLITTGTKWPPHGIMRSSALHQPHTSGPTFASSHPLSHPCQRLLDPGPPYCPVDTVGNSIQGYFNEPQFTCRHVIFDKESQSVLSEPVTGSPGTLSLLRQPQWPPWDCRAFTRAQLGPPCISSGTYVTSWNPKTTFKKQQFYNYVPKSGDTHSVGPTLTWFTPAYSHSLLRPDTTNDISGLSLWRPTFRSSLNAQFPTNRHTGMVTPYAHTHTLARDTKHTPHRTLENLHTYYNAHTAMHLPHAWAPQTQLSSCVHQVNETPGVPQLTHWNPNDYTITIRRNPFCTHLRQYSQVDDVPLHYVPPTNHTALTFQASLTHIVTTTSLHTSASYSPPPTTPHHPTCRGCHTPTPVRHVLPQAHHEFHPRHQPPTTHGANHHTTVCHTLACARQDIPPATYDAIRDYTAHHRRTPTPRPRRTTSTDATRTHARAH

SEQ ID NO: 999070 - protein, 72 aa, Homo sapiens
TLKKGRGPTLRTRGFAMAMSMRTADGGGSPGAGGFRAVSGSGYRPEADDSDIIGHAYKHCIKSHHDKAVASI

SEQ ID NO: 999071 - protein, 102 aa, Homo sapiens
AHKPHVTGSKDPEHKGLSGNQMSKTLAGGTVMLCSNPLSPGFTACVSWRIRCEVSRVSCLYVTIQSYHILVAPPLECNGHHSRLNWNLHLLVQAILRPQLPK

SEQ ID NO: 999072 - protein, 227 aa, Homo sapiens
MDLYTRLTRIEERGGDFSVYNENRTTVTHARKGVDFYRQAPRWKQLPPLEVPRGNAHCGESHLYNSALGVLHTGDFDKLTERAMQLTTQLAQMHFANRWGKVGGQGDLASTTTLGENTDIHATRLSRAQEWRTHTPEAQRHGQTYPRGQHVGAQRHTRHILPTGTRTYRGTQSSGHAHHQNTRLPEVGNGHNTERLQDSHRPASTPTTSQNNMTDDTTEHQRRHGRR

SEQ ID NO: 999073 - protein, 433 aa, Homo sapiens
IITLRWINDENEHPVHLLSNGQFQGLVQRHAVHHCSQASRQCNSRRQSHFKVNTGNFATMSVQPTVSLGGFANQNTYQWSSRLQDVVQGQDGHIKWHKTIQSASWKESMPEVKTDARGQGRHVKTLKVISVERRFLTPVQGWLDKDYKDKKGKNIEIECMTGMHDLNELMKEGMNDEKIELIGMQLTEGNELSGTADSTKRTHRGKHPLHITADMRTHDPKTHASKKVQTSDTRQQRKSNKDNALNNRHTQDTHTTGHQREHNFLITTNKNNGTQHTTSRYSTTRTNGNAITRCMVGKRSRRRRPPDRQAHKNTDTIEQHKARGEHNHQPNNNGWGTTTQQHDATVQQEKTVRSTQNCGLLAEQVDLTTTARARTRSKNSRQRDRTGAKKQPTILPNTKQGRHTATYHHRQHRQTGNTRVTKNEDTHRDETTR

SEQ ID NO: 999074 - protein, 111 aa, Homo sapiens
STESGTRSWRDAAGKREALAHARVLELCTILLTRGYRIIVHQDFVMFVEGQGSPENKCLALYEEYSSSTPRFNKLVVDARDIVVLNAGIPEVSEENFQKHPTTLAVTLGRR

SEQ ID NO: 999075 - protein, 105 aa, Homo sapiens
MAQAATHVLAYVNIMSNHLHASFLSDNHFIITFYKQMVFVNNVGGHNKHTQTEGKRILFPNGISAIPCAPSITHVPTWHRERNEHVRYNSIYSSKDTLLIICTPL

SEQ ID NO: 999076 - protein, 240 aa, Homo sapiens
MPHHTQPDTTHTETCTQTFPGPHARGATAPHVEHGDRQMNRGRYRTTHSQPITYTHATPSSRRTTANCSAPSNTTDSTQDPRNTNRSAFTSDKRKPSVTPSSGHSAAINTPATTALERPSTQHHSTTRTSEQNVNQSHTPHSSEKTTESTASKHNRTDSEHWDPSHTPTNTQRKDTYNQAHKQTMNTNHHTTHNHTRTTDLRHAHTNNPANNSSRTQTQSTHKKHRNQLPAEDTEPNVDD

SEQ ID NO: 999077 - protein, 111 aa, Homo sapiens
MLQVHLGYSLAPTHRIPRINPHDPKEPMVPLSGESYLETTIWAMQNGAGAYWDVNMSVAELRTYVCILIHAICNNIYQSSMWCPKPNTLSLVLAGHSHDRKHGPQKHQGGT

SEQ ID NO: 999078 - protein, 391 aa, Homo sapiens
DLVYKLILKSLYQHNFSHSSSKHNSTFFPLHRHVTSSSAHAFINRTHTSLSFQLSQDMQFVKTRPQDTYIPFQLANSIIMPIISTLTGTTSPFLHPLFIKAALVLWPLFITAYYLSHDYNINCTHLLRRPCTSFTYVSSLQGPQALLHATLFISASSTLHAHSHTLHTTQHWQNTIYGQTVLPLSGTSWRPIAQSATLTSTKEHTTQIDKDMIPTQPYTNTQRPTHTHEHNHILPSKTPKRITANNHDATTVTHQPTTTPTLHRHTPGTTTEQPAILNHKRTTRGTRQGTSVPLPLPPPTWTQTHNTHATRAHPALSRRKRTGTPQTTTQYTRNRQGAREQINREKESTGHRANQPLNETPKQVDKTQHENQPKKPHTRTSYTRNANEHTA

SEQ ID NO: 999079 - protein, 123 aa, Homo sapiens
GGSQVRVAVAAGVGLSQFVGPGAADPDGWPTEPVTQRKALGLGSREPGHRPRARPRPSAARSSPDPSQQTDAAGLRHPLCSLSLRWLSDSGAMGKARSRSWSSIRPQTLKFKGTFRDVVTYKS

SEQ ID NO: 999080 - protein, 415 aa, Homo sapiens
MSAGGCTGLACTWQHMPASRHGQGSNVRASSPSWRQRTARAHTKQAHINHTHHTRTTKVTEDEAPASDVEATPAGGIRGNWADLLVGAHLIGLWVRQASGTRGARARNTLLTLNKEHVNRENFNVQGSNVQASNENSNNSFQDTSIMRDEVKFMKEAIIHDSESHSEGSTKRRPMRPGTRTGSGHGPRRTTTKHIHSTAHPGLDKPGHHTTGTGKRERTHARGAGHATNTSGSKRQTHRERRTPEREQHTPTGAENGNTLTHMETSDTTQGRDHCGQQSSRTNQRAHTITRTDAKEKNEIAGQRTSTRRRARHQQRRQSTKDNQQNDVENSENQQRRPGIRTEHNAREHVLPASVRGVASVSRVLGIGHDGPGASWVPERYTADPGHGGQLKGSTGIAVSRSERSTDTRRIVDGE

SEQ ID NO: 999081 - protein, 175 aa, Homo sapiens
MNWAPKRTHTRHGGNTDDVDTTHTHTNKHTNITIKETYNTPKRTSSHRESENTKTQSYKQNETEKSNEQRGTTQHTTTMHTVRPNSGECPTDRRRTRESHKQRQEERKDTPPPHQKHSARSVADKDGAVPQQQTTKHGNRNEKNNHKAAVMTNQDERNNKRIQEHTYKKKPRPQS

SEQ ID NO: 999082 - protein, 342 aa, Homo sapiens
SPEQCSLLLGALRPRAVAMTSELDIFVGTHDPYRLRTCIAICARWITQDDLTRWPCRVRLGNPGADWQPRQTVAAEATPMDHYRHLTTARADCMHCARPSYCTQTHLPDSALPAGHYVIETATMPFDEAKLREALRTEAVQNGTKHRPWLTSSTTHRHHPPAAAASTATTPHGSSRCVEDMPGSLVENIQPHFLLSDRTGQDYAAIDSLLTTSAQGRTHGRSEHQDTSLPRRTRIQHRPIGTANPRAPRTRHSQEPNACTDHGPRPQRLVDTTRGRHPATAPTTEAATRTTGRRRANAQHDKPAPNRPQRHHSHKSTATQATKRHHARARETAPTPPHPPQR

SEQ ID NO: 999083 - protein, 204 aa, Homo sapiens
MILGRKPFGLSSCSIDQHRGHSTYIFSFGYEFITYCTSILNSSVLSTICEDDNSSTPSSLVPWTIHSGDLHHCRNNLAISWDTSHRAADVLILCGYVAGLPFTKARDRSRAQRMQHHAIPSLPPTPRATETALTSFTADGIHSLPKTPRPTPRPQSTHTYSPHNAYATNTNDTPPDPPARSTRSRPHHRPTQASDETPYRAPAP

SEQ ID NO: 999084 - protein, 242 aa, Homo sapiens
MLMPMVGPEPRGIEFLGVSGVPMNADAQAWREWLVSTQLAMAIRKSSRVRVYDTSAFSRHESFSAEEVLWKLLNGCEMRRSDFLLMQLASLVGYRPKAVAEQMGGAMRGNPVPILIPCNKREICSKRETDGATYSGGLGRKEMASGPGRASGRGKPGQRRELKVWQGQGIKGRGGYLGLPDRVGRHLSMCRNGWTVEAKNRCYTGIGCRTWRDPWIKGSGASGINKKPKKRQTIPHAAIQSQ

SEQ ID NO: 999085 - protein, 447 aa, Homo sapiens
ETESLIDLGMEWSGPRSSAHCNLTTPRVDRPLLLTSDLPEWLCDCTDMLTTYTHGLNLLADDSLYALDDGGYSHRACSHGQRDTSDTSTATSTTTETWTPSPSAHVPHKPARGTQQEKVKAKRRHQAKNATNSNDNTKLNDKNPTDPTDTQHTPLHHRTRHTHKHHKANQEEHTSTAPPPHTSPTHHENQAPRHRESERTPPANEQRNPPHAPAHHHLPIPLTIPSLTTYLNESTIPIYNNTIIQTQKIKYSTITAKLHTNEYTQPSKKHRDTHRVGEKHRARTKRNARTGESNDGNDSKTTTGGQAADAATGAPRTQHGQHARSARRPRGEGEQAARKGPPTPPHRRGEKREHDAEQHEQRGDQSGDRRAPTTGQEHKKAAKQAPYGEEGGRENEQRRQAEKAAQERGGAPAAAKRASSAAGADEDGRQRSALQDAADATERRTRK

SEQ ID NO: 999086 - protein, 573 aa, Homo sapiens
ETIVLFRYSAGSTFAHICVIQAISQHHQTPVQFLHIQASVCSPFAFMVQAHTSFNTSFSCTQVKHLTFHGIPISILHSSASLILVSTHSSHPTHACAHLHINTAMAAAHRHIIILLQASATTCVHTSGHIYHHLAHSPHRPISSAHRSSNFSHSNFERHNTLSRSLNLAKSNIADNTLSTQQGPGLHHHLGRVTGQSAKTLAYPLRIHTSCTPHHSTAPGAPLHLPYIVLGHRVHALEANHQDLSTHSAQRLVKARRNRDTTSSCRHHGIYQTRRTKRRHVHIHNRASNSITQAPTERPRIVQTPYTHRIGATATTHWVYPARQTSSRQQTNHKEQLGRLTLTSNREQHTTAGHTTAHHPVTQDTQPDKRINNTHTSNNTPEQHTIRQAHTNKTRDTTTSKQQSTTQHSEQPHAHQRISAKRYPGNSHEYLIVHLHTTNTRARAKDTDSTHTRTHEAKNHTHAHWTQGQTAAKPRHKQETTQAPANAQQTDTHERERSDPTTRNLTHKAHTSTTSAKDRDNTQSRTQIYNHEGQASRQTHNHEKSTLRHTRPNTDTAPDNAPTKRTAHHTHRS

SEQ ID NO: 999087 - protein, 409 aa, Homo sapiens
MTGRSRRCTAFFHGSQQNMSFSHQQHLQEHKALPRKPPVNLITHTSTGATWPLPPFNTCTGCTFKTKLQQAFSALQPSSVHGVDLQQYLMQRAGLVLSPHKKNSKPGKGCTSPTNRLANISIAPARGQALGPSPSPHRPLTFHNANSFTSKTRHELERIRAHRIQPLALHARVQRTGDTNCLGSNDSHRSEHALRTHIVNHTSNVQGNTPNEPATQTPDTGAHPHASDTPTPSESNHAHPLHHTGHTTGTPEPTPEPPHATPHAPAPKRHPRARPPGAHCSRPRHRTTSRRRSRSTTGSPRCNTLPPQPHHVTRHMFTPQAPHNPPRHRPTPAQRAERGRHCRLLERRGELKIRQDEHPTAAGASHVQPSRHGRTPAPAATQAASLERHREGISSETVRRAAAGTLPAA

SEQ ID NO: 999088 - protein, 129 aa, Homo sapiens
GGCEIPTAVAASAADGASRTLIQPPTEPHPRSPGRRGCNRSREPENQATEPDARTIRGQPQAQSQVVEGDVSTSDLGPRKEGQRRSEPKERTTEAHHHPHPQKADTRLDLQGTQMTVGNQVGQRETRPW

SEQ ID NO: 999089 - protein, 451 aa, Homo sapiens
GPEAFRFDGGVCKPIATSTNTCKHITHHLSRPSKFMAALHMYHAGSTALHDPHSTEAHMGLGKPSAGLGKHPLPAVTWQASFTCHQGHDFTIHIMQAVYRMHVPAAAFITLRQQNNCKYICTLNVVLPLHRTESFLSTLECTLDSYTVRQTANSHHIAILPIRYQDFRTGTVLTDEQTGGKLKNEEHYSSNLKLSWTSQIHTYSPVYCHLQSILTTAQPPPSSAHNQPHATRTTPSAHEDRTTTDKPTNQRRPNTMTKNIRHGTPRQRTIPTTPPTANSQHTTLAAPAAYPDTRGKTRNKGQPTSTTTTRRQDETNAHDAHHKQIDTLQPHGDDKQTTRHRASKRTAPPHVPASTADHTTDRAQNERRREHTRRERSRAGDTEPNTGRQRSPSGRHHDLERRNAANDQHHSAHTASEKDTECEQRHTAARSCAEAKATTKRSSRHHEDNSG

SEQ ID NO: 999090 - protein, 536 aa, Homo sapiens
MSLTGSSTTQQFPSLRHLQHGISPVLAQTISACSMHMRHSILAHLPHVQLSICHMLSCSCKFSSPHAMARVAHTNTIHQTIMLRLPSLATIVDLSTAHVHLDPNRNQVFAKPDPSIIRFISELTPSSRLILPLRQHSHSNFYIQVYPTAAPILLTQTTDSLPVGFLPLTVHLGQPHAHMEQQRAITHALLDNTLTSGPLNPHPTQNQTFPPPLATLRPSPHITTSLPTASSAPPTHTSHLTPPDGEAMANQEKKPHTINATRAAHTFEPHTPLGHRAAATKTGLGNHTDNATPTPRAKATPQNAHLTQTPSHWPTRPNAQPTTYHPTHRDNPHPHRPKHPRIPRRRRARYNRHHTTRATTTHSSNPPHQHGPRPTHPTQRDAAHHTQEHNNDRHHHTRAHSETGAQTHGPLRSAHAVCHNAPDYFSTERPGQCSTSLLTRHLCRTSHTAGTPLRHTPLSYAHTIPLDTARGSRPPSASTHAADGAHADTRGRLPTRVAHQSPDAPTRTSTERPPRSSPSPATHPDRTPTTTPRDTT

SEQ ID NO: 999091 - protein, 90 aa, Homo sapiens
MPHIVQAVSGLTNRAICVRANSALTREIHFLGARTILDSAISSPATVWASPQIHVGSNLLRAPISDGYYIVQRRTGSDNPIYSSHYRATH

SEQ ID NO: 999092 - protein, 144 aa, Homo sapiens
ETFFAEESSGFPASTVLGREPVRIVPQTGRTAHSQPITSSRSPHPQDSPKVPGRRSELTAHEQAAQPARHIRPPYSSGRPVKRLAVQHSARVRPSKLHTQGTPEGGHQMRTACKGGKSLTAVPFRVIPWFAMVLYPIFVDPRIE

SEQ ID NO: 999093 - protein, 201 aa, Homo sapiens
AQTLGDTLSSRRTAQGSFKVYMYHEIHVQSSAWRVITSTPPSAYGSVKAYNNLDAERDALNYETRPSRPKVWMKVIHCQHFEPTVRQCSRDRISPSPNQRRTKKELASATRSQLFIWHTWRTAHVGPIEDNLSQDDASSRLNSFHEGLLVNRQRTHLIDIICSMNQPGSCRHINRVYKDNVQDVIWSKDIISDHIWMTSAS

SEQ ID NO: 999094 - protein, 229 aa, Homo sapiens
KETESIAPAAMMDVGSKDGPDWRALPDLLRSSPWTRLGIPLLPEEHLKPPSNLWLDGGSVLIVVVIVGALIMGLQHEPENTLETGSGDLIIWRTARKGAMHTPGPWSEVTWLTQLRQHYLPIQEDPNIGIIAMTCLDLASKACNDSAHYTKPQAHHWHTWYDHRRFNVGNVICARARGQQREMSTRRFLVEGELRSTFTEDAMVSQEQMRSPSGATKYAVMCGGTCTVM

SEQ ID NO: 999095 - protein, 110 aa, Homo sapiens
DNDEEEVVTFELGEMLLMLEAAGGDDELTDSEDEWDLFHDELEDFDDLDAIATLRWRVNWSADLRQQLSPVDGVAEPGVLLLRQGFFNSKVTVLRNFNPGPSLSQPLTFP

SEQ ID NO: 999096 - protein, 127 aa, Homo sapiens
SAGPALPSCVLLEQSQGQGKQVPTKKDILHPVSSCPYSAEMCCMYFTYVISSISSMCNEALILEYWDTNEEETTVYNPSGCTRRKTRSAKKILPAYPRLTEETTDCPCEHPTSLADTVGLKISPLWP

SEQ ID NO: 999097 - protein, 124 aa, Homo sapiens
MPGNPRLLEESVEARRIALEPWESEVASEPNALCHCDSSLGEVRADYCHLLEKEEASIEKEVVIQASVDDGRRKIMQEGISYKESVYSNMVHSPKIETTHLSPSDYTTNLLGQLHTEKSNANMI

SEQ ID NO: 999098 - protein, 151 aa, Homo sapiens
MERDRNTSTPNEEKQNEDNRHTQSNNTTNNETNTEAQNKTDRTGNRKSPMPKTPPNQRKKHTRRVDTTRPTHKQNKERTTQSKHTNRNTNEKRKSNKIEHTQDMTNTAKHEKQTTAHNEKHTTQTGQPTTKTTTHKNPQDTATRKPKTTTR

SEQ ID NO: 999099 - protein, 74 aa, Homo sapiens
EYLRIMSASHGFPIQRQWARNGMEPEGVIERTEMKHSSTAEMIPCKPLEKDPLSPCASTPMVFEKPHLSIRGKT

SEQ ID NO: 999100 - protein, 128 aa, Homo sapiens
MTHGIQITGLKNNTHPTTYPTRQAPEHPKGGTPYRHPGQPSPREHPPPQNTTDNQHPKNEESIEHEATPSPNAPDPANKNYARSIPDANSTRRRKQHHTPHHHPQTEHLELRNAISTHQTNTAANHIL

SEQ ID NO: 999101 - protein, 68 aa, Homo sapiens
IPEAEQTFVSEMSRSEVLSCARATLSFWPGGYPSVLHQIHGLLTSLQHSNGKSNFLNCYVSGFHPSEH

SEQ ID NO: 999102 - protein, 366 aa, Homo sapiens
SPSGSSSAAAVACVVASRHNPVSACSHGCTQLTASSQHCQQFHTAQLFSTHLHQQHGAWHTHNHPTGTLGQLVTCSISLGQHITKQTSKQLQQAPMHSNAQSAMLDGSIGHPIATLRCTFSAPIALGQAKQLDQHNSTRCKAKATFSSTAIPGGDMGSQGMGNSGGYHTSWVAKKVSTNVGLEKKHLGGTGKVRQDGKQSWQCQMTSRGARQHHWNWVDWVHRYTLMTRRRVPNIDVTRQQCTRTPSVPTMVGYTMCIVSKKNGLNSAHTPRAWQTALLVKQGYNSTTGSETTKLCPVNRKNRAHQVTTTGNPYRVIIKSNNEPTNTLIETKIRKQTQAEANGKNTREHMNKTNYKHEPSNLQEER

SEQ ID NO: 999103 - protein, 73 aa, Homo sapiens
VSKNVHMKIDSKVFLHESGSCDEVLLRSLCPSRDLTESSKAPPASSSVTQTFRIEHVGNERASPGQPGKSPCT

SEQ ID NO: 999104 - protein, 113 aa, Homo sapiens
MKTSRGAQGRNDGCRQSRRYGPMDHQARDDKRSENLPSHTQEDHERSQKTSAGRRTAPATKKAGPRRHPHRHIDKHTPVHRITTATPHGPAPPDKDLQRQPLAMYTNTYSRQD

SEQ ID NO: 999105 - protein, 242 aa, Homo sapiens
MQNYLTHQEECTGTCLITHLRVCDLRRYIKQTGVRSSLNCPWHVTNTQQTATRRKRRRNGPAQNRAHATTNSETDPTPRPLHRGNLRTHPRHTQTATHTTDRHNKTSEQSATHHNTTPQHTPPQPRGHEPRTRARQTRKRPAGSRRPRHPNTEAPHAATATTTPTGRHATPQPRPMGQRDEQDTGTKGENPRHAPEQPPDKRAEGAPTEAPETKTRHNTTHPHAVARTTSSRKQTHNEPRRH

SEQ ID NO: 999106 - protein, 444 aa, Homo sapiens
HLSELNFLKDKVFIFQDSFSLNLTNKTLLRQQSKGAGQGSSKHSSSSSRQPKQPTSSSSNKMQFHRQHPSVTHQCTAAAGMLHLPQNVSYGNLFAWGIPQVPYFSSQVAFVFPFNPQRMVRRVRKFSEQFFLKNPWIDFDRPQQCISRHTHRKIYTTRDDHLTWSIPQDILRNSRDCQGQNGTLVWYPLWTTWGTLIVSRSHSLCNIPFVPNWNHSKYSLGAIHSFNEGNVASTTNGGAYTLAWVNPTLPPEEGNAREISPELPLAREKTPKQHLGNAGYKQTLGNLVTKNTTGLGPTRGITMGQLGNGARAPTLAEHTDHPEDYLEDMQGGRTQPKPKPNHRKGKWMHKQRNKRPRRQTHKETNSGDNAQIPSVPPQSTDRRIRRKRDQHTLTPFAHQPGKTSPTTEPRKRQTATPTATTHSTQQRQPWHTNNNGPPTHRQTV

SEQ ID NO: 999107 - protein, 104 aa, Homo sapiens
RRSDSHSMHSNPFAFLGQSWRFFIKAVPCAKPKQACTRHCSCCTNNMYKCARITSRIIRSSEASSMRHIVAEQNHPDIHWFLCNNQGSTYHHDPTVTHCRTSIM

SEQ ID NO: 999108 - protein, 414 aa, Homo sapiens
NNNIIGTKPHMLINQSCNVARHCTFSHFSKLQPGSNGIQQIKHPSYIITLQGNTLYLIMAPCSTQTHQQAMENKLLHTNRNRKVSRSSSYLCPDQQQHFKSKHESKKKTTTHTKKKKTEGTKERQNRSNKKTDAQQKTTHRGLRKYHAVVVHNTVRHKRRRTIEGNPKHENSNEYKQTKRTSTQADRRPGGRQTTKPPTNNHDRQSKTNTQHPEYRKQQTKKNNTDTCEKRRKKERNTKGGEITSGHNRGGTTPQKQAESQQTNRVSQPKQNNARTRRKDAVATLTRPKGGENMLRTTTNKTWEAPRQTTSNHTSNIVHNTAEKNTTYAKVDTEQHTRGHKQQQPTTKETPMGKTNKPPIRHDNQHKPPTREDRPSQHNEKHGQTAAEAAHREHTTTQHNTGSKPHRRPARHAT

SEQ ID NO: 999109 - protein, 158 aa, Homo sapiens
DRARTLEGSTDGSRQHAVGAWAAGPQLCWAGTYVACSHTSQPGIGDATGCSKCNGGPQANHPSGLDMETEHSAGQQAWQGPVSPGSEAPGHQSLARCPSQRLPLPSGWSGLPADARILRCPRPVTRHWPPDPAPHSSRSRVSHHHPVPPHASCTILPC

SEQ ID NO: 999110 - protein, 102 aa, Homo sapiens
MRHPGNSTLQAYRHGSQLVLHSVRPKTIEAEKNSQDERLANMCQHHAGKSTHGRHPQPTRGTSRHNRRQSHGRPGRHTSHDNGRRRKEQGASTHRRTGQQRG

SEQ ID NO: 999111 - protein, 268 aa, Homo sapiens
MCLARVALFFAGTSLTAGFYCGDITDQRLLVVYTQHTNCSLCASLVSLRPPAVPRLHSSLFSLSLCSTPARIARSLSCLSFPPLLVSWLAVHSVRSAALLSLCSSTRASVLFERCCVAGVPQSGPRGVLSLSASVVCGYVPVVGCPRSSLCGWRLVRRASRLVCAPPPLASSFVCGVGSVVCAVRVRLWVLVAVWFLCATPPSLCGLFLAWVRTYVYRVGRPVVGRVCHVELLTASAVVARLYYVTRTYSRQLGRSSPRLLSVRYVSL

SEQ ID NO: 999112 - protein, 145 aa, Homo sapiens
PEYEYITPEHRNQQEQRPPRTHSTDNTSNKGEARRDSSGNTQESTTETRNTQAQERQRERIKHQNYKPQEQQQHTQHHNSPEEEGEDTRTRHKTKAHKANTLRRRETQEPSDTQRLPPANNRQKTDEQRTMTTKEPKPKGTDKNK

SEQ ID NO: 999113 - protein, 239 aa, Homo sapiens
MACYLDQLYSLHWVRDLSDCVWAGGTTQERTVFYVMYCVIGLELSILVQMWTGDAVRFLDQILSITNAEYVRFDERREGTFRGGDRMLRRWTDRREYGEQPRMDYPGERPVRGLLVVHSYWQTANYGAGRRASAVRAVSPPKVTAVSFRRPQCHMSATDKMLLVCSVRWLSIAGSPGEIRVGHGNCPRNENALGMCVQKGLDPTDGRPGAFRSLVDVGTQLPREWTRYPSGGVGEPKGD

SEQ ID NO: 999114 - protein, 190 aa, Homo sapiens
MKPVLYYKHANKFSRACRHVPEGRQNRYEPGRWRLRYADIATLNYQPGRRSETPVSKKQDNNNGRDHTIHHMKQPGARTDTTPAATQSHKEKAERKRGNHYEVLRVNTEHKPLCVRTTTKWGRKHAPPRNQQKRTHDYNETTTPKPMAQSKHVDARHAGPLSPHPPTETYHTDTKRLKRTGARQHTVGTD

SEQ ID NO: 999115 - protein, 138 aa, Homo sapiens
MRRWLIFFKVESRGRLSSPDFKTDHKAIIIKMGMGLGTELNQRKTFRNSRKFYQVFVGKVSTVLKSAHFNGGNKRGPNKAEWAIGVGDINYSNTACQNNFQMRNRGSNKWSLIIKSLETWCVPRGRADWKGRLLNLKP

SEQ ID NO: 999116 - protein, 104 aa, Homo sapiens
MITDGLSNDVSTRKPQMIGFYSHPVSDGCVPCSDNLVTIHPGGPGTMVDKAYLMATFADCGSDIIRKTTMLMACTNYIMYDSQSCNLRIQTERMVDKMDDVYII

SEQ ID NO: 999117 - protein, 130 aa, Homo sapiens
VHTLVGKTGGNRKKIFTGSGKGTVEGRIGTMSGISETKGGGSLILPDWLCYTKILRWNKTLEVNVPGPICWTTQGDFFRACDLKNYPLRHFVVTVGASGQRGTCSRSPFLWLNVCKQVGCLWEFINLWTA

SEQ ID NO: 999118 - protein, 204 aa, Homo sapiens
MTQRRKAQRRTQPKTQETATDQTETRQEHKSQNRRQNERRETEANDRPPERKTTGTYTRLAKLRPNKYTKQAEHEREEKEKRATRSRRRSTGGETRDNGADEDRGAGSTETAVQEATDSRDKGAGGQEQRKSTQAEARSNARPQKRKRERGARHKQTREGETAKQHTADARARQAPRERERKARDDRERDAKGATGESTEQRRS

SEQ ID NO: 999119 - protein, 164 aa, Homo sapiens
YWGRGADPVVMLRGSLGSRLCGVLGGSHRRSGPEVSGSGAHGVAGESMAHAGWSGWDLEMTGLDIEKEQIIEMACLITDSDLNILAEGPNLIIKQPDDVAGQQCQIGVKEHHGEVWTYPKAAAGEYNLHCTQAEYEFLSFGRQQTPPGALYTLRGNNLSSTVHR

SEQ ID NO: 999120 - protein, 128 aa, Homo sapiens
VGGMAPPMLLVVPVCVLLVPSLCEALIPCRCLRPAPMPPRGGSGGACAGSPCKFGLCWVAGGDPLELLWSQATATAPLGLGELTLENAGEVVPSFGDTSPGGDHKRCWPKRSYPGRLPLALAGDNPWA

SEQ ID NO: 999121 - protein, 144 aa, Homo sapiens
MIAHQNEPSHQPTLDHHKPDSAPALRATTTTLTHHDRNTKPFLPPNTPHRRRIGGDPREDRPHTSERHRPDDTHARTDQAACFRPKGRSDRPGGDNRQKQGERVDDSTQATDVKKIRPPRGEATQHRGRTQHNTPPTHIERRPY

SEQ ID NO: 999122 - protein, 166 aa, Homo sapiens
GRAAHALTADRHLPSRGGSSRCKRRVCCPLGAPAAARAVAGVDEGQARQGRPSSIAAPPAPGQGWEGTARGRARVASRTAASSLAPVPRQTGMLPRCGSLHRNMGLGCQGSFQLPKATSETADQGVPWAAASRKYCHPKKCMDRCATLSQSGGAFRRLLTGPKLTP

SEQ ID NO: 999123 - protein, 261 aa, Homo sapiens
RGTMLRVAGWRRRAPVWLLVAERGARRGGCWLALWAPGMRPYFPLAISAELAGCLLRPGGTVSGVLSRGGKPQRQGPSPGGRELPGRGAPGGPHRLLPCSPLPGGLASGPFPAWGACIAPALWFPRVAPMSREIGPFHAIRLLWTFLWSGGLPPQGAVGVRLRRELPKGLSTRVVGPRGYCEKGRPGTGDPRVTVGISTADASKNPSFWKRRGTRISTAKRPRVCSKVKDKSQKGTGKVTRAPKDNGNALVHPADQRVRAP

SEQ ID NO: 999124 - protein, 104 aa, Homo sapiens
GQCGSGLAEGVALRFPQGSDATLGCGARSFLFPPPGKGLGAGLARRGARQMNWELLLWLAGAVRAAPALGAAAALLRADEDLTLYGPSGRDDAQNGADDMVCGA

SEQ ID NO: 999125 - protein, 69 aa, Homo sapiens
AETGPSNLSQTPELQIQAFWESEAPGLEKSLSALLLLILLVLGWSAFLGKESRAESRRLDSESPRSLDK

SEQ ID NO: 999126 - protein, 72 aa, Homo sapiens
QWLKPVIPGFWEAKAGGSRGQEFQTILANKVKRRVYKKHKKIIRALVAGTCSPSYSEAETEEWREPRRRSLQ

SEQ ID NO: 999127 - protein, 83 aa, Homo sapiens
MRQKGGPLIFQNFPETFGFWRFYQQDPRDGQSGKNGAKKPQHRAQKSLRSHHQAPTGLIFGGPQKEGFPLFSHKWGPLPKGYI

SEQ ID NO: 999128 - protein, 223 aa, Homo sapiens
VVGPVSTEGTKVGWAWWCMPVVPAIGWLRQENHLKWGVEVAVWPECLCTPALPALGCDRDGCSTSRPPRTPRAPTRKQRTHGPTFNIYTNLVALVQALAKDGKNQPNFKGTFSHETFHGLGGCRRWGLPTNPLVKITAKGQLFLVRHGPFALWPAGSVDFPSQKGGSQRRRFLPETRTLKDPFGVPKNPNLVSDTTPARLGFPYAQTLVDTRGHLTRKEQKKR

SEQ ID NO: 999129 - protein, 102 aa, Homo sapiens
MATVLNCHSLRSFQQQKTQALRQQLGWNRYGIPGKSGWVNSAGVYQWALKYHYGHLKGQVEIMDLVNNTRLEDLVGYKLLWEWEWREGGWNETSTPVRGGIA

SEQ ID NO: 999130 - protein, 373 aa, Homo sapiens
DDSEAVIMVDVTPSFLVLSGMPCALTLDLGAGSRSLQRDFRRLSVSRSGRGEPRFLLCGLRGRYPVRALRQATPLSPVGWCRVVADEWEQEWRQMYSGPGDIAYDARDDRTDFPDVESLPRTLRGLTLHIQSEARISSTACQVECFWSCSSLGGHATSVVIYSPPGVLNHDIRPYRRSKDISPPAELRDFCASLDTLRGRINESGSMTLPEARDSPTLIAFLRAVSTCTSPYSPLGKQELAIGISEGLSLLDQQFRLGAGQRVGMWRTQSRLSQPFVWPLQYGPPTFAPSPKLPIAFLTLVEGANTLQQRSEAPGGYNPLAGKLDHWRPGTGHRTLGTAPDPQGTTDGSVEKTQGLARGIWNTLSEILGTILI

SEQ ID NO: 999131 - protein, 193 aa, Homo sapiens
DQTREVLLLLQVPVLSQWNQLKDKVVRLLPEALVVLEIGQRQGEQHVKGGKGRQGLEVCCAPTSGQQRLQSLKLSSTSAMNVVSNAKWAGSTHWHRQVSSDLNGAASRVCRATGSGFVNTAIRTLPSQFRTGTSNAALLLNARAVCAKHFVGPHFGASKVGAIVDTVHMIITAAFVGNGGTCELARGLQNRQG

SEQ ID NO: 999132 - protein, 411 aa, Homo sapiens
APTWNSLLRCCLLLARQCSMPARACRPGQLPPVALAAVPLLVPSRLVLGVRRGQGWAPRGKLEGTRAAEGSFVDFTAAKNLGRRRGANRGPDFASRGGLGGTPEGGAHQAPKGPRRELSEIAGEPKGDQRTRRRGSRLDSWRDEGRRAITATQDHRGKRIINHGRVTHRLPQQLSPGRIQYTQGGQGRRGAIDPQGRNRAGTQTRRDIVENGPGKEITPGGYPRGENKSPRGMRGTTIQGRHTTTAVVPSGRQNKAALREPNSRSRHKPQTRGNTTDEHPGGHTNLGALRTTRRAPQRGAFNRETCRTNNQNKLGETHNRSSRRAHRPTPRDEEENTGVKRHCYAPLTHRCGHREGTNKERVGEERPRRRGNTRLRVDATETPFPIGGTSATAKTERDPKSVTPRRSTQET

SEQ ID NO: 999133 - protein, 198 aa, Homo sapiens
MRSWSWAPLGQLGKSTYCATMGPRHLCSPSSGLVQGCKPGSKQQNTSTTPVHGLTSWETESTVELTCTLDGTDFLLTEFRVPKRRDSGVLMCMWSTFWPNNFLDVAGTNLVLGHCKDGTSYILLRHCPRSRLTLYTSTWLVMKPAWVQAASKHAGKFQSLVELHTCVGFLKFMVGVQFQSLIFCGHLGQPLKLAHGSL

SEQ ID NO: 999134 - protein, 353 aa, Homo sapiens
MVPSWRQCRQRLTAKQLLALQHAPTSVRNCTFNMQHSSVPTHSNYHQWHCSTMAQVPPGYQLSCTGANTHSPSFVNFNISVSRHHPFLHLSLQVNGLHVCTNYSVFQITSVFHSPMGPLSCYYRKFPKPHRTWVPQVSFFQSKSRLMRSYQATIHDRPLALYPEDNWPTGHTPDCNGTQSAGKLTSCPYLYQWLTVTDELGYTHTGQLSAIEVKRARHTLGAGDHSHLHWQLPSGSRTMTPLGFYSSSRYLKAADTGNYRFPYLWGSNTSSWERTTPLVGAHSKLSPGITIMCNTRSIINTRYIAGACVGNTSGDTPLKLPAGQHNVATWERCKRCSQLYTLHPCGHSFVVTN

SEQ ID NO: 999135 - protein, 84 aa, Homo sapiens
MTYFSDARINNTRPRLTSDLYKRATSGGANLSKIWLDYSLSSQHTPLCVKSVIPHKAINPFYERTDTHAYRKGVAEHWRENTLP

SEQ ID NO: 999136 - protein, 375 aa, Homo sapiens
MGEFQIASVIFVSSNHIKKIVSIKIASDLVTLVEQATQLPLNVSLHSNLEPRFRDHPLDKSPNGGTCTSPSEDLPTIYTREKIGPARFFPELSHYSNLPLNWHHFDKQQLALHTMSNTHTATQNTRSIRTPLLYTPKVKKIAFANTGPFRRSRIGSSLRGNNTEGLGLIRTARQTEALDWAKRCSSSIIHHQNGPTDIRKITPTASNYVYYQQKQRQHYKSFSIRTHFINGQASPLPCDKYVCGTTHVAISLPINTLAKTTTAGGLSLPKEATRDPRVSHQFMRLNHPRAGGPIGLWQRLRTQQRFLWDDSFITPTRREINSGHHLRSTELGETPTSRAISPMPSLSRRINSLPPHSRIRSKASPSRGKSAHDAH

SEQ ID NO: 999137 - protein, 89 aa, Homo sapiens
ESRNWLIEKINKINKPLVRLMKKNTEKNQIDAIKNDTGDITTDPTEIQTTIREYYKAHYTRYPRKSRRNGYIPGHIQPAKTQPGRHLNL

SEQ ID NO: 999138 - protein, 292 aa, Homo sapiens
MGHEQNQGAALLQMLPLLWLLPHSWAVPEAPTPMWPDDLQNHTFLHTAVLPGWESQLWDFSEAYDEDQLFFFDFSQNTRAASPARTLLTGAQEQGTCSCPSYFDNSSFCELADPRQIGPKTSAWHELPAVHERFPNLLKCLTPEAPLELWQAPNTLGSAPRSATSSSPPIADSCNWHALNFPSSLCDRDSGGPTSSLLSLARTATFTLSTASSSHFTPFHNQKPFCSTSSFLATGDLTRNHLTAYTRQLVPNRGTPGKPHLAPHEFCLAAIAACRSPSGLWPLAPVSSHTSH

SEQ ID NO: 999139 - protein, 135 aa, Homo sapiens
MSKTELLPDRLGHMFSGPPEVCVTEHDHSHLAENKSLLIFYRSTLFADTLYFVWQPYSPLNHLFDVSRVMALYVKVRSQTVSGIITAKFKIAGLTLEHRRRKTPSGRLSTDKGSLSRTQESILGSLAPTRLEANP

SEQ ID NO: 999140 - protein, 137 aa, Homo sapiens
MNERLAQLDITTTHHNTNNNFLIAPREQLPCSQPLLHNPQCEDSTLRGTINSCLVDIRHDSTTVSDNKRLYAAADREHRCRDISMLPCKARHRATGVPEERSDIIGSYETARAAASTPTHHWHTVQKTARRKSNERE

SEQ ID NO: 999141 - protein, 218 aa, Homo sapiens
GSRRRWQGEVEAVERSERAGPGTDGSIAGLAGVAGKLSDEWQRACVRPVSLTVCGDQGGGGGRGELARPRVPLLVESGGPGVRPGVARALGFSGLTRRTLPTFLGLLFLRVRNNAQGGPFGPPGSRDTFRTLRACMPRSARRTKIPLNVPSAGSRAGPIGAQLPLDPSMCGARPLVGSDRVCFATRSSAATLIRKRGAPYPSQCVLSGETHVVTVERN

SEQ ID NO: 999142 - protein, 143 aa, Homo sapiens
SGDQICMNEELLLTDEQSKWFLKKECTPDEEAVNIVEMITKDLEYYINLVDKEWQGLRGLTPILKEVLRVKCYQTASHATKKSGMKGKVSQFGKLHCYFKKLPQLPLPSATAILISQLTSTRQELHHKKDCNLLKTQMIISIF

SEQ ID NO: 999143 - protein, 102 aa, Homo sapiens
MHFLSACTKRAHRYNTTSTRGNTNQETGQQYLTKSQKCSYSNRKGNNDTDTVWSTSSSLLTGTVANSGNMHEKRITAKLLNRSRVTSWTTTSLLEHYFAQTR

SEQ ID NO: 999144 - protein, 72 aa, Homo sapiens
MKVLVQRITKCAREGRPEVQNPQPELGCRHIKVPRAGEGKRGVTPEETNTHNEKPGVCTSSSVNRTEKQKRS

SEQ ID NO: 999145 - protein, 82 aa, Homo sapiens
MIKGDHRASEEVAPRRGRVVKGPPGTRRTLPHRSEWRTDGDIAANEGKHDQGNTAEKRDEEVTESAQEMSTNTEAERRENEE

SEQ ID NO: 999146 - protein, 75 aa, Homo sapiens
TPYRGSLILQHGVSEAPWRLRMAVSWNRYTDGAELPLALAGDTRPRVWGRTLRLSVISSMATDSFFSFLFFLPFF

SEQ ID NO: 999147 - protein, 32 aa, Homo sapiens
METLYEPSISVRRVCFLANDERSELERGSGAY

SEQ ID NO: 999148 - protein, 186 aa, Homo sapiens
KGPVVSATAQITIMKFLTLALVYLLLGPEMSSSQKSVLFCCRSDGELLSVWLRGSCVMNAYSDYVSDIQLNIGFRSKYFHCLGENYEMLTNIWRTLAASLGRMKVISTAEMKIREILFVPSVMLHGLYLGLRSESLVQNDTGVQRRLAVVPRLMFRTCVCREKLLRLPLAFLTLSEIWVVEEHYRV

SEQ ID NO: 999149 - protein, 103 aa, Homo sapiens
ILRCLGMSDALLQYSIYTTDDSRNCSVLSPDSLHGHSSTYAYSRRGHVNMARVHPRVIAARICQEVNMPSIDGLKMLCLIPSMSQSLLPLYIAQRFMSWILEI

SEQ ID NO: 999150 - protein, 72 aa, Homo sapiens
TILESLFRVPCLLLDVCLPESEEAAWLASVTLICVLCTGCIVSRGGSVVSLLLFLHASEGGILMELESILMK

SEQ ID NO: 999151 - protein, 33 aa, Homo sapiens
MQFPGRLNQITFTVYTTVGVYYGQLLLKSVEQN

SEQ ID NO: 999152 - protein, 103 aa, Homo sapiens
MGNHAWGLAHGGVYQHSGIMTTALRQVTKILSMDRLCSGAHKRSEVLEHQGMCIELNWALVKKCELGGARVKVEQRKALPTQYQLGRKIVGFGALARWVTNTL

SEQ ID NO: 999153 - protein, 69 aa, Homo sapiens
PDTDDLKQLANGVDRYISKYELGHKPFSDYGNTPRIESTLDKVVDTCEGMTAHSVSQKFTKIALTGKSL

SEQ ID NO: 999154 - protein, 110 aa, Homo sapiens
MSIITNMDISTLGAVSFQKNQTTNGAPEMLLLILLLQAFITSISTRVSIGRVIASRTQMNMPSRSDRCYYDVTKECSVERDDINQLLCRIVPQGSDDGLLGADAANGRHS

SEQ ID NO: 999155 - protein, 84 aa, Homo sapiens
MESYYSKGYRHKFPAPSVSICGELGVLIMVLLNFGITWDTFGEKGLRQGYLVEAQSKIVLGQEQDPDGGKFDRSQCLVREMGIV

SEQ ID NO: 999156 - protein, 134 aa, Homo sapiens
GTRSSVTVQIRTMKLLTVPGVLLLGPGVSAAEACFSFLVLRLLEWGPRDYVDEPPPLDMRERHNSHLASDEKYVPMPRRWNVMMLPKRGPWGMSWRVQERGVTPSAGRELSREYLMAYGMRKDSTRFAFQGWLE

SEQ ID NO: 999157 - protein, 113 aa, Homo sapiens
MFDHIAVHRCDRDAVKLELAPARKGRHCSRVSIKGMLCVGSNARDLARGWWSRAAPRLVGSTRALRACRGRRLRSGKRRILEEDRYGRGPKVPQRREWDVNKGMAVMLMVKQK

SEQ ID NO: 999158 - protein, 211 aa, Homo sapiens
MNRIIVYDASDDRGLTDTYAWHARSMCCSPEDGDGRQDSILAYIIRDIVRPKSKTLQKDSIDSHEECLLCSVAKSSRQTVAGRSRILASLYDSIPNHRLEVSVAWSYTWGFLIPEWRLNSGRRCTVRQGRNGSTGAFLILVLPRSSGTIQRKSEYAYVLASYFGVNKRSAGQQFPLSGHSSSLNVVPQHAMSGNDDNYLHDHMEIGLNYQN

SEQ ID NO: 999159 - protein, 204 aa, Homo sapiens
VPVPWPGGGERGTWGREHSRSPLLCTPLVGEHSRSPLLCTPLVGEHSRSPLLCTPLVGEHSRSPLLCTPLVGEHSRSPLLCTPLVGGPRLQPTADPPGAPGWVSLSRKGYVVGAPHCGWGDLIPHRPPPSSWSFPPRHCFAPAPFGITVPPCLRNCFGRCKQPPTRPPRSHGPSPRPKKTFCSCKYSQQVQTCDFIFHVFLRTD

SEQ ID NO: 999160 - protein, 233 aa, Homo sapiens
DCCSMKIFDVSCSIAQMTVSLIDKLIWYICSPYMATTMKYRLSHNVEKFHVWSQGTTSSWRSRYVMHEMRYLGENMSLPEEPRYLQKHMSHVAKGDHLCKGLTSTSAYQMCSYLSPWMRVCLRCMPCVWVFRVFELVDHLGDEKSFCYYSPNLMALNSSPYSMCTRLDDSDLEFQIAAHSSCRKRGIVIVGLRWRTRSNRRPLRRPSSHFGSLYYQRLATFTQNVILITVIAY

SEQ ID NO: 999161 - protein, 197 aa, Homo sapiens
PRPGVTGELLLLAWKRGTESTTLMINVRREEIDQRDASPACIGKEERSGTEKRLLFRLTYSHVAPSSRYTCLSTFMSCHPVGHWMNETPVQFTGFLGELSNSKWPHARSRSFSHECARSTIHSDRLGGYFERTRGRRAIRGCGGKGRLLYTQLGAESSLFKRIRPLETLEANNRELNHPGGFSDPPVNNYGYCPLPI

SEQ ID NO: 999162 - protein, 237 aa, Homo sapiens
METNSPLRYFLNVRIFPHYCKRTLLKRNEYQRIRNFWHPFFERLPLRDLTAQFDPLSALLKFHREATKSLGRQVVGFPIWHKALAKERRHTEGVREYRLRVTVSHHLFALIGVSDSEGNTLLVNRVSSQYRDIGPPDSLTLKRSTFSWNLSHYPESLLVGPQKVSLKRVVNCGVSQPPTHVRKVGLHLGWEQPYMHNLDRPSTGVTRRHTWTPPKLVYKETHLHARCIKSSRKYNTC

SEQ ID NO: 999163 - protein, 222 aa, Homo sapiens
MCPISPDVVYCIDQVALRRFIEDCALLYYFSRQDVACMAKDELNMNAATWNGAVMARRRSATLISLYIAYTKDLSLTPYHPKELVHCVDSILNGSVSRDLGFTIGQEDMMRGYDDSGDYYSQIHTRGGRWDERRKEWMMLPRGSVDSCILEQMAVTVLLYYKSLEVITAFSVCPDSPYRYSPSLAYLDAVNELFLINPDSRAGDYCQVGQYLIILLSLFTYK

SEQ ID NO: 999164 - protein, 116 aa, Homo sapiens
MVKRPLGLGPSLAAFDQSWRFAQLEVKVAFINSRTLGRNDIHLTLMDNGELYDHPLGEIANVYVSYTCVPFVRFGFFSLSDESNISDCSECAIVRQAGESGVKHTEWCKAYYMRLY

SEQ ID NO: 999165 - protein, 130 aa, Homo sapiens
MNKKEVVEAVDHVETQTMVVVGIVGYTWENPSRPPDIQELDIGMRHISDDMQGERTYQELGMKSKERRPRPKVPGRRKHGQGTEGMGKENATPGGREHTGKDGRKVLGKGHAGVIGPRTQMRHEARQGAK

SEQ ID NO: 999166 - protein, 245 aa, Homo sapiens
NHIYSSIKYNIESWICTDFLAGHGALRRHSPSQRFVNPRLCPQTFNSMNMHGTMKVYVWVLMDVRCKGKRPMHAWCMLQEPRRETVRQYFPETWIWDIGRCDKLSPWLWLSVRSTQSPGHHHPSEEVRRGLLDCLKMLGLWLSACHCLLSEPVQALSLVVSSQMPLTLWVVGEALLALECASVRKGTFPNIAIRECSVQAWKPLRDFLSWGRRGEGKQRALTAVCAITGLAKLVSWAVNPESHEE

SEQ ID NO: 999167 - protein, 80 aa, Homo sapiens
TEWLHCPLGVLCEKKTLLGQDSQWVICFIVLVATVMVTGDREWTKLALPPGSCQFRTLGSNAVPLVVCDSVANSIALLIF

SEQ ID NO: 999168 - protein, 105 aa, Homo sapiens
MSVISNLCIGLKAVQQAIPKPWAPWFVSSLHTLVGWLQSYPGFTKRDICTTEHTCNICSSPLLDHGAVVSTSKCTIEIPDGSLQLLQPLFTTSFQLENQPAIHEC

SEQ ID NO: 999169 - protein, 137 aa, Homo sapiens
MSLAGIPDQLRTSFSMYYARALGEDQATESYQGIEPPFWGNNTDPRRHGEKDMWVRPPHFSLCVKNSFMGYAEYQKPNLIRYYEIEVQHSVATCALFGTLFRWPVITRANIGLCPGELPPSWKLHTKGPLINNTVCL

SEQ ID NO: 999170 - protein, 85 aa, Homo sapiens
SLFCKSCKLQYGVRRLHIPSLRVVLCGAERIWKTSNGYNYYNALTPSSCPQSGHIAKQEPVTTDARSLKRSRSERLVAESQRLVD

SEQ ID NO: 999171 - protein, 226 aa, Homo sapiens
MWATTCAAPCLQRVEEEDETWKFEDQDSKEAKKPNFINLGHQSADIIITYLGADMEEFHGRTLPDDDSCQVIPVLPQVMMILIPGQTLPLQLFHPQEVSMVRNLIHERRTFGCPCLQHMSTEREAQFGNNSRDYMPIEKNRIREMEIVNSEQPWDTQRFKVLELRTSQMESSKLKCKSFPNGVCAFNQCCSSLRNPLIKCQHFSLQTCLTEKTNVPTNVARRIPEA

SEQ ID NO: 999172 - protein, 166 aa, Homo sapiens
MGRETNHESTTQTQKTTVVAAHTAHPWNTALFGTHPNGERRPRRSAQQRPTQCNTLRHKRRAIRTTEERHTHDGGKHTNEKGGVGREKPQPPEVKDNETSRAALERNKRSAQGAPGDQTATNHQKKGESAVEGAPIDSSDDSHQARPGRQPTQAGRRAQKFSRGIT

SEQ ID NO: 999173 - protein, 105 aa, Homo sapiens
MPFKCTELCDSDGLSRGRSDIARNYHGAWFRREFDRDIDGVKTSVYVDPVHVLQGHDLGASCELDLEEDGLGQWESSWSRPRPLEHTHLKTAAMMGPRRPPGIGP

SEQ ID NO: 999174 - protein, 76 aa, Homo sapiens
ALSWRVCLKNDHWPCGIWRVLRILLIESANEYCTLKILDVLELKIPEDNARIYDKYTEQTYKLTSWLWFKCVKPAC

SEQ ID NO: 999175 - protein, 148 aa, Homo sapiens
GKESRLLCFSQPVECAGGGDSSALACRPLRLSCGFPGDFLLCPPLPQVWAVEHLCRGMCVPAIYRGHTFSCFSFILWGVFLTVDNRGFSRHVFVPQAVALSNSPDPLVLTLACALQPSRYSRAVDPPAPQALYFVVSPKWGGAHFSLI

SEQ ID NO: 999176 - protein, 213 aa, Homo sapiens
KEGRRKERKEEDRNEEEKKKKETIEEEEERKEKRKREERGKKENEEEERRTKKKEEEEKRGKKKTNKEEEHKGRRKQKKRTETEGRGTKNEEKRKRTDGGEEQGEEEENEGTNGRTNTRTDERRTHGTKAEQITRTTRNDGHERTRRHTNERTNERTKKKPNEGRTNAGEHERKLNDNRRTDRQKNLTKNARTDTKDNRTNERKREGTTGEEK

SEQ ID NO: 999177 - protein, 125 aa, Homo sapiens
VLEPLNLTSEPSDYALDLSRFPPATPGRLLTVTPSHSPKKNPENSHKENATRVPGARERIPNWDFRGKLNSEHYSGRRHPVLEAGPMRTETEAHRDRGTAQTGGYVPCAGHMDESSLSLFSYLSH

SEQ ID NO: 999178 - protein, 120 aa, Homo sapiens
MFKFIDCLTSMQTSYTYSFNSTILGVTLESITTIECAHHVIKVHDCDRFSLNWSAHALPLCAVNCERLLFMPVPLRYMLEQNRWRVYVSSRGLLCVQWSLLRKSCWAHFNYQGRLRFQRI

SEQ ID NO: 999179 - protein, 96 aa, Homo sapiens
MAIIDREGLHTKGEAEYESLLYGMMALGRERDGVGPGIKALQYTSRTISPTVRRLVLPFRYIGLGMGLAWTDKTVVVKEVDGGSSLAEHQMKPQRR

SEQ ID NO: 999180 - protein, 207 aa, Homo sapiens
MNRRSRKTVITSSSFVPGEYTGLAMTSHRAGKVVTGLGIQGDTSKEVVVGCGPLYDTHTRMDGCGHWWATVETAVDVLYRTIQRSGSLVHGRTLNVHAMHRRRFYVRIWALNLDERVRSFLCNRLSAQEKIGLGLERWGMKRLTRERGTFQDLLLNRKVTGTNMPTRWCIVTPSYSQELRPWRILLTTQERKGLNAELDNAMVEVGW

SEQ ID NO: 999181 - protein, 83 aa, Homo sapiens
MPLSTPGVGNSSKTLVLQKMEEINNIVINILHEFICPQYLASKENVEPSLKKRVIPKGLLKIMFVPSAYHTLVCSICGKWTKK

SEQ ID NO: 999182 - protein, 39 aa, Homo sapiens
MRVARFKHCDYVCAPKEKAPIQGLRAWYLKKWLGQTISI

SEQ ID NO: 999183 - protein, 221 aa, Homo sapiens
MAFTPSVASGGLDRADLVTPPAWASLRTRITGVNHQCLAFFIFGTQSPTPCGPGRRKRREAERPVGHKEAPNLNRGPSETTRGHNPPKDAGNNGAAVSTKTGAQFVYTLNEATGRFAPHFGAAGCLSEFLETLWVNPPTWRCGGPPHKGGAGDYVAACGQPNTHPPSLFGGKRVLFKYHDGATNMGILAWRTIYFSQRVSLYIKGNYSCRRTQCCHKRISR

SEQ ID NO: 999184 - protein, 62 aa, Homo sapiens
MRLGCLTKVRRRLELNLRGGKSFLEEKHWNNGDRDKDKINKRLLSKEKAPENALGHYVVDLI

SEQ ID NO: 999185 - protein, 108 aa, Homo sapiens
MSAWISPPWVLESPKDDYSGLRNSRYGDRTLTDAWWTWGYPTQQECVLFSTWSIDSSVKYLGETADLFFDHYQIIVKEGDVQKNPWFIWVGEKVSDGRLVNLGETPVR

SEQ ID NO: 999186 - protein, 313 aa, Homo sapiens
WLTEVLTLGSSYPSTSASHVAGTAGACHHAQLIFKFFVDTRSCCVAQGGLEFLGWRSSHLGLPKCWDYKHEPPCWPWNLFFFFQEPGLNLGCPGWKRSGHNLGSLQPRTSRAQVILPHQASRVSWDYRVCTITPVHNLEFISREGVWPVGPGVVSNSSAQVIPSTSASQSAGITGVSHHAVAHGEFLDHKDIGALNRDWGRDLETSGNHNGTGSRYTQVMAVIQLAAQPGFSKSWELGPSIHFAKLSGHIVFGANQNRFKKKPNLLSVVTRRVPARDRKLPKNVLTSSPYNSGGPMVLVVTRGGGPTSILINP

SEQ ID NO: 999187 - protein, 359 aa, Homo sapiens
INAQWPYTAWGTCDSLLRCCRFGPYTQTDCQPPCTGPAPAADPCRGPSPGPLPVGPGVRREAGTGAQWEAQRDAAREVLLMMDISRHANILVRSSGHTAGTVIASRSQPYEGPGGGITPPKGPETAIRGHRATRDCRKTDDDAGRTEKTRMTGRQTKQEYTDWASRCSQLGSNHTQRQEDSTRHRPGGHEEPGTHTWEQTRAVEDQSQEPAPRPHTGKQQGNPAALGVGIEDGRRRQQKARAQRADTPGDNTSRMGKQTTPRWEQPVTESTKGQERARGKVPPRMAQGWPTDAGTNASIQRNLTAGNTTIGETQSMTAHHDYTQQGRRRGTERETHRSDGGTTKEKPQWRTNRQERSDE

SEQ ID NO: 999188 - protein, 386 aa, Homo sapiens
VRTPRDRTCGLTLHGGLRRCGARPFSSSPGCCVVPDERCPTGKAGVPLMNTSMLREVCAVALFGKMRCDVRSVHLGRRLADDPEDRLVTTRSLELYSAVNILEEVFPPNLGTLTECEGPSRSGARRSITWCSYPRTLRRHEVVTLPRSVDFSTKGTGFPMVPRAVGELGVPPRARCLIFEDATHTLNVSACVFPSIFHRFGNSVFIITSGFGCPSELWIRLEWRLRGALGWGLLRGGPEQKQATEYPTAFRVARSEFPAPCTKSCRLVRSIEPGRLIASCYQYRGFSRGAGFGVIACDWGLLRRGSCPFVTVACRHRSAPRLCSCCGRGVPTFRFPRVAFPVSPPFCRAPGAGGPWGPDVLQRSNPWGQNFLLATDSLGGPKLVGR

SEQ ID NO: 999189 - protein, 102 aa, Homo sapiens
MLARMVLISCPHGPPASASQRAGIAGVSHRAQSKISLLKLRHDLVVKRLVVSRILGGLRAREIPCIPEVWQTYLLEVDQLHCAHVWPSHGVWMSTQVMQLCS

SEQ ID NO: 999190 - protein, 222 aa, Homo sapiens
MLQMITYQEDLKEKKEVVERGGNMDRRRPCLTAKWLMMEALGTQEADNEETQEEDSKVRGDGTEEDGPKTGDLVRKQDGMHEGLKASCSSALRGEGRGPGLQLIAWRGLKPIGRLNPHERSRKATRAQGIDVRPRPSIDRVTYEGFKSAVENSIKNIQGAQVAVGHPIKFAYAAVSNLCAPHGLPFREQLLDKRACEDSQSLRITMRGPIYDNSIGGAPRRT

SEQ ID NO: 999191 - protein, 372 aa, Homo sapiens
GLLGRRADGLAIELSGAGNAELLPACSGCLGLRRGLQPRGSSSLCLAPADTLAVDTLAVGTLRGRAAAGACCACAVPAGGMTGHVARPGAMLRKDGSRKECARRCCCVCSDLPGPILAFDCLDTCSGSPQTSDLKLVGTAGRALGLAADVRRDYRACPDAGGSRRRRLPLKEEASALGKRRSTGPDRWVAENPKAKHLTTMRTEMLCGTHGTSGHDRRCRSHTHIPHTYDIIASERTAQGAPGREFITHRLQTEARDYWNEPCARNIREPNSPGSLVRPVVQRVQKAPANYQTISKKPTLEKHARETKDHIQYQTATLMDNKHPQGAHNLAQTTSNGTTTKCEPLRARPPPALRKPPDPHVPTPNPMTRTRN

SEQ ID NO: 999192 - protein, 186 aa, Homo sapiens
MVSEGPGPQCQGARRAVLCRGEEPHHHPVSSPSHQSPRQRVQELSTGVRGEQRCPAGTESHHQPVSINRHPVSLARRVQDLTVPGNRGEQRKHNRRDESTTVTQSIRHGHTRLHRPRGIQDTQCQQCDANQQTGTREQNRNSRQSHPDITTPGARYGQKTPASKTHHMDTRTHYRRKRNTRRGKED

SEQ ID NO: 999193 - protein, 130 aa, Homo sapiens
MVITALREAKVGRIHEVQEIENQSWRTTVENTRINIKKIPQNISPGSAREGSHEAQSHRTRLKRQENWTETVGQAGAMAQYEARKWDDIENQDMEQTHTRNPRQGPETQGQIKALGTTHRRHKGNNARQR

SEQ ID NO: 999194 - protein, 150 aa, Homo sapiens
MAAKYNYLLLRRDARGASFPTAVRHTAPPAAASPDEGGGEHTFFLSDRSTQAYILDETNRLSSTLFVRQNPHPLSVVLGAFVVAHQHQSYFAFHIRSGGPQRVDLFSDGIQPACGEGEGDNHSSWGGYGGDAPSKEGDHTHPVSEGYTGR

SEQ ID NO: 999195 - protein, 195 aa, Homo sapiens
YLIRQRRRICILGTPDYHQNPRSIVGTSTVTGPSDFEPVVKVVQIVDGHAATILRGSTCKIIYSSIHANRHARMRDHRITTRWKEQDAASIIDTHEKSAQELKAKQGVHYINNRHECHRLMINQPERMPKLKGQASNTSSILRTKLSSTARRTHSLQLLEACKEQQAIPVMPHVLNPRRGSKSVSRKTPVSQNGR

SEQ ID NO: 999196 - protein, 132 aa, Homo sapiens
MSGTRLEGDARSVSSRSSWPYPGSRSEGLEILAFRCLECRWDSHVLMKHGPAYTPSMDTSGVQHEFTTALVPQTGDSCVYLLQCCCWYRMVNVDAEMNFRSMFDIEFWTLTWQLTLPSVLEYLQKLSLPLFG

SEQ ID NO: 999197 - protein, 73 aa, Homo sapiens
MALTVLEHEAQRIEGERRLLEHTDNRYESGDHVPIPRGNGPVETTHADGRRMTDSYTTIHRERASRGPRATAP

SEQ ID NO: 999198 - protein, 83 aa, Homo sapiens
MPTENMNYAYYNTPDKYDTFPIQQRGSVYAQHDSHTGNEPTLTYQLGRGTSETDEEHNTHADTYNTRQRTYIDTHIRPHTRTQ

SEQ ID NO: 999199 - protein, 174 aa, Homo sapiens
MPDPDICLLDMYCSEGIQMRSLYSPLPSVLESIFSSADFRYPSSGSFHLMNAETLSTLARCLVVFMRALPFALHRKTLVEVAPMNLQINRVECTNSDDEMAAISDHCCFQSRTWLRVLPTLYPSLMVPPPTPDPRGLIIGLCAEVEIASWMDSLARRKPRDEEGIKVRNRAYKC

SEQ ID NO: 999200 - protein, 151 aa, Homo sapiens
GALCSLVGFSRNIVVFGLSFVTNGSLFVCCPGWEMRVASDYQARGESRDRPGVAGDSPASALPSRWGLVRHNTITDRTKFFVVNVGRKTKVFLPCWPGMGLRTPDLRCSSTDHWVRLKKLPGELNKGDGKTPNANNTQRPKGAALMDRLGT

SEQ ID NO: 999201 - protein, 146 aa, Homo sapiens
MPCNSQHLGSAQGLGQITRVSLETILALTRVKPRSLLKFQKNLRQGVLARGPCSPSLLRRLEVDQLGCEPRGSRVVASDAGRTQRPSVFPPSLRQQEARTGASSKITMCCAYPVNHYFGLGSPNVLFFPFGAKQTSLGTTLGLKVP

SEQ ID NO: 999202 - protein, 108 aa, Homo sapiens
MPYSLVAIRRIFIISLVLRKSRIRIVYAICSYHKRNSWPKLYSRKALVTLRNISFTLSGHENNCQVGLASPRLHTSTSMPLSRTHENCGLITVGRILIIDTRCVMLEA

SEQ ID NO: 999203 - protein, 104 aa, Homo sapiens
MLLHSGDLPESVQVVSSFLQNQTDESTQHSVMKCIRTRWMASPTNIPGSILYRAGPLYTISSLMWLLVSDSTIDVDSGRTVSSLSIPRSLAEEIAQRATKSSPE

SEQ ID NO: 999204 - protein, 89 aa, Homo sapiens
TACQSEHSFFYDPIVTSLAITFATDIRPVERNEVTAEHIAPSVTDSYQYSRVLNEAVAVLKVLRGYHELVQTVRWSQKDVDAQVDAWEF

SEQ ID NO: 999205 - protein, 49 aa, Homo sapiens
QRHTEEWLLEHEHWGAGRPRQRLALSEHLVTHCQRSSIGSTGLLVYDLP

SEQ ID NO: 999206 - protein, 71 aa, Homo sapiens
ISDQKKKRLSVVMSHWKTVLICISNRQRSGSKDPRKKQKVYSCDVCNKSPDNGFRSIDKSVDVYSQLIMAG

SEQ ID NO: 999207 - protein, 214 aa, Homo sapiens
MRDTSDQLAALAICEDLLGFQTYAVYVSTLTQLESKTCHVRRTRDALKHMSGVSRCTEGFTVASRNPLSKAMGKVLDCSAMTAGIFAIDVSSGTHNSRGRFLATEQIFKGQKLALVSERRLGVCWVRGGRFPLAPPYNLIKASTFEANAELAAQTPVTLGGTISATQIRKVRTFEAAFSRRHWSHNLQGDLLERLCRLKSGATQLDKVRYANVS

SEQ ID NO: 999208 - protein, 178 aa, Homo sapiens
MLGSVHERRGLPSIPYNAPAATRTRSERKSENGFSERHYVDSIDTAYGSEGPKLQIIHQLYVPLSPDRGDLKARTRTSECRESATEEHIVQTKYRRRQEHPYNDEESIEPYTSSNKDRDKTIHTHRQDAKEQHDNGKIHKRGKITKIDRKHKRDLRKQAKRKQKKQRSTTITDMSTED

SEQ ID NO: 999209 - protein, 86 aa, Homo sapiens
SLSWCSAPQWAKFELMLPGARAKSVKGFPFLCPTGVPCAGLPVPLSVLWQPGGSGGWLGLWAGEAEALSVWVSQHMWSPWAEHQDL

SEQ ID NO: 999210 - protein, 208 aa, Homo sapiens
MTEPVRLSLRTLEVKVEYAYSDNSLEPGLLVESTLQGECELYHELIASVPPVPLLSPKQMMSDSDYQQEAYQGVLQRTVLAAAQQHSGLSKKKEGRQSREAMMTFQNAIVPQLGQQERSSPIGIPKAQQSPSYHTERPLSRSQSFCTRRQEKTQGEEEGVTSCQHRECHRHLNDHAKMKLMSKIGARHTGKNAPGRGRKQGNSLNQGS

SEQ ID NO: 999211 - protein, 181 aa, Homo sapiens
SITIRVWPGPSQVSEHGDTCVSYSDPWVSDRSAWILIQIQGRLGGKSRRTVTNVTYGGSVGHITSDHIRQEVEAEFDSSELSSTARTQGKGEAKRENTEEQTTKRRDRERQHDKKRKEHHRQNRRTTRHRNNGEHTQATGHRRASNTREKKRQRTQTNKRHTTIPKKRRQKRETTTKKKNK

SEQ ID NO: 999212 - protein, 298 aa, Homo sapiens
MASPYTILRSQVKQRTQNTYACTRVEERWRGTTERHNPETQMRGIAYTERGKKRETETHSGKTHGHERGQSHTTIEGYTTTPKGDRHERDRRAKNQTHQVSTANKRYKQMDTSNTRTPWTTHMQRTPPNRENSEHHKGYRAKDKQATYQNNTRAQYPKRHIPNEHHVLGDNHSPQSHETTQAQQRKTHKGHQEGHNTTEKRFTSNSQNERTGITNQTTRQKDNPQEDSHMATATPEEKSEDTSDTHTQKSTDTTQEGKTTEDYQNNKWRTTEDSRETHRNERRSANHTQKQGHTQLTL

SEQ ID NO: 999213 - protein, 235 aa, Homo sapiens
GDFLRRESRGSPASTVLGRTPGARVPSPGRTVPIVSPPVHTSFSGDPRNCPRRTLLTQCVVSAALGIYIETCTSVQRNLITVASAYSLIDAASHIVVMVASENISSKGPRELHGYPNSAKNRKPLRRSPIVSSPIFDAWSQSIFDPFVNTADMIVSAYWKETFVRKKITYSVSTTNRFLSAANDARAIRRRDEKPFELEEVLAYEKRKILVLATREFPLPYSESESYRRRQNFVE

SEQ ID NO: 999214 - protein, 81 aa, Homo sapiens
RRITEALLEREIPVMVVSESDDGDRSTGSPKRSVGYRVARARAVMPLHSSLGTTEQNPSQKKKKEVTIHQGKQDYTGDWSK

SEQ ID NO: 999215 - protein, 121 aa, Homo sapiens
AGMQSCKSWLAASSASLGSGDPSRLSLDEVAVGSYGTLSCNHQQFWRRLVICTVLVCMTGVCLPTGGPGHGSWISWISRQCGAHRSAIPRVLADCTRVTRPAASMVARSFSFRYLGDWKSR

SEQ ID NO: 999216 - protein, 192 aa, Homo sapiens
MAWRIGWCYCLLSPSTTFSSADAPGTRLALPIAATAQHIRSQTAPGMATATQSNSPSRPARPTPRTHAHHSEPAPPARPTACTTTPHTHHRNPTQGSQTPPTSGPNRTPTWTAPATHPAQPPATRNNNFPRTPTHIPPNHPTPHTPHRPAAAHGSQHPPRIRCRTPPGTQPNPTTARPADPAHPHPHAPQPA

SEQ ID NO: 999217 - protein, 328 aa, Homo sapiens
DSSARWDRLPSFRQNRSRFACWSQTGCTRIITCSAHAPGGHAFIGGNVAPQGFEANTTRSGRIRFSTDSSWETSVEAFVFRPHTLGDVYSPYVRRYYGDIVQEPAKAWASLEDLAIEGSVNVAMGRVLQIDLGVGGDPVLCTCVGQRAVTHSGVSENVGEQEDARARDRMFETVVFPEFDRMGIGEVPRDAFAQSPRFRGPIAWRIPRPRHETRLEQDGAYCPLIEQGFRCVGCGITDTYWIPLDYKTTPRQDWVLSFRVINPPKSLSHCGQGGKPFFGLDRISVKGVYRSLLASLPQAWSTTTENKKAFALNPPGCIRKGIRGTSRW

SEQ ID NO: 999218 - protein, 145 aa, Homo sapiens
MKTNALYLQGQSSERCTTITSLHLSTNSEFPVLLCEEGAFVTLLGRCHLRKFTLCRRTGFILSWHTLECHDACFHVDHDGALKIGGHGGLLMSSLWKPILLLDAIECPLSLNEYTSSTWLKCKTVEFYRGFQEEAMSVQILVPDR

SEQ ID NO: 999219 - protein, 37 aa, Homo sapiens
MQLRVYDLDVGLRTIPVVQPLCDRFVPLQAIEKSYVI

SEQ ID NO: 999220 - protein, 39 aa, Homo sapiens
MEEAFSRMDGELESGWSEKAGGRRPRAGEKSNRESNEKE

SEQ ID NO: 999221 - protein, 73 aa, Homo sapiens
TAKDKNRWEDPGKQLYNVEATSCCPLGPTAAKRRLTLCLPSCVGSNEQRYYGGGYGSTQATFMVFQACGSDTK

SEQ ID NO: 999222 - protein, 71 aa, Homo sapiens
YFTLRYHNSVAIPTGVKRYLYDVYSPLPLTERTVLNTDHARYVRSEALAIHYFLLCTATVGPERRPSCDYA

SEQ ID NO: 999223 - protein, 120 aa, Homo sapiens
MDFGSETSSCYTELSSTRGYSIFSYATKRQDNEILIFWSKDIGYSFTVGGSEILFEVPEVTVAPVHICTSWESASGIVNLGPPVAILFATWRETVRTEAKLASGGAKGLTNNRALTTWSL

SEQ ID NO: 999224 - protein, 90 aa, Homo sapiens
IVSCVSAVAVEELKLGKYGVDSFVIVNSKFCVWILRKNSLEPIYIPFMVSPRSSSRHMASYESNTKNPIDTNIRQQYTLLTVCYDTDIGV

SEQ ID NO: 999225 - protein, 137 aa, Homo sapiens
MPGSYLPYRYIAALHSKAPGGMASDFASARYAREQILVCTPRTCLPARDKIRGVGGAGALRKPWKRPAPFPFAVAAAQWRGSSAPPRKSRQLEHFRRDTELRNGWEYLSTMVERRPIEGPTHPSTGNKGRHRKDAPT

SEQ ID NO: 999226 - protein, 262 aa, Homo sapiens
HCLNPDDSCISMIDPSGPACTCSSLSVLDLEDSSQSQIGATRRYRAASMDLTPMRVMQKSLVMLVFNTRCSVHLRTTHVDTSKTVFRKSLADVLLFHPQKLRVETRILMLSIGMPNPRVRHGVYNASDLPCASPCLEISGRLASGLHCGGVGECLSGSPLADSPQRAETWDLIMLCLCDTLDECRIDSSGVWPGLFARHALSEATVALWDQVRDDMRVHLIRGYGSVLHYCSLMYRIANGQGLVACRTWQPLKAYEVDSVLP

SEQ ID NO: 999227 - protein, 108 aa, Homo sapiens
MRAEAPSGNTQYSGLRSASSRRKMPKKAGATTKGKSQSKESRVDHLPLLGPVAVDPEQDAVTIAPSLCENLDSKQNVCNRLEQQMAVNVAIACTSIMREEAYMLSSVV

SEQ ID NO: 999228 - protein, 72 aa, Homo sapiens
MNPLAQPVIYSTIFAGYTHQQRYSSSLIFYLSRPSKEDMRELVIPVLTKKINPSFLQKRAIEVFPRRKQPHP

SEQ ID NO: 999229 - protein, 68 aa, Homo sapiens
IQHGGATFGYKEAVSEKGVYYVVVAVYYVVAMYGIIILSGLSICKKRKEEQGVGWFAENVVNENRSET

SEQ ID NO: 999230 - protein, 142 aa, Homo sapiens
MVQGLHVTYTIGATCSRSMIRARRAVVGSDCKQDDLVDVEVLLFEATKTSRREVSTHMQCPQRLAQLVENSRCVQTKGEQRQREVHNIGITTRAPVDKPVASIVPIGANSRRKDNQDIRTIVQSHCVVQRLVDYAMSDLAAS

SEQ ID NO: 999231 - protein, 177 aa, Homo sapiens
NFTLLVETGFLHVRQADLEPPTLRRFTHLGLPKCWDYKHEPPCPDIFFFFWRLDVSLWSTQAGMWHWAAISVHLATSGLPGVSRRFSCLSLPSSLGITGAHPPHPAKFGIFNVRRRGFHHCWPGRSRTPDLRDSTLPRLPQSAGDHRALSHPTWANFDYSLLVISLAEQLTTIALFL

SEQ ID NO: 999232 - protein, 118 aa, Homo sapiens
MKDGHQRPEASLAYRVNGQYIMDTDVASILPYLQWRGLGFIDPGPIECAKYPQNSIDSFFCALDTSVSYRVLTWLEYHDEMNTAGLSDGLDAFDQEYQLDTGFRILSMTVVRGCTNSS

SEQ ID NO: 999233 - protein, 105 aa, Homo sapiens
QWLAPVVPALWEAEAGGSRGREIETILASTVKPLSTENAGNWPGGVAGACGPGCSEAEAGEWRQAARRGLRWAEIVPLHSSLGNGAGLHLKKNKKSRDGISSLLS

SEQ ID NO: 999234 - protein, 67 aa, Homo sapiens
GITIQDIGTGKDFMTKTPKAIATKATIDKWDLIKLKSFCTAKETIIRVNRQPTEWGKVLQSIHLTKL

SEQ ID NO: 999235 - protein, 280 aa, Homo sapiens
RRSSPRVVGVSCFTRCCGRNPALVPPCPVADRAGVVCSTRPVTFLFDSASPSGSVRPRESLSSAIRVPGGATPSPVGSRLCPGLGLIRRILGSDPVAVKQIAGVPNLRGGMRCLCKKFYSQSMGNLRVSGTGGSPTTLGKESKCLGEVFITGLRLTSLDHVDHGVIVYIAFLRARLIVTWWGLSELIERFLTQMVDVCANQTTWSYHLDRGPDGGEQWENWFPLGWEEQLLWTPWNMGPLGTTEGSPRRARNGVMGATGKGLPVCPVFHRVEVNSEMNLT

SEQ ID NO: 999236 - protein, 249 aa, Homo sapiens
MLHTVQRPGCPLTGIDGPPWEIYIHLFNVEAGIVGMLPICRHAIRLGKLQENVGIDLSNSKGWGMALPVVCGTDNLGHTWQRAPFPCVSQFGPGQWRTHKVSDGHHWERKEKGFLWRNVNGPLGKAFINGRHQRALGSAQGTTLNFDWGTGLVWPHYAAEEPRGGGKFALRLPNWGKTDRNKAGRQGGGTTELGFPCPTRTKRPDHTGSGIWFGPPLGGPTPGRAIGGKNRLVGDNGFQGNPKDFPFKP

SEQ ID NO: 999237 - protein, 110 aa, Homo sapiens
IVLTLQGSELRALRHHELVHCTPGNLNSSTFYALLISSLQLCVAYVATRDNCCILDEEIRIVYLSNLPVVDRRFYLSTYQTKCRLEDLQSLARHSYSLTLKTEIIQNVNT

SEQ ID NO: 999238 - protein, 175 aa, Homo sapiens
MISSSYPNRTEPSYINKKAAIMVFPHSNATRIHKSCLNSVSSSFNIRLTEQVRTSKAQVHSNTITSVTLINSTTVVLHSTCRTGRTEPAFSDVVEIPYEGFNHAKVAMRAVEHIPVAHVVCIYLQRLNTKKARTAAHYILTSHYYTKIGVIERPTSKAVKAQFVTVKNPSFENSI

SEQ ID NO: 999239 - protein, 135 aa, Homo sapiens
GWDEDLAAYAVPMYSFDSLTVSQHVFDCFMSGQVLAGLPRTSRQVHSSTESYYNQYESVLWQPVTGDLIVKKKQVHFTVNASDVDNVKVPLYMCAEFHAVSCVADVDRSYCEQQISQGDSQPTSLRHRTMNSITH

SEQ ID NO: 999240 - protein, 194 aa, Homo sapiens
MNRRKWIQCFNDVIAIIFVVVSKQLTRWSSGRTIQSQSALQERSECLLQESSGMQGWAAQPISGESCILNQAMICVAEKVLAGKFEDVMDYLSHEVCSSYTTRCRMHTSRRPGSRTQRVTRCQSTSFEMSDREDQPGHVVGWASRTATAHFHLCVCVTLRTIRRCCSIDCRDIIQGMRLRQLRAALRRESRKFN

SEQ ID NO: 999241 - protein, 235 aa, Homo sapiens
MTTQIVQKALCVGSSVDRFGVHVDTCDSMVVPLFGNAIIGDRHCMAGIRQLKRRDVVKIHHLLLSFRLQTLQALDIDFGSEAHSPPLSVTPVLVGDDYSICNRFPLRNNLRFGFDTSSKHEARIQVAARSFAIGLATNHKWENPLSASHNVVTVPYLVLALMGTYNMEKCTPKAPKNNLRSPQKYGEWEEIAKESAFGFGICTRFDRACAICYAIWQANIARAKLALLWWIATRH

SEQ ID NO: 999242 - protein, 116 aa, Homo sapiens
TFRYLSSDHPYPMCSFKHYPASLFIIRNSGPSVWCALKVFLCHNAAAMEGGCDGEMGIALHDHAHKTTRNILSCICGFSKGLLYFLTILFARTLSTLYDCYLTFFVQCIPKMLYFR

SEQ ID NO: 999243 - protein, 288 aa, Homo sapiens
NGEWNGMENWNREWNGMENWNEMRWLNRMRWWNGMYTGTGGWCGSNGTKLRVVEWYQRHYDLLRHSTCSVREIYLALGRTGTLLTAHCDGSGTRARHCELRRATQLANWTTYELDTARTWTHGTFATHCATTHTRTLRNLARDCDPGTLGTTLHTGQLRHMARHWEQGTLRPSRRLRAHRPTWNNWHHSTETATLARQLGTMCTCASTSGNSDTHWRTEANGQLGIKLPTWQLAAPTAPSDTLPNGRNYTLPVRHKHVNRNTERTGLMETTRDNGHQQNIAKNKPGTL

SEQ ID NO: 999244 - protein, 82 aa, Homo sapiens
TVLTLQGSELRAPDIMVVLPPELSYFYVFYSLFNMCSICATRDNCCILDDRSVVCPYLWHADSCLLIKPVDRIYVLEDILHQ

SEQ ID NO: 999245 - protein, 67 aa, Homo sapiens
QWLTLQGSDLRALRHHEFGPCMLRVKSKYRAYLSLLYYIFYSFITMCEVLSVAYTIETNCVASYSIE

SEQ ID NO: 999246 - protein, 268 aa, Homo sapiens
MGDPISRSAMMSMLYDPILSSTRCNGILFYQLRGSHAKRSSLTRKLYENDDTLLRCQNVEHHLGNLFCIHVDSSHEHLLQAFIICTRWYFSLCLKGRGCNQASNPHSILVEINGEVDPPYISLDHLQCSGLYASLAFPGKASIGQFRHIPLILLTSVDKFLFAVKEGHPEARIDTDTKRWPKCPTVKGAPTTKAPAYSGRTNSGFFQCPSGPIIQATGGYEFAVNQWFANNSQLDVTPLRKTHYVGRPLSDKKRGLRVTIYAQSLNDP

SEQ ID NO: 999247 - protein, 55 aa, Homo sapiens
MSFRIAFLGTEHFTDSRCQLDIAHAMNYVIDLDPSAGNIALIVAQALSPQDNDGP

SEQ ID NO: 999248 - protein, 120 aa, Homo sapiens
MLETNSQPIILYRELLVHKGLTRYLPMGYEQRVLQLHPTITEVKRLKLDVWNNPRIDLELEQRMLLVFHGLMIQTVDQVKDLYSGLIWPLIVCPKSLVGKYSKSSEGNWEICRVLVSSFG

SEQ ID NO: 999249 - protein, 320 aa, Homo sapiens
MRLRRSSVFPGVALLLAAARLARCLRRCYDLTDDQTFESRISDSGLLRALMLRSQSFAPWLVDTCKEHLHPDASEACKLTRDLKGIVPSSQNGWTLPRAQQPKPPGKSTLVRSQAGTIRKAPLNNELLPNDAMCSHTKRQGAGIIKWHLANPITSTVALGTSPTQLRSTAPAVAHAQAGRPMGKPQRPFSQRWTPVPLQGSNPWCSCKRPHLFINTATHTCPRYNALAFRNSECDALPILNLKRHSHTHTKRGISHCAKVSKVSLPTLPPEKGIRRISTKSPSPTRANNPFGKGRRKLQPVYNPGSHFLRAPPIFSPKSP

SEQ ID NO: 999250 - protein, 140 aa, Homo sapiens
MECQACKRHWHTDRKWPFHEYSVDEVKYSKCWNDVLPDTPSFVSFQEHVFDDEDAVVGQRRDRRNCRCEGLLGNPERTCSLTWPRGTRKIRVCFGTYLDCGPGDSLASPIPRHGRVNSLILPRGAPACTPCAGDTHHLKT

SEQ ID NO: 999251 - protein, 110 aa, Homo sapiens
ASRIPQREKPGHMYQNEDYPVRSGLAKQKSIRFCGLRRLTGSHRQYLWRNEVTLRALLTLSSVDRQTARDVPVTCEESGRLSRPCVNSTGQPLTDWLYSDIVGVRELELV

SEQ ID NO: 999252 - protein, 44 aa, Homo sapiens
MHASRLSRHDTHTSKEQTRSQGRPVPPRTCTQHLSSITPSQTFR

SEQ ID NO: 999253 - protein, 130 aa, Homo sapiens
YSKGREPPIKQSTVDSLVGRAAWSDREEGAVYCQPCRFLRQCTICPTPGQTFEAFMNAANRSAGRAHPEGDGYHEGVSKIVQNGNALHNVAPSHRWGPKVQSKHEFTDWGVTRIVEPRDDEIDWRRRDVE

SEQ ID NO: 999254 - protein, 533 aa, Homo sapiens
MQFGGPAGLSLCFNSVWTEQISGYSLPRLSNQSLPIYSRPALVTVLGPIFSAIIPALMVHSVTGTVIAVVKLPILCQTNHAAPKIRQHIYFALDSWDEPARSNRSLGPEFVTHVKGPPIQPYTFFLRGAILVTNPAIELSGSVTRGAEDPTCSYPPTETICVQHAAVTRLSGRGSLNAKAGSFRNAYELAQQDSHRQARRRGRLTVHPFIFPKVDPPSNRTQLHSHWYNAISTRWARAYTQARAPMHNSGTIHAIDRPEAPSRGPPLRDSNTEYGLGRIHTVRPQYSLGGTSHCTNVGPPLEALSFGPPDDRGLTLNTTSLRWVGNHGSPWGSNPTTRFPPLKTPDTRKTVTAKRAIYIRNANTDNCVSDNPQPLWKPTLTLSPNHQAPGALRDSTGASVIGVACAAVTVITPSISRDSTAALPISHRQTPTGNALTAKAPLHLNRPHSHGTLPGQGGPHVVPKKRTTYRGMFPADVKTLEFDCSHCPTPWGNALCRLTPVSRTHTLVLVITTSVRNHNRLVLIRMSHNHYAH

SEQ ID NO: 999255 - protein, 106 aa, Homo sapiens
MSSRFKSGQRSRLLFLEPLGKFKVLHESYYNIEIVLWQPVTADLIVTKETSPFFCRCIVSVDNVKAHLHVSGIPCSVLLGEMVDDLIQAADFQRTTVESPEPPHRT

SEQ ID NO: 999256 - protein, 71 aa, Homo sapiens
RPVDLIEDGGAICVGHYQKSLHVDSLRYTDVEKFWSRIQKKRKSPVCLSEDSSKMNKGKTYPSCVQLLRKP

SEQ ID NO: 999257 - protein, 67 aa, Homo sapiens
VLRCVRASYGSGHQECTKANKMPSSLFLPVRPGLRMLLRVVTCRGENSSIGGILACLSSENYDSRTQ

SEQ ID NO: 999258 - protein, 110 aa, Homo sapiens
MEVIPGELGYCRENGTDAYEAPSEPRSRLGICSSFMGEDNCSDSSLIRPRGQFVGTDIVLSKLRNGRNCGPITLKPVGRINPWGVASFGHCAPSFTYPTLCPPVLLPPGD

SEQ ID NO: 999259 - protein, 294 aa, Homo sapiens
EASGTTTEPGDSVIDYAVFCLVGHPPAVRGLCQPGPCSPWLEDPSVEDAGRWKTDIDLALMILGEFTQPFNKVSPPNLVEFDCLALYRLMTGHHPVLTGTNIFFSPVSIVTACCNVSPWGSQADTHDEYPEEVPVISDLTVDSGGSRSDGSVSRELLRTLIQSDSQLLLTIELWPVPQSTGLKLWIRSGMDVKIVVATQKCLLLSILSVDTRMRPEVKADQTDYVVDRVFRGNFVVFGSSTLDRDATFVLWVKLPIFFRKASGEKTFEGQGLRGQRNFHVDPGDHREGCYDERV

SEQ ID NO: 999260 - protein, 247 aa, Homo sapiens
MSPWKWFNGFWRETFDEDRRLVAPSRPEDYPMGDIHHRYPHTEPWGQEHVQPHNAGSISGQKASMFPSETLGAHEKLRQDSRSKGKRISGNRRGANATNPDSVTSARIVPGAHDPVMNRANKFWSINRKNCLDTYPANYLGGGTWLLGNKAPPGERQDIAPTCKCGRHILGRHLNCSIALENGAHEPVVKIKHCVLEHVFDVDPRSHGKYELSITTPFLDTARAYNQTHVVKHRAANWYINGRCTQS

SEQ ID NO: 999261 - protein, 43 aa, Homo sapiens
MLVTHIKPTCLQIVSTSLARLFPHYNTLGTRPTNQLSSQPFTR

SEQ ID NO: 999262 - protein, 170 aa, Homo sapiens
SFPLLSTPHAFGTMNVCDRPLSFPVSLCSLRLARYSRVCVCCRRCTTKSEVASSCLKDSWCMNDRIFKRLAIAVELALMHLCSISSGEGVHCMTWTPCRENLMWRLDRRARKFIARIHDCWFAYEWKVLRLKTHSCCSTKVNVFMSPMFGEDTDVMATSLSERPLPLKKP

SEQ ID NO: 999263 - protein, 336 aa, Homo sapiens
VRKSKSPASFEANTSQLRPALKGPRKREERERGAERRRSSTKQRVFRQAAKKEGETEREDKRSKKKEGRERRRTEQRDSDRTTRKAQKAAEKRENKKTNTKKRKEKKKQEKRKAKERKKNKKKKKRNENKREKEQARKRERKEREKREKRNKKRKKEGEEQKEEEKKREKKKEIKQRERKEKARNTREREREHRQQERESQGQEKQRDKEKGTRQETKELEEDSTEGRKREGRRAEQTLSRDGRRRESEKSRTDGEEREESEERKRRGKKQRAGGRDGGDAGGGEEERGEETGREGAGGRKEDGARAERRAKRGETRKRSGTEEGGREREGGSGDE

SEQ ID NO: 999264 - protein, 112 aa, Homo sapiens
MRFFMKEHECKFCLALVISTKHYYVRYGNKKGKEMRESEKERVTEKEERKVSQGNIKNCKRKQLNNTTTNTYGTGHGDDGTPRDTDGHEHTTTTRRLDTRGDDTRLDTKQLP

SEQ ID NO: 999265 - protein, 119 aa, Homo sapiens
SLSWLTYGNAVTLTSGPEHGHAVAIVPYSGDKWIHDCAARNMRITLSVCLPRASNVMMLAHSILMIATDLFLGTKSSVLDIIDYKEHTLNLTTSSSLGRLDNLWSFAAYLTNTNAYYDA

SEQ ID NO: 999266 - protein, 136 aa, Homo sapiens
MPCFCFSWRSVPSLTWPKVLLTSTLATPVLPPGHESMPLEGRMSRPQTYLDSYRQHMYFRIHRNCLTMTLNHLPPISHVTCKLQTLYSSNIRARWSPSRSTKINRNILALLPLSSKLSGYLALFAYCSPMVRVLQA

SEQ ID NO: 999267 - protein, 258 aa, Homo sapiens
RIRNERPMTVPRMEPVDRISTEDGENSLFSMNIWLVESCHAFYFIVFNEESKDSFSSRSIVIDLRISVESSFATALYYLLMVLIAILLSTLASSFTRIVVVSAYPRLLAALRSTVFRDVPFFDLGRSSGPRVWDHGEYYVVSIGWFLSKDPIRWPSSVAFMCRPMSDLSNPQIKMGALRVAGLLQSAALPGIPRRPLESESVFVERSSITIRELLRSTRERWSLGRRTPTSVDTFRRARPPWKAPGRVARCGGSLANF

SEQ ID NO: 999268 - protein, 57 aa, Homo sapiens
MASFLWNLGHSWPSPSLPTWMEGSKRQVGFPIGLNATLGSLRRSRLETRGQVNRIGF

SEQ ID NO: 999269 - protein, 107 aa, Homo sapiens
MKDSVVIVQLTCCALHDCPGLLINDQEESKDLQILGKTSYIKVEHENIRSQSACIKAIRTHVISPDRIIDNQDMKTLRTFGVQENVRRNYEDMKRSIVNDDESQIFD

SEQ ID NO: 999270 - protein, 206 aa, Homo sapiens
SVEGLRHSVGGPYLISRRPLLQCGWALPNQSKDFATAWVGLTQSVEGLCYSVGGHYPISRRPSPQREWALPNQSKAFATAWVGLTQSVEGFLPQRGWALRNQLKAYCHSVGGPYPVKGLCPQRGWALPNQSKALDTAWVGLAQSVEVLRHSVDGPYPISRSPIDTVSGGTLPNQSKDNDTGVGGPYPQVSRRANKSRRSKISLREE

SEQ ID NO: 999271 - protein, 110 aa, Homo sapiens
MRAGLSVFCSVGLLPAAYLTPCSAMEVFPGLQPSLFMVAGGLEIGCLLRDYVLGECLVDSCQEQGLVAAFMLYTFAAALLFQPISTVGYLRNLIAMLCEALYALLTSYFE

SEQ ID NO: 999272 - protein, 363 aa, Homo sapiens
MHNKETKVVCESHLTQRIGGELIDLGTRAKYKLGAALGINSHMGRGEFITRSEGSKRYSAANGRILLADHPRAQERNKTARKRRLKTPPTPILTSKPTRLPIRGAYPLLGLRWRVMAGGVCSQLFAPGLFCRCAAILSPALLANLLLPPPPLCRAGSLLLIVAPPASLARRVLCRPCLGRWSATRIVGGVLRSNAIPPLSRSFCRSQSLCNALGVPCLRASLADWLFFPCVVLCVRSSLDVSAVALPPSVLPLACFVFLRNRSGEHSSVFVLRGGSSESCLRVLAVEAASLCVGFGSRRGLVERRCVSFGQLGWPLLCGVSCRVSAVRWRVGVVFSSPWVWCWWALGVVVCFGRGARLGVFGC

SEQ ID NO: 999273 - protein, 146 aa, Homo sapiens
MKFLRDILLVLPLLDRLAPLKSFVERFYIPKREENQSPGEIVLITGSWRLELGETDCLLNLAKLKSKRGPRADINKHVDLEEHLSAKVHRDLACPKGFQYPFVGPHLGTENRDDTHFSTSFLPQTHRSNGAGTILGQHSVHDTSPR

SEQ ID NO: 999274 - protein, 128 aa, Homo sapiens
EERYGGSLKAECRIAVPWAGLALLLLHSIGQTCSYLTIYYQRPNYPLEWLCVVQFTDTLVIRANLILAPSVCISLHLDYAQKGCHDVLLLESASVLSYLNPCSAYGTIPCGAAFILHVHGDLGSKLVD

SEQ ID NO: 999275 - protein, 163 aa, Homo sapiens
CDPDLSYGPHQLHVSFFTVVRVICLHPMRCLADAQIDSEPFFSSDSRLPGRALLYCECIARTVMRVAPYFPCDNAEDIPDVHHQAVGSKYFHLSPSATRDECVPIKGTCGGVPCDPYDADRTELSVEQIVRQYVIMSATGLRVVHLAWTRIMCLCLNNMWVSE

SEQ ID NO: 999276 - protein, 124 aa, Homo sapiens
MSYKQGGLGNKRVNHKREVALSRCRTIGCKSSEGRFFGTPWGMRNPGAIGEGKAPTFGWGQPDTTREGNINGELNYVRHKRHKGNHSQATTTGVHKRTRPESGGEDRGVTMDIAHTLDNPAWTN

SEQ ID NO: 999277 - protein, 78 aa, Homo sapiens
ESSFLWNLKKPMQILIPSLDSGFIVYEDYDDPVDSIYITMATGQKLMRAVRVVESGGPVSPEHCDQILQYRFQKTIRF

SEQ ID NO: 999278 - protein, 188 aa, Homo sapiens
MFVTRASQSAGQVHWTDAKRLYGSRGLIATDFQDSAAVKKLIKRLREEWNQRGKITDLIKELERILSDVSWVNCIFFKCQDGRCPLTPKILIEYKVRLLSREKGEVIGAHDAFRMHLTIPYFLVDEELSVLTVVDAEVQQVGCQRDSSSSRIYYRDGGKLEAMAASPEAPLATPADRLSCVASRRALG

SEQ ID NO: 999279 - protein, 106 aa, Homo sapiens
RVVYIAGKCGLVPVLAENYNKSDNCEDTPRGRVFLLYAVVKKISFDLTWDNLKGKKSWHTASWQNRWLELSLHGACSTIRSITADLMELCACEGCAPGSRERLQSL

SEQ ID NO: 999280 - protein, 332 aa, Homo sapiens
MALYGISMQTVCKRKAFRIAYNLFRQICYSDILLSGYAVTYACQGDEKPRDRRPADSFIVSMSFGHVNMRDLCIIVRDRVPPYIIDPIRVETYWLSPLKREFTLWRLTAIFARCTNYDKEKLGCLADPMRTCSRYCHEEQLRPVVEVSDELSSLEERVYRFVDLPEQEYEPRVLVAQCGTSGMIFERNPVKFEIAKEVPAGICISTLSGHYIFAYTPGLSGNSASTKYAKSKRGHFIVYNQYTAERSYFLGPVKQHNTKEIVHREMAIREKRGTIWYLKTRGPKLGTRAWLRMGHMGYKPEENFWHEGGKRDQGGQRFTPRSDEITQKQWAR

SEQ ID NO: 999281 - protein, 95 aa, Homo sapiens
DISSGYPVSGGGLSFLRGVKGSDGHLKVFEGSSIWRLYKMFENNMSEDSDSRTYYDCSRRRSALMTEVRTTATGKVYCGSLQVARASGNLCSNMT

SEQ ID NO: 999282 - protein, 156 aa, Homo sapiens
MAFALNAHRSPATDGVGIIIGPEQYWIEVHIILEGQRPLLRQVSLTPHLPHLTLVDRTSKDFENLKTGNAQMVPDLRGSSRQTQYLRRSRNRAPDGSTHKPNQQAGAIGKHSSGSTPLPVYRHGTPKHAPLRLDNRPTHNTHAVAHCNPRGNVHRT

SEQ ID NO: 999283 - protein, 76 aa, Homo sapiens
LHVWFQVSVSRLQRGSGQGSMIRRVQLIPELPHGSTYEYSYSRWLPDLRCNACCSSWTIIRAFMVTMSSHTDCWCE

SEQ ID NO: 999284 - protein, 172 aa, Homo sapiens
MPSDGLLRVDFVTFCHLVMASITPEETRRTADPVNIPSVIRALKRTYCSVIHGVLKADEGISYRGLLIIDRYRVFYREITVRMTIHCVAGSVDETFETRYRPSSSLTEHGDVKTQMAGKPGSDTIMPDVHNEQKNISPSKKMERWSCLKLPGMRLGIPLRTKHLRLEYKSPH

SEQ ID NO: 999285 - protein, 371 aa, Homo sapiens
GPHVGAAASDPRGYAEVDLGTEYSPAVSVLLSSCSEAPVASSCSSVLVNCVRRTTLCVETVVPGISGNTCQTHGFMVGLRIPFLKDQPTEAGHDSARSITYYRPVWGHARLNQTLATIFCILATDADVTTLTCSFWRLALFSPEADAMMLRLSGKADFTSDRRLSAVNKRLDVEEFRRRAHGSDCPVHSNGETSILMGRVQNAISMYQARLPKEMPRLGTNWRRGVTYNARKERPEWDMAGTIWVPLGEGGMVSENPWVPLIFGQSFSFDPVAGSSRARQTADPSGSFVMEPYSMGRISDRSMRKLNVQRCGNAFVESYRVGGWTRSVEKSLPNGGVVGGAQWTGFVLLEAEANPPEQRNAFQAPSNGNRT

SEQ ID NO: 999286 - protein, 273 aa, Homo sapiens
MAPLLLQLAVLGAALAAAALVLISIVHLQLLQKCQHSIDMNEEKFFLNAKGQKETLPSIWDSPTKQLSVVVPSYNEEKRLPVMMDEALSYLEKRQNRDPAVHLLTADQYVDDEQYQIRPQRVASHYCQTLLAHVTTVRCDNPWLKNRGQRCDAISTGYMQVLRRQTKILYGTLLNGGHKRFQMFGEHLDKGATLILTALGPNYNMAIALWISKLHSSSTESLAQRSLLPVLFSCMGSHFPAVVLSVKATQGHTVLVHNLFTPKQLHGTFNTLD

SEQ ID NO: 999287 - protein, 37 aa, Homo sapiens
MLTLFTTSPSAIWDILQDQTMRRSSREEIERPRKLMW

SEQ ID NO: 999288 - protein, 732 aa, Homo sapiens
QRASTSLFTGYIFSTHELVTALVEPLNLHSQTGLTLYLLQPYFLAIVACSCGTLAPPPTSHGYLPAARRLLVRKVPRTHTATPLALPHLHGNPCGTAYLTSPLTLSAYTLLTHFIANFPKKRTPTLNWPPSCTFKATTTPSYFPALQPLSPTHAPWRTGPKPSEDPLTALSHIFPANTELLTGSQLAPAPPPILARALWHGPFLRAPLSTAGPLLAAAPLPRALTRPGHPLRFPNAVPMLPVPAVLSRPCFFPLGATVSPRVPISPPLLSVHPDSPCVSFCPQPAPTRYAHLPSLSRLLHRPFPFIPNGQHPRCSSNPYNVVLSPTLAQIPHGLLQPPHFPWDLPPIQNPKMRPNNIVKTQNTHFPHSAAPPHHPPYLNWRPTPPTPGREPYKHPHPFSVPRTHQMPPPLCRSAPPFSVAPAHHTKPRAYNPPRNGGLPQPKQREGRTHPFPHHTHAPSSPLLNPRHTTPSTNYTSPPEVAPPRSPAQAPQPTLTRTTRHNAPLSDHYSTPPAPPPPPALKRHTRSLPTLPPPLTPTHARPKPTAHDPTLSAPPTKHAPRSDNTTHPTTTVDHSTHIIRPTSRRRPPPNDPRHPIRQRGQAPHHCAGAHPPQPRRSTPHAQRNNSLPTHTTPVWRHTQPHTTTHTTPPPAATHPPTHHHCRLHLAAHPPPCPTTTTQQQPHAYLAHHKHTTHTPPSTQTRPQPAPPHNTATTSTHAPDANTTSHTHSPHLPP

SEQ ID NO: 999289 - protein, 161 aa, Homo sapiens
MVNRLVDLNPRLYVISRLTVMPLTLHGQSIRNPPKLVFKPTFLWASMDFWKKSFRNPIRRVRGRRVPRRVLVGHNWWEQLRLVEPQKEKNPTRQIDTIAGQEDITHKRRIEKRGAPGRENPGGVSQTSICESCDVKGGTQARGDKHHRSLKHKTPRMKIAQ

SEQ ID NO: 999290 - protein, 116 aa, Homo sapiens
GNNLSVIVRYPALCNLLIRSCVTLHPWMLDDVITHNTSLCDCLGKALRCEFEALDEAARLSEPVMRKPLNDRRQTVVTNHVSEREYYKCNDIGQKSGSALLVSHAKADKTLPYKIE

SEQ ID NO: 999291 - protein, 108 aa, Homo sapiens
LLFQSSGSTKMSALGAVKPFHASEWISVLLRLRWRSQGQFECHCDYSVMTASCLLPNAPPRIDIMDYVGRHSAIDISVKEAYYQMLRKLQWQMDDVTPFTITLATVTL

SEQ ID NO: 999292 - protein, 105 aa, Homo sapiens
MVRTWTRVSRVLIRKEGKELFRLPIKDAARRKQGKDSHSRELEKDPLGGQGMRSLDPYVLEARCATLCAQTRFMEGRKTSAVLRNRNTRTGVAFAEIHAELRSTP

SEQ ID NO: 999293 - protein, 128 aa, Homo sapiens
ETYFAETRRGFPASTVCFVTEPGASFRPPPVRPCHESSTSVNLFTAPSVLPQGPRRRFQRSTRDSSLPRPARPTLYPSDRPPIERPDVHPRKVRPETTNQELRRPAINPPRSTWELYASYVIPVPLSY

SEQ ID NO: 999294 - protein, 183 aa, Homo sapiens
MQSTFDLPSIAPSPVIKTLAIEFSPFIAPMFPCVIALLPHKLQWVDSDLIKREVVPSSLGVTGIKTMIAYNSSAYNGPIHVLYIFRCPAISRLRELDKTHIFRSKIPPEKACIAAPHGPLSPLESALTGTFKQSLHVTYFLALGRDSEPLRNRQLQQDQAMHVRFPFVLPQGSVSETFVLPPP

SEQ ID NO: 999295 - protein, 69 aa, Homo sapiens
MLIPGRLRRKPLSPLHDRGYTTVNALKSVEQTTVFMPIVLELIPLKNLEKGPYLPYRHPSTPLEFKNKQ

SEQ ID NO: 999296 - protein, 105 aa, Homo sapiens
MLCPMQQMTVLRGWAQWIMPVNPTCSEDGCEVDKINLMAMEVRRPNLVQHAKNPSLSKNTKEFVPGVVACAYNPSYQGGMRLHVEDCAICSFSLWSIKCDSKKKV

SEQ ID NO: 999297 - protein, 105 aa, Homo sapiens
MVYLGLLLVVRVLSERRDCTDDADGSQIELGIMLKRNPPRAMDRYLMRNLQFGVPKILHVEMLDDWMLLAIYILTRSSMLRITHVTKERCQEPIDRSLRKKDFFG

SEQ ID NO: 999298 - protein, 113 aa, Homo sapiens
RQGDLGHLAPELSGEYILCKGDEFEEPLYHWQKDVTMEKLLVYRSRTGRSLMLLARLDDCRGRLRCIPRESDTSVCIPSKCTVNEAGVKAFHVCASTFKPREFVLDPWVQIYS

SEQ ID NO: 999299 - protein, 106 aa, Homo sapiens
MLAKASHNLVLSPPLLTYWEKSLELVTALLLIKYHSPYLQDSNILVNRTYTSLYMIYPEKQMGLIFTPPTLTTIKTLIQQREKHPHVHTPIPHISYISLNHDIITE

SEQ ID NO: 999300 - protein, 130 aa, Homo sapiens
MQSYYTQNVDGYTKNLQIETAPLERYGYLAHIIWDFTRDISSLCNAEENNLVDHNATPCWLSGQLDTMFSGSPFLNGALNGVQVNSLAESWDLPCKLFVHGVKPGRALSKSLGYKQKCGVPNPGNKGLLN

SEQ ID NO: 999301 - protein, 403 aa, Homo sapiens
VLSFPSSWDYSSFLSRSPMGMACGRPVPLLCRQLTAEPRCTRRFTTPHTCKMKTAYPLTTKHFSHPGIPTPAPWLPGPVQLQMPPSSARPRTPPPLCQRPLHRPPRYCPCIRSLSAPSHAPDPAPPRLSAHLSHLTTTTLYPHPPPFPPTILLTSTPLPLPTPSLLTAPPPDLVPLSPPLPPSLSCPHTCLLPHALTGHLPDQATSPCGTLHRVSSAPPPALTRYLSQPPLAYQLRKRHFRNLKRNWRRNTTPAPKPTTSHFTTNSLRTTLTRLIPLPLKNTPLTPSTTLIPPLALLHLTHSTHPPTPPLLTFTPYFVSTTPHYSHHPTSAPPPPLTTALTPAHRALRPLPTPPPPIPRTATTPSPDHTPRATRLHSALLPRPPQPTHHHPPTHHTPPAPHLP

SEQ ID NO: 999302 - protein, 240 aa, Homo sapiens
MSIGYSKAVGIQYVKNRKFLKKKSTDRTNIDKTVQIAINSAHGRIRRRIPSKRMPQRARVDIGDNIGITTIGKSVRSTILYRRCASLASEVNAKEATSVIGDEYTWGRTKAENCQRQRMRRREGMEDNVRRPRIPQYSNADKGVNSQRDVCDTFGRSDIQLVHKNAIQVWGGGAERWAHMRREGMRKSSRGGLYPGSANYGSGGAKEVTITIVLRAERDDQIWSRASIQERAYGARRDRT

SEQ ID NO: 999303 - protein, 245 aa, Homo sapiens
SLGGPLLNDLRPSHADSSLSTSITLLILGLLTKHTNHIPNDGRDANHEKAHTKDQSTHQPCSQQQAIRPSGTTLRTVPHPSATLTPTSRHRPKHEQTPHHPPSQTIGNQEPTQSSGRADSAHRTARYTPRGNRSPAHERAKSGPYETQTVHATHAHATHGKNSTLHLRKQPHKSPRVRPNENRENGETPQLARKRPTTNERRHQEPPTNSKARPLTQSRRENTPGGLDTPEAQSSRTGSRTETAP

SEQ ID NO: 999304 - protein, 105 aa, Homo sapiens
MRTKQGEWRHIEPPRGESHSRGSTPKREVRPPAGTTPAQTMKETPTQQKTREDTLGTHLHPQGDGDKNNPKHTHHRRPRDRDAPNTINNERGAEDATPHGAREQT

SEQ ID NO: 999305 - protein, 169 aa, Homo sapiens
MVMCCTHNGCYTILARSLTRRGELGIITNEVFPWEHCRWGARAKGGEFLLRCFVRSWAQGPHKVGASPQWGCSLGRPHRRKNLFTWAPCPPYTPFSGLWEFLLAPQEGCVRLGGGPITYFPQDKGPHSGGKKSLVLGTTWGDPKVHSRDLEHTLWDITPFISQSKEQTP

SEQ ID NO: 999306 - protein, 280 aa, Homo sapiens
HCLAPRASWSQICALSMGSYSPEPPYLCVEAAESQLCANRSSGAHHSSANLDRILDKWFIYRDRAYRNEGVTMRVGVQEIQATFCLLHHRNKTRGHDAFSESYHEPDSDQCFYKTNYLNVQRENWDHLQILWEAKSHYRYTMLNPQGTTMNLACIALSSDTMEEEKLGGVFVIYELYKPQRRPTAAELGRDATESSSTALLHFAKSDVVYTECEEKAECEPVGSTAATKKEKETTESGGNPSRITSRGSRHRSTWGGQSWPFRSTEQCGTFSFIPQIGIH

SEQ ID NO: 999307 - protein, 67 aa, Homo sapiens
AVVEMAMKSLNTLLSYLEECRVDGTLLGCACDGRLSQGDEETMNATYVPECSHFVCTQDDVNAEVEG

SEQ ID NO: 999308 - protein, 98 aa, Homo sapiens
DRERTSFTSTTNKETRGIITVDHIGQVRRTTTLKETLVCIHSDFYILLMRHVHAGTTLRNHIIHVCSADATKDGIYRLNIALLRQSGNFAKVVITIVI

SEQ ID NO: 999309 - protein, 296 aa, Homo sapiens
SFNFRHRATWTLGDSESRIASAFLSLVLHPSMRGQSRVRAVVAHVSPGMRIALGQIADQKTDTCTTNEMQDQPNHSGPRFSPRNAWVDVSALSRLLTSHARQEARSQEASNIFFSPVEHQHGERLAKMRTSTIGVDEGFEASLIESPRKESEIVRIVVLVGYPGRLQVSYLQRGFTMVAFHSGYRPQMRWLRTEEQERPKCMIRRRARVGPLVTSKVQGAIRRGYGWEIEAGIWDVEAGLSTLGLIFHDPSSNDPFSSLCRILFRAGNETRTLNERPNSLVSGTLGLKVLAIGNVR

SEQ ID NO: 999310 - protein, 180 aa, Homo sapiens
MGVSTDVRCHIPQSVAGKSSLEQQALNFFLLPPVQQSAFVSVMRIAPALGGTHKASTNILGKDILAYGPCNGRPSIVYDSLEAPVSNVTVSPGKFLSVSLISSSSIAEIFLARLYLANGTVILPAEGALYDAMVVNSSCCKRGNGQKDVVPKVSIEHIPAGRDLTVRHSPYVGPKEARID

SEQ ID NO: 999311 - protein, 165 aa, Homo sapiens
IPEADSIREDDVSLRGLSCARADSLFLGLEAIQRTPEAFRGLLTSVQRENGKSHFLNAIVSGFHPSDIEVDLLKNGERLEEVEQFETCRFSKDWIFSILLYYTEFTPSEKDEYAMPCEPCDFVTSPRSRYVGIEDMSSSIMAGSTDAALGIGMNFQILLACFVIH

SEQ ID NO: 999312 - protein, 208 aa, Homo sapiens
MNGQSNFTHSELKLFGIIMPWETTSKFQTVRIHMRTWIWTRDSGQTMEDPQHLARKQMRQDTPLPDRTTGMADIHLTYSTMGDKGIETKRHLGPNETGEGLEPTARPGAANRLRKKQTLPERAHKDQATTPESTLTPDTHQPRHSAPHGTTSQTWNRQASQATQAPRHNTATGVTKTTHRQPTPGIAADYRGQRTPGTPTGPPLRRPQ

SEQ ID NO: 999313 - protein, 72 aa, Homo sapiens
MAQLGNEFRDLGTFIDLRHGRAPWCRARVLSAGSIRSHSEEGDTEAVGIPGQHFIRDDYVQVWIPTSVTLDC

SEQ ID NO: 999314 - protein, 347 aa, Homo sapiens
KKHSKNFHQRFYLLECSGTISAHCNLYLPGSRHSPASASRVVGTTGAHHRAWGFFFFFFVDIFLGIKEGVFPYVFDAGDVVLGISSCEPLVCLHPTLLGPLPKVCWGHLSAKRCFSPMRATDKGTCALCAGAFVICAPLAAFNFCGPRGPFYNGLDFRGGPVVDGNHHPIFCPRDITREVWPPLSVEKLFCATVPVWGAALSQRRGEMLNGAPHVVNRGHFSFGPNRDFVASQYIFSSLRTRRAQKRAFLINHGGGEACGQTRGQTSQQILSVLWTLFLGNINVASPTTTSVCGPPAELLISGNSAGAYSSSETQHHNLFVADPTKKPAARRFPAEPLAGPKITLGA

SEQ ID NO: 999315 - protein, 179 aa, Homo sapiens
MVEGRTGNRNGWMKHLVESYTSSKLYERLCLESEHAVMEDGACIVCVVQSFLASGTLQRMTEANECLRAGSLGDSALKPVECESLKTSGLDKRNKSYVTVSVVKNSSGRGRFMENLSKWTFRERRLPFVLPRASQGTFSPKDVWRAKFRRILNFMDTHLERIKGWFPFEEQPLEEGFPL

SEQ ID NO: 999316 - protein, 112 aa, Homo sapiens
MRSLHPPGIEFLYLLCVFNFSLSSIVVRQYRKATKKTTSSCTLRMQAIQVSLLSDHYHVGSLQAFSLVITYHFNSNKVLLMAQSSQRHLCETHIRYHLPVCINLLNSSNGLG

SEQ ID NO: 999317 - protein, 142 aa, Homo sapiens
MPPSPASPLPCSLPPPPPPAAAPPLPSPLPPPYSCLILLPPPLPPPPPPPPRSLAMLPRHCLSSPLPPPLLSRSLHGCAQTFPARSARHAALSAPPPLTSPPPSPHLLRSARPLLLPPRPPPRPPLTAPPPPPPPPPSLPSP

SEQ ID NO: 999318 - protein, 282 aa, Homo sapiens
MARKEIGEPVLLEGINGSARKGPNMYANSPAATFALNSHTSVTTSKDSSPFIVCLLFGTSSVDPGVWKETHILGGGDLDTLGFLNSGVEPKGPLSKQQKRDKCMTYLVSMKVNLTRKPFIRKLAYGPANFPPKGSKTCFRWLPTRQLGEHNTGTTRLLRTQPGERKGKANEGNVEEAKNPAKRRGGKFPKAQGTHKALCGIPGNQETNLCGGAPIPLAPPSQIPAEQFVCLPLPRAFYIPPVPTFGHFQKFKKRLSIEMIYEKGQDNDDTTQYTKHTIDKHT

SEQ ID NO: 999319 - protein, 116 aa, Homo sapiens
MCKPRKLPYSWLIILPLVIPLQLNGINTEHTVVGTMMRKHKAGGLLQHCDYTYHDRYGLRLVLIFGKVSRGCWNPGKQTLQRHFQHFSPADFTVNVRIGSGEQGHLSSTSSPLRIF

SEQ ID NO: 999320 - protein, 215 aa, Homo sapiens
QIGSPEGLSLDFNQCLDGTDRGDSLPMPSERTLTEFLSSGIVEMRPETYSLLEHNLFMLLVITSTVLVWLLAPFCARSETHEAPLEFSRDIMSTGNVEVRRRYRPWSNEYSRKVSVHLPYSRGGFYSQRQQMDCWLIGRGSGADLSVHGNCGPDVRKARRVYDAVILIKIAKYQAVGERSDLIHFTSVPILDEKTPSLERLVDGELTNPLEELAI

SEQ ID NO: 999321 - protein, 148 aa, Homo sapiens
MDLCQDRCPKLVPLESLRCLLRVNYRYNARETNWQTYIQLEKAIELIIPKGTLNLRSGISRVLDGKTVESKNVTNQVYIFGVLGEENLTMPLHVSHPRKNSRKRDSLLRRRSDVNNAGRATKRLMLTLELQVGDPTLIKGYDVRRIET

SEQ ID NO: 999322 - protein, 124 aa, Homo sapiens
MPAPRETCGIENDFLLNRNRLEVESGGIGTYAHAEVTLENYYSEYIFGAWSPGYPVDVVPGHSYSASHASSRLLCSGIHGIYHMQWAYVGDYPFAPDQDRASVTFYVGVDMGVDVLAQWTLRGC

SEQ ID NO: 999323 - protein, 156 aa, Homo sapiens
MSENRAPEKGGRDKHCSLGQGAPGEDAGTQRVPTQAWPCRGKHTRAGTGGRHDTSDLLSPYGRNSPRRYNTRAVTGNPTPAEVRVRRRRTNSRGRLIANSRDTPDEPTKETNSEAHGRPGETNDQTSDNKTIARTRTATTTLAEARRRKNGESAKR

SEQ ID NO: 999324 - protein, 156 aa, Homo sapiens
QFGGPSDMPPCSSGCRTDQQIRGTLIPTSDRSSDFLSVCISSGDHSFSAISLAFWDHARLPVCCWFSSFLPAQISDAPISSISEFMTTRSWESMRVKQAHGSNVVTVLALLLHTSFSLVRSYFSEHRRISIVGVLRRAVMPNFVRRSTLGRSDEAQ

SEQ ID NO: 999325 - protein, 106 aa, Homo sapiens
MRRLSPWLVHVLGDVNQWQCGIKGSRGKHEKFLVGHRILHWYRSAKRGFTAFVVSLASTGISYNPFLLVGGRGATLISKIVVVWSDTLGRWEISTRVRFAWQPKRG

SEQ ID NO: 999326 - protein, 81 aa, Homo sapiens
VLYFKAPTLTLEQMNRQLPVCLYSVGALLTEDLSRTMMLPESLIIPESERVPQASMLRPRTIRIQVPLDGSRIDHDILSEQ

SEQ ID NO: 999327 - protein, 89 aa, Homo sapiens
VMSLSSSACPWLLTLRDHLASVGAAAIVVSLFKIFWQMLVEKLECIHLPRTYFWLVTSMKEEQSQLQFDMTRKSFPFVFSLLQETRKLF

SEQ ID NO: 999328 - protein, 81 aa, Homo sapiens
QFGGSRGSVSCFNSVRTGTRSWGTLFPAFRLGLPDIRSARLAKTTRRPIMSSVRSTLLSWNPGQDHTVYRGYLPSYVQAKQ

SEQ ID NO: 999329 - protein, 132 aa, Homo sapiens
DSADTYKALELLGTSRHHELVLVTPPEFNFSTFYASSYVLSFKHAVAICCIARRLNMHDYTVDAEDSCQLNVSYTTIVADCYFRVHTCIQIATRLKVLIPAHLGNTTSPSAIYMFEKNDTIHAEYEEQACIT

SEQ ID NO: 999330 - protein, 112 aa, Homo sapiens
MARCNTRKHITKVSNETTCPKKAFDSWDNPIEYLRSASLLQDFTESFIPLETHRDLTAANLGEDPWSTGERAFNASKFPRRMSTVPKSSILVLSFGSAGTYQLYAEGITHYV

SEQ ID NO: 999331 - protein, 110 aa, Homo sapiens
MKPLTNQTYMLVCMSVRIYSVKQIWLIDSLTMKISLFREAPHFVNCISSSGTGILSFVKLHSGLDKGKRLSNFAFDLSTKFSCETLWQESDTNWTLAVLPCGPIQPKNGN

SEQ ID NO: 999332 - protein, 311 aa, Homo sapiens
AGRLMPCNYLVNPGTAEYRVVDRSSVVVQSRRSILAVRRGVRHRRGLIFITLGLNVSPERVVWLARHSTITPDYYGYESESQRKCAFEPSAHGRDVWRKEVTRRMHPLHTWHMPRAIRRSTQRRDSPVWYLTHKLKQSANRDLLLLIAHYPGGSQRPEQLQRMNIPWEGRELYKLSAEVFPEGVEDPMYMAFPCVISLRYPSKLARHCQLPRVNQRWSSGLVSVIAEGPLTRLVGIMFTEEGWLKGVSTNVQEAYTVVQLSGDTQRRTCPMINLIPSDLLLEEGGNLTGGTTGRNLGPTVGFDQKITSKML

SEQ ID NO: 999333 - protein, 92 aa, Homo sapiens
GMNLQLSLLDQYLMEFNACRCRALALHQNGSDPLAAEGIRMPDMDAQMRAWDSMGCWLMRRNRTKDRMETQDDTMRKRGKVASEPSVVMLSP

SEQ ID NO: 999334 - protein, 149 aa, Homo sapiens
MSGLERTDEKQTYDQRIERLSFAHYSISSSIPVGVLAYCQYILITQIKLRDLKAKISKKRTQNNLVVRLAKNVATFGINYGRIRQSRLSYSPRVCNLGKDLETIISTSNGIDYTLPNAGPPIGTTFIRSHYKSRRETSGVDRAYQENTQ

SEQ ID NO: 999335 - protein, 410 aa, Homo sapiens
RFSHSVNTHTTYRHNEVSNLYFPLLYSLFRLRLHSQGVVVISRSMPPQAVAGMLHQVFTAYRAASKHYQTAIAVAYALMLQLIFQDPLVPYVCKPSMLTHITVALQVTVGNFSLQHHVASWMEGQSLRHIGALQYTSRYAIYTGRTNIQLAHKRRHNSHSGCTNPIKRCTHLRQWNWAEKPNTPTDQPWTQAPTGNCLVIGKPTTPRSPNTPQKTIQPDTYGQNSSHERPGKSDMGGTAGKITDEDKDDARPNQRTHASTIKTQWQKRDDANGKGARTPWEIEPPGKQHPSHLRCTKEKPHHKARQEEQTGKGRPNASHEQNRQGVPLKAHKAYDMTKSRRMTRGTARPNRPKNEDNNKERHTQPATNKGTHRKQYEGAMAEIHDQAHRENHTTKTEEREKKTHTNRNTR

SEQ ID NO: 999336 - protein, 135 aa, Homo sapiens
MALNQNEHNEEMKHKSLEAKNLPKPGVLVVGAPAGGPLARNERTYWLLQYTHCKDVGSALGRYPRRKSLQERPPYLVLPPRQNGSPEGGPPFVQLITSRRAFDVPKAIITLPTPRCRTPSAFKRNTHNHKVMCVP

SEQ ID NO: 999337 - protein, 107 aa, Homo sapiens
MFWAHILEPPRLSTIFAKPLVLVHHGLLREKKGISEVIEPIRLRTCNVVHAKTAMYSIVAFFGSGVTSPRESWEKYPRLRTVGRTECLLNQQRLVGALFLRLKQLPY

SEQ ID NO: 999338 - protein, 125 aa, Homo sapiens
MARAGRSDADRHIKRENRRRRDDYRHSLDNKNSTTQGVKEEGEGGGAATHQTRTTESARGGGRENIESRYRERYKNQTEKRRGSSVEESKGGCVGAINERQASGTAEGEKHRKNNAPPRRAGGWE

SEQ ID NO: 999339 - protein, 121 aa, Homo sapiens
KCLAPDYKVHIISFNRSLSPMHIDAYLQHHWNLRIVAFLTPVLDACHPSIDLFQVKLVMVLSFTPPTTNLSRGRSIHSGMSSKWLSMNVLMLDEKRVMVDANEVPISSDVLKSWVSLPFKV

SEQ ID NO: 999340 - protein, 268 aa, Homo sapiens
ISTLHSSLGNSVRLHLKKKKQKILTNYSHGGKATTSCHFKLTIQGSQRFFQGGQSLHSRFFTPRVVFKGEIIEIREAEIIALLAPLETRGSYSLCSHHIRAIFILLSLVYTQNLKVKQCGFFCVLFIILSSPCENGGIFHLLQQLSTSKFDQGANLYLTLRFLSTPYVFSFIVPPIFERAHLIGPKALFLHKTLFSVFKQELQLNFRCLGNMCYMIPLINIYLQPKIPNFYLFGTRGLPSGHQSFVSPIGKPQCISPYYRFMVTINCF

SEQ ID NO: 999341 - protein, 335 aa, Homo sapiens
DYRLQHCYYWDQNAVRPGLPQAHPHALSAWLSEAPTSIARATPGYPTCSRSTDANPLSTCMLMYMVRFYDREWSCYPEYRPRIKSLYRACTTKQSRINSLSCHAIEEHHACPIRLTREHVAQRGSYLHPMAVNTSYLVISSRLPSAQDPMSSSRPVNTAGDALISCVFVHTFAYCLRTGEKPDDGICLRSRSSLLRSKTSSCWFPDERAKSQYKARRPWHSVGDQCLTVGLLAHGVWARSLHLMVSVTTPDPLLRTKDSRNRLRSNSRNGERQAQSTSEGQNPCGPHNENVLNGDHTWASDALSLVTSQMCITSLFDALNSDCLRVGVCLMLPTC

SEQ ID NO: 999342 - protein, 119 aa, Homo sapiens
MLTYLVYMGYNFPHPLQIQSEKLCDLPWLHLQTISYFNMASYQGFHSYIPVLNSEFQAYGLNFQFLGTQNNKIPLRHRVLIVGHLPILGNYGKWQCTLIHSEFTDPIHYTPKGTFREIG

SEQ ID NO: 999343 - protein, 135 aa, Homo sapiens
MFGNRNLPSKAVWPLSYWMTKEKGEERENHYSSNASEDIPYSGGTEFESNYHRYSLGNLRFDFQITPSHNLVKTCNPIRKNDHCPSKTLKSKFKAPTGDKLSSPGNNILATHREIVASIPSSQRDRTSGWKNKAP

SEQ ID NO: 999344 - protein, 71 aa, Homo sapiens
MVHTPYYDNVKGETFSEYKIPGFDFGACRSPRPADSLCVGLQNSQKFQPSARTWGSEQRWSTSWEMADPIG

SEQ ID NO: 999345 - protein, 389 aa, Homo sapiens
MHGSREHSAWQPIPHLPLRAVSYTSYGESSWVHIRSYEINLALDFLVDLVQALLLLSSVYSFACAYARYVIIPLGSLAMYCQFDIICITQRRIAWDVHMLGSVRMRLRFESTLCHHSTVHLHITQPLTAITFLRDRLRTYAQNPRPDLANLVVSFLEEKGGCSEGRKPFFHIPRSVIALGGHGRRMQRDSPVRSAIKPGKDQVCGFAWAYIASGARSNSANWAGLEGLRPTRSCPSQWPIFRQGVTTIKDTGKIVQPRPLRKEEIGYSSGAEMDSVTTPLTQNSASLFGFNGPWFPYLEGNTIGVKGGKNINGLVEDHQTEDNSWFWCGANSLFPIVDTAASRGIFAIGSGPRIWLVQIANTGKLFKFPLSGNPGLAGFRVEEEPSKTF

SEQ ID NO: 999346 - protein, 89 aa, Homo sapiens
KPTVAWSADKSFQVLYDCTLPKEVLGKGSVLTMWVYLAAGPSGGPCSIAFLAIVGSPGKGKVSEAYASKNEVYIMNRRGIVDSESLLGT

SEQ ID NO: 999347 - protein, 224 aa, Homo sapiens
TTHSSSSSTQSNHLRYDETSDHLLGSHALTPSKLTTGVFHSPVHVLYQYASNAIFNQVTNYYSRDVELWLRSIRIPVTANRPSLNYSLSDSLTYYIEDEGHILRIISLHQKPERSALILVLASIANRPLHEAMSSREAKYHTEGPQIISKLIIRHPIHGTELVSMNREEDYSDRQVPALKELLYLFTVIYAVDYPRDPMTAHPTPMLARKGIYTRPLGITSECR

SEQ ID NO: 999348 - protein, 78 aa, Homo sapiens
MHDLREEPWSRPRDRVKLVDRLGAPNVTTVANTAGRPENFRDTTKGHSRRRSGRSGILWHGKHGWENGRDIIAGTTKS

SEQ ID NO: 999349 - protein, 353 aa, Homo sapiens
MKRARSQTVLLLTICSLEGALVRNTGKGAIVCESLVSQYFQTCDSIYGKAPDGRQVIESQMLQAEVQVCTLKSRKEQLIPLIKKAGTELVQLLRGYFCWNLEHMTAIQEVVRDALSSNAPAGRLENHTGQSKSSVSLSKFFANNEDGMNEVRIKSTKKAMKSLCYWPIVRTLANRSYGTQPVIFGCPVGPQELKVDPVGPNSEVSPEEKLQCGLSTEVHGEMSLPPVEEMRRTRAVNQESVDIRDRICDTVEALGRAPYGGLLRQRGRQLTTREPGEINQEVSARAAGEDCMEADTPVRSVNKGQQDQKAATPDRSKRAERRSEVAKQRQWDQNEKTGGAGIADKQTGTEKKN

SEQ ID NO: 999350 - protein, 270 aa, Homo sapiens
MSGVRQSNTPSTRGSGAAMGKLIRTMELANYKATVGTKDVWRSTGNKFLSVHLHSCCATRTMAGDTSLAHSRLNAIHRYTDCLEMTSRENNSDTYSKTFNALKTSRDSYMRPLGKVTHQTEKYGPEPKLAWGIDRYNIGIGPHKVTSDHSTRATDYSYQQVSHTLGAQSANSGELAGIHCANKALINIIRRTVQLEWMATVFYVPMQPKFAAGATEYTSVATGGPSGEPNKLKLKTRWHTNGVSDITRQCLCTVTHKTQHDTPHFFACKT

SEQ ID NO: 999351 - protein, 194 aa, Homo sapiens
MWLPLQRFTPHIRRKTPTQAPVVPVTLAVARNLAPLRPNEFGTPLSGPRNIPTENTPLAANAGTGREHQAPNWAELNFALGNPMGGAHFPCKQVARIARAPLYKVPRAQLELDHETLGGPIQTHPSYLEQHGHGALNYGITQQPGDDVQTPYSTDPTFPPEQGDKTPLAPGLYSQAPNSAKHATLTRLLVKDAT

SEQ ID NO: 999352 - protein, 155 aa, Homo sapiens
RDPQIRYGTDQHHESLSRAWFSASLVLGVRSLKLLFSVPFGGGFRMGIGNNVESLTSVNEEKPIRFGSRDNTARVFGDYVCMPKIGDRVGVLWAVENADHEEWQREEYPGRILLGRMGAGGTRWFESTAMEIDIEGKEVGKTTCIIYLLRYLNGS

SEQ ID NO: 999353 - protein, 67 aa, Homo sapiens
DSADTTRLGSPGHSDIDELVTCEPLVNLDSRTVYAYFYFLSVNIVYSILLLTMRLDCLAILEMNTIR

SEQ ID NO: 999354 - protein, 73 aa, Homo sapiens
ACKNYDGDVQSDSVAQGYGSLGMMTSVLVCPDGKYSEEAEAAQRVLKSRHYRMYQERTGGRPPIPWLPFVPGA

SEQ ID NO: 999355 - protein, 168 aa, Homo sapiens
SSLSGTSTDLRQWIDHDFVLCSCRQFSCCTIAIGVLSRFLLLSPCAVENYSWQDWMTTSEKIYHTRPEDLEGVTFVPILTMESLAEFGLEFCTSSHNIDKRSLKHVSETRNTSFTSSIVFDTQDRRQSGYDEHLCMMYIIAHCGETPTTVLLTSSDVDDQSIETERPF

SEQ ID NO: 999356 - protein, 120 aa, Homo sapiens
MRLLPTAEYRPNSSPDDWDRNKRLQWQFDLTRVVSAEALELRIRTQYKPPRGTYLPSVRLTAEHANLLSCPSKPRLVICNLIQHTTSRHQEEAMIVKLGHRTSNPMRVIRQARNGDSAIA

SEQ ID NO: 999357 - protein, 118 aa, Homo sapiens
ETFFAESRRRFPASTVLDGTRRIDSHTPDRPPIDQTLRSPRSPHPSDMHPRPPPPTPAPTQHTRRTHDELSISRPHMTTADPPRRCARTTTRTSEADHQPHRSTVERLRHHKYVYHDP

SEQ ID NO: 999358 - protein, 148 aa, Homo sapiens
NAGPPRDSLMAAVSEAGVAGIYAVAVHVMASQLKPSRSPAPCPCIWRASPRRQDSARHGQCLAGRSAVLGGALPTVPCWCGPLNPLVCLGCVLVTVMGLLCGGPCRVWVAQPGRASPGSCSQAVGQNPLGTRFSPPSAIPASGFRTVG

SEQ ID NO: 999359 - protein, 157 aa, Homo sapiens
MFEVSARSRSLSRQEARLSLGLVRSYLQLITEKKHQSYQNRDSEVTTEAIEGPIISVGVTEAFIMGQYNRGGMETTVNGEYGKHTVLVEAVKIPGPKEKSFTSQEHLNSDIALTGQRLISVFSTYRLISKAVDGKKLSKMRIRVRVRREAEQNLEAQ

SEQ ID NO: 999360 - protein, 79 aa, Homo sapiens
KLFPVVSTEQFSQDRISGCTLRIDTRCTHGLGQYTNVEAVHARHTYAQQPMRSISWALEPDQQLSYVNAIEKVFKSVQS

SEQ ID NO: 999361 - protein, 212 aa, Homo sapiens
MYFTVSEGRLETRNGPSFCIARLGLIYTFHEGPVGYGFIDFPTNMALGLGSQSLSILGCLRGIRVTLCFERMVLQGGPHGPFMVTSVEGPGGDAETFGGLHAIRFQLIGWSPRMFAFLMAQRRRLYSVSGFTYFGPVWHVLEQLLGVVGADVGAAGSWVGAPRKRRRMWLSSGGRTRARALEGRTPYVGPPVSWRPFGGAPVFPIPVWLWAV

SEQ ID NO: 999362 - protein, 205 aa, Homo sapiens
MVFEVHVEANRSWLVEPKGSLEVELQAPPCETSLKLEWSGEPSLDYKTSAGDRKQSSSGNQLLWISKIIVPMTRNPPNDSPSTAPGSRSHMTFHNVTQCTQALQRARSVTEHQQDRDYEMACASYTLLVTQFEVCSRCAKRCKAPWEHGINHVSLHVTSWAQRRITARSEGPFRGSARPLHPEWTGRKNTFKQARDDCKDVQPQL

SEQ ID NO: 999363 - protein, 66 aa, Homo sapiens
AQAIATLHHSRVIAATTRGFIEPGILPIFTISESRVTTAWCLIPPGSKLSLSPVGSGSQTDAYPAP

SEQ ID NO: 999364 - protein, 247 aa, Homo sapiens
VSRQASSLVDDIDCITYPADGHIPWIDITDLMHGPYELHVLGSNHGKVPYYISLYSILVATTCDGIYPENVFIGRELVRIVWLPYDSIAAGIRQCLRFAGVKDLVCPDRTKQRIEPGDEVSIYRSVSALRKIDPTGCLSRLQLVMCLAHTYRGRRPVVGFLYGVTPKRMGIAVHHVRTSTGYQFVFALRATIFRGGSAQRIDVVTLIDFVLSLWSVTHQLAGHVLYCLVRCHPQKSELGYPIGVAPL

SEQ ID NO: 999365 - protein, 114 aa, Homo sapiens
MGEFPLWGHTQRLGVCKGCELLRALNVGTFQPLRGSKSKFSRAFKPLPKLAWEYTRRHTNQRPSYNFVGILGDKEVGFPPALRPRACFSKDLAWNLEGQFHAWPADPPKRWRGE

SEQ ID NO: 999366 - protein, 273 aa, Homo sapiens
PFLFKGVWPRARSPLTFRRPGRVRSSVWRQRRALSGPRGRASWGSGPWSRRAGEKGVTGGEKAAEKMCERDPGCRREMLTRRQAKPGRRNAAQKGGGLQGRVGSPRAQGGGAPFGPEGGAKENNRGRPRTIRGLWDPGHTKRSYTEKDVRQVWPNQLQGRDTLQSKRVEARGASQGRGCDPIMWGQGKGDAACEKAPRRSAPLKRDARGGGKDARETFLGGPPKRCWAPGEEGTSWASMWGRKKKKTPRIKKKDGRYQKVQGGWVPQDFPRVV

SEQ ID NO: 999367 - protein, 145 aa, Homo sapiens
RLQELRKEEEVAVGRDPATVLQLVQQSETPSQKKKKGKKKKIFGRLGPWKKFFKPLVWGRGPRWVRVDLGPKGVVPKGNSGAKEKGGVEFFQPIKKSAPGGDTPRAFSWNNSQEVGVPRKAITGILSPGRSKEDVSDFHIYRPVL

SEQ ID NO: 999368 - protein, 103 aa, Homo sapiens
AEIEEVYQWCLLRIKYLIALGISQIDHIDEKAFEKLLDLICELAHSRSQSRFYENSKHQRESFRLELKQLKKLHINQKNLTESVGPLPKSLEDLQTYVISKID

SEQ ID NO: 999369 - protein, 113 aa, Homo sapiens
MEFNDLSDRATPLALNTNDTKTYQGFTRPKGGLLFRDGGAIRTAFQSTNGLSYVHRPDSTRNQAFPPVELHQWLSHNLRLGSVSVRTYAGPRTNPASPFMCMAQNIFNVMPCT

SEQ ID NO: 999370 - protein, 178 aa, Homo sapiens
MGQEDKGQQGSLGKLKGGSIFCFHHVLVYLNKGSQKQNQHNNTTHNNIFCGGGSSAPQKKTVFVKPTCGVGARGGPQFVRYWTTLSHKQCGFPHKEEHTLAGAEKRQHRAAGGASLHHKKLKKHAPRAAHTQQGFADKTTLPTQGGGSSTEDAQHKGGAYQQQRGGPNSEAAPAFNNT

SEQ ID NO: 999371 - protein, 343 aa, Homo sapiens
LKTRTDITYTSDMTQAQHPPHTHRASTNDKRQVMMPNKTHMHTQQTKIDNLNIRRTYYAAALKVRYVVAQTTRSQDRRAAQENMCMERSHTTTEQRIRRSERAHMGFKHPDKDKERNTRRERHNIDPGCSKHTKTWRRIHAAHTSTPDEQQDGANKNKYGAIATLIDGASSRVNDDNNPRVSGGGKSELHEERSDTLTQSARYECSVNEAMAAMSRTTKELKIYEAYHITDNTQYIRNRQQHDTSLEQHQPLDTRAIESDYYAKRGERESGSLNRHKVAVSARTDSNDDNKAVLSETSIWNIIHRTRRRYNVSDLAKHQALSPQRTRGHDVRKSRDHLTKHWS

SEQ ID NO: 999372 - protein, 114 aa, Homo sapiens
MGTNIVGGRPIGRPFCASFGSATMRRQHLGRLAQRHFPGPFYHGPKRKGLGERTKFSPSPEDVAFLEHILRDKSGGHKGVPPLPTGLLNHKVAKADIFPKFVTVCVHTQADRQH

SEQ ID NO: 999373 - protein, 146 aa, Homo sapiens
MLEDGSNDNISHLVAQGLGNCHDSGEFSGHSLDNPPACPVRTHYRLHPHALLSPSSDATAYGDYHVIEVPTKLHHQVINVKGNLVLLMKKHQEDLQPKSSSGTKRPGHTSNSGFPWKPVRMGFLITLDPSVGHRLRDISLAMVEKV

SEQ ID NO: 999374 - protein, 132 aa, Homo sapiens
SGVRIRVSVIMYNDDGDADVSCLEGPRSTVQALFAWHYLVPECVSHRVHTAQLSKIRSVRQHTWTAVSQSGHISEARLSSHAYVLPNVCDCERYIDCVSCAIHMIKKSRNRSREARRDRIPGAPNVMTMSGA

SEQ ID NO: 999375 - protein, 70 aa, Homo sapiens
QRCLLTSAIYALQGRSVAVQKQIILKSVFHSNLYPVLVLCLECEDVKNARECVQNGSYLINLEEGYCTLR

SEQ ID NO: 999376 - protein, 108 aa, Homo sapiens
MSTTVHYYQAVCVTDESGTMLISEDDNTDKKTRSAAYVTGTILDLMQYKVISNLEARNSGGQELAPLLQEEDSRTSGLLMGLAGSHLPHRRNRIGGNIIFIPVVLHVQ

SEQ ID NO: 999377 - protein, 152 aa, Homo sapiens
DGKRFQTVCLRKECRCDESEKTKESREVSCTVIELLSPLLKLDCKDKSPVEDTDEKGCGCLRLHSNKKIFARMLALFGLCPRPCYRDLTSLDNTCETDDKSARYSAMERRISEYLGAQGQHLHLEPTLYHFNCRKVSEEQKKNNPLFRDNTF

SEQ ID NO: 999378 - protein, 153 aa, Homo sapiens
MHRTQEKTQRHTTNNEDNNGRRRAPRALGEEGEHTKWKRARRGHKRESAANGGKQGGGTNERGDDGETQRQQTGRTRDSPNQQKEQEKKPPPGQVNTAQKAVPCNDDTKHRAKRSTTEKGQEQQQQDTDKKTDGEEVTRRAERQNTDQSKEKH

SEQ ID NO: 999379 - protein, 72 aa, Homo sapiens
VSFWRAEHMVVQYWKVTKNLSYHQMDGPVAQAIVSDGRPRIRTVRDPFLSTLIRWCEDDGHISSQNDRRAIV

SEQ ID NO: 999380 - protein, 96 aa, Homo sapiens
TPMCWMYRYYCVLYPFSSCENNERTLVESNASSSKSYMRVPFIKFHVRIEIERIALIIVICTDKGMGERKRAMNRVRERDYAWRIWGDKWITLLEE

SEQ ID NO: 999381 - protein, 183 aa, Homo sapiens
MKFLLGHPPASPVTGSSGSLESFVKLFIPKRRKSVTGEIVLITELGHGIGETDWPMNLAKLKSKLGSSGDINKHWTGRKQLAKLARGLGVPRVHTLVGRLAATEKIFTGSGKGRVEGQKFGKMLVFIGNIMAGVVALYIQNWVGLHKNPQNLEKNFVTVKWYCGTIFVDLQEGIFFRAMTEEI

SEQ ID NO: 999382 - protein, 119 aa, Homo sapiens
MKLTEHDDDDEHDNNWQRTLKLTIQTTRLTMKLTDDETDTDDDNDEQELMSMMTTETEDETDEIDEMNMKLIEMTMTVTMTLQMKLELDDDNETDKLTMNNMNTEHNWNMKVTLNTETD

SEQ ID NO: 999383 - protein, 154 aa, Homo sapiens
MCVSLLVVLLMMFDAVLCVHAVLAEMPIIKWKRPWIDVAGRDYLHAYLLLVTLDRLIAALFCPFPPSCECAGDCPAMHAYRRNPFLLLHDRRSNRCVSFHSAIGRWSVASFLNHAIDSLKLHYVSRGPNGTDHNRLVAPERKLTTGQLDRKKAS

SEQ ID NO: 999384 - protein, 75 aa, Homo sapiens
KDLVLDVPIDSLPILIKVQYQYFSVNARRVQSRYSNEIVNSIYKSKLILIEDVHILDISLHHMLTMYFTIALHQS

SEQ ID NO: 999385 - protein, 205 aa, Homo sapiens
MHHINRTNDKNHMIDYLKRAEKAFDKIQHPFMLKALNKLGVDGTYLKIIRAIYGKPTANIIIEWAKTGSILFENRHKTRMPSLTTPIQHSGRSGQAIRQEKERKSIQIGREEVKWSLFADDMMVYLENPIVSAQNLLKLISNFSKVSGYKINVQKSQAFLYTKNRQAERQIMSELPFTTATKIIKIPRNTTHKGCEELQTTAQGT

SEQ ID NO: 999386 - protein, 108 aa, Homo sapiens
MKATCMVLLSLSKRSMRIHRCYQSNEDEGLSARHGDSLLCDSKILTLLMLSPITGLWRGDDNTVCIPGRSCKTCNVANSFENKKREDAKASLPRENPENSEEANFKHS

SEQ ID NO: 999387 - protein, 231 aa, Homo sapiens
GKVARGGGGGSQGPIPRTTSGFRGGQLTLGGKGIQGLPGRHLHPGTLARGSCTARDFKEAGADPNGSVYPGFLGPTPYGSRDPFGRHPAWPMCTTLHEESVEGNRISQRGTQQSILTNSRGNVNIPRDRHIRGYTPETSIDSAERRPCQRKCGRETSAQHEEEKFRTVIETAVTIPSRYYATVSEADKSKEIRERRGERAPRDGGNTPYEEEGVSGYRTQRDNSVGVYMRK

SEQ ID NO: 999388 - protein, 69 aa, Homo sapiens
CTFSAVMVRLMLVLAPVMCYSLWSLESPRLLSTIHEAIWYDTCRPSSHTEDAMKQAWSSTLTRIIEIES

SEQ ID NO: 999389 - protein, 118 aa, Homo sapiens
MNLIRVLDDRSSGLISRVAYETQVPRSHLGQRLPVSPYKATAGYYALLVSNHEDVRKVSCYFDDTTDDLHENVSLLWYPNSGMFAYAFHVIVTPELKRQYFTLWRLNSLEIIHDHTFT

SEQ ID NO: 999390 - protein, 309 aa, Homo sapiens
MTRPATYNRADRRRVSYHVRNTTGGASYAGPHATRHQRTTTPVGAAERWCTEHKPRSQHGASSEYSSCHVHPDCDTPTTVTTSSTQTATHSTTTRATAGKRACGPPKRNTTQVPTAAHLRNREERRSEGQRHTGETGRRSDSRIGARGVRRGKLEPRVSRRPDPVCNDNAHKLTKQTRTEQSASERRREHEIEKELTREDQGSRRRHGREKHNERREKGRRAERSEEERAEEAGDKPGEKQGTARVAERGTRRSGKRAETAEQQENGRRAAEREGRAKGAGEEQSTYRQRENKRNERRQTEQASTRSRE

SEQ ID NO: 999391 - protein, 144 aa, Homo sapiens
MVQERCTSFPVVAGSRRKPGLAEARVFHGMHNATSSIGTSSGRQAPTHARMSRSVVCYKCADKHERHVELLRNSCISTHVFLRSQEMTKNTAGLGYIHPYELRAFARDGQFGPYLDLIGVLKSRCGGIGGETSQAIDRPEDKAI

SEQ ID NO: 999392 - protein, 40 aa, Homo sapiens
MAKGEERDKGISSWSIWIYGGGLSKYATGTWSNEGWKCRK

SEQ ID NO: 999393 - protein, 130 aa, Homo sapiens
MRLDVELVKGTIKSSGPQFSMSKKKTKGKNKTMLWGARHGPPEKSCLTPSGGGRGGPVGSCRPGHNVCPRKKTGGQRNQEAGGILPPNKQEAPQGEQREMFSEKVPKEKIQRDKTGVFQREASKRPRNKV

SEQ ID NO: 999394 - protein, 119 aa, Homo sapiens
MSHRKGWCQGCEACGLMPGDARLCDAWMVNLKERAQGNMKHVLFQELNVNCFQCRKPEESETSTKLSLAASHSITQPVNEASAKAQTSHKSRDLGYSPEVSDERDRACNRVSSLIEGVG

SEQ ID NO: 999395 - protein, 65 aa, Homo sapiens
MDDMLLLDEYPGSMASCHRVVYTHIAIATGREFRKIQHYSQWQFLDVVSCIILNPRMILIECSWY

SEQ ID NO: 999396 - protein, 115 aa, Homo sapiens
MVKGGMQQAELTILHIYAPNTGAPRFIKQVLRDLQRDLDSHTIIMGDFDTPLSILDRTMRQKINKNIQDLNSALDQADLQNSELELSFGPSRHLHNSPLQINRIYILSSTTSHLF

SEQ ID NO: 999397 - protein, 131 aa, Homo sapiens
ITRLKLLLQNILKRTQPVLLVGGMMATKAHHALEQLIRDCNNNVQSMRRTEELSLPEAMKIEFRVQKYSLLISQSRWLVKSGERDSLGSSGASPGLRRKLNTAPVTHCDLIQMTCLLAVVGPVEGSRFPGI

SEQ ID NO: 999398 - protein, 111 aa, Homo sapiens
KRRAHPRFPPRRCRRSSPSSPPRKLREPPLALCQPRKGLPQCSGELKGSSMLRPEVGAKAEEAPRASEGLPASLSPLNRKLGNQTYLRKQVILFLTWKPGGKNQHELFVYL

SEQ ID NO: 999399 - protein, 43 aa, Homo sapiens
MKRYARTDKEEKETKSQDGAGRHEKDKKQNRTHAANHSKTRTP

SEQ ID NO: 999400 - protein, 135 aa, Homo sapiens
QLLRTHKMKLKIPLRIHSQAHLKHILTKSPGERSAMDYYRIICQLVFAGRHCRLCSSSCSPYFQLLDVQRLPRECTLQEKPFFSQPGAPNTSVHGLLLLYSIFHSTKVQERRCWSKQNVTSESTCCVAKSYKQGH

SEQ ID NO: 999401 - protein, 124 aa, Homo sapiens
MGLGHTKGIISDNLSSMTCEKFFSGECHRNRIDNKVPDEATCMGVHAHRDEYIPSFCIQSKKMRDCALPNVTRYNLNPRYRTCDAFTYTGCGGNDNNFVSREDCKRACAKALTKKKKMPKSFRI

SEQ ID NO: 999402 - protein, 207 aa, Homo sapiens
MRPPCPESSQLNRQVSPQLLTDASDTTAVNWQIGPNTQAWLALPGVPFPTSFNLVPRSQPLVQATRATPYNTETVPPNFGQGLHTSRPLALAQLAHRPTVGLGATQPAVLRTLAWERNHSAALDSKGYAAYHQTALPLTLATDIATTLSSQAGLVTASGRGLTTRPLLTLAYTLHNGVLMDTVCPGHTGHSPADVCDSADKPPYSDT

SEQ ID NO: 999403 - protein, 71 aa, Homo sapiens
GDGMIKVKNQLRFLAELAYDLDVDDAPGNSQQATPKDNEISTFHNLGNVHSPLKLLTSMAISVVCFFFLVH

SEQ ID NO: 999404 - protein, 119 aa, Homo sapiens
MPPTYPPRKLAPTLNNQPPPSRPAPSILQPTITKCDGSTHRAPCETRYQKPPRGHKAAHPQPEPHKSSKARLTHENATQGNAVPQQAPTGAADLIRPLTPDSRVHPPPNSRQTSRTIKQ

SEQ ID NO: 999405 - protein, 55 aa, Homo sapiens
MANAKPPNIQRINYSVHQTKQHPRGPRPTTWGEKSPRQTHNEDPQHTPRQPLSIH

SEQ ID NO: 999406 - protein, 119 aa, Homo sapiens
MFRPNILHYTPCCEKAPRTLYMILDAKPSTPPNATITLNILVNIFYSHITYFHAIRQLSPTHVILYDSSAIRIIIIGQGHVNQWDILIDYVYLVACNSPQGHHLGGNVQRSLTPKVLIV

SEQ ID NO: 999407 - protein, 135 aa, Homo sapiens
MEAALPGIRLGKREPTIPTRTTAVPKQQTTGVALNTGTSRLTAKVILAPSIPPRCQSREKKGRRHTTQPFDENEGATPRCYEFDREKVKQDLVSVRYKRGVERNTHNHVIIIVRGASYIDHPSCIRYAYVCQHRT

SEQ ID NO: 999408 - protein, 288 aa, Homo sapiens
MAHACNPSIWDAKAGRSPEVKVWDQPGQHGETPSLPKNTKYKNLARLGGIAPVIPVTQEAEAEELTWTLGGQRLAASQESNLWATEARTRDLKTKKKKISGQFSFIAIIWPILQIEESSPKQRINKVGTPRQQNVATPPRFIPRDSCEGRRQREKGRDLTERHTREKLWNTSTVGSPKMSGVKTPRGSIYTINTFPEQKSTRETRERGRQAKTPVNGPQSRYIKARKRQKGEGKKRAAVKTKREQVGKGAPMENANKQHGHHPGRDPNVMGETSSKPKKLTNDTQKTK

SEQ ID NO: 999409 - protein, 101 aa, Homo sapiens
SLLPSLSTQHRHAHKGRINTVKMTMLPQSNLYIQRNSHQNTIIILHRTRKTILKFIWNPKRARITKAIPSKKNKSGGITLPNFKLCYKLPKQPGTGMKIGM

SEQ ID NO: 999410 - protein, 104 aa, Homo sapiens
MTGPMKSTRKNQEKKNLQLVQKEELSRFLYHNSERSAHTDQILSSQYQNSIHDQDRHYAESCNLLTFFVDMYYINKYVDDLSQIINISDDHMSSTVFPSNHSPG

SEQ ID NO: 999411 - protein, 130 aa, Homo sapiens
AVVSTQSAHYGRGSFNLLMQTVPNKPTGPRLPNLPLNNFSWGDLGAEPEASEHVHANDFTSQSELVYSIESNRLEPTEQVTLGITVSNPILESISTMRVYDLDCWIMDYPDGARPLLKRFVLFNRLIRPT

SEQ ID NO: 999412 - protein, 99 aa, Homo sapiens
VRLISGRLSTDQITRVKREPSGCDKFGGYVVGEVNRNAINCTAGCSLKVGCLFDDMRIKANFNVTCNVVGPLNVEDSYIEIDSQRGCFIMILVGVHTQD

SEQ ID NO: 999413 - protein, 88 aa, Homo sapiens
ARSRGGLEYGGHGLGYNLMRKEADQRAKYAHCYSRYFYTCTIGVSETSLCVRRKMEGMGVCKSNSDASVLGTAPKEIDVSNLLPSVPE

SEQ ID NO: 999414 - protein, 165 aa, Homo sapiens
MVLHTEHMQRIFARSRLSGCCCECISHSRYLSVQDCPELLRYMVNKPILSPMPGVTPNTYSGMGCCFSRSISDSSNGPMKDVIVWCRESAHVGLEESELSVVVTLIYSYYYPIGSRSSYWWRSSNSGHCTPITESLAHDCSGYHCFVYFFALRVRYTPSYSIGKV

SEQ ID NO: 999415 - protein, 117 aa, Homo sapiens
MIESEEDSGVNVRIRKGSDIWHVLNMLSSLSAWFTPSGYTRGLMTCGKGVWSLESNKLGAHYGSSIMTMRKLIITSRGALIFSICKNTDNEVIHSCGILQDQDESTCLKFQAHHAAS

SEQ ID NO: 999416 - protein, 71 aa, Homo sapiens
AVTENSYDEANNRLFGSTSLTALIHYSCKNTPRGNESASVSYYRIIVHASLSGLAVVRVCYVAMFYHFLTS

SEQ ID NO: 999417 - protein, 122 aa, Homo sapiens
MSQDCRPCNSRPGQQSEIPSQKTQKTHTTKQQPEQQWPRGKAIKKTRIGTRGTTRTGNMAIPRTPKRNTRGNDKRRVGRRPPEIKQRRGGPPQAGLEQHAKISTGANTASLQKRVHSEAAYK

SEQ ID NO: 999418 - protein, 323 aa, Homo sapiens
MATGRTSGSKNEGNANRGENPGGDKDSKRRMEITPHTIQENAPRGENTGRESMEENTKIYREGGEIHERGPQLQAGGSYSKPNDGGEIPNKEEEPSEKNTRNKEATRNEGGKQTTDRGTKQRGKEKKEEGRKKKKKQQENEEKKREKRRERKREKRKERGQSRRETKRRRQRDRRRKRPQEETEERKDGGENEKEKQKGERRRTEKRQEREQQGEKKEAEREKEERERRKQEGEEKERREAQERDKTEQQKSDETERREESRKGKNRRKKREGRERKRARRKRGAQNKETKQKEKKRDTRRKKTTRQQKKTNRRVQQEETETR

SEQ ID NO: 999419 - protein, 281 aa, Homo sapiens
GDDPGFEGQRGKPGGPKDIREKPGDPGTSRRSSDLLASTRADCRGGEQKRAGSGDRASEGDAQMGQLRSHNQGAKSLGHTIGGEQVADTGRMMRVPKALARAAQGLDPGFDGHFNGTLLEPQGADPRLAFGTATGRNRRDACDAGRGQARRDLGKLGDALWSTRRQLGETPVAPPVETQETARRRLGHPWTCTDAPVGAGVLPCDERRTHGETPKALLVDQAGRPWVKAVPARVITRKRQATWLSLGDPGDGWALSDLRATEAMRVPQVRGGRRSPGPADP

SEQ ID NO: 999420 - protein, 102 aa, Homo sapiens
MDLVAMVGVMTCTWVAFLLALIEGAGILLTKICLCIRFPNGPQVLLERPLLQLPLNSDYLSSSLETIDYISEDFFPRISLTEGVVVREGFQKITCQAVFKTR

SEQ ID NO: 999421 - protein, 78 aa, Homo sapiens
GEVLLPWEEAQDRQRRKGRVYDSDTPLLHRNVRLSIRKSSLRPQREETNKTAGDSCEPLSAPPCTQHINVERGARVHK

SEQ ID NO: 999422 - protein, 121 aa, Homo sapiens
FSLHPDYAMVGVCGSGGRCSVPPGPLRVTHRLQRRCPQFSSYCGSAPSGGSILSWDRMRGKASPSARSRGPDNGLHRWRSLAQWVDVQLRLREYHQILNALGSAEGTGDSDLVVGGGPAFG

SEQ ID NO: 999423 - protein, 120 aa, Homo sapiens
MFPLYYSNEQHDVWGKHLPLVMTRHITQLRPHKAVRPPVSHKTLLKFATYEIRWIGSCAVCINIPRRGGGTPIDNDRATDLLATLTEPMDSIETEEIYPHPLMCITTNNILYMTPRISQR

SEQ ID NO: 999424 - protein, 81 aa, Homo sapiens
MHAHGPPDNTRGHGGHTPTRTPRHGHSGQGQATRRHRQHGQQQPTRSQRRQRTHRATHTGHNQRKQAQPHTQPPPCNSGKR

SEQ ID NO: 999425 - protein, 187 aa, Homo sapiens
MSNETIGTLAFLTSEIKYSLCIPFLAERIISMLNLLPATNLVGPQKMGCLKSQRDFSDIDFKPPAAYVSDICNYLTLNLGDEENFCANFAQGWTSYSRNSLGHRQFEVYEGKNKYRLGHYGSWASSATLDRREILVLLAEPADNQEAGRNPIGGMPGGLRFPWNPPIHGAPPGVWWTLVVGLPSLSQ

SEQ ID NO: 999426 - protein, 425 aa, Homo sapiens
QTTSGQLLQQASLLSRLHKLRSAVLVWALSLSTPDSPLTVKQIPCIHGLMLTGMHAESACLLHERILVHDLGVIRTRACCGLQFAAALCIVPDIHPHRYVAVHRSDRFSLTHAYACRMAAFCPPDMSSEHGRYLRSVAQQGSSSWPKHSKTSFLCGFHRLISLAIWTIRRKSHDCNPLNILLVIAYPTIPMVRGEFSIPIPEGSSYNNVSVPIYSCTCRGTAVTTREERSICIEFFAHESTSDFQFSQQPDFGSNVLQRCYVQFELRALMVACFIAESNGYQNRAYRSPRGRHSLCNGAFGIVHYLPQAKLLGLFPIHQSLLEPPYCILLFSVTQGNSYPFPEKIPPPVLSPSLTPAGDVRSASVTPNLKVHTRKLCGNQICMTGNLSRLYRTRGHNPTSCGTDWAWARVTYYGAREWQTQICDI

SEQ ID NO: 999427 - protein, 106 aa, Homo sapiens
MVWSMVAKNTWLKKPEIPGHLHLRLHRAQLIPLQGSFNGACYKHDGVPPVVTLGSFKPKRADPFLPNRNVSPNSFMVLGGTTFCGRTRRRGPWGGVPPYYGSCWAP

SEQ ID NO: 999428 - protein, 121 aa, Homo sapiens
MPVLLERPTHGHPPIRHCDIHWVGLYTERVASRCHSTYLASTLDMLRDVIITRYKNQRSGLNPRHAHKFNVELPGHALLTVIEISFEIGYVWFCVFVNILQISAPFCTTCETGFKILCLQC

SEQ ID NO: 999429 - protein, 90 aa, Homo sapiens
LGSGISHHLQNNELLRDIFGLGPVLLLDATALKACYVPRFEKHLYNSQLAFKARTKARKSVCGTMSGQTIRVKQDLSEEETFYALVIRIL

SEQ ID NO: 999430 - protein, 151 aa, Homo sapiens
MDRGPKKPLSRCGSSTAACWDNDRCVCSSSIHRSPEVERSVYPSSFYLRKRLLSSAPDEEMKLTEDLHASGYPDTNFDGARGPDEDNNAYPLPGLHWNDHSGKLTKERGRKILPDEESSDTPNGISFATAHRYTHLTAGPRLQVVHSDEQI

SEQ ID NO: 999431 - protein, 389 aa, Homo sapiens
RNPTNVKNVAKLLAIPQTWLHHEITHTEEKPYKCKEAVTQTFKRLLRPLAKHKIIHAGEKLYKCEECGTALSRSSNLTIHKVHTYVERNLTKCEECGESIVTGPQALLTHKKNFQYIEKTEPFTMLQRLLAQAIYIMVPSNPKAKTIHDGLTTTWRTESPYHKWCTANGETQKASGKDQRTTSRDPNQTVKTATQGKHWYKSPGDRKEKTRSHKWYKHMDGPNAANKPQSHENPTDVHNSKPTRQRARGRAHEHEQPADTSHSAGQRHTSGHTRKRKQTQAPNQKLRQTKKRRQGKNKADRRERGRKTADPRKETNRHAKQAGKKESQIETAEGGTQQTSTRMNTQDAGRHEKHQKRQETASQKNRVTRQRRQTTGNKRRGQHSESKQT

SEQ ID NO: 999432 - protein, 68 aa, Homo sapiens
QRPRENDVTGIYKQRIEMEEGDYKEILDVGKDKTACECLKGPRIHPAHADCIDAGCEADNLMSATRTR

SEQ ID NO: 999433 - protein, 296 aa, Homo sapiens
MKEHLLPDGMNEVLLAIYKFFLKFFELNLPIEKGVLENQVYGDQGVSFFGNKEGIPLNLTIMCQGVSMKDILYEKEQHEGPKFDIQRPPKERRMDIGHGNWGEPFTRGQTWSGTSNNVDYRDTRRASGWIHPIPIHPGNLGVNAYINLPGEVTFHGRPFSGNTHEHLPHVKNTFCHFKAAAHHGAGPTAVKQWGVAQAARISLGYQVGIQHWGVPTRGGKKRNMGLTPSCVNVAEDLGFFHVWWLSQKRHTFPGEPLPKVTRGAIPAIPGHGGHFGGNERELAARLIQIGGKGGDG

SEQ ID NO: 999434 - protein, 111 aa, Homo sapiens
YNVAKEERGRTLMDCEFHKKKNRPVNLTFYRIALQKNTQPPGVVPQPTLSTLSTLGSFNTGKHQAQLCHFCVCDHNISGTNTPGIKTCLTFSRATIVEHNQFDQTPSYQEC

SEQ ID NO: 999435 - protein, 81 aa, Homo sapiens
MEDLETPRRNGYVGCRLDPLHFVAEPIFSQQVVETCNSSIVAQYGTLVNPVPSTTWDGHRGVCVNSRPGGEHCLSGALPGK

SEQ ID NO: 999436 - protein, 310 aa, Homo sapiens
MTLNTVVQRNTAGAFIRFNNRIIQTHSQTTPTQYDPVNRNMRLDHTLPNYTTHNPFNPYTITPINNNTNTMKEAPEKTSYNTTHINITTTKTNFYISTPQTLQHTNTVLTQKKYRHHNQLIMTLTLQHNTTYNHPYTQLTTPLKYDNPYNTHTRCHHTTTTATPKPTHKHHIHTPIRKKHLFSNTSSYTPHITPLDIPPKHTTRHTMQQHNQLIARYSESERIERAPNGDHNGQSNHATPSDQVDKQDQHRTVHHSQLLMSSTSRHTPHQNKNETTTACLTAKGARPVRYRTTSAPTLGGPYHGRSHQGG

SEQ ID NO: 999437 - protein, 113 aa, Homo sapiens
MGWMSDQASLCLRTFQKDKEMSLPLPKHQRSLAFPCGPCVPGFALLVDPKPSVHFPVTQGPLHSQKLAFGPYGWPLGSGLKCLGLVVAIKKGASQGLVEGPLEPLYYTLCTSS

SEQ ID NO: 999438 - protein, 228 aa, Homo sapiens
GLEATDVYGASCQILLHLAHSRQKTYTVLAHGHAFGPLIRRGQTLIYSQQIGSNLQHHTCEETCGVVIAPKTRPRTTPELATPTPYLAHRPCPTQEHFVPNETTYYKSKYLVAFRNFTLGAILLLGAATLAPHPPPFAHSYLHQKLDGGNSSRLFPNCWATLLGGLKTVSAAHAANTEHTAQRAYTTQARWVQHPLHYNRAHRMTQAHNLTTTRADHNISHRFYTGPT

SEQ ID NO: 999439 - protein, 77 aa, Homo sapiens
QEGLVLKGVQQLTKTEEDPHVTHSRRSERHSQHSPENMSHTYPTVESAPRRNKLTDYAIIKLPLTSMSLRIEEDRRQ

SEQ ID NO: 999440 - protein, 244 aa, Homo sapiens
PRVADAWGHIVLCAELTYTLVHRGSGTHGVYHVARMRATGRGENSNVLLNNFDSCSTGPFEDADYELPQSKLIVGVRHRPLKAGEVHPLIHEILGGGLMRCVTSLPWCSEASKTTCSNDMMFVMYTKYANERVRRRMGRTHAERTYSTQNNRGGHTDCNPGYENAQFANMSVLDAHTYTNGAYAARERKVARDLYLSELHVVHILKRGASYTRTGRFVKRPYRIRHINGGQGGDMQQPLVPFSE

SEQ ID NO: 999441 - protein, 131 aa, Homo sapiens
MLSPVIICRDVGIANSACRIVLRVWVLNTRSGYSDTGVDKMRRTVDSICDLVIIMCHDGKSAVIELIELVLPRHNQRHMIFLQTHEKTLILTIGRPYHGEGQDTGVTRLVTKDDYIVGHLRGTGDPYLRYA

SEQ ID NO: 999442 - protein, 135 aa, Homo sapiens
MRLSTFRVLRETHVGFLTKCVQYPAISNLVETTPCARGGVWSVVPSGCLASRYKATHGGVDIPRTMRHEHDAWRVPSTDRQVEFYFSATHRKRVSYADNQTTHFPGYFMQGINTKHAVHACVDNNAFNNEVQTSA

SEQ ID NO: 999443 - protein, 298 aa, Homo sapiens
TGMTITLLRRDGLQTVHCAKRFDQKNNDDANSFALPARTPETFGQKQLSNHFLTTVLLLIVLTGLTPAIYWVVLCHELTTDHALERQHNSLALTSSFTRDLRHLHYQRSTYLITHNPCAKPPPQSLIHTSSSGLISATLLPALHPTPPCKLSPMRDLDTLATLGASKPGTNVPMAPTWPIDSAFIHPQATNTYLEPIQRIEFVSLMAPRLPGRAIPIGTFSYKRNTERRTSNLHTHSETITPNQSNVNTRNPNTVTHYSPSHHLYYAPLLPPTPTPTFTHYSSVNSNNPLTHTPPPAE

SEQ ID NO: 999444 - protein, 189 aa, Homo sapiens
MWPLYSQVAMVVEKTTDGRSYNGGEADELPKVVLDHDLGQGNNLAEHKLGVTHSTRRGTHAARGAIGHYVIARPYTLGLFTTWTDRHGPTELHRTSHRTNRRTGRGENQHARASRADNSAKSPGTVRAHTEETAQQPLSRAHNVDKVPLTARGTGVTYEGNTPAQDDKHNQHKENVEGARPAAQSSTNN

SEQ ID NO: 999445 - protein, 125 aa, Homo sapiens
MSYSCSQPTALCTQDTRLLPVALLVLQHGVTLIEHTRQGALGETSVRSPRIHLTAGHKTHTTTHPSPPLPLPRAQHQPVEQPTPTYAPNVTSLAQHTDHAHEPLHTAEDTQQPKPTKSPPILDPT

SEQ ID NO: 999446 - protein, 489 aa, Homo sapiens
MREISVRCSTSVAQWVTYLTQNRRRRVEQKLSARTNFPSMVEVHRRVRLKCCGVLVRPSYVRQAGTHEMVKVNSHPSPMHRHSSYQSNKRIANLTTHCMDLLDNPLTLRVPTTGQQVPAHFNWPITKLSTNMLQGIVRVDSITTQGLITNHVTPLHEVWALYLRLSLLYEGIANGPRLWRILNTRDDANATHTKGAPNLDAHREHHFNTRIISILICRQPRTLYRPYVSRKAKYPRQNYLSAVTSQDDIGLGQRMRRERATQPIVRQCTHRSYKEHTVHTYSHRLHAFCAAVTETHYAAYSSNRSFVPSLSPPAISAGHISEATQSVPQVALGVVCNTTNKAAGYHRTQRRGNRHRTPVTALSHMKVTYALPLNDLSLSSTGDQRLQIAAVVQIEATHPSYSTTSAHNRGRGASPSEVRNQVNRRDKTRERTPRTRTNGTTTTQHQEHRARTTKDKIGGIPPVAHIWQTLRRETRQKSTKKSETHQSST

SEQ ID NO: 999447 - protein, 45 aa, Homo sapiens
MAQYYPGTNPGHGGETWCEAIATPAIQSPLTPKRGIPATHNPQKL

SEQ ID NO: 999448 - protein, 357 aa, Homo sapiens
KHQMADDAWCSGVGPGPGGPGMGNRGGFRWRFRQMASCGPGVAGLCDLCVPVCLSACGARWECNGLRIRTWMPVTKVGPLGHRTMKINVPEEEIYLFSLPIKESEIIDFFLGAISQEMRFEDSCQLQKQTLLPASAPGSRHLYAIRGLTMGHVGQGVTVLHLSVDHRHPVVGIILAKLSHRPLLRKRAELGGTKIGEAAQKCPSDKVDHCRIVGSVLGTPSSLEAPGRQLAIRVFLHPLFAVSGMHGSIDCAWVVRIGRCFTTFPGAVGVETLAHPLGRVFGTRVQAFVNCSHFLQGNPEQGVNLVAPRSPSWKRDNLVIIPKEFCRYSEWSYTWNHVYGTKNPETQEVFRVKRRHS

SEQ ID NO: 999449 - protein, 147 aa, Homo sapiens
EYLEDTKNKGDVKKHSQIFRTIPLRLFVEKERDKEVSDDEADRPTDRPTDTNDKHDNHERRNDVGTTIPETCQMLVLTEDTKKQKDGDKNDSKKKIKEKYIDQEELNKTKPIWTRNPDDITNEEYGEFYKSLTNDWEDHLAVTAYFS

SEQ ID NO: 999450 - protein, 311 aa, Homo sapiens
KLSSEPLPECRGGEAASGTEKWAGSRGRGGGELRPGAQAGDLCRGPWSGWALPGSVVPGLRGGWPCGLGERVRPVDGRVKQPLQCLVCAPVCWGWLPGWAFVRMWPRSRRSRGCPFAAHDAGAASCSLSRSMWLACSVGTFNGGGHREWHNCRLERVVDFALDLFAGRVVTACVQRNLYFPRLGRLGHSGSPVLACEDDSVGCCCAMLLAVRGTVACLATPTGESSPRGPWGAIVVQAAQRDPLEGTQCRTGQKPWSPATQRGGISGEAGIQDDTRQRQARGGKVAKPLGPALKGFFVGRFSRKVTDQALG

SEQ ID NO: 999451 - protein, 144 aa, Homo sapiens
MDSGLHRLGAKHNLRGRDQLQMSSWLITGALPVFVAVTSQIQYLCARTTPSVNAEGARTFVGILRAVIPLKRPNEVSNALTIGLGGSRSEYVIRDRTAKWEHQEEWFPIVGVDPPKSRQCKEEITHLRGVGPFSWCVEEQLLPG

SEQ ID NO: 999452 - protein, 97 aa, Homo sapiens
MADLTRLLSLRKHLHVTLAKVAHSNLWTHKYFGHQRFTKTQYNHKAHNYTRTSHHTHGAPPQLETNPTGQRPDNNAASHRANPGPRPGPQNERPQSK

SEQ ID NO: 999453 - protein, 116 aa, Homo sapiens
PRVARGLGHAAVKARGDSMGERGAGAEEALRHVFVRKGEARGAGGSDSRVQAGALTRGCVFPRPRSAGCPVLAMRPHTRRQVSSKGVHSCETTARWGHRLTVLEIQGSLRSVDEPD

SEQ ID NO: 999454 - protein, 96 aa, Homo sapiens
TRKYEPERILLEFSYSSRTVVNTTVRWLEIVPEMAIQAWRMAMDVTEKLLLARFHCSVVYELVIYSKDIQCVSPVVYRTCNTVWYMLYSLSTDDYL

SEQ ID NO: 999455 - protein, 226 aa, Homo sapiens
GEPGNLAGVGTSSWSSQERGALGKCTISTDAGPGTAANAGKEGGNPGCGPVWPQYSPACFGAAGQGCAPGAIRGWAPVFLDREQSISLMSVGFLSGEARTRPWCRRGPKKNVLIKQFVSDCELGGAGLPGGGYTSPRVTSDELHGHHEKALRPYQPLGALVVTMPQAVSRGGREAAELTHSVWKTGLQGDGNRVENMSGFTCTHTALVVSTSVFSRGGGEELASSP

SEQ ID NO: 999456 - protein, 242 aa, Homo sapiens
LLSGGGPRLTSPLKKSDPVVSYRETVSEESNVLCLYQGPPNKHNRLYMKALAHSPDGLCRRTSSKARGVRPVRRLKQTRRRYPGPSKYELGRWPESPQRLLVAYEAQTAPWAPNILTDYTPKGSAVATTEDTRTTLVDWHRDSPPVGPPKERDALVDRGKNNSPDGVAALRTDTKERSNPLTQHRSANNKHKREKRRPKESSTTETSTREGLAPSYGRSSGIEPSPTTKPRPVGSQPIDNIG

SEQ ID NO: 999457 - protein, 102 aa, Homo sapiens
MSLLIHRWLLTDILGEENLGEAVDSRSGIQTLAFIQPIVSIIGTLFNMNVPAVHTHKRRQDLFTCGMETFQNELLRMTSIDMNDALVPMYTADVSFVSQVSR

SEQ ID NO: 999458 - protein, 217 aa, Homo sapiens
NFTLGIKKRGILGKWSLCPPHSSLVWSPVAYSPLPLNAPTPIKIACGPIHQFDAFTCWYLPLQTPFINVGVRNRTMRGRWTSCPAPHLKALMVKSPLCPTNGGLKPLYAVSGGSSYLPRGQAIVLFTCIRNTVRVLESYTTFLIYMVIDNRHRETGERAGRLANIKREFIPTRRERLPQRFYTGPISPAVYLSVSTQREWAPPHIWRKRKTCEYYLV

SEQ ID NO: 999459 - protein, 132 aa, Homo sapiens
NSQSGNQKAGDSGQRVLGPSQSHPGSGSPVCLISLLTLSTTPTESGGPAPSPACVSPQTLFRMGREKEERGGDLAPSPSGNLGRALCPQWALYPFPWGASSSRDTIVSQISTPVNKHYKFNNEVNNKNKQEG

SEQ ID NO: 999460 - protein, 109 aa, Homo sapiens
MRHMRYRRWCVYTKHTLVADLRGHTHRCCTRCGRHSWWQQETQLPFVGGETPILVVTHSSLTKDFSASKREHNLNVVTAWTYRGVTPTREIALRRREKLRLPEQSLYNT

SEQ ID NO: 999461 - protein, 187 aa, Homo sapiens
LSPPRRQRWLRESAPSSRNAWVTRSQVLVVSFGRAGDLVCNSCPPLSPLLASSSVMINKGMPYNYPGPAVNDGNMPRSWPQIAHRIPSMGTLEVHVNVVSNDKLVVVRAPFTNVNDVETRRLRFTGFPKYEIVDTTHNNCYVEMKEYFLKEKALTSARLQKYKCASLKPQDKYVCVPCVETLHWKIQ

SEQ ID NO: 999462 - protein, 176 aa, Homo sapiens
MKFWYPVESSRLWQGSCTKLHSFILPCIIMCAMWPEQSDKWPTADESKMDISSVNSEKMSKSTGQLPHFDPKAIDKVVQQTGMRFGSGMTAGDTVRRCQPLWNANGQMHGILRFCTPWVETWVNTKLACQGWGQSLRSWFRARQLSTDYAVFGHVKWELAVNFIRDNQNQRDYLTR

SEQ ID NO: 999463 - protein, 163 aa, Homo sapiens
WVSAALGWRRCEWQRGKAAQFREGCRRAASPQCTRHAPSPTGTLARAFPDRHGCPRGRSAPAEGAANGRAQEEIGADCQLNLLQKWKRSRKRQQRRHKSSDKQSAKQQKGTHGEQTGNTVPKWLTQETKKKTYLRTKPGENGKTEAESRPLIEGSEQETKPKS

SEQ ID NO: 999464 - protein, 118 aa, Homo sapiens
DAWVEISGSMTILFLCSSLLLFNLREVNINKNGSGAFENIRSGGPIGERGYPPDYCYVTQCWAPYSTGDCRLIYHMLAHRALISSYAAGPGPVGNTAYLVATLGVHQEHPCIALHAER

SEQ ID NO: 999465 - protein, 300 aa, Homo sapiens
KAHGAQVGLQEATSRYHQKSLIDLSVITPVYDHCVPYRACPYVLLCRVFPKDLEETITRLSTKAISDAFRNVDRTVLENYELTPAESYRSLSICLIRTVPLRQSRFNGLTRAMDRTEIAVTACSHVKSQMWRDQKWVSREAIDVRRERSGESYMLAELRYSRLSYTSIVPEQPRAELANVLGRLSTSESVYSGDLEDLPILVLDRLTFTKNGACTSMKLVRPGFKALERTGLQIPSDRHKSTTTFHAAKTEPGGYTYGSNWLMKILVRSNSDSFIAAIVPTTLSFPLNNAFEHRGPVIYA

SEQ ID NO: 999466 - protein, 285 aa, Homo sapiens
GSCCQCCLELELPGSLWSASCAGARLEPAPGTAIGGLDCTARQQAGHGARHAWMNLSIVYLEPADFLVVNNALGRSAVDRQRRGWETLTLQNASCRYPLPELADPDTCYGFRFCHQLDFSQQQGAAVALGLNKGKPPGKLLYKCCFTGKQRALLTQRALTLGNFAGKGAHNPMDRRREVTQVMPIAILAREHSHRLCLRHQNKIVAIQKCAFEQRDMVEKTPKKPRGLQQRIVSRYLWEHLGECTGNMHNYHGLLPEKELQFDMKKRREYKTGRTRVTKHNPRAH

SEQ ID NO: 999467 - protein, 72 aa, Homo sapiens
DAWVCRQNTGVVNTTPKSQEWETEKDSYQPLYVIGPRRFADIVHHLAVPFCIYTHAGWPLEQMRSHIDNTLC

SEQ ID NO: 999468 - protein, 107 aa, Homo sapiens
MRRITLGAESPGEGKSSGQTSPSILPGSQRSPSARDFPSPSGPQSRLREHSGLWSEWIVKSNDRIQGLLSWGDSRILQCWCNARDARLGQFDRGTQCQETPSGDGAT

SEQ ID NO: 999469 - protein, 406 aa, Homo sapiens
ELAAERVRVRAHLVITARVAQCDTVRTGHAAARATGADRGKPGGLCPIENELRVSGDTLYPPPKPGLSGGGAPEPLLCPPLIGSAITMTSWGRPCTVGGRLYARRLSLRQLTVSGPYLPCCVSTCRRYRRDASVQTQSTHFKRVHIEVVISYPVVRMVESCTVISPPNISVRFTLVDYALWNPLLQSPPEKMPGIERVTTFESNVCSKNWNQYRDGYLVRRLAYQRHLNVAKHHDVGARIFPTFRRGETPPRRSKYSTEESLRGQTRLVEQPVFGRLVYIYWGSDTSHLTSEAKRKVHEQSKTNRRIIFHEIGRRTRQALGRQQHYKKVERHLSMIGVLVVQKRSPSKKTPSGPRHKSRMPNSAFGNRVMHTKGGRYTCTFPPITHIERCFQREYIPTCLTQKPHC

SEQ ID NO: 999470 - protein, 111 aa, Homo sapiens
MRFVGPAAGACPWSFPVPMTKTRGGCPHQPVRLALGRAVLVRKAGSDVATRIQWAPLTPRCLRLECAMPARYRRTLYVVDNQSSGTQRNLSFIFAWVTSYNIFPISIVVHA

SEQ ID NO: 999471 - protein, 112 aa, Homo sapiens
MALPTSPPQAPGLPRCSRRERNTFQDLDKTAVYRNIQACKELAQTTRTGHTGDQMEGTNGYQHLGERCFVTNDAATILRELDSTASCCKNDCNGFLSLMGKSKKLEMAAKPF

SEQ ID NO: 999472 - protein, 126 aa, Homo sapiens
MLRSIGDNEHAEKKVGATEMARQESIHTDVLPFQAGISAIKATLCDPTVFTSFELTMMASPLENELPLTQLSPNGPSEVADRKDTHVGTGPLPRLPTEGPLMDTPETHPKNDPILLASLLAACHSG

SEQ ID NO: 999473 - protein, 251 aa, Homo sapiens
TKSQYMGTGRQTHINIVVFGHVIPGKSTTYWPSDLINAGGIRHKRYPLGNQILQNGMAAGDIVPTQALSSRVCHVVVWITTDMAGSVKRAYHSICILCLAEEIVDDPAQLLCRRIIDVPQGHMKILIHKPSDLHGTESQGLIVCLSVIVAAGGCARISRQLAISKVTRGMDPQYVMHLLGLTPLVWCITSTEVRAGAYTDKLCIPTAAHPLLGLALEITARNKGRNGTCSTVAFYHLLYTDVGLTYPRDSE

SEQ ID NO: 999474 - protein, 146 aa, Homo sapiens
VSRAPCEVGKRRNGALRWSCSSLWSVLCAVALGVLPGRTGGWSSVLRHHWTTTGENCVERETGLIEFYATVVPCLSKSSTGMRKRFAAMRETILRLLIANITMSQSEPGREWTVIYHYTALPTIYHLYDDGEFRRYQGPTGLRRTS

SEQ ID NO: 999475 - protein, 109 aa, Homo sapiens
VSGRRAGAGAGASAITARRAVDTVRTGLRRPATGADRGTPRLCPMKRSFCCLADNYSLPPKPLDIRGGAPKAKPNCPPLLLKGLPYNLCGPLFTQVVAPLVSARPLTPN

SEQ ID NO: 999476 - protein, 103 aa, Homo sapiens
SSIDFTYSQAILKTKTYAKRSHSQLFILHRGKSNFTSRHKLFSGHIRNARRCYSDYPRCIDHMKYSYLVCGSIHCLYISRYTTLISLFSDTDEASRLTMSKKS

SEQ ID NO: 999477 - protein, 33 aa, Homo sapiens
MQGGTWQKVGLCWSLSPETPGPGALNLASTETR

SEQ ID NO: 999478 - protein, 77 aa, Homo sapiens
MPELMPRLQIGTTRSTEKLPYSVEPRLSTGYLYERPPVRRRETHRSVGAQGHTPPKTRAATPDNRATKDDHAQTPRK

SEQ ID NO: 999479 - protein, 136 aa, Homo sapiens
TPPTEWCYPAWSGHDMSLLDMAQTWGEFRVAESSTITNEAVAASALEEGRVREDLWLGLRYAMSAHVHRIPVLDRLGYHSPHIPTDVKIDVCLDAVSSASRKELMEIQYAISGCPQLSGCSRCECLQAVLQIHLNP

SEQ ID NO: 999480 - protein, 155 aa, Homo sapiens
MRPVARLLSYVCEHADTWIPYLISVAAVRDMHCHRIIIIDRRLRLRYVHVTTTWLQDSHNRCRITGELQADARVSILVLVMYRWGLTILARLVLNSLTSGDLPASASQSAGMTGVSHLHLALYIYIFRDRVSLCCPRVVLNSLAQVILLPRLPKH

SEQ ID NO: 999481 - protein, 158 aa, Homo sapiens
GLQRSSNQQQPKEVSRPVISPASIPLVPTGPVKSAELDWRALWLLGALCGEDRHRGPWAGGGPLCGPWDGGGVVGRPDRGSTGRGSYTGTPFVQRTATQSARRGTRFYLRNPWPLGLYLAPKETFSYKTFSINKCPGAPSGREFPSKRVTQTVGQGLI

SEQ ID NO: 999482 - protein, 108 aa, Homo sapiens
MIDSPQQHGAEVTDKFKAVYRTADVCQLVTCYNACWGMAAREYRLHSSIAHAGKAGPEVIFVMPGISGILRHLAAISSKTSGRDNAGARSAREQPTFIACASCAWWVE

SEQ ID NO: 999483 - protein, 254 aa, Homo sapiens
MSSRRTKDLLQRVQWGSNVLVTPNPNYIRKIHREKLHTYRHQWLKLTSGDNGKLTDNRETQTFWTFMSRTLRRPCRLRRRRHAISSSQITEQRKYSRLTQTNLTGHDYSYLPPLLDTTLARDNETNGRTHGREQECRKALNLKGDTDGIETQQIVCLQPSRTCCNFEKPNQLTLTDLYHENLVAPHTGISTLISHITSKISFPLQPSGTPYPQRWTTKLHRWGNKTTLPGPTWDSEGFIGISRTKPAQQQITNG

SEQ ID NO: 999484 - protein, 124 aa, Homo sapiens
IAYLETTANEVGIFLCVLSPVFFSSPHAQDFPGTSDTQGSRSSFLVLGAAQDPGYSQEGFDTVTVKCAGTRNGFPQLNSNDRRVRKLTSTQHSDRRHCRYGGEVPPGFLAEAIQAFTLGLPSDG

SEQ ID NO: 999485 - protein, 202 aa, Homo sapiens
EWSVLCQCNVFAKVWSLTVMKPIYELFQSVSSNVTAMSLQWNLIRKLPPDCFKNYHDLQKLYLQNNKITSISIYAFRGLNSLTKLSRAVKDGSEEMKRTGQNRYLSHNRITFLKPGVFEDLHRLEWLIIEDNHLSRISPPTFYGLNSLILLVLMNNVLTRLPDKPLCQHMPRLHWLDLEGNHIHNLRNLTFISCSNLTVLVM

SEQ ID NO: 999486 - protein, 83 aa, Homo sapiens
DPSRLCANDMVLQTLAWHEFEAGGGLMCITFRSTSMPKQLGQRLVRMLFATQNQWLWGQSREPMALPSEAMTRVALLIFAIDC

SEQ ID NO: 999487 - protein, 325 aa, Homo sapiens
MPLKAPALMVSAAAWALPFPAWGWAPVAGVRPVETAGRRGGQPAMVMSRPLLVRQRVDLCTKYTTHCELAPRHGETPSANVLIGCPIVVALGPQLSLCAGWGGPHQQAPTEGAHQQGDIFFPSFEADDELALEPQSTLGGAALQKPWSKRNIFSPTDIIAWPMAKACVVTLMTVLAWHYPVCCHTQGIVSNPVWQHQRWNWRAHPDYSERWSPLRCEGQLPPHTTRQRLSIPRATAHPCGQAQLFPQSSVRRQYVSIDQQRYFGQAKTTLFLSVHNQPEPALRQHPVIFHVLQRPNMCDPTTFAGNTYGIPTSRTLLAGGHATDR

SEQ ID NO: 999488 - protein, 71 aa, Homo sapiens
LHWSSLTRYRGSFDFIYFIVNDIYECVIYLACSYATVYLIYLKFKAIYDGNHDTFRVAGFWWSLWEASLLY

SEQ ID NO: 999489 - protein, 114 aa, Homo sapiens
PPGRHRGRTRETSPPPPPKTPPECAKSPPTGLAALGGNSSPRRQGHQEDLWTAWVYEADDDRLNKVISELEFGKNFEDVHVPRVWASLPSDTCREWGCSRSHACPRLLESPCAC

SEQ ID NO: 999490 - protein, 260 aa, Homo sapiens
VAAAALAAVSQAAPASSGPSPSDPSPLLDPTAVSDIAGKMSDEFSLADALPEHSPAKTSAVSNTKPGQPPQGWPGSNPWNNPSAPSSVAFLEFQQIEKPSHGSLFGDTAHKQDSVSSPCLTAGPPPGPPRTLFLLPDHHVPQLVVLIQPQLCRAWPHRAISYTKYALSRATQTHMVHPQIQLQLAFRSMGIHVFWTLGARNGRAVSYSLNAISISRPISSISILPKAHEDSTNLFHGGTSSTGAWGPHRPYLALQDRIPN

SEQ ID NO: 999491 - protein, 235 aa, Homo sapiens
MHKYVAIIVRSAAIGSREGLCAKGDVNTIEQVAQDTNPYVHEDDKRRRQRKQKCPYKNTRLNAVETTMHRDESWRLEEDLTCAQTQEPPEGNNEKASGARKTEHTREEENNNERSNGSQTKRTAEPGNHPVGEQRKAPQPKTKETEDSKQFAPIKKEGEQQQNDRKEEGADQHAHTIREVKYPDSEKEGAAPRQERLDDARTETPQEEKEKIDTRQEHTEKTHNIKVGKACNNKS

SEQ ID NO: 999492 - protein, 340 aa, Homo sapiens
MRGEEVAQVKTPHGGGRGRRRRGSERQERRARQLASREGPGRGGERRKRAVERTSAERGKKTQGRAGAAEGQTVGRANNRTREEEVAGRVRMGDEERSNGQRAAAQSERRTKRRRRGGRSGGHKRRRKGGDGKRKRADKATEAEKERQKGGEEAAEKGKEAEEKAKRTHRQGGERRQDRERRQEKQKNVKGKRKRKREKERKEHRRNERKRRRKDSRTGERKRRGTKGTREELDKEREGEEARGQRVREREQERKEEDGRTRDGEEPRHGARQRRGRERHGGEERGRREGNRRRKARAETEAGESGQEGQEGGKRRRTREKGKGTRKSAEQGGAKKSEGD

SEQ ID NO: 999493 - protein, 169 aa, Homo sapiens
MVEKIIGHPLPSKFVLVWTFVFYQDVSVDIPVEYPKDRYSYMVLLVDVSMRVNTDCLEYLRMLGLVRCRYLQERLMFGLRYPDGCVAILLLVHLSVGTDQFMELSVVGVASLYWSQPIIFLLESDDDDHSSTCHSISSHLTSSCSKKYMDYIAQQVLVLRRPNRSLQQV

SEQ ID NO: 999494 - protein, 88 aa, Homo sapiens
ASSAEATVLLDVPAAPRVITRRCMPGGLASSGWTVARRTLRANTLASGLHPVFRRTVRGRLMVGISLVCTSRRVDCLPQMLLPTRSVA

SEQ ID NO: 999495 - protein, 288 aa, Homo sapiens
MLKEEQEVATAEEVPHNPGRPMSTVIHILRSDDLACLTMWSGPCSSTLFMNTCCLGFIAFAYSVKSRDRKMVVRRAPGTRLYVTTIARVPENILEPVIWGYLASHRFVLNHHPRCMVVPGPSDKIRQAVIAGPGALTTCTCIPGNIYHFHSSSLTSRRPRSLCTIERWYIHVKSSLALLRTVVPKARVLAFNPLILTQHWLHQNGDLANYNGRVLIGCALDPDRNTTIHTEIADTERTFGGADAQATPHETAPLHEHNQRPWTAAAAPIKNARTRRDIGGAKRQARRR

SEQ ID NO: 999496 - protein, 220 aa, Homo sapiens
MVCPFVRKHSQAKIVTKYVNIVRRSGKKKPSELVRARPVIHRSVIDAIPIPYGSPFSISRRKDPTESRPRYAVQESSRDNQHGSHENRNGDTSRTSRGGHLNAFETSVRIVSTPSYLPRRPQGGTLAKQTHVQRLKQNSARNRATITHGNMGKVTHANVPAESKVEVNQNAPPKRNRRHSGNRPDWQALGDTANELVAGPHDEPDTGDGRHMYTQRTKIR

SEQ ID NO: 999497 - protein, 183 aa, Homo sapiens
MRRTRLRRGMEASEWGGPVIRTPGALRSPQVVTEAGRFTHGSTLMKAMVLMRQPGRVQEIVGALGKGGGDRLQISQYGHAGFLILDMNGCPHQYLGAFILPKRSPVISDFDMTLSRFAYNGQAMPFFFNILDNSTIISEECRKELTALLHHYYPIEIENRKKTPRGGKPPGVFPKKRGGKKGK

SEQ ID NO: 999498 - protein, 142 aa, Homo sapiens
MGLPVTSTQKQLPWSAPCLNQRGESTKSNHFFHFHATRGATTRPTTTSQTRHRNLRTVLPNTSRPTGHWTSQNLFQAQLYPGPTNLVRTLAFPRRHGQEKHPIDNGAPTVPFVRLGNDRTRIAIAPAIASQFPPYALPCQES

SEQ ID NO: 999499 - protein, 134 aa, Homo sapiens
RPTSVSQAGQGPQLGPSRLGPKKHLKRVAAPKHWMLDKLTGVFAPRPSTGPHKLRECLPLIIFLRNRLKYGPGTQAKELETLKRKHLHCSGSLKSMARSELTISLPWLRIFHWGQLGSNFQAILDQGTGSRISR

SEQ ID NO: 999500 - protein, 117 aa, Homo sapiens
MKTTPKSHIMGKEKYDSNYRRNCLLDWDNDRCRRTRRIHVTRGMRDSILCRGSNVLYVLDENKLVKNGALSLKILGDNGVIPYAKGSAHVRSYWRMIDLRTSSECVEAVRGNTANVE

SEQ ID NO: 999501 - protein, 118 aa, Homo sapiens
MSCRFSLRSKLRGATEALSLLVHSYTCDTTGQRHLITTEAGPETTCGDPQTWDDIRTDRWTDQKTYEKEQQGEQPLGQETRGYQLTYIVNATKEERDKMVDHKDGAPPTYSNVNTASG

SEQ ID NO: 999502 - protein, 93 aa, Homo sapiens
GPDRRSRGSDLVAFNHARNEYGENKILGVLHRIQRLSEYVHFRIYSRLAYANSSWATHPSYESIIHDFMVNSCTDTRDASGKTIDYPGPEPYH

SEQ ID NO: 999503 - protein, 43 aa, Homo sapiens
MLWWGARAGHHNEYIEDTAAQEGCVTEENNRVDNTGAAGSPPR

SEQ ID NO: 999504 - protein, 126 aa, Homo sapiens
MGPTNTFGAVGHEITLGERQVYMARKRNGKIGDFNVPMEILENTRKRVGPAVTEDENLRTRRIVSPSRSVSPPIGPVVNGKETRLEKCALGRVKQFSWVVRWKGKTLEPFLSVPTQRNCSPPVFRL

SEQ ID NO: 999505 - protein, 200 aa, Homo sapiens
MVCSKKPTGARRKTGQTENHTRGHERHSGRRRQDHNRRQHPKPRKQKEARTGTIQITKAPIRDTNPHESETHTERRKLRGPLHGDASESEEVEQHNDTGHTPSHTHRSTRTSPRKDSNQGRNNNNGPNTQQKDEHATSYHTTTHREQRSLTKTATSSTDRDAETRKNDSTIEKRSERTPHDKAEAHDRRQTRTTRLQRRT

SEQ ID NO: 999506 - protein, 85 aa, Homo sapiens
LVELGAGGDARSLTLVVLRIDCLHERLQSTSLSCCTEWQDLYRKKLIDTSVRKRKEYSFQKLINDTAVDEDCMDQRLGDVTVLHI

SEQ ID NO: 999507 - protein, 150 aa, Homo sapiens
MPTTLTKHLSSTHPGLGQAQTLLVVPNNLLRATHNLGPKRRHLAPNGLLTHLSYRLFNTLWSLNVWAPFGLTARSPLNQRGLYQPSPRAHTHLFTFLKKPFKHPPLAGPMPSDGKQLYTSRASNNLSYHILSYTPPVWLTPLFTPPFVPH

SEQ ID NO: 999508 - protein, 93 aa, Homo sapiens
EASVKHIVSLSSRTFPHSRVSYAWVLVVTLEPQASTLIELATLRHGMCRYARIIASLFHDNSHSFQLSCYLMIRSPRHLYCRLDDAVIDDDFA

SEQ ID NO: 999509 - protein, 85 aa, Homo sapiens
MVGSQKSFREIREIVAFEAKDRNCTQLQYRPLIGLAKIFDRGRFEEIIVACTKRDDGNRKERQRCVGYREYFDRFGQLRSGGEWG

SEQ ID NO: 999510 - protein, 337 aa, Homo sapiens
MLGGSRARSVRATMRVRPMNASSGDEVMAGRDDGVSVWQPGRATVFMPPAAPGTQKNTNAPGIGGHTCASYARGGRHRTGTRYSPGKPFEGRSRQGHPWAVSSRLVPRKSLEGPGHHASAHLGAVKTGQSPRVIGRPPPGMTADLMKRGRKKRRRTCNGPNQKVPRDWPKVFQENSIAFSAEIVPSCPSLKAISERVRKPYPHETLPGGANNGFGETLGTYPRLGMAIKLAPYSTGKRGYRAGSQHQAWRRRKVPTGGHPTLVKLATTISTPLGVAHMGSDAMQGNKRCQAMLPGFTQHAIAPGTVTTQRQHNGPHHWRTEHPKQTALGRGTPPSIR

SEQ ID NO: 999511 - protein, 149 aa, Homo sapiens
MAAVVVAACGWRGTGGPAGGRSLPGLCAVRSRPLGLGLVYPGSMSSLPKWSHGDRGRPEGGQPDGKRGSGAEGRSSRANALSTNRKREQGSSCWGKGQNPRRGFRQVAALEEKRPVGDFGNSKPMLGGHYPGRRVNLFTSRLVVDNRKD

SEQ ID NO: 999512 - protein, 261 aa, Homo sapiens
MPLYATAVIHFYAYVSPNPLQVTEFIRITSAISRRVTHNAQNQRERHNDALAKPQGNLVSPEDRAPLKALIGHLFVQINSPLKGQDSPSNSGRGDPGTQEFRESVGPPTLEHTEPRTRSQGNGETHNVKSKPISPLRPHFQSQHKFVPVAQFTTYVTHIFFFHYFIKHTSFLQTFQIVAHFLQPHSYCATKSHLPPLEDAHRGHKPFGKCHQPRSTRYPYVGECGNDPVEDHQPDLTDRHRVRPPLVRNPGDDHSPTPHAK

SEQ ID NO: 999513 - protein, 83 aa, Homo sapiens
EISDALHSSISKILKKIQDDYMLMGEADDEKLALFHYAVTPEFTVRRLQYYSYSYNVNYRRTVKIRAKEHDNVYSVLRLPTLF

SEQ ID NO: 999514 - protein, 168 aa, Homo sapiens
GSCGGGGAGGRAGVLECDRLDALWLVRAVEPWSCWTLWALGGAGPGWASTRALTWRPVVCEAPWGSAWTAMGLGAPGLPKTGAGLSGGASTPGVGPTHHHKMAPAESRAGKPHKEIHHIARVKGTREHGDMEREKGDTQDEKDHGHIEPEENGPMEIGRVEKMKVKTS

SEQ ID NO: 999515 - protein, 207 aa, Homo sapiens
MYESRVEIVWRRIELMCRSEMVHPFNIRQHRDYRRLLLQLGIKCSAPSNTLYLSRINTLESSMCHSLVYVINVSRPVFTVSFLRPHQEAEQMPAPCSLYCPAETVKTIKTLFSRHKPKESKTLQTNKQKRVVAGHQQQGPQEKSACQDKPTRDENSGGANKKGKGWSQYAPQTGDPQRDRGASKQKKALAQQDQNNARGGNPEGMKQ

SEQ ID NO: 999516 - protein, 79 aa, Homo sapiens
KALLSWEMSARVWEEPWGLSRSGFAKRCSCVTRAVAGFHCISYDCLFEVERVIHDYMIINLDKAGITVRALKESCKAII

SEQ ID NO: 999517 - protein, 393 aa, Homo sapiens
DLAVLPVLLGLIPLVMHVVLLVSCLVVRRPMRKCCARKTLNGRFRLELVDIEAAPEGPRESYLIWVVNVIGQIKCFIHLYRGFATNCIDDHFDDNHAILLLKHTGSTLSHERLVLAIRDVGSATFLFAQAGTRHLDTLPDTGKLLKVLQKGSYPPWRPPRCLGERWVLVSEGPQQGYMPPFVSGPFSDKIKTEHENLRLRVPMQHAVFAQGRCGCANWGRPSFGHVYFKVGATQGQHCKGSRPWFAEARHVVGRGKVPRTGTRNGTEQGKATCLKERPCNTANYSVPHKRPWSVAPPSERRRRYSSQTGFSLAACLTASSYQNTPRLGRGPATGIGIATELGVELTRKRPAVAAAQRMDCNCNMQLGMSGTAHGSASASASDKQPPPSTLAKE

SEQ ID NO: 999518 - protein, 279 aa, Homo sapiens
MGKNKLHHKPLLDEAVNTHRRGSVASFLKSVRPRTQEFQTQNRCETLFPRIIKLSAVHGGVMFCNSCTLGDLRRCGSLDGHGIGDQPWPSMVKTAVSSYNTYNTKLTHGAVDARLWSQSTRELKGRRITVCTVRKVEVAVSPTIVHPLSLQPGRQSEAWSQKKKALFESDNVVKPQKANETARHWRRDHETLKKVLKDIIMPRGAWQQEGTNQCACRLALQEDTCRKMKEVEDSSPKKNDRREQTSRGGRNRPKGLRGDNIMELRKREQSQRGDPKSKL

SEQ ID NO: 999519 - protein, 107 aa, Homo sapiens
KSGNGVCMIFESLLHRTSASHINDDKQQLRPTFDTVPEVEGEKEKVFEPTFQMQYSSRDLPSHTEINTDRLLRMPLKRFVTVTSGESLEEQRESCCKRERLGIVQPE

SEQ ID NO: 999520 - protein, 104 aa, Homo sapiens
QQKAAGGGQWCAILPRGASPEAEAPGLTDRRGIQDEGVNSLLRRRGNCREEKQNRLMTKENVSRRCSDDPVRENGRRWGEFHKVGVDAKDILERLPVDVDMLYD

SEQ ID NO: 999521 - protein, 123 aa, Homo sapiens
MTHNEQLAPRDKQCVHTDHPSATRRDTHVQYRRAGTTARSRLSQPPDEQAGRTYGHNKAADTQDAPLGRITRWRPHVPDNNTISATHQAPTQYVPRNADAQLCTAQRTNQTASTTFGGQATGS

SEQ ID NO: 999522 - protein, 199 aa, Homo sapiens
MPARLHRTPELQRPGRRTSSAFSCGYGRLLEVDLKNGYGFVEFEDSREPDDAVYELNGKDALRRARDRRSTPGARVAIGDGLQLRKPQWWSVDTTHVGRTSGRDPTTDHLLRTRITGSLYEQLFLVGARAQDSQDLMRQRKRASNLMRTAHNGTDTNLSGCNVQYTLLPPDPDTRAFGPTLGVAPHIQLADILAPMERY

SEQ ID NO: 999523 - protein, 259 aa, Homo sapiens
AEDGRCAPRGPKSELTDVRESADPQGDSLDLESVCALYDMHVTCEAPRRSDAQSMDPRLRDRVYGTLYCCCPLMHPRKSRVMFQTVALCGPCLLVSRPCVIRKLGVVPTDTMCTAWAMGCQKGEGCGQAVVRNLWRHVLHTDCLQSSTRRAPGRHTGYRTHDSCRQLNQRVTTTRRESGHTNRHAREHLHPRDHFHRAHMGGPPMRFPGDQDTRGNGRRGHARDNHHPGRALPGPHDERGWQASKKGPAGWAPRKRGSE

SEQ ID NO: 999524 - protein, 80 aa, Homo sapiens
PDMCHTHYLIYVKASSSDYQPSLNIRMKLVKVKSNPSVPMNITVLIITREYSVESMSNRLSSSSSQNSALQLYLNPLVTS

SEQ ID NO: 999525 - protein, 169 aa, Homo sapiens
VRRLEICFTHNLLSSHVRGVGSRGFPLRLQATEVLSALVEFQPQFRVARYEYLKVEVARRPVEAADNLRSDSRCRKGRLRDMRRSEEFLLRTSAPPCVLEVGSDEGTLAVARNRDVMFPISRGIPNMLLSGEELTVIVPGRKFSLVNGPGYLGGSIPCFRIRPVCFPNL

SEQ ID NO: 999526 - protein, 102 aa, Homo sapiens
MVWVNNQVVIWVPHARTAFKASHGLTSNICVGDARFFERTKHTGAMIQTFHEIRDAGFMWFVDLGGNKCAHDLDSKLLELKVHVVPEELRVCSTGKHYSKKE

SEQ ID NO: 999527 - protein, 213 aa, Homo sapiens
MCEWPLESVSYSIPMAPLCHVTRSTRLVHQEWPRKPSGHATSSDLRNAQWWAVLVRGATVEGQKWQQEQSATALGPEALPCLPVQSPEASRLKGPPAEADLPRSLETLTEREELAREPGPGYCQVETRRGAAKWQPVLAQHRVALELLQASGRPVSHLGPIQAAGPHLEDASFGRIRRVLCDTVCPGRSTPMYWLQVPGSRCLKVGSRNRQVV

SEQ ID NO: 999528 - protein, 165 aa, Homo sapiens
SLATQSAVRSCETWLKYLYANDASLGASDDVAFAISTTRDANSAPGGRLEAVASNEIARMVVYWMVDMTEISWNMRRTPGRIGFQKVSDFASCGREFYPCGLHRAQISEAPSITESQNAFRNKAPFNQAAVDSTKLSTCDPQNTIRILTRHFWLATISDPGYLRL

SEQ ID NO: 999529 - protein, 147 aa, Homo sapiens
LSNLAAAEWSPAKTAGEKTQRCRSAINDGGNPRIHPSDIAASVDPWHVRFTEAVLPRGSSQEIRKFAHYGRMANFAGLLSPLSNSRATITKPGSVCPRRRYRQLLPLTRKCQCCPACSHEYTAYLTDCPRLHTIHKRYNKLSEVCPK

SEQ ID NO: 999530 - protein, 404 aa, Homo sapiens
AVRSSEEPKSERASTEARAASRSADPYSRACLPHCAGEIRPGLPGERAPAACDHLAALIPPTNRHRGPEARAEEEEAMSEAGEGHLPTSKQSIPSREGSATGRRPCRGTSARDPRRCANESLGWGTRVDAPLGGGGEPRVAQVGLTCDAKGNNDPRVEDSCEANGIQGGETRRSHPDLHEEAKRPHRSEEKKTGRDNQRVSRNKTRTGSRGTRGTPKRGPQPGQNARTEGRTCTIQEVKQARQKYVDSVPTDQVEQLTEEEMPHHGKGTCSELVATIKRRRTREQRSRETRNKTGKEREHNTEEKEETRDTGKEENPEEKRHKKNHNEEAEQPQPITGANNAGRGSPRYNTQIKYRTTEGTKREHASREKNQEQRKTHTRSKKKEEEIVGAPDENRDGNEPQQY

SEQ ID NO: 999531 - protein, 84 aa, Homo sapiens
ILEAEGGHYVSHVSLLNYNSRWWNVLTLDQGVTTLSSFQSLEAPLLPDTGVVQSVTNVTYLGLSKYPTLHTIPITRTHSTTHLT

SEQ ID NO: 999532 - protein, 95 aa, Homo sapiens
MSVEEDGYLPSVYIEIPGPEPFSLGLRGPYLEGLRIRGGLPMGSLSPRPMWWLIGAEVRVETAKAATRMRPWSQLWDPVADIRNAEGFRTKEPLP

SEQ ID NO: 999533 - protein, 246 aa, Homo sapiens
SLHCLHGGVGAPASAARDRAGSCAAGRGRRRLKRERDADATVGSRAAPGRPSLAVARPRPWTGSCGSPFPLGRRRPLKRVGNSCPGGPPWAHRSRPSLPPAGCPIWAFLPGGDHTTLGQHTGTMMRENRHRQGIREEPKSFYPHWKDYITRCLFQEKPPGRAPGTHLSWTKHTWVDPPRSVTREHYWSSHYYIFRPHPLIVTSAGENTTVPHFGPPAVQTPRTCGHISRGKFSRRDCDRRTRRRYA

SEQ ID NO: 999534 - protein, 190 aa, Homo sapiens
MIRVLEPLQRLYLWRPIVTVLSCNVLNGPMIPGIPPERANHLTESVPEGSIFFGWDTSSFCVTYRHRNFFFSDFTGYPVHWMSDHLAPCGHQRLEGCGEFPDPRPEDSCTLGHRLLDTNYPCNVLSSTNAIYGRKGFQWTENPAGYQVCYPPPERGRGASISCKAGQDAKIAIPRFLDYSCCETCRVLVH

SEQ ID NO: 999535 - protein, 463 aa, Homo sapiens
AKPSPKPTPPYYQTTLAKPCYPNKVKAHSNIATPGAIAYSTRTGATACNNIITESDNHSTGTNPIYRSAIKCNSTQQINVCQGSSPKQLKTRRRPARSYRKQQLNAERHPDLCSENQVGTALASESEAHEPYPEPWCISVVCPKEEDSLYELQACTSCATRDTQSKIHRVDYTLVKRVVEFPKQGNTQRHIEHHIGENTTLGIARRGTKTRLETKPRLRLSALKDARTTEFTRQGRLPSHQPRRKHNPYKKNPTQESNYSLKLPYTRHNIGETKDPEFKPPLIQEHGKRINSDDKALNGTTSRLESKASIRREVRDKYTPPVQGPNGHCSSTSQPWETEEPTEATQGTPSELAEGTRKPQRTQHTHATSNTPVTQRGTKHPRQHDNGTVRDHTKRGHTGITDDTNRWDDRAHTETKTHERPPGAERDDRETTHDRRESNHTPDDRRSASSRPEKQHRQHKSTE

SEQ ID NO: 999536 - protein, 139 aa, Homo sapiens
MSSQKGYVARSRPQKHQNTFSFKNDKFDKSVQTKKINAKLHDGRMSALYTKFLSGVSTYSTYKPLSKPNTVSSPVLHKAPVKDSYHTTVHGHVPVNLKFCAQMWQRKKTLYSMESPSVAQAWSAMAGSSDHTSSTPLYK

SEQ ID NO: 999537 - protein, 88 aa, Homo sapiens
YLVLYLNDQVRNRYIAKLVSEDMTDMSDVLSSKLFPIGHHQSDLIINSPAMHVYAHVLRSSLTRILKSLFVELTIIDRHYCVLVLSSI

SEQ ID NO: 999538 - protein, 370 aa, Homo sapiens
LPQKFFSSQDFSEPFYHIQTYAPTTPIRRALAPQQASHPLNPLEVPLTKTHPYYSPSGVSTHLSITNRSNRKQPNTTNTSQALPLSTHLSHGISSYYPPTSLRDTSSLPFTIIRTRIYEINIKPVEQQAFLTDYHVHYSAQTFLTHPASFRHTHYLTPLPSKTHSHKGLRKRLTDPELTGHTQSKRSAKQQMNPEMTIPKYHARRGRNHHSKQKQHKKNKSRKRKPKGTNDIAYERAAAGRRGAEGRMIPPEPTTPVQSHCYGHRKRPTCPKAQGDRTNEMDDRRETRDENRRQGRRRQQIKSQTKRQTLEGSNKEAHKHRTTTRSTRAAQKRKQTTRVGMYKNKDGEHTRSQREERSPRTGRGTQKRRK

SEQ ID NO: 999539 - protein, 134 aa, Homo sapiens
VHAVTVGCAEGYLLLIVECYNIIVSSCLLQASIADSPVAPAKFFLLIILAIIGAREQQYQTADSAEKLASWIKPSRSKPRARDTTWERNNLAVQNECRQRDGSDRDAHALDHLFDKWGRARRWYQNLRCRPQVD

SEQ ID NO: 999540 - protein, 251 aa, Homo sapiens
MGANAEEYEELMRMETSYGRSIGNSRSFTCFLKINVNFGIRRTTLILHGLTENSKGYVTKRRFCGRSSGVRQDFLSGAMHEDYKFSRSTVILRTSRGDLNRERRPTIKTCCLKKRVDNQRKCIPIERTLDTAHRKWQNTLVRVHYQPNCSQGQPQQLAQEFHSTQRQYTTHARTRCDSSHRKRGGDRQDTKQDQRKKEGQVRPSGGSLLGKKGSIYTKAKNEREKTDNARETPRYTTREASQSHAPQTRGE

SEQ ID NO: 999541 - protein, 271 aa, Homo sapiens
LSAENRHHYRYVSSKVTERQIGKQRRGHGRCYDSHRSLEIDMEYNFDLGTINAECRIRKVICRHQGNGILFKTGMPHKCYHGKTGRVYNVTQHAVGIVVNKQVKGKILAKRINVRIEATHVKPRLKTTRRIKLPCTTCDTDHTGNHTPKKETKTQTPDRLATPHRSRTTSTKNNIAKKRCHTGAQQTEDAPNEGETETAVLRQTTRGLHKHRDLETDNAQHRRKRPPREETTQDEDEENSYRKGKQRGHTNEGPRHNTAAPRSNAAAPQVG

SEQ ID NO: 999542 - protein, 126 aa, Homo sapiens
DSARRCISWRHLVVMPVACAPLIEQTRGLSIETGAGLGVVYLSGQSKSTKCRDTGSVKCLRQYGFGFGYSKQLDMLHGGIIGYVKARQRADLLAARRLASIGQDLAGLECFTQHVYRIQGTVRVRP

SEQ ID NO: 999543 - protein, 204 aa, Homo sapiens
MANKHKKRAGQETKTRRKTQKERQNETTRTGQSKRQRNRETTNTRHVRQAIVEGEERGDKEERKRRRGETETKREEDKATSTRRTPNRYKKQEQRGEEDKTEDRAQQKDRRHERAEKAARQRQSRKREQEQDSRANYTEKTATRQGTRREEENAKSSEEEQRREEARSKHPATTQTNKQETEDSHRGQRETRRKDKEETQSQKQ

SEQ ID NO: 999544 - protein, 189 aa, Homo sapiens
GKAAAMARSSGGGGGGRRRWCLLLLAPAPAVIRAERPPAPDEHCWRAGCALSLAVRVAGAEDVDALRMPSTTPDSRDTVNIELMLAQEMWPCQGMAPEEDGAAEGDENRNSMMRYWLWHTRQKEQIHLARNSTFEGAWLLMDSQRRYNPLQSNWEHNQASLFFIATKEWPLLKRPIRTAWGTNTTFRHV

SEQ ID NO: 999545 - protein, 68 aa, Homo sapiens
DEEEDEEDEEDEEEEAKITKMTMNEEDDDDEKLVLAQSNEYIWVYREHLSPPCTQASLLLKKEASLRM

SEQ ID NO: 999546 - protein, 70 aa, Homo sapiens
SFRCRDRAPSWTRIHAPGIVACASRSLYPIVAQPFPTWLEVRSIMIDVKTPAAFTNVAYSMGRYSSQRIA

SEQ ID NO: 999547 - protein, 345 aa, Homo sapiens
VVPALDTEPRWGSPSALQGPEMRQWRRHEGAGQPAGHFSARPDSPPRAGREILGGTIIRGLRVNPDTGTLTRRIERAAIAQGEPFLGRPRPHEITCQRSSKRYTPWELAPRTALDMPLYEHEDQTPGVKDTKKDKRIERLTDPGETSGRDVHRVKDNSLAQTPQHNGQLGRSEGSTTHSANETGETTHNAIVRENAATPMEKNTTPDEEYHATYKPSFDTQPPHHEAKMTHGNDHTDNSGISLNRDCGNPLCAIPPDDREVEQQSGSVNMRKHIPTCRDQHNSKPDARRFSQPIHDSLEDNSVLHEHIRRITHISPKITVFSERQPQLRGDNTLITTRYGHRTLE

SEQ ID NO: 999548 - protein, 91 aa, Homo sapiens
IVCPTKQPIWRREPTRVQLEVEINNRLDTVFIDRCSISDHVTSTVSDSQFHDEWMRDSSYNENASQLGISADYIGEEVSYVITASMMIHED

SEQ ID NO: 999549 - protein, 170 aa, Homo sapiens
MREKIVIAVRLSHGTGRTHDRGDETDTSPGHEGRLGMSLSPSASVSKLGWRPLQGPYEKGHNPPLEDFLRKAHGWTPGSRTPMFNRTDAWYRHLVRTRGRFVKTKGITQGHGPLGGAPTHVVPWPGVRTNTSKECFNESAVSNRQQCTSLHGKEVYPGGHYWAWKPVGSS

SEQ ID NO: 999550 - protein, 72 aa, Homo sapiens
YRSSVISVRGPSILVLRTMNVQFRIRIATVFMILCKLYNVYKKLVIKKRNPRKVRWTYSIPGKQAGKERIQW

SEQ ID NO: 999551 - protein, 113 aa, Homo sapiens
MTTGPELLPKPICGLDKQHLLLERMMMMKFQILWQNFDEASKEGGKLNGVNFLKIKTEEVLGAGILYYDWFLRKFAFMGSGEKSRSPNILRHKALGTLAGSFKFGYTQFNLGR

SEQ ID NO: 999552 - protein, 195 aa, Homo sapiens
MVWSYDIKLVFLVGCIVCERLTDDIYEIGDETIERPRRHYCHSSVLPMNLSTIPYRPSKVFSGTRPHSIGKQYEDDHAASDSEPIEISSIHFTARKVVLTVHRIRQTHHYDIVVHDDVVPLKVHHSHYVANRYQERSIVPFYEEAFIQLEFPLILMAIPLRPTQLKRQEFQFHLCIIYMSAFIRNFDFRKQFSRT

SEQ ID NO: 999553 - protein, 119 aa, Homo sapiens
MVIVRNSCVFVPLNTILGQEESDSLEGGMDASGLSEQCHRRLQALSSCKPWITQIDENRIEAFSMSSLKKSSPCVDPGILGIVQFTLESCLFQMKRYVEQGSLIRQSLGYKTLRWLPTE

SEQ ID NO: 999554 - protein, 106 aa, Homo sapiens
MVMGPRGQSVEEHHTVAHMCPYTVKRTQPVLSKVVKSWIHTSQNHFQTSSGDELTIRETESEVGLTVLGRMILLRLRSQAERSGLSHGVTFANTLLTWLDELVLGM

SEQ ID NO: 999555 - protein, 226 aa, Homo sapiens
MNNSVCGQRCLNAHKSSRGSEQAKITHTTATPFFRRYTTQHLTIRSAVMDTHPHKEKRAQKHEPPHFCLRTRVRYGALLGETPCDPLHHPTCHLSMWPAPGLAPQEESVTVRRTTFRCDHILSLVFPIKAQNSPCLPFMTNYGCPLVDITLDPPTLYRAIYGPPVLGATTRARLFFWGAQTTVAEYLEDHRHGADHIRGGVNSISTKRGQLYHQRRAARLVNTVSQ

SEQ ID NO: 999556 - protein, 416 aa, Homo sapiens
IEPRHSSMGDRARLHLKKKKKCSWAWWHDPVFPATWAEAGKSLKSGRQDGWLVDAGRFARHFPSLGATKEGKLPGLQRQKQQHNTRQRTHETPLYAFHTAKGILLLQVKNHLRCVYTSAATHRGAVASSHNHTNSTPPNTQGGGSTGRTKSLVCTHGGKTRAESPGVFTPKEPLFGPHNKHREAENKETPPLFILEPPLYNPPQIKRGAPVIGANKQLCVFDNNDNWVAPLLENDEDDHPTIVLATNTLRPVDLLLNTRTYNSHSVGEAQLHPTSRFNYNHDGGVTTHTCCAYHDSPHNNFVTPRSRHSGGPTTTPYSQCPLDVSRRQNKKQHTTCDRRALIERKRKFECREASKYNRAPTQLLSGQHTDRQLLTRGSSNNLHAPPRTIYEPGVFETTNISRRHIGNSLSHTPPPI

SEQ ID NO: 999557 - protein, 68 aa, Homo sapiens
MHVPWFVKSHQATPSFNCNKTTFVATVAGEPGKWLVPKAQRGGGEGAPMFGRPAPSSRAPAKCRVQRL

SEQ ID NO: 999558 - protein, 104 aa, Homo sapiens
MQRASRLKRELHMLATEPPPGITCWQDKDQMDDLRAQILGGANTPYEKGVFKLEVIIPERYPFEPPQIRVSLLSIYLPTHRDCWEESDVVRVIVLIQSATKEVL

SEQ ID NO: 999559 - protein, 108 aa, Homo sapiens
MLVGQKVIELLRYEDHHLGFSVNRPWIFLSGHFGLYRCILDNFAPEVYYTLARIVCEGELIVVNNSASYITQETQAAISSDIKVQTDYITGYSISAGDTLCLPYPTAT

SEQ ID NO: 999560 - protein, 66 aa, Homo sapiens
MLAARGRGVSSVTLPSRVGPPSFHPMASPCCEGTSITKNQWVVTDYAREYVHTKHEMGYCRCESTW

SEQ ID NO: 999561 - protein, 458 aa, Homo sapiens
MSQPKVLRSQRWVLSVFLARDSGSEPASMWKDEGALPYGVSPIQAGSTVIRLSWEYRGLVMIQHRSREARAVPVYLRMNHMEWTDVLRWRGDATMYEDDLPKVSWFACEQIDGVLQDGNRDSHYGRDFGGKQFITNLGYIYVDEKPNHSPAGPLGTIGTIDSARYFFYVQEKLCDALPDYTDNKCNRIDALNFINTIGFRTFVRRIQQELPKVANRHTRPFGAKRVRRPTDLRCRYPRVAFSKSLGPTCQSSRGDVGTTVYYSLILLIFMRLQREYGEDNCRPTWRSPSSLTWRASTTGKEAPQLFWNRGKRMSATGVCKQRGEQKTSLGRAHPAPHHSHRATIEGCTQRRDVKGLTGTAQAQPGSALRSGKYPRGGIRGVNMRALGHGLATPRNKDCADRGGVEHPKQRTRDREVLTKTRGVIRQREFGRNRGLAPPPQKTAWTSHTPQLGTHKEHV

SEQ ID NO: 999562 - protein, 272 aa, Homo sapiens
MKEEKEETGSTKGRSHEQQKNNKKNRSSNSIQTKTTSQEQAEEETTNQREERGEAKGKKKGEKEEQGEKTRGRERTRAEKGEEQEGGGKREKEEGRREEEQREEREETEDRADRGDEGRRERRRREEKGEKRAAETRGEEKRGAKEREKTRTDERGERRREEKKETERSKETEEEEREAKRKREETRKRAKEKREAKRENESEKGEEGREEQRERAEGEGEEDEKEGRERRMGERRKGEEAENEARKAEEEREKEKRGARGKRQGEGQEKEE

SEQ ID NO: 999563 - protein, 107 aa, Homo sapiens
MHIRAKERGKHIVSWKRSKGIEELDKKKRVCSASPTAKASEAGIRASNSIKHKRHRTATGIKHRSLRMHKGLGEAHGKIKDFRTSNKRLANADKLETGTLGTCMHDR

SEQ ID NO: 999564 - protein, 125 aa, Homo sapiens
MKCRPGRRAHEQRKRGDTTQSPPGIHGTGAARPGVDENNTGNQQKATGKRRGGARRVTPPQEGPERKKPERERRPGTQRNEQDTKHPPQQGEKRSRDNHKNRTSRTHPPGRGPDDQTRMESNRAK

SEQ ID NO: 999565 - protein, 161 aa, Homo sapiens
MQRGGIKVQDDCAAAFFYIERTTVLTEWPGLCFPICLIYRGLAGKERTCMWVKEEVAVEEVGWDDSEIYSKTKLAQGVLQAVMQFNQSCHFGSWLQLISSLCGTGTDFCSMVPIRPAFHTSSTRDKNTKTILDEWLPALDARNTVDYTTPPWSSRDPQEYV

SEQ ID NO: 999566 - protein, 203 aa, Homo sapiens
MGGLGAPEKVFKNHAYGGGGGTTDEAKWQHGVTGAVSPEEESAGHLNQRARGNFPPQIKKTAARGEKTSSESFVKHNIRKREGSSPRERSLYKRGVYLYHTERGSSQEAARSLQKIYQQYIIPRAPARPWGGGQTNNEAKNEKKQQGRQQPNDETNTKKGRSERAARRDQQKGTSKTGKTTDQKDNKQKPSEGQTKRDERTTE

SEQ ID NO: 999567 - protein, 84 aa, Homo sapiens
MVGFHKKKAEVSIPLTRTLKFLVIFACWTNLKKGQTRTRRGYSYAGALKNDCTDYAHLQGGQAVTYWATKAQIMTTEYIACKVD

SEQ ID NO: 999568 - protein, 304 aa, Homo sapiens
MKAEHLLPSHWLPEYSLKWTMKARNFVLLYEKRMATDGCCCLLWVTEWKGYVVRISVWERLNNGFPMYAGCLDPVARVRLLTVRKEVIPVEQTNGRTVRRETRKSVRGCIVDANLSVLNCGYRKQKERRIFLDWLILAVPRRPGGPKRASRIRKAFQISLKNDDVRQYVGKKALRSQKVRKLGPKLPKIQRLVTPRVLQSHTAGIALKKQRTKTNTGRGLQNYAKTFGQREMKEAKEKPPGTTLAKRRRIFLSAKLLLLSSESSQELRICGVTHINYTRVWPTKKQNRARTTLGRPPLHKKFRP

SEQ ID NO: 999569 - protein, 105 aa, Homo sapiens
MAYRKKCYYLVSGPDLSWDTGMMFSPANDCQGVQILANLNVHTDRLYNRASAILAKLAWTNSIPDKQLVKSLQWIIHLNLMEIVVNETYLNSSESYANKHVSDAM

SEQ ID NO: 999570 - protein, 124 aa, Homo sapiens
DHAFHLSRCVFYLLIGKLLLLLALDHVSPKLSPWLDHVWSTHCATDVRAPEQNVIHAVARDVDLRCKDRACLLACCHCWGCDAKVLPPGTCIMRRRDVSGRSAVLSVRCMPGTDCVTLMLTIET

SEQ ID NO: 999571 - protein, 134 aa, Homo sapiens
TPTQLAFVPIFLVGMVTTVLDAESAKRCTLASKGYVSRDPTRKGMANAPSWTTEACVEGFCELAIHYRANIVSNLTEAHAPCHLLGCLRESDSVICVLVRCGDPRCEDLVVVSSKYPGVIGIGQPILACTVKTD

SEQ ID NO: 999572 - protein, 203 aa, Homo sapiens
MRKRGLPSQGIALESSDINTWKGLGVETVVINHCGYPHFAGNILKNQAKIHIGEPSILIAPREQQKTFIQRHQLIYTVDTIPHGLGLGAWSPDSSLLRIEVDRGRTFSNAWVFIPIDIVATNPKEGNCPLFLELLQQHRALMEKHKAYTSVRAGFNTKTLGTFPNLEGTAPTQDTGKHDYSHGNNLLIKGEEASGHIYHFSQQ

SEQ ID NO: 999573 - protein, 176 aa, Homo sapiens
SRSRGGDMLFPSFSCFFSALTTPFLGGINGSPYRLEYAEQFREIDKERTSSKEPEQTTRPSHKRSTHTAPREQQTNGPERTDAETKHDKGRHERHTRAHHHSVKHDAAKRVKHSKRARITQRIEDHKGQKEKPINKKQAGGRMKRKLSQQEARQDSDTHRTTTHKREGEKEKKHEK

SEQ ID NO: 999574 - protein, 113 aa, Homo sapiens
ARTKRRNSELLAEAALVNRARLCGKSFETDGHHVEILAVAYVHVMHCEEWYRGKQQVKRIIEYEENCIAIEEQNFVDDAFWEIARSYPKAEQRQIVINQNPQIVKIMHGPSHA

SEQ ID NO: 999575 - protein, 93 aa, Homo sapiens
TERERREKREREKKKGRKQKEETREKEENREREQKDRHGGRGNERRERARRRESGPREGGGAKRRREREKEEKEERGHNEETSSKERREERRD

SEQ ID NO: 999576 - protein, 133 aa, Homo sapiens
MLTLGALAHRYGRTLDRHLTLRFGYHKITLVVTCPKFNEVAAQQKNLLADNGTDRTTIHWGADSNFGSSNNPSCGINTLANRGVRGNILPSVYHLRLSGGAPAQKERSSHYPRTKTPGGGHYKGKRDPGRPHL

SEQ ID NO: 999577 - protein, 336 aa, Homo sapiens
GHISSGYSVERLVVYSSAELKGSVDISGLQGSSIWNYTQVQKTCLEDMTPGPLYSSPEGSLYTKLDIIANGKLIWNMQGNLVPANISSTHGWVYLALQAAENANIARKTFFALKSRFIASWNITKFVCTTFQVAGTSGPLPAWWDEGHLNGLVELPYNGFLEHYNLDTLKGPLLGSPNTGTSHSTTLIPAKAQIKHCCTPRMRAFTRPTLLLELLPNTRSRLIYHQTSRRSAKKPVPPFSGQVRQLWPRFTTLALGGHLKATPNCGRFIQGPFLNVQSKVGTPLQVAAHTFNRGRGHSAATRAPTPQLRQLGAHKIQLSAGIGPAQGGSQTGFEHH

SEQ ID NO: 999578 - protein, 151 aa, Homo sapiens
MVLSHSQHWRSSRVTLLLNNEVIYCMAYSGYGVHLTPWVIRCHSQYIIWAAYDPEREPSVIMNDNLNFILMDCIGWAAVAITRVANLLLCMYAKDDRGLLAMLNGQGPGFACSHLAGAPHPNVASILTAIGRKLGVTRKSKCTICEAAWAS

SEQ ID NO: 999579 - protein, 206 aa, Homo sapiens
CSVTYVLGFLYPIIKIARLGTRVFLNNLHDVHVLMVITGDLMQSGSPRRDSIQYALALRVISTRRGRQAVRHAWVQFGTLPGPPYTLHSSLRRSSFAPAMNDGLWKEQLSHLLSGETGPSEKARRSYRSVSLNDATYQAVAGQRISSSDIQESRADRLSWGKNPKTPGKAANGPGRNKLEPRPYMRSFMTLRYMTRTEPPSSVTFL

SEQ ID NO: 999580 - protein, 184 aa, Homo sapiens
EDVLRRKSSGFPASTVLGRIPGCSFLDPRAGPLHRPSASVTLFTRNRSDLPHGAPSAALDAPRIYRLTRAGISYNRPAMTDIDVHASQVVGQELPSRISESRHLTAQYQNWKLYDILTFTCSMCLLTCDRRCMCALTELVPKYFRSPNLMQEREHAVRNCMNAAGTNEVADIFLQRYQGNQYCA

SEQ ID NO: 999581 - protein, 152 aa, Homo sapiens
MSKRALIVHVDCPLNVWQSSSEHGLKADGRNSLGKRFLQKNSMINMNVSSKSLESDGIWGEHDVDYLSLVRKNVTLNPDPNEIKQLWLCVKGRTTNELLKKAVSGEINDNAMVYNLLQRLFSLNGADNLNHLTLSLLTMTTLSECEYVGTMI

SEQ ID NO: 999582 - protein, 130 aa, Homo sapiens
MTRVEQYENPPHIPPAHIIALDHASSYLCPPVNTYSNPILRQQESSTEGRKTIRLASPGPRLPILADSGKTQRRGIRAGLRRQHKQSTGPEPDALPTKDTRGHEPKGSKMNRAHRNTHARQDKPGVPGTI

SEQ ID NO: 999583 - protein, 143 aa, Homo sapiens
MEPPIGPYTESSCRIHLGSRCLLYAKGPVTEFHHRQVIRILIARCSIGANTKEGPRLAVLDPVRIITRRALDIAVLFSHASHLASVGTSHIVTERKQVRGKPSNNLRIRSDLSALENARDDTLVSLLTPIDAYFWICLTGQLT

SEQ ID NO: 999584 - protein, 127 aa, Homo sapiens
QCVGPAEVCLLLQQCLDCATDPCGTLFLASDLLLRIILSACQCSVVPSSRARSPVFFGPCPRTVLVVSSLSCETKLIELPRGFSPGVSFATCSVVAQRGAKQRTWYKLCTACKCPPSLSHSRLLGPA

SEQ ID NO: 999585 - protein, 99 aa, Homo sapiens
PGVIPSCAVVLVEQRFFYLLSAFSSYPKLRACNPNGKIRRTIGHEPPVGPRTIFYGCELKADEDYPLQGGLNDEHEHQLSLQEPGHTVSRALGVAHNAT

SEQ ID NO: 999586 - protein, 476 aa, Homo sapiens
VLSWRVLDKRGQPCLIPLMIYESDAAYDPVTPYSLADLLHYCNSSDDSKSHGTRCPLMHTIHVLQPAKRYQADSTAALHSQTTLHYQAYSLPPNRTCVAPGNSLGTIGTPIATADLHQQRPSTKSPPRFRDASLPQGIASRIPNDGSRKRQPGLATIGTYTYPIGEHQFANLEPQHANRPLIDTTNTARFDTTSKAHQHNRPLVRERAKHFTRAPMMAHHAQAKRDTNEEQKAHPTIMDQLRDNAHSLSHSLADHDKTADATTRTPHGNNHHAQPQFGATTTHSSDKKTINTHIAKLTKDVTNNFSYDVQLPVIHRQERRAPPSSHGYNPNQFGSRHNKENADSDHRQIGRRTLGPDQHDAGTDSRHTSGVTTKSGNTKVAQRTKRDTTQAGRAPCSTHRTRYNESTNHKNDVYNRDLRATNKKAERIDQYVATVQKETYKDTRSHAHAHNRTAIGHTTESMTRELNQCWTNITQQ

SEQ ID NO: 999587 - protein, 68 aa, Homo sapiens
AAAELRVGESGGKFVLGRTRRVCGLGENASCKKQLKLEDRALQRDILQNNLQLETIITDMAKHTELAT

SEQ ID NO: 999588 - protein, 184 aa, Homo sapiens
MRDPNERPDEANCPQYVDFVCAKLVGRSIRRSTQMLQVQRSQSFLAKCSEEVEDLVSCYDENGQYLIRLMAEKRDKARFVIVDIGNTLYPLPKGGSTSKEVSIGSQMSPEEGSFGRIRSSFVRLRYLPSKIIMQNHRVAMFHMRDRCEGNWESMWTYITGCEIDKAGLMIEKAVKLKDDMRKGV

SEQ ID NO: 999589 - protein, 107 aa, Homo sapiens
MYTSRMLTQGLGVLLTRFNKFCWEHQGFRITVWKFNQSDTILYGVPWERERNTAITAKHMSRTNTTNGAICSGATGVSADPTPGEGTLFSNTRPVYQCVCGPADAPY

SEQ ID NO: 999590 - protein, 311 aa, Homo sapiens
SLARRSSCQVDMSFFKSLCDGNSTCTHLLVDALRGKTVADPGNAAYVLLLRIISILVETDLIQRKWFALWRSRRMLALSYHLSMPAQIQLVPIPLETVHAGSLDGTENAHDAVEGLFAKVHRGQIQTYSFLSMKFACPQILAGEIVVRALCKVVSADTGLDSSTVDEVPGASSSASARFKRVANSLHDLGGLRCRFGAPSAVIFSMDGPIGHEKNTSWGPSVGAREDKETFLVMAPMGISYRYGPPVKDTSAGRPPDSYNRYPVRIVAGVIRRSGGNPRLVYGWTYLGGLLVSLVLNDLSTVSSLGALGSS

SEQ ID NO: 999591 - protein, 113 aa, Homo sapiens
MCAWGGNLGYSGECSGASWDSRQFSVAQASRCSWETTGWPGHHGLGKFLGDYHNFFWRNGSSGSGPPRLGCRSGRRSGAHWEVSGPQGSMAILSAVRLPQVSVGPTGCPTHTN

SEQ ID NO: 999592 - protein, 77 aa, Homo sapiens
ERRKEVVCRMATAAYEQLKLHITPEKFYVEACDDGADDVLTIDRVSTEVTLQSRKMFLLQLSQDQYWYTGHNPSGGR

SEQ ID NO: 999593 - protein, 270 aa, Homo sapiens
EVVMVAPEAQVLSSVRSPDLEWYEKSEETHASQIDLLETWLYVQEPLKRFGVPFVQETADGTSGVAWACEPWTAAVMVHCVNYYIAVSCINGQTVFPSALVEDTLNDNLLSEQPFSPGRGGLLKKKPLGPPLDGDAVGECANQATGQESLDELSSRASWEGRIFCNRSLLGTGGVLDAPWVANAFKAPQGVLLHARLVFCVAPLLLLEPVPRKSPVCLVCAVLYLGPIFVADCLVAQLLAHSTPGHRRRGTGTRTLDKVVSPELSIECRG

SEQ ID NO: 999594 - protein, 34 aa, Homo sapiens
MARCPEKYLQRPGMSKALNAVINLALVLSAPTSQ

SEQ ID NO: 999595 - protein, 101 aa, Homo sapiens
RTDCGSGLGSVAAFALDPLLVRAPARVSSRPPVPGRRARGAMACRLVTLRPSRQWCVSREASSRRTHGKRAKSPAWWFLSRLGVVVFSTIAVVRRVSAVAC

SEQ ID NO: 999596 - protein, 215 aa, Homo sapiens
TERHDTSRSVTEVSPIDDNAENFYHMHYRASGYDAVDITCELSPYCCDTDELRHYRVVDSEALQGYEEKIRLTWTRYVWLDINGEDGLDSVESRKAPSLSRSNPGQRERLERHQMEQGQGIDISEAEVGSRSIQAWELLEGNRRGHYACPIEWTQQGTHDVGRQKRPRIQHIRSERGGSADRCQCHALLAYCSKIAPSGARGHEQNGGEKGIVTM

SEQ ID NO: 999597 - protein, 235 aa, Homo sapiens
MSKTTGLRTADREMRDRGKAQPAKGTSGTLDIITHMRIQRKACMSTQIANGRHTSMVDLWAPFRRKALAKNQDVSDGRPVNLTLTKGLNSRRYTPILYPCHGHPSEPVNDGDLSRNVAVLRYTDLNAQGNSPQIGGGAETLVYTQRVANQTKNMHRSKGYRSSPSGDNSAECSPGTVLIDQKDAHLGGKKRFRSRKGLTKDLSHRKMWPSALQMCERHALRGPPYLCEAPVKTPC

SEQ ID NO: 999598 - protein, 338 aa, Homo sapiens
MPPACGRHQSTPDARTNARTRHTPVKTARVRSKIAPICLTAPEVRDTPLPPLKYKFCNLTCIPPCQHNTTLGHQHEEHLLASHSSFLDTWAPDEKAATQNLRLTAPNNHHEPSLTVSLEAATRKAKETKGTQRTYRNRHTERRANDQQNPHHNGPPRYGTGRPTIGLGAHNRRSTADTDQKPPWQHTYGTGTYMGKKSNGSRAPTIPVTSKQHPDRTNKATNKDEETRHINAIGNNTVSPHRLRRGNSQLKDNDQRSHQNNGRTSSTPTAAHRSALTHNSEENTWRTERPPYRDPRTSNSRERRERYRRPSDQNSDTEHEHTEPREQRQQTQGRTDHN

SEQ ID NO: 999599 - protein, 111 aa, Homo sapiens
GERDGAGARAAGRVPTRLRRRRRLVGGMAAVVVAAAGVRGTGGPAVWPVSTGACAAVRSLRPGPGARVTRAVARLPSSAPAQGRSPSGGRRLARQGSGGPRAEAQRPKTFS

SEQ ID NO: 999600 - protein, 351 aa, Homo sapiens
EVRWRLLWWLGPACRMDDLLRCAPADASCPCALCCLLCLCLQCWHAWGGPRGRRAGVAVRALLASAGRGRLALPDIFSTAGPRRASARAGGEPAEAFRRDITGFFTKRSCKKSTSNPRMGSHYLHWNWSLTHLLDTNSFQENTYPFFNAFASGMATHPCGAWISPLGYTFTFWHTRQRPFGGILTFILARLNSHKLCIVPFLSPLGLNTPKGLYILTLLVGTLLGGVGDPHFPRKLDGRGHKNRYMNYPESPIFPSITQGTGLLFPSSASNDEPLLQILGPRLNALHNPPMAKSVACDTLSSTHMHELPNVFPDWQHNHSRGFAPQVFLVWKQQPLVFNLANLLSGLPGNT

SEQ ID NO: 999601 - protein, 216 aa, Homo sapiens
APNLRWSTSRPLEHQHLSPRDAARYSAADYDDEEETIMNQEKLAKLQARQCALVGKGTARRKKKVVHRISAQQMTKKLQFSLKKLGVEEESRGIEEVKYVYESQGTVIRLYRTAKVQAISGERNTCTITGHAETKQLREMLPSILNQLEVRTRLTSSTETGRSSAPNNSVDGTSTTCYLGAGMHWLTDSSTISWTTHCMRLPRMSAHLTLTSTFCT

SEQ ID NO: 999602 - protein, 267 aa, Homo sapiens
MADLEEQLSDEEKVRIAAKFIIHAPPGEFTEVFNDVRLLLTNDNLLREGACPCICSSYNLDQFTPVKLGQVMKEQVIDNRTWRLGNMETFSDPKNRICLKFDHSKEGRQLIQDPVKSTLQLNSWRTSVETALRAYVKEHYPNGVCTVYGKTNRWTANHYCMHRKPSVPSKNISGMVVGGPTGTLRVTPSTTQVVGILNIQVQIHEHGPLSASESYRYTKIPLTVVYLAVQTAKELLQIGEAEQLHTDCILRFPDMVTTHATHSADAQ

SEQ ID NO: 999603 - protein, 300 aa, Homo sapiens
GSFPLAGSAEAARCLELAVKDVNQQEFVRALAAFLNKVRECCICPPKWVDTFNAGARHKELCIPYDENWLLQREHVFHSRETCTSGVGSWWFGSNDQRSMGDVERKRMSCPKTISAGGSKEDVGPAVVRPKPLGVGLKDGGRKDRLRGRISGEASGDKERLVDRNPHATQVGKACQVESKATVSRPESNDLGGIITHWALRLRAKKQAGNPLDTKERKRPKKGPKRSPTRGKRGSTLRRLRSQENKYAKVKATRNDHRRRGRGHTAGDTRNTTEEDQRADPTGVRPETRRGGAPPKGGRR

SEQ ID NO: 999604 - protein, 99 aa, Homo sapiens
IRFRLRCERRRVYVREYQCQAPLPAIVPPPGRPPLRMIFLHGLGDTGHGWAEAFAGIRKFTYQIYTARMRLLGPVTVTYERGYAFMVGYYRAFTRFTGG

SEQ ID NO: 999605 - protein, 348 aa, Homo sapiens
MTVTHYPELPHGHINNRNKHQFTYPVAVPPPNLLYHTRPKYISGTITPNHTRPKHHYNYGEWLYTQSPMSRRAPRQQRPKTERRLRHNYSRPTTSLWQRRTHQRQSYANVHTHLVRTRATRPYPRRTQRADHTGSAQPTATRDEPRLASRRPHHHARSKAHVYHIIVNSHNPSHTTHTEEHNPEGTLRATRKAATYAHTTPTKDKLKHHTRLPTRQRSAQPATRTAQPRYRTPALNTAYTYKPNPPLRHLHVRSHTTYGHLNKPNRNTPYLTYKIAAHRDKTQVTTQRPANYKHDNNDKATQRKRDTTRQNQQIHAHTPPNLAADTQNNTPPPHHDQAAQTTPPQNTH

SEQ ID NO: 999606 - protein, 81 aa, Homo sapiens
LVLVKHPRLVIQSVLSSPLFLFEHVCVDRMQYESFLGTSLRIHSRVRLLRDPRGKGACVSSYSLPTEFDYQVSIWRRELEN

SEQ ID NO: 999607 - protein, 101 aa, Homo sapiens
MTLCHIRELLRSCLVPLASSPSKLQRSGPSSNDLLGTGDPALRVSLSRLYRILARWLLSLADLFVSSHWRKGRSSHDIPLGMFIRYATKRVSCGHSTRLRC

SEQ ID NO: 999608 - protein, 108 aa, Homo sapiens
MDFSSSCILLCLAVLVFSCLRLLPSGHLVIVRMCPRVWSKVSRVLSGRSPRPSMWPLLSCAIKRLVDRRPWRMPIFVVLRDSCLVQSFGHAWLLAFAIVHCRRRDISV

SEQ ID NO: 999609 - protein, 69 aa, Homo sapiens
GGLPEATFRMGLWLPVFSRAGVAGLSAWTLHAATGFNVRQYGNFEEIITMETKVHQRTSRTLTKSMNTW

SEQ ID NO: 999610 - protein, 106 aa, Homo sapiens
MYSTYSISLQDNYIIARIIQNDVLTVDQRSVAPSSEAQLPVNLGKGPRCNIHDITWEQIVKTKPIRELNRAGFTLFKPLKAKQQFLVYCEIDGVWTHGMDCCFKRD

SEQ ID NO: 999611 - protein, 193 aa, Homo sapiens
MAPGTHFQLRCKCVLQAAYDNDTVAVSLHCMNRCALVLCLHNTSIGVRTYRREIALEEKAYQMLPKILGEPRKLCTNGPSHAGILWKHMQTYRIAHRGISSASAHGAQRRYISLKSMIGSAYQSSPKGYQLKREACNKEYPNLPGEHWHRPNYGRELSFALWVKVGEPWELRNHGARLGITLLASNIGYIELP

SEQ ID NO: 999612 - protein, 157 aa, Homo sapiens
MGVSAFGAPRLGVAVVARSGLTGEPRLPGFKQISSGLSLPSTLGITGLCTTKPGWFLGFFRGTHNGLKGLIELAVVFEELAILFTGQAVVLQVVGSPHFGFRCTHQADGTSPVFSGNGAGLGTLELVNAIGLSRESWWKNVGFILLECLAQGGPNVV

SEQ ID NO: 999613 - protein, 147 aa, Homo sapiens
MRRQSSRSVSSIGLRRLSGMEWKIFKSLLVVRLPFSLQYLHAVVLFGQHHCHRDLSCISIRQLAYLPTETIVVGSDEISVYKFVSKIRLRVSLFLDDEDYCTMLRETPSVEHADALQHQWPEAACAIIDQWTPGARRLDMACRLANN

SEQ ID NO: 999614 - protein, 71 aa, Homo sapiens
FTILLTDRYLNTSFFDPSVRRKPHSSIQSSYYSIIYGHPVVSILIRTQDFGNNLPYCNLTIVRKEWNHLDT

SEQ ID NO: 999615 - protein, 136 aa, Homo sapiens
MIIVTRNAGDVVSCPSSVAASELLPSWTYCSCARVEYAKARYLRQNPARDLELVSMLGAWYPGSERKLVAPTEQEYIIVRTLKHHVPELLPELMLVCHFMVEHALSCAYPSGRVTVAAPVLYCGIVCGQSIPKCLV

SEQ ID NO: 999616 - protein, 120 aa, Homo sapiens
MDYPRCIRSFAFLMSIRLERPMFDRPLDRLRFELSDFDRQYVLESRSGLMVDQYALIHSVAQDLPEHNSNDKAIPITFGSSPLLSAIHYNTSSDSRPKRERSSTYKVGSIRITPFTSRHC

SEQ ID NO: 999617 - protein, 130 aa, Homo sapiens
MRTGLLGGRRACRQFIENQCSAAPGRRQYVKDTCKKGLSRPFEVSYRMCSNNMLTAVKQLALSVFRSMVSLVMVEPGNDRPPRLVRRLRCMIPRFCYHDRLSVAGNCRMCLVEIEKAPQGCSCLCHAEWM

SEQ ID NO: 999618 - protein, 95 aa, Homo sapiens
ELFSSVNPTRLWHNEVGNLYCTASFSSLASAYSRGVFRRDAQKSEVAHRFRDLGEENFNRPYGVIAFAQYLQQCPFEDHVELGNEVTELCKDMCC

SEQ ID NO: 999619 - protein, 518 aa, Homo sapiens
MCMAAVRFRSTGYIDERSMNSISEVHVNFVTSAFQGITEGTWIDTNRAGIAALQMRNRHRLIHPSHSVEQAQSSSAHVQCGRRNSKNMRGCKRCVSTDDTDHYPLGPAGMLMTCRITYTREACGFPGLKDSATRHNVANVATQHYEAMVDHIYAWGRCSTKKRYVDNPMGVHGHGAVVCGTGYIRVTRRNSPVANLPACRRPNRDEDSIRPITYSSTCEIQTRTIGFDRGFRTVHLTQHVHYRICAYIRCTRVTNHSWISRRGLCIRTSPLQIKQLDVTVNIHQEFDFSTSSLRDAPEQSLLRTDWGHMSPTRSLPTLDTEYNWHKAVYRVYKTKGEYTDRTSNNQAQLTETRTPDSRPTRNCAHAGIHTRGTYRAASPTNAPRETQHIGDHHTTPTHARPAQTDIRTKPKTATTNKRRQERDNRDKETNTADDDHETHEHRRETPQTEAQARDTRAQPHTKPAKTARRVGAAHQATQQRSGDSHPTSRRKKHHRRAVADRHRAPPPPSATRPTRPTA

SEQ ID NO: 999620 - protein, 142 aa, Homo sapiens
MPIEAPDSYNNYITRRLALMSCPQNLRLTKQMQFPDVYTKPLSPLHDRGYTTVKALEICGANNSYIAIVLAMSALKLFDIGARIYPIAPPVNPALDAKTEKHNAETESRKNETREREETKKEKAGQAGERKHRQNGEGEERE

SEQ ID NO: 999621 - protein, 162 aa, Homo sapiens
APQLQAPSLTWDSESTVPSSVSWGILLLAGHVLPGSLCITGLRSPQGDDCPEDRYNAIMIMDHANSSGQDHPHPGREFAHAAVVSVSCTLPCPTSELLSFVLPECSICYRLMLCSPWGPRLTLTDEISWRVVNLRTHQDIPEAQIHEGFQWNSIRYPSKQSD

SEQ ID NO: 999622 - protein, 66 aa, Homo sapiens
SPCMQDRSHMPYTDAVVHEIQRYIDLLPTKLPMHADPVSVKFYINYPHPQGSRSIIIIPDFCVCHK

SEQ ID NO: 999623 - protein, 247 aa, Homo sapiens
MRSRSEPLWPLGGVTANKTTMWAPLEFSITPGLFVVNMGESPGIMEMARVPQYGTPYCLDNQVLEDRLKNGPRSLKRDNYPYFQDSELVPLLTNFFFGQITWFRQGEVLHNFFSRNAVDTLHGEFGGPLKGRRAGEYNTLCVTNRVGLPNLHSETPWGALTNQGGRGPQGHSTRAHLRDTPQGGANWRRAVNPSFGEKDPSGEKGAPILLLHNTSPHCENKKNNARRRTQTTRTSPHDRASKQYTQT

SEQ ID NO: 999624 - protein, 110 aa, Homo sapiens
MTRRYAYESSPGFVNLVCPCELVIHGKPSGLRRAEPYDVCEKKLILLVLRMIVESCYTCSHVIQLWSRFTTAENVRSSNNEVSSSVDFRAYSDLSRAYSLFSYNTQGRDK

SEQ ID NO: 999625 - protein, 139 aa, Homo sapiens
MAPPLTPYGSSQYFFSNHLTIQGPPMEEALTNTDKNKQQNNERQTQCCCGGHCRPSERRVLQEHHLRRGSPGAPPMAHSAEHLVHRGGSTKKNTGGNKTTGRETPTPLKKNARRGEHTEAFLKQHHTESARAGAKQGGV

SEQ ID NO: 999626 - protein, 77 aa, Homo sapiens
VYCENYYHHHNMTVCYDDPNRVSLTPLRDSITDNVVRTIPNRFSSHNQSDDWSDPTMLHSRCIVIIVIHDVANSVFG

SEQ ID NO: 999627 - protein, 104 aa, Homo sapiens
DPPYHYDYQYSKSQSHEPVTGALSARRITGPPALDHCGVVICSIPSNGSLNSIGAYLHLIDISGLIYPNEVAATVTTSKSDDDRIGTIQKNRSSHDDMGVRIRD

SEQ ID NO: 999628 - protein, 172 aa, Homo sapiens
MISYGNQSGMSSLCLMRVARTGAAVSRQESLEYTVACYLAYNERWSLPVIVWMLVKRFSESGINYEIIVIDDGRAKMEEWDVLLKHVGRRSMGSEHELLAIVPPEETPVGDLRNLTYYSSDMKGMPRGMLSLNLLWIGDVLCNDDSQNVYFLDTLVRKAKWRDNMFDCWSLE

SEQ ID NO: 999629 - protein, 43 aa, Homo sapiens
MRVDSGPAQILGGNADLIGETAIGIGVGCHHYPVTSHIYMALT

SEQ ID NO: 999630 - protein, 108 aa, Homo sapiens
MAYIIRSYEYEKRVSRGVLHVSKASRIQSTSAITPRLAYSYTRHWAQLYFSHRAPSSMTFMRELMYKIIEYASGEDTIIWSRTYPIARCPIDSLYVRILIIAHPHMSA

SEQ ID NO: 999631 - protein, 132 aa, Homo sapiens
MRSLLSRRKQKTHHRRPRHNSFLCGARYGAPGRGEAVFLHKHQVGVCGARGAHTWGVTAQRRAHKARATDEQQTRAQKQDGVVKLHQNNKKPPGSKPKSCRRKTTKRNIERPKTRSKTTRGTQSERRKTKSA

SEQ ID NO: 999632 - protein, 169 aa, Homo sapiens
QVHDIIWLKSNLRASQYRCPSSPVTLGCLTSLMEDNFLDIRCQTENFPRTMAGDRLQIYERVCVKLRSHVNRTVFIYLRNYLHCREPRSLRCSKHTASVILTDSNLHDEHLIYHTLIRALCNIWFYVRISLVSLGILFAETHLQDIGHVQMHELGTLALRVVLFVHVTS

SEQ ID NO: 999633 - protein, 424 aa, Homo sapiens
MIAYDAHSFLGVRHAPLQLMPSLGTTCCLDELVSYEVRDSVPVLIDALMSELVVYLDHFVIAFELKRPRLSVRTCSISIMLQLFNASVCIIFVGHHSMIDIGYTSCGHLDQDFLRISTLTYYFRKEGHKADIYSMERTSPLKGLCYRRHIGTYRKEVMEHRDLLSNGFSKLSTFLGYRKPHTKRFTHDVFSEMGTLKLPWTTHKGLFSTHGELAPLCHRTRQHKLGGYAFRKAFRGGKAFRRLAKYQTLNKVIRPVVKSYLWAEISEHFSGGTTKLRGILVGGMRTTLLLTRGWFAFWPGISTAGDNFQTRFSGRSTGEPHRPVFMSVARPVWAKLVWTPTVVFVRSTGGKQPMVGKLLPTHLHFGRRESAKIRLFTGTLKRVKDRRQVSPPNIYWAYGRSKRDQRATMIGQQRQIVIRRGYNR

SEQ ID NO: 999634 - protein, 80 aa, Homo sapiens
DCAALLRDCILPRDMRMYSCGSAGTLLTSSYCASDVSLSRVEALRVGSRSSGSFSWYLGPDTLRLLPVMSVLRDPALRLP

SEQ ID NO: 999635 - protein, 70 aa, Homo sapiens
KKLSYVNLYYALGGKALVLDYYGSKMWASYQEFVWIIVYGIVDDGLRRKTKEFQVMLLVNDRGCVDTGEK

SEQ ID NO: 999636 - protein, 153 aa, Homo sapiens
MNRGDEQGEKRYERKIHLKGRTQNTHKEKTRTPTTPREKRETKDQSNKNTRTDKRGQNRDGRPGREQKLYNSREGNGDEGRKENGRKHKRNEEMNRGDEKTIQPRTNFTLDTGRNPSNQLTGRTRPRNQHISQGEATENKTHKQQPRTTRHDT

SEQ ID NO: 999637 - protein, 162 aa, Homo sapiens
GSRPWYWITKFFVGALAMPNHLSKTNTQSETEVSYDRCIEMVLLNLSITPIGREVKKTTRMISIEATMPRVFDYEEIMLVVHNHTCPARVLVAEREDHAMCSPARGVSRLEHWVFGKQKRANENNACCQRVAHLWVLLVGTSLWSRATSTSVVLVIILWVHQ

SEQ ID NO: 999638 - protein, 378 aa, Homo sapiens
TVLQTERLRNPTSLASSTPCRQRLRNGENVISAWLWGLLWRTGVLALSGPRASPNQTALDEENLIQESLMTGGTQPWSLRDLVLLRLTWTSAYQALLQGMYEAVKATLIEVSSSSQPSGVTRHYQSLECFTLSFMGSPSKISYTMYRKIICIGHQKVQTMQRRSSREGLDNCTAGWHFQAGLPASTHSKCKSERECKSASLGGYSGKMPDGQDGKEAKCKDLDWGPGLQRGSGMPQRRACNGACPGPGLCGRQRWNPLCTVAPSSAVGRPKRKGVQVQGGTLGLGKDNRFDLTWGGTHIPTGETSGLPWGTPWNCPTCKTNGCGSPGVEISPVMLSLKGPHDEGGSGPFWELLQSMSLDPGRGRPNSQSIVQHSGGTT

SEQ ID NO: 999639 - protein, 120 aa, Homo sapiens
MSGGPVTNVDCIRLPTVVWRAELGMCRSQSQHSVRQSYPSLFASPKSCSALINWTIDGKTSDVKSAEGVHATETTMERGGQGVAPDACPRQSLSEFPFIRCCKHFTYRPWGVISIYPSNV

SEQ ID NO: 999640 - protein, 133 aa, Homo sapiens
NWDVCADMVGTFTDYRGPWPRFKMKYWGVASFRPEKVEGVTTGIVDYRSTTTYAVQYSCRLLNLMAPVLISYSYRVIPVGPQTGLTPESCRQIVMACGKEELCLGRQYGLIVHNGYCDGRSDSKPFVRNSQRI

SEQ ID NO: 999641 - protein, 164 aa, Homo sapiens
MPSDFAHAQVAMETHMAKGRRVGEVPMDSHRGATGLCPKTSVANKGRLKAEAGVKLLIETRLEQLKPDIFLRSTCAHIDWGLGTTGDWGPRSVSKKRTNLGWGQWVGISPTKTKRGEFPLIKTQRDLGTPFWCSLRWPHTQQFRAWGNLTEASLGKRHTRAGHP

SEQ ID NO: 999642 - protein, 116 aa, Homo sapiens
MSQGVNRQLRRVFYRGDAMVHFEPRMDKNAREEAVWLQTGKGNREDSVDELNNNVEAVFPGPPLASLSVTVYVAVEGPCGIRGVREASEKDEMNKVYKYQLSTALQESGKVEAYYI

SEQ ID NO: 999643 - protein, 228 aa, Homo sapiens
QRFSMMGISSVDFTKSNLSRAHQNFLFIVTCPMEEDGTVHSETTLMAVKTLTEDGKDYDNGFWKFWSKNYGEYWLGIEGHLHFLTTQDRLHFDKSTLQIVEQISAVMHNDKTFHNVGDDKEVSTSLNIGEVLLVTAGDSLAGELVILRCSGGLVTTDIEIQHVGQSIMTTMTGNCADEDQSGWWFNRCHSANLNRCILTADPYTGIPDNGIVWYTWHVVVDTLKSVVM

SEQ ID NO: 999644 - protein, 105 aa, Homo sapiens
MLTLRLRRISTMNLSRCSYRICEYPKSYVAHVHSYRVPFRETMTSFEQLLQDRIKSIYNNAGKMVHKRGHLKLRERAESLKNINLLIKISEEIEEYFCTTTKTSI

SEQ ID NO: 999645 - protein, 132 aa, Homo sapiens
MNEREAKVRKESEVDDREKDTTRAKARERKAKVESKREGEREPAQGKSKEFERFYEGPLYRKGPLRYGKLISAIDFEVMKGLYLLGVFQNGKFLTLEVEFGIGEILRNLVLNGIGLTKVIRIQRIIGSIAIT

SEQ ID NO: 999646 - protein, 368 aa, Homo sapiens
MLKEVYTKGNRVSPRDSQLKHLKITLYTSNIEQANRSNIDRNNRNIEIEHFETPQNDRTLERNTRTINSSIETDRSNTRTSQHACNWQLHCTHATCMTVHDNANGCKCKSEIVTIMQVTHATECTWHMQIACQMHCNLNTACTHGMAKSNIASLQNSNATHAMQHGTDWQMHATMHCHQALPRYQDWHSTLDIGTLQTPPCRHCNNKSCKPWQARQTFQVEKMRNIASTGQQVNANVAQSLATMHTRHTIACPPMRQAPPRNSDQAQGHEASQTPATRPTEHNDANYMTGRLPRCTLAATEGHRTAQLQTGRQQGETQRKRRKPSKAGTKTAQGQQKARREKRTGTERRQTQTRKKHERPGAVNMGPT

SEQ ID NO: 999647 - protein, 107 aa, Homo sapiens
ETVLTVQGSETTGISDHHELVLDTPGNYNSLLLCSYMFSSSPMCYAYSLLSTRQTDSSISKMYIRYGVQCICHNLTLMVIPSSTFLRSIITPTIQHVTTTRYRHYAL

SEQ ID NO: 999648 - protein, 163 aa, Homo sapiens
MIQLTATPVSASCGLSQMHYSNATGLIPFQMVSLVRHHWKTENRYDMYYSQAHLYGTNEFGRGGPEVMLTSLGGDHMGVHPMGLFWSREDLICYELRLLKRDVMNRPFQVQVKVYDLELIREQYQLPSASKGQPELCRGGMWQLVSHELRSEKADYEELSYCD

SEQ ID NO: 999649 - protein, 121 aa, Homo sapiens
MRVLETVIRAGYDVSTWMKRLVHWFHSIDCYNTQVAQYPGINPNFLDHERLWSRSAAPQWSRITVMILGYLNLGHAYSTLHKEYRRLSHPGLHFFFYLCETGCITQEHSNTQPTKHWWDTH

SEQ ID NO: 999650 - protein, 134 aa, Homo sapiens
NSININKKDFHTKTPSEGHQHQRPKVDKSMMMRKNQCKKAENSKNQNTSSPPKDHNSSPAREQNWMENEFNKLTEVGFRTWVINSSKLKEHVLTQCSETKNFEKRLEELLTRITSLEKNINDLMELKKHSTKTS

SEQ ID NO: 999651 - protein, 372 aa, Homo sapiens
MTSGARMGLAVPHKCSPSDEVPGIREDLVETSYSTKRVTPCIVLSHYRFAGADVNCTLFESCRSIELASCAILKATPESYSLTSVMLTHRELSGVSGLGIENALEHSLRDLGRKIVRWRLSLFALVCRDLARPQRLREIYRVGTNRLRLWRAPIVVRITPNSKILTHINAHSHELTHISTDSGDVIQLRATFRETNITKLWARPFPLVATFLVVYLSGGVGSYFMVVGFLSMGCGPFKFPGQRVCFVSPFSNLVYFRYGGLPPPRCVPGVVVVREPKWPLKSRGLHLPPLFSLTSKLVCLVPNGNGIMGLSLWRFETVFDPDKWSGCKQRTLGTLARHVDAATIFRIAAELVFPTYKRGLPIRWQETAPQGV

SEQ ID NO: 999652 - protein, 179 aa, Homo sapiens
MNSLFGSIDVQPCSMKHYPANKVLTDEQELRMDFTSRKVCMLISSRFIYLSEVIIMHVCSTMHDFTVLMSWYCPITCHRLQGEIPISFYTQSRGGPQLPSVDMELLLSLAGISPSPAKGPNDRPMVGDPKEAHPCYSSMDPTVLNVSRKSIMNEVFNDVDGGSFQTVCRSINGRLIQLP

SEQ ID NO: 999653 - protein, 132 aa, Homo sapiens
MDRTYHPNTINAEGTDTNYCLDLSHEITAPSTYHGLNCIPKALTSCAQYALATCNGSAHSDSFGGISVIERRHARFTPRIHSQENPIVQVPNILLSCSNGHTVVCVKPVTQLALWYTTELQLLLRRPPPTDS

SEQ ID NO: 999654 - protein, 98 aa, Homo sapiens
MGCEQKGLYRASQGPWRSGSRSPCKNPGKKKDSEAEDSSRKRKIDSSGGKGRPPEREGLKETTREMGHRRDTQKRGETTTVGKTGGARRRTGGAEARE

SEQ ID NO: 999655 - protein, 125 aa, Homo sapiens
MVKLKSFCTAKETTIRVNRQPTTWEKIFATYSSDKGLISRIYNELKQIYKKKTNNPIKKWVKDMNRHFSKEDIYAAKKHMKKCSSSLAIREMQIKTTMRYHLTPVRMAIITQVRKQQVLERMWRK

SEQ ID NO: 999656 - protein, 134 aa, Homo sapiens
QRAILYKRLKAASVRINQVRPECPCDSPNMRTSGVLNAGPYKQYMTYETRSEIIKKDKNIKSNNKIFVHALERTRRRMVVYEPQHLHRERGATPLVGQAYAWVAYTAEHPQGGNDLACPFEAEKGVRRICRSPR

SEQ ID NO: 999657 - protein, 373 aa, Homo sapiens
MGLTLRCSHNPPTRHGNWASHPLPRRSAAERRQRRGAPTESDMEPHLPHVKMEEKEREGTRQVDKERNDTGMTQSHTSPEKTPDEKTSRVNDETGKEDKSKTREQDHDNHAVPHQGGNREDKKRASNEDRKDPHVQERQRHRHKSNGSRPDPSARGADGKSRMEVRDGSRGTIGVEYNNWIRSHGSELAVQSAHAKTMNKAMSARRGQTARDVIDNADRQKQYAQGDEVDTEGRPEEGDLTHKERAIGAPKAEWITRQCEQPAESQGNETYRPADLGASEGDRRDGEAGKSTSTQPKGETLKERQEHTDQERETPKEKAPGHETEDGTDKRGHQRKHTPRHKETMSSYNEKTTAKPHTTHGMDTDSKLESAQI

SEQ ID NO: 999658 - protein, 84 aa, Homo sapiens
GLIDLREEREWPLPAVQSAGPLAAASRSSAGRPRVRGGDNEDSGGNSTSWCHRLMHCVGRESVFLEGLYGPPATNETSVYLERL

SEQ ID NO: 999659 - protein, 80 aa, Homo sapiens
VDHNTRTTTWQWPTMESVRYCEQWQSRMEAIAREAMHTSLTNDDLYSDSMLAAETHDPYGPLPPGWKTRCGFCRPGVLTL

SEQ ID NO: 999660 - protein, 140 aa, Homo sapiens
ISDHDGAYLSDFIKLMTEKKKKKKKKKKNKNIKTTKNNTQTRKKKKKEKETMWLAAAAAAPQRRDSLTPPSAGGGRRPQIDNKTRTTAHKMYAQKKRRLEQTNKRGGVLSPKKNKRPAGGTNRLWLINKPRDEGRVRESK

SEQ ID NO: 999661 - protein, 289 aa, Homo sapiens
NREMWKELKKPPFVPNSTLPILLLQPQTLSLPALPLLTAWHLSNQLSIFHAFSALSVTKHKLLLYILTLLLLCYYSLCALTTIQRCAAGLTPLYNSRTLGYHPSRVFPQLMLERGPPWLWSQQPALLTVTFSPSPLYLTLLIAGYTLSKLSPNTRVTGTFPCPLGSPTLLLIHDRPAAYIHLNATNLLRLQLNAEQLCNLCCAQTSPPHPSPGCQRTPRALYCLSNSLHLEQGKPLNPRQSDESSPVDSYPGHSLEWESPFDKLPPPRARPAIKLQASHACLKQQPNTP

SEQ ID NO: 999662 - protein, 405 aa, Homo sapiens
SQAYWLRLSSDSDLIKYGPIYASCTNLSKDKQLLTRANDSKLRRLYAKSDNARNTCEEQAVPISFSAITSMAYYFFPQLRLLTKNLSNPELLRLTSSLTDNLWTLQLSANHIWRMAGDRVASSFSPLMKSYTDISPSNWTQPHCSGPLLHAASHTSNGRDHTSQAIPQSLSFPPDTTPPWGLPTLLSQPHNVCRHNALSIYYSSGSRLLEPLSTYGQVTLPKITNRFLQHSPGLCRPSLGRTRNPPHLGPISSTSGQLAATLAARPLNIGWPIPPQLGDGQRSLLTTLCRSNRALDAYETFKFNRYLKPTTQQVFPCYREGGPLGHLSGYTGNFSRPLHTRQPYNPSLHNARGKWPLQELSIGGYDHFSRSLRHFSIQPHTNANPKITHNSSFMNTTYGELLPYV

SEQ ID NO: 999663 - protein, 119 aa, Homo sapiens
MPVFPNQRHNDNVDYMTNIVRRSGNRKPSELILPCQSSYVLIALRIPYAVLYIEQTGQLIAILLPLNISLGTKWYCTVRRYTELRRYVSRSSYLHYLRPLVPRKPGERYRNPCTLDKSQ

SEQ ID NO: 999664 - protein, 475 aa, Homo sapiens
IVSAEAKSEVLSRAVALLHLIRQPKLGTAYRARADTLQQPKRLAWQTSRTPIEQCTLTPTYPGTTLNREPEGDMVLYCPAVVGAEHGALPRAGKLRAKLVQLGNLLRPLEGQNPFPNRVNPVGPNFLELQPRSEPAPQSELKGQRTVDLTWKDRTIPPATYLEEKPAHQQISQPKFQEEETVTHAKRAPIKGAAKERGPKAPNPGEHPNIATTTRLGLTDPPLSYPPLPLGNPFVVRTKPPHNGTRHHAYYTSKLLKHGANKRETRLYPRPGALLNTCPWQRPPYQSAHKPLSPANPPPAHPRAGQRQPPTFGPPPLRTPGRRTHCATHTAPRPTTIGRDTPTRPPNHPHHHPARAPHPPRANARYSHDSPNPNAGAKRTPPPWRRTPQHDRANLPLGTRPKPRLTCHTNSGNGKSHERAGRNTPRSQNRETRSGPHLLAQLQARPATTYMGAAVRKRHAGKRTIHAHRYSEHIA

SEQ ID NO: 999665 - protein, 258 aa, Homo sapiens
DNTRDPAAKRSSLKQWTRKLAAQMSEADGREDCSSYRRVHKRGVEDDAADGHWITSWSTVEATYLRCCHGEPCTEADRRSLICGPARRDGLVKTLDVDMRMTWIGAGPTRPDNVCEIEEMFDRVVHPNTILPKKPDELNQSPLMLFGLALKALLCSHFTILDLLDKVLHVLFSLIEELTKDSELLRVGFHGYGETDFLGADLGVPKVQGDPKADLCASNGCYQATSPALVCFTQPDKVPTDIRRMQHEECVKATTMRR

SEQ ID NO: 999666 - protein, 228 aa, Homo sapiens
NPFSKKAGSRALSSPPTQKGAGEEKAAAFCAGDSWARLLIFPGCFPSRVRSVLRLRKEPGKWSRPGREIILQRMMGRWYPERVTQQLFLVTLKIEALQCSHRSGEVVKRSRLLQTYSLEKPFGESPLRRTGPRLPSQTLDEGTVKSPRSNGERSALKRASYFLAGSACKQHVCRPDRRGTSYKRQHVELTGRTWQSLETQNSRTRNSIWHKTWADVENLNSQNEAELR

SEQ ID NO: 999667 - protein, 172 aa, Homo sapiens
MRGSKRKPVTHSGESLRNVQIPVNLNYITQLPGRHRALAPVAQAGTCKRVQAPAHWEPPMGPKQILSGPKASLSSGGIHRVHHQSKGPGLKLGGRYRGYERHQAGFGPGVGPRGPHGDRRLRESPERPQDGGSRAWPSRQRSRKKEQEEEVTTGDVEAAHTGPEASRQVCAE

SEQ ID NO: 999668 - protein, 72 aa, Homo sapiens
IVLIPPASHVNSAIDVLIGRLLRVDRLILQCNADVSRKNERKPALSEYSNEERRNLSCNRGHDIEQKGLTLA

SEQ ID NO: 999669 - protein, 103 aa, Homo sapiens
QLLRTHKDEAKIPRSCSTVNRPDTHPAIKPRERSAMDYYRKYAAIFLVTIVWCNLRCAPFRCLMMQDCPECDATGKPILLPAGCPNTSVHGLLLSLEQYSHFH

SEQ ID NO: 999670 - protein, 122 aa, Homo sapiens
YCRSSPLLCTTDIYVYIPSTLITAKIITTRLGRARMRVLTALKPMVLVASDIHGFVICCLMREIRATVIVLMVWAKAVWPDSVCNLQSSSYLLTNFHGCSYSVRNAVHVLDEEDSFSCVRMT

SEQ ID NO: 999671 - protein, 227 aa, Homo sapiens
FLKLTAFGNGDVIGPLGPIDCASAAYSLFLAWMLSSVTSKDSGVLYSSIQTRAMESPISMNCYVSGLSIPITDLLEVMNVYVDMTSGEEYFRNITCGASFKDIMDRIASVTGNWDLFLHSSYCHYNDWEISIPSLVKTRNAVVALGPGLTTIGEPILFTERQHELGIKLWDSEVPLIYVQQFNGTGFDNESSRQYLGLSVLLHKLPREFLPYAGGLCLLTNCGLLPL

SEQ ID NO: 999672 - protein, 257 aa, Homo sapiens
DYGLCFWQCDSLVSSEIPRLQNPVTAFQLIIRGLWKRAHALVHILIKRASGTRKTVQCAKCFEQTIKAQMPNASTSSSMNSGNEFEKEATFTSILNTVILLWSLVAYLPLLVVSDGIPYLSSSVGKTKSMGAFTSARLCVLNTKSPSSRENLWDFCGNYYKLRLAISKMLRFYPFFYLAIGSNLFVLRLRNFLQLAFKHSVGKAQTLMTFTSIFLRRSPIIPVNFPATSESITWGKQTGMYKSLSPWLLLNHVLTKL

SEQ ID NO: 999673 - protein, 107 aa, Homo sapiens
MLMICLPYGRYQYDVVAITSEIEPDEDDSMDILEILLNCKSVQEPFSTMCAFSGTNKWVLANWGPGRLMDGVTVQPSYGLGHRGTVAVVHIWCDTEAEGLLVYLPEW

SEQ ID NO: 999674 - protein, 162 aa, Homo sapiens
DPNTQELSPHNKIRLTALFIDRRRTPLQASSDSDETSDHSLDDLPDPSKVTIQDYALANVTISSRRLRTCFSLNRPHLLADVYYGLEVSPYIHLTAKGRLQYVFICPLPEHIVSARYIDAIDFSDSVEDLKHRPGILLLCNGIADEVFIRLWSSREAESYHP

SEQ ID NO: 999675 - protein, 160 aa, Homo sapiens
MSEWTMSYLEWQCAIVISVKTWYCFARHGLATILHLDMMARLPGIHKNAFVHFIWTHRCVTRQTIHIPIVNPENCLMSLYVSSYMPARKTRGYDGAWITLDSYVLVQYWINVWDTEKLYRLEFILNKLNCANDMKMDKVRSRQGDSNVTYQTRSMSVVIR

SEQ ID NO: 999676 - protein, 42 aa, Homo sapiens
MQGHGKKNRDMATEHHEARTLTTQTRNIKAPRNKQRSSGEDN

SEQ ID NO: 999677 - protein, 97 aa, Homo sapiens
VSLTPVVPALGEGEEGGSRGREMETILTNMVKPFSAGNAEIGWAWWREPVVLATREAEEENSLNLGIGGCRARIAPLHSSLAIDRDSVSKKKKNYQF

SEQ ID NO: 999678 - protein, 633 aa, Homo sapiens
PLTLICRKRGYTGTMHSENGLQNVRYGDKIIEDGESRTRKLRSNRSSPYTTIALADRNDIECELWRIATRADDAHSTVHRQILSYQPCQELEGTLKGPGLLYVGTLLLVLFYLGGEQIATFALLKKCRLRRKPWTLKEPLRLVCSVYGVGEDNPITVKGDIGYLYSNPSAIDCKRNGNAKSVALAQDTCWASYIDLLVAGSRHFLKKVQHLRNLRSIGGGVGSRPYGNFAKTLPNKHFGPQSFTLNVNSGLGVSARTFTKTTTKILIQHIEINPVEGGYIKKLSREETSDSLGRHTYERYHVGWDVQIQGLMLEIYGTRDWNLRTPRETRTPRKGNIGHQRQETARSRQRDVGLAQVVRTTVLHKNGTGLRHTLEDTRDYFNINRGSDIQENNREEAQRANKEKTQTTNDRHTRQEWAQETTNRNRAEKAYSHNRHPKRGARKKSDRTDTTNNDKGTNNYRRANEHHDEQKPRRSDAQDSEKAPRTITKVTTTTIARLNMREQTMNDTQRQNTHHKANTTYQRHINKQKQVKKQSTSQTQEGNKGPRKHSRGSTRGDSKQEEQKTHDGNRHKNRGEKTIAASSEHTNVTDDKERNANTHRTIQATQRTHNDDAQGKQHSNSQQDEHTRTRRKT

SEQ ID NO: 999679 - protein, 243 aa, Homo sapiens
GSSVLWPPSRNRLGIRGELQLPVVSSLTQPISISLSFWVSCLSLSGSLSEEEREKRTEDNKETAKQRKQKQKKKKKKKKKNRDGNERGDDARERGTQPNTTRAKETTARRRGARRQRRGGREEAEEKGAAKTEGRGQQAEEERRRHNGEEKKGEKNANARRSEGAEPQQKTTKRRPEKAKSNRREAERRRESKGGKRIEERDGAERTGGRERKRRQNREAGRETRADSGGGEGREERTHRRGQ

SEQ ID NO: 999680 - protein, 32 aa, Homo sapiens
GLRNRTLSRLLRIGVRSGRLLSCLEVHVLGIQ

SEQ ID NO: 999681 - protein, 79 aa, Homo sapiens
SYLIGVKSMIFFPQRLTTVYPECPDVNSDYPDAIHHMTTVLFISEGFISFFCLAAVIIDLIVTIEFDECLTAYECENSP

SEQ ID NO: 999682 - protein, 220 aa, Homo sapiens
MVTRSQVAGTTGAHHHTQLIFVFLVEMGFHHVVQAVPELLTSGDLPASVSQSTGITGVSHHARQGEPVRVSKLKNLGSDCMRAGQHSRRAHKACRLAQARPISLSHNSSCPASLLRCHTCIQICALPRSQHGLCTSHSPLISTYHLSTPGNHTNTHHTLTIKLLPILPLQLPNIQTPDNPPRTIHPIHHCHPTLDSNVYHTHQIIFPSAITTSISILPNY

SEQ ID NO: 999683 - protein, 117 aa, Homo sapiens
MLAIDAGTPNCSYTSLDPQNTRQLEHSARTWWKPEMQTCQARGSHQWDKTGLVCPLMGHHCATGAEDVTAFREPHPPKVVITVKDMTQSKPRAHSGAVRDRIMVFTPSAAYTGLALR

SEQ ID NO: 999684 - protein, 126 aa, Homo sapiens
MIVCVLGSSIITNKAQAAERNRYPDDLNPSSRDARSLSVCDSCLYGDMERSGRARKASGNNLEALTGPPALLWNDAHTTHATETKRASRATRNQTAESKATGTQKHTHNGHRATDKTTKPTRTQPQ

SEQ ID NO: 999685 - protein, 90 aa, Homo sapiens
MGTPEALDHQEPETLVSQDNADANARVRGPKPPWARSQAQRETKHGPKPSTTVLSRTYAENPYYEAVTTELKGLYVGYHSPTRPHGKPLA

SEQ ID NO: 999686 - protein, 140 aa, Homo sapiens
GSYGGGSGGAVAIPEPLRRSLRQLVAQVACVDAGRGTGQQFAASAPAARQQARRDAPRHPPPSAGPVAGPASADQIPSADVSPRRLRASEPGLAPKHDSDFKPGDLIFAKMKGYHPLASSSRRKFLMELLKPTQKRNYRI

SEQ ID NO: 999687 - protein, 283 aa, Homo sapiens
MGFLMKTHFSSPFWGLYHAPTNYYSANEEFRPEMLQGNANVIVTGAQPKADREETMRLSHSGRTALGARPIVALRCTGGRAPRIDIHLVPRTPGGSIPNMATVNALLGTRTATCMPTHPEPLTAPAHTPTWRKAEPLAPPYHGQQTAKPLSGLGPPNTDQVRKHRTSTIVGDKRNPLRDTLLGHSRSLPVTDTYPQRHKFPKTAVQSPCPLMFHALVGQDHYPLLALNEPTTMLPKMRQLIKHSTPPPAKNGLISPRPTIIDETTATPFVAHTKGLLQQDELI

SEQ ID NO: 999688 - protein, 327 aa, Homo sapiens
GRTWALGKIIKTHGRSLSMRTNTPPNETPPNFWTSICIGRRDDWNGDPFAGTSARDTVSELVALGSVTHCPSHMTSSRGTGPHVLVLTVADDYCAQCTIHNAFTGAPSQRTYANNQLRDMLVGAIPWGMSQGLLTDISFPWACRTSRLPTQRTTVELISLLRVCNPIGPAKGWHYQEGRITSMEVWSQLRLQHGFQTYSKTVSSENSHDGCVGPKLGRRSNSRRAFQSAPRVLLENAAYGNPTRWPSGPFPPLPLDLAFSTGAGEFGTAPRPGPRRHRFVPFRPCAVALQFPRTPLEVTAGRCLRLLTLTFWAPLGGYTPRQALLGV

SEQ ID NO: 999689 - protein, 193 aa, Homo sapiens
MFMVIKLFAQVQKKKKKKEQEQKCVAARDTADTTEKKTLSENNWLMEATQGDPTEESKRNTGRPTSGSPTGRKTRAQSKTARGGIFAHQNRKNRARERTQGKRLQGHNKLQEAREHPRGDTKTKGGTITLKTAREGKKQQKKRSQRKNNKAIQKSPTTQKGHPKPTTRKTHTPHETNKPHPTQTNNTHANKQQ

SEQ ID NO: 999690 - protein, 395 aa, Homo sapiens
MRKKAAASRETLWGRGGHSLTPKLKKRPPGGTTPEGVSWKQKFLQQWELLERGPTNGGEPLSHNREGDVPPKGRERSQQNHLKYLERPTDPCGVAQHLKTETRQQEHKNIKTKQKKKKERRATTEERPSHEQSDNHSTERREEGKSGSEEMRGTRGQSGREQGYARTKGGTRRSGEGAGENAEERTEEQRVERRKRKEEEREQRKRGRSEEKRAKTKAEGGQKQAQRETEDKADELKHERRQQREGNEGETGDRKRKQAEKTEEQGERHDTEEEIGRGNDGIGRRTAGEKQERQATADNAEVRAGAHDAAHKQTARRQAARSRSEREREEAKAQEDTTNDRQEKEDERGNGERQEGEKDEKGKDREQERRETTMKKEQREKNKANHEQRQGPQQT

SEQ ID NO: 999691 - protein, 103 aa, Homo sapiens
PREAVVNKGECRIVAALAAELVAATKDSEANWTTEEWKSGKRLDGKTRNALKRNKDVEITQKAVTDVTTGACSILLKQVRLLVLRRCKSSQGIDFFREQIEEI

SEQ ID NO: 999692 - protein, 98 aa, Homo sapiens
MQCPTNQHFYHTEDIARILACKLPEDNGASSSITCYIGWRLLENQLDRESSLPILKIDVEWAFFQVTFAAEQASSIHTPGLWSNENSSGWPINRQYTD

SEQ ID NO: 999693 - protein, 141 aa, Homo sapiens
MTRKRTQMKKRRKRNDTIVTPITRQQGRTTATHGSYNARDQPKQVRGQTTGIKRSGAPYQTREKEKAHTPRYHNDEEHAKPLNTVGPPTRQKAPRATQSDLPLSHLNHAELTDKHHGTVNTEQTTRTPTGQPNTEQTHKKP

SEQ ID NO: 999694 - protein, 193 aa, Homo sapiens
MTTWAELGRKWSGERSSGSSTLVSSGPCQRMVPENAGELVAHVSGALLMDVTTAGGPAAPPRCSAAPGTVAARTWRESTTRAPPCKDQGSTEKALGTPSQDFCPYPRDRPQVRTPSATYPPLCSLTLTAKSPARAWHGLACRLSHTRLARVRMPIARQHQGQPPVGQSSKSSERTRDRCVPRVAGGCQNTRCR

SEQ ID NO: 999695 - protein, 64 aa, Homo sapiens
MTSQKCWCLAPGTVRGNSPSRCGIDERHITSRGTKRQNTENNSSWRCPRSTWESRPPDRIRACI

SEQ ID NO: 999696 - protein, 176 aa, Homo sapiens
MQTCLLTKFHILPKDIAGTQAGYLIGRPNTPCPHWQVYPLPRVVCNTFHCRHGSTSNPGPMKFCHHVATHSAHGKYPRPSSSLSVHLTCGQLTGNDQAQGAPLEEQLTGGAHAGQQTGPYKTAGQGPSTPDKASAQQQRDGNNTCTDGRREQDRTNTPQVSGSRTQAHNNQPDTTQ

SEQ ID NO: 999697 - protein, 217 aa, Homo sapiens
QRVENSRGDRAAVLEAFLEPKLSSTGEDRASRRHHGAPLSPTSQSACTLAGASAHKPFNFSNPSWETPAHTTASHMNPAIKCKGKEVSLVKSAQNLATVVQGERVMERQLENAIGIKSTQARNSGRETIYPNASLLIQNVTRMTQDSTPYKSEVRSVNEEATGQFHVYPECQASISRKSNLLEDKMLWLTGTESGTLLGITSELGQPSECMEGSSIG

SEQ ID NO: 999698 - protein, 125 aa, Homo sapiens
ERDEKVARLAVPDSPRCRIPAQIREELQECGASDFQYTSRSGQRLRGNSTLAQRRRSEETVVDLHEYPPTEYNMKRLCPRHARRSQSYEGIGTSNRARVYMILTSPPWKEGIESHHSNFLRQEMV

SEQ ID NO: 999699 - protein, 70 aa, Homo sapiens
NSEHSLYGQSRMKCFGWNSSFFHRATAYYGSIITSDLVAEDPSEKPEIGFQNNFACKSRTIRSYSNFEQH

SEQ ID NO: 999700 - protein, 148 aa, Homo sapiens
MITPSIIIFLICFLAPVCPFPNTHNKTNLILIISVRSGKRRPSEPILPAIDPWVLIALPSLRILYITDEVNDPFPLTIEIILGHRQCVLNRYEYTDYGRTNQFNSYILPPLCLEPGDLRLLDVDNRVVLPIEAPIRIITYITRRLASA

SEQ ID NO: 999701 - protein, 242 aa, Homo sapiens
KQWYQPRVPITAGVRYQTREKEEEGEERGEEGRTNGRTDRTENTRRTRTDEPTGTETNERTNERRNRRTRRGEEDTTDTDTNDPGRPTDTRHDPPRHEGRRTTDRTTGPSDGYDEPETKNEDRTNGPTDTPREPKKRTTGTGNRTGEEERTKKTKDHGTRRRKTEPKNATYLGTTDRNRGKKEPRHPKGTASNQREGQTNRHTTTRTKHATHRSKEEKERTTPDRTSERKGNERNGNTNRAP

SEQ ID NO: 999702 - protein, 130 aa, Homo sapiens
GSELEITPLVSSLGDESETPSQKNNMQAKDEEPPCIEAGTSGKLIKYNKGKIVLAWDRFAKYHEMPPDIILQTGCLPWKVRGLFQVPRSYPKSSLLRRSYQAAVSMEHISEKVSPVRKYVQCKPKECVWS

SEQ ID NO: 999703 - protein, 102 aa, Homo sapiens
MARWRMLGDGYTDTTVVMTEERSSRPRDLGMFSPEANVQEGSGEIVRRQGRRLTLLQDYWSVTQADIEVSFEEQRGSSRTFLSYPISFLIDLMNYWRGGKRL

SEQ ID NO: 999704 - protein, 112 aa, Homo sapiens
GKGGLPSVFARGLEVQVGGNLGLTCNLVPPGSEQFSVPRPPECGTGIAGACHHALAKFGVLRWKNGVPTLVGSGVALEASCEPRVNLCPPCGIPQRVLWGIAGIEPTRAWQQ

SEQ ID NO: 999705 - protein, 149 aa, Homo sapiens
EAIINSLPTKKVHGPDELTAEFYRECTQRRQLVPFLQRTTSLKTNRISEGILPNSFDETSIIVLIPIICARDRTTTEKNFRPISLMNIYVKIAQINYWQTKVQQHIKKLIHHGSSQASSLGCKAGSTYTNHVNDKSITINMNANDKRPP

SEQ ID NO: 999706 - protein, 68 aa, Homo sapiens
AQRNTLSWIITTMASANTPPCAFLVLPALLPLPYTLLTTFKLKVYIIILTNSMWSLSKELAMESQKGK

SEQ ID NO: 999707 - protein, 121 aa, Homo sapiens
MPLLGSDLRCPESGYCTSSRIVGNVPLLGALLRYRSRELDKPELAALKYCRRVVARRGIQVPLKGWIGNSRQGELMQLDDPSRRNAVTGKPSAVVSPRFLSNTNRVGCYGGPVVVAEGKRA

SEQ ID NO: 999708 - protein, 110 aa, Homo sapiens
MRRGFVGQYVRASLRKVALRALRAPRGGETPRSRTRQTDGPLIYAGTSVTGATTKGRQPWGAPNCCAVREQYTSLNKGDEKDGVDTDNVTPRAETDTLTNKRGDTKQRAQ

SEQ ID NO: 999709 - protein, 305 aa, Homo sapiens
MVLEHAEPEYIIRSPAIVPEAMAVLPSIAEFLSSSTWAFRSAIMDDGITEGQRSIEIRRMHWHYVSLEDTGPTLQSALTERIHLLDSRRVRTKVVHDQMLTYQPGGLYQVGEYPLDEGYMGNSYVGKGRGIIRFRVKCKVERFAFTKGDWSYVQGDYKIEETGRSKISEVVNKWSVLTRNVYVRAMARENNLGEVCDKGGSNDRWIIRTNLERNKRVTKFDSKVLQKGDEPKKYPREERYLGEIESLKDYGKHRCITSYSTNRRASYGCKGDPLGPLVALPEEVRGTQQKVRLDWPMKNFALFPE

SEQ ID NO: 999710 - protein, 205 aa, Homo sapiens
MKPAGHVAWHKKRHLLTKLVGQKVPPRELKHLPLSQTKGGEQSMEQEKPRGQPGEKRHRGLVETEALSEDITCTKHIDNRETDQRGQLRGAPTGKQTAGTYEGTSHIATAAQMANMEHTDGNRPQPNEEPQGRNNHEGPQNTGNKHDRGTPKGDIERDTMRDPTKIGPSTELGPKPRENNRPPKGKHIRDRQKMDATASRNSRET

SEQ ID NO: 999711 - protein, 101 aa, Homo sapiens
TILQPNHSSLYTSPPASALTDFNTYFFTCSFDGTHSDTRLNNTDWYTRQTYYTPWSEGTRRRHLIMYDGLCSTTTTHTTLPFTTILTGLAFDTPTYGTLLL

SEQ ID NO: 999712 - protein, 109 aa, Homo sapiens
MKRKEKKERREKKEDRNKQNREREKTDKARAEGGRGRGEGSRREKKKRRQRQRGRAARGARDGERTEHKQTRKRESRLASRRERKAKNKTTTKTKRRGQQEREASEEGE

SEQ ID NO: 999713 - protein, 192 aa, Homo sapiens
ETFFAESRRGFHASTSAVDGSRRSFPLTQARAPHCRPFRSTIFYRDSSRCVPKVPSIDCVLAPDARQHEQNRRDRRVLTYKVQPAQWELSLAVYYSFVDVVADRIEHQHNQAESPGMGRHYSNPGQRVNYPWEGFSSPLLPLKSVLEPPSRCPHWVALRTFELWLRALGGTSKLRSGTSPEEWKTLYRRKTF

SEQ ID NO: 999714 - protein, 162 aa, Homo sapiens
LFDPPSAVEPGIKMQIFVKNPYGGLTITLEVEPSDTIEDVWARIQDKERNSFCDPSETVLSWQCAVRCDVLCLDLQCFIPWYVYSSSLPCRDALQCVELHEGTSVEERSLTNYLPVDRFRHYEKGTGSTTRSAPLQYYLSSGVIAELCINYGTAIRQTSCPF

SEQ ID NO: 999715 - protein, 57 aa, Homo sapiens
MLHPTPGGKDPKKGNATKRIPLAQACQLNARGQVYKKVPQGAGGYYNPTAAHQCSIG

SEQ ID NO: 999716 - protein, 144 aa, Homo sapiens
GGGGAIGRAVTVVCPGAGGSGYSAAGDGAEVTPQVQRPEAEDQRAAAGDAAAGPGVSKQAKRDSLEDAADRTTRRNGDSGTGDISVAEDWRGEVAARRRDIRIPDLHEAGRRGMNTPDSRGGHFFRIHTDKWIAKVKVMAICLH

SEQ ID NO: 999717 - protein, 55 aa, Homo sapiens
MGQKPRETREMVTRNDRDRHEDPKGTPRLREQHRMDKRHTLQDTNHRRTHRELLT

SEQ ID NO: 999718 - protein, 147 aa, Homo sapiens
AVAHACNPSTLGSWTICESGGSRPCLHQHVVTSPIFTYLYPENLSRGYWLVYCRGTVLSIPQGGFACTAEAGQFKLGKSPPWGTGAQHRNFGFGFRNRVWMQTFNGCIPDRHSIAYISDRFRTYDTSTTSNVCAAARHSCAESTQHE

SEQ ID NO: 999719 - protein, 214 aa, Homo sapiens
HDTTETEKRNRRKKDKIKKNTKKKETEKNKKQDKTKKKQNKKNKKTKRKKNKGEKERQKKRRKTKTEEEKKKERTKEKWKRRKENAKTQKREEKEKKESKKDDREKREEKTGTEERHRRKKEKEERKREIEEKREKKQSKKKKKQKKREQEKQKENKTRQKNKKKRKKKKQRKNKERKKEKRKRKEQKRRRTKKRDKMNKEDKKGQIRTRKRAK

SEQ ID NO: 999720 - protein, 158 aa, Homo sapiens
LEKVKLPGWISVRVPFRAIWQAVNVVHVTRVLVHVRPSRTRARITDVYHRHLIGKTLNTIRAYDLVLLCEVVCTHGLSSTGGMVSSRVEWTPSNTMTGRGAQVRNSDLEDETSSSLISDNESRNVNLHTEHIDLAKIARHKRSFMNKVHQRGPQWRYR

SEQ ID NO: 999721 - protein, 47 aa, Homo sapiens
KHIRRRQRGAESRSALACAPTRCPAVEFNAPCPNPLTPPPPTPPPPP

SEQ ID NO: 999722 - protein, 261 aa, Homo sapiens
RLGAPGLALWRRSPLPPSLHLSLPGLMYRALYAFRSAEPNALAFAAGETFLVLERSSAHWWLAARARSGETGYVPPAYLAPPAGPGARMSSRPLTGPSRLYTNTAIAGLVASYKPGNRRWSPPESLIQPTDKKTLFNLQKAPFSPSKCCQVMTFNQPVDQPIGLLLASQGMPMAVCRTGFRACKHSLPQFLRHLEAQTGGPLNQNSYQQASHEASNPIKNGTQTKVKHAGRTRRSAPLTLAFIGETVDGTKSMPIGPSQGR

SEQ ID NO: 999723 - protein, 80 aa, Homo sapiens
KKHIKVLLAQVPTKYGCSAEKLYETCTISTNVWKLGSMIGKAATVVKNNRLYVSSSTKIHDRHCISETITFTIIRQGQYD

SEQ ID NO: 999724 - protein, 184 aa, Homo sapiens
KKSEDGSWGYRTPIYMPNRAIRLQAVLEIITNQTASALEMLAQQQNQMRAAIYQNRLALDYLLAEEGAGCGKFNISNCCLNIGNNGEEVLEIASNIRKVARVPVQTWEGWDPANLLGGWFSNLGGFKMLVGTVIFITGVLLFLPCGITIKTLVETTVNLLTIQMMLLLQRHDGYQPVSQEYPKN

SEQ ID NO: 999725 - protein, 222 aa, Homo sapiens
METKGSWGPAVERSAVQSKTQRVGHTRSKEYQGQRRHAQNMRWAPYDVWRDSVENRGYARKFQMRDPTAEYGPRKLGNRKDIAAVDGTSGRSSGDKRWNLKAGDTEGKTPHKQHAGHHSVTTLPSHRRLPTLGLRRLGSHTTSCGDNRREHAKRRAQADIPRRQASPLSEQHRRYHRRDARQSQPQRHKNGDKRRTREGQTNKNKTGHRGDAGKADKRHSRK

SEQ ID NO: 999726 - protein, 202 aa, Homo sapiens
LLHPGVSEAGAPFVSVSWLKDRGSEAGPGQAADTGCPEPHARTGAGHDLEKQDVVGLSQRGYEKHQECNIDVVVEKQQINVDCFPEFACMCVLNLINEGVVMRLIDKDASLAYYIARLDGKRLSTDVLYTMLVVGCCISERYAVSVNGYNCQYREVDEGPVELDELTRLRGLVVGRKTVMLLHLCGVFGVDCQCLGPFGKSS

SEQ ID NO: 999727 - protein, 104 aa, Homo sapiens
MSCYFLITISRKSNVNDAVHMRYFIGPSNNSSLGGDTRRTQRGTREKLKRSRVEYAKRRTFNLWGSKHCVRRSLARLGAPLFLKHNLCLRVGKNFGLDVGRAEW

SEQ ID NO: 999728 - protein, 226 aa, Homo sapiens
MCLTLPRWGQLASASAHAPAAASMPWVGPLGESEGSVASSGQCSHDPMSVCTSLRVWEEEKKRYDAVRMTLTGTPSRGAGDSGWYSQVMLGPYRHNMVNVDCKVNVLSYWWPETESLWVLDLSDRLPYSPNQYGGTGSSSKTNCKPFMVNACSLVSQIRASCLESGVQNAYIITLKDLRGSDSPLYNILETTCVGQPGPKEDADRGEAEPQKIPGQSGCEETSPYI

SEQ ID NO: 999729 - protein, 289 aa, Homo sapiens
VDVLWRKHQRREKLRDRESLGGYFSREGEEKNGEENEEPKEEEEKEEKKEERRTKNETNEQEKELRRTPDEERTNERKRTWGTERTDGRDERERNEHERETPNEHDNTDDRSDDGRKNERRKDTNDTETHRTNERTESDDTLTRKDGERTKDRRSDGRQDRRNTYRRTENDGDEGTTNGRTETKGEEPNEDRTGKDGRHDKKLREDTKRNATRGTEGKHGPNRGQDTHRPAPDRHRNLTDSKQRDTGTKGTHTHTSTRTGTEETGQDEGHATTTTSEHPRNGRSNSRRT

SEQ ID NO: 999730 - protein, 331 aa, Homo sapiens
MKKTTLNSTLHLIRLIFSSLIPSMHDMRITWGWFSSRIYNLCHHDHNHKKHDFGAGTGLPQTTQSLSTTHPGEWATQVAKYWSATCTLVVANSGGHAYWKWTPEWVQRHNALGKGKNSHPLTINNSHPCGKKNDQKRKFSLDNSQADTDSAQRKNSRGTPPQHVGGTTRYPRATREAWPHKSRTNSDRFTQTARNLQSAHHIRGDVNSQSNPQHSGPSETEPQTGPKQHSQGTSRTRGHTGKGHSPLRTQSSETRAGGRTTTTNTTRATAKPTDPTKVRSERHDKQDEVTTPNQHNGAQRRQRNTGPSGAHKNNATQTATYGKKQHVRPNQ

SEQ ID NO: 999731 - protein, 95 aa, Homo sapiens
VPQYFSCMGCCFSRAYPTPLRSAEDDVGPMENVTYRRSNMAGCSLELIFNQGVTVNVREVTNVEEKPYGRAIAEPVHLLTQSYKCVYSYVAGYWT

SEQ ID NO: 999732 - protein, 142 aa, Homo sapiens
MVRNGDEGSQNNATEKRTKRQARERERSGRRGSEEERDQKKKNRQKRTEEKRKKGASNGSREGEARRKPKERRRETKEAKQTQPSANARPEAVAEQKPQTDKLDRPHEKTEEAKEGSTAQDGQRKDKSNKKQKTTRINGSVF

SEQ ID NO: 999733 - protein, 126 aa, Homo sapiens
MVSPKGLSAAVGCCVRRCGVRGCCAPGSRDFPSCSRWEERQAVLVALTLPFLSECFSPWASQLLHVSLRRKTVPARIWLVGQHKIQSQKKSAKNASLDKSKRHVDMIIMACLPIVRVFDIYPVTCL

SEQ ID NO: 999734 - protein, 84 aa, Homo sapiens
SAEGGRTAAMSDSACFRNCLDPRLISYTRRTDYRAGRDPMEVALSSTLSLRQSSSYGRGSWSQGITYNMFLGTVTPDHCLEFTM

SEQ ID NO: 999735 - protein, 363 aa, Homo sapiens
RFQRYLNLWKRLYLLLNFKTLQTVRLATLTIQTQTPRKKTIASNAQCHSEPLAHRKLDYSSGLLTPTLHKTFCLATARTLNLGTLLLPHAANTTHESHLTQLLDAHRLPFPKPHQPPLHPLHVLLSLTRLANCFHPFRGERSDSPLTTHKDHRLCPLHTALPNMAHRQVQRSARSKPFNGISLPHLQHTHARRHTEKHTYAPCSSDFHKRLFQPKLLQNAPPLVKRQRPDTTEPIPAWDAPRHFCRRHLTTAGQRTPRPQTLQPNFWQTPTPLEKPHAWWQHHARTQVSPSHILPQRTPTRRLGLNSQALAPPNNFQQFPSSFRHNQPFPNPHSSQSSAVENRQPLWTNSPFLEHSTFYSDPS

SEQ ID NO: 999736 - protein, 200 aa, Homo sapiens
MVWQPCEQYIMKAQAYQTGKAHLYNITMRRQPSNTICKIKSQTPSCIRAHVFDELTEDDDDKTVYDLAEVKSLKQQRFGPGYLLPDTKAYGDRIDTDMLRLSLNIDPDAKVEEEPEDDPDRASRRHNRQTQSKHEDDDPGMLGKQDMNESTEDTGKTRNLSQLEHTRLATCSNFTTSSPIQGILVVATTPIGRHFHHSFK

SEQ ID NO: 999737 - protein, 349 aa, Homo sapiens
MYYCLTTIFKRSLLFILCMRLRGGANENGHEEVLTTSQDRIHAHTTTTTGYSWPVPDHYLLHRWTDETGQTYDSRFDRDVPLSCTDMVRAWVLILMGTAHLSTQNTYSVGTSDMVHDLYNVVSSANNPSNAQTVTWVIDASTYTKYPHGKTHKAHTARTPPKPKTKRKHKAKHPNPARTKHRPRPTHRRATQRKHDRPTDRAHSHESSQTHGPGGRAALALANRDGRRAVARTEGTKQDSVQPDGARYQPRGTAVGKASGRNGTPAETAHTRPPTPTTQLRVSRRHSTPTSLHSSIYSSLTPGDRHTRPDNPLAPREPSPSAQRVEQEEQAHPTHPQMAEPGAATTSAP

SEQ ID NO: 999738 - protein, 175 aa, Homo sapiens
MATRGRFGSVSVTMLMALLHLFGTVPSVLRATKNGGDMVLSRTMVTQVEWTLVVTYMTCEEGMPGDESSGRACESPDSSKMSPLIVMFTCSSIFGIDSSVMEDASSSARITYDPDLILLGRYYHVSSSSTRDIVLPMVGVQMKALTVLLMLVHDFSSKLSSTYLPKVNPRRGDTV

SEQ ID NO: 999739 - protein, 327 aa, Homo sapiens
VLPGRGRTAVAPSRASVVGPLSLLCPAVGDSCCCSGSSGSGLGDCPAFVAPAAPQMINAEGFGQGLVIIPTSPETEGDQRLAGTQCVPFAGNPMRFEGPRKRHQNAQRCLWDAAGGPWGSGAGRAGAPECHRRRQDAGYARSRQERHVASHRSVRVAALSYPRCRLPAEQWINPGVALAWDGHLLPACPRRKGTLSTNRWGETESRLAGTLRPVTRDTYQSGRPYIGKGGSNRLTSKPAPRPFTGMRHTMKPADARKRGTGFNRRHGNFKTLCGLWGHTTRGLTHRGRGGQPRRGAIQAQNTGPKMLCPVWIISTAQLDIRTAVGDI

SEQ ID NO: 999740 - protein, 109 aa, Homo sapiens
SVYGPRYETRSDVRGAISLINQYSDSDFRIAMSGTECSSSWYYIFILNMRPCRIKYTRETRRALSTNLFLLVVYASCYLTRNVLSLKIFSSNYLPNLKTNFSPLNLKKI

SEQ ID NO: 999741 - protein, 107 aa, Homo sapiens
MDQLIFFSNAHNLYLFINTMSVGYTKATSDHVTTQSIYAFSVYDILDLQLLAIQLNLLSFYDSVDIPATEYGNSHISYHTSSYTSPSYYTSVPYENCFQLTVELNTT

SEQ ID NO: 999742 - protein, 72 aa, Homo sapiens
MTGAQLYMDVTHQVCHTVIGDCAIGKAQAMLPKHRNLGESFSMERTLDLAVILAREVATNNLHSTCTKFNGS

SEQ ID NO: 999743 - protein, 117 aa, Homo sapiens
MHWKVSAIELDYTLERNDSKCQSYEDKASELAQSDKDNKSNLQTMNAASNKFVQQPSLKNNWLFPRKKKNLNSWQNKSEGLIEENFPGLARDLDIQIQEAYRTTWEIHHNKDHHLGT

SEQ ID NO: 999744 - protein, 304 aa, Homo sapiens
SAHPDVGGGGGGIRRSKAGTKSPTSSYVPKGRRRVEPFSAVREGGVDRRAECPELRLAGSFPEKAQAKAAGEDVQVRERHVAGLAAGEGFAPRPRWSGGSSRVSSQVLGASSFARSVSGSQFPGLEPVFVQESEEQVQVPVPKAPTAEVQALIAVILAEPGADPESAVTERGATGSTRRYYRVSFAVPVPVPEQVEHLGEGRTGGKGVRDRAGDSDNYDYEAHKRTRRITANGEGAKGPKGRRVARHKEPTQLSANVRDRIRIETLVRKISQTTHWRGKALGRHSTDFDVPRKDTRTGPRAKER

SEQ ID NO: 999745 - protein, 85 aa, Homo sapiens
EKSVTKCDMREKTIAKRIERPPDTYEETASNLKAKDNQGSIIMTVIEINTIDEILTLNAMWAYNARIQKGYMTGQYRIIVNTSNR

SEQ ID NO: 999746 - protein, 252 aa, Homo sapiens
MTERQEEPMECRLLEHLLHCHIRLLITLVKRVLHDIIMHSTCLTLSGETVTLFEIGSKGSPSVERRTSSYPPKTMLSRRGRNGIVSYRERLFRNRIWLSESLCMAYNLWITKETKRDWHPRIHCDIYLVDTVRLRRGPRYSVITNGAMQYQSGDREDQIVFLMQSHCDEFQTLFNTGEARRNPYKTLPPFTKKRRVHTELEGVKLALFPPFKLYTLKLDQCPTFTTQGTQKPWGRIKGCLKAFQLVNPKSEK

SEQ ID NO: 999747 - protein, 109 aa, Homo sapiens
VWGVRGSLALRRFFKRSLVSTRHRMSPVPFILEDRSKESQELHFETHAYKSAGTSIPVVSLVGCMQADGGPMDYIISEDARGNTNNVHFIHESIIAVCGMPKGFDCLSK

SEQ ID NO: 999748 - protein, 95 aa, Homo sapiens
GIHSFQLLLRVEVDENAYRCGSGMLYGQRTVKQLKRRHQNTEPVDPKERGTKPCSERHNGQDDLDVDDRLCVLKLNGERRVLCSYNVVQVIRFAS

SEQ ID NO: 999749 - protein, 108 aa, Homo sapiens
MPGDTHIRGDAIGTGHENARGGQMLAAEKDNNSARERGHYTPERAAEATTRTRMGRILSWGALPKGGHTGGNGRGKPSQRKPKPYIHTITMSLLGHHVCGIYHPSGTP

SEQ ID NO: 999750 - protein, 80 aa, Homo sapiens
ASGRRRWVRRIKLEIMEFVNFLKNPKQYQDLGAKIPKGAMLTGPPGTGFTLLAKASGGEATVFFFTNGSELEMGGGVGPP

SEQ ID NO: 999751 - protein, 148 aa, Homo sapiens
FDPRVREVTDRKLASVVLALRTRTAVTSLLSPTPATALAVRYASKKSGGSFKNLGGKSSGRRQGLLFWKTMFMLGTWGGHAIPPGTQVPMWVLGRINVCYAIKKGIVRYTKEVYVPHPRNTEAVDLITRLPKGAVLYKTFVHVVPAKP

SEQ ID NO: 999752 - protein, 155 aa, Homo sapiens
FGDPAANSRAPAQLGSPRTEALGAPRTRGTPAAPGQPPAGAPLAPPAPRGPSPPPRLCPQGAGSRVQPQTRRGPWGRASPAVAATMEEPRARSHTVTTTSSFAENFTSSSFAYDREFLRTLPGFLIGAEILGLLVWTLIAGTEYFRVPAFGWVMF

SEQ ID NO: 999753 - protein, 151 aa, Homo sapiens
TGRGADERGHEPGGAEERGRERTAGGRTHTAGERRGRPAPRESGREAETGARKRPPADGKDTPPANHWLGIADGMGDLGTKQGSKSWGDSRKMRPGPQPWRTMRAQKKNLPAPPENNTSRIKQGTAQAPGLGAREPVQGGSAGAGGSRKVK

SEQ ID NO: 999754 - protein, 229 aa, Homo sapiens
YNSISGVSPVYWQEQAALIQQPSCKSVSFQQMSGNLCIIEASSAFIVVKLMPTIDSPISGCNITSISSYNATVTKLLQPIGENLETIRNQLIPTRRRRRFAGVVIGLAALGVATAAQVTAAVALVKANENAAAILNLKNAIQKTNAAVADVVQATQSLGTAVQAVQDHINSVVSPAITAANCKAQDAIIGSILNLYLTELTTIFHNQITNPALSPITIQALRILLGSTS

SEQ ID NO: 999755 - protein, 32 aa, Homo sapiens
SPGFVIKYVCVEKGQCVICGPEDAVVRVSIRT

SEQ ID NO: 999756 - protein, 75 aa, Homo sapiens
KAIPYILHPALTLYGNRYHILHHPSTGIQSRTASTCHEGDPVRLTALTHYMHPPPSSPLPLRFRTGAVISSTTKI

SEQ ID NO: 999757 - protein, 104 aa, Homo sapiens
MNAIVDHNGAYMITVQLAICYVLLMYAHQQSPSYLGLYTPYAAPPFIELLTLRTRKRCLALLSIPSRAHDPAIVIGYRNLQAKRLKPALQPYTLTPSVHHEKHS

SEQ ID NO: 999758 - protein, 30 aa, Homo sapiens
TVLYGALATLIYPTVSIQTSWTHNYRIKVV

SEQ ID NO: 999759 - protein, 33 aa, Homo sapiens
ADPTYGAMFDTAFSDDKTVITAYFSLSFYNHEP

SEQ ID NO: 999760 - protein, 36 aa, Homo sapiens
MIYTSWARSSSDGKPLPIIACTIFAAAYTKSRTIAF

SEQ ID NO: 999761 - protein, 216 aa, Homo sapiens
MGPQTLSRAAITLGGASFPRPQPLFPTTAHPAPPHSPPLTSATHHSLNPPNQQTPPRLPPPPPPTRAITHHLLPPYLQLPPAPHSPTPPTATHPLPPFPFTTPKPPPPHHPASFDSLARKLWRTYHNNSFHHQSHKQNTAGTRTIYTSTDASVANPPLSTLNSPTTLIPPDSYPPSFYQPHCGHTPLVNIVSNNSVPYAPVIPLPHNANSYTPTTL

SEQ ID NO: 999762 - protein, 78 aa, Homo sapiens
GQRMSLKGSRLLKKKGKLIILFSKFYDYHASLFSYYFSGATGADKDVRPIGGLLPQSLLTPWLDKDLGKTISTRKLWP

SEQ ID NO: 999763 - protein, 38 aa, Homo sapiens
MGNAERRVIRTTARQHDSREERVRGDQPHPAWGSRTRG

SEQ ID NO: 999764 - protein, 99 aa, Homo sapiens
MDSNEDIIPLCRGGTYQTLMAGKADNLKQLPESSWRSNTLKNYQTYRTQVKAFLSRGGYDTISNTEGLTMRAQWSSMPPGSVPIVGNTSPDSTLMGAGT

SEQ ID NO: 999765 - protein, 97 aa, Homo sapiens
GLLTVRQSRVYNKNTQRCKKASNKVMDIKLAHKLKLYLENLTRDNKNKATVCNTANNNRNFNFVWYFGVFKHFPCYLHQKLINRKIIPAYICVIPIW

SEQ ID NO: 999766 - protein, 160 aa, Homo sapiens
MTAVLDPRNVPVIYVVANIYENVNISTAHPLPVLSPASFLASSPDIGEDYDERVLASITTEILKSVVARFDAGELITQRELVSRQVSDGAYMSEPASFGLILDDVSLYTSDLRERSSQKRWKPNRWLSRNARGPDCVVAKAEQQTTRRPSFSAEGDSNAA

SEQ ID NO: 999767 - protein, 150 aa, Homo sapiens
VGDRCQSCLDSRKQEHALRNRQPPYQIDPDACFSAKVEQLQPDEVQDYTQTLTASVLNLTPVSLFWMARNRQLLAGHKLESSDMEVLKHIAEYCTDLCNLNTYSCMHSYLQNFSVFLYNCCNDLGLQRYALRYVSPPGFKKFEFTHLEDC

SEQ ID NO: 999768 - protein, 79 aa, Homo sapiens
VGERCLSCLDMRKQNTRFGIAAKYQIDPDDLLLGYSEQLQPDSVTSDIAQTAKCQVINLTLSALLDGQERSMLVATSLV

SEQ ID NO: 999769 - protein, 180 aa, Homo sapiens
MLMVLGALLGAEGSSIGLSGAFPREVTYGEVPRSDKFEGKFRQRAIRIRELFGPLGDIPGDDFPAEYLTLTDPLEKGPLAFLGSTPFVCSLCETFRRLPFFTLDPPFLNLVFPIYLLGSGRPLFKVLGASYGKRTIGSQRIGGPLRGSHNVWPPTFRAFCFEKVLGSISELFNTKPLRFQ

SEQ ID NO: 999770 - protein, 112 aa, Homo sapiens
MSNESIKFIHECRLRDESCLVHCLAGVSRSVTLVISIHHDQSSDFGLEDALNTSACWEILAKPNVGFQRQFQEFEKHEVHQYRQWLTGSTMERALCMDAEEAKNHAGRSGTF

SEQ ID NO: 999771 - protein, 88 aa, Homo sapiens
RHSSLSQSEVGLLGSVVPVLPVCPFWWRLLHQVAARTPVSRGHILASTLVHGPTRIAPNNGCTLSSDSLCAMSPQTPGDDVPVTFHPS

SEQ ID NO: 999772 - protein, 406 aa, Homo sapiens
AARYTVVAVHVGARPGAVAPMEAGSSGTGVARLEQRLADVSPPARARSGGPCGGSVKPDSRECDPGVRPGDPGPLLASRQPSAPRLGPGRRSPPHAFGRLLRVSHKSLSRVFPCLTSLLRSVRPRRLSSGWSHLLVTHGPPVPSGVHEEGLGRGYTRFGANLKWRTVARNPLASYFVFARFEACLACLGTPLRQHTLCARTTPAHADKTSTFVETAIITQTAVLHAPTTTATFLRRTLVVVQKAHAKTPLTQARLQHDFQHRLRPTLERASVGLGVRVGDYHINRGTGYTRIEHFPGPLGRLEKYERPPPWSTLPLTQSRTQITSSRRPHVGQHQHSNPDRKRPQSTPGLTYLGSSGTNGRNHPYRPLGIAYLVRPYLTDTALNGTITYEGVHLMGYAARHAVLIW

SEQ ID NO: 999773 - protein, 243 aa, Homo sapiens
MQPIVETYYGPGRLYTLIKYLQVECDRQVEKVVDKFIKQRDYHQQFRHVQNNLMRNSTAEKFEPRELDPILTEVTLMNARSELYLRFLKKRIRLWLLTVGRLHCASEEGKCIDAPECVLVQYSLKYTAFIDACTNAWMLTWSYTVTIGRMYFHDGMTVNRWSVALDTYENGPVLTSSMVDDVFYIVKKCIGRALSSSSIDCLCAMINLATTELESDFRDVLCHKLRMGFPATTFQDIQRGVTS

SEQ ID NO: 999774 - protein, 104 aa, Homo sapiens
RGVDAVYENVFPPGTQCFFTMGMWSIGAGALGAAALAIAWLANYRRSICTSPRKRALEYLEDYETMKNHLETEPKDLSIDNMCSYVENQCVDCDYCAVAVQAQR

SEQ ID NO: 999775 - protein, 36 aa, Homo sapiens
MFKRLPSGGTCEDKKTVSEERIGKGVQEMKGTDMVR

SEQ ID NO: 999776 - protein, 142 aa, Homo sapiens
MKAREKEAQQEHEHENREEPRTNSARNKKQRHTRGKQHQEDRNNQERDKTKLNTQYKETTEKQEKKDDKSTGGGNKSRAETERQTKQRTGQRDREHAKQTASPRNENTRTKTRTQQKGREKKKKAEEQEQSQQRTEKKKQTK

SEQ ID NO: 999777 - protein, 266 aa, Homo sapiens
LHSTGIKDLDFWLSEVEALLGYEDYGKDLASVNNLLEKASSCWNADISAHEDRLIGPDTDAGRSAIDDQRSAFDTSQVQGQEGHHHTGRFQKIKSMAASRRAKLNESQIACYQFFRDMDDEESWIKEKKLLVGSEDYSRDTNWRAEPEERSTSGWKQNWLRMRPAIQGVLDTGQEAVRDEQQAVGKEDDTAEAGRHVWWSTGKRLKQAGSCPESKTAGRSPWGNISRFVAQCWTEARRPGSGEKDERWWAAKITGETLDRPYQGVN

SEQ ID NO: 999778 - protein, 215 aa, Homo sapiens
MAWLELQLARQLKVHILTSVSRTVRVSCSDAQLCESCHMRHGNVVGRDQEQPSQSMLAERTGGWITALDRGRQESVAQHLETKETSMSSSQAIQGYPYKTSSAVLNRARKSNMYGGTPRSIHMPSSRTILRMRTLCVRASYPWFPPKHTPRGKWVKLGSARLASTYRLPSTLVVGENPAAGVSSLSESLSVDAGVPRGGTWMHPTRASYSAVSNV

SEQ ID NO: 999779 - protein, 337 aa, Homo sapiens
LLDETGPEVLQDSLDRCDPTPSGSLNCLTHASPTEVPFMYWSNSMLAWLLTWMKSEKYRKGGKRPRAIMPRGVSRELLDEQRACKSCRIHVDRCHSTSVQVGMNVPDLMRRRLQKKPEEQQEEGTRDAKDLASYGRWDKKLEKRTAGTSERERTQREPDDDARETYKRGHATMARDSMERSWPRHVAKTNVHERITLDAHPERRRVTRGYKRRNSKNLGARNHDRGTVSTVKKYRADYQTRKGKRKRQHRLAAGHTRQPQEPDGMQKPRGKHDTRAQRATNATQPTEHHNAGDQNGAKQQTGKKEMETGQEEKANTTQEERKNKRATTAEVNASAEE

SEQ ID NO: 999780 - protein, 156 aa, Homo sapiens
MVGRLETCTSAWYHSHPGYGCMASLAMDVSDSQCSISSSLEPFVSSGCLIHTRYNYPSGNSESWRVPGAYPEGPYKASVMKGPSEYQSIPREVKIGRFWVYTGKQYYALEVCIFEILFGIARLLELVWNKYWVNTSSSCSWLTNADYTSGRVFDSS

SEQ ID NO: 999781 - protein, 168 aa, Homo sapiens
METKIWTLKFSHNYFNIRLHLSFSMVFGRRSWALGTELSEIFAPTDLSMLLTYGLFGTDASRPRLRTRLTATHTNRWQQLTLLLDIHLTRTLRTLLTLAHLAQHTDSCLRHNLGGISLAAAYSLKLPITGVNSSHFLRASLAGFSLNDQTLLIKTDQFQSGSEPWEQH

SEQ ID NO: 999782 - protein, 231 aa, Homo sapiens
MHPRGAPSKGAPATTGHHPLRLLCIPSFLGRLPFAPAAGPPAPAVPPLPRALGAHPARPWRQGPSPARAHSPRGRPAPTTTRSPGPLLARAPHTPSPGGSSPTVAPCASASCPLCGTSGPGGLCWAPGASSHCPPPRLSSSTARRHPTPPVRGNTTPAHLLSRPRPPPLAASLAWRAPPVAPHVVTVVPSPKSLAPPPSSGRAPHHAGVTRPSPRPRGTSLTCGATPLSRR

SEQ ID NO: 999783 - protein, 347 aa, Homo sapiens
MGSVLAASAPWRAGYHVCVEVPRVCYADAVLVENNSTVTRLIYALFLLVGVCVACVMLHTRNWQEQLKRFLDFVRMTKVFVPCNILWLATNSCYIVCASASGYCLYSSSLFTNDQQLTQYHADSKTLHVPQLDFRLSLNLLQQLAIIIGALLHSSKELFTTAVRLMLGHWPRALLVLILIQPSSLPYLHSCTIPLDTGHPWRRTHTRQPNGATPKHAPLMHAFAHPAYSLLTLSACSFHLPIRPVPWSTNTQSSPVVQEKPRAVHQAVNNAPSCVGCFPVNCPYYWPNTIPKHLPQPKILALGPQLSSLLPAPTPTALPPCATSVPRDPQPHFPPPPTPLRATLSPS

SEQ ID NO: 999784 - protein, 130 aa, Homo sapiens
MSPELLIPLHVEIDPEIQRVRTQEREQIQDPQSNKFAYLHRLRCRYPRSKQNNGAGDQVLALLHGAGPELVVYTRNNLEPLFEDYLVEHAESTGWTRTFTEAMRGVRLGIQELRDTCRDLGGRTFNDPCY

SEQ ID NO: 999785 - protein, 97 aa, Homo sapiens
MTEQDDDAQPPNRPRGSKPGHDKNTKETTKERGRRRQDDSRHNTVDPPREPRKRKKRRGEIERHQNTSAHEPNDPRNKYRQKQKYRERQSKTQEHRP

SEQ ID NO: 999786 - protein, 349 aa, Homo sapiens
VTPFASILKDLALQVIQSAAKCSVRNIYFIWVTRSQRQFEWLADIIRAGCEEQLHHQDLDVCAASTIQSMLAEIVRTSWTTDAVRSVSRYFQKGFLNRASIRQAMRLPSPTFARPRHFEPFFNSHARRSTPKVRKIGGVQAVAPTGHDQNYTVRKTALIKHHQPVQEPGPHLLPTHLLRNLLKPLNRARVLPTDPKLDAGRFLKPQQPTSFMLPYPYIAWHCLRPLHPELIRETSSNAVCLPSVGPVSSSTPLVLGLQGTAPGNPANAVRQRMDANCAARADTLILKGGPVTKLERKGHGRSIPWNSRPGNQLDSPFVRFQNTSSQITLLIHLSDPLTRDQRSPTAGMC

SEQ ID NO: 999787 - protein, 212 aa, Homo sapiens
MLLFYVSLTFPSLNKHGEITKKKRHKFDHRDEPKDYDEKEQIRELLPQLQSSLENDIRGFIPPSPWHVERHVVFSDSYFTSCVCSTVLALYLRRMLAHSLDTSRHILPMVFTLRAGISRSLIDPSPILSSWVVSPWACVSMVHRHIFIYTSVGTRVLALFTNVCPFTTPRGQGPPRTTRLWRKLVSRIISRKPPLSPQRKLFPPVPVLEPIS

SEQ ID NO: 999788 - protein, 155 aa, Homo sapiens
HGEPRGVRMLLIRVMNGEITTRKVIDPTDSITANSQVKQIQSEPESIRKWREEQMERLEPLNQYTKQEAEWKEKAIKELERIEYEDRTEQQQENKSKQQEAQKKGRRKKSNRRNGPKLLKKNKETEEIEKTSQGQAIRMHRIETPVKRDWTTNRA

SEQ ID NO: 999789 - protein, 93 aa, Homo sapiens
QNRFRCECRYCQSHRPNLSGIPGESNRAPHPSSWETLVQGLSGLTLSLGTNQPGPLPEAALQPQETEEKRQRERQQESKIMFQRLLKQWLEEN

SEQ ID NO: 999790 - protein, 285 aa, Homo sapiens
SQPFNKRCTHMKAQIIRRVVHEEELEPRTRRESCETEENPALESELKQGDGWYPMRVNRALYQWLLRHPLHTQRRQVFQANEKVGKVMLRKLEETAPPHALMVACVTWRCLSLSSVDVNLWTPLWLGWMHVQSDDELRQYPQGDASRLKWRAFSHEVELNLSMIEHPKAYLLREVSHNAQSDMERVQVQDAVAGGWAYSHTLSSIIFVPAWLSSSTAGSACAHLSSLSHYWRQVCLSSHVCLLSRGRSCPTCSRHLPGVVSKSCEFGLTDHCVTFDIPHMLLALT

SEQ ID NO: 999791 - protein, 115 aa, Homo sapiens
MLIYPRAVPLTRPVIAHTAPHAILTGSRILPEYLGRNLPRRNGEFNDGIDLYDSMCSCQKSCAVLGKGLSGSSVIALPFNNPAYVDPGTDRPILRLPEGSMSGYSAPWPKAFTPD

SEQ ID NO: 999792 - protein, 117 aa, Homo sapiens
MQWGFRSLWESSKAAISYGLKPWRGRGARGTTVGDLLNPLQSEQFSHGQLSMGLGFHLQKELASIKDFKSTPKRSSWGVRGDGSQLRASLRCSGSSPFISSLAGLEQNDGSRPCCQL

SEQ ID NO: 999793 - protein, 108 aa, Homo sapiens
CAAASLCSPHSLLRCFVGSVSYPSLNYVVRRSAQSPGRPGSLVPLFLYGSGSGIALACLAGVVFRSILYLTSSSLAHLRCYNGSWAGFSSWPVFHNRVPCIPPGRSYW

SEQ ID NO: 999794 - protein, 389 aa, Homo sapiens
GCPGSGWTGWRSASAWGDQRDLGHPVPAPKVSKASHDPLVTQIIPHLTTPTGSVGVQRAFARHPWMARWAMQAQREDRLERDENDKAHVGKITRQHAVRPTHTDIPQVPGRKPTTCDPVTCTTKWTSECIDKQPGQRMRTEDIRGDPSTNPHEGNPHIDMPSFFTIHFRETIPQRHIEGPSPYWHPGQDNEGILYIANTPKGDIPGRPPKTHHSNTDRGPTKERTTSRQLAPNNQEHSPQIRTQDGIPKKVGSPHTRSPDAPTKNNPSPTQYTADDRGAQSEKAEWQQGTHKEMARGQQSPQQDVLAQREHQNRPRSHVKQAPESTNTGRLGREETHGRAHGPTGGHSRKSGSRAKTHSKTHPNNPRIQRGEQRRPDITTHHTQTYRDQ

SEQ ID NO: 999795 - protein, 340 aa, Homo sapiens
ARAQAGPKHTGRGASGPLILRRRTPLSQQVSHDTPLCPWRGLNRWRHREAPSLVRTQGPRRPPGADNSARYLQASAPRGVPNSPGVSGTSGWHDALRPGRLMTCLSMEGSASAAGPAKVAFPTLSKPSLCTPFEQGTLSYYGVIDIGVGVNVGVQPVGGVSPQPVAGPAVGTSLLILRCRTVPSSGWVTQLLVHLIYSVSVLPNRESGLEGPGPLGGPSCLAMGFCFLCLLRLAQGLLWDPGKFLRDLPRVPGPPTLAMLLPDRPATSYVPAGLQTPASCPPPGVCMVGSHWVEGPIDEAGPGSGTGGGAGPPTGCPGSAIPGWGMGSASKRVGSTVLQV

SEQ ID NO: 999796 - protein, 96 aa, Homo sapiens
MTQRHTGTTAPMNNREAEQHSGKQHTQRRDHGHPNATGTGNQNSNRNSTRRNALPSTDRSDHKLRCTRDGQTVNWRRETTVRVIAGQEQHTDITTT

SEQ ID NO: 999797 - protein, 230 aa, Homo sapiens
KPSMHLCLEYASLTQPMATPSRASSGAGDSVKLDTPESREALRRFIFNPLTSGSPVVPHQCQDAAVDTSSEDHHQGLRGEEGSSGRGRRMVRDAPGYRRMPNEENGGAGRLHKCRSARQEHKRRKGARAGSSAAHGKKHTCMGAGNDATGGSHHGRTARGQAYGAQLGKHDRMMHGMTACSIRKDRQEGPDPGMTRQPPPGTSLPRRQNTRAGPDPCTHISTPMPSIQGL

SEQ ID NO: 999798 - protein, 223 aa, Homo sapiens
FSLPSSSGFCACSFHNCFTAAYRLVVTGPYALGSAHPYLCVPRRVLLMRHPFSSSHWLSCLFMLLLPRATTSTLTGFCARTPITQVPFLSRSLSLVDGSKPWCYSINAVPRGCLTRYGLFSGGALCLMRSSLITSSHGSPVPDFVMFSAVDKFYAAFTFDALPLQANHRYLSEWLIWALQMRGAVFKMHAKTGAYTVVEAQYHRGAFKSASVTLSPMKHVCVT

SEQ ID NO: 999799 - protein, 125 aa, Homo sapiens
PHGIMVRSHGCLPNGKRPQPLRGPIKALNSVVTNKRHISLPLTHILMGNDQGDECNKFLVFVEILSATKDGQLVPRSASVYSVREDTSRDIACHRLPMFLGTASVLARTVLSIIATALLLRELFG

SEQ ID NO: 999800 - protein, 106 aa, Homo sapiens
MIQEALDLDGEPDLSSLEGFQWARSFPLFLVPGLARKRSLFWEQRDHGQSSFRRKASYSEEGTGKENEPQQKVSHSNSLRAGQSQKATMHLKQEVTPAGMPSLRIR

SEQ ID NO: 999801 - protein, 393 aa, Homo sapiens
VESRVPVYLILWGNQVGSVLTGWWCNLYPSACKNLANIEDGVLGKYIALRHYGAHAQEEVNEFHRCTEHPPKEIAPAHMTSTYQNGRRPESGNTPTERTTWGANSKGPHGECLHRYGNCADLLARRKLATSQSHPDRSSRSGHGTTAWMQAIRKTARGRQVDPKKSEGNSGDPHSDHHSHFLVKLTSWARLQVGARQLGLLSISSHGREEVGVCTRDTRGIEESERIMIFGPSLEETDPGGSSSMPTCPWNRDDVTHEARNSHHTYVVVLCLPLRASFIMLSGILTNAAGKLIITATPWRKGGEGNLIQAPHVRHAVGAMQARQQLLHPDNPRPLGMVVRSSPSESIGIVYTCVRKDISQQCGGRQDSPWNEACSIYGGRGEGVPENHAILWK

SEQ ID NO: 999802 - protein, 36 aa, Homo sapiens
MAICITGSFVGKLDYDPTEKHQITKGTRLSRNSYLS

SEQ ID NO: 999803 - protein, 329 aa, Homo sapiens
MGVHPLVFTGFVWESILGRLSRGPFLERGLSQGSHGIGALVAISRSGRPRPGPEAMAKALRLQCVGSWVKASWVLRYEVPLGNRRSDGKADRIRTTVEVPSWAMRLKGTGLEVCEHKAKSCNAQLLGLCLVERSPFLYWVQDCSLRMQFSMSIIRTERDGSRVPGSRREAAPAVQVLADGASTAAALGLYGHEANSLSGGYWGLARYRWYLVHCPPAVVLAALLLADSRDADQSDTIVDRTLLPPHHVARGHTMCSSLATDPQPAPQASELHGCYPVRLPTGISRSLPQVEGRAVPQASELCAGAVAMGRCCHAASSHRVLPQDTLLNV

SEQ ID NO: 999804 - protein, 135 aa, Homo sapiens
PPPSRMRGSSLWDGLDSSPLMARLCLCVPLWWGAPSILGLFGPIFCGTLYRIRNLWTTAWSSGEGSPFLGPGHSLFGVLKGSLSGFPPPVCAEDIDTLLGLNSRSEQQRLAAVTYSESLAPACVPFDCAHDESSE

SEQ ID NO: 999805 - protein, 111 aa, Homo sapiens
MFAGRSCRLLCDSPRRWFVDVLIASLPTCGLGSAVAVLRPSASRLTTSVWCYYGSAVASVCLWPSFLVLVLPGAPSRVSRVSIVFVVICVRDFLGPLRCRSLGPGCASGQI

SEQ ID NO: 999806 - protein, 290 aa, Homo sapiens
LQPPTLVTALSSPGTMASTVTTISDATAAAAGVSGANSARLPGVMPLLCFSSYVRVPLQGQWWPGVVHVEELAFGSRSLYGLGGSKRISIGGGSCAIQWRLWQAEPEAAMALVAPSSGLRFRWWMPALAWVWVVDAGLAGRLEGALEFRCVPPLECIQEGHRGIRRLLSPHQPARFDPVDPAVMRADGAVQQIQRPSRTEFASLHRQGVSSVDRENEEFWDTKWTLDCKEQGTETVRQNLEPEYEQYIKKLRRQLDSIVRERGRLGLGAEKTLHEPGWKELQEQILTDEI

SEQ ID NO: 999807 - protein, 234 aa, Homo sapiens
LLSRFGFALLCRFPLQFFLCALCFVLSSLPAPSVSSFFSVPLFGLPLLCVPHLFHPPLVSFHCPAPLAPPGFCWPSFSVWFFFVSLCFPLALLCVLVGLSLLCVLLSFRLSCPVPIGFLMLPLLVALLLILFCLVSTCLTLFVISWALAYFVSLRICSRCIVSHLVPPTFPIRLLRTTAFDLYSRSASDGYLHDTHASGHVRLHANAIMFLLKIPPLFESADDEMRAAHVQQVD

SEQ ID NO: 999808 - protein, 302 aa, Homo sapiens
SFFLGVASRSADVLFPPCVVVCPLVLSLASVSSVRPLVFVFSLVVSLVVSPSVLCLSAIVSLPCGCILLYITPFYVCFFSSVASVAFHCGYCVFFCAGGLLLGVPRFVLVFFSLSFLSRVPSSVFLGVFLSSVAHLCLWSMSYVSLFISVCFSSSLLSPPLFRSSRVFASVPYCLLALSYCDGRCCVLIFSPFGVETDWLIAFTRVLECPPFAALMVVGGHSSHVCLARYLYSLDLAPLGSRYCLCALLCLYLANSSIVRWASITWPLSPWGLVSSSAAESVHSPSSDGKSRFLVDRPLADP

SEQ ID NO: 999809 - protein, 99 aa, Homo sapiens
FPIFLFWFTMIGSYGNVSALLTFCGCFPGLLTFAHSPVSLYPFVGDPCTSSGVVYVQLPFDIGVANPGLAVLCSVGYLASSPQALLRSRRCFFVLAAMA

SEQ ID NO: 999810 - protein, 217 aa, Homo sapiens
ASYMCCCRLSILCSLFSLVLVFRNYSFTVHSGTICTPRSGYGSSYLPLPPLACLFRGWYCSAFCTSLCAFWVSIPLFLVCLSLVSFGCAFPLMYGPSFLFRLFVSILNLLSIYCVIPFTFCPCPSEFYCSCLSSFVCCYGYNLAVFFFALGFMPFPNYVFSLRNFPIISLMYFLPLSVNFSWSAISHLSCLFHLFIPIPYTFFLHYFPVYSTFFGYL

SEQ ID NO: 999811 - protein, 203 aa, Homo sapiens
EPSEMKVQMLSPESGLIYVREIQVVTYRAVPRNYDPGFTSFRGPTRIYKSFNMLPILERVFAEIIPCLRWMVTVMSVYCLASLPEKLSTVLSGAVMDRFRILESNSSWNCIRDNTSTVNGFDEEVLYSLFVGLLFSLLVMSKTVKQWNKMDWARAMDDDRRAITYNIRTRQCILGTWIIIWKRSCISATCGQHRRRFGMKLKN

SEQ ID NO: 999812 - protein, 415 aa, Homo sapiens
RIPFYLWCRVLSFPVWVCLPSLVTLFVSRLVLFSRLRGVLLHNPSVFVPSAPLFHPTFVLPLVCAYPILVFEILPPGFSFSILRSSLVLVGVSPFGGPIVSRLLVLSSPLLYDFSPPVPRRKSSRGQVHRRAPQIARRLLRLGPLSTSVPCVTLSTPHVLVSDRLFIGVPAMTCPVPCLPLGDFPRFRIGFLWISKSFESVRGLSWFSGPVSLPRLSTPRKFPRHSDVCRVHDLSPYEPTQSSLKMISVSAPSRSCPLRGTNHSLLRKHSWCSRFSRTIPSYSDCPHQMNETGYGHAYTIIKSRREAKRLEWNEETDGRRKSNGGPGMVHRNKKQLKPAQDRRFPRSEMLLVTQADHHTPSLTVYVSNSDLPSIMTVDGQRAQLRASQEAEEALRGSGEALTRNICTMAQNGSFQ

SEQ ID NO: 999813 - protein, 238 aa, Homo sapiens
PVRIAAVACARSNKNEGLDLINRETVHEREVQTSNADDAHSWRGYSFSHEVTELTVEVNPASPKRHRFHSCVTRHLSAHPSWGIEGEQCDYDHPLQEFWYSSNVIASNALFPSPYRTRFTDPGEAQESAIILLLDRSVLVTIEYDDTCEHGKLNYLAKVDFSEGINLTMLYFLTLHQLSRSWLCVYLRDNPLDGEASTSCARIFLELTSRKVSITTDFSCVTWPSGFSIYFHVDEAFV

SEQ ID NO: 999814 - protein, 126 aa, Homo sapiens
IPSRSTSGDAFTLLSPVAARFPGRYALKLRQAYRLSSPWSRVDETLACRQVRLQPFFEPALQTSTSCVSFGASSPQSFTGANGGTDWSNVAPWLIGLRSIQTAMTIAKNAQPTDTFPCLLLSDDAR

SEQ ID NO: 999815 - protein, 147 aa, Homo sapiens
SPFLCAPFLLFVCLIVTPSTVVGVPTSLITFGNSLLLSSSCCGAGFFTATALSVSVTYCPFVVHPLFCVYFFSHRPLCFPPCSLDFYSPWDTSALHLLVPINYVPPSLRCVPWYVVYAPRSRATCIWRSIGLPSVPPYVGTYVGVVI

SEQ ID NO: 999816 - protein, 111 aa, Homo sapiens
GASLVASLSYVPRFSYVFLRSIVPLSVGALLREWMVILFAPLGLSWYCRLFLGTHLLGRSTMTCVFRVFLIYSPTLTRACLPMFIFCLVTRACHFCVLLSAAYLRGRLPVF

SEQ ID NO: 999817 - protein, 144 aa, Homo sapiens
LPSHNNGTSSPEPFESHPLTVGSKQASASARKTPESFLGPNAALVNLDSLVTRPAPPGQSLNPFLAPGAPAHLGPCELPFQVNQPLPLTLNQLSGEPMSVGDQHYPLGLAQEWSPMAVASMTSAVPLSALGATWFLSDTTGPCI

SEQ ID NO: 999818 - protein, 149 aa, Homo sapiens
MVSMSFLSCSIRRIRWQETEKFCPTVLCIELGKYDPSSPNRDLHETVLSLQLHCDLNEMLSQIVPGEITMDIVFMSQNKPKCKQVFLFEFKMGCKAAETTCNIKSAFGPGTANERTVQWWFKKFCKGWPGAAAHTYNPSTLGGQGIRIT

SEQ ID NO: 999819 - protein, 209 aa, Homo sapiens
AKHELKGLHDHPVKIATRGGPHRKDPREERKGPPRLLRATVPATANPENMHRHTPPANVREDRMLVGTKACCIAQSAKIMECCHSVFSFNVLIPFRAGLGWSRQEMRWRLSGSPRQELRNHTSRYEDNSMSIGKRGAAFPFWAALPAKSQDEQSQAESYGAKQLLCASPQIENDALITIGPHGCNRMADPMGWRSGLLPCCHSSNVLSV
